United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 204

SEQ ID NO: 8473027 - DNA, 22 bp, Homo sapiens
tatccacactcaaggggagggg

SEQ ID NO: 8473028 - DNA, 22 bp, Homo sapiens
tatccacactgggatgttttga

SEQ ID NO: 8473029 - DNA, 22 bp, Homo sapiens
tatccaattcaccattgatggg

SEQ ID NO: 8473030 - DNA, 22 bp, Homo sapiens
tatccattaggtctatggtcaa

SEQ ID NO: 8473031 - DNA, 22 bp, Homo sapiens
tatccattatgttggctagtct

SEQ ID NO: 8473032 - DNA, 22 bp, Homo sapiens
tatccatttattttctaggcaa

SEQ ID NO: 8473033 - DNA, 22 bp, Homo sapiens
tatccatagtttatagatcaag

SEQ ID NO: 8473034 - DNA, 22 bp, Homo sapiens
tatatattcttaagtagtgtag

SEQ ID NO: 8473035 - DNA, 22 bp, Homo sapiens
tatatattcttaagtagtgtag

SEQ ID NO: 8473036 - DNA, 22 bp, Homo sapiens
tatatcagagttaaaagaatgt

SEQ ID NO: 8473037 - DNA, 19 bp, Homo sapiens
tatatattttggggttgtg

SEQ ID NO: 8473038 - DNA, 22 bp, Homo sapiens
tatatcaccaaaaacagttctg

SEQ ID NO: 8473039 - DNA, 22 bp, Homo sapiens
tatatcaccaaaaacagttctg

SEQ ID NO: 8473040 - DNA, 22 bp, Homo sapiens
tatatctaagtgtatgtaagag

SEQ ID NO: 8473041 - DNA, 22 bp, Homo sapiens
tatatctgggaaccaaaggggg

SEQ ID NO: 8473042 - DNA, 22 bp, Homo sapiens
tatatctggatggactgcagaa

SEQ ID NO: 8473043 - DNA, 22 bp, Homo sapiens
tatatccataggctgtgcctag

SEQ ID NO: 8473044 - DNA, 22 bp, Homo sapiens
tatatccagaaaatcagttcat

SEQ ID NO: 8473045 - DNA, 22 bp, Homo sapiens
tattattgcaagtatataaagt

SEQ ID NO: 8473046 - DNA, 22 bp, Homo sapiens
tattattgactattcagaatgt

SEQ ID NO: 8473047 - DNA, 22 bp, Homo sapiens
tattattgacatttacttggtg

SEQ ID NO: 8473048 - DNA, 22 bp, Homo sapiens
tattattgaatcagttctttga

SEQ ID NO: 8473049 - DNA, 22 bp, Homo sapiens
tattcatgagataggcagtttt

SEQ ID NO: 8473050 - DNA, 22 bp, Homo sapiens
tattcatgggaggtcacaactt

SEQ ID NO: 8473051 - DNA, 22 bp, Homo sapiens
tattattttagcactgaggatt

SEQ ID NO: 8473052 - DNA, 22 bp, Homo sapiens
tattcatgtgttggaaaggaac

SEQ ID NO: 8473053 - DNA, 22 bp, Homo sapiens
tattcatgtcggctgaaaaagc

SEQ ID NO: 8473054 - DNA, 22 bp, Homo sapiens
tattccaaaatagttaagcact

SEQ ID NO: 8473055 - DNA, 22 bp, Homo sapiens
tattcatgggggtccaggtacc

SEQ ID NO: 8473056 - DNA, 22 bp, Homo sapiens
tattgaattagaccctaaaatg

SEQ ID NO: 8473057 - DNA, 22 bp, Homo sapiens
tattgaaatccattacgttctt

SEQ ID NO: 8473058 - DNA, 22 bp, Homo sapiens
tattcttgtcttttccagaaat

SEQ ID NO: 8473059 - DNA, 22 bp, Homo sapiens
tattctcagcaacacacatgga

SEQ ID NO: 8473060 - DNA, 22 bp, Homo sapiens
tattctggtttccggatctcta

SEQ ID NO: 8473061 - DNA, 22 bp, Homo sapiens
tattctgtgtgatatgtaaatg

SEQ ID NO: 8473062 - DNA, 19 bp, Homo sapiens
tattctgttaacctttgtc

SEQ ID NO: 8473063 - DNA, 22 bp, Homo sapiens
tattctctgcagctgaatgttt

SEQ ID NO: 8473064 - DNA, 22 bp, Homo sapiens
tatttattggacagtgttgctg

SEQ ID NO: 8473065 - DNA, 22 bp, Homo sapiens
tatttctcttcaaaattgatgt

SEQ ID NO: 8473066 - DNA, 22 bp, Homo sapiens
tatttattggacagtgttgctg

SEQ ID NO: 8473067 - DNA, 22 bp, Homo sapiens
tatttattctttgtactgcctt

SEQ ID NO: 8473068 - DNA, 22 bp, Homo sapiens
tattgacatttttatagcttga

SEQ ID NO: 8473069 - DNA, 22 bp, Homo sapiens
tatttataatctgccaaagaga

SEQ ID NO: 8473070 - DNA, 22 bp, Homo sapiens
tatttatattctgccttctgct

SEQ ID NO: 8473071 - DNA, 22 bp, Homo sapiens
tattagaaagcttaatatcgtg

SEQ ID NO: 8473072 - DNA, 22 bp, Homo sapiens
tattagaaaggctattgcatag

SEQ ID NO: 8473073 - DNA, 22 bp, Homo sapiens
tattagaaaggctattgcatag

SEQ ID NO: 8473074 - DNA, 22 bp, Homo sapiens
tattagaaaggctattgcatag

SEQ ID NO: 8473075 - DNA, 22 bp, Homo sapiens
tattacagttcgagtttctagg

SEQ ID NO: 8473076 - DNA, 20 bp, Homo sapiens
tatgtgattttctcatcaat

SEQ ID NO: 8473077 - DNA, 22 bp, Homo sapiens
tatgtgaagagattaaaaaata

SEQ ID NO: 8473078 - DNA, 22 bp, Homo sapiens
tatgtcttttgcttgcaaatag

SEQ ID NO: 8473079 - DNA, 22 bp, Homo sapiens
tatgtacaccaaggattgaaaa

SEQ ID NO: 8473080 - DNA, 22 bp, Homo sapiens
tatgtacacttaagtttgagaa

SEQ ID NO: 8473081 - DNA, 22 bp, Homo sapiens
tatgtacagggatagaacttga

SEQ ID NO: 8473082 - DNA, 22 bp, Homo sapiens
tatgtacacggtggctctgaag

SEQ ID NO: 8473083 - DNA, 22 bp, Homo sapiens
tatgtacaccggggaaggtggg

SEQ ID NO: 8473084 - DNA, 22 bp, Homo sapiens
tatgtacataacatgaaatgca

SEQ ID NO: 8473085 - DNA, 22 bp, Homo sapiens
tatgtacataacatgaaatgca

SEQ ID NO: 8473086 - DNA, 22 bp, Homo sapiens
tatgtacaatttgttgtatgtc

SEQ ID NO: 8473087 - DNA, 22 bp, Homo sapiens
tatgtacaatttgttgtatgtc

SEQ ID NO: 8473088 - DNA, 22 bp, Homo sapiens
tatgtacacacacatgcatgta

SEQ ID NO: 8473089 - DNA, 22 bp, Homo sapiens
tatgtacacacacatgcatgta

SEQ ID NO: 8473090 - DNA, 22 bp, Homo sapiens
tatgtacaatcagcagttcata

SEQ ID NO: 8473091 - DNA, 22 bp, Homo sapiens
tatgtacaatcagcagttcata

SEQ ID NO: 8473092 - DNA, 22 bp, Homo sapiens
tatgagcagacagtggttttac

SEQ ID NO: 8473093 - DNA, 23 bp, Homo sapiens
tatgagtcatctgctacaaccca

SEQ ID NO: 8473094 - DNA, 20 bp, Homo sapiens
tatgagtattactttcagga

SEQ ID NO: 8473095 - DNA, 17 bp, Homo sapiens
tatgaggcagtttgtga

SEQ ID NO: 8473096 - DNA, 22 bp, Homo sapiens
tatgagctttggaatgagaaac

SEQ ID NO: 8473097 - DNA, 22 bp, Homo sapiens
tagacagagtgaagacaagtgg

SEQ ID NO: 8473098 - DNA, 22 bp, Homo sapiens
tagacagatgttttctggctgt

SEQ ID NO: 8473099 - DNA, 22 bp, Homo sapiens
tagacactgtatgagctgggtg

SEQ ID NO: 8473100 - DNA, 21 bp, Homo sapiens
tagaggcaggagggactgcag

SEQ ID NO: 8473101 - DNA, 22 bp, Homo sapiens
tagacacatcttcatccacaat

SEQ ID NO: 8473102 - DNA, 22 bp, Homo sapiens
tagagggaaggaagaatggatt

SEQ ID NO: 8473103 - DNA, 22 bp, Homo sapiens
tagaggcataagagggaagcag

SEQ ID NO: 8473104 - DNA, 22 bp, Homo sapiens
tagacacaaatctcagtgacac

SEQ ID NO: 8473105 - DNA, 22 bp, Homo sapiens
tagacacaaatctcagtgacac

SEQ ID NO: 8473106 - DNA, 22 bp, Homo sapiens
tagacacaaatctcagtgacac

SEQ ID NO: 8473107 - DNA, 22 bp, Homo sapiens
tagaattttctgctttgatagt

SEQ ID NO: 8473108 - DNA, 19 bp, Homo sapiens
tagaatgcccacttaaaaa

SEQ ID NO: 8473109 - DNA, 19 bp, Homo sapiens
tagaatgcccacttaaaaa

SEQ ID NO: 8473110 - DNA, 22 bp, Homo sapiens
tagaatgtagtgcttcaagatt

SEQ ID NO: 8473111 - DNA, 20 bp, Homo sapiens
tagaatctgttctgattcat

SEQ ID NO: 8473112 - DNA, 22 bp, Homo sapiens
tagaatgagaaagtgtagcagg

SEQ ID NO: 8473113 - DNA, 22 bp, Homo sapiens
tagaatctttaaaattcatagt

SEQ ID NO: 8473114 - DNA, 22 bp, Homo sapiens
tagaatgttaagaatatgtata

SEQ ID NO: 8473115 - DNA, 23 bp, Homo sapiens
tagaatgtcattcaatgatatgg

SEQ ID NO: 8473116 - DNA, 22 bp, Homo sapiens
tagaatgtggaggtaacagact

SEQ ID NO: 8473117 - DNA, 22 bp, Homo sapiens
tagaaagtgaaggttaattaat

SEQ ID NO: 8473118 - DNA, 22 bp, Homo sapiens
tagaaagtggttgagagtttag

SEQ ID NO: 8473119 - DNA, 22 bp, Homo sapiens
tagaaataaatctgcagctggg

SEQ ID NO: 8473120 - DNA, 22 bp, Homo sapiens
tagaaataaatctgcagctggg

SEQ ID NO: 8473121 - DNA, 22 bp, Homo sapiens
tagaaatcatttagaagtattg

SEQ ID NO: 8473122 - DNA, 22 bp, Homo sapiens
tagaaatcaggtttttagaaag

SEQ ID NO: 8473123 - DNA, 22 bp, Homo sapiens
tagaaatctacttagactttct

SEQ ID NO: 8473124 - DNA, 22 bp, Homo sapiens
tagaaatcttgttactatgtgt

SEQ ID NO: 8473125 - DNA, 22 bp, Homo sapiens
tagaaagtagccacttacagag

SEQ ID NO: 8473126 - DNA, 22 bp, Homo sapiens
tagaaagtagggaaggtaggat

SEQ ID NO: 8473127 - DNA, 22 bp, Homo sapiens
tagaaagtcaaaacactgtgtt

SEQ ID NO: 8473128 - DNA, 21 bp, Homo sapiens
tagaaagtcaaagctatcagc

SEQ ID NO: 8473129 - DNA, 22 bp, Homo sapiens
tagaaagtcatgaattacacca

SEQ ID NO: 8473130 - DNA, 22 bp, Homo sapiens
tagaaagtgaaggttaattaat

SEQ ID NO: 8473131 - DNA, 22 bp, Homo sapiens
tagaaagtaaatcagttttatt

SEQ ID NO: 8473132 - DNA, 22 bp, Homo sapiens
tagaaagtactaaatttaactg

SEQ ID NO: 8473133 - DNA, 22 bp, Homo sapiens
tagaaagtactaaatttaactg

SEQ ID NO: 8473134 - DNA, 22 bp, Homo sapiens
tagaaagtagccacttacagag

SEQ ID NO: 8473135 - DNA, 22 bp, Homo sapiens
tagaaagtaaacacgaagtctc

SEQ ID NO: 8473136 - DNA, 22 bp, Homo sapiens
tagaaagtaaatcagttttatt

SEQ ID NO: 8473137 - DNA, 22 bp, Homo sapiens
tagaaagaacttcatgtaaaac

SEQ ID NO: 8473138 - DNA, 22 bp, Homo sapiens
tagaaagaacttcatgtaaaac

SEQ ID NO: 8473139 - DNA, 22 bp, Homo sapiens
tagaaagcatgcaagtttgatg

SEQ ID NO: 8473140 - DNA, 19 bp, Homo sapiens
tagaaagccagaaaacaga

SEQ ID NO: 8473141 - DNA, 22 bp, Homo sapiens
tagaaagccctgtgttcactgc

SEQ ID NO: 8473142 - DNA, 22 bp, Homo sapiens
tagaaagcgttaaatctacaga

SEQ ID NO: 8473143 - DNA, 22 bp, Homo sapiens
tagaaagccctgtgttcactgc

SEQ ID NO: 8473144 - DNA, 22 bp, Homo sapiens
tagaaagcgttaaatctacaga

SEQ ID NO: 8473145 - DNA, 22 bp, Homo sapiens
tagaaagcttggggtgtttaaa

SEQ ID NO: 8473146 - DNA, 22 bp, Homo sapiens
tagaaagctgagtaatacattt

SEQ ID NO: 8473147 - DNA, 22 bp, Homo sapiens
tagaaaagaattttatttgata

SEQ ID NO: 8473148 - DNA, 22 bp, Homo sapiens
tagaaaagataacattctgtgc

SEQ ID NO: 8473149 - DNA, 22 bp, Homo sapiens
tagaaaagataacattctgtgc

SEQ ID NO: 8473150 - DNA, 22 bp, Homo sapiens
tagaaaagataacattctgtgc

SEQ ID NO: 8473151 - DNA, 22 bp, Homo sapiens
tagaaaagataacattctgtgc

SEQ ID NO: 8473152 - DNA, 22 bp, Homo sapiens
tagaaaagataacattctgtgc

SEQ ID NO: 8473153 - DNA, 22 bp, Homo sapiens
tagaaaactaatacatgcttga

SEQ ID NO: 8473154 - DNA, 22 bp, Homo sapiens
tagaaaactaatacatgcttga

SEQ ID NO: 8473155 - DNA, 22 bp, Homo sapiens
tactttttgtctctttgaatgt

SEQ ID NO: 8473156 - DNA, 22 bp, Homo sapiens
tactttttgtctctttgaatgt

SEQ ID NO: 8473157 - DNA, 22 bp, Homo sapiens
tactttttatgataagaactga

SEQ ID NO: 8473158 - DNA, 22 bp, Homo sapiens
tactttttagcacagtgtgtgc

SEQ ID NO: 8473159 - DNA, 22 bp, Homo sapiens
tactttggggacaatatggaat

SEQ ID NO: 8473160 - DNA, 22 bp, Homo sapiens
taccaaaagcttgtttcataca

SEQ ID NO: 8473161 - DNA, 22 bp, Homo sapiens
taccaaaaccaagccattatct

SEQ ID NO: 8473162 - DNA, 22 bp, Homo sapiens
tacattttctaggggaccaaga

SEQ ID NO: 8473163 - DNA, 22 bp, Homo sapiens
tagaaacagaatatgagtgaga

SEQ ID NO: 8473164 - DNA, 22 bp, Homo sapiens
tagaaacacagatctggtgtca

SEQ ID NO: 8473165 - DNA, 22 bp, Homo sapiens
tagaaacaatgacatgcttgta

SEQ ID NO: 8473166 - DNA, 22 bp, Homo sapiens
tagaaacatataggatggcagg

SEQ ID NO: 8473167 - DNA, 22 bp, Homo sapiens
tagaaacagaatatgagtgaga

SEQ ID NO: 8473168 - DNA, 22 bp, Homo sapiens
tagaaacattcagttgcagtcc

SEQ ID NO: 8473169 - DNA, 22 bp, Homo sapiens
tagaaacatgagagaaactctt

SEQ ID NO: 8473170 - DNA, 22 bp, Homo sapiens
tagaaacatatgtttgagacat

SEQ ID NO: 8473171 - DNA, 22 bp, Homo sapiens
tagaaactagattgatagcgga

SEQ ID NO: 8473172 - DNA, 22 bp, Homo sapiens
tagaaactcacgttatcattgc

SEQ ID NO: 8473173 - DNA, 22 bp, Homo sapiens
tagaaactcaggatactcttcc

SEQ ID NO: 8473174 - DNA, 22 bp, Homo sapiens
tagaaactctcaatctgggatg

SEQ ID NO: 8473175 - DNA, 22 bp, Homo sapiens
tagaaactgatagtcttgtgct

SEQ ID NO: 8473176 - DNA, 22 bp, Homo sapiens
tagaaactctcacgagtgaaac

SEQ ID NO: 8473177 - DNA, 22 bp, Homo sapiens
tagaaaccatctcactgctcag

SEQ ID NO: 8473178 - DNA, 22 bp, Homo sapiens
tagaaaccatctcactgctcag

SEQ ID NO: 8473179 - DNA, 22 bp, Homo sapiens
tagaaacccaggatttgtattt

SEQ ID NO: 8473180 - DNA, 22 bp, Homo sapiens
tagaaacctcagggaaatcttt

SEQ ID NO: 8473181 - DNA, 22 bp, Homo sapiens
tagaaacctcagggaaatcttt

SEQ ID NO: 8473182 - DNA, 22 bp, Homo sapiens
tagaaactactagaataagaga

SEQ ID NO: 8473183 - DNA, 22 bp, Homo sapiens
tagaaacccatgtttattcagt

SEQ ID NO: 8473184 - DNA, 22 bp, Homo sapiens
tagaaacccaggatttgtattt

SEQ ID NO: 8473185 - DNA, 22 bp, Homo sapiens
tagaaaccatctcactgctcag

SEQ ID NO: 8473186 - DNA, 22 bp, Homo sapiens
tagaaacctcagggaaatcttt

SEQ ID NO: 8473187 - DNA, 22 bp, Homo sapiens
tagaaaccctgccttagtagct

SEQ ID NO: 8473188 - DNA, 22 bp, Homo sapiens
tagaaaccctgccttagtagct

SEQ ID NO: 8473189 - DNA, 22 bp, Homo sapiens
tagaaacccatgtttattcagt

SEQ ID NO: 8473190 - DNA, 22 bp, Homo sapiens
tagaaacccatgtttattcagt

SEQ ID NO: 8473191 - DNA, 22 bp, Homo sapiens
tagcagaggctgtctgacttaa

SEQ ID NO: 8473192 - DNA, 22 bp, Homo sapiens
tagcagaggcaaggatgtgaat

SEQ ID NO: 8473193 - DNA, 22 bp, Homo sapiens
tagcagaggaaaagagaacatt

SEQ ID NO: 8473194 - DNA, 22 bp, Homo sapiens
tagcagagcagggatcagagcc

SEQ ID NO: 8473195 - DNA, 22 bp, Homo sapiens
tagcagagcgggtgcgaggcgg

SEQ ID NO: 8473196 - DNA, 22 bp, Homo sapiens
tagcagagtaatactttggagc

SEQ ID NO: 8473197 - DNA, 22 bp, Homo sapiens
tagcagcccagtttctggccaa

SEQ ID NO: 8473198 - DNA, 22 bp, Homo sapiens
tagagtaacacaaacgaattgg

SEQ ID NO: 8473199 - DNA, 22 bp, Homo sapiens
tagcagaaccagtcagtgagcc

SEQ ID NO: 8473200 - DNA, 22 bp, Homo sapiens
tagaggtgttgacgccaaggta

SEQ ID NO: 8473201 - DNA, 22 bp, Homo sapiens
tagaggtgttcattctctccat

SEQ ID NO: 8473202 - DNA, 22 bp, Homo sapiens
tagaggtgacactgagaccata

SEQ ID NO: 8473203 - DNA, 22 bp, Homo sapiens
tagagggttattaggacagaag

SEQ ID NO: 8473204 - DNA, 22 bp, Homo sapiens
tagctgtttgaagtatttttct

SEQ ID NO: 8473205 - DNA, 22 bp, Homo sapiens
tagctgaaggctacagcagaac

SEQ ID NO: 8473206 - DNA, 22 bp, Homo sapiens
tagctgaagagggtattgtagg

SEQ ID NO: 8473207 - DNA, 22 bp, Homo sapiens
tagctgaagggcatttaataaa

SEQ ID NO: 8473208 - DNA, 22 bp, Homo sapiens
tagctgaatataggcacaacag

SEQ ID NO: 8473209 - DNA, 22 bp, Homo sapiens
tagctgaatgccttggattttt

SEQ ID NO: 8473210 - DNA, 22 bp, Homo sapiens
tagctgaataatgcgtctgcag

SEQ ID NO: 8473211 - DNA, 22 bp, Homo sapiens
tagctgaatgtgaccttaaaga

SEQ ID NO: 8473212 - DNA, 22 bp, Homo sapiens
tagctctggagtcttctcagaa

SEQ ID NO: 8473213 - DNA, 22 bp, Homo sapiens
tagcccaggagaattgtctttc

SEQ ID NO: 8473214 - DNA, 22 bp, Homo sapiens
tagcccagcttggcctatttct

SEQ ID NO: 8473215 - DNA, 19 bp, Homo sapiens
tagccctggccatcatgag

SEQ ID NO: 8473216 - DNA, 19 bp, Homo sapiens
tagccctggccatcatgag

SEQ ID NO: 8473217 - DNA, 22 bp, Homo sapiens
tagccctctttaatccttccct

SEQ ID NO: 8473218 - DNA, 22 bp, Homo sapiens
tagccctctccagcgaggtctg

SEQ ID NO: 8473219 - DNA, 21 bp, Homo sapiens
tagccctctctgtctgtgtac

SEQ ID NO: 8473220 - DNA, 22 bp, Homo sapiens
tagccctgtccttggcctgtgc

SEQ ID NO: 8473221 - DNA, 22 bp, Homo sapiens
tagccctcagcttggagcgtgg

SEQ ID NO: 8473222 - DNA, 22 bp, Homo sapiens
tagccctcatctgctcaaaagg

SEQ ID NO: 8473223 - DNA, 22 bp, Homo sapiens
taggatatgtgaaatcatatta

SEQ ID NO: 8473224 - DNA, 22 bp, Homo sapiens
taggatatgcatttttatacat

SEQ ID NO: 8473225 - DNA, 22 bp, Homo sapiens
taggacagtggagataaccaga

SEQ ID NO: 8473226 - DNA, 22 bp, Homo sapiens
taggaaacagtgcatatatagt

SEQ ID NO: 8473227 - DNA, 22 bp, Homo sapiens
taggaaacatttgaagaggatt

SEQ ID NO: 8473228 - DNA, 22 bp, Homo sapiens
taggaaactaatacagtctgga

SEQ ID NO: 8473229 - DNA, 22 bp, Homo sapiens
taggaaaccaatcttttgggag

SEQ ID NO: 8473230 - DNA, 22 bp, Homo sapiens
taggaaactcaaagggaagtgg

SEQ ID NO: 8473231 - DNA, 22 bp, Homo sapiens
taggaaaatatctcttattggg

SEQ ID NO: 8473232 - DNA, 22 bp, Homo sapiens
taggaaacaaacctgcctcttc

SEQ ID NO: 8473233 - DNA, 22 bp, Homo sapiens
taggaaacaaagcttagcagga

SEQ ID NO: 8473234 - DNA, 22 bp, Homo sapiens
taggaaacaaagtaatgcaact

SEQ ID NO: 8473235 - DNA, 22 bp, Homo sapiens
taggaaacaaagtggatgaaat

SEQ ID NO: 8473236 - DNA, 22 bp, Homo sapiens
taggaaaagtctagattgatga

SEQ ID NO: 8473237 - DNA, 22 bp, Homo sapiens
taggaaaagcacaggatgttct

SEQ ID NO: 8473238 - DNA, 22 bp, Homo sapiens
tagggaggagggttttcaaatc

SEQ ID NO: 8473239 - DNA, 22 bp, Homo sapiens
tagggatgagccagtgggtagt

SEQ ID NO: 8473240 - DNA, 22 bp, Homo sapiens
tagggatgaggatagatttttc

SEQ ID NO: 8473241 - DNA, 22 bp, Homo sapiens
tagggatgagcaactggtagtg

SEQ ID NO: 8473242 - DNA, 22 bp, Homo sapiens
tagggatgaagttgctatttac

SEQ ID NO: 8473243 - DNA, 22 bp, Homo sapiens
tagggatgaagatggtatttct

SEQ ID NO: 8473244 - DNA, 22 bp, Homo sapiens
tagggatgactatgattcccac

SEQ ID NO: 8473245 - DNA, 22 bp, Homo sapiens
tagggaggctacttcttgtagg

SEQ ID NO: 8473246 - DNA, 22 bp, Homo sapiens
tagggatgacgaaaggacagag

SEQ ID NO: 8473247 - DNA, 22 bp, Homo sapiens
tagggatgacgaaaggacagag

SEQ ID NO: 8473248 - DNA, 22 bp, Homo sapiens
tagggcacagcttagataaatg

SEQ ID NO: 8473249 - DNA, 22 bp, Homo sapiens
tagggatgtggtgagaactgag

SEQ ID NO: 8473250 - DNA, 22 bp, Homo sapiens
tagggatgtaaacatagtaatt

SEQ ID NO: 8473251 - DNA, 22 bp, Homo sapiens
tagggatgtcctgagacttggc

SEQ ID NO: 8473252 - DNA, 22 bp, Homo sapiens
tagggatggatgatgcctggca

SEQ ID NO: 8473253 - DNA, 22 bp, Homo sapiens
tagggatggaaactaggaatct

SEQ ID NO: 8473254 - DNA, 22 bp, Homo sapiens
tagggatgggagattctcaaac

SEQ ID NO: 8473255 - DNA, 22 bp, Homo sapiens
tagggatggcagcatgtagctt

SEQ ID NO: 8473256 - DNA, 22 bp, Homo sapiens
tagggatggcagcatgtagctt

SEQ ID NO: 8473257 - DNA, 22 bp, Homo sapiens
tagggatggaaacccgttttct

SEQ ID NO: 8473258 - DNA, 22 bp, Homo sapiens
tagggatgcttagtaggaccca

SEQ ID NO: 8473259 - DNA, 20 bp, Homo sapiens
tagggatgccagtacttctc

SEQ ID NO: 8473260 - DNA, 22 bp, Homo sapiens
tagggatgatgtctaaaatcat

SEQ ID NO: 8473261 - DNA, 22 bp, Homo sapiens
tagggatgatggagcctatgta

SEQ ID NO: 8473262 - DNA, 22 bp, Homo sapiens
tagggacactgctcatgagttc

SEQ ID NO: 8473263 - DNA, 22 bp, Homo sapiens
tagggagaaacaccaatttatt

SEQ ID NO: 8473264 - DNA, 22 bp, Homo sapiens
taggctgggcattctggccagg

SEQ ID NO: 8473265 - DNA, 22 bp, Homo sapiens
taggctgggcattctggccagg

SEQ ID NO: 8473266 - DNA, 22 bp, Homo sapiens
taggctgggagcctgaggctag

SEQ ID NO: 8473267 - DNA, 20 bp, Homo sapiens
taggcaattagtagataaca

SEQ ID NO: 8473268 - DNA, 22 bp, Homo sapiens
taggcaagtggaccagaggttt

SEQ ID NO: 8473269 - DNA, 22 bp, Homo sapiens
taggcaagttgcccaatctctc

SEQ ID NO: 8473270 - DNA, 22 bp, Homo sapiens
taggcaagtggaccagaggttt

SEQ ID NO: 8473271 - DNA, 22 bp, Homo sapiens
taggcaagtggaccagaggttt

SEQ ID NO: 8473272 - DNA, 22 bp, Homo sapiens
tgttctctaagaaaagaagcat

SEQ ID NO: 8473273 - DNA, 22 bp, Homo sapiens
tgttctctaagaaaagaagcat

SEQ ID NO: 8473274 - DNA, 22 bp, Homo sapiens
tgttctcatctggatctcagga

SEQ ID NO: 8473275 - DNA, 22 bp, Homo sapiens
tgttccttcacagcagtggaca

SEQ ID NO: 8473276 - DNA, 22 bp, Homo sapiens
tgttctcttctcattgaacatg

SEQ ID NO: 8473277 - DNA, 22 bp, Homo sapiens
tgttctcttttcctgctgagcc

SEQ ID NO: 8473278 - DNA, 21 bp, Homo sapiens
tgtttaatacatatttgtgga

SEQ ID NO: 8473279 - DNA, 22 bp, Homo sapiens
tgtttaataattctatgatagt

SEQ ID NO: 8473280 - DNA, 22 bp, Homo sapiens
tgtttaatcttcaggacagtct

SEQ ID NO: 8473281 - DNA, 22 bp, Homo sapiens
tgtttaatctataaaatggaga

SEQ ID NO: 8473282 - DNA, 22 bp, Homo sapiens
tgtttaatgaagatggtttttc

SEQ ID NO: 8473283 - DNA, 22 bp, Homo sapiens
tgtttaattgggccaacagcgg

SEQ ID NO: 8473284 - DNA, 22 bp, Homo sapiens
tgtttaattcaccatcatgttc

SEQ ID NO: 8473285 - DNA, 22 bp, Homo sapiens
tgtttacagggtgattttacct

SEQ ID NO: 8473286 - DNA, 22 bp, Homo sapiens
tgtttctttgtagatattcttt

SEQ ID NO: 8473287 - DNA, 22 bp, Homo sapiens
tgtttcttgggtgctcacatca

SEQ ID NO: 8473288 - DNA, 22 bp, Homo sapiens
tgtttcctaagtgtctctgaag

SEQ ID NO: 8473289 - DNA, 18 bp, Homo sapiens
tgtttcctcctggaggct

SEQ ID NO: 8473290 - DNA, 22 bp, Homo sapiens
tgtttgagttctagcgcattta

SEQ ID NO: 8473291 - DNA, 22 bp, Homo sapiens
tgtttgagttctagcgcattta

SEQ ID NO: 8473292 - DNA, 16 bp, Homo sapiens
tgtttgcaaagcaatc

SEQ ID NO: 8473293 - DNA, 22 bp, Homo sapiens
tgtttgaaaagtggagatttat

SEQ ID NO: 8473294 - DNA, 22 bp, Homo sapiens
tgttttcacaatgatgtcagat

SEQ ID NO: 8473295 - DNA, 19 bp, Homo sapiens
tgttttcaagtgggattat

SEQ ID NO: 8473296 - DNA, 22 bp, Homo sapiens
tgttttctcttgaaaagcagtc

SEQ ID NO: 8473297 - DNA, 22 bp, Homo sapiens
tgtttactagccaacatggaga

SEQ ID NO: 8473298 - DNA, 22 bp, Homo sapiens
tgtttactatgatgtaacctat

SEQ ID NO: 8473299 - DNA, 22 bp, Homo sapiens
tgtttactccagctgatggaac

SEQ ID NO: 8473300 - DNA, 22 bp, Homo sapiens
tgtttactagccaacatggaga

SEQ ID NO: 8473301 - DNA, 21 bp, Homo sapiens
tgtttcatgctattttcttgt

SEQ ID NO: 8473302 - DNA, 20 bp, Homo sapiens
tgtgtgcatctgtatgtatt

SEQ ID NO: 8473303 - DNA, 20 bp, Homo sapiens
tgtgtgcatctgtatgtatt

SEQ ID NO: 8473304 - DNA, 22 bp, Homo sapiens
tgtgttcaatcaccaaaggtat

SEQ ID NO: 8473305 - DNA, 22 bp, Homo sapiens
tgtgttcttaaaagcagtgata

SEQ ID NO: 8473306 - DNA, 22 bp, Homo sapiens
tgtgttcttaaaagcagtgata

SEQ ID NO: 8473307 - DNA, 22 bp, Homo sapiens
tgtgttctggctgtgacagctg

SEQ ID NO: 8473308 - DNA, 22 bp, Homo sapiens
tgtgtgcacaaagagtacatgg

SEQ ID NO: 8473309 - DNA, 22 bp, Homo sapiens
tgtgtgcacaaagagtacatgg

SEQ ID NO: 8473310 - DNA, 22 bp, Homo sapiens
tgtgtgcacaggagtgtttgaa

SEQ ID NO: 8473311 - DNA, 22 bp, Homo sapiens
tgtgtgcacgctgggagctgga

SEQ ID NO: 8473312 - DNA, 21 bp, Homo sapiens
tgtgtgcatatgcatgtacat

SEQ ID NO: 8473313 - DNA, 22 bp, Homo sapiens
tgtgtgcaggcactgtgccaga

SEQ ID NO: 8473314 - DNA, 22 bp, Homo sapiens
tgttcctctgaacttcttccaa

SEQ ID NO: 8473315 - DNA, 22 bp, Homo sapiens
tgttcagaacaaaggtaaatga

SEQ ID NO: 8473316 - DNA, 22 bp, Homo sapiens
tgttcacttatgttctcccatt

SEQ ID NO: 8473317 - DNA, 22 bp, Homo sapiens
tgttcacaggggagccatttat

SEQ ID NO: 8473318 - DNA, 22 bp, Homo sapiens
tgttcacaagcagatgttgctt

SEQ ID NO: 8473319 - DNA, 22 bp, Homo sapiens
tgttcacatgtacatgaatatt

SEQ ID NO: 8473320 - DNA, 22 bp, Homo sapiens
tgttaaaaatgcagattcctat

SEQ ID NO: 8473321 - DNA, 22 bp, Homo sapiens
tgttatactatttagaggtaca

SEQ ID NO: 8473322 - DNA, 22 bp, Homo sapiens
tgttatataacttacaacctgt

SEQ ID NO: 8473323 - DNA, 22 bp, Homo sapiens
tgttatctgcacgtagagtttt

SEQ ID NO: 8473324 - DNA, 22 bp, Homo sapiens
tgttatctggttgtctgattac

SEQ ID NO: 8473325 - DNA, 22 bp, Homo sapiens
tgttatgaacttctagaaaaca

SEQ ID NO: 8473326 - DNA, 22 bp, Homo sapiens
tgttattctctgcctacaagtc

SEQ ID NO: 8473327 - DNA, 22 bp, Homo sapiens
tgttatttatctgagcatttat

SEQ ID NO: 8473328 - DNA, 19 bp, Homo sapiens
tgtgtgcaaatggaagcca

SEQ ID NO: 8473329 - DNA, 19 bp, Homo sapiens
tgtgtgcaaatggaagcca

SEQ ID NO: 8473330 - DNA, 22 bp, Homo sapiens
tgtgtgcaagtgacattagaaa

SEQ ID NO: 8473331 - DNA, 22 bp, Homo sapiens
tgtgtgacacattgatatgtgc

SEQ ID NO: 8473332 - DNA, 22 bp, Homo sapiens
tgtgtgaggtggttctgagaag

SEQ ID NO: 8473333 - DNA, 22 bp, Homo sapiens
tgtgtgacctggggtgagatag

SEQ ID NO: 8473334 - DNA, 22 bp, Homo sapiens
tgtgtcttacataattacatgt

SEQ ID NO: 8473335 - DNA, 20 bp, Homo sapiens
tgtgtcttcctttctttatg

SEQ ID NO: 8473336 - DNA, 22 bp, Homo sapiens
tgtgtctgttttgctcaccatt

SEQ ID NO: 8473337 - DNA, 22 bp, Homo sapiens
tgtgtctttggcgatgtctgga

SEQ ID NO: 8473338 - DNA, 22 bp, Homo sapiens
tgtgtcagcatcctttgggaca

SEQ ID NO: 8473339 - DNA, 22 bp, Homo sapiens
tgtgtcatattagtattgagag

SEQ ID NO: 8473340 - DNA, 21 bp, Homo sapiens
tgtgtcagtctttggaagcaa

SEQ ID NO: 8473341 - DNA, 22 bp, Homo sapiens
tgtgtccaacccagggacaagt

SEQ ID NO: 8473342 - DNA, 22 bp, Homo sapiens
tgtggttttggttcagaaacaa

SEQ ID NO: 8473343 - DNA, 22 bp, Homo sapiens
tgtgtaaaatctgattaatact

SEQ ID NO: 8473344 - DNA, 22 bp, Homo sapiens
tgtggtggctattctggtctca

SEQ ID NO: 8473345 - DNA, 22 bp, Homo sapiens
tgtgtaaatttatttacataaa

SEQ ID NO: 8473346 - DNA, 22 bp, Homo sapiens
tgtgtaaatttatttacataaa

SEQ ID NO: 8473347 - DNA, 19 bp, Homo sapiens
tgtggtctctgttctcagg

SEQ ID NO: 8473348 - DNA, 22 bp, Homo sapiens
tgtggcctctaagctcacgaag

SEQ ID NO: 8473349 - DNA, 22 bp, Homo sapiens
tgtggcctcctgttcctgggta

SEQ ID NO: 8473350 - DNA, 19 bp, Homo sapiens
tgtggggagtcagggggct

SEQ ID NO: 8473351 - DNA, 19 bp, Homo sapiens
tgtggggagtcagggggct

SEQ ID NO: 8473352 - DNA, 22 bp, Homo sapiens
tccccccagcctttcacatgag

SEQ ID NO: 8473353 - DNA, 22 bp, Homo sapiens
tccccctcattacctcattcaa

SEQ ID NO: 8473354 - DNA, 22 bp, Homo sapiens
tcccctcccttccaacagagct

SEQ ID NO: 8473355 - DNA, 22 bp, Homo sapiens
tcccctcctctcctgatatggg

SEQ ID NO: 8473356 - DNA, 22 bp, Homo sapiens
tcccctccaactccaactatgg

SEQ ID NO: 8473357 - DNA, 22 bp, Homo sapiens
tcccccaggctggagtgcagtg

SEQ ID NO: 8473358 - DNA, 20 bp, Homo sapiens
tcccccactgtttctgctac

SEQ ID NO: 8473359 - DNA, 22 bp, Homo sapiens
tcccccactctaaaggagcctt

SEQ ID NO: 8473360 - DNA, 22 bp, Homo sapiens
tcccccactctaaaggagcctt

SEQ ID NO: 8473361 - DNA, 22 bp, Homo sapiens
tccccagtaagcctgcactgtg

SEQ ID NO: 8473362 - DNA, 22 bp, Homo sapiens
tccccaggtcctgtcggctcct

SEQ ID NO: 8473363 - DNA, 22 bp, Homo sapiens
tccccagtaagcctgcactgtg

SEQ ID NO: 8473364 - DNA, 22 bp, Homo sapiens
tccccagtcccggcggtgggtg

SEQ ID NO: 8473365 - DNA, 22 bp, Homo sapiens
tgtggactagagaattctgttg

SEQ ID NO: 8473366 - DNA, 20 bp, Homo sapiens
tgtggactcagtttcttgct

SEQ ID NO: 8473367 - DNA, 22 bp, Homo sapiens
tgtggagaagaaggccactgca

SEQ ID NO: 8473368 - DNA, 22 bp, Homo sapiens
tgtggactttattttagggagg

SEQ ID NO: 8473369 - DNA, 22 bp, Homo sapiens
tcccctctctgcgctcccaggt

SEQ ID NO: 8473370 - DNA, 22 bp, Homo sapiens
tcccctctctgcgctcccaggt

SEQ ID NO: 8473371 - DNA, 22 bp, Homo sapiens
tcccctctggaggctgcagggg

SEQ ID NO: 8473372 - DNA, 22 bp, Homo sapiens
tgtggcagaaccagaattcaaa

SEQ ID NO: 8473373 - DNA, 22 bp, Homo sapiens
tgtggcagaactgggactcaaa

SEQ ID NO: 8473374 - DNA, 22 bp, Homo sapiens
tgtggataatgcactatccata

SEQ ID NO: 8473375 - DNA, 22 bp, Homo sapiens
tgtggatgaataaagtgcagac

SEQ ID NO: 8473376 - DNA, 22 bp, Homo sapiens
tgtggaggtttaagtaatggga

SEQ ID NO: 8473377 - DNA, 22 bp, Homo sapiens
tgtggcagagagagcttccttg

SEQ ID NO: 8473378 - DNA, 21 bp, Homo sapiens
tgtggcagagacaatgctagt

SEQ ID NO: 8473379 - DNA, 22 bp, Homo sapiens
tgtggcagattttataaattgc

SEQ ID NO: 8473380 - DNA, 21 bp, Homo sapiens
tgtggcagatgttgggaggca

SEQ ID NO: 8473381 - DNA, 22 bp, Homo sapiens
tgtggccaggcccctgatggtg

SEQ ID NO: 8473382 - DNA, 19 bp, Homo sapiens
tgtggccatggttcagctg

SEQ ID NO: 8473383 - DNA, 22 bp, Homo sapiens
tgtggcagtctcactggagggc

SEQ ID NO: 8473384 - DNA, 22 bp, Homo sapiens
tgtggcagtataagagctagaa

SEQ ID NO: 8473385 - DNA, 23 bp, Homo sapiens
ttaagtggtcagttttagacaac

SEQ ID NO: 8473386 - DNA, 22 bp, Homo sapiens
ttaagtgtcataatttccaaga

SEQ ID NO: 8473387 - DNA, 22 bp, Homo sapiens
ttaagtaacttgtccaaatgag

SEQ ID NO: 8473388 - DNA, 22 bp, Homo sapiens
ttaaggcattctcctactaata

SEQ ID NO: 8473389 - DNA, 18 bp, Homo sapiens
ttaaggataagcagacta

SEQ ID NO: 8473390 - DNA, 17 bp, Homo sapiens
ttaaggtggatcagcac

SEQ ID NO: 8473391 - DNA, 22 bp, Homo sapiens
ttaagggccattatggatgggt

SEQ ID NO: 8473392 - DNA, 22 bp, Homo sapiens
ttaattacaaaacacataggtt

SEQ ID NO: 8473393 - DNA, 22 bp, Homo sapiens
ttaattactaagcacaatgcaa

SEQ ID NO: 8473394 - DNA, 22 bp, Homo sapiens
ttaattactggcatggtggttg

SEQ ID NO: 8473395 - DNA, 22 bp, Homo sapiens
ttaattagagctgatgttcata

SEQ ID NO: 8473396 - DNA, 22 bp, Homo sapiens
ttaattatgagaaagggaaaag

SEQ ID NO: 8473397 - DNA, 22 bp, Homo sapiens
ttaataaacaggtgcagctgaa

SEQ ID NO: 8473398 - DNA, 22 bp, Homo sapiens
ttaataaacaggtgcagctgaa

SEQ ID NO: 8473399 - DNA, 22 bp, Homo sapiens
ttaattaattagttaagcatgt

SEQ ID NO: 8473400 - DNA, 22 bp, Homo sapiens
ttaattgagccagaaagtatct

SEQ ID NO: 8473401 - DNA, 20 bp, Homo sapiens
ttaagaaaagcacatcctgc

SEQ ID NO: 8473402 - DNA, 20 bp, Homo sapiens
ttaagaaaagcacatcctgc

SEQ ID NO: 8473403 - DNA, 22 bp, Homo sapiens
ttaagacacatttctcagacgg

SEQ ID NO: 8473404 - DNA, 22 bp, Homo sapiens
ttaagaaggtactcaaagatct

SEQ ID NO: 8473405 - DNA, 22 bp, Homo sapiens
ttaagaaggctgtttgctagac

SEQ ID NO: 8473406 - DNA, 22 bp, Homo sapiens
ttaagaaggtactcaaagatct

SEQ ID NO: 8473407 - DNA, 22 bp, Homo sapiens
ttaaggaacttgtctttctctt

SEQ ID NO: 8473408 - DNA, 22 bp, Homo sapiens
ttaacactgattgtagagacac

SEQ ID NO: 8473409 - DNA, 22 bp, Homo sapiens
ttaacagacttgggattttcta

SEQ ID NO: 8473410 - DNA, 22 bp, Homo sapiens
ttaacagagtgcctggcatgta

SEQ ID NO: 8473411 - DNA, 22 bp, Homo sapiens
ttaacattgtccttagcagatt

SEQ ID NO: 8473412 - DNA, 22 bp, Homo sapiens
ttaacaatagagtttcttcagg

SEQ ID NO: 8473413 - DNA, 22 bp, Homo sapiens
ttaacaatagagtttcttcagg

SEQ ID NO: 8473414 - DNA, 22 bp, Homo sapiens
ttaaattaggactctagttctg

SEQ ID NO: 8473415 - DNA, 22 bp, Homo sapiens
ttaaattaggactctagttctg

SEQ ID NO: 8473416 - DNA, 22 bp, Homo sapiens
ttaaattaggactctagttctg

SEQ ID NO: 8473417 - DNA, 22 bp, Homo sapiens
ttaaatgtgatcctggtatgca

SEQ ID NO: 8473418 - DNA, 22 bp, Homo sapiens
ttaaatgtgatttcatttatgt

SEQ ID NO: 8473419 - DNA, 22 bp, Homo sapiens
ttaaatgtgatttcatttatgt

SEQ ID NO: 8473420 - DNA, 22 bp, Homo sapiens
ttaaatctgttctcatgtctgt

SEQ ID NO: 8473421 - DNA, 22 bp, Homo sapiens
ttaaatgaacgagatatgcaac

SEQ ID NO: 8473422 - DNA, 22 bp, Homo sapiens
ttaaatgacttttattattctc

SEQ ID NO: 8473423 - DNA, 22 bp, Homo sapiens
ttaaatgaggctgatgtagatt

SEQ ID NO: 8473424 - DNA, 22 bp, Homo sapiens
ttaaatgaggctgatgtagatt

SEQ ID NO: 8473425 - DNA, 22 bp, Homo sapiens
ttaaatgaggctgatgtagatt

SEQ ID NO: 8473426 - DNA, 22 bp, Homo sapiens
ttaaatgagatgttcagatatt

SEQ ID NO: 8473427 - DNA, 22 bp, Homo sapiens
ttaaatggggatgagtagatgg

SEQ ID NO: 8473428 - DNA, 22 bp, Homo sapiens
ttaaatgtcaatagattgcttg

SEQ ID NO: 8473429 - DNA, 22 bp, Homo sapiens
ttaaatgatgcatatcatttag

SEQ ID NO: 8473430 - DNA, 22 bp, Homo sapiens
tgttttgtccttttctatatac

SEQ ID NO: 8473431 - DNA, 22 bp, Homo sapiens
tgttttggtttaagtatatgaa

SEQ ID NO: 8473432 - DNA, 22 bp, Homo sapiens
tgttttggtagattgattatgg

SEQ ID NO: 8473433 - DNA, 22 bp, Homo sapiens
tgttttggaacaaaagctattc

SEQ ID NO: 8473434 - DNA, 22 bp, Homo sapiens
tgttttctgattctcgtgtggt

SEQ ID NO: 8473435 - DNA, 22 bp, Homo sapiens
tgttttctgatggttaatgagt

SEQ ID NO: 8473436 - DNA, 22 bp, Homo sapiens
tgttttctgatggttaatgagt

SEQ ID NO: 8473437 - DNA, 17 bp, Homo sapiens
tgttttctgctaccttt

SEQ ID NO: 8473438 - DNA, 17 bp, Homo sapiens
tgttttctgctaccttt

SEQ ID NO: 8473439 - DNA, 22 bp, Homo sapiens
tgttttctgggtggaaggtact

SEQ ID NO: 8473440 - DNA, 23 bp, Homo sapiens
tgttttcttgtcctggtataatt

SEQ ID NO: 8473441 - DNA, 22 bp, Homo sapiens
tgttttctgggtggaaggtact

SEQ ID NO: 8473442 - DNA, 22 bp, Homo sapiens
ttaaatattatgttgtctgcaa

SEQ ID NO: 8473443 - DNA, 22 bp, Homo sapiens
ttaaatagtcaaatcagtggca

SEQ ID NO: 8473444 - DNA, 22 bp, Homo sapiens
ttaaagctaggtggaacaaatt

SEQ ID NO: 8473445 - DNA, 22 bp, Homo sapiens
tgtttttcaaatattgctctgt

SEQ ID NO: 8473446 - DNA, 23 bp, Homo sapiens
tgtttttcattcacatgggctgt

SEQ ID NO: 8473447 - DNA, 22 bp, Homo sapiens
ttaaagcatgctgcttttccat

SEQ ID NO: 8473448 - DNA, 22 bp, Homo sapiens
ttacacttacctgtccattgaa

SEQ ID NO: 8473449 - DNA, 22 bp, Homo sapiens
ttacacttagggtttgtcagag

SEQ ID NO: 8473450 - DNA, 22 bp, Homo sapiens
ttacacttctaaaaaaagcagg

SEQ ID NO: 8473451 - DNA, 19 bp, Homo sapiens
ttacacttctgctttgtga

SEQ ID NO: 8473452 - DNA, 22 bp, Homo sapiens
ttacacttctgaaagcctaggt

SEQ ID NO: 8473453 - DNA, 22 bp, Homo sapiens
ttacacttgtaaatggcatgta

SEQ ID NO: 8473454 - DNA, 22 bp, Homo sapiens
ttacaggaggtgctaggtgttt

SEQ ID NO: 8473455 - DNA, 22 bp, Homo sapiens
ttacaggggacattggggacat

SEQ ID NO: 8473456 - DNA, 22 bp, Homo sapiens
ttacaggggtgtggaggcaatc

SEQ ID NO: 8473457 - DNA, 22 bp, Homo sapiens
ttacagggttgcagcattgacg

SEQ ID NO: 8473458 - DNA, 22 bp, Homo sapiens
ttacagtagctttatttggagt

SEQ ID NO: 8473459 - DNA, 22 bp, Homo sapiens
ttacagtagattttgaatgtgg

SEQ ID NO: 8473460 - DNA, 22 bp, Homo sapiens
ttacagtaatcgagtgttgtgg

SEQ ID NO: 8473461 - DNA, 22 bp, Homo sapiens
ttacaggtggagaagtaaggct

SEQ ID NO: 8473462 - DNA, 22 bp, Homo sapiens
ttacaggtgggaaaactaagct

SEQ ID NO: 8473463 - DNA, 22 bp, Homo sapiens
ttacaggttgtgtattcagtga

SEQ ID NO: 8473464 - DNA, 22 bp, Homo sapiens
ttacatcagcaagagtgtatgt

SEQ ID NO: 8473465 - DNA, 22 bp, Homo sapiens
ttacatcactttacttaataat

SEQ ID NO: 8473466 - DNA, 22 bp, Homo sapiens
ttacatattgtctattgttcaa

SEQ ID NO: 8473467 - DNA, 22 bp, Homo sapiens
ttacatattatccaaaactgct

SEQ ID NO: 8473468 - DNA, 22 bp, Homo sapiens
ttacatattatccaaaactgct

SEQ ID NO: 8473469 - DNA, 22 bp, Homo sapiens
ttacatcattgagacatacata

SEQ ID NO: 8473470 - DNA, 22 bp, Homo sapiens
ttacagtgctcttcaagacttc

SEQ ID NO: 8473471 - DNA, 22 bp, Homo sapiens
ttacagtgctcttcaagacttc

SEQ ID NO: 8473472 - DNA, 20 bp, Homo sapiens
ttacagtgggaccttcctga

SEQ ID NO: 8473473 - DNA, 20 bp, Homo sapiens
ttacagtgggaccttcctga

SEQ ID NO: 8473474 - DNA, 22 bp, Homo sapiens
ttacagtggcagagttgggtag

SEQ ID NO: 8473475 - DNA, 22 bp, Homo sapiens
ttacagtgaagtaccattaaaa

SEQ ID NO: 8473476 - DNA, 22 bp, Homo sapiens
ttacagtgaagtaccattaaaa

SEQ ID NO: 8473477 - DNA, 22 bp, Homo sapiens
ttacagtgacagttgctatgat

SEQ ID NO: 8473478 - DNA, 22 bp, Homo sapiens
ttacagtgacagttgctatgat

SEQ ID NO: 8473479 - DNA, 22 bp, Homo sapiens
ttacagtgagggtgacatttac

SEQ ID NO: 8473480 - DNA, 22 bp, Homo sapiens
ttacagtgactcacattaacaa

SEQ ID NO: 8473481 - DNA, 22 bp, Homo sapiens
ttacatattatccaaaactgct

SEQ ID NO: 8473482 - DNA, 22 bp, Homo sapiens
ttacatagttaaatagtacagc

SEQ ID NO: 8473483 - DNA, 22 bp, Homo sapiens
ttacagtgaagattcaggttcc

SEQ ID NO: 8473484 - DNA, 22 bp, Homo sapiens
ttacagtcagtgaatggaaggg

SEQ ID NO: 8473485 - DNA, 22 bp, Homo sapiens
ttacacagaaattttattgcct

SEQ ID NO: 8473486 - DNA, 22 bp, Homo sapiens
ttacacatctagacccattttt

SEQ ID NO: 8473487 - DNA, 22 bp, Homo sapiens
ttacaaacaacagacatttatt

SEQ ID NO: 8473488 - DNA, 22 bp, Homo sapiens
ttacacaaacacattccagata

SEQ ID NO: 8473489 - DNA, 22 bp, Homo sapiens
ttacaaagaaaattaggcattt

SEQ ID NO: 8473490 - DNA, 22 bp, Homo sapiens
ttacaaacaagatcttattctt

SEQ ID NO: 8473491 - DNA, 22 bp, Homo sapiens
ttacaaacaagatcttattctt

SEQ ID NO: 8473492 - DNA, 22 bp, Homo sapiens
ttacacaacatctgtattatta

SEQ ID NO: 8473493 - DNA, 22 bp, Homo sapiens
ttacacaacagtgcatcagcag

SEQ ID NO: 8473494 - DNA, 22 bp, Homo sapiens
ttagaaagaactttagatatca

SEQ ID NO: 8473495 - DNA, 22 bp, Homo sapiens
ttagaaagaactttagatatca

SEQ ID NO: 8473496 - DNA, 22 bp, Homo sapiens
ttagaaagaactttagatatca

SEQ ID NO: 8473497 - DNA, 22 bp, Homo sapiens
ttagaaactttggaggatagat

SEQ ID NO: 8473498 - DNA, 21 bp, Homo sapiens
ttagaaagctcactacagtta

SEQ ID NO: 8473499 - DNA, 21 bp, Homo sapiens
ttagaaagctcactacagtta

SEQ ID NO: 8473500 - DNA, 20 bp, Homo sapiens
ttagaaagagcgtgataaga

SEQ ID NO: 8473501 - DNA, 19 bp, Homo sapiens
ttagaaactgttgacactg

SEQ ID NO: 8473502 - DNA, 22 bp, Homo sapiens
ttagaaactcaactctgggaat

SEQ ID NO: 8473503 - DNA, 22 bp, Homo sapiens
ttagaaacaaaatagttatttg

SEQ ID NO: 8473504 - DNA, 22 bp, Homo sapiens
ttagaaacaaaatagttatttg

SEQ ID NO: 8473505 - DNA, 22 bp, Homo sapiens
ttagaaacccagactcttaggt

SEQ ID NO: 8473506 - DNA, 22 bp, Homo sapiens
ttagaaaatttgcttctttgga

SEQ ID NO: 8473507 - DNA, 22 bp, Homo sapiens
ttagaaaatttgcttctttgga

SEQ ID NO: 8473508 - DNA, 22 bp, Homo sapiens
ttagaaaatttgcttctttgga

SEQ ID NO: 8473509 - DNA, 22 bp, Homo sapiens
ttactttccagctctagcttca

SEQ ID NO: 8473510 - DNA, 22 bp, Homo sapiens
ttagagaagctgtaattattca

SEQ ID NO: 8473511 - DNA, 22 bp, Homo sapiens
ttagagaagttttacttaagaa

SEQ ID NO: 8473512 - DNA, 22 bp, Homo sapiens
ttagagaattccaaatgactac

SEQ ID NO: 8473513 - DNA, 22 bp, Homo sapiens
ttagagagaaccatcaggatct

SEQ ID NO: 8473514 - DNA, 22 bp, Homo sapiens
ttagagattgtctagtattgtg

SEQ ID NO: 8473515 - DNA, 23 bp, Homo sapiens
ttagagatgattaaaaaatcttg

SEQ ID NO: 8473516 - DNA, 22 bp, Homo sapiens
ttagagccccagaaaacagtgg

SEQ ID NO: 8473517 - DNA, 17 bp, Homo sapiens
ttagagctacatgttga

SEQ ID NO: 8473518 - DNA, 17 bp, Homo sapiens
ttagagctacatgttga

SEQ ID NO: 8473519 - DNA, 22 bp, Homo sapiens
ttagagctgatagtacactggt

SEQ ID NO: 8473520 - DNA, 22 bp, Homo sapiens
ttagagctacggcctttaaaaa

SEQ ID NO: 8473521 - DNA, 22 bp, Homo sapiens
ttagagctagatgaggtcatga

SEQ ID NO: 8473522 - DNA, 22 bp, Homo sapiens
ttagagccagttacaaggtcaa

SEQ ID NO: 8473523 - DNA, 22 bp, Homo sapiens
ttagagccccagaaaacagtgg

SEQ ID NO: 8473524 - DNA, 22 bp, Homo sapiens
ttagagctgggatggattttcc

SEQ ID NO: 8473525 - DNA, 22 bp, Homo sapiens
ttagagcttcccaattaaaacg

SEQ ID NO: 8473526 - DNA, 22 bp, Homo sapiens
ttagaggactgtaggtgggaat

SEQ ID NO: 8473527 - DNA, 22 bp, Homo sapiens
ttagagaaagggtttgattccg

SEQ ID NO: 8473528 - DNA, 22 bp, Homo sapiens
ttagacatgtttgctaaaatga

SEQ ID NO: 8473529 - DNA, 22 bp, Homo sapiens
ttagacatcagtgcttctcagc

SEQ ID NO: 8473530 - DNA, 19 bp, Homo sapiens
ttagaagccataggtacag

SEQ ID NO: 8473531 - DNA, 21 bp, Homo sapiens
ttagaagctaatgcagctggt

SEQ ID NO: 8473532 - DNA, 22 bp, Homo sapiens
ttagaaagctttccatagtcaa

SEQ ID NO: 8473533 - DNA, 21 bp, Homo sapiens
ttagaaagctcactacagtta

SEQ ID NO: 8473534 - DNA, 22 bp, Homo sapiens
ttagaagccaggatggagcagg

SEQ ID NO: 8473535 - DNA, 22 bp, Homo sapiens
ttagaagcatcacctgttctgg

SEQ ID NO: 8473536 - DNA, 22 bp, Homo sapiens
ttacattttggggtaaggataa

SEQ ID NO: 8473537 - DNA, 22 bp, Homo sapiens
ttaccaaatcccgtgcacattc

SEQ ID NO: 8473538 - DNA, 22 bp, Homo sapiens
ttactacattgtaacacagtac

SEQ ID NO: 8473539 - DNA, 22 bp, Homo sapiens
ttactacagagagagctccagt

SEQ ID NO: 8473540 - DNA, 23 bp, Homo sapiens
ttactacacaagtaacgattccc

SEQ ID NO: 8473541 - DNA, 22 bp, Homo sapiens
ttactagtggagaaactgaggc

SEQ ID NO: 8473542 - DNA, 22 bp, Homo sapiens
ttactagtatatgtcaagcaac

SEQ ID NO: 8473543 - DNA, 22 bp, Homo sapiens
ttactctgaatgtttctactga

SEQ ID NO: 8473544 - DNA, 20 bp, Homo sapiens
ttactcataggaccacaagc

SEQ ID NO: 8473545 - DNA, 22 bp, Homo sapiens
ttactgcaacataatgtagtct

SEQ ID NO: 8473546 - DNA, 22 bp, Homo sapiens
ttactgagggtgtatcttagtg

SEQ ID NO: 8473547 - DNA, 22 bp, Homo sapiens
ttactgaggagcatatctgagt

SEQ ID NO: 8473548 - DNA, 22 bp, Homo sapiens
ttactgaaccctacttttacag

SEQ ID NO: 8473549 - DNA, 22 bp, Homo sapiens
ttactgaaataatgaaacacat

SEQ ID NO: 8473550 - DNA, 22 bp, Homo sapiens
ttactgatggaacagagataga

SEQ ID NO: 8473551 - DNA, 22 bp, Homo sapiens
ttactgatttttgggccctacc

SEQ ID NO: 8473552 - DNA, 22 bp, Homo sapiens
ttactgatacacataagaattt

SEQ ID NO: 8473553 - DNA, 22 bp, Homo sapiens
ttactgatacacataagaattt

SEQ ID NO: 8473554 - DNA, 22 bp, Homo sapiens
ttactgatggaacagagataga

SEQ ID NO: 8473555 - DNA, 22 bp, Homo sapiens
ttacttcttgtctcatgcctat

SEQ ID NO: 8473556 - DNA, 22 bp, Homo sapiens
ttacttgaaaaccaccagtatt

SEQ ID NO: 8473557 - DNA, 22 bp, Homo sapiens
ttacttctttggccttcagcca

SEQ ID NO: 8473558 - DNA, 22 bp, Homo sapiens
ttacttctttggccttcagcca

SEQ ID NO: 8473559 - DNA, 22 bp, Homo sapiens
ttacttcttgtctcatgcctat

SEQ ID NO: 8473560 - DNA, 19 bp, Homo sapiens
ttacttcaggagtgaaatt

SEQ ID NO: 8473561 - DNA, 22 bp, Homo sapiens
ttacttacaaaggcaaaggaag

SEQ ID NO: 8473562 - DNA, 22 bp, Homo sapiens
ttacttacagacagtagactct

SEQ ID NO: 8473563 - DNA, 22 bp, Homo sapiens
ttacttcttacaaaagaaatat

SEQ ID NO: 8473564 - DNA, 22 bp, Homo sapiens
ttacttcttacaaaagaaatat

SEQ ID NO: 8473565 - DNA, 21 bp, Homo sapiens
ttacttctgcttgttattgtc

SEQ ID NO: 8473566 - DNA, 21 bp, Homo sapiens
ttacttctgcttgttattgtc

SEQ ID NO: 8473567 - DNA, 18 bp, Homo sapiens
ttactgttatcaaaacag

SEQ ID NO: 8473568 - DNA, 22 bp, Homo sapiens
ttactgttcatgttgtacactt

SEQ ID NO: 8473569 - DNA, 22 bp, Homo sapiens
ttactgttggtgtatccatagc

SEQ ID NO: 8473570 - DNA, 22 bp, Homo sapiens
ttactgtttttaactaattgtg

SEQ ID NO: 8473571 - DNA, 22 bp, Homo sapiens
ttactgttttggtacctcattg

SEQ ID NO: 8473572 - DNA, 22 bp, Homo sapiens
ttactttagatcatactgtgtg

SEQ ID NO: 8473573 - DNA, 22 bp, Homo sapiens
ttacttgaatgctgtgatctca

SEQ ID NO: 8473574 - DNA, 22 bp, Homo sapiens
ttctagatgcttataggcatat

SEQ ID NO: 8473575 - DNA, 22 bp, Homo sapiens
ttctagattgcctgtaagtaaa

SEQ ID NO: 8473576 - DNA, 22 bp, Homo sapiens
ttctagacttcaggcattctcc

SEQ ID NO: 8473577 - DNA, 22 bp, Homo sapiens
ttctagacaaatgtgttcattc

SEQ ID NO: 8473578 - DNA, 22 bp, Homo sapiens
ttctagaggggagatactagta

SEQ ID NO: 8473579 - DNA, 22 bp, Homo sapiens
ttctaggaagggaagcatggca

SEQ ID NO: 8473580 - DNA, 22 bp, Homo sapiens
ttctagaaggcaggctgggcca

SEQ ID NO: 8473581 - DNA, 22 bp, Homo sapiens
ttctagaagctgaaaaggggga

SEQ ID NO: 8473582 - DNA, 22 bp, Homo sapiens
ttctagaagtgtctatgtctgt

SEQ ID NO: 8473583 - DNA, 20 bp, Homo sapiens
ttctagaagtttgctaccca

SEQ ID NO: 8473584 - DNA, 22 bp, Homo sapiens
ttctagaatgatatgaggtact

SEQ ID NO: 8473585 - DNA, 22 bp, Homo sapiens
ttctagaatccttgtctacttt

SEQ ID NO: 8473586 - DNA, 22 bp, Homo sapiens
ttctagaatgttttgaaaggga

SEQ ID NO: 8473587 - DNA, 20 bp, Homo sapiens
ttctagaatgcccagggaca

SEQ ID NO: 8473588 - DNA, 22 bp, Homo sapiens
ttctagaatgatatgaggtact

SEQ ID NO: 8473589 - DNA, 19 bp, Homo sapiens
ttctagaactgttctctca

SEQ ID NO: 8473590 - DNA, 22 bp, Homo sapiens
ttctagaagctctaggggagaa

SEQ ID NO: 8473591 - DNA, 22 bp, Homo sapiens
ttctagaagaactagccaggaa

SEQ ID NO: 8473592 - DNA, 21 bp, Homo sapiens
ttctagaaccgtgggcggttc

SEQ ID NO: 8473593 - DNA, 22 bp, Homo sapiens
ttctagaaccatgacttcaggg

SEQ ID NO: 8473594 - DNA, 22 bp, Homo sapiens
ttctagaacaggcaaaaccaat

SEQ ID NO: 8473595 - DNA, 22 bp, Homo sapiens
ttctagaaatccgtaagtgaat

SEQ ID NO: 8473596 - DNA, 22 bp, Homo sapiens
ttctagaaactggagcaaacag

SEQ ID NO: 8473597 - DNA, 22 bp, Homo sapiens
ttctagaaactggagcaaacag

SEQ ID NO: 8473598 - DNA, 22 bp, Homo sapiens
ttctacaaatatttactgttcc

SEQ ID NO: 8473599 - DNA, 22 bp, Homo sapiens
ttctacaaatatttactgttcc

SEQ ID NO: 8473600 - DNA, 20 bp, Homo sapiens
ttctacaaaactgattctga

SEQ ID NO: 8473601 - DNA, 22 bp, Homo sapiens
ttctacacacctctgaggacat

SEQ ID NO: 8473602 - DNA, 16 bp, Homo sapiens
ttctagaaaagaaggt

SEQ ID NO: 8473603 - DNA, 21 bp, Homo sapiens
ttctagaaaagtatgggactg

SEQ ID NO: 8473604 - DNA, 22 bp, Homo sapiens
ttctagaaacacatgcaaacag

SEQ ID NO: 8473605 - DNA, 16 bp, Homo sapiens
ttctagaaaagaaggt

SEQ ID NO: 8473606 - DNA, 22 bp, Homo sapiens
ttctacttctgacactgtttgt

SEQ ID NO: 8473607 - DNA, 22 bp, Homo sapiens
ttctaattgaccttaggctgtg

SEQ ID NO: 8473608 - DNA, 22 bp, Homo sapiens
ttctaattaaatctacgctagg

SEQ ID NO: 8473609 - DNA, 20 bp, Homo sapiens
ttctaatttgatggagtagc

SEQ ID NO: 8473610 - DNA, 22 bp, Homo sapiens
ttctaattgtgtttgcatatct

SEQ ID NO: 8473611 - DNA, 22 bp, Homo sapiens
ttctaagtcactcagattttgg

SEQ ID NO: 8473612 - DNA, 22 bp, Homo sapiens
ttctaagtctgctgtcttcatc

SEQ ID NO: 8473613 - DNA, 21 bp, Homo sapiens
ttctaagtgttaccttttctt

SEQ ID NO: 8473614 - DNA, 22 bp, Homo sapiens
ttctaagtgttgacaaagtcta

SEQ ID NO: 8473615 - DNA, 22 bp, Homo sapiens
ttctaagtttctcagtttcagt

SEQ ID NO: 8473616 - DNA, 22 bp, Homo sapiens
ttctaagaaatggaaaacgatt

SEQ ID NO: 8473617 - DNA, 22 bp, Homo sapiens
ttctaagaggctaatgaagaat

SEQ ID NO: 8473618 - DNA, 22 bp, Homo sapiens
ttcctgttagccattattagct

SEQ ID NO: 8473619 - DNA, 22 bp, Homo sapiens
ttcctgtgtacgtgtttcgctg

SEQ ID NO: 8473620 - DNA, 22 bp, Homo sapiens
ttcctgtgtcccgggcaccctg

SEQ ID NO: 8473621 - DNA, 22 bp, Homo sapiens
ttcctgtgtcctatttcgactt

SEQ ID NO: 8473622 - DNA, 22 bp, Homo sapiens
ttcctgtgtgaccgagacagtg

SEQ ID NO: 8473623 - DNA, 22 bp, Homo sapiens
ttcctgtgtgactcaagtggtt

SEQ ID NO: 8473624 - DNA, 22 bp, Homo sapiens
ttcctgtgtgaccgagacagtg

SEQ ID NO: 8473625 - DNA, 22 bp, Homo sapiens
ttcctgtgtgttggtggcagaa

SEQ ID NO: 8473626 - DNA, 22 bp, Homo sapiens
ttcctgtgtgctctcatttagt

SEQ ID NO: 8473627 - DNA, 22 bp, Homo sapiens
ttcctgtggtccagagtcatcc

SEQ ID NO: 8473628 - DNA, 23 bp, Homo sapiens
ttcctgtggtatattttataggg

SEQ ID NO: 8473629 - DNA, 22 bp, Homo sapiens
ttcctgtggctgtcactcctgg

SEQ ID NO: 8473630 - DNA, 22 bp, Homo sapiens
ttcctgtggtgtttcccagaca

SEQ ID NO: 8473631 - DNA, 17 bp, Homo sapiens
ttcctgtggtttgatct

SEQ ID NO: 8473632 - DNA, 22 bp, Homo sapiens
ttcctgtgatattagccactgt

SEQ ID NO: 8473633 - DNA, 22 bp, Homo sapiens
ttcctgtgcctcaggtctcagc

SEQ ID NO: 8473634 - DNA, 22 bp, Homo sapiens
ttcctgtgaagccggtggtctc

SEQ ID NO: 8473635 - DNA, 19 bp, Homo sapiens
ttcctgtgctgctgtgtcc

SEQ ID NO: 8473636 - DNA, 22 bp, Homo sapiens
ttcctgtgcttaattctcactg

SEQ ID NO: 8473637 - DNA, 22 bp, Homo sapiens
ttcctgtgcttattcttctctg

SEQ ID NO: 8473638 - DNA, 22 bp, Homo sapiens
ttcctgtggccttacatctgtg

SEQ ID NO: 8473639 - DNA, 22 bp, Homo sapiens
ttcctgtgaagatctgggtgct

SEQ ID NO: 8473640 - DNA, 22 bp, Homo sapiens
ttcctgtgaaatataggtccat

SEQ ID NO: 8473641 - DNA, 22 bp, Homo sapiens
ttcctgaagtcaaagatctaaa

SEQ ID NO: 8473642 - DNA, 22 bp, Homo sapiens
ttcctgaacatttctaagttga

SEQ ID NO: 8473643 - DNA, 22 bp, Homo sapiens
ttcctctttctctgtgctatgt

SEQ ID NO: 8473644 - DNA, 22 bp, Homo sapiens
ttcctccagaagctgtagggga

SEQ ID NO: 8473645 - DNA, 22 bp, Homo sapiens
ttcctccacgtgacaggagcca

SEQ ID NO: 8473646 - DNA, 22 bp, Homo sapiens
ttcctccagcctggagcacttc

SEQ ID NO: 8473647 - DNA, 22 bp, Homo sapiens
ttcctctggggccaggccaaca

SEQ ID NO: 8473648 - DNA, 22 bp, Homo sapiens
ttcctctgtatgctttgctgct

SEQ ID NO: 8473649 - DNA, 22 bp, Homo sapiens
ttcctcagctgtttgggctcat

SEQ ID NO: 8473650 - DNA, 22 bp, Homo sapiens
ttcctcagctttagactatgaa

SEQ ID NO: 8473651 - DNA, 22 bp, Homo sapiens
ttcctcagtgcccccatacggt

SEQ ID NO: 8473652 - DNA, 22 bp, Homo sapiens
ttcctcagggaggctagcagta

SEQ ID NO: 8473653 - DNA, 22 bp, Homo sapiens
ttcctcagggcggatgggcagg

SEQ ID NO: 8473654 - DNA, 22 bp, Homo sapiens
ttcctagaatggttagaaaata

SEQ ID NO: 8473655 - DNA, 22 bp, Homo sapiens
ttcctatagaaagctgtgtaga

SEQ ID NO: 8473656 - DNA, 22 bp, Homo sapiens
ttcctagggcagagccgctggg

SEQ ID NO: 8473657 - DNA, 22 bp, Homo sapiens
ttcctagggcagagccgctggg

SEQ ID NO: 8473658 - DNA, 22 bp, Homo sapiens
ttcctcagcacaaagccaagat

SEQ ID NO: 8473659 - DNA, 22 bp, Homo sapiens
ttcctcagagagacagaaacta

SEQ ID NO: 8473660 - DNA, 22 bp, Homo sapiens
ttccagaattgggagccttgag

SEQ ID NO: 8473661 - DNA, 22 bp, Homo sapiens
ttccagaagatggcagcaaagg

SEQ ID NO: 8473662 - DNA, 22 bp, Homo sapiens
ttccagaagatggcagcaaagg

SEQ ID NO: 8473663 - DNA, 22 bp, Homo sapiens
ttccagaagcctccatattact

SEQ ID NO: 8473664 - DNA, 22 bp, Homo sapiens
ttccctggctcttctacatcgt

SEQ ID NO: 8473665 - DNA, 22 bp, Homo sapiens
ttccctggccctggcacgctct

SEQ ID NO: 8473666 - DNA, 20 bp, Homo sapiens
ttccacatctttgcacatgc

SEQ ID NO: 8473667 - DNA, 22 bp, Homo sapiens
ttccagaacaatgtggacgtat

SEQ ID NO: 8473668 - DNA, 22 bp, Homo sapiens
ttccagaactcaagaaatgccc

SEQ ID NO: 8473669 - DNA, 22 bp, Homo sapiens
ttccacagccatcactgttgct

SEQ ID NO: 8473670 - DNA, 22 bp, Homo sapiens
ttcacaaaacactattttctgg

SEQ ID NO: 8473671 - DNA, 22 bp, Homo sapiens
ttcaatttagtgatgttgttgg

SEQ ID NO: 8473672 - DNA, 22 bp, Homo sapiens
ttcaatttcataatatctagct

SEQ ID NO: 8473673 - DNA, 22 bp, Homo sapiens
ttcacaaaaatgctgaacagtt

SEQ ID NO: 8473674 - DNA, 22 bp, Homo sapiens
ttcaagaaagagtggctattcc

SEQ ID NO: 8473675 - DNA, 22 bp, Homo sapiens
ttcaatgcatatagatatagaa

SEQ ID NO: 8473676 - DNA, 22 bp, Homo sapiens
ttcaatgtctatgtacatttta

SEQ ID NO: 8473677 - DNA, 22 bp, Homo sapiens
ttcaatgcctagaacttagcat

SEQ ID NO: 8473678 - DNA, 22 bp, Homo sapiens
ttcaatgcttatatggactaat

SEQ ID NO: 8473679 - DNA, 22 bp, Homo sapiens
ttcaatttagtgatgttgttgg

SEQ ID NO: 8473680 - DNA, 22 bp, Homo sapiens
ttcaattctgatgaaggcaata

SEQ ID NO: 8473681 - DNA, 22 bp, Homo sapiens
ttcaattctgctctgatcttag

SEQ ID NO: 8473682 - DNA, 22 bp, Homo sapiens
ttcaattcaattctaaatatat

SEQ ID NO: 8473683 - DNA, 22 bp, Homo sapiens
ttcaattctaaactaatattct

SEQ ID NO: 8473684 - DNA, 22 bp, Homo sapiens
ttcaatgtttcttatcaagttg

SEQ ID NO: 8473685 - DNA, 22 bp, Homo sapiens
ttcaatgtttcttatcaagttg

SEQ ID NO: 8473686 - DNA, 19 bp, Homo sapiens
ttcacaagtgatgtctctc

SEQ ID NO: 8473687 - DNA, 22 bp, Homo sapiens
ttcacaagtgtgaaggcagagc

SEQ ID NO: 8473688 - DNA, 22 bp, Homo sapiens
ttcacaagtcattagctgcata

SEQ ID NO: 8473689 - DNA, 22 bp, Homo sapiens
ttcacaaacttcatgatggcac

SEQ ID NO: 8473690 - DNA, 22 bp, Homo sapiens
ttcacaaacttcatgatggcac

SEQ ID NO: 8473691 - DNA, 22 bp, Homo sapiens
ttcacaaagctggagcatttcc

SEQ ID NO: 8473692 - DNA, 22 bp, Homo sapiens
ttcacaaagctggagcatttcc

SEQ ID NO: 8473693 - DNA, 22 bp, Homo sapiens
ttcacagtgagctatgtcttgt

SEQ ID NO: 8473694 - DNA, 22 bp, Homo sapiens
ttcacagtgccagggggcaggc

SEQ ID NO: 8473695 - DNA, 22 bp, Homo sapiens
ttagataaattaagactttaca

SEQ ID NO: 8473696 - DNA, 23 bp, Homo sapiens
ttcaaagcttaagctctttccac

SEQ ID NO: 8473697 - DNA, 17 bp, Homo sapiens
ttcaaagcttatcaagg

SEQ ID NO: 8473698 - DNA, 22 bp, Homo sapiens
ttagataaaagtgttcaataaa

SEQ ID NO: 8473699 - DNA, 22 bp, Homo sapiens
ttagagtttttgtaagtacaat

SEQ ID NO: 8473700 - DNA, 22 bp, Homo sapiens
ttagagtttttgtaagtacaat

SEQ ID NO: 8473701 - DNA, 22 bp, Homo sapiens
ttagataaagtgatgtaggcta

SEQ ID NO: 8473702 - DNA, 22 bp, Homo sapiens
ttagagttttatcattgcctta

SEQ ID NO: 8473703 - DNA, 21 bp, Homo sapiens
ttagagttgccattatatgta

SEQ ID NO: 8473704 - DNA, 22 bp, Homo sapiens
ttcaacaaaatatatttttcca

SEQ ID NO: 8473705 - DNA, 21 bp, Homo sapiens
ttcaacaaagggaataagttt

SEQ ID NO: 8473706 - DNA, 22 bp, Homo sapiens
ttcaacaaactgttcacgaatg

SEQ ID NO: 8473707 - DNA, 22 bp, Homo sapiens
ttcaacaaggctgtcaaaagtt

SEQ ID NO: 8473708 - DNA, 22 bp, Homo sapiens
ttcaacaaggctgtcaaaagtt

SEQ ID NO: 8473709 - DNA, 22 bp, Homo sapiens
ttcaacaacttggttcaaatgg

SEQ ID NO: 8473710 - DNA, 22 bp, Homo sapiens
ttcaacaagtcttttttcactg

SEQ ID NO: 8473711 - DNA, 22 bp, Homo sapiens
ttcaacaatgaaagctaaggaa

SEQ ID NO: 8473712 - DNA, 22 bp, Homo sapiens
ttcaacatcaagaatgcatgga

SEQ ID NO: 8473713 - DNA, 22 bp, Homo sapiens
ttcaacaattaagtatcagcct

SEQ ID NO: 8473714 - DNA, 22 bp, Homo sapiens
ttcaacaattaagtatcagcct

SEQ ID NO: 8473715 - DNA, 22 bp, Homo sapiens
ttcaactattatgaataaaatt

SEQ ID NO: 8473716 - DNA, 22 bp, Homo sapiens
ttcaactagaggtgattttgcc

SEQ ID NO: 8473717 - DNA, 22 bp, Homo sapiens
ttcaactagatttatacaattc

SEQ ID NO: 8473718 - DNA, 22 bp, Homo sapiens
ttcaactaatgtttattttatg

SEQ ID NO: 8473719 - DNA, 22 bp, Homo sapiens
ttcaacatgttctacataaggg

SEQ ID NO: 8473720 - DNA, 22 bp, Homo sapiens
ttcagtgtatattttttgagta

SEQ ID NO: 8473721 - DNA, 22 bp, Homo sapiens
ttcagtgtacagtgaagggatt

SEQ ID NO: 8473722 - DNA, 22 bp, Homo sapiens
ttcagtgtcacaagagcaagcc

SEQ ID NO: 8473723 - DNA, 22 bp, Homo sapiens
ttcatgctagtatgtgctgttc

SEQ ID NO: 8473724 - DNA, 20 bp, Homo sapiens
ttcatgctggaggggctggc

SEQ ID NO: 8473725 - DNA, 22 bp, Homo sapiens
ttcatgtaacttttcttctcca

SEQ ID NO: 8473726 - DNA, 20 bp, Homo sapiens
ttcatgggagcaaagaggcc

SEQ ID NO: 8473727 - DNA, 20 bp, Homo sapiens
ttcatgggagcaaagaggcc

SEQ ID NO: 8473728 - DNA, 20 bp, Homo sapiens
ttcatgggagcaaagaggcc

SEQ ID NO: 8473729 - DNA, 22 bp, Homo sapiens
ttcatgtatttatcatgtaaat

SEQ ID NO: 8473730 - DNA, 22 bp, Homo sapiens
ttcatgtagtgtaatgtcttca

SEQ ID NO: 8473731 - DNA, 22 bp, Homo sapiens
ttcatgtagcttagcagagagg

SEQ ID NO: 8473732 - DNA, 22 bp, Homo sapiens
ttcatgtaggctgcaatgcaca

SEQ ID NO: 8473733 - DNA, 22 bp, Homo sapiens
ttcatgtaggctgcaatgcaca

SEQ ID NO: 8473734 - DNA, 22 bp, Homo sapiens
ttcatgtaccgtgtaccaggca

SEQ ID NO: 8473735 - DNA, 22 bp, Homo sapiens
ttcatgttcatatgtgtatatc

SEQ ID NO: 8473736 - DNA, 22 bp, Homo sapiens
ttcatgttggattcactgtgag

SEQ ID NO: 8473737 - DNA, 22 bp, Homo sapiens
ttcatgttgtagtatgtatcag

SEQ ID NO: 8473738 - DNA, 22 bp, Homo sapiens
ttcatgtttcatttgttactat

SEQ ID NO: 8473739 - DNA, 22 bp, Homo sapiens
ttcatgtttcctcttgtgctgc

SEQ ID NO: 8473740 - DNA, 22 bp, Homo sapiens
ttccaatttgtggtgagttaat

SEQ ID NO: 8473741 - DNA, 22 bp, Homo sapiens
ttcagtaaaacactgcaatgtc

SEQ ID NO: 8473742 - DNA, 22 bp, Homo sapiens
ttcagtaaggataataaacaga

SEQ ID NO: 8473743 - DNA, 22 bp, Homo sapiens
ttcaggtgtcaaggataggctg

SEQ ID NO: 8473744 - DNA, 22 bp, Homo sapiens
ttcagtatccctgcttggacag

SEQ ID NO: 8473745 - DNA, 21 bp, Homo sapiens
ttcagtatgcgtcatgctgtt

SEQ ID NO: 8473746 - DNA, 22 bp, Homo sapiens
ttcagtatgattcctccagtag

SEQ ID NO: 8473747 - DNA, 22 bp, Homo sapiens
ttcagtatacattatctaattg

SEQ ID NO: 8473748 - DNA, 22 bp, Homo sapiens
ttcagtaaggataataaacaga

SEQ ID NO: 8473749 - DNA, 22 bp, Homo sapiens
ttcagtatacttcataacattt

SEQ ID NO: 8473750 - DNA, 22 bp, Homo sapiens
ttcagtatacttcataacattt

SEQ ID NO: 8473751 - DNA, 22 bp, Homo sapiens
ttcagtcttgttgaaaacttgg

SEQ ID NO: 8473752 - DNA, 22 bp, Homo sapiens
ttcagtctcaagtgctgctcac

SEQ ID NO: 8473753 - DNA, 22 bp, Homo sapiens
ttcagtatttcatgactttctt

SEQ ID NO: 8473754 - DNA, 22 bp, Homo sapiens
ttcacattagccaagagatgga

SEQ ID NO: 8473755 - DNA, 22 bp, Homo sapiens
ttcacattacaaggccatattt

SEQ ID NO: 8473756 - DNA, 22 bp, Homo sapiens
ttcacattagtggttctatata

SEQ ID NO: 8473757 - DNA, 22 bp, Homo sapiens
ttcacattagtggttctatata

SEQ ID NO: 8473758 - DNA, 22 bp, Homo sapiens
ttcacagtggctaagttctgca

SEQ ID NO: 8473759 - DNA, 22 bp, Homo sapiens
ttcacagtggctaagttctgca

SEQ ID NO: 8473760 - DNA, 22 bp, Homo sapiens
ttcacagtggccctctctgagt

SEQ ID NO: 8473761 - DNA, 21 bp, Homo sapiens
ttcacagtggataactttctg

SEQ ID NO: 8473762 - DNA, 22 bp, Homo sapiens
ttcacattatcaggattgtttc

SEQ ID NO: 8473763 - DNA, 22 bp, Homo sapiens
ttcacattccgcggctattttc

SEQ ID NO: 8473764 - DNA, 22 bp, Homo sapiens
ttcacattcagaaaaagcccgt

SEQ ID NO: 8473765 - DNA, 22 bp, Homo sapiens
ttcacattataatcagttctgc

SEQ ID NO: 8473766 - DNA, 22 bp, Homo sapiens
ttcacattataatcagttctgc

SEQ ID NO: 8473767 - DNA, 22 bp, Homo sapiens
ttcacattataatcagttctgc

SEQ ID NO: 8473768 - DNA, 22 bp, Homo sapiens
ttcacattgaaggtgctttctt

SEQ ID NO: 8473769 - DNA, 22 bp, Homo sapiens
ttcacattctcacaagaggaaa

SEQ ID NO: 8473770 - DNA, 22 bp, Homo sapiens
ttcacattccgcggctattttc

SEQ ID NO: 8473771 - DNA, 19 bp, Homo sapiens
ttcacattggaagaagtag

SEQ ID NO: 8473772 - DNA, 22 bp, Homo sapiens
ttcacattgaaggtgctttctt

SEQ ID NO: 8473773 - DNA, 22 bp, Homo sapiens
ttcaggagaaagttcagtactt

SEQ ID NO: 8473774 - DNA, 19 bp, Homo sapiens
ttcacattggaagaagtag

SEQ ID NO: 8473775 - DNA, 22 bp, Homo sapiens
ttgaattataagtgtgtctact

SEQ ID NO: 8473776 - DNA, 22 bp, Homo sapiens
ttgaattataagtgtgtctact

SEQ ID NO: 8473777 - DNA, 22 bp, Homo sapiens
ttgaattataagtgtgtctact

SEQ ID NO: 8473778 - DNA, 22 bp, Homo sapiens
ttgaattataagtgtgtctact

SEQ ID NO: 8473779 - DNA, 22 bp, Homo sapiens
ttgaattagactttgctacagg

SEQ ID NO: 8473780 - DNA, 22 bp, Homo sapiens
ttgaatggcttctaggttctcc

SEQ ID NO: 8473781 - DNA, 22 bp, Homo sapiens
ttgaattagactttgctacagg

SEQ ID NO: 8473782 - DNA, 22 bp, Homo sapiens
ttgaatgcttacaatatgttag

SEQ ID NO: 8473783 - DNA, 22 bp, Homo sapiens
ttgaattatttgtttgcaagct

SEQ ID NO: 8473784 - DNA, 22 bp, Homo sapiens
ttgaattatatgtatgtccttt

SEQ ID NO: 8473785 - DNA, 22 bp, Homo sapiens
ttgagatggagcctcagtcttg

SEQ ID NO: 8473786 - DNA, 22 bp, Homo sapiens
ttgagatggagcttcactcttg

SEQ ID NO: 8473787 - DNA, 22 bp, Homo sapiens
ttgagatggagtctcactctgt

SEQ ID NO: 8473788 - DNA, 22 bp, Homo sapiens
ttgaatgattaaagtcatctga

SEQ ID NO: 8473789 - DNA, 22 bp, Homo sapiens
ttgaatgatcctatctagcaca

SEQ ID NO: 8473790 - DNA, 22 bp, Homo sapiens
ttgaatgaggaagagcactggc

SEQ ID NO: 8473791 - DNA, 22 bp, Homo sapiens
ttgaatgagtgttttactcatg

SEQ ID NO: 8473792 - DNA, 16 bp, Homo sapiens
ttgaatgactgtgtgc

SEQ ID NO: 8473793 - DNA, 22 bp, Homo sapiens
ttgaatgaccatgatgcaaggg

SEQ ID NO: 8473794 - DNA, 22 bp, Homo sapiens
ttgaatgagaagttattgccat

SEQ ID NO: 8473795 - DNA, 22 bp, Homo sapiens
ttgaatgaattctacttccaga

SEQ ID NO: 8473796 - DNA, 22 bp, Homo sapiens
ttgaatgaattctacttccaga

SEQ ID NO: 8473797 - DNA, 22 bp, Homo sapiens
ttgaatgaatttgagcagagat

SEQ ID NO: 8473798 - DNA, 20 bp, Homo sapiens
ttgaatgaatgtctggctca

SEQ ID NO: 8473799 - DNA, 22 bp, Homo sapiens
ttgaatgaatggtccatataga

SEQ ID NO: 8473800 - DNA, 22 bp, Homo sapiens
ttgaatgaatagttgctagaag

SEQ ID NO: 8473801 - DNA, 22 bp, Homo sapiens
ttgaatgaataaaagagtaagg

SEQ ID NO: 8473802 - DNA, 22 bp, Homo sapiens
ttgagatgggctttatgttcag

SEQ ID NO: 8473803 - DNA, 22 bp, Homo sapiens
ttgaggagttaggatgtttata

SEQ ID NO: 8473804 - DNA, 18 bp, Homo sapiens
ttgaggagttcactgtct

SEQ ID NO: 8473805 - DNA, 22 bp, Homo sapiens
ttgaggagttgtgacagatact

SEQ ID NO: 8473806 - DNA, 22 bp, Homo sapiens
ttgaggcaaaatcaacgggaag

SEQ ID NO: 8473807 - DNA, 22 bp, Homo sapiens
ttgaggcaaaatcaacgggaag

SEQ ID NO: 8473808 - DNA, 23 bp, Homo sapiens
ttgaggcaaactcttttctgaaa

SEQ ID NO: 8473809 - DNA, 23 bp, Homo sapiens
ttgaggcaaacatgtaagtagga

SEQ ID NO: 8473810 - DNA, 22 bp, Homo sapiens
ttgaggcacagattttagtggc

SEQ ID NO: 8473811 - DNA, 22 bp, Homo sapiens
ttgaggcacacacaggttgcat

SEQ ID NO: 8473812 - DNA, 23 bp, Homo sapiens
ttgagctcagtagctctgctggt

SEQ ID NO: 8473813 - DNA, 22 bp, Homo sapiens
ttgagccctacctcagactttc

SEQ ID NO: 8473814 - DNA, 22 bp, Homo sapiens
ttgaggagtgtttagggtgagg

SEQ ID NO: 8473815 - DNA, 22 bp, Homo sapiens
ttgaggagtgtgaggtctccca

SEQ ID NO: 8473816 - DNA, 22 bp, Homo sapiens
ttgagcccaggaggcctgggtg

SEQ ID NO: 8473817 - DNA, 22 bp, Homo sapiens
ttgagcccaggaggcctgggtg

SEQ ID NO: 8473818 - DNA, 22 bp, Homo sapiens
ttgagcccaggaggcctgggtg

SEQ ID NO: 8473819 - DNA, 22 bp, Homo sapiens
ttgaagattattctattaaaag

SEQ ID NO: 8473820 - DNA, 22 bp, Homo sapiens
ttgaagagtctagattggttat

SEQ ID NO: 8473821 - DNA, 22 bp, Homo sapiens
ttgaagagtctttctttccccc

SEQ ID NO: 8473822 - DNA, 22 bp, Homo sapiens
ttgaagagtgccttccagacat

SEQ ID NO: 8473823 - DNA, 22 bp, Homo sapiens
ttgaagagtgcattagcatatt

SEQ ID NO: 8473824 - DNA, 22 bp, Homo sapiens
ttgaagagtgtccttgtaaaaa

SEQ ID NO: 8473825 - DNA, 22 bp, Homo sapiens
ttgaagagttttatgccaacct

SEQ ID NO: 8473826 - DNA, 22 bp, Homo sapiens
ttgaagagtttgatagagttga

SEQ ID NO: 8473827 - DNA, 22 bp, Homo sapiens
ttgaagagtttgatagagttga

SEQ ID NO: 8473828 - DNA, 22 bp, Homo sapiens
ttgaagagtcgcttaacctgtg

SEQ ID NO: 8473829 - DNA, 22 bp, Homo sapiens
ttgaagagtagaaaatgcaaat

SEQ ID NO: 8473830 - DNA, 20 bp, Homo sapiens
ttgaagagtcaggtagggcc

SEQ ID NO: 8473831 - DNA, 22 bp, Homo sapiens
ttgaagagtaaagtgttttctc

SEQ ID NO: 8473832 - DNA, 20 bp, Homo sapiens
ttgaagaggatatatcgctc

SEQ ID NO: 8473833 - DNA, 22 bp, Homo sapiens
ttgaagaggactttgcagctgt

SEQ ID NO: 8473834 - DNA, 22 bp, Homo sapiens
ttgaagagacaatttggaaagc

SEQ ID NO: 8473835 - DNA, 22 bp, Homo sapiens
ttgaagagaatcagaaggttga

SEQ ID NO: 8473836 - DNA, 22 bp, Homo sapiens
ttgaagagaatcagaaggttga

SEQ ID NO: 8473837 - DNA, 22 bp, Homo sapiens
ttgaagagacgatttttccacc

SEQ ID NO: 8473838 - DNA, 22 bp, Homo sapiens
ttgaagagctgcttgataccct

SEQ ID NO: 8473839 - DNA, 22 bp, Homo sapiens
ttgaagagcaccagcattttga

SEQ ID NO: 8473840 - DNA, 22 bp, Homo sapiens
ttctttccttgcctcagtgaag

SEQ ID NO: 8473841 - DNA, 22 bp, Homo sapiens
ttctttcctcccagcctttgga

SEQ ID NO: 8473842 - DNA, 22 bp, Homo sapiens
ttctttccttgcctcagtgaag

SEQ ID NO: 8473843 - DNA, 22 bp, Homo sapiens
ttctttccccatggagttcgga

SEQ ID NO: 8473844 - DNA, 22 bp, Homo sapiens
ttctttcccagtagatgtgaaa

SEQ ID NO: 8473845 - DNA, 22 bp, Homo sapiens
ttctttctcaacatgaatgttt

SEQ ID NO: 8473846 - DNA, 22 bp, Homo sapiens
ttgaagagaaccgcggcttatt

SEQ ID NO: 8473847 - DNA, 22 bp, Homo sapiens
ttctttatgcttctgtttaggc

SEQ ID NO: 8473848 - DNA, 22 bp, Homo sapiens
ttctttatggaatggtgatagt

SEQ ID NO: 8473849 - DNA, 22 bp, Homo sapiens
ttctttatggaatggtgatagt

SEQ ID NO: 8473850 - DNA, 22 bp, Homo sapiens
ttctttatcagttactcatagg

SEQ ID NO: 8473851 - DNA, 22 bp, Homo sapiens
ttctttatcctatttgtaggtg

SEQ ID NO: 8473852 - DNA, 22 bp, Homo sapiens
ttctttattgagacttcattgt

SEQ ID NO: 8473853 - DNA, 22 bp, Homo sapiens
ttctttattagtttagtgagct

SEQ ID NO: 8473854 - DNA, 22 bp, Homo sapiens
ttctttatgttaatgaatctat

SEQ ID NO: 8473855 - DNA, 22 bp, Homo sapiens
ttctttatgttaatgaatctat

SEQ ID NO: 8473856 - DNA, 22 bp, Homo sapiens
ttctttattgagacttcattgt

SEQ ID NO: 8473857 - DNA, 19 bp, Homo sapiens
ttctttccacatcttctct

SEQ ID NO: 8473858 - DNA, 22 bp, Homo sapiens
ttgatttcttactcttccaagg

SEQ ID NO: 8473859 - DNA, 22 bp, Homo sapiens
ttgatttcaaaatatatgcttg

SEQ ID NO: 8473860 - DNA, 22 bp, Homo sapiens
ttgatttatagaatgttcaagc

SEQ ID NO: 8473861 - DNA, 22 bp, Homo sapiens
ttgatttatagaatgttcaagc

SEQ ID NO: 8473862 - DNA, 22 bp, Homo sapiens
ttgatttatagaatgttcaagc

SEQ ID NO: 8473863 - DNA, 23 bp, Homo sapiens
ttgatttagctgggattgcatgc

SEQ ID NO: 8473864 - DNA, 22 bp, Homo sapiens
ttgattgaattttgaaaatcta

SEQ ID NO: 8473865 - DNA, 22 bp, Homo sapiens
ttgcaaagttccctacacatgt

SEQ ID NO: 8473866 - DNA, 22 bp, Homo sapiens
ttgcaaagagataatcctaggc

SEQ ID NO: 8473867 - DNA, 22 bp, Homo sapiens
ttgcaaatattgtttacctttc

SEQ ID NO: 8473868 - DNA, 22 bp, Homo sapiens
ttgcaaatattgtttacctttc

SEQ ID NO: 8473869 - DNA, 22 bp, Homo sapiens
ttgcaaatcacaagagcagagc

SEQ ID NO: 8473870 - DNA, 22 bp, Homo sapiens
ttgcaaatctttgccagaaggc

SEQ ID NO: 8473871 - DNA, 22 bp, Homo sapiens
ttgcaaatctttgccagaaggc

SEQ ID NO: 8473872 - DNA, 22 bp, Homo sapiens
ttgcaaatcagaagtatagatt

SEQ ID NO: 8473873 - DNA, 22 bp, Homo sapiens
ttgcaaataaacaagtatacat

SEQ ID NO: 8473874 - DNA, 22 bp, Homo sapiens
ttgcaaataatagcctgaaact

SEQ ID NO: 8473875 - DNA, 20 bp, Homo sapiens
ttgcaaatatctattgattg

SEQ ID NO: 8473876 - DNA, 22 bp, Homo sapiens
ttgcaaatgtgaataattacac

SEQ ID NO: 8473877 - DNA, 22 bp, Homo sapiens
ttgcaaatgtgaataattacac

SEQ ID NO: 8473878 - DNA, 22 bp, Homo sapiens
ttgcaaatgaccattgccacat

SEQ ID NO: 8473879 - DNA, 22 bp, Homo sapiens
ttgcaaatgaccattgccacat

SEQ ID NO: 8473880 - DNA, 22 bp, Homo sapiens
ttgcaaatggtaccaagggtct

SEQ ID NO: 8473881 - DNA, 22 bp, Homo sapiens
ttgcaaattaaagaggatagca

SEQ ID NO: 8473882 - DNA, 22 bp, Homo sapiens
ttgcaaattatataagggatgc

SEQ ID NO: 8473883 - DNA, 22 bp, Homo sapiens
ttgcaaatgttatactgccagt

SEQ ID NO: 8473884 - DNA, 22 bp, Homo sapiens
ttgcaaatgtgagtttagactg

SEQ ID NO: 8473885 - DNA, 22 bp, Homo sapiens
ttgcaaatgtggttagggcttt

SEQ ID NO: 8473886 - DNA, 22 bp, Homo sapiens
ttgattactatgtgttgaaagc

SEQ ID NO: 8473887 - DNA, 22 bp, Homo sapiens
ttgattcaaccacttaataatc

SEQ ID NO: 8473888 - DNA, 20 bp, Homo sapiens
ttgattcaagggctgatgga

SEQ ID NO: 8473889 - DNA, 22 bp, Homo sapiens
ttgattcaaaacaggaggtagg

SEQ ID NO: 8473890 - DNA, 22 bp, Homo sapiens
ttgattcaaaggggacaagtgg

SEQ ID NO: 8473891 - DNA, 22 bp, Homo sapiens
ttgatgtacagaattgttcaca

SEQ ID NO: 8473892 - DNA, 22 bp, Homo sapiens
ttgattcatttattgagtgcct

SEQ ID NO: 8473893 - DNA, 22 bp, Homo sapiens
ttgattcatggacaggccaggt

SEQ ID NO: 8473894 - DNA, 22 bp, Homo sapiens
ttgattcatcttctaataccca

SEQ ID NO: 8473895 - DNA, 22 bp, Homo sapiens
ttgattctacttaaaacatatg

SEQ ID NO: 8473896 - DNA, 18 bp, Homo sapiens
ttgattcatattaaccat

SEQ ID NO: 8473897 - DNA, 22 bp, Homo sapiens
ttgattcatatagatatgcgtg

SEQ ID NO: 8473898 - DNA, 22 bp, Homo sapiens
ttgattcagtaaagctaaattt

SEQ ID NO: 8473899 - DNA, 22 bp, Homo sapiens
ttgattcagagaagattggccc

SEQ ID NO: 8473900 - DNA, 22 bp, Homo sapiens
ttgattcagaaaaagatggaga

SEQ ID NO: 8473901 - DNA, 22 bp, Homo sapiens
ttgattcacaattaccaagact

SEQ ID NO: 8473902 - DNA, 22 bp, Homo sapiens
ttgagtcttcagtaaaagggta

SEQ ID NO: 8473903 - DNA, 22 bp, Homo sapiens
ttgagtctgcccaaattaagaa

SEQ ID NO: 8473904 - DNA, 17 bp, Homo sapiens
ttgagtctggggtctac

SEQ ID NO: 8473905 - DNA, 22 bp, Homo sapiens
ttgagtctgcaatacataacac

SEQ ID NO: 8473906 - DNA, 22 bp, Homo sapiens
ttgagtctgtgccctatgctgt

SEQ ID NO: 8473907 - DNA, 23 bp, Homo sapiens
ttgagtcttataggattgaggtg

SEQ ID NO: 8473908 - DNA, 20 bp, Homo sapiens
ttgaggcatgtctagaagta

SEQ ID NO: 8473909 - DNA, 22 bp, Homo sapiens
ttgaggcattactgtaatgaga

SEQ ID NO: 8473910 - DNA, 22 bp, Homo sapiens
ttgaggcattactgtaatgaga

SEQ ID NO: 8473911 - DNA, 22 bp, Homo sapiens
ttgagtctctgccaaaacacaa

SEQ ID NO: 8473912 - DNA, 22 bp, Homo sapiens
ttgaggcaggtccgggtccttc

SEQ ID NO: 8473913 - DNA, 22 bp, Homo sapiens
ttgaggcagcccttaattggga

SEQ ID NO: 8473914 - DNA, 22 bp, Homo sapiens
ttgaggcagggcatggtggccc

SEQ ID NO: 8473915 - DNA, 22 bp, Homo sapiens
ttgatctctgttgctgtctttg

SEQ ID NO: 8473916 - DNA, 22 bp, Homo sapiens
ttgatgtaaagtgattcatggg

SEQ ID NO: 8473917 - DNA, 22 bp, Homo sapiens
ttctgttacaagtgaaaaaatg

SEQ ID NO: 8473918 - DNA, 22 bp, Homo sapiens
ttctgttacatggggcacagtg

SEQ ID NO: 8473919 - DNA, 22 bp, Homo sapiens
ttctgttacctttgtgagtttc

SEQ ID NO: 8473920 - DNA, 22 bp, Homo sapiens
ttctggttacattgttacagct

SEQ ID NO: 8473921 - DNA, 22 bp, Homo sapiens
ttctggttacattgttacagct

SEQ ID NO: 8473922 - DNA, 22 bp, Homo sapiens
ttctgttagaattttgaaaata

SEQ ID NO: 8473923 - DNA, 22 bp, Homo sapiens
ttctgttactgttggtcataac

SEQ ID NO: 8473924 - DNA, 22 bp, Homo sapiens
ttctgtttactcagaaatacaa

SEQ ID NO: 8473925 - DNA, 22 bp, Homo sapiens
ttcttacaagtattccaggtcc

SEQ ID NO: 8473926 - DNA, 22 bp, Homo sapiens
ttctgttttgcacagacttgaa

SEQ ID NO: 8473927 - DNA, 22 bp, Homo sapiens
ttctgttttgcacagacttgaa

SEQ ID NO: 8473928 - DNA, 22 bp, Homo sapiens
ttctgttttagaaataagtagt

SEQ ID NO: 8473929 - DNA, 22 bp, Homo sapiens
ttctgtttgccatatatagtag

SEQ ID NO: 8473930 - DNA, 22 bp, Homo sapiens
ttctgtttgccatatatagtag

SEQ ID NO: 8473931 - DNA, 22 bp, Homo sapiens
ttctgtttgccatatatagtag

SEQ ID NO: 8473932 - DNA, 22 bp, Homo sapiens
ttctgtttctggggtctctgac

SEQ ID NO: 8473933 - DNA, 19 bp, Homo sapiens
ttctggtctggaatcaagg

SEQ ID NO: 8473934 - DNA, 19 bp, Homo sapiens
ttctggtctggaatcaagg

SEQ ID NO: 8473935 - DNA, 22 bp, Homo sapiens
ttctgggctaccttcccggcag

SEQ ID NO: 8473936 - DNA, 22 bp, Homo sapiens
ttctgggcctcctaggacaggc

SEQ ID NO: 8473937 - DNA, 22 bp, Homo sapiens
ttctgggcctcctaggacaggc

SEQ ID NO: 8473938 - DNA, 22 bp, Homo sapiens
ttctgggctcacagagcagcag

SEQ ID NO: 8473939 - DNA, 22 bp, Homo sapiens
ttctgggctaccttcccggcag

SEQ ID NO: 8473940 - DNA, 22 bp, Homo sapiens
ttctgggcctcctaggacaggc

SEQ ID NO: 8473941 - DNA, 21 bp, Homo sapiens
ttctgggccggagaaggggcg

SEQ ID NO: 8473942 - DNA, 21 bp, Homo sapiens
ttctgggccggagaaggggcg

SEQ ID NO: 8473943 - DNA, 21 bp, Homo sapiens
ttctgggccggagaaggggcg

SEQ ID NO: 8473944 - DNA, 22 bp, Homo sapiens
ttctgggcccactgtagcatcc

SEQ ID NO: 8473945 - DNA, 22 bp, Homo sapiens
ttctgggcccactgtagcatcc

SEQ ID NO: 8473946 - DNA, 22 bp, Homo sapiens
ttctgggcccaaccctagagtg

SEQ ID NO: 8473947 - DNA, 22 bp, Homo sapiens
ttctgggcccaaccctagagtg

SEQ ID NO: 8473948 - DNA, 21 bp, Homo sapiens
ttctgggccatgctgcttctc

SEQ ID NO: 8473949 - DNA, 19 bp, Homo sapiens
ttctgggcattcatattta

SEQ ID NO: 8473950 - DNA, 22 bp, Homo sapiens
ttctgggccaatctcttaatct

SEQ ID NO: 8473951 - DNA, 21 bp, Homo sapiens
ttctgggccatgctgcttctc

SEQ ID NO: 8473952 - DNA, 21 bp, Homo sapiens
ttctgggccatgctgcttctc

SEQ ID NO: 8473953 - DNA, 22 bp, Homo sapiens
ttctgggcttggctgtttccat

SEQ ID NO: 8473954 - DNA, 22 bp, Homo sapiens
ttctgggcttgaaagtttaata

SEQ ID NO: 8473955 - DNA, 23 bp, Homo sapiens
ttctgggctgtggaagcctcggg

SEQ ID NO: 8473956 - DNA, 22 bp, Homo sapiens
ttctgggcttgaaagtttaata

SEQ ID NO: 8473957 - DNA, 22 bp, Homo sapiens
ttctgggcttggctgtttccat

SEQ ID NO: 8473958 - DNA, 22 bp, Homo sapiens
ttctgggctgtccagagggtga

SEQ ID NO: 8473959 - DNA, 22 bp, Homo sapiens
ttctgggctcacagagcagcag

SEQ ID NO: 8473960 - DNA, 22 bp, Homo sapiens
ttctgggctctctttctgtgtg

SEQ ID NO: 8473961 - DNA, 22 bp, Homo sapiens
ttctgggctgtccagagggtga

SEQ ID NO: 8473962 - DNA, 23 bp, Homo sapiens
ttctgggctgtggaagcctcggg

SEQ ID NO: 8473963 - DNA, 22 bp, Homo sapiens
ttctgggctcccacatatttca

SEQ ID NO: 8473964 - DNA, 22 bp, Homo sapiens
ttctgggctcccacatatttca

SEQ ID NO: 8473965 - DNA, 22 bp, Homo sapiens
ttctgggctctctttctgtgtg

SEQ ID NO: 8473966 - DNA, 23 bp, Homo sapiens
ttctttataaatcaatgggatgt

SEQ ID NO: 8473967 - DNA, 22 bp, Homo sapiens
ttctttaggtagatccagtttt

SEQ ID NO: 8473968 - DNA, 22 bp, Homo sapiens
ttctttatagctattggatgag

SEQ ID NO: 8473969 - DNA, 22 bp, Homo sapiens
ttctttatatctgctagtgggt

SEQ ID NO: 8473970 - DNA, 18 bp, Homo sapiens
ttctttaattcagtttga

SEQ ID NO: 8473971 - DNA, 18 bp, Homo sapiens
ttctttaattcagtttga

SEQ ID NO: 8473972 - DNA, 18 bp, Homo sapiens
ttctttaattcagtttga

SEQ ID NO: 8473973 - DNA, 22 bp, Homo sapiens
ttctttaaatgaattctctgta

SEQ ID NO: 8473974 - DNA, 18 bp, Homo sapiens
ttctttaattcagtttga

SEQ ID NO: 8473975 - DNA, 22 bp, Homo sapiens
ttctttaaaatagtgagaaaga

SEQ ID NO: 8473976 - DNA, 22 bp, Homo sapiens
ttctttaaaatagtgagaaaga

SEQ ID NO: 8473977 - DNA, 22 bp, Homo sapiens
ttctttaaatgaattctctgta

SEQ ID NO: 8473978 - DNA, 22 bp, Homo sapiens
ttctttaaaatagtgagaaaga

SEQ ID NO: 8473979 - DNA, 22 bp, Homo sapiens
ttcttacagagtttacagagcc

SEQ ID NO: 8473980 - DNA, 22 bp, Homo sapiens
ttcttacagatttggtgaatga

SEQ ID NO: 8473981 - DNA, 22 bp, Homo sapiens
ttcttacagccctattactaaa

SEQ ID NO: 8473982 - DNA, 22 bp, Homo sapiens
ttcttacagccctattactaaa

SEQ ID NO: 8473983 - DNA, 22 bp, Homo sapiens
ttcttacatattttcatatggt

SEQ ID NO: 8473984 - DNA, 22 bp, Homo sapiens
ttcttacattactttacatgtg

SEQ ID NO: 8473985 - DNA, 22 bp, Homo sapiens
ttcttgaaggggatataaatag

SEQ ID NO: 8473986 - DNA, 22 bp, Homo sapiens
ttcttgaatcactttagagata

SEQ ID NO: 8473987 - DNA, 22 bp, Homo sapiens
ttcttctttcctataattaatt

SEQ ID NO: 8473988 - DNA, 22 bp, Homo sapiens
ttcttctttcctataattaatt

SEQ ID NO: 8473989 - DNA, 22 bp, Homo sapiens
ttcttctttccaattacatggt

SEQ ID NO: 8473990 - DNA, 22 bp, Homo sapiens
ttctgagagtgccagaagttct

SEQ ID NO: 8473991 - DNA, 22 bp, Homo sapiens
ttctgagagtgccagaagttct

SEQ ID NO: 8473992 - DNA, 20 bp, Homo sapiens
ttctgagagttcacagcccc

SEQ ID NO: 8473993 - DNA, 22 bp, Homo sapiens
ttctgagatacaaaatttactt

SEQ ID NO: 8473994 - DNA, 22 bp, Homo sapiens
ttctgagatgtgaatctgtcaa

SEQ ID NO: 8473995 - DNA, 22 bp, Homo sapiens
ttctgagatgaggaggaaaaag

SEQ ID NO: 8473996 - DNA, 22 bp, Homo sapiens
ttctgagatgcgttagaaattt

SEQ ID NO: 8473997 - DNA, 22 bp, Homo sapiens
ttctgagagagcctctcatgtt

SEQ ID NO: 8473998 - DNA, 22 bp, Homo sapiens
ttctgagagagcctctcatgtt

SEQ ID NO: 8473999 - DNA, 22 bp, Homo sapiens
ttctgagagctgaagaaatgtt

SEQ ID NO: 8474000 - DNA, 22 bp, Homo sapiens
ttctgaatggcaagcattaggc

SEQ ID NO: 8474001 - DNA, 22 bp, Homo sapiens
ttctgaattcatgagatttggg

SEQ ID NO: 8474002 - DNA, 22 bp, Homo sapiens
ttctgacacattactacatgga

SEQ ID NO: 8474003 - DNA, 22 bp, Homo sapiens
ttctgacaattcagtaacagca

SEQ ID NO: 8474004 - DNA, 22 bp, Homo sapiens
ttctgagaatgcttctggaatc

SEQ ID NO: 8474005 - DNA, 22 bp, Homo sapiens
ttctgacatatccagtctcagt

SEQ ID NO: 8474006 - DNA, 22 bp, Homo sapiens
ttctgacagcaaaactcagcct

SEQ ID NO: 8474007 - DNA, 22 bp, Homo sapiens
ttctagttcccacatagttgcc

SEQ ID NO: 8474008 - DNA, 20 bp, Homo sapiens
ttctagtttggagttattaa

SEQ ID NO: 8474009 - DNA, 22 bp, Homo sapiens
ttctagtttccattttaagaca

SEQ ID NO: 8474010 - DNA, 20 bp, Homo sapiens
ttctagtttggagttattaa

SEQ ID NO: 8474011 - DNA, 22 bp, Homo sapiens
ttctagttaaagtatgtattag

SEQ ID NO: 8474012 - DNA, 22 bp, Homo sapiens
ttctataatgcaagccactgca

SEQ ID NO: 8474013 - DNA, 22 bp, Homo sapiens
ttctgaaggtcagcagcttggt

SEQ ID NO: 8474014 - DNA, 22 bp, Homo sapiens
ttctgaatcctcgaaacatagc

SEQ ID NO: 8474015 - DNA, 19 bp, Homo sapiens
ttctgctgttcctaggctg

SEQ ID NO: 8474016 - DNA, 22 bp, Homo sapiens
ttctgcttagagggcatttgca

SEQ ID NO: 8474017 - DNA, 22 bp, Homo sapiens
ttctgcttattcaaatgatctt

SEQ ID NO: 8474018 - DNA, 20 bp, Homo sapiens
ttctgcttgcaaatatcaag

SEQ ID NO: 8474019 - DNA, 22 bp, Homo sapiens
ttctgctttcagttcttctggg

SEQ ID NO: 8474020 - DNA, 22 bp, Homo sapiens
ttctgcttttagctaaactata

SEQ ID NO: 8474021 - DNA, 22 bp, Homo sapiens
ttctgggcaggactggggaccc

SEQ ID NO: 8474022 - DNA, 22 bp, Homo sapiens
ttctgggcaggactggggaccc

SEQ ID NO: 8474023 - DNA, 20 bp, Homo sapiens
ttctgggcagccatgtactt

SEQ ID NO: 8474024 - DNA, 20 bp, Homo sapiens
ttctgggcagccatgtactt

SEQ ID NO: 8474025 - DNA, 22 bp, Homo sapiens
ttctgggcagagctggagctgc

SEQ ID NO: 8474026 - DNA, 19 bp, Homo sapiens
ttctgggcagcacatgaat

SEQ ID NO: 8474027 - DNA, 19 bp, Homo sapiens
ttctgggcagcacatgaat

SEQ ID NO: 8474028 - DNA, 22 bp, Homo sapiens
ttctgggcagagctggagctgc

SEQ ID NO: 8474029 - DNA, 22 bp, Homo sapiens
ttctgggcagttggaaatttca

SEQ ID NO: 8474030 - DNA, 22 bp, Homo sapiens
ttctgggcatgttacattctgt

SEQ ID NO: 8474031 - DNA, 22 bp, Homo sapiens
ttctgggcatgttacattctgt

SEQ ID NO: 8474032 - DNA, 22 bp, Homo sapiens
ttctgggcaggactggggaccc

SEQ ID NO: 8474033 - DNA, 22 bp, Homo sapiens
ttctgggcagttggaaatttca

SEQ ID NO: 8474034 - DNA, 22 bp, Homo sapiens
ttctgggccaatctcttaatct

SEQ ID NO: 8474035 - DNA, 19 bp, Homo sapiens
ttctgggcattcatattta

SEQ ID NO: 8474036 - DNA, 22 bp, Homo sapiens
ttctggaaaagaaagttaagat

SEQ ID NO: 8474037 - DNA, 22 bp, Homo sapiens
ttctgggcaccaccacagactt

SEQ ID NO: 8474038 - DNA, 22 bp, Homo sapiens
ttctgggcaccaccacagactt

SEQ ID NO: 8474039 - DNA, 22 bp, Homo sapiens
ttctggaaagcatttgaggccc

SEQ ID NO: 8474040 - DNA, 21 bp, Homo sapiens
ttctgctgttcaccaccaccc

SEQ ID NO: 8474041 - DNA, 22 bp, Homo sapiens
ttctgctggtaactatgtttca

SEQ ID NO: 8474042 - DNA, 22 bp, Homo sapiens
ttctgctgcgacccaggagtta

SEQ ID NO: 8474043 - DNA, 22 bp, Homo sapiens
ttctgctccaccacttccagca

SEQ ID NO: 8474044 - DNA, 22 bp, Homo sapiens
ttctgctgagtgggcaggtgca

SEQ ID NO: 8474045 - DNA, 22 bp, Homo sapiens
ttctgctgaaaacagccatgta

SEQ ID NO: 8474046 - DNA, 22 bp, Homo sapiens
ttggtcagctcaatggagaggg

SEQ ID NO: 8474047 - DNA, 22 bp, Homo sapiens
ttggtgaacacatacacatttt

SEQ ID NO: 8474048 - DNA, 22 bp, Homo sapiens
ttggtgaattgagaccatttgt

SEQ ID NO: 8474049 - DNA, 22 bp, Homo sapiens
ttggtgtacatctccccttcat

SEQ ID NO: 8474050 - DNA, 22 bp, Homo sapiens
ttggtgttgaacaaaactaaat

SEQ ID NO: 8474051 - DNA, 22 bp, Homo sapiens
ttggttacaagtttgctctgcc

SEQ ID NO: 8474052 - DNA, 22 bp, Homo sapiens
ttgcaacatctgaacatttatc

SEQ ID NO: 8474053 - DNA, 22 bp, Homo sapiens
ttgcaacacaaagtttgattcc

SEQ ID NO: 8474054 - DNA, 22 bp, Homo sapiens
ttgcaacaggtgtgttttggtg

SEQ ID NO: 8474055 - DNA, 22 bp, Homo sapiens
ttgcaacacaaagtttgattcc

SEQ ID NO: 8474056 - DNA, 22 bp, Homo sapiens
ttgcaacattgtaagtttatat

SEQ ID NO: 8474057 - DNA, 22 bp, Homo sapiens
ttgcaacattgtaagtttatat

SEQ ID NO: 8474058 - DNA, 22 bp, Homo sapiens
ttgcaacattgtaagtttatat

SEQ ID NO: 8474059 - DNA, 21 bp, Homo sapiens
ttgcaacaacctatatatttt

SEQ ID NO: 8474060 - DNA, 23 bp, Homo sapiens
ttgcaaatttcagttagttcatg

SEQ ID NO: 8474061 - DNA, 23 bp, Homo sapiens
ttgcaaatttcagttagttcatg

SEQ ID NO: 8474062 - DNA, 22 bp, Homo sapiens
ttgcaaattgcaagagttggat

SEQ ID NO: 8474063 - DNA, 22 bp, Homo sapiens
ttgcaaattccaatccaatatt

SEQ ID NO: 8474064 - DNA, 22 bp, Homo sapiens
ttgcaaattcatggatctgaat

SEQ ID NO: 8474065 - DNA, 22 bp, Homo sapiens
ttgcaaattattttagtccctt

SEQ ID NO: 8474066 - DNA, 22 bp, Homo sapiens
ttgcaagttccttatgagaatc

SEQ ID NO: 8474067 - DNA, 22 bp, Homo sapiens
ttgcaaggtttctctctgccta

SEQ ID NO: 8474068 - DNA, 22 bp, Homo sapiens
ttgcaaggtgataaaagaatga

SEQ ID NO: 8474069 - DNA, 22 bp, Homo sapiens
ttgcaatctgcaaagctgtgga

SEQ ID NO: 8474070 - DNA, 22 bp, Homo sapiens
ttgcaattaacatatgtcaact

SEQ ID NO: 8474071 - DNA, 22 bp, Homo sapiens
ttgcaaggagccactctgcctg

SEQ ID NO: 8474072 - DNA, 22 bp, Homo sapiens
ttgtctgtaaagacggccacca

SEQ ID NO: 8474073 - DNA, 22 bp, Homo sapiens
ttgtgaatagtgccgctataaa

SEQ ID NO: 8474074 - DNA, 22 bp, Homo sapiens
ttgtgaatagtgctgcaataaa

SEQ ID NO: 8474075 - DNA, 22 bp, Homo sapiens
ttgtgaatagtgccgcaataaa

SEQ ID NO: 8474076 - DNA, 22 bp, Homo sapiens
ttggtttaggaactggcttgga

SEQ ID NO: 8474077 - DNA, 22 bp, Homo sapiens
ttggtttagcaacttcctgtgt

SEQ ID NO: 8474078 - DNA, 22 bp, Homo sapiens
ttggtttactaggattcaaatt

SEQ ID NO: 8474079 - DNA, 22 bp, Homo sapiens
ttggtttactctggggatatct

SEQ ID NO: 8474080 - DNA, 22 bp, Homo sapiens
ttggtttatttcttcctatgag

SEQ ID NO: 8474081 - DNA, 22 bp, Homo sapiens
ttggtttagagagtgtggttac

SEQ ID NO: 8474082 - DNA, 22 bp, Homo sapiens
ttggtttatctgtggatctctt

SEQ ID NO: 8474083 - DNA, 22 bp, Homo sapiens
ttggtttagtacctgccagcgt

SEQ ID NO: 8474084 - DNA, 20 bp, Homo sapiens
ttggttgagccagggcctgg

SEQ ID NO: 8474085 - DNA, 23 bp, Homo sapiens
ttggtttacaggaataagcaggg

SEQ ID NO: 8474086 - DNA, 22 bp, Homo sapiens
ttggtttaccagagggaacgtg

SEQ ID NO: 8474087 - DNA, 23 bp, Homo sapiens
ttgtaaaacagtgtgacggttcc

SEQ ID NO: 8474088 - DNA, 22 bp, Homo sapiens
ttggttttgggatgtacaaagg

SEQ ID NO: 8474089 - DNA, 22 bp, Homo sapiens
ttgtctaatgagctccacttca

SEQ ID NO: 8474090 - DNA, 22 bp, Homo sapiens
ttgtcgggcttacgcagggcca

SEQ ID NO: 8474091 - DNA, 22 bp, Homo sapiens
ttgtttccattgcagactgtgt

SEQ ID NO: 8474092 - DNA, 20 bp, Homo sapiens
ttgttagaggaatgccatag

SEQ ID NO: 8474093 - DNA, 22 bp, Homo sapiens
ttgttacttgcatgtagactaa

SEQ ID NO: 8474094 - DNA, 22 bp, Homo sapiens
ttgttactgttctacatacagt

SEQ ID NO: 8474095 - DNA, 22 bp, Homo sapiens
ttgttactaagcctttaaatag

SEQ ID NO: 8474096 - DNA, 19 bp, Homo sapiens
ttgtgactggctctgcata

SEQ ID NO: 8474097 - DNA, 22 bp, Homo sapiens
ttgtgaatggtgccgcaataaa

SEQ ID NO: 8474098 - DNA, 22 bp, Homo sapiens
ttgtgacacatgccgtcctgag

SEQ ID NO: 8474099 - DNA, 22 bp, Homo sapiens
ttgtgtttctggccaagatgga

SEQ ID NO: 8474100 - DNA, 21 bp, Homo sapiens
ttgtgtttccccagtcacttt

SEQ ID NO: 8474101 - DNA, 22 bp, Homo sapiens
ttgtgttaaggtgcatctagtg

SEQ ID NO: 8474102 - DNA, 22 bp, Homo sapiens
ttgtttctggaaaaggcgagaa

SEQ ID NO: 8474103 - DNA, 22 bp, Homo sapiens
ttgtttctctggtcttgagtga

SEQ ID NO: 8474104 - DNA, 22 bp, Homo sapiens
ttgtttctgagttttcatgtat

SEQ ID NO: 8474105 - DNA, 22 bp, Homo sapiens
ttgtttctccagtctaggaaaa

SEQ ID NO: 8474106 - DNA, 22 bp, Homo sapiens
ttgtttcttcatttagaagctt

SEQ ID NO: 8474107 - DNA, 22 bp, Homo sapiens
ttgtttctttgaagtttctaga

SEQ ID NO: 8474108 - DNA, 20 bp, Homo sapiens
ttgttttaaatcctggatga

SEQ ID NO: 8474109 - DNA, 22 bp, Homo sapiens
ttgttttcctgggataccaacc

SEQ ID NO: 8474110 - DNA, 22 bp, Homo sapiens
tttagttctcccagtcttgatt

SEQ ID NO: 8474111 - DNA, 22 bp, Homo sapiens
tttagttttaactgaaagctat

SEQ ID NO: 8474112 - DNA, 22 bp, Homo sapiens
tttataaaatagactgggtcta

SEQ ID NO: 8474113 - DNA, 22 bp, Homo sapiens
tttataaaatagactgggtcta

SEQ ID NO: 8474114 - DNA, 22 bp, Homo sapiens
tttataaacagtaccacggtgc

SEQ ID NO: 8474115 - DNA, 22 bp, Homo sapiens
tttataaccaagttctgcttgt

SEQ ID NO: 8474116 - DNA, 22 bp, Homo sapiens
tttatacatggagaatttttgc

SEQ ID NO: 8474117 - DNA, 22 bp, Homo sapiens
tttatacttcataatgtctatt

SEQ ID NO: 8474118 - DNA, 22 bp, Homo sapiens
tttatacatggagaatttttgc

SEQ ID NO: 8474119 - DNA, 23 bp, Homo sapiens
tttatacaagaaaccgctggcct

SEQ ID NO: 8474120 - DNA, 17 bp, Homo sapiens
tttataattggcctctt

SEQ ID NO: 8474121 - DNA, 22 bp, Homo sapiens
tttatagttatatacagatgtt

SEQ ID NO: 8474122 - DNA, 22 bp, Homo sapiens
tttatataacagagactgctat

SEQ ID NO: 8474123 - DNA, 22 bp, Homo sapiens
tttatagtcgtctcagtaataa

SEQ ID NO: 8474124 - DNA, 22 bp, Homo sapiens
tttatagtcgtctcagtaataa

SEQ ID NO: 8474125 - DNA, 22 bp, Homo sapiens
tttatagttatatacagatgtt

SEQ ID NO: 8474126 - DNA, 23 bp, Homo sapiens
tttatttatttaggctgagggat

SEQ ID NO: 8474127 - DNA, 22 bp, Homo sapiens
tttattagattatcaaagaggt

SEQ ID NO: 8474128 - DNA, 22 bp, Homo sapiens
tttattatccagtgttgtcatg

SEQ ID NO: 8474129 - DNA, 22 bp, Homo sapiens
tttattattctgttctctctac

SEQ ID NO: 8474130 - DNA, 21 bp, Homo sapiens
tttaatttgcatgtatgacgc

SEQ ID NO: 8474131 - DNA, 22 bp, Homo sapiens
tttaatttgtatttctagaggg

SEQ ID NO: 8474132 - DNA, 22 bp, Homo sapiens
tttaattttcctggtaggcctg

SEQ ID NO: 8474133 - DNA, 22 bp, Homo sapiens
tttaattatatctgggcagtta

SEQ ID NO: 8474134 - DNA, 22 bp, Homo sapiens
tttaatgtttgagtcagtatat

SEQ ID NO: 8474135 - DNA, 22 bp, Homo sapiens
tttaaaatttagacctctccac

SEQ ID NO: 8474136 - DNA, 22 bp, Homo sapiens
tttaatgttaaatttgtagatg

SEQ ID NO: 8474137 - DNA, 22 bp, Homo sapiens
tttaaacaaataggattgccta

SEQ ID NO: 8474138 - DNA, 22 bp, Homo sapiens
tttaatgtgagtccctttcaag

SEQ ID NO: 8474139 - DNA, 22 bp, Homo sapiens
tttaaaatcagatgggagttgg

SEQ ID NO: 8474140 - DNA, 22 bp, Homo sapiens
tttaaaagttatcatctgtcca

SEQ ID NO: 8474141 - DNA, 22 bp, Homo sapiens
tttagttattgttacagtatga

SEQ ID NO: 8474142 - DNA, 22 bp, Homo sapiens
tttagaaattgcagagtgggtg

SEQ ID NO: 8474143 - DNA, 22 bp, Homo sapiens
tttagaacagatattgtaactt

SEQ ID NO: 8474144 - DNA, 22 bp, Homo sapiens
tttagaaattcatctatggcct

SEQ ID NO: 8474145 - DNA, 22 bp, Homo sapiens
tttagaaattcatctatggcct

SEQ ID NO: 8474146 - DNA, 22 bp, Homo sapiens
tttactttgtgtcaagtcaaga

SEQ ID NO: 8474147 - DNA, 22 bp, Homo sapiens
tttactttgtgtcaagtcaaga

SEQ ID NO: 8474148 - DNA, 22 bp, Homo sapiens
tttactttctcaagtatatagg

SEQ ID NO: 8474149 - DNA, 22 bp, Homo sapiens
tttactttgtgtcaagtcaaga

SEQ ID NO: 8474150 - DNA, 21 bp, Homo sapiens
tttactgagcacttactatgt

SEQ ID NO: 8474151 - DNA, 19 bp, Homo sapiens
tttactctccaaggtgagt

SEQ ID NO: 8474152 - DNA, 22 bp, Homo sapiens
tttactcttgctacacaactgt

SEQ ID NO: 8474153 - DNA, 22 bp, Homo sapiens
tttactgaatttggtatattcc

SEQ ID NO: 8474154 - DNA, 22 bp, Homo sapiens
tttactttctcaagtatatagg

SEQ ID NO: 8474155 - DNA, 22 bp, Homo sapiens
tttacttcatttccagtgagga

SEQ ID NO: 8474156 - DNA, 22 bp, Homo sapiens
tttacttctgcatttcccctag

SEQ ID NO: 8474157 - DNA, 22 bp, Homo sapiens
tttactgttcaacttgcaagta

SEQ ID NO: 8474158 - DNA, 22 bp, Homo sapiens
tttactgtctcagagagacaaa

SEQ ID NO: 8474159 - DNA, 22 bp, Homo sapiens
tttactgttacacctaccttct

SEQ ID NO: 8474160 - DNA, 22 bp, Homo sapiens
tttactgttacacctaccttct

SEQ ID NO: 8474161 - DNA, 22 bp, Homo sapiens
tttactaagcccagttatatgc

SEQ ID NO: 8474162 - DNA, 22 bp, Homo sapiens
tttactaagcccagttatatgc

SEQ ID NO: 8474163 - DNA, 22 bp, Homo sapiens
tttacctggattcttacttcct

SEQ ID NO: 8474164 - DNA, 22 bp, Homo sapiens
tttacctttgtgggtctccctc

SEQ ID NO: 8474165 - DNA, 22 bp, Homo sapiens
tttaccttcttttaactacagt

SEQ ID NO: 8474166 - DNA, 22 bp, Homo sapiens
tttacaactttctgttctgtat

SEQ ID NO: 8474167 - DNA, 22 bp, Homo sapiens
tttacaaggcagaactgattaa

SEQ ID NO: 8474168 - DNA, 22 bp, Homo sapiens
tttccaaataaggtcacactca

SEQ ID NO: 8474169 - DNA, 22 bp, Homo sapiens
tttccaaaggtggcaggaacaa

SEQ ID NO: 8474170 - DNA, 22 bp, Homo sapiens
tttccaaaggaggaaccagttt

SEQ ID NO: 8474171 - DNA, 22 bp, Homo sapiens
tttccaaaggaggaaccagttt

SEQ ID NO: 8474172 - DNA, 22 bp, Homo sapiens
tttccaaaggctaaactcagtt

SEQ ID NO: 8474173 - DNA, 22 bp, Homo sapiens
tttcctctgggccctgccaccc

SEQ ID NO: 8474174 - DNA, 22 bp, Homo sapiens
tttcctctgctgccattgcccc

SEQ ID NO: 8474175 - DNA, 22 bp, Homo sapiens
tttcatttcatagaattgtgtt

SEQ ID NO: 8474176 - DNA, 22 bp, Homo sapiens
tttccaaaatgaatctaatgca

SEQ ID NO: 8474177 - DNA, 22 bp, Homo sapiens
tttccaaagctgagttgagcaa

SEQ ID NO: 8474178 - DNA, 20 bp, Homo sapiens
tttcattgtcagaatcttat

SEQ ID NO: 8474179 - DNA, 22 bp, Homo sapiens
tttcattgtctacatatgacat

SEQ ID NO: 8474180 - DNA, 22 bp, Homo sapiens
tttcagtgcttctgtttaccgg

SEQ ID NO: 8474181 - DNA, 22 bp, Homo sapiens
tttcagtgaaagctactgttag

SEQ ID NO: 8474182 - DNA, 22 bp, Homo sapiens
tttcaggagagaccagaaatga

SEQ ID NO: 8474183 - DNA, 22 bp, Homo sapiens
tttcaaagacagccatatttgt

SEQ ID NO: 8474184 - DNA, 22 bp, Homo sapiens
tttcaaaggaggctgagaggat

SEQ ID NO: 8474185 - DNA, 20 bp, Homo sapiens
tttcaaaggcacctatgaag

SEQ ID NO: 8474186 - DNA, 22 bp, Homo sapiens
tttcaaagcaactgaaaaggaa

SEQ ID NO: 8474187 - DNA, 17 bp, Homo sapiens
tttcaaagcagtcagga

SEQ ID NO: 8474188 - DNA, 17 bp, Homo sapiens
tttcaaagcagtcagga

SEQ ID NO: 8474189 - DNA, 22 bp, Homo sapiens
tttcaaagggaagttatgaagt

SEQ ID NO: 8474190 - DNA, 20 bp, Homo sapiens
tttcaaaggcacctatgaag

SEQ ID NO: 8474191 - DNA, 20 bp, Homo sapiens
tttcaaaggcacctatgaag

SEQ ID NO: 8474192 - DNA, 20 bp, Homo sapiens
tttcagagtgtctttccatt

SEQ ID NO: 8474193 - DNA, 22 bp, Homo sapiens
tttctacatttgtaaccagatt

SEQ ID NO: 8474194 - DNA, 22 bp, Homo sapiens
tttctacattcaaaaactacca

SEQ ID NO: 8474195 - DNA, 22 bp, Homo sapiens
tttctaagtgtgtttcatagga

SEQ ID NO: 8474196 - DNA, 22 bp, Homo sapiens
tttctaagtaagattaacttct

SEQ ID NO: 8474197 - DNA, 22 bp, Homo sapiens
tttctaagtgaacattcaagtt

SEQ ID NO: 8474198 - DNA, 22 bp, Homo sapiens
tttcctctttgtgacacagctg

SEQ ID NO: 8474199 - DNA, 22 bp, Homo sapiens
tttcctgagtcagagacaccag

SEQ ID NO: 8474200 - DNA, 22 bp, Homo sapiens
tttcctggtttgaagcagcagc

SEQ ID NO: 8474201 - DNA, 22 bp, Homo sapiens
tttccttcatcatctgagagct

SEQ ID NO: 8474202 - DNA, 22 bp, Homo sapiens
tttctcatggaacatagctcct

SEQ ID NO: 8474203 - DNA, 22 bp, Homo sapiens
tttctccacgccagcttgctta

SEQ ID NO: 8474204 - DNA, 22 bp, Homo sapiens
tttctccacttctcttgccaac

SEQ ID NO: 8474205 - DNA, 22 bp, Homo sapiens
tttctcctccagagagacacag

SEQ ID NO: 8474206 - DNA, 22 bp, Homo sapiens
tttctcagttactagctgtggt

SEQ ID NO: 8474207 - DNA, 22 bp, Homo sapiens
tttctcagttactagctgtggt

SEQ ID NO: 8474208 - DNA, 21 bp, Homo sapiens
tttctcagttgtgtgagcagc

SEQ ID NO: 8474209 - DNA, 22 bp, Homo sapiens
tttctcagttgtgcgagcagca

SEQ ID NO: 8474210 - DNA, 21 bp, Homo sapiens
tttctcagttgtgtgagcagc

SEQ ID NO: 8474211 - DNA, 22 bp, Homo sapiens
tttctcagctgtggagcctatc

SEQ ID NO: 8474212 - DNA, 22 bp, Homo sapiens
tttctcagctgtggagcctatc

SEQ ID NO: 8474213 - DNA, 22 bp, Homo sapiens
tttctcagctcagcatctgggt

SEQ ID NO: 8474214 - DNA, 22 bp, Homo sapiens
tttctcagcctccttgctggag

SEQ ID NO: 8474215 - DNA, 22 bp, Homo sapiens
tttctcagtagtaatggcagtc

SEQ ID NO: 8474216 - DNA, 22 bp, Homo sapiens
tttctcagtaatgtcctggaat

SEQ ID NO: 8474217 - DNA, 22 bp, Homo sapiens
tttctcagggaggagtcaagcc

SEQ ID NO: 8474218 - DNA, 22 bp, Homo sapiens
tttctcagtaatgtcctggaat

SEQ ID NO: 8474219 - DNA, 22 bp, Homo sapiens
tttctactttggaatgcactga

SEQ ID NO: 8474220 - DNA, 22 bp, Homo sapiens
tttctcagaggagccagacggt

SEQ ID NO: 8474221 - DNA, 22 bp, Homo sapiens
tttctcagagcacggggagtga

SEQ ID NO: 8474222 - DNA, 22 bp, Homo sapiens
tttctattggcgtcactgttgt

SEQ ID NO: 8474223 - DNA, 22 bp, Homo sapiens
tttctattgtaagtctcctata

SEQ ID NO: 8474224 - DNA, 22 bp, Homo sapiens
tttctgaaatgctggctttgga

SEQ ID NO: 8474225 - DNA, 22 bp, Homo sapiens
tttctgaaatctcttttgagga

SEQ ID NO: 8474226 - DNA, 22 bp, Homo sapiens
tttctgaaacatggtctttgta

SEQ ID NO: 8474227 - DNA, 21 bp, Homo sapiens
tttctgaaggcaacatctatc

SEQ ID NO: 8474228 - DNA, 22 bp, Homo sapiens
tttctgaacttggtactggagc

SEQ ID NO: 8474229 - DNA, 22 bp, Homo sapiens
tttctgaagatacagctttgct

SEQ ID NO: 8474230 - DNA, 22 bp, Homo sapiens
tttctcttcactgtgtgcctca

SEQ ID NO: 8474231 - DNA, 22 bp, Homo sapiens
tttctcttcactgtgtgcctca

SEQ ID NO: 8474232 - DNA, 22 bp, Homo sapiens
tttctcttgcgatatgctacac

SEQ ID NO: 8474233 - DNA, 22 bp, Homo sapiens
tttctctttcaatctgcagtac

SEQ ID NO: 8474234 - DNA, 22 bp, Homo sapiens
tttctctttggaggggctgaat

SEQ ID NO: 8474235 - DNA, 22 bp, Homo sapiens
tttctcctgagttccacgctac

SEQ ID NO: 8474236 - DNA, 22 bp, Homo sapiens
tttctctgggcactctccaaac

SEQ ID NO: 8474237 - DNA, 18 bp, Homo sapiens
tttctctgtcgtcttctg

SEQ ID NO: 8474238 - DNA, 22 bp, Homo sapiens
tttctctgggctgttggcagcc

SEQ ID NO: 8474239 - DNA, 19 bp, Homo sapiens
tttctctgtgcaccttttc

SEQ ID NO: 8474240 - DNA, 22 bp, Homo sapiens
tttctcgcgtttgagctctcag

SEQ ID NO: 8474241 - DNA, 22 bp, Homo sapiens
tttctcttaatgtctctgtgct

SEQ ID NO: 8474242 - DNA, 22 bp, Homo sapiens
tttctctgtgggctttatgcat

SEQ ID NO: 8474243 - DNA, 22 bp, Homo sapiens
tttctctgtgccatttccataa

SEQ ID NO: 8474244 - DNA, 22 bp, Homo sapiens
tttctctgttctctaactgtaa

SEQ ID NO: 8474245 - DNA, 22 bp, Homo sapiens
tttctctgttctctaactgtaa

SEQ ID NO: 8474246 - DNA, 22 bp, Homo sapiens
tttctgaagtcttctaacagat

SEQ ID NO: 8474247 - DNA, 22 bp, Homo sapiens
tttctgaaggttaaggaattag

SEQ ID NO: 8474248 - DNA, 22 bp, Homo sapiens
tttctgaagtcttctaacagat

SEQ ID NO: 8474249 - DNA, 22 bp, Homo sapiens
tttctgtaattggccaagtcac

SEQ ID NO: 8474250 - DNA, 22 bp, Homo sapiens
tttctgtaagtggcaaataatg

SEQ ID NO: 8474251 - DNA, 22 bp, Homo sapiens
tttctgtagggatttcacagtt

SEQ ID NO: 8474252 - DNA, 20 bp, Homo sapiens
tttctgtagctcagtattca

SEQ ID NO: 8474253 - DNA, 22 bp, Homo sapiens
tttctgggactggggagattct

SEQ ID NO: 8474254 - DNA, 22 bp, Homo sapiens
tttctgtaaggacttaatgcaa

SEQ ID NO: 8474255 - DNA, 22 bp, Homo sapiens
tttctgtaaagaccaagccagc

SEQ ID NO: 8474256 - DNA, 22 bp, Homo sapiens
tttctggcagcgggacaggggt

SEQ ID NO: 8474257 - DNA, 22 bp, Homo sapiens
tttctggcagcgggacaggggt

SEQ ID NO: 8474258 - DNA, 22 bp, Homo sapiens
tttcttatgtgcagagtgagta

SEQ ID NO: 8474259 - DNA, 22 bp, Homo sapiens
tttcttatggggtagtccttta

SEQ ID NO: 8474260 - DNA, 22 bp, Homo sapiens
tttctgtattttgtcataacct

SEQ ID NO: 8474261 - DNA, 21 bp, Homo sapiens
tttctgtcctttccatcagct

SEQ ID NO: 8474262 - DNA, 22 bp, Homo sapiens
tttctgtagggatttcacagtt

SEQ ID NO: 8474263 - DNA, 22 bp, Homo sapiens
tttctgtagggatttcacagtt

SEQ ID NO: 8474264 - DNA, 21 bp, Homo sapiens
tttctgtctctgccactagtt

SEQ ID NO: 8474265 - DNA, 19 bp, Homo sapiens
tttctgtctgtgttttgcc

SEQ ID NO: 8474266 - DNA, 20 bp, Homo sapiens
tttctgtgcccaggtctgtt

SEQ ID NO: 8474267 - DNA, 20 bp, Homo sapiens
tttctgtgatagagaggtgt

SEQ ID NO: 8474268 - DNA, 21 bp, Homo sapiens
tttcttatctgtaaagtggga

SEQ ID NO: 8474269 - DNA, 22 bp, Homo sapiens
tttcttatattctgtcattgtt

SEQ ID NO: 8474270 - DNA, 23 bp, Homo sapiens
tttctgttcctctagctttgcat

SEQ ID NO: 8474271 - DNA, 22 bp, Homo sapiens
tttctgtggtgggtagttcaga

SEQ ID NO: 8474272 - DNA, 23 bp, Homo sapiens
tttctgttcctctagctttgcat

SEQ ID NO: 8474273 - DNA, 22 bp, Homo sapiens
tttctgttaggcatcattttaa

SEQ ID NO: 8474274 - DNA, 22 bp, Homo sapiens
tttctgttaggcatcattttaa

SEQ ID NO: 8474275 - DNA, 22 bp, Homo sapiens
tttctttaaaggaactctgttt

SEQ ID NO: 8474276 - DNA, 22 bp, Homo sapiens
tttctttaattctcacagcaat

SEQ ID NO: 8474277 - DNA, 22 bp, Homo sapiens
tttctttaattctcacagcaat

SEQ ID NO: 8474278 - DNA, 22 bp, Homo sapiens
tttctttaaaggaactctgttt

SEQ ID NO: 8474279 - DNA, 22 bp, Homo sapiens
tttctttatcatagcatctttg

SEQ ID NO: 8474280 - DNA, 22 bp, Homo sapiens
tttctttatcatagcatctttg

SEQ ID NO: 8474281 - DNA, 22 bp, Homo sapiens
tttctttaattctcacagcaat

SEQ ID NO: 8474282 - DNA, 22 bp, Homo sapiens
tttctttaattctcacagcaat

SEQ ID NO: 8474283 - DNA, 22 bp, Homo sapiens
tttctttaggctgtgttgccaa

SEQ ID NO: 8474284 - DNA, 22 bp, Homo sapiens
tttctttaggctgtgttgccaa

SEQ ID NO: 8474285 - DNA, 22 bp, Homo sapiens
tttcttctctaatctcaatgat

SEQ ID NO: 8474286 - DNA, 22 bp, Homo sapiens
tttcttctctaatctcaatgat

SEQ ID NO: 8474287 - DNA, 20 bp, Homo sapiens
tttcttgtcggctgttgctg

SEQ ID NO: 8474288 - DNA, 22 bp, Homo sapiens
tttcttgtaagatgtttattaa

SEQ ID NO: 8474289 - DNA, 22 bp, Homo sapiens
tttcttctcatccctgaaatca

SEQ ID NO: 8474290 - DNA, 22 bp, Homo sapiens
tttcttcctaaatatgatttcc

SEQ ID NO: 8474291 - DNA, 22 bp, Homo sapiens
ttttatcattacccagctgaaa

SEQ ID NO: 8474292 - DNA, 22 bp, Homo sapiens
ttttatcattacccagctgaaa

SEQ ID NO: 8474293 - DNA, 22 bp, Homo sapiens
ttttctagggtgctaaatgaac

SEQ ID NO: 8474294 - DNA, 22 bp, Homo sapiens
ttttctattaactcattttgca

SEQ ID NO: 8474295 - DNA, 22 bp, Homo sapiens
ttttctttaatctggtggggtg

SEQ ID NO: 8474296 - DNA, 22 bp, Homo sapiens
ttttctttaatctggtggggtg

SEQ ID NO: 8474297 - DNA, 22 bp, Homo sapiens
ttttcttcggtgctgggttgat

SEQ ID NO: 8474298 - DNA, 22 bp, Homo sapiens
ttttcttctacctgctgtccaa

SEQ ID NO: 8474299 - DNA, 22 bp, Homo sapiens
ttttctaacatctagtaatttg

SEQ ID NO: 8474300 - DNA, 22 bp, Homo sapiens
ttttctaacatctagtaatttg

SEQ ID NO: 8474301 - DNA, 22 bp, Homo sapiens
ttttgatatcatgatgaacaga

SEQ ID NO: 8474302 - DNA, 22 bp, Homo sapiens
ttttgaataattcagaaacagc

SEQ ID NO: 8474303 - DNA, 22 bp, Homo sapiens
ttttgcccttgctagatcactg

SEQ ID NO: 8474304 - DNA, 22 bp, Homo sapiens
ttttgcccttgctagatcactg

SEQ ID NO: 8474305 - DNA, 22 bp, Homo sapiens
ttttgcaatatgttcctgaata

SEQ ID NO: 8474306 - DNA, 22 bp, Homo sapiens
ttttggatgagcccagatttct

SEQ ID NO: 8474307 - DNA, 22 bp, Homo sapiens
ttttggaatttatacagtaatg

SEQ ID NO: 8474308 - DNA, 22 bp, Homo sapiens
ttttggaatctgggaaaacagt

SEQ ID NO: 8474309 - DNA, 22 bp, Homo sapiens
ttttggctccagtggtttgtgc

SEQ ID NO: 8474310 - DNA, 22 bp, Homo sapiens
tttttcatctgattgataactc

SEQ ID NO: 8474311 - DNA, 22 bp, Homo sapiens
ttttggcactgcgtctacatgg

SEQ ID NO: 8474312 - DNA, 22 bp, Homo sapiens
tttttcatgagactagaagtca

SEQ ID NO: 8474313 - DNA, 22 bp, Homo sapiens
tttttcattgcagcctctctcc

SEQ ID NO: 8474314 - DNA, 22 bp, Homo sapiens
tttttcctaagcagtggagctg

SEQ ID NO: 8474315 - DNA, 22 bp, Homo sapiens
tttttcctagcgatttgtcagc

SEQ ID NO: 8474316 - DNA, 22 bp, Homo sapiens
tttttccttaggggttactcac

SEQ ID NO: 8474317 - DNA, 22 bp, Homo sapiens
tttttcctagtgctttctggta

SEQ ID NO: 8474318 - DNA, 20 bp, Homo sapiens
tttttccttctctacaggca

SEQ ID NO: 8474319 - DNA, 22 bp, Homo sapiens
tttttccttggatgtgtctctc

SEQ ID NO: 8474320 - DNA, 22 bp, Homo sapiens
tttttctaatggcttaggatgt

SEQ ID NO: 8474321 - DNA, 22 bp, Homo sapiens
tttttctactgcccacattgta

SEQ ID NO: 8474322 - DNA, 22 bp, Homo sapiens
tttttctactggtgttggtgta

SEQ ID NO: 8474323 - DNA, 22 bp, Homo sapiens
tttttcttgtgctggatctaat

SEQ ID NO: 8474324 - DNA, 22 bp, Homo sapiens
tttttgaaggctgatgtgatta

SEQ ID NO: 8474325 - DNA, 22 bp, Homo sapiens
tttttggcagctcagaaacttc

SEQ ID NO: 8474326 - DNA, 22 bp, Homo sapiens
tttttgctccacaactttgaag

SEQ ID NO: 8474327 - DNA, 22 bp, Homo sapiens
ttttttgtcttgaagaaatggt

SEQ ID NO: 8474328 - DNA, 22 bp, Homo sapiens
ttttttgtcttgaagaaatggt

SEQ ID NO: 8474329 - DNA, 22 bp, Homo sapiens
ttttatacttaagacagagttt

SEQ ID NO: 8474330 - DNA, 22 bp, Homo sapiens
ttttatacacatgaacatgcag

SEQ ID NO: 8474331 - DNA, 22 bp, Homo sapiens
ttttataagcaagaaagggaaa

SEQ ID NO: 8474332 - DNA, 22 bp, Homo sapiens
ttttagaagttcatgtgggatt

SEQ ID NO: 8474333 - DNA, 22 bp, Homo sapiens
ttttagaagttcatgtgggatt

SEQ ID NO: 8474334 - DNA, 22 bp, Homo sapiens
ttttagtttggatttctaaagc

SEQ ID NO: 8474335 - DNA, 22 bp, Homo sapiens
ttttagaatcaggttgtctggg

SEQ ID NO: 8474336 - DNA, 22 bp, Homo sapiens
ttttataaagagagtcagttgg

SEQ ID NO: 8474337 - DNA, 22 bp, Homo sapiens
ttttataaagagagtcagttgg

SEQ ID NO: 8474338 - DNA, 22 bp, Homo sapiens
ttttatattgagtgagagttcc

SEQ ID NO: 8474339 - DNA, 22 bp, Homo sapiens
ttttatatggcacattggttgg

SEQ ID NO: 8474340 - DNA, 22 bp, Homo sapiens
tttgttttcaatgtgtcattca

SEQ ID NO: 8474341 - DNA, 22 bp, Homo sapiens
tttgttttctgtaggcctttcc

SEQ ID NO: 8474342 - DNA, 22 bp, Homo sapiens
ttttagaagttcacttgggttt

SEQ ID NO: 8474343 - DNA, 22 bp, Homo sapiens
ttttaaactcccctagttggtg

SEQ ID NO: 8474344 - DNA, 22 bp, Homo sapiens
ttttagaagtgcctatcctatg

SEQ ID NO: 8474345 - DNA, 22 bp, Homo sapiens
tttgtttagagaattgaagcag

SEQ ID NO: 8474346 - DNA, 22 bp, Homo sapiens
tttgtttagaaagagattggtg

SEQ ID NO: 8474347 - DNA, 22 bp, Homo sapiens
tttgtttagaaagagattggtg

SEQ ID NO: 8474348 - DNA, 22 bp, Homo sapiens
tttgtttagagaattgaagcag

SEQ ID NO: 8474349 - DNA, 22 bp, Homo sapiens
tttgtttatcaaggtctagcat

SEQ ID NO: 8474350 - DNA, 22 bp, Homo sapiens
tttgtttagatggtaaatcagt

SEQ ID NO: 8474351 - DNA, 22 bp, Homo sapiens
tttgtttattaggggagagttg

SEQ ID NO: 8474352 - DNA, 22 bp, Homo sapiens
tttgtttagatggtaaatcagt

SEQ ID NO: 8474353 - DNA, 22 bp, Homo sapiens
tttgtttagatggtaaatcagt

SEQ ID NO: 8474354 - DNA, 22 bp, Homo sapiens
tttgtcagtcatgtctgctttt

SEQ ID NO: 8474355 - DNA, 22 bp, Homo sapiens
tttgttcactgatgtatcccaa

SEQ ID NO: 8474356 - DNA, 22 bp, Homo sapiens
tttgtcaagtttgcaaatacgt

SEQ ID NO: 8474357 - DNA, 22 bp, Homo sapiens
tttgtcaaatcaaaccacattc

SEQ ID NO: 8474358 - DNA, 22 bp, Homo sapiens
tttgtcaaagatcagatgcttt

SEQ ID NO: 8474359 - DNA, 22 bp, Homo sapiens
tttgtatttttcccagctagct

SEQ ID NO: 8474360 - DNA, 22 bp, Homo sapiens
tttgttcttgcaacagttatta

SEQ ID NO: 8474361 - DNA, 18 bp, Homo sapiens
tttgttgggttgccttta

SEQ ID NO: 8474362 - DNA, 22 bp, Homo sapiens
tttgtttacaaaaataagcagt

SEQ ID NO: 8474363 - DNA, 22 bp, Homo sapiens
tttgtttactcattcattgatg

SEQ ID NO: 8474364 - DNA, 22 bp, Homo sapiens
tttgtttacaaaaataagcagt

SEQ ID NO: 8474365 - DNA, 22 bp, Homo sapiens
tttgttggttgcactggtgggt

SEQ ID NO: 8474366 - DNA, 22 bp, Homo sapiens
tttgtacttcattggttctact

SEQ ID NO: 8474367 - DNA, 22 bp, Homo sapiens
tttgtagcagcatgatttataa

SEQ ID NO: 8474368 - DNA, 22 bp, Homo sapiens
tttgtataagaacattctagca

SEQ ID NO: 8474369 - DNA, 22 bp, Homo sapiens
tttgtacatgtaagattgcatc

SEQ ID NO: 8474370 - DNA, 23 bp, Homo sapiens
tttgtacattgaggaggcagaat

SEQ ID NO: 8474371 - DNA, 22 bp, Homo sapiens
tttgtacacaggatgttataat

SEQ ID NO: 8474372 - DNA, 22 bp, Homo sapiens
tttggcaagtgggaaattagta

SEQ ID NO: 8474373 - DNA, 22 bp, Homo sapiens
tttggaagacagggcaggaaag

SEQ ID NO: 8474374 - DNA, 19 bp, Homo sapiens
tttggaactttttgatgcc

SEQ ID NO: 8474375 - DNA, 22 bp, Homo sapiens
tttggacatgttgagtctgata

SEQ ID NO: 8474376 - DNA, 22 bp, Homo sapiens
tttggactgcatgatgatctgg

SEQ ID NO: 8474377 - DNA, 22 bp, Homo sapiens
tttggacttagcctgcagaatt

SEQ ID NO: 8474378 - DNA, 22 bp, Homo sapiens
tttggacttagcctgcagaatt

SEQ ID NO: 8474379 - DNA, 19 bp, Homo sapiens
tttggacagagtgtccagg

SEQ ID NO: 8474380 - DNA, 22 bp, Homo sapiens
tttggacatgttgagtctgata

SEQ ID NO: 8474381 - DNA, 22 bp, Homo sapiens
tttggacaagttactggtttcc

SEQ ID NO: 8474382 - DNA, 22 bp, Homo sapiens
tttggacaaatgtctgactttc

SEQ ID NO: 8474383 - DNA, 20 bp, Homo sapiens
tttggagagaaagaagtagt

SEQ ID NO: 8474384 - DNA, 22 bp, Homo sapiens
tttggagagcagctaggccctt

SEQ ID NO: 8474385 - DNA, 22 bp, Homo sapiens
tttggagagatgaagttctgtg

SEQ ID NO: 8474386 - DNA, 22 bp, Homo sapiens
tttggagatagggcctagcaat

SEQ ID NO: 8474387 - DNA, 22 bp, Homo sapiens
tttggagatggagagagggcat

SEQ ID NO: 8474388 - DNA, 22 bp, Homo sapiens
tttggcaaagatcaacatgtta

SEQ ID NO: 8474389 - DNA, 22 bp, Homo sapiens
tttctttcaattctcctaatgc

SEQ ID NO: 8474390 - DNA, 22 bp, Homo sapiens
tttctttcaattctcctaatgc

SEQ ID NO: 8474391 - DNA, 22 bp, Homo sapiens
tttctttccagagtgattggca

SEQ ID NO: 8474392 - DNA, 22 bp, Homo sapiens
tttctttccagagtgattggca

SEQ ID NO: 8474393 - DNA, 22 bp, Homo sapiens
tttctttatcctcctttgcaca

SEQ ID NO: 8474394 - DNA, 22 bp, Homo sapiens
tttctttatcctcctttgcaca

SEQ ID NO: 8474395 - DNA, 22 bp, Homo sapiens
tttctttatcctcctttgcaca

SEQ ID NO: 8474396 - DNA, 22 bp, Homo sapiens
tttctttatcctcctttgcaca

SEQ ID NO: 8474397 - DNA, 22 bp, Homo sapiens
tttctttccatgagcctatgta

SEQ ID NO: 8474398 - DNA, 22 bp, Homo sapiens
tttctttccatacatattgcta

SEQ ID NO: 8474399 - DNA, 22 bp, Homo sapiens
tttctttccatacatattgcta

SEQ ID NO: 8474400 - DNA, 18 bp, Homo sapiens
tttctttctgcctggggc

SEQ ID NO: 8474401 - DNA, 22 bp, Homo sapiens
tttctttctcgtaaacttagtt

SEQ ID NO: 8474402 - DNA, 22 bp, Homo sapiens
tttctttctcgtaaacttagtt

SEQ ID NO: 8474403 - DNA, 22 bp, Homo sapiens
tttctttccatgagcctatgta

SEQ ID NO: 8474404 - DNA, 22 bp, Homo sapiens
tttgcaaatatgtgtttctatt

SEQ ID NO: 8474405 - DNA, 22 bp, Homo sapiens
tttgcaaatatgtgtttctatt

SEQ ID NO: 8474406 - DNA, 22 bp, Homo sapiens
tttgcaaataccatgaaacttg

SEQ ID NO: 8474407 - DNA, 22 bp, Homo sapiens
tttgcaaatacagaggtcttgc

SEQ ID NO: 8474408 - DNA, 22 bp, Homo sapiens
tttgcaaataccatgaaacttg

SEQ ID NO: 8474409 - DNA, 22 bp, Homo sapiens
tttgcaaataaataagtgctcg

SEQ ID NO: 8474410 - DNA, 22 bp, Homo sapiens
tttgcaaataaataagtgctcg

SEQ ID NO: 8474411 - DNA, 22 bp, Homo sapiens
tttgattttcagcaatagtggc

SEQ ID NO: 8474412 - DNA, 22 bp, Homo sapiens
tttgcaaatgctctgcagagct

SEQ ID NO: 8474413 - DNA, 22 bp, Homo sapiens
tttgcaaatgaagctctgagga

SEQ ID NO: 8474414 - DNA, 22 bp, Homo sapiens
tttgcaaattagccaccctgtt

SEQ ID NO: 8474415 - DNA, 22 bp, Homo sapiens
tttgcaaatgctctgcagagct

SEQ ID NO: 8474416 - DNA, 23 bp, Homo sapiens
tttgcaaattggacacaaccaca

SEQ ID NO: 8474417 - DNA, 22 bp, Homo sapiens
tttgcaaattcttgtctagcct

SEQ ID NO: 8474418 - DNA, 23 bp, Homo sapiens
tttgcaaattttcctgactactc

SEQ ID NO: 8474419 - DNA, 22 bp, Homo sapiens
tttgcaaatttcgtctcctcag

SEQ ID NO: 8474420 - DNA, 22 bp, Homo sapiens
tttgcaaatttcgtctcctcag

SEQ ID NO: 8474421 - DNA, 22 bp, Homo sapiens
tttgcaatgtgaaattaaagaa

SEQ ID NO: 8474422 - DNA, 22 bp, Homo sapiens
tttgcaatagtcctggcctgta

SEQ ID NO: 8474423 - DNA, 22 bp, Homo sapiens
tttgcaatggtagttgttgctc

SEQ ID NO: 8474424 - DNA, 22 bp, Homo sapiens
tttgcagagtacctgaagagga

SEQ ID NO: 8474425 - DNA, 22 bp, Homo sapiens
tttgcagaagaaaacatgaaca

SEQ ID NO: 8474426 - DNA, 22 bp, Homo sapiens
tttgcagaagaaaacatgaaca

SEQ ID NO: 8474427 - DNA, 22 bp, Homo sapiens
attgatatcagtttgctgattg

SEQ ID NO: 8474428 - DNA, 22 bp, Homo sapiens
attcagaaatagaaaatttgat

SEQ ID NO: 8474429 - DNA, 22 bp, Homo sapiens
caaatgatacctattactaggc

SEQ ID NO: 8474430 - DNA, 22 bp, Homo sapiens
attttacttcatttgaaatgcc

SEQ ID NO: 8474431 - DNA, 22 bp, Homo sapiens
attttagagaaacaaacgtagg

SEQ ID NO: 8474432 - DNA, 22 bp, Homo sapiens
caaaattctgcatttctaataa

SEQ ID NO: 8474433 - DNA, 22 bp, Homo sapiens
atttctgtggcttcattctcct

SEQ ID NO: 8474434 - DNA, 22 bp, Homo sapiens
atttctgttatacctttctcag

SEQ ID NO: 8474435 - DNA, 22 bp, Homo sapiens
atgaaacaaacctctatggagt

SEQ ID NO: 8474436 - DNA, 22 bp, Homo sapiens
gaacaaacacatcccagcagtg

SEQ ID NO: 8474437 - DNA, 22 bp, Homo sapiens
gtcccagaaacatattgctggt

SEQ ID NO: 8474438 - DNA, 22 bp, Homo sapiens
gtcccagatgtctggaactccc

SEQ ID NO: 8474439 - DNA, 22 bp, Homo sapiens
gtcccagaggctttggccacag

SEQ ID NO: 8474440 - DNA, 22 bp, Homo sapiens
gtcccagaggacagggtcacat

SEQ ID NO: 8474441 - DNA, 22 bp, Homo sapiens
gtcccagagagcactagtccat

SEQ ID NO: 8474442 - DNA, 22 bp, Homo sapiens
caagtcaaagactagaactagt

SEQ ID NO: 8474443 - DNA, 22 bp, Homo sapiens
agtcccagctactcaagaggct

SEQ ID NO: 8474444 - DNA, 18 bp, Homo sapiens
agtgtctggatatttggg

SEQ ID NO: 8474445 - DNA, 22 bp, Homo sapiens
ctgagaaaggacctcaaacagg

SEQ ID NO: 8474446 - DNA, 22 bp, Homo sapiens
agtccccaggggatgcccacgc

SEQ ID NO: 8474447 - DNA, 22 bp, Homo sapiens
ctccagctgccaccagatgttt

SEQ ID NO: 8474448 - DNA, 22 bp, Homo sapiens
ctccagcttccctcagctgtgg

SEQ ID NO: 8474449 - DNA, 22 bp, Homo sapiens
ctccagctttttcccagttggc

SEQ ID NO: 8474450 - DNA, 22 bp, Homo sapiens
atccaccctgtggtggctttct

SEQ ID NO: 8474451 - DNA, 22 bp, Homo sapiens
cttagatgaagtcacagaaccc

SEQ ID NO: 8474452 - DNA, 22 bp, Homo sapiens
atatgcagtctcttgcccttct

SEQ ID NO: 8474453 - DNA, 22 bp, Homo sapiens
atatgtttttggaaagaacaca

SEQ ID NO: 8474454 - DNA, 22 bp, Homo sapiens
atactaagctcattacattttg

SEQ ID NO: 8474455 - DNA, 22 bp, Homo sapiens
atagcagaaaccaagcttcttc

SEQ ID NO: 8474456 - DNA, 22 bp, Homo sapiens
ctggaatgagcagggcttatgg

SEQ ID NO: 8474457 - DNA, 19 bp, Homo sapiens
ctggaatgatagagacctc

SEQ ID NO: 8474458 - DNA, 22 bp, Homo sapiens
ctggaatgtagagacagcttag

SEQ ID NO: 8474459 - DNA, 22 bp, Homo sapiens
atacctgtgtatccacaagcgt

SEQ ID NO: 8474460 - DNA, 22 bp, Homo sapiens
ataatttactaagctctacctt

SEQ ID NO: 8474461 - DNA, 22 bp, Homo sapiens
atacaaagtattaatcctggat

SEQ ID NO: 8474462 - DNA, 22 bp, Homo sapiens
atacaaagctttctgtctggta

SEQ ID NO: 8474463 - DNA, 22 bp, Homo sapiens
ataacagatgtgaagtgctaat

SEQ ID NO: 8474464 - DNA, 22 bp, Homo sapiens
aggctgtgcacagggcacctgc

SEQ ID NO: 8474465 - DNA, 22 bp, Homo sapiens
aggctgtgacagggtcatggag

SEQ ID NO: 8474466 - DNA, 22 bp, Homo sapiens
cctacacatctcacctcacagg

SEQ ID NO: 8474467 - DNA, 22 bp, Homo sapiens
aggcaagaacagacatgggagt

SEQ ID NO: 8474468 - DNA, 22 bp, Homo sapiens
acaggcctgtgtgcacacgagg

SEQ ID NO: 8474469 - DNA, 22 bp, Homo sapiens
accagacactgtgaagacaggc

SEQ ID NO: 8474470 - DNA, 19 bp, Homo sapiens
aggctgtgagggaggactc

SEQ ID NO: 8474471 - DNA, 22 bp, Homo sapiens
aggctctggcaacagctggtgt

SEQ ID NO: 8474472 - DNA, 22 bp, Homo sapiens
acatttctccttgcaggagtca

SEQ ID NO: 8474473 - DNA, 22 bp, Homo sapiens
acatttctccctgcatgcctgc

SEQ ID NO: 8474474 - DNA, 22 bp, Homo sapiens
acatttctcattctcccctaac

SEQ ID NO: 8474475 - DNA, 22 bp, Homo sapiens
acatttctcatctagtagagta

SEQ ID NO: 8474476 - DNA, 22 bp, Homo sapiens
acatttctcaggtaagtcattt

SEQ ID NO: 8474477 - DNA, 22 bp, Homo sapiens
agtgcaatagcaaagaacaaca

SEQ ID NO: 8474478 - DNA, 22 bp, Homo sapiens
atctggaaaacacagtgtagac

SEQ ID NO: 8474479 - DNA, 23 bp, Homo sapiens
atcaagtcatcagcaaaatacat

SEQ ID NO: 8474480 - DNA, 22 bp, Homo sapiens
ataaatttataattgtttcctg

SEQ ID NO: 8474481 - DNA, 22 bp, Homo sapiens
atcttaatcgagtccatgaaaa

SEQ ID NO: 8474482 - DNA, 22 bp, Homo sapiens
atgttctaatccctgctatgta

SEQ ID NO: 8474483 - DNA, 21 bp, Homo sapiens
attttctgtgatagctgtctc

SEQ ID NO: 8474484 - DNA, 22 bp, Homo sapiens
agatgtttgtaaacacactgct

SEQ ID NO: 8474485 - DNA, 22 bp, Homo sapiens
caaagttctcggctcaagtcct

SEQ ID NO: 8474486 - DNA, 22 bp, Homo sapiens
attttttagaacctggcctgat

SEQ ID NO: 8474487 - DNA, 22 bp, Homo sapiens
agcaataacagaaaactttcct

SEQ ID NO: 8474488 - DNA, 20 bp, Homo sapiens
attctacaagaataagcatg

SEQ ID NO: 8474489 - DNA, 22 bp, Homo sapiens
attcttctgcctactttcatcc

SEQ ID NO: 8474490 - DNA, 22 bp, Homo sapiens
attctacaacccaataataatt

SEQ ID NO: 8474491 - DNA, 22 bp, Homo sapiens
agaggaaaatgagttccagaat

SEQ ID NO: 8474492 - DNA, 22 bp, Homo sapiens
agataatttgagtaaattaatt

SEQ ID NO: 8474493 - DNA, 22 bp, Homo sapiens
cagcatcaccgccatttctgat

SEQ ID NO: 8474494 - DNA, 22 bp, Homo sapiens
caatttcttgttaattctcagg

SEQ ID NO: 8474495 - DNA, 22 bp, Homo sapiens
cagaaacttctggtgtcaaata

SEQ ID NO: 8474496 - DNA, 22 bp, Homo sapiens
cagaaactatgtaagaaagtga

SEQ ID NO: 8474497 - DNA, 22 bp, Homo sapiens
aagaagaagtgttatttttaga

SEQ ID NO: 8474498 - DNA, 21 bp, Homo sapiens
aagaactattgaggtacacag

SEQ ID NO: 8474499 - DNA, 18 bp, Homo sapiens
aagaactgaggtcctaga

SEQ ID NO: 8474500 - DNA, 22 bp, Homo sapiens
aatgtacaaaccttctttgtag

SEQ ID NO: 8474501 - DNA, 22 bp, Homo sapiens
aactttaaggctataaattatg

SEQ ID NO: 8474502 - DNA, 22 bp, Homo sapiens
aatacagaggggtcacaattca

SEQ ID NO: 8474503 - DNA, 22 bp, Homo sapiens
aatacagatattcagtggtact

SEQ ID NO: 8474504 - DNA, 22 bp, Homo sapiens
aaaatttccaccatctttgtgt

SEQ ID NO: 8474505 - DNA, 22 bp, Homo sapiens
aaaacatgtccatacagaaact

SEQ ID NO: 8474506 - DNA, 19 bp, Homo sapiens
aaaaggaatattctttggg

SEQ ID NO: 8474507 - DNA, 22 bp, Homo sapiens
aaaagtgttcaggaagaataat

SEQ ID NO: 8474508 - DNA, 22 bp, Homo sapiens
aaaagtttaagactcattctag

SEQ ID NO: 8474509 - DNA, 22 bp, Homo sapiens
aaaagttacctctgtaatataa

SEQ ID NO: 8474510 - DNA, 22 bp, Homo sapiens
aacatgaaacccaaacagaata

SEQ ID NO: 8474511 - DNA, 22 bp, Homo sapiens
aaagttctctatggtgtaaaaa

SEQ ID NO: 8474512 - DNA, 23 bp, Homo sapiens
aaatattcttttttagtaagtgc

SEQ ID NO: 8474513 - DNA, 20 bp, Homo sapiens
acagcagataccacaactat

SEQ ID NO: 8474514 - DNA, 22 bp, Homo sapiens
actgtacacacttctctgtctt

SEQ ID NO: 8474515 - DNA, 22 bp, Homo sapiens
actgtacaaatattgcaaaata

SEQ ID NO: 8474516 - DNA, 22 bp, Homo sapiens
actgtacaactgctgagcagaa

SEQ ID NO: 8474517 - DNA, 22 bp, Homo sapiens
actgtacaacctctgcccctgt

SEQ ID NO: 8474518 - DNA, 22 bp, Homo sapiens
actgtacacattcgtcaagact

SEQ ID NO: 8474519 - DNA, 22 bp, Homo sapiens
actgtacacagtggtgtactgt

SEQ ID NO: 8474520 - DNA, 22 bp, Homo sapiens
actgtacatatggattctaaga

SEQ ID NO: 8474521 - DNA, 22 bp, Homo sapiens
actgtacacgtgtcatttacag

SEQ ID NO: 8474522 - DNA, 22 bp, Homo sapiens
actgtacatgcatcttgtctat

SEQ ID NO: 8474523 - DNA, 22 bp, Homo sapiens
actgtccataatattggtgaac

SEQ ID NO: 8474524 - DNA, 22 bp, Homo sapiens
actgaaaatgaattagaaacag

SEQ ID NO: 8474525 - DNA, 22 bp, Homo sapiens
aagtgtttccgggagacttggt

SEQ ID NO: 8474526 - DNA, 22 bp, Homo sapiens
acttttatgataatcaatgttc

SEQ ID NO: 8474527 - DNA, 22 bp, Homo sapiens
agaactggtggtgatcagttat

SEQ ID NO: 8474528 - DNA, 22 bp, Homo sapiens
taggaaaagcacaggatgttct

SEQ ID NO: 8474529 - DNA, 22 bp, Homo sapiens
taggaaaagtctagattgatga

SEQ ID NO: 8474530 - DNA, 22 bp, Homo sapiens
taggaaaaatacagaattatat

SEQ ID NO: 8474531 - DNA, 22 bp, Homo sapiens
tatttctattccccaggcaagt

SEQ ID NO: 8474532 - DNA, 22 bp, Homo sapiens
tattgaaatccattacgttctt

SEQ ID NO: 8474533 - DNA, 22 bp, Homo sapiens
tattgaaatccattacgttctt

SEQ ID NO: 8474534 - DNA, 22 bp, Homo sapiens
tattgaaattcttcatgtcctc

SEQ ID NO: 8474535 - DNA, 22 bp, Homo sapiens
tatccaattcaccattgatggg

SEQ ID NO: 8474536 - DNA, 22 bp, Homo sapiens
tacaaaaaattgatactgacga

SEQ ID NO: 8474537 - DNA, 22 bp, Homo sapiens
gttcaagttcatatctcttaac

SEQ ID NO: 8474538 - DNA, 22 bp, Homo sapiens
gttgaggtgatgccagccctgc

SEQ ID NO: 8474539 - DNA, 22 bp, Homo sapiens
gttaataaaggtatagaatcag

SEQ ID NO: 8474540 - DNA, 22 bp, Homo sapiens
taaacaagctgtctgatattct

SEQ ID NO: 8474541 - DNA, 22 bp, Homo sapiens
taaacaagggttactgagcatg

SEQ ID NO: 8474542 - DNA, 22 bp, Homo sapiens
tccatctgtttactataaagat

SEQ ID NO: 8474543 - DNA, 22 bp, Homo sapiens
tccagctcagggttggctcaag

SEQ ID NO: 8474544 - DNA, 22 bp, Homo sapiens
tccagctggggcagtggctggg

SEQ ID NO: 8474545 - DNA, 22 bp, Homo sapiens
tccagctggggacatgggcttc

SEQ ID NO: 8474546 - DNA, 22 bp, Homo sapiens
tcaagtcttgatgagacaaacc

SEQ ID NO: 8474547 - DNA, 22 bp, Homo sapiens
tcaagtctggagatctggaact

SEQ ID NO: 8474548 - DNA, 22 bp, Homo sapiens
tcacaagatacagttagaagca

SEQ ID NO: 8474549 - DNA, 22 bp, Homo sapiens
tcagtcttccctccagtgcaac

SEQ ID NO: 8474550 - DNA, 22 bp, Homo sapiens
gccagcctgtgcttggccaggc

SEQ ID NO: 8474551 - DNA, 22 bp, Homo sapiens
gcggtagctcaagcttgtaatc

SEQ ID NO: 8474552 - DNA, 22 bp, Homo sapiens
ggtctcagctggagtccttggt

SEQ ID NO: 8474553 - DNA, 22 bp, Homo sapiens
gtccaagagtcaagaagggggc

SEQ ID NO: 8474554 - DNA, 22 bp, Homo sapiens
ggtttggttttggccatcttcc

SEQ ID NO: 8474555 - DNA, 22 bp, Homo sapiens
ggcaggaggaagagttagcacc

SEQ ID NO: 8474556 - DNA, 22 bp, Homo sapiens
ggcagaggtagctggaaccagg

SEQ ID NO: 8474557 - DNA, 22 bp, Homo sapiens
ggcagaggaaggatgaattcac

SEQ ID NO: 8474558 - DNA, 22 bp, Homo sapiens
ggcagaggaggggtgaatttgc

SEQ ID NO: 8474559 - DNA, 19 bp, Homo sapiens
ggctctggcggctgtagcc

SEQ ID NO: 8474560 - DNA, 22 bp, Homo sapiens
gaccctgtttctacaaataatt

SEQ ID NO: 8474561 - DNA, 22 bp, Homo sapiens
gacaagacacctctctccatcc

SEQ ID NO: 8474562 - DNA, 17 bp, Homo sapiens
gacaagacagaattcat

SEQ ID NO: 8474563 - DNA, 22 bp, Homo sapiens
gacaagacagcttgcagacaac

SEQ ID NO: 8474564 - DNA, 22 bp, Homo sapiens
gacaagactatgtagaaagtat

SEQ ID NO: 8474565 - DNA, 22 bp, Homo sapiens
gacaagacatgtgatgacatca

SEQ ID NO: 8474566 - DNA, 22 bp, Homo sapiens
gacaagacattggtaaagatat

SEQ ID NO: 8474567 - DNA, 22 bp, Homo sapiens
gacaagactggtttatttaagg

SEQ ID NO: 8474568 - DNA, 22 bp, Homo sapiens
gaaatccagttccctactctta

SEQ ID NO: 8474569 - DNA, 22 bp, Homo sapiens
ctgttaattgtgaattttacat

SEQ ID NO: 8474570 - DNA, 22 bp, Homo sapiens
ctgtgtccttttagttgctgtg

SEQ ID NO: 8474571 - DNA, 22 bp, Homo sapiens
ctgtgtcctgcgtcaagccaat

SEQ ID NO: 8474572 - DNA, 22 bp, Homo sapiens
ctggcttttagtgtgaagactt

SEQ ID NO: 8474573 - DNA, 17 bp, Homo sapiens
cctgtcttgtttctgcc

SEQ ID NO: 8474574 - DNA, 21 bp, Homo sapiens
cctgtcttggactgaggcacc

SEQ ID NO: 8474575 - DNA, 20 bp, Homo sapiens
cctgtctggagacaaagaga

SEQ ID NO: 8474576 - DNA, 22 bp, Homo sapiens
ttcaagttcatgtgtagtcagt

SEQ ID NO: 8474577 - DNA, 22 bp, Homo sapiens
ttcatcttgatggcttcctaat

SEQ ID NO: 8474578 - DNA, 22 bp, Homo sapiens
ctattaaacactactgtgcact

SEQ ID NO: 8474579 - DNA, 22 bp, Homo sapiens
ctattacaattctgcaaggagt

SEQ ID NO: 8474580 - DNA, 22 bp, Homo sapiens
ctacagcagagctacactaact

SEQ ID NO: 8474581 - DNA, 22 bp, Homo sapiens
ctacaggtatgtgcatgacatc

SEQ ID NO: 8474582 - DNA, 22 bp, Homo sapiens
ctacaggtcagtaagacctaga

SEQ ID NO: 8474583 - DNA, 22 bp, Homo sapiens
ttttcagaaagatgagaaatta

SEQ ID NO: 8474584 - DNA, 22 bp, Homo sapiens
ttttagacttgtatgtaaagcc

SEQ ID NO: 8474585 - DNA, 22 bp, Homo sapiens
ttgtctgtcccagcttgtgcat

SEQ ID NO: 8474586 - DNA, 22 bp, Homo sapiens
ttgtcttttgtgggaaatatgg

SEQ ID NO: 8474587 - DNA, 22 bp, Homo sapiens
ttgtctttggaaatttaatgtt

SEQ ID NO: 8474588 - DNA, 22 bp, Homo sapiens
ctcccactcctggctcaccaca

SEQ ID NO: 8474589 - DNA, 22 bp, Homo sapiens
tttccactgtagagatgttgaa

SEQ ID NO: 8474590 - DNA, 22 bp, Homo sapiens
taatccaaaactgaatctgtgg

SEQ ID NO: 8474591 - DNA, 22 bp, Homo sapiens
taatccaatggcacaatgtatg

SEQ ID NO: 8474592 - DNA, 22 bp, Homo sapiens
taatcacagaaacagactgttt

SEQ ID NO: 8474593 - DNA, 22 bp, Homo sapiens
cagtattttcaggatttggaag

SEQ ID NO: 8474594 - DNA, 22 bp, Homo sapiens
tccatattaactaaaactagaa

SEQ ID NO: 8474595 - DNA, 22 bp, Homo sapiens
tccattttagagatgaagaaac

SEQ ID NO: 8474596 - DNA, 22 bp, Homo sapiens
tctaatcctatggtggggaggg

SEQ ID NO: 8474597 - DNA, 22 bp, Homo sapiens
catctgctgttccttggactca

SEQ ID NO: 8474598 - DNA, 22 bp, Homo sapiens
tggcctggggacctgtgagacc

SEQ ID NO: 8474599 - DNA, 22 bp, Homo sapiens
tggcctggctgccctgtctgga

SEQ ID NO: 8474600 - DNA, 22 bp, Homo sapiens
tggcctgggcctgccggtgcaa

SEQ ID NO: 8474601 - DNA, 22 bp, Homo sapiens
tggcctggggaagaccatgggc

SEQ ID NO: 8474602 - DNA, 22 bp, Homo sapiens
ccaggtggaaggtctgtgctct

SEQ ID NO: 8474603 - DNA, 22 bp, Homo sapiens
tgagacagttctgcagctgggt

SEQ ID NO: 8474604 - DNA, 22 bp, Homo sapiens
ccagtcctggccagtaacatga

SEQ ID NO: 8474605 - DNA, 20 bp, Homo sapiens
ccagtccctgagcaccaggg

SEQ ID NO: 8474606 - DNA, 22 bp, Homo sapiens
ccagtcccgcatggtccagaat

SEQ ID NO: 8474607 - DNA, 22 bp, Homo sapiens
tttgttcactgagcaatgatta

SEQ ID NO: 8474608 - DNA, 20 bp, Homo sapiens
ttttatatgtagggtatatg

SEQ ID NO: 8474609 - DNA, 22 bp, Homo sapiens
ttttatcagcagggataacaag

SEQ ID NO: 8474610 - DNA, 22 bp, Homo sapiens
ttttgatatcatgatgaacaga

SEQ ID NO: 8474611 - DNA, 22 bp, Homo sapiens
tttctatttacagtgctaggta

SEQ ID NO: 8474612 - DNA, 22 bp, Homo sapiens
tttctccaatgtatcagcacac

SEQ ID NO: 8474613 - DNA, 22 bp, Homo sapiens
tttctacattcaaaaactacca

SEQ ID NO: 8474614 - DNA, 22 bp, Homo sapiens
tttctacatttgtaaccagatt

SEQ ID NO: 8474615 - DNA, 22 bp, Homo sapiens
tttcattgtcaataaactgtat

SEQ ID NO: 8474616 - DNA, 20 bp, Homo sapiens
tttcattgtcagaatcttat

SEQ ID NO: 8474617 - DNA, 22 bp, Homo sapiens
tttaccatcctcttttagaatt

SEQ ID NO: 8474618 - DNA, 21 bp, Homo sapiens
tttattaacaactgtggacgt

SEQ ID NO: 8474619 - DNA, 22 bp, Homo sapiens
ttctagttttgccttatcaaca

SEQ ID NO: 8474620 - DNA, 22 bp, Homo sapiens
ttctagttaaagtatgtattag

SEQ ID NO: 8474621 - DNA, 22 bp, Homo sapiens
ttctagtgtccttggacttgct

SEQ ID NO: 8474622 - DNA, 22 bp, Homo sapiens
ttctagttttcagtccaccagg

SEQ ID NO: 8474623 - DNA, 22 bp, Homo sapiens
ttctagttccctctggaatgta

SEQ ID NO: 8474624 - DNA, 22 bp, Homo sapiens
ttctagttcccacatagttgcc

SEQ ID NO: 8474625 - DNA, 22 bp, Homo sapiens
ttctagttcatattctcaaaga

SEQ ID NO: 8474626 - DNA, 22 bp, Homo sapiens
ttctagtttagggctcttcaac

SEQ ID NO: 8474627 - DNA, 22 bp, Homo sapiens
ttctagttgagggagacaaata

SEQ ID NO: 8474628 - DNA, 22 bp, Homo sapiens
ttgagatgggctttatgttcag

SEQ ID NO: 8474629 - DNA, 22 bp, Homo sapiens
ttcagtctcctcattttacaaa

SEQ ID NO: 8474630 - DNA, 22 bp, Homo sapiens
ttcaggaggtgagcaagaaggg

SEQ ID NO: 8474631 - DNA, 22 bp, Homo sapiens
ttcaggagaattccaagaagta

SEQ ID NO: 8474632 - DNA, 22 bp, Homo sapiens
ttcaggagaaagttcagtactt

SEQ ID NO: 8474633 - DNA, 22 bp, Homo sapiens
ttctaattgtgtttgcatatct

SEQ ID NO: 8474634 - DNA, 22 bp, Homo sapiens
ttctacactcacccagctgtaa

SEQ ID NO: 8474635 - DNA, 22 bp, Homo sapiens
ttctactttggacataaaggac

SEQ ID NO: 8474636 - DNA, 22 bp, Homo sapiens
ttctactttagcatgctcattc

SEQ ID NO: 8474637 - DNA, 22 bp, Homo sapiens
tgttttctgtgtagagatcaca

SEQ ID NO: 8474638 - DNA, 22 bp, Homo sapiens
ttaataaacaggtgcagctgaa

SEQ ID NO: 8474639 - DNA, 22 bp, Homo sapiens
cagaatgttaccagttagtctg

SEQ ID NO: 8474640 - DNA, 22 bp, Homo sapiens
ggcagaggtgacagtgtctttt

SEQ ID NO: 8474641 - DNA, 22 bp, Homo sapiens
cacttggaggccccctgtgccc

SEQ ID NO: 8474642 - DNA, 22 bp, Homo sapiens
cacttggaggaaggcctattca

SEQ ID NO: 8474643 - DNA, 22 bp, Homo sapiens
cactgtactgggttgaaggacg

SEQ ID NO: 8474644 - DNA, 22 bp, Homo sapiens
cactgtactgtgaataaggagg

SEQ ID NO: 8474645 - DNA, 22 bp, Homo sapiens
cactgtacccatttaaataaat

SEQ ID NO: 8474646 - DNA, 22 bp, Homo sapiens
cactgtacagcattaacaaggc

SEQ ID NO: 8474647 - DNA, 22 bp, Homo sapiens
caatagtaaattacggaggaga

SEQ ID NO: 8474648 - DNA, 22 bp, Homo sapiens
atggcagaattaggatttcaag

SEQ ID NO: 8474649 - DNA, 22 bp, Homo sapiens
atgcagtactgatacatgccac

SEQ ID NO: 8474650 - DNA, 22 bp, Homo sapiens
atgcagtagataggcactttta

SEQ ID NO: 8474651 - DNA, 22 bp, Homo sapiens
atgcagtataaatcatttctgg

SEQ ID NO: 8474652 - DNA, 23 bp, Homo sapiens
atgcagtatatgtcagtagttta

SEQ ID NO: 8474653 - DNA, 22 bp, Homo sapiens
atgcagtaaatgttctagtttg

SEQ ID NO: 8474654 - DNA, 22 bp, Homo sapiens
atgcagtacagataattctaca

SEQ ID NO: 8474655 - DNA, 22 bp, Homo sapiens
atgcagtacatacaaacactga

SEQ ID NO: 8474656 - DNA, 22 bp, Homo sapiens
atgcagtaaaataggaggtaat

SEQ ID NO: 8474657 - DNA, 22 bp, Homo sapiens
atgcagtaaatgttaagaaaaa

SEQ ID NO: 8474658 - DNA, 22 bp, Homo sapiens
ctttggaaaaatacctggcata

SEQ ID NO: 8474659 - DNA, 22 bp, Homo sapiens
atctggaatccttgtggacaat

SEQ ID NO: 8474660 - DNA, 22 bp, Homo sapiens
attaagactgcccatgttttta

SEQ ID NO: 8474661 - DNA, 22 bp, Homo sapiens
attgtacagatgaggtaagtga

SEQ ID NO: 8474662 - DNA, 22 bp, Homo sapiens
caaagactgcataacacatgaa

SEQ ID NO: 8474663 - DNA, 22 bp, Homo sapiens
caaaagaagctcttggggctag

SEQ ID NO: 8474664 - DNA, 22 bp, Homo sapiens
attttagatttaagaataaggt

SEQ ID NO: 8474665 - DNA, 22 bp, Homo sapiens
ccagcttttcttatcattataa

SEQ ID NO: 8474666 - DNA, 20 bp, Homo sapiens
agggcagagggattacaggc

SEQ ID NO: 8474667 - DNA, 22 bp, Homo sapiens
agggaaattaatgtgagcaatg

SEQ ID NO: 8474668 - DNA, 22 bp, Homo sapiens
catgtacattctgtagatggag

SEQ ID NO: 8474669 - DNA, 22 bp, Homo sapiens
aggacctgagagttggaaatcc

SEQ ID NO: 8474670 - DNA, 22 bp, Homo sapiens
cagctgagaagtgatagctgca

SEQ ID NO: 8474671 - DNA, 22 bp, Homo sapiens
ctacaagatttttaaaactgta

SEQ ID NO: 8474672 - DNA, 23 bp, Homo sapiens
ctacaagagcaagcatggacaag

SEQ ID NO: 8474673 - DNA, 22 bp, Homo sapiens
ctacagaaaatcagccacaggc

SEQ ID NO: 8474674 - DNA, 22 bp, Homo sapiens
agtctcttggcattctgaaaca

SEQ ID NO: 8474675 - DNA, 22 bp, Homo sapiens
ctcaggagttggaggctacagt

SEQ ID NO: 8474676 - DNA, 22 bp, Homo sapiens
atctggaacaaagcttaggaat

SEQ ID NO: 8474677 - DNA, 21 bp, Homo sapiens
atctggaagaactggtaagtg

SEQ ID NO: 8474678 - DNA, 17 bp, Homo sapiens
atctggaagctagctga

SEQ ID NO: 8474679 - DNA, 22 bp, Homo sapiens
atctggaagccagatactcagt

SEQ ID NO: 8474680 - DNA, 22 bp, Homo sapiens
ctgtgtcccacacgaggtgtat

SEQ ID NO: 8474681 - DNA, 22 bp, Homo sapiens
ctgttatttagaacatggaatc

SEQ ID NO: 8474682 - DNA, 22 bp, Homo sapiens
ctgggcctggggctgttgagag

SEQ ID NO: 8474683 - DNA, 22 bp, Homo sapiens
ctgtaatcccagctactcggga

SEQ ID NO: 8474684 - DNA, 22 bp, Homo sapiens
agtttctatgtaagctacgtga

SEQ ID NO: 8474685 - DNA, 22 bp, Homo sapiens
agtttctagcctcactgtttag

SEQ ID NO: 8474686 - DNA, 22 bp, Homo sapiens
agtttctattttcatgtctgtt

SEQ ID NO: 8474687 - DNA, 22 bp, Homo sapiens
agtttctgttaccatatttgac

SEQ ID NO: 8474688 - DNA, 22 bp, Homo sapiens
ataatttaaattagtatgtgat

SEQ ID NO: 8474689 - DNA, 22 bp, Homo sapiens
ataatttaattttcacagtggt

SEQ ID NO: 8474690 - DNA, 22 bp, Homo sapiens
ataatttacaactgcttttaat

SEQ ID NO: 8474691 - DNA, 20 bp, Homo sapiens
ataatttaccctgcaccact

SEQ ID NO: 8474692 - DNA, 22 bp, Homo sapiens
acatttctttctattcagtagc

SEQ ID NO: 8474693 - DNA, 22 bp, Homo sapiens
acatttctttgctagacagcag

SEQ ID NO: 8474694 - DNA, 22 bp, Homo sapiens
acatttcttttcatctctatat

SEQ ID NO: 8474695 - DNA, 22 bp, Homo sapiens
acatttctcttgatgtctctat

SEQ ID NO: 8474696 - DNA, 22 bp, Homo sapiens
acatttctcttagagttggact

SEQ ID NO: 8474697 - DNA, 18 bp, Homo sapiens
acatttctatgcttctgg

SEQ ID NO: 8474698 - DNA, 22 bp, Homo sapiens
acatttctcagggagttttgct

SEQ ID NO: 8474699 - DNA, 18 bp, Homo sapiens
acatttctaggtgaaagc

SEQ ID NO: 8474700 - DNA, 22 bp, Homo sapiens
acatttctaatttaatgtaaca

SEQ ID NO: 8474701 - DNA, 22 bp, Homo sapiens
acatttctagttgttcatctcc

SEQ ID NO: 8474702 - DNA, 22 bp, Homo sapiens
acattgtataatgattatcaca

SEQ ID NO: 8474703 - DNA, 22 bp, Homo sapiens
acatcacagagcccagataaag

SEQ ID NO: 8474704 - DNA, 22 bp, Homo sapiens
acagttcccgtcttgcacagct

SEQ ID NO: 8474705 - DNA, 22 bp, Homo sapiens
acagtcctgtacaggccatatc

SEQ ID NO: 8474706 - DNA, 18 bp, Homo sapiens
acagtaaagaaaggaatt

SEQ ID NO: 8474707 - DNA, 23 bp, Homo sapiens
agaaaagttcatacctttttaac

SEQ ID NO: 8474708 - DNA, 22 bp, Homo sapiens
ataaaaactgacccatcctttg

SEQ ID NO: 8474709 - DNA, 22 bp, Homo sapiens
actgtataaggcataggtaagc

SEQ ID NO: 8474710 - DNA, 22 bp, Homo sapiens
actgtacttttcttggctagat

SEQ ID NO: 8474711 - DNA, 22 bp, Homo sapiens
actgtaaccagtgtggtgagag

SEQ ID NO: 8474712 - DNA, 22 bp, Homo sapiens
actgtacatgtaaacattgtca

SEQ ID NO: 8474713 - DNA, 22 bp, Homo sapiens
atactgtatcacttgtgagtga

SEQ ID NO: 8474714 - DNA, 19 bp, Homo sapiens
agtcccaggcccgaaagag

SEQ ID NO: 8474715 - DNA, 21 bp, Homo sapiens
agtcccaggggtgagtgatgt

SEQ ID NO: 8474716 - DNA, 22 bp, Homo sapiens
agtcccagtgacttggccagaa

SEQ ID NO: 8474717 - DNA, 22 bp, Homo sapiens
agtcccagcttcccccatgcag

SEQ ID NO: 8474718 - DNA, 22 bp, Homo sapiens
agtcccaggcagccgagccggt

SEQ ID NO: 8474719 - DNA, 22 bp, Homo sapiens
agtcccagttcggttcttcctc

SEQ ID NO: 8474720 - DNA, 22 bp, Homo sapiens
agtcccagtgagatgagccacg

SEQ ID NO: 8474721 - DNA, 22 bp, Homo sapiens
agtcccagtgagatgaaccagg

SEQ ID NO: 8474722 - DNA, 22 bp, Homo sapiens
agtgcaatgtgtacagaaaaat

SEQ ID NO: 8474723 - DNA, 20 bp, Homo sapiens
actggacactgaggtgagct

SEQ ID NO: 8474724 - DNA, 22 bp, Homo sapiens
actgcagactctacagttataa

SEQ ID NO: 8474725 - DNA, 22 bp, Homo sapiens
agtcccagctctgccacttact

SEQ ID NO: 8474726 - DNA, 22 bp, Homo sapiens
agtcccagctcagaaccactag

SEQ ID NO: 8474727 - DNA, 23 bp, Homo sapiens
cagaggcatcggattcaacatca

SEQ ID NO: 8474728 - DNA, 21 bp, Homo sapiens
cacaagacacatagggtgttt

SEQ ID NO: 8474729 - DNA, 22 bp, Homo sapiens
cacaagacttatttgtgtagaa

SEQ ID NO: 8474730 - DNA, 22 bp, Homo sapiens
cacagtcctacagagatcagag

SEQ ID NO: 8474731 - DNA, 22 bp, Homo sapiens
cacctgagcactggggccgccc

SEQ ID NO: 8474732 - DNA, 22 bp, Homo sapiens
atgaaactgggataactatagc

SEQ ID NO: 8474733 - DNA, 22 bp, Homo sapiens
atggcctggccagagctctgct

SEQ ID NO: 8474734 - DNA, 20 bp, Homo sapiens
atggcctgctagaagtctgt

SEQ ID NO: 8474735 - DNA, 22 bp, Homo sapiens
atggcctggggagcatgggaag

SEQ ID NO: 8474736 - DNA, 22 bp, Homo sapiens
aagttctacagcttcgcaggca

SEQ ID NO: 8474737 - DNA, 22 bp, Homo sapiens
aataagaatttacttgtcaaga

SEQ ID NO: 8474738 - DNA, 22 bp, Homo sapiens
aataattttgagagcctggaaa

SEQ ID NO: 8474739 - DNA, 22 bp, Homo sapiens
aataattttagctcagagttgt

SEQ ID NO: 8474740 - DNA, 22 bp, Homo sapiens
aataatttccagccaactggaa

SEQ ID NO: 8474741 - DNA, 22 bp, Homo sapiens
actaagacctagatactagggg

SEQ ID NO: 8474742 - DNA, 22 bp, Homo sapiens
aagctttaaggaattttatgga

SEQ ID NO: 8474743 - DNA, 22 bp, Homo sapiens
acatgtgtggacatgaatctac

SEQ ID NO: 8474744 - DNA, 22 bp, Homo sapiens
aagtcaatcacatgcacactga

SEQ ID NO: 8474745 - DNA, 22 bp, Homo sapiens
aagtcaattagtaaacttggaa

SEQ ID NO: 8474746 - DNA, 21 bp, Homo sapiens
accatcttccatgcattatat

SEQ ID NO: 8474747 - DNA, 21 bp, Homo sapiens
accatcttccatgcattatat

SEQ ID NO: 8474748 - DNA, 22 bp, Homo sapiens
accatcttagtggccagctctc

SEQ ID NO: 8474749 - DNA, 22 bp, Homo sapiens
accatcttaaggggacttctta

SEQ ID NO: 8474750 - DNA, 22 bp, Homo sapiens
acagcaaaggacgaacactctg

SEQ ID NO: 8474751 - DNA, 22 bp, Homo sapiens
acactgtaaattgagtgcgtga

SEQ ID NO: 8474752 - DNA, 22 bp, Homo sapiens
acactgtagctgagggcatgcg

SEQ ID NO: 8474753 - DNA, 19 bp, Homo sapiens
acaaactgagtacacttgt

SEQ ID NO: 8474754 - DNA, 22 bp, Homo sapiens
aaaatccacaacgctcatttca

SEQ ID NO: 8474755 - DNA, 23 bp, Homo sapiens
aaaaaaccatgtaggcactcagt

SEQ ID NO: 8474756 - DNA, 22 bp, Homo sapiens
aaaaacctttcccatactaaga

SEQ ID NO: 8474757 - DNA, 22 bp, Homo sapiens
aaacagactgaagagttgaagc

SEQ ID NO: 8474758 - DNA, 22 bp, Homo sapiens
aaagttcagtgccttctataca

SEQ ID NO: 8474759 - DNA, 22 bp, Homo sapiens
aaagttcagtgccttctataca

SEQ ID NO: 8474760 - DNA, 22 bp, Homo sapiens
aaactagagcatgtgagtggga

SEQ ID NO: 8474761 - DNA, 22 bp, Homo sapiens
aaactgaaacatcatcatgttg

SEQ ID NO: 8474762 - DNA, 21 bp, Homo sapiens
aaactgaagagacaggaactt

SEQ ID NO: 8474763 - DNA, 22 bp, Homo sapiens
aaactctttccacgattacttt

SEQ ID NO: 8474764 - DNA, 22 bp, Homo sapiens
aaactcttcctttctttaaagt

SEQ ID NO: 8474765 - DNA, 22 bp, Homo sapiens
aaatgcagattgtcattcagga

SEQ ID NO: 8474766 - DNA, 22 bp, Homo sapiens
aaattttctctctaagacttaa

SEQ ID NO: 8474767 - DNA, 22 bp, Homo sapiens
aaagtcaatgatttctcctgga

SEQ ID NO: 8474768 - DNA, 22 bp, Homo sapiens
aaagtcaaaatgctctcctgtc

SEQ ID NO: 8474769 - DNA, 22 bp, Homo sapiens
aaatgcaggttcttgagccaag

SEQ ID NO: 8474770 - DNA, 22 bp, Homo sapiens
aaataattatagcgagtctatc

SEQ ID NO: 8474771 - DNA, 22 bp, Homo sapiens
aaataattgagttggtcaatat

SEQ ID NO: 8474772 - DNA, 22 bp, Homo sapiens
aaattctatgtcaatgtttatt

SEQ ID NO: 8474773 - DNA, 22 bp, Homo sapiens
aaatgttcctttggattaaact

SEQ ID NO: 8474774 - DNA, 22 bp, Homo sapiens
aaatgttctactttgataatta

SEQ ID NO: 8474775 - DNA, 22 bp, Homo sapiens
aaatgttccattattgtgtaat

SEQ ID NO: 8474776 - DNA, 22 bp, Homo sapiens
aaatgttcccaatatgaagctg

SEQ ID NO: 8474777 - DNA, 22 bp, Homo sapiens
aactgttcttcattttcagtat

SEQ ID NO: 8474778 - DNA, 22 bp, Homo sapiens
aagatttaccactttattcaag

SEQ ID NO: 8474779 - DNA, 22 bp, Homo sapiens
aagagctgtgggtggtagtcct

SEQ ID NO: 8474780 - DNA, 21 bp, Homo sapiens
ggctgtggagccatgactcac

SEQ ID NO: 8474781 - DNA, 22 bp, Homo sapiens
gtgagctgggtgaatggtaggg

SEQ ID NO: 8474782 - DNA, 22 bp, Homo sapiens
gtccagctgatcttgacccagc

SEQ ID NO: 8474783 - DNA, 22 bp, Homo sapiens
gtacaaaagttattgcggtttt

SEQ ID NO: 8474784 - DNA, 22 bp, Homo sapiens
ggttcagtttacattaaaatct

SEQ ID NO: 8474785 - DNA, 22 bp, Homo sapiens
ggttccacctggcgaggggtat

SEQ ID NO: 8474786 - DNA, 17 bp, Homo sapiens
ggttcagttctgcattc

SEQ ID NO: 8474787 - DNA, 22 bp, Homo sapiens
gctgtacatttgtgtacacttg

SEQ ID NO: 8474788 - DNA, 22 bp, Homo sapiens
gctgtacattctgcacaggccc

SEQ ID NO: 8474789 - DNA, 22 bp, Homo sapiens
gctgtacattctgtgggtttgg

SEQ ID NO: 8474790 - DNA, 22 bp, Homo sapiens
gctgtacatcacaatttgctgt

SEQ ID NO: 8474791 - DNA, 22 bp, Homo sapiens
gctgtacagtttactaggtggg

SEQ ID NO: 8474792 - DNA, 19 bp, Homo sapiens
gctgtacagtaaggagaca

SEQ ID NO: 8474793 - DNA, 23 bp, Homo sapiens
gctgtacaggaaccagtttggag

SEQ ID NO: 8474794 - DNA, 22 bp, Homo sapiens
gctgtacagggttatcctttcc

SEQ ID NO: 8474795 - DNA, 19 bp, Homo sapiens
gctttagtttactcatcta

SEQ ID NO: 8474796 - DNA, 22 bp, Homo sapiens
gcttttatttcttcacaaaagt

SEQ ID NO: 8474797 - DNA, 22 bp, Homo sapiens
gcttttattgtctttacgacga

SEQ ID NO: 8474798 - DNA, 22 bp, Homo sapiens
gctttaaatggcttgcccaagt

SEQ ID NO: 8474799 - DNA, 22 bp, Homo sapiens
gctttaaacctctactctgtcc

SEQ ID NO: 8474800 - DNA, 22 bp, Homo sapiens
ggagctgtaacgagccattgct

SEQ ID NO: 8474801 - DNA, 22 bp, Homo sapiens
ggagctgttgcgcatgcgctcg

SEQ ID NO: 8474802 - DNA, 22 bp, Homo sapiens
gtttcttttgtgatcaccaacc

SEQ ID NO: 8474803 - DNA, 22 bp, Homo sapiens
gttatatatagtatttctctga

SEQ ID NO: 8474804 - DNA, 22 bp, Homo sapiens
taaaactgaatacatactgagg

SEQ ID NO: 8474805 - DNA, 22 bp, Homo sapiens
taaaactgcttggtatggtcta

SEQ ID NO: 8474806 - DNA, 21 bp, Homo sapiens
taaaactgtaactttgtcctg

SEQ ID NO: 8474807 - DNA, 22 bp, Homo sapiens
taagacaattcttcagtcacaa

SEQ ID NO: 8474808 - DNA, 22 bp, Homo sapiens
taacagctctgtgtggctgtaa

SEQ ID NO: 8474809 - DNA, 22 bp, Homo sapiens
taacagctggcgttataggaat

SEQ ID NO: 8474810 - DNA, 22 bp, Homo sapiens
tactgtactcaacatgtgagtt

SEQ ID NO: 8474811 - DNA, 22 bp, Homo sapiens
tactgtactgtcttttttgctg

SEQ ID NO: 8474812 - DNA, 22 bp, Homo sapiens
tactgtactgcagttctgcaaa

SEQ ID NO: 8474813 - DNA, 22 bp, Homo sapiens
tactgtacattccgtttgttgc

SEQ ID NO: 8474814 - DNA, 22 bp, Homo sapiens
taccactacatttgctaatggc

SEQ ID NO: 8474815 - DNA, 20 bp, Homo sapiens
tacagtcagggcacaggcag

SEQ ID NO: 8474816 - DNA, 22 bp, Homo sapiens
tacaagatgacaggtgcatgat

SEQ ID NO: 8474817 - DNA, 22 bp, Homo sapiens
tacaagacgagggaagttcttt

SEQ ID NO: 8474818 - DNA, 21 bp, Homo sapiens
tacaagaccggattcgggccc

SEQ ID NO: 8474819 - DNA, 22 bp, Homo sapiens
taaggaaagtacatgttttgac

SEQ ID NO: 8474820 - DNA, 22 bp, Homo sapiens
taaggaaacaacttgtattttt

SEQ ID NO: 8474821 - DNA, 22 bp, Homo sapiens
taaggaaagtgccatgatttct

SEQ ID NO: 8474822 - DNA, 22 bp, Homo sapiens
tattttctggacagtcttgctt

SEQ ID NO: 8474823 - DNA, 22 bp, Homo sapiens
tattttctgtggaggaccagat

SEQ ID NO: 8474824 - DNA, 22 bp, Homo sapiens
tatggaaagtgttttcttctgt

SEQ ID NO: 8474825 - DNA, 22 bp, Homo sapiens
tcaggagacttatgtcacagtg

SEQ ID NO: 8474826 - DNA, 22 bp, Homo sapiens
tcatgaaaatagatcagaaatt

SEQ ID NO: 8474827 - DNA, 22 bp, Homo sapiens
tcagtctcctttcctctagaca

SEQ ID NO: 8474828 - DNA, 22 bp, Homo sapiens
tcatttctatctatgcagcttc

SEQ ID NO: 8474829 - DNA, 22 bp, Homo sapiens
tcatttctctgagtctgataat

SEQ ID NO: 8474830 - DNA, 22 bp, Homo sapiens
tcatttctccgacctgctgtcc

SEQ ID NO: 8474831 - DNA, 22 bp, Homo sapiens
tcatttctattgctactgtctg

SEQ ID NO: 8474832 - DNA, 20 bp, Homo sapiens
tcatttcttggggttccaag

SEQ ID NO: 8474833 - DNA, 22 bp, Homo sapiens
tccaataacatctaaaaactta

SEQ ID NO: 8474834 - DNA, 22 bp, Homo sapiens
tcagaatgaaatttctttcaga

SEQ ID NO: 8474835 - DNA, 22 bp, Homo sapiens
tcccagagaagagctggatgga

SEQ ID NO: 8474836 - DNA, 22 bp, Homo sapiens
tcccagagcagatgtgctaaag

SEQ ID NO: 8474837 - DNA, 22 bp, Homo sapiens
tcccagagcagtactccaggag

SEQ ID NO: 8474838 - DNA, 22 bp, Homo sapiens
tcccagagatttcctctccttc

SEQ ID NO: 8474839 - DNA, 22 bp, Homo sapiens
tcccagagacagagcctcctcc

SEQ ID NO: 8474840 - DNA, 22 bp, Homo sapiens
tcccagagacatcatttctccg

SEQ ID NO: 8474841 - DNA, 22 bp, Homo sapiens
tcccagaggtctctgctggttc

SEQ ID NO: 8474842 - DNA, 22 bp, Homo sapiens
tcccagaggttgagtcacttat

SEQ ID NO: 8474843 - DNA, 22 bp, Homo sapiens
tcccagaggctccagtctctat

SEQ ID NO: 8474844 - DNA, 22 bp, Homo sapiens
tcccagagccaagctatggatg

SEQ ID NO: 8474845 - DNA, 22 bp, Homo sapiens
tcccagaggcagttggtaactt

SEQ ID NO: 8474846 - DNA, 22 bp, Homo sapiens
tcccagaggactgttggtgcta

SEQ ID NO: 8474847 - DNA, 22 bp, Homo sapiens
gagatttccatattttgtaaca

SEQ ID NO: 8474848 - DNA, 22 bp, Homo sapiens
gacaaaacacattagtttaaaa

SEQ ID NO: 8474849 - DNA, 22 bp, Homo sapiens
gaatgtttttataagtgttaca

SEQ ID NO: 8474850 - DNA, 22 bp, Homo sapiens
gaatgtttttaggaatgttatg

SEQ ID NO: 8474851 - DNA, 22 bp, Homo sapiens
ctgtgacagagcttgagtgaga

SEQ ID NO: 8474852 - DNA, 22 bp, Homo sapiens
ctgtcccctgtgctttcacttg

SEQ ID NO: 8474853 - DNA, 22 bp, Homo sapiens
ctggttcaagtcctggctctgt

SEQ ID NO: 8474854 - DNA, 22 bp, Homo sapiens
ctggttccaggatggatctttc

SEQ ID NO: 8474855 - DNA, 22 bp, Homo sapiens
ctgggcctcaccctagaccaat

SEQ ID NO: 8474856 - DNA, 22 bp, Homo sapiens
ctttggaacatactgctgagct

SEQ ID NO: 8474857 - DNA, 22 bp, Homo sapiens
ctttggaataatttcctggagt

SEQ ID NO: 8474858 - DNA, 22 bp, Homo sapiens
gaaacttttaaacctcatgagt

SEQ ID NO: 8474859 - DNA, 22 bp, Homo sapiens
gaaaaagtgaccttggtagcta

SEQ ID NO: 8474860 - DNA, 22 bp, Homo sapiens
gaagaactgtgacagaagcagt

SEQ ID NO: 8474861 - DNA, 23 bp, Homo sapiens
gaaatgtttcttgattaatccta

SEQ ID NO: 8474862 - DNA, 22 bp, Homo sapiens
gaaatgttatgagatatgtact

SEQ ID NO: 8474863 - DNA, 22 bp, Homo sapiens
gaaatgttggacacttgaaatt

SEQ ID NO: 8474864 - DNA, 22 bp, Homo sapiens
gaaatgttgtcctgtctcttga

SEQ ID NO: 8474865 - DNA, 20 bp, Homo sapiens
gaaattctcgtattagttta

SEQ ID NO: 8474866 - DNA, 22 bp, Homo sapiens
gaaattcaggacaaagactctt

SEQ ID NO: 8474867 - DNA, 22 bp, Homo sapiens
gaaattcactgtatttcttggg

SEQ ID NO: 8474868 - DNA, 22 bp, Homo sapiens
gaaattgtcagcttctttcagt

SEQ ID NO: 8474869 - DNA, 22 bp, Homo sapiens
gaaagacatagttgcaagatgg

SEQ ID NO: 8474870 - DNA, 22 bp, Homo sapiens
ctcaggagacagtgtccacatg

SEQ ID NO: 8474871 - DNA, 22 bp, Homo sapiens
ctcaggagagtcttatatctcc

SEQ ID NO: 8474872 - DNA, 22 bp, Homo sapiens
ctcaggaggaggaagttcattg

SEQ ID NO: 8474873 - DNA, 22 bp, Homo sapiens
ctcaggagcttcctcagcccat

SEQ ID NO: 8474874 - DNA, 22 bp, Homo sapiens
ctcaggagatgacagaaggtat

SEQ ID NO: 8474875 - DNA, 22 bp, Homo sapiens
ctcaggaggccattctcaaggt

SEQ ID NO: 8474876 - DNA, 22 bp, Homo sapiens
ctcaggaggatgactgccttgg

SEQ ID NO: 8474877 - DNA, 22 bp, Homo sapiens
ctcaggaggtttcctgtctagg

SEQ ID NO: 8474878 - DNA, 22 bp, Homo sapiens
ctcaggaggtggtagaggccct

SEQ ID NO: 8474879 - DNA, 22 bp, Homo sapiens
ttatttattcattctgtctgtc

SEQ ID NO: 8474880 - DNA, 22 bp, Homo sapiens
ccttttctgtttcctgtcactg

SEQ ID NO: 8474881 - DNA, 22 bp, Homo sapiens
tttgttcattttgagctcatca

SEQ ID NO: 8474882 - DNA, 22 bp, Homo sapiens
tttgttcatgcctatattctca

SEQ ID NO: 8474883 - DNA, 21 bp, Homo sapiens
tttgttcaggggcaaagttaa

SEQ ID NO: 8474884 - DNA, 22 bp, Homo sapiens
tttctacatgtcaatccaaacc

SEQ ID NO: 8474885 - DNA, 22 bp, Homo sapiens
tttccactgggcacggggccag

SEQ ID NO: 8474886 - DNA, 22 bp, Homo sapiens
tttctacaggttgatgggtttg

SEQ ID NO: 8474887 - DNA, 22 bp, Homo sapiens
tttctacagtactgatttcata

SEQ ID NO: 8474888 - DNA, 22 bp, Homo sapiens
tttcagtttccagctttgtcat

SEQ ID NO: 8474889 - DNA, 22 bp, Homo sapiens
tgaaggaaatgacggcagaaga

SEQ ID NO: 8474890 - DNA, 22 bp, Homo sapiens
tgagctgggagtggtgatgagg

SEQ ID NO: 8474891 - DNA, 22 bp, Homo sapiens
tggctaacaaggtgaaaccccg

SEQ ID NO: 8474892 - DNA, 22 bp, Homo sapiens
ccggctactcgggaggctgacg

SEQ ID NO: 8474893 - DNA, 22 bp, Homo sapiens
tgtattccaaaatgctgaggat

SEQ ID NO: 8474894 - DNA, 22 bp, Homo sapiens
cctgcttaacattgccatgaca

SEQ ID NO: 8474895 - DNA, 22 bp, Homo sapiens
tgtaagtagtaatggaaggaca

SEQ ID NO: 8474896 - DNA, 21 bp, Homo sapiens
tcagctttgcaactgcacatc

SEQ ID NO: 8474897 - DNA, 22 bp, Homo sapiens
tcaggaaaatactgcttatcca

SEQ ID NO: 8474898 - DNA, 18 bp, Homo sapiens
cagtcccaaaccttagga

SEQ ID NO: 8474899 - DNA, 19 bp, Homo sapiens
cagtcccaaattcttgtca

SEQ ID NO: 8474900 - DNA, 22 bp, Homo sapiens
cagtcccaaggaggaagcagtc

SEQ ID NO: 8474901 - DNA, 22 bp, Homo sapiens
cagtcccactagtgccaatacc

SEQ ID NO: 8474902 - DNA, 22 bp, Homo sapiens
cagtcccaccaggatcgctctt

SEQ ID NO: 8474903 - DNA, 22 bp, Homo sapiens
cagtcccacaagatctccacaa

SEQ ID NO: 8474904 - DNA, 20 bp, Homo sapiens
cagtcccaatccagggccag

SEQ ID NO: 8474905 - DNA, 22 bp, Homo sapiens
cagtcccagaagagcctgggag

SEQ ID NO: 8474906 - DNA, 22 bp, Homo sapiens
cagtcccagacatagtaaggga

SEQ ID NO: 8474907 - DNA, 22 bp, Homo sapiens
catgaaaaatttactgttaaca

SEQ ID NO: 8474908 - DNA, 22 bp, Homo sapiens
tcccagagcctctgccactctg

SEQ ID NO: 8474909 - DNA, 22 bp, Homo sapiens
tcccagagctctgacaccagct

SEQ ID NO: 8474910 - DNA, 22 bp, Homo sapiens
tcccagagctctggaggttgga

SEQ ID NO: 8474911 - DNA, 22 bp, Homo sapiens
tcccagagctgataagccttta

SEQ ID NO: 8474912 - DNA, 22 bp, Homo sapiens
tcccagaggaaatggcagctga

SEQ ID NO: 8474913 - DNA, 22 bp, Homo sapiens
tcccagagcccaagttggagag

SEQ ID NO: 8474914 - DNA, 22 bp, Homo sapiens
tccctagtcgcatctgtggaga

SEQ ID NO: 8474915 - DNA, 22 bp, Homo sapiens
catttgtacagaacagctttat

SEQ ID NO: 8474916 - DNA, 22 bp, Homo sapiens
tctccactctgagtgcctttca

SEQ ID NO: 8474917 - DNA, 22 bp, Homo sapiens
ttttctgtgccctgctagctgg

SEQ ID NO: 8474918 - DNA, 22 bp, Homo sapiens
ttttctgtttgcttcaagacat

SEQ ID NO: 8474919 - DNA, 22 bp, Homo sapiens
ttttctgtttacagagggacct

SEQ ID NO: 8474920 - DNA, 22 bp, Homo sapiens
ttttctgtgtgtccctcgacag

SEQ ID NO: 8474921 - DNA, 22 bp, Homo sapiens
ttttctgttacaaagtacagcg

SEQ ID NO: 8474922 - DNA, 22 bp, Homo sapiens
ttttctgtgtatccaggcttcc

SEQ ID NO: 8474923 - DNA, 22 bp, Homo sapiens
ttttctgtaagaggactttaat

SEQ ID NO: 8474924 - DNA, 22 bp, Homo sapiens
ttttctgacctatctacattta

SEQ ID NO: 8474925 - DNA, 22 bp, Homo sapiens
ttgacaaaggaccttgctattt

SEQ ID NO: 8474926 - DNA, 23 bp, Homo sapiens
ttgcttagagacctcctcatcag

SEQ ID NO: 8474927 - DNA, 22 bp, Homo sapiens
tttaaataggactcctgggggt

SEQ ID NO: 8474928 - DNA, 22 bp, Homo sapiens
tttatatagagatttgtgcatg

SEQ ID NO: 8474929 - DNA, 22 bp, Homo sapiens
tttatctgaaaaaactcttgga

SEQ ID NO: 8474930 - DNA, 22 bp, Homo sapiens
ttatactaaaacgcattgaatt

SEQ ID NO: 8474931 - DNA, 22 bp, Homo sapiens
ttagctcagaaaatttaaactt

SEQ ID NO: 8474932 - DNA, 22 bp, Homo sapiens
ttattatagattatgcaagatt

SEQ ID NO: 8474933 - DNA, 22 bp, Homo sapiens
ttgaaatgatctatttcagtag

SEQ ID NO: 8474934 - DNA, 22 bp, Homo sapiens
ttgaaatgcatcatcatttaga

SEQ ID NO: 8474935 - DNA, 23 bp, Homo sapiens
ttcttatttactttggaatctcc

SEQ ID NO: 8474936 - DNA, 22 bp, Homo sapiens
ttctgtgtgctgtcttggcttt

SEQ ID NO: 8474937 - DNA, 22 bp, Homo sapiens
ttctgtgtgcttactggtgttc

SEQ ID NO: 8474938 - DNA, 22 bp, Homo sapiens
ttctgtctgatggtgccagaac

SEQ ID NO: 8474939 - DNA, 22 bp, Homo sapiens
ttctgtcttcccactgaggagc

SEQ ID NO: 8474940 - DNA, 22 bp, Homo sapiens
ttctgtgtcttcttgttctgtg

SEQ ID NO: 8474941 - DNA, 22 bp, Homo sapiens
ttctggaagtgttagaatctgg

SEQ ID NO: 8474942 - DNA, 22 bp, Homo sapiens
cagctcctattagacactgaat

SEQ ID NO: 8474943 - DNA, 20 bp, Homo sapiens
gtctccactgggggttaacc

SEQ ID NO: 8474944 - DNA, 22 bp, Homo sapiens
ggagtgactcacagctgggaca

SEQ ID NO: 8474945 - DNA, 19 bp, Homo sapiens
caagttctggagattaggg

SEQ ID NO: 8474946 - DNA, 22 bp, Homo sapiens
cacagcataatgaaatatactt

SEQ ID NO: 8474947 - DNA, 22 bp, Homo sapiens
gaacatttccagaaaggaacta

SEQ ID NO: 8474948 - DNA, 22 bp, Homo sapiens
gaacatttatgatgcaatacct

SEQ ID NO: 8474949 - DNA, 22 bp, Homo sapiens
gaaatctttatggaaataacaa

SEQ ID NO: 8474950 - DNA, 22 bp, Homo sapiens
gaaaactgtgattagaatgcct

SEQ ID NO: 8474951 - DNA, 22 bp, Homo sapiens
gacataaaattcaataatttgt

SEQ ID NO: 8474952 - DNA, 22 bp, Homo sapiens
gacataaaccttgagatattaa

SEQ ID NO: 8474953 - DNA, 22 bp, Homo sapiens
atgtaacaaatggtatacatgt

SEQ ID NO: 8474954 - DNA, 22 bp, Homo sapiens
atgtaacattgaattatatagt

SEQ ID NO: 8474955 - DNA, 22 bp, Homo sapiens
atgtaacacccacttttatagc

SEQ ID NO: 8474956 - DNA, 22 bp, Homo sapiens
gcaaaaaccacaattactttta

SEQ ID NO: 8474957 - DNA, 22 bp, Homo sapiens
gcaaaaactgcaattacttttg

SEQ ID NO: 8474958 - DNA, 22 bp, Homo sapiens
gcaaaaaccacaattacttttg

SEQ ID NO: 8474959 - DNA, 22 bp, Homo sapiens
gcagaatgtaggccttcagtgt

SEQ ID NO: 8474960 - DNA, 22 bp, Homo sapiens
gcagaggccatcaactttgcca

SEQ ID NO: 8474961 - DNA, 22 bp, Homo sapiens
gcagaggctctttaatgcttag

SEQ ID NO: 8474962 - DNA, 22 bp, Homo sapiens
atttaaatgcttaagagggttt

SEQ ID NO: 8474963 - DNA, 22 bp, Homo sapiens
attttctgtgtgcagataaata

SEQ ID NO: 8474964 - DNA, 22 bp, Homo sapiens
cccagtcatcctgcaggtgaaa

SEQ ID NO: 8474965 - DNA, 22 bp, Homo sapiens
ccctcagcagatatttgtgttt

SEQ ID NO: 8474966 - DNA, 22 bp, Homo sapiens
aggcagagagcagtggccgtct

SEQ ID NO: 8474967 - DNA, 16 bp, Homo sapiens
aggcagagatttaccc

SEQ ID NO: 8474968 - DNA, 20 bp, Homo sapiens
aggcagagcgcacttttaga

SEQ ID NO: 8474969 - DNA, 22 bp, Homo sapiens
aggcagagctgatgttctgtga

SEQ ID NO: 8474970 - DNA, 22 bp, Homo sapiens
aggcagagctaggaagaattgt

SEQ ID NO: 8474971 - DNA, 22 bp, Homo sapiens
aggcagaggaagggtggatttg

SEQ ID NO: 8474972 - DNA, 22 bp, Homo sapiens
aggcagaggagaatgatcttcc

SEQ ID NO: 8474973 - DNA, 22 bp, Homo sapiens
aggcagagctgggttttgaaat

SEQ ID NO: 8474974 - DNA, 22 bp, Homo sapiens
cagttcctatgggcaaaacaca

SEQ ID NO: 8474975 - DNA, 22 bp, Homo sapiens
cagttctaattaataggagtaa

SEQ ID NO: 8474976 - DNA, 22 bp, Homo sapiens
caggtcctgcagggagagtaaa

SEQ ID NO: 8474977 - DNA, 22 bp, Homo sapiens
caggtcctggcatcaggcaggt

SEQ ID NO: 8474978 - DNA, 22 bp, Homo sapiens
aggaaacagtgaacttggcagg

SEQ ID NO: 8474979 - DNA, 22 bp, Homo sapiens
ctgagctgacatcttcctcttt

SEQ ID NO: 8474980 - DNA, 22 bp, Homo sapiens
ctgagctgagccaaatctgtct

SEQ ID NO: 8474981 - DNA, 22 bp, Homo sapiens
ctgagctgctttgcttttgggg

SEQ ID NO: 8474982 - DNA, 22 bp, Homo sapiens
ctatttatctatttctgaatga

SEQ ID NO: 8474983 - DNA, 22 bp, Homo sapiens
ctattgcatttgcatcttcatc

SEQ ID NO: 8474984 - DNA, 22 bp, Homo sapiens
ctgtaatcccagctacctggga

SEQ ID NO: 8474985 - DNA, 22 bp, Homo sapiens
ataaactgaagggaacactgag

SEQ ID NO: 8474986 - DNA, 22 bp, Homo sapiens
ataaaaatgagggcggtagcta

SEQ ID NO: 8474987 - DNA, 22 bp, Homo sapiens
ataaaagaagttttggtacttg

SEQ ID NO: 8474988 - DNA, 22 bp, Homo sapiens
atcagtctgtgttagaaaagag

SEQ ID NO: 8474989 - DNA, 22 bp, Homo sapiens
acttttttataaggaagaagat

SEQ ID NO: 8474990 - DNA, 21 bp, Homo sapiens
agaaaaacacgatataagccc

SEQ ID NO: 8474991 - DNA, 22 bp, Homo sapiens
actgttttctaaagaacagatg

SEQ ID NO: 8474992 - DNA, 22 bp, Homo sapiens
actgttttcctaatgagcaaga

SEQ ID NO: 8474993 - DNA, 22 bp, Homo sapiens
actttgctgcaggtttaaagag

SEQ ID NO: 8474994 - DNA, 22 bp, Homo sapiens
actgcactcctgcctgggtaac

SEQ ID NO: 8474995 - DNA, 22 bp, Homo sapiens
acctttcattaaagtctgtagt

SEQ ID NO: 8474996 - DNA, 22 bp, Homo sapiens
acctttcacggtatcagacatc

SEQ ID NO: 8474997 - DNA, 20 bp, Homo sapiens
acctttcaaatgattcagca

SEQ ID NO: 8474998 - DNA, 22 bp, Homo sapiens
acctttcaaagtggctatcact

SEQ ID NO: 8474999 - DNA, 22 bp, Homo sapiens
agcttttagtacgttaaaattg

SEQ ID NO: 8475000 - DNA, 22 bp, Homo sapiens
acatgaaaagactatctgatta

SEQ ID NO: 8475001 - DNA, 20 bp, Homo sapiens
acatgaaaggaaacaggaaa

SEQ ID NO: 8475002 - DNA, 22 bp, Homo sapiens
aggctgtgattccaccactctc

SEQ ID NO: 8475003 - DNA, 22 bp, Homo sapiens
accagtccgcggagctccgggg

SEQ ID NO: 8475004 - DNA, 22 bp, Homo sapiens
agactgtaattgacatgtcagc

SEQ ID NO: 8475005 - DNA, 22 bp, Homo sapiens
agactgtaatttgtggcctcct

SEQ ID NO: 8475006 - DNA, 19 bp, Homo sapiens
agactctgccactcttctc

SEQ ID NO: 8475007 - DNA, 22 bp, Homo sapiens
agactctgattccctcatgtca

SEQ ID NO: 8475008 - DNA, 22 bp, Homo sapiens
agactctgataagcaactcttg

SEQ ID NO: 8475009 - DNA, 22 bp, Homo sapiens
agactgtagggatagaggtctt

SEQ ID NO: 8475010 - DNA, 22 bp, Homo sapiens
agactgtactttctgcagctct

SEQ ID NO: 8475011 - DNA, 17 bp, Homo sapiens
agcactaaaatgcttcc

SEQ ID NO: 8475012 - DNA, 22 bp, Homo sapiens
agcctggtttaagcattttata

SEQ ID NO: 8475013 - DNA, 22 bp, Homo sapiens
aactttctttcacagaagtatc

SEQ ID NO: 8475014 - DNA, 22 bp, Homo sapiens
aagaaagtgggtaatatgattt

SEQ ID NO: 8475015 - DNA, 22 bp, Homo sapiens
aagaatgttcattaaactgttg

SEQ ID NO: 8475016 - DNA, 22 bp, Homo sapiens
aacatttcttctgaaactgagt

SEQ ID NO: 8475017 - DNA, 22 bp, Homo sapiens
aacattaattacagtcaaacat

SEQ ID NO: 8475018 - DNA, 22 bp, Homo sapiens
aacaacttgcgttcagagatgt

SEQ ID NO: 8475019 - DNA, 22 bp, Homo sapiens
aaacaacttctgcactatgggt

SEQ ID NO: 8475020 - DNA, 22 bp, Homo sapiens
aaaaactgtaattacttttgca

SEQ ID NO: 8475021 - DNA, 22 bp, Homo sapiens
aaagaacttatcctagaatttg

SEQ ID NO: 8475022 - DNA, 22 bp, Homo sapiens
aaacttgatttagaactaaggc

SEQ ID NO: 8475023 - DNA, 22 bp, Homo sapiens
aaatatgtaagattagcactag

SEQ ID NO: 8475024 - DNA, 22 bp, Homo sapiens
aacactgtactggaagatggac

SEQ ID NO: 8475025 - DNA, 22 bp, Homo sapiens
aacatttcagcaaataagaaca

SEQ ID NO: 8475026 - DNA, 22 bp, Homo sapiens
aacaagtaagtttatatatatt

SEQ ID NO: 8475027 - DNA, 22 bp, Homo sapiens
acactacaatctcagaactata

SEQ ID NO: 8475028 - DNA, 22 bp, Homo sapiens
acagatcctggttacagccatt

SEQ ID NO: 8475029 - DNA, 22 bp, Homo sapiens
aagaattttccagcatgtcagt

SEQ ID NO: 8475030 - DNA, 22 bp, Homo sapiens
acaactgtcagtaaagaatatt

SEQ ID NO: 8475031 - DNA, 22 bp, Homo sapiens
aatgttacgatcaacaacacat

SEQ ID NO: 8475032 - DNA, 22 bp, Homo sapiens
acaaaaagctccattactgtcc

SEQ ID NO: 8475033 - DNA, 20 bp, Homo sapiens
agatgttttgaagtcttgga

SEQ ID NO: 8475034 - DNA, 22 bp, Homo sapiens
agatgttttagagtttgacttg

SEQ ID NO: 8475035 - DNA, 19 bp, Homo sapiens
agactctgtgtgagacttt

SEQ ID NO: 8475036 - DNA, 19 bp, Homo sapiens
agactctgccactcttctc

SEQ ID NO: 8475037 - DNA, 22 bp, Homo sapiens
agactctgtgctccttgctttc

SEQ ID NO: 8475038 - DNA, 22 bp, Homo sapiens
aatgtacatctcagtgtagtac

SEQ ID NO: 8475039 - DNA, 22 bp, Homo sapiens
acagaactgcaggaggaaaagc

SEQ ID NO: 8475040 - DNA, 22 bp, Homo sapiens
acagaactgagaattctctatc

SEQ ID NO: 8475041 - DNA, 22 bp, Homo sapiens
acaggtccttataagagcactc

SEQ ID NO: 8475042 - DNA, 22 bp, Homo sapiens
aataacaggctcatcagatgct

SEQ ID NO: 8475043 - DNA, 22 bp, Homo sapiens
tcaggagatgtaaccttagctg

SEQ ID NO: 8475044 - DNA, 22 bp, Homo sapiens
tcaggaaagagtgtatccatca

SEQ ID NO: 8475045 - DNA, 20 bp, Homo sapiens
tcaggtagatctttgaggtc

SEQ ID NO: 8475046 - DNA, 22 bp, Homo sapiens
tccagtctctactctgagataa

SEQ ID NO: 8475047 - DNA, 22 bp, Homo sapiens
tcccagagtgtgggcatcaagg

SEQ ID NO: 8475048 - DNA, 21 bp, Homo sapiens
tcccagagtgcttgggactgc

SEQ ID NO: 8475049 - DNA, 22 bp, Homo sapiens
tcccagagtgagccaggggcag

SEQ ID NO: 8475050 - DNA, 22 bp, Homo sapiens
tcccagagtcagaggtggggcc

SEQ ID NO: 8475051 - DNA, 22 bp, Homo sapiens
tcccagagaaagtcaaggtctt

SEQ ID NO: 8475052 - DNA, 22 bp, Homo sapiens
tcccagagtattagcaattgct

SEQ ID NO: 8475053 - DNA, 22 bp, Homo sapiens
tcccagagtcttctcctgtaat

SEQ ID NO: 8475054 - DNA, 19 bp, Homo sapiens
tcccagagtctagaggttg

SEQ ID NO: 8475055 - DNA, 22 bp, Homo sapiens
tcccagcacgtctgctgtttct

SEQ ID NO: 8475056 - DNA, 22 bp, Homo sapiens
tcccagagtttcctgtgtccca

SEQ ID NO: 8475057 - DNA, 22 bp, Homo sapiens
tcccagagttcaatgggaaggt

SEQ ID NO: 8475058 - DNA, 22 bp, Homo sapiens
tccacattctctgttacagata

SEQ ID NO: 8475059 - DNA, 22 bp, Homo sapiens
tacaggaagcactcaagaaatg

SEQ ID NO: 8475060 - DNA, 22 bp, Homo sapiens
taaagtttggcagacaataaca

SEQ ID NO: 8475061 - DNA, 21 bp, Homo sapiens
taaataataagttgctgagat

SEQ ID NO: 8475062 - DNA, 22 bp, Homo sapiens
gtttaattttaggttgtcaagc

SEQ ID NO: 8475063 - DNA, 22 bp, Homo sapiens
gtgttaaccagctaaactttgc

SEQ ID NO: 8475064 - DNA, 22 bp, Homo sapiens
tagcatttcactgatcttcact

SEQ ID NO: 8475065 - DNA, 22 bp, Homo sapiens
tagcatttcccaaatgcatttg

SEQ ID NO: 8475066 - DNA, 22 bp, Homo sapiens
tagcatttggcaccagttattt

SEQ ID NO: 8475067 - DNA, 22 bp, Homo sapiens
tagcatttggacattgtcacct

SEQ ID NO: 8475068 - DNA, 22 bp, Homo sapiens
tatttctaagctgtaagtctga

SEQ ID NO: 8475069 - DNA, 22 bp, Homo sapiens
tatatgtgtggattcttgtaga

SEQ ID NO: 8475070 - DNA, 22 bp, Homo sapiens
gctgtgagctgcctgtgtcaca

SEQ ID NO: 8475071 - DNA, 22 bp, Homo sapiens
ggagagctggtagctggctcca

SEQ ID NO: 8475072 - DNA, 22 bp, Homo sapiens
gcctgggtgaatttgatcctaa

SEQ ID NO: 8475073 - DNA, 22 bp, Homo sapiens
ggatgctgctgcacatcctgca

SEQ ID NO: 8475074 - DNA, 22 bp, Homo sapiens
ggcagcagggtctagattgatg

SEQ ID NO: 8475075 - DNA, 22 bp, Homo sapiens
ggcaggagctctccagtttgcc

SEQ ID NO: 8475076 - DNA, 20 bp, Homo sapiens
gtgcaatggctcagtctcag

SEQ ID NO: 8475077 - DNA, 20 bp, Homo sapiens
gtgcaatggcgcaatctcgg

SEQ ID NO: 8475078 - DNA, 22 bp, Homo sapiens
gtgcaatgtgcttcgtgccatg

SEQ ID NO: 8475079 - DNA, 22 bp, Homo sapiens
gtaatctcagctacttgggagg

SEQ ID NO: 8475080 - DNA, 22 bp, Homo sapiens
ctgcagtatgagctacccaggt

SEQ ID NO: 8475081 - DNA, 22 bp, Homo sapiens
ttttcctgggctttctgtgtaa

SEQ ID NO: 8475082 - DNA, 19 bp, Homo sapiens
ttttctcgtgcttgtctgc

SEQ ID NO: 8475083 - DNA, 22 bp, Homo sapiens
tttttctgagcggtaatcatca

SEQ ID NO: 8475084 - DNA, 22 bp, Homo sapiens
tttttctgagaatatgagagga

SEQ ID NO: 8475085 - DNA, 18 bp, Homo sapiens
tttttctgataaaacaag

SEQ ID NO: 8475086 - DNA, 22 bp, Homo sapiens
tttttctgccattcaaagagga

SEQ ID NO: 8475087 - DNA, 22 bp, Homo sapiens
tttttctgccattcaaagagga

SEQ ID NO: 8475088 - DNA, 22 bp, Homo sapiens
tttttctgtctcttacattgca

SEQ ID NO: 8475089 - DNA, 22 bp, Homo sapiens
tttttctggataactgtatctc

SEQ ID NO: 8475090 - DNA, 20 bp, Homo sapiens
tttttctgggcttccatagc

SEQ ID NO: 8475091 - DNA, 22 bp, Homo sapiens
tttttctgtaaagggccagaga

SEQ ID NO: 8475092 - DNA, 22 bp, Homo sapiens
ctgaaacattgcaataacaaag

SEQ ID NO: 8475093 - DNA, 22 bp, Homo sapiens
ctgagggagggactttgagact

SEQ ID NO: 8475094 - DNA, 22 bp, Homo sapiens
ctgagctggttctcttgtgaaa

SEQ ID NO: 8475095 - DNA, 22 bp, Homo sapiens
ctctggagggaggctgagctgg

SEQ ID NO: 8475096 - DNA, 22 bp, Homo sapiens
tttatatccatctttgaagtaa

SEQ ID NO: 8475097 - DNA, 17 bp, Homo sapiens
tgttttcattcattgct

SEQ ID NO: 8475098 - DNA, 22 bp, Homo sapiens
tgttgatttgtgggctgcaaaa

SEQ ID NO: 8475099 - DNA, 22 bp, Homo sapiens
tggttcagagagttgctgacca

SEQ ID NO: 8475100 - DNA, 22 bp, Homo sapiens
tggttcaggcagggtgttgctg

SEQ ID NO: 8475101 - DNA, 22 bp, Homo sapiens
tggttcagatatggagctggga

SEQ ID NO: 8475102 - DNA, 22 bp, Homo sapiens
tgttttctcttgaaaagcagtc

SEQ ID NO: 8475103 - DNA, 22 bp, Homo sapiens
cctgtattaggtagacaactat

SEQ ID NO: 8475104 - DNA, 22 bp, Homo sapiens
cctgtactagggtctcattgcc

SEQ ID NO: 8475105 - DNA, 22 bp, Homo sapiens
cctgtacattagctgtgaattg

SEQ ID NO: 8475106 - DNA, 19 bp, Homo sapiens
cctgtacattattctcccc

SEQ ID NO: 8475107 - DNA, 22 bp, Homo sapiens
cctgtacatggccatctttacc

SEQ ID NO: 8475108 - DNA, 22 bp, Homo sapiens
cctgtacatctgctctcattgc

SEQ ID NO: 8475109 - DNA, 22 bp, Homo sapiens
cctgtacagtgaatgaatgtga

SEQ ID NO: 8475110 - DNA, 22 bp, Homo sapiens
cctgtacacaattccgaggata

SEQ ID NO: 8475111 - DNA, 22 bp, Homo sapiens
cctgtacacggtctatgcctcc

SEQ ID NO: 8475112 - DNA, 22 bp, Homo sapiens
cctgtacaagagccatctggat

SEQ ID NO: 8475113 - DNA, 22 bp, Homo sapiens
cctgtacaagctcttggtgaca

SEQ ID NO: 8475114 - DNA, 22 bp, Homo sapiens
ttcttcatgggttcttttagga

SEQ ID NO: 8475115 - DNA, 22 bp, Homo sapiens
ttctgaaaggcaggttgtttgc

SEQ ID NO: 8475116 - DNA, 22 bp, Homo sapiens
ttctgtctccctgatgtagagc

SEQ ID NO: 8475117 - DNA, 22 bp, Homo sapiens
ctcaggagtagttcagcagctg

SEQ ID NO: 8475118 - DNA, 19 bp, Homo sapiens
ttcagtttcctcatctgga

SEQ ID NO: 8475119 - DNA, 22 bp, Homo sapiens
ttcagtttctaaatgctcctct

SEQ ID NO: 8475120 - DNA, 22 bp, Homo sapiens
ttcagtttcaaatcctgtgaag

SEQ ID NO: 8475121 - DNA, 22 bp, Homo sapiens
ttccacttagtggaagggcatg

SEQ ID NO: 8475122 - DNA, 22 bp, Homo sapiens
ctagttcttaactgttatgatt

SEQ ID NO: 8475123 - DNA, 22 bp, Homo sapiens
ttctcaggtgaggctgaggctg

SEQ ID NO: 8475124 - DNA, 22 bp, Homo sapiens
ttctaccagaccccagacttgt

SEQ ID NO: 8475125 - DNA, 22 bp, Homo sapiens
ttctaccagctactcactgata

SEQ ID NO: 8475126 - DNA, 22 bp, Homo sapiens
ttctaccattgggaaaacagcc

SEQ ID NO: 8475127 - DNA, 22 bp, Homo sapiens
ctacattaaattggcttactta

SEQ ID NO: 8475128 - DNA, 21 bp, Homo sapiens
ttctacaggatgaatgaaaac

SEQ ID NO: 8475129 - DNA, 22 bp, Homo sapiens
cttttctgtgatgctgacagtc

SEQ ID NO: 8475130 - DNA, 21 bp, Homo sapiens
cttttctgtgttcctccctgt

SEQ ID NO: 8475131 - DNA, 22 bp, Homo sapiens
cttttctggccaggaacttgcc

SEQ ID NO: 8475132 - DNA, 22 bp, Homo sapiens
cttttctggaatcatctctaac

SEQ ID NO: 8475133 - DNA, 22 bp, Homo sapiens
cttttctgtcagtgcccaaatt

SEQ ID NO: 8475134 - DNA, 22 bp, Homo sapiens
cttttctgggccccacgctgga

SEQ ID NO: 8475135 - DNA, 22 bp, Homo sapiens
cttttctgtatcaaaaggatta

SEQ ID NO: 8475136 - DNA, 22 bp, Homo sapiens
cttttctgagagggccaagatt

SEQ ID NO: 8475137 - DNA, 22 bp, Homo sapiens
ctgttttcctgggttccatgag

SEQ ID NO: 8475138 - DNA, 22 bp, Homo sapiens
ctgttttctacagtctgggtct

SEQ ID NO: 8475139 - DNA, 19 bp, Homo sapiens
ctgtttctgagcttgcttt

SEQ ID NO: 8475140 - DNA, 22 bp, Homo sapiens
ctgcttccatggtctggagact

SEQ ID NO: 8475141 - DNA, 22 bp, Homo sapiens
ctgcttccatgcaatggcagtc

SEQ ID NO: 8475142 - DNA, 22 bp, Homo sapiens
ctgggccttggattgacactgt

SEQ ID NO: 8475143 - DNA, 22 bp, Homo sapiens
ctgtacataaaggaataggtgt

SEQ ID NO: 8475144 - DNA, 22 bp, Homo sapiens
ctgtacaggtcaatgataagat

SEQ ID NO: 8475145 - DNA, 22 bp, Homo sapiens
ctgtacagagttctgagtgtac

SEQ ID NO: 8475146 - DNA, 22 bp, Homo sapiens
ctgtaaaacactgtagtatctg

SEQ ID NO: 8475147 - DNA, 22 bp, Homo sapiens
ctgtaaaactgcttaagtatgc

SEQ ID NO: 8475148 - DNA, 22 bp, Homo sapiens
ctgtctgtcaccaaaacagact

SEQ ID NO: 8475149 - DNA, 22 bp, Homo sapiens
tgaaacaaatttggaaaatcta

SEQ ID NO: 8475150 - DNA, 22 bp, Homo sapiens
tgaaacaagggaccgtcctttc

SEQ ID NO: 8475151 - DNA, 22 bp, Homo sapiens
tcttttgagggccagaggaaga

SEQ ID NO: 8475152 - DNA, 22 bp, Homo sapiens
tctgggccgctgcgttccatga

SEQ ID NO: 8475153 - DNA, 22 bp, Homo sapiens
tcttacagaaaatagataacat

SEQ ID NO: 8475154 - DNA, 22 bp, Homo sapiens
tgagtccaagagccagtgggaa

SEQ ID NO: 8475155 - DNA, 22 bp, Homo sapiens
tgagtccaccttagtatatggg

SEQ ID NO: 8475156 - DNA, 22 bp, Homo sapiens
ccagtcccagctctgccatgct

SEQ ID NO: 8475157 - DNA, 22 bp, Homo sapiens
ccagtcccaggcagaaatccag

SEQ ID NO: 8475158 - DNA, 22 bp, Homo sapiens
ccagtcccatctctgtcgctta

SEQ ID NO: 8475159 - DNA, 19 bp, Homo sapiens
ccagtcccatacaggagat

SEQ ID NO: 8475160 - DNA, 22 bp, Homo sapiens
ccagtctgaggcctggtgaggg

SEQ ID NO: 8475161 - DNA, 22 bp, Homo sapiens
tggcttgtcatgtatctgaggc

SEQ ID NO: 8475162 - DNA, 22 bp, Homo sapiens
tggaaactaagactagagagac

SEQ ID NO: 8475163 - DNA, 22 bp, Homo sapiens
tggagctgaggggaatgctgag

SEQ ID NO: 8475164 - DNA, 22 bp, Homo sapiens
cagtcccagacccagaaggtgg

SEQ ID NO: 8475165 - DNA, 22 bp, Homo sapiens
cagtcccatgagcccagaacat

SEQ ID NO: 8475166 - DNA, 22 bp, Homo sapiens
cagtcccatctcccaggtggct

SEQ ID NO: 8475167 - DNA, 15 bp, Homo sapiens
cagtcccagggaccc

SEQ ID NO: 8475168 - DNA, 22 bp, Homo sapiens
cagtcccagctgctcagaaggc

SEQ ID NO: 8475169 - DNA, 22 bp, Homo sapiens
cagtcccagggttggttcagct

SEQ ID NO: 8475170 - DNA, 22 bp, Homo sapiens
cagtcccagtttgagactctgg

SEQ ID NO: 8475171 - DNA, 22 bp, Homo sapiens
cagtgctgttgtaagctcattg

SEQ ID NO: 8475172 - DNA, 19 bp, Homo sapiens
cattttctcattgtgcccc

SEQ ID NO: 8475173 - DNA, 21 bp, Homo sapiens
catttctattgatgagaaaag

SEQ ID NO: 8475174 - DNA, 22 bp, Homo sapiens
catttctatggcaatgggaaaa

SEQ ID NO: 8475175 - DNA, 22 bp, Homo sapiens
catttctaagaaggctgcacat

SEQ ID NO: 8475176 - DNA, 22 bp, Homo sapiens
catttctagacaagtcctggag

SEQ ID NO: 8475177 - DNA, 22 bp, Homo sapiens
catttctagggatcataaagta

SEQ ID NO: 8475178 - DNA, 22 bp, Homo sapiens
catttctacagcttcttcagaa

SEQ ID NO: 8475179 - DNA, 23 bp, Homo sapiens
catgtacacacagctgtacagtg

SEQ ID NO: 8475180 - DNA, 19 bp, Homo sapiens
catggtgaaaccccgtctc

SEQ ID NO: 8475181 - DNA, 23 bp, Homo sapiens
ttttccagaatcgactctgtaga

SEQ ID NO: 8475182 - DNA, 22 bp, Homo sapiens
tttctagatgcttttgaaaatc

SEQ ID NO: 8475183 - DNA, 22 bp, Homo sapiens
tttctagttctctgccaaaaaa

SEQ ID NO: 8475184 - DNA, 22 bp, Homo sapiens
tttctagtcctcatgcatcatt

SEQ ID NO: 8475185 - DNA, 22 bp, Homo sapiens
tttctattctggatctgtggca

SEQ ID NO: 8475186 - DNA, 22 bp, Homo sapiens
tttctattgatctaataaacat

SEQ ID NO: 8475187 - DNA, 22 bp, Homo sapiens
tttctattggcgtcactgttgt

SEQ ID NO: 8475188 - DNA, 22 bp, Homo sapiens
tttcacatcagaggtagattag

SEQ ID NO: 8475189 - DNA, 21 bp, Homo sapiens
tttatttatataggacacatg

SEQ ID NO: 8475190 - DNA, 22 bp, Homo sapiens
tttcctttgcccaatacatgtc

SEQ ID NO: 8475191 - DNA, 22 bp, Homo sapiens
ttgtatatattcttaaagatgt

SEQ ID NO: 8475192 - DNA, 21 bp, Homo sapiens
ttggcctgatatcttggagca

SEQ ID NO: 8475193 - DNA, 22 bp, Homo sapiens
ttgccattggcaggcctcttgt

SEQ ID NO: 8475194 - DNA, 22 bp, Homo sapiens
ttcatagtgtttccttccagtg

SEQ ID NO: 8475195 - DNA, 22 bp, Homo sapiens
ttattttcagctaggaaagcca

SEQ ID NO: 8475196 - DNA, 22 bp, Homo sapiens
ttattttctcctcagaaagtgg

SEQ ID NO: 8475197 - DNA, 22 bp, Homo sapiens
ttgaaaaaattggtagaggatg

SEQ ID NO: 8475198 - DNA, 22 bp, Homo sapiens
ttctcttgtgccaagttgttgc

SEQ ID NO: 8475199 - DNA, 22 bp, Homo sapiens
ttcgagttggctttattaaact

SEQ ID NO: 8475200 - DNA, 22 bp, Homo sapiens
caaactgttctctgtgggattc

SEQ ID NO: 8475201 - DNA, 22 bp, Homo sapiens
caaaaactgcaattacttttac

SEQ ID NO: 8475202 - DNA, 22 bp, Homo sapiens
caaaactgtctagagagagaag

SEQ ID NO: 8475203 - DNA, 22 bp, Homo sapiens
atttctacagtacacatgcatt

SEQ ID NO: 8475204 - DNA, 22 bp, Homo sapiens
attggaaatacagtagaaaaat

SEQ ID NO: 8475205 - DNA, 22 bp, Homo sapiens
atgttttcaaagtaaacttgta

SEQ ID NO: 8475206 - DNA, 22 bp, Homo sapiens
atgttttccattgccatggaaa

SEQ ID NO: 8475207 - DNA, 22 bp, Homo sapiens
atgttttcctgggagagcactc

SEQ ID NO: 8475208 - DNA, 22 bp, Homo sapiens
atgcagaaggagccatgcttgc

SEQ ID NO: 8475209 - DNA, 22 bp, Homo sapiens
cttggtcatttggggctgctat

SEQ ID NO: 8475210 - DNA, 22 bp, Homo sapiens
cttggtcatttcttgtcctgtt

SEQ ID NO: 8475211 - DNA, 22 bp, Homo sapiens
atgtctttcttatggtctgttg

SEQ ID NO: 8475212 - DNA, 22 bp, Homo sapiens
atgtctttcaaattctgcctag

SEQ ID NO: 8475213 - DNA, 22 bp, Homo sapiens
gctgtacaaattccacaagaga

SEQ ID NO: 8475214 - DNA, 22 bp, Homo sapiens
gctgtacaaggcctctgccatc

SEQ ID NO: 8475215 - DNA, 22 bp, Homo sapiens
caatttctaacattccatggat

SEQ ID NO: 8475216 - DNA, 22 bp, Homo sapiens
ggttccccaggcggcccttgga

SEQ ID NO: 8475217 - DNA, 22 bp, Homo sapiens
ggttccacggtgtttggaggca

SEQ ID NO: 8475218 - DNA, 22 bp, Homo sapiens
cagagctgtatttatctttcca

SEQ ID NO: 8475219 - DNA, 18 bp, Homo sapiens
ctgtcttttttctctcca

SEQ ID NO: 8475220 - DNA, 18 bp, Homo sapiens
ctgtcttttttctctcca

SEQ ID NO: 8475221 - DNA, 22 bp, Homo sapiens
ctgtctttggtcctgtctgtta

SEQ ID NO: 8475222 - DNA, 22 bp, Homo sapiens
ctgtcttttcatactttccctc

SEQ ID NO: 8475223 - DNA, 22 bp, Homo sapiens
ctgggcaggagggctctatgga

SEQ ID NO: 8475224 - DNA, 22 bp, Homo sapiens
atacaagatcactccagaaaat

SEQ ID NO: 8475225 - DNA, 22 bp, Homo sapiens
atacaagactcagcacagacgg

SEQ ID NO: 8475226 - DNA, 22 bp, Homo sapiens
ataatacatggttgatcttttc

SEQ ID NO: 8475227 - DNA, 22 bp, Homo sapiens
ccttggagcggtcagcactggt

SEQ ID NO: 8475228 - DNA, 22 bp, Homo sapiens
agtcccagactccagttttctg

SEQ ID NO: 8475229 - DNA, 22 bp, Homo sapiens
agtcccagatctacaggaggga

SEQ ID NO: 8475230 - DNA, 22 bp, Homo sapiens
agtcccagatctccattcggtc

SEQ ID NO: 8475231 - DNA, 22 bp, Homo sapiens
agtcccagagaggtcggggcca

SEQ ID NO: 8475232 - DNA, 20 bp, Homo sapiens
agtcccagatcaaatttctg

SEQ ID NO: 8475233 - DNA, 22 bp, Homo sapiens
agtcccagcctgtaggattggg

SEQ ID NO: 8475234 - DNA, 22 bp, Homo sapiens
agtcccagcccagtcctgtaag

SEQ ID NO: 8475235 - DNA, 22 bp, Homo sapiens
agtcccagcctaggctgtgctg

SEQ ID NO: 8475236 - DNA, 22 bp, Homo sapiens
agtcccagatgacccagctact

SEQ ID NO: 8475237 - DNA, 22 bp, Homo sapiens
ccagtctggcaggagggggaac

SEQ ID NO: 8475238 - DNA, 22 bp, Homo sapiens
ccagttctgacacaagcacagt

SEQ ID NO: 8475239 - DNA, 22 bp, Homo sapiens
agggagaaggtttagctgtgag

SEQ ID NO: 8475240 - DNA, 22 bp, Homo sapiens
cagtctctgtgccagatcctgg

SEQ ID NO: 8475241 - DNA, 23 bp, Homo sapiens
aggagaagagatttccacatgca

SEQ ID NO: 8475242 - DNA, 22 bp, Homo sapiens
cagtcctgcccaggctgacaga

SEQ ID NO: 8475243 - DNA, 22 bp, Homo sapiens
cagtcctgagccaatcatgatg

SEQ ID NO: 8475244 - DNA, 19 bp, Homo sapiens
aggcagaggcttggctagc

SEQ ID NO: 8475245 - DNA, 21 bp, Homo sapiens
agaattcttaagtattctaat

SEQ ID NO: 8475246 - DNA, 22 bp, Homo sapiens
atggcagagggattgaacagct

SEQ ID NO: 8475247 - DNA, 22 bp, Homo sapiens
atgttacaattcaaaatgctgc

SEQ ID NO: 8475248 - DNA, 22 bp, Homo sapiens
attaaacaatgtaaagttcttg

SEQ ID NO: 8475249 - DNA, 22 bp, Homo sapiens
atttattattgtggttacttct

SEQ ID NO: 8475250 - DNA, 22 bp, Homo sapiens
atttaaattttctgatggagag

SEQ ID NO: 8475251 - DNA, 22 bp, Homo sapiens
atttaacaagacagagaactgg

SEQ ID NO: 8475252 - DNA, 22 bp, Homo sapiens
agcaaacagtgtgctaagaaat

SEQ ID NO: 8475253 - DNA, 22 bp, Homo sapiens
agccaggatggtctcgatcggc

SEQ ID NO: 8475254 - DNA, 22 bp, Homo sapiens
attttctgtaactatttctata

SEQ ID NO: 8475255 - DNA, 22 bp, Homo sapiens
attttctgtaaaaaggcactaa

SEQ ID NO: 8475256 - DNA, 22 bp, Homo sapiens
attttctggttgaggtttaaca

SEQ ID NO: 8475257 - DNA, 22 bp, Homo sapiens
attttctgagtccagaatttac

SEQ ID NO: 8475258 - DNA, 22 bp, Homo sapiens
attttctgagcacgtgacagca

SEQ ID NO: 8475259 - DNA, 22 bp, Homo sapiens
caaatgatactgtttttagtct

SEQ ID NO: 8475260 - DNA, 22 bp, Homo sapiens
agcataaaggtcaacgttttag

SEQ ID NO: 8475261 - DNA, 22 bp, Homo sapiens
cacagtccagactcctggagtt

SEQ ID NO: 8475262 - DNA, 22 bp, Homo sapiens
actaaaaactactgccaatagc

SEQ ID NO: 8475263 - DNA, 22 bp, Homo sapiens
agtcggaagctgtgcgtaaatc

SEQ ID NO: 8475264 - DNA, 20 bp, Homo sapiens
actttggggtctttctcaga

SEQ ID NO: 8475265 - DNA, 21 bp, Homo sapiens
actttgggcactttcctgccc

SEQ ID NO: 8475266 - DNA, 22 bp, Homo sapiens
actttggggaacttttctcctc

SEQ ID NO: 8475267 - DNA, 22 bp, Homo sapiens
actttgggtaagccaggtgcta

SEQ ID NO: 8475268 - DNA, 22 bp, Homo sapiens
agaaaattagattttactgtgt

SEQ ID NO: 8475269 - DNA, 22 bp, Homo sapiens
actgtaaattttggttgcaggt

SEQ ID NO: 8475270 - DNA, 22 bp, Homo sapiens
agtttctaacatatagcattgg

SEQ ID NO: 8475271 - DNA, 22 bp, Homo sapiens
accctcaacaaattcactctat

SEQ ID NO: 8475272 - DNA, 22 bp, Homo sapiens
acataaaggtgactaacatctt

SEQ ID NO: 8475273 - DNA, 22 bp, Homo sapiens
acaggcctcaagacacccaggt

SEQ ID NO: 8475274 - DNA, 22 bp, Homo sapiens
aacatgtagcagaaacgactaa

SEQ ID NO: 8475275 - DNA, 22 bp, Homo sapiens
aacatgaaaacctccacagcaa

SEQ ID NO: 8475276 - DNA, 21 bp, Homo sapiens
acagcagagatcaagactaag

SEQ ID NO: 8475277 - DNA, 22 bp, Homo sapiens
aatttgttacacagcaatataa

SEQ ID NO: 8475278 - DNA, 22 bp, Homo sapiens
aattttactaatctgagtgtga

SEQ ID NO: 8475279 - DNA, 20 bp, Homo sapiens
aagaaacttgaaagtacaag

SEQ ID NO: 8475280 - DNA, 22 bp, Homo sapiens
aattctataggcaagctatttt

SEQ ID NO: 8475281 - DNA, 22 bp, Homo sapiens
aagaaactgaaagtggcttcat

SEQ ID NO: 8475282 - DNA, 22 bp, Homo sapiens
aagaaactgttgcgtgacagcg

SEQ ID NO: 8475283 - DNA, 22 bp, Homo sapiens
aagaaaacgttttgaggagttt

SEQ ID NO: 8475284 - DNA, 22 bp, Homo sapiens
aaacactagcaggaagcactga

SEQ ID NO: 8475285 - DNA, 22 bp, Homo sapiens
aaacagtagaagtgtattttat

SEQ ID NO: 8475286 - DNA, 22 bp, Homo sapiens
aaacagtattatcaatatattt

SEQ ID NO: 8475287 - DNA, 22 bp, Homo sapiens
aaaactgtatcttcttgggact

SEQ ID NO: 8475288 - DNA, 22 bp, Homo sapiens
aaaactgtaggaattgggtgcc

SEQ ID NO: 8475289 - DNA, 22 bp, Homo sapiens
aaaaactggtaactattcccca

SEQ ID NO: 8475290 - DNA, 22 bp, Homo sapiens
aaaaactgcaattacttttgtc

SEQ ID NO: 8475291 - DNA, 22 bp, Homo sapiens
aaaactctgcagttagtttcta

SEQ ID NO: 8475292 - DNA, 22 bp, Homo sapiens
aaactgtaggagggaaaggaag

SEQ ID NO: 8475293 - DNA, 22 bp, Homo sapiens
aaactgtaagagaataaactac

SEQ ID NO: 8475294 - DNA, 22 bp, Homo sapiens
aaactgtaaagcaggtgagtag

SEQ ID NO: 8475295 - DNA, 22 bp, Homo sapiens
aaactgtaaatactagtaagtg

SEQ ID NO: 8475296 - DNA, 23 bp, Homo sapiens
aaagactgctgagaattttagga

SEQ ID NO: 8475297 - DNA, 22 bp, Homo sapiens
aaagactgcaaaaacgcacaga

SEQ ID NO: 8475298 - DNA, 22 bp, Homo sapiens
aaagactgggactgcagcaggc

SEQ ID NO: 8475299 - DNA, 22 bp, Homo sapiens
aaagactggtgtgttacatata

SEQ ID NO: 8475300 - DNA, 22 bp, Homo sapiens
aacactgtggtcttttcagtaa

SEQ ID NO: 8475301 - DNA, 20 bp, Homo sapiens
aacactgtgcgtggtaggtg

SEQ ID NO: 8475302 - DNA, 22 bp, Homo sapiens
aactgtacgataataaatttgt

SEQ ID NO: 8475303 - DNA, 22 bp, Homo sapiens
aactgtaatttttacatagtaa

SEQ ID NO: 8475304 - DNA, 22 bp, Homo sapiens
aactgtaatgaattgttcatga

SEQ ID NO: 8475305 - DNA, 22 bp, Homo sapiens
aactgtaaggcttagaacagca

SEQ ID NO: 8475306 - DNA, 22 bp, Homo sapiens
aactgtaaaggttgagtggtaa

SEQ ID NO: 8475307 - DNA, 22 bp, Homo sapiens
aactgtaagacaaatgacttct

SEQ ID NO: 8475308 - DNA, 22 bp, Homo sapiens
aagactgtatgagacaatataa

SEQ ID NO: 8475309 - DNA, 22 bp, Homo sapiens
aagactgtacattttccagtct

SEQ ID NO: 8475310 - DNA, 22 bp, Homo sapiens
aagactgtctgggacaagatga

SEQ ID NO: 8475311 - DNA, 22 bp, Homo sapiens
aagactgtgtctatggctactc

SEQ ID NO: 8475312 - DNA, 22 bp, Homo sapiens
acagactgtttggttcatgtct

SEQ ID NO: 8475313 - DNA, 22 bp, Homo sapiens
acagacaagtagttcagacaag

SEQ ID NO: 8475314 - DNA, 22 bp, Homo sapiens
aatgttttaaaagagattgaga

SEQ ID NO: 8475315 - DNA, 22 bp, Homo sapiens
acaagattttatgactcttttt

SEQ ID NO: 8475316 - DNA, 22 bp, Homo sapiens
acaagaattatttctagttaac

SEQ ID NO: 8475317 - DNA, 22 bp, Homo sapiens
actgttcatttggatttctctg

SEQ ID NO: 8475318 - DNA, 22 bp, Homo sapiens
actgttcatttgtcctgtatct

SEQ ID NO: 8475319 - DNA, 22 bp, Homo sapiens
actttcttaggctgtataaatg

SEQ ID NO: 8475320 - DNA, 22 bp, Homo sapiens
actgatacatctgtggaagtgg

SEQ ID NO: 8475321 - DNA, 22 bp, Homo sapiens
actgagtgtaggactttgagtt

SEQ ID NO: 8475322 - DNA, 22 bp, Homo sapiens
actgcactccagcctgggtaac

SEQ ID NO: 8475323 - DNA, 22 bp, Homo sapiens
actatacattgaatgttaaggt

SEQ ID NO: 8475324 - DNA, 22 bp, Homo sapiens
acatttctgcatgtagggtaat

SEQ ID NO: 8475325 - DNA, 22 bp, Homo sapiens
acatttctgagcagggagctgt

SEQ ID NO: 8475326 - DNA, 22 bp, Homo sapiens
acatttcttccctttagcagaa

SEQ ID NO: 8475327 - DNA, 22 bp, Homo sapiens
acatttcttccacatgctgctg

SEQ ID NO: 8475328 - DNA, 22 bp, Homo sapiens
acatttcttagcctagttccag

SEQ ID NO: 8475329 - DNA, 22 bp, Homo sapiens
acatttctgtcttagggactgt

SEQ ID NO: 8475330 - DNA, 22 bp, Homo sapiens
acatttctgctagaataggtga

SEQ ID NO: 8475331 - DNA, 22 bp, Homo sapiens
ggtggttcacgcctataatccc

SEQ ID NO: 8475332 - DNA, 22 bp, Homo sapiens
gtcccactgggcaactagaaaa

SEQ ID NO: 8475333 - DNA, 22 bp, Homo sapiens
gtggcctggcgagctggcgcgg

SEQ ID NO: 8475334 - DNA, 22 bp, Homo sapiens
gtggcctggaaaggctggtctg

SEQ ID NO: 8475335 - DNA, 22 bp, Homo sapiens
gtggcctgccagcagatggcgc

SEQ ID NO: 8475336 - DNA, 22 bp, Homo sapiens
gtggcctgatgccagccctgtg

SEQ ID NO: 8475337 - DNA, 22 bp, Homo sapiens
gtggcctgagcttcagagttgg

SEQ ID NO: 8475338 - DNA, 22 bp, Homo sapiens
gtggaagtagatttgagaaggt

SEQ ID NO: 8475339 - DNA, 22 bp, Homo sapiens
ggaggctcgctggtcgcacagc

SEQ ID NO: 8475340 - DNA, 22 bp, Homo sapiens
ggaggctcctaagctgacttga

SEQ ID NO: 8475341 - DNA, 22 bp, Homo sapiens
ggcagagactgggttggcagag

SEQ ID NO: 8475342 - DNA, 19 bp, Homo sapiens
ggcagacacagttgacatg

SEQ ID NO: 8475343 - DNA, 22 bp, Homo sapiens
ggagctgatgacgtcaccatgg

SEQ ID NO: 8475344 - DNA, 22 bp, Homo sapiens
ggagctgagcagcgatggcgga

SEQ ID NO: 8475345 - DNA, 22 bp, Homo sapiens
ggagctgaaccccatcgtgctg

SEQ ID NO: 8475346 - DNA, 22 bp, Homo sapiens
ggagctgaaggggtgggctcag

SEQ ID NO: 8475347 - DNA, 22 bp, Homo sapiens
ggaaacagagggcacctgagcc

SEQ ID NO: 8475348 - DNA, 22 bp, Homo sapiens
gagtgcagttggggtgagggga

SEQ ID NO: 8475349 - DNA, 22 bp, Homo sapiens
gagtgcagtatgagaggctgct

SEQ ID NO: 8475350 - DNA, 22 bp, Homo sapiens
gaaagtttgcctctctcttgag

SEQ ID NO: 8475351 - DNA, 22 bp, Homo sapiens
gagaaaatagcatgtgtagtat

SEQ ID NO: 8475352 - DNA, 22 bp, Homo sapiens
gactgtacttgagagaggaact

SEQ ID NO: 8475353 - DNA, 22 bp, Homo sapiens
gactgtacgtcattgaaggcca

SEQ ID NO: 8475354 - DNA, 22 bp, Homo sapiens
gaactgtataggagcagtgttt

SEQ ID NO: 8475355 - DNA, 22 bp, Homo sapiens
gatgttttttaggatctcagca

SEQ ID NO: 8475356 - DNA, 22 bp, Homo sapiens
ttttattctcaagacaatggga

SEQ ID NO: 8475357 - DNA, 22 bp, Homo sapiens
ttctgtatggaaacatcctcca

SEQ ID NO: 8475358 - DNA, 22 bp, Homo sapiens
ttctgtatctctgtgtttcttg

SEQ ID NO: 8475359 - DNA, 22 bp, Homo sapiens
ttgataaaatgatatcttcttt

SEQ ID NO: 8475360 - DNA, 22 bp, Homo sapiens
tttacacatacctctttaaagt

SEQ ID NO: 8475361 - DNA, 20 bp, Homo sapiens
tttcagttatcttgaccttc

SEQ ID NO: 8475362 - DNA, 19 bp, Homo sapiens
ctctccagctccagtagct

SEQ ID NO: 8475363 - DNA, 22 bp, Homo sapiens
ctctccagatctgctgagccag

SEQ ID NO: 8475364 - DNA, 22 bp, Homo sapiens
ctccagtctagtagagcctgct

SEQ ID NO: 8475365 - DNA, 22 bp, Homo sapiens
ttggccacactcactagagccc

SEQ ID NO: 8475366 - DNA, 22 bp, Homo sapiens
tggagctgagcacctccagggc

SEQ ID NO: 8475367 - DNA, 22 bp, Homo sapiens
tggagctgactcacaccagcta

SEQ ID NO: 8475368 - DNA, 22 bp, Homo sapiens
tggagctgagagccaggctggc

SEQ ID NO: 8475369 - DNA, 22 bp, Homo sapiens
tgtctcatctcttaaccccact

SEQ ID NO: 8475370 - DNA, 22 bp, Homo sapiens
tgtgcccagactgcctcagtga

SEQ ID NO: 8475371 - DNA, 22 bp, Homo sapiens
cctggcttttgtttataaattc

SEQ ID NO: 8475372 - DNA, 22 bp, Homo sapiens
tgtgttcaatccctagtctcag

SEQ ID NO: 8475373 - DNA, 22 bp, Homo sapiens
caggagctggatctccttgcgg

SEQ ID NO: 8475374 - DNA, 22 bp, Homo sapiens
taaagccacttcattctagtct

SEQ ID NO: 8475375 - DNA, 22 bp, Homo sapiens
caggaatgacccaacagtttca

SEQ ID NO: 8475376 - DNA, 22 bp, Homo sapiens
caggagactatggcccaaggcc

SEQ ID NO: 8475377 - DNA, 19 bp, Homo sapiens
gttttctgatcttgccccc

SEQ ID NO: 8475378 - DNA, 22 bp, Homo sapiens
gttttctgattagcaaatctga

SEQ ID NO: 8475379 - DNA, 22 bp, Homo sapiens
gttttctgccggtggtgggctc

SEQ ID NO: 8475380 - DNA, 22 bp, Homo sapiens
gttttctgcctgaaggtgacca

SEQ ID NO: 8475381 - DNA, 22 bp, Homo sapiens
taaaaagtagtgagaatggcgc

SEQ ID NO: 8475382 - DNA, 19 bp, Homo sapiens
taaaaactgaaggaagcag

SEQ ID NO: 8475383 - DNA, 22 bp, Homo sapiens
gttttctgtttcttaacggcat

SEQ ID NO: 8475384 - DNA, 22 bp, Homo sapiens
gttttctggcagttattcctta

SEQ ID NO: 8475385 - DNA, 22 bp, Homo sapiens
taatttaatttcatgccagcct

SEQ ID NO: 8475386 - DNA, 22 bp, Homo sapiens
taatttaatccaagtgttacat

SEQ ID NO: 8475387 - DNA, 22 bp, Homo sapiens
taatttaattccatggattcta

SEQ ID NO: 8475388 - DNA, 22 bp, Homo sapiens
cagctgagcatcactagtctgg

SEQ ID NO: 8475389 - DNA, 22 bp, Homo sapiens
gtggcctgtcagaagccgtggg

SEQ ID NO: 8475390 - DNA, 22 bp, Homo sapiens
cagctgagtttccaagtctgcc

SEQ ID NO: 8475391 - DNA, 22 bp, Homo sapiens
cagctgagttactctgaggtct

SEQ ID NO: 8475392 - DNA, 22 bp, Homo sapiens
tctgtcttagcatctttgctca

SEQ ID NO: 8475393 - DNA, 17 bp, Homo sapiens
tctgtcttgactgtcac

SEQ ID NO: 8475394 - DNA, 22 bp, Homo sapiens
ccactgagaccttttggaggag

SEQ ID NO: 8475395 - DNA, 22 bp, Homo sapiens
catttacttaaatctttacaag

SEQ ID NO: 8475396 - DNA, 22 bp, Homo sapiens
cagtttctctcatacatatttg

SEQ ID NO: 8475397 - DNA, 22 bp, Homo sapiens
cagtgcccaagatgtgccatgc

SEQ ID NO: 8475398 - DNA, 22 bp, Homo sapiens
tcagaaatagtctttaaaatga

SEQ ID NO: 8475399 - DNA, 22 bp, Homo sapiens
cagtcctgtgttaaacaagagc

SEQ ID NO: 8475400 - DNA, 22 bp, Homo sapiens
cagtcctggggaccaggctgag

SEQ ID NO: 8475401 - DNA, 22 bp, Homo sapiens
tatctgcatctgcatgtgtatt

SEQ ID NO: 8475402 - DNA, 22 bp, Homo sapiens
ttccagctaactcacatccctt

SEQ ID NO: 8475403 - DNA, 22 bp, Homo sapiens
ttaataaagtatgaattggaaa

SEQ ID NO: 8475404 - DNA, 22 bp, Homo sapiens
ttagatcttaggcaaatgtgtt

SEQ ID NO: 8475405 - DNA, 22 bp, Homo sapiens
ttagtaatgtgttaatatgaat

SEQ ID NO: 8475406 - DNA, 22 bp, Homo sapiens
tgtgcctactgatagagccaag

SEQ ID NO: 8475407 - DNA, 22 bp, Homo sapiens
tgtgcctgagttggctgagtac

SEQ ID NO: 8475408 - DNA, 22 bp, Homo sapiens
tgtttttccatgtgcagaacaa

SEQ ID NO: 8475409 - DNA, 21 bp, Homo sapiens
tgtttatggaaaagagacaaa

SEQ ID NO: 8475410 - DNA, 22 bp, Homo sapiens
tggtcaacaggcagggatgaaa

SEQ ID NO: 8475411 - DNA, 22 bp, Homo sapiens
tgtcctcaaggagcttcagtct

SEQ ID NO: 8475412 - DNA, 22 bp, Homo sapiens
tgtaacaaaataccttggattg

SEQ ID NO: 8475413 - DNA, 22 bp, Homo sapiens
tggttacacagcatgtggactt

SEQ ID NO: 8475414 - DNA, 22 bp, Homo sapiens
tggagctgaactttgaggccag

SEQ ID NO: 8475415 - DNA, 22 bp, Homo sapiens
tggagctggaatttgagctgga

SEQ ID NO: 8475416 - DNA, 22 bp, Homo sapiens
tggagctggaagacagtgatat

SEQ ID NO: 8475417 - DNA, 22 bp, Homo sapiens
tggagctgatacagctggcttt

SEQ ID NO: 8475418 - DNA, 18 bp, Homo sapiens
tggagctgagtgctgtgc

SEQ ID NO: 8475419 - DNA, 21 bp, Homo sapiens
tggagctgccacttgtcctcc

SEQ ID NO: 8475420 - DNA, 17 bp, Homo sapiens
tggagctgcgtgtgttc

SEQ ID NO: 8475421 - DNA, 20 bp, Homo sapiens
tggagctgtaatcttgtctg

SEQ ID NO: 8475422 - DNA, 22 bp, Homo sapiens
tggagctgggatttgaactgca

SEQ ID NO: 8475423 - DNA, 22 bp, Homo sapiens
tggagctggtaaacagtgacat

SEQ ID NO: 8475424 - DNA, 22 bp, Homo sapiens
tggacaacatagtgagacctca

SEQ ID NO: 8475425 - DNA, 22 bp, Homo sapiens
tgcttccagctctctgtaaggt

SEQ ID NO: 8475426 - DNA, 22 bp, Homo sapiens
tgctcagtgagtctgtgacagg

SEQ ID NO: 8475427 - DNA, 22 bp, Homo sapiens
tggcacatagcaggtactcagt

SEQ ID NO: 8475428 - DNA, 18 bp, Homo sapiens
tggcctggagacaactct

SEQ ID NO: 8475429 - DNA, 23 bp, Homo sapiens
tggctccatgaaaattacgagga

SEQ ID NO: 8475430 - DNA, 22 bp, Homo sapiens
tggctccatcatccatgcaaga

SEQ ID NO: 8475431 - DNA, 22 bp, Homo sapiens
tggcctggtccttgtcaaggca

SEQ ID NO: 8475432 - DNA, 22 bp, Homo sapiens
tggcctgggtgctgctgacatc

SEQ ID NO: 8475433 - DNA, 22 bp, Homo sapiens
tggcctgggtcacaccagggtc

SEQ ID NO: 8475434 - DNA, 22 bp, Homo sapiens
tggcctggctcacagtgagatt

SEQ ID NO: 8475435 - DNA, 22 bp, Homo sapiens
tgggaatgtgagcattcattca

SEQ ID NO: 8475436 - DNA, 22 bp, Homo sapiens
tgagctgtcaaggtacagtgaa

SEQ ID NO: 8475437 - DNA, 22 bp, Homo sapiens
tgagctggaatcttcttgactg

SEQ ID NO: 8475438 - DNA, 22 bp, Homo sapiens
tgagctgtaaggctgtcactga

SEQ ID NO: 8475439 - DNA, 22 bp, Homo sapiens
tgagctggtcactccttctgaa

SEQ ID NO: 8475440 - DNA, 22 bp, Homo sapiens
tgagatgaataactcctgctaa

SEQ ID NO: 8475441 - DNA, 22 bp, Homo sapiens
tgagatgaataactcctgctaa

SEQ ID NO: 8475442 - DNA, 22 bp, Homo sapiens
tctttgcatggacatgtgtttt

SEQ ID NO: 8475443 - DNA, 22 bp, Homo sapiens
tcttttatagtgaattttcttg

SEQ ID NO: 8475444 - DNA, 22 bp, Homo sapiens
tcttttatctgttgtgtaacaa

SEQ ID NO: 8475445 - DNA, 22 bp, Homo sapiens
tcttttattaggctgaaatggg

SEQ ID NO: 8475446 - DNA, 22 bp, Homo sapiens
tgaaacaaaccagtaattttgt

SEQ ID NO: 8475447 - DNA, 19 bp, Homo sapiens
tgaaacaaacttaaaagga

SEQ ID NO: 8475448 - DNA, 22 bp, Homo sapiens
tgaaacaaaagtatgtagcttg

SEQ ID NO: 8475449 - DNA, 22 bp, Homo sapiens
tgacaaaactgcaattactttt

SEQ ID NO: 8475450 - DNA, 22 bp, Homo sapiens
tgatcagtgttggttctatcta

SEQ ID NO: 8475451 - DNA, 21 bp, Homo sapiens
tgcaatccagcctgggcgaca

SEQ ID NO: 8475452 - DNA, 22 bp, Homo sapiens
tgcacatctttcagcatcatac

SEQ ID NO: 8475453 - DNA, 22 bp, Homo sapiens
tgcagctgaggccagctatgcc

SEQ ID NO: 8475454 - DNA, 21 bp, Homo sapiens
tgcaggagtctgtgagtcagg

SEQ ID NO: 8475455 - DNA, 22 bp, Homo sapiens
tgccatttacgagcagtatgac

SEQ ID NO: 8475456 - DNA, 22 bp, Homo sapiens
tctgaaatgcaaatttgactga

SEQ ID NO: 8475457 - DNA, 22 bp, Homo sapiens
tctgaaatgcaggcaatttgct

SEQ ID NO: 8475458 - DNA, 22 bp, Homo sapiens
tctgaaatgttctcttgttttg

SEQ ID NO: 8475459 - DNA, 22 bp, Homo sapiens
tctgaaaatgttgactttgttt

SEQ ID NO: 8475460 - DNA, 22 bp, Homo sapiens
tctctgagtaagtgacagttca

SEQ ID NO: 8475461 - DNA, 21 bp, Homo sapiens
tcctgtaagcttgggtggctc

SEQ ID NO: 8475462 - DNA, 22 bp, Homo sapiens
tcctttgacttcttgcagtcca

SEQ ID NO: 8475463 - DNA, 22 bp, Homo sapiens
tctaccacttattagctctgtg

SEQ ID NO: 8475464 - DNA, 22 bp, Homo sapiens
tctaccactaagtgtgctttga

SEQ ID NO: 8475465 - DNA, 22 bp, Homo sapiens
tctatttgctggttgcttctgt

SEQ ID NO: 8475466 - DNA, 22 bp, Homo sapiens
tctatttcgcatataagttttg

SEQ ID NO: 8475467 - DNA, 22 bp, Homo sapiens
tctgtacatttgtgttgtgaat

SEQ ID NO: 8475468 - DNA, 22 bp, Homo sapiens
tctgtacatttggggaccccag

SEQ ID NO: 8475469 - DNA, 22 bp, Homo sapiens
tctgtacagtaccagatagtaa

SEQ ID NO: 8475470 - DNA, 22 bp, Homo sapiens
tctgtacatgagttgagaatca

SEQ ID NO: 8475471 - DNA, 21 bp, Homo sapiens
tctgtacatcattgagtcccc

SEQ ID NO: 8475472 - DNA, 20 bp, Homo sapiens
tctgtacactcatcttctgc

SEQ ID NO: 8475473 - DNA, 22 bp, Homo sapiens
tctgtacaccaggggccattct

SEQ ID NO: 8475474 - DNA, 22 bp, Homo sapiens
tctgtacacttcagcatgcatc

SEQ ID NO: 8475475 - DNA, 23 bp, Homo sapiens
tctgtacacatcagcatctccca

SEQ ID NO: 8475476 - DNA, 23 bp, Homo sapiens
tctgtacaattgagaagagaaca

SEQ ID NO: 8475477 - DNA, 22 bp, Homo sapiens
tctgtacaacaaagggatgaga

SEQ ID NO: 8475478 - DNA, 22 bp, Homo sapiens
tctgtacaaaggctatttggag

SEQ ID NO: 8475479 - DNA, 22 bp, Homo sapiens
tctgtaatcaagatatttgaga

SEQ ID NO: 8475480 - DNA, 22 bp, Homo sapiens
tctgtctttagaggcctgtgct

SEQ ID NO: 8475481 - DNA, 22 bp, Homo sapiens
tctgtctttgagatctcagcct

SEQ ID NO: 8475482 - DNA, 22 bp, Homo sapiens
tctgtgcctcatctggttcagg

SEQ ID NO: 8475483 - DNA, 22 bp, Homo sapiens
tctgtttcttcttctgttatat

SEQ ID NO: 8475484 - DNA, 22 bp, Homo sapiens
tctttctacatcatttgcttct

SEQ ID NO: 8475485 - DNA, 22 bp, Homo sapiens
tcttattattgttgtaaaagca

SEQ ID NO: 8475486 - DNA, 21 bp, Homo sapiens
tctgagaacttctgctgcagc

SEQ ID NO: 8475487 - DNA, 22 bp, Homo sapiens
acatttctgctagaataggtga

SEQ ID NO: 8475488 - DNA, 22 bp, Homo sapiens
acatttctgctagaataggtga

SEQ ID NO: 8475489 - DNA, 22 bp, Homo sapiens
acatttctggagtttctcaaca

SEQ ID NO: 8475490 - DNA, 22 bp, Homo sapiens
acatttctggagtttctcaaca

SEQ ID NO: 8475491 - DNA, 22 bp, Homo sapiens
acatttctgtcttagggactgt

SEQ ID NO: 8475492 - DNA, 22 bp, Homo sapiens
acatttctggagtttctcaaca

SEQ ID NO: 8475493 - DNA, 22 bp, Homo sapiens
acatttctgtcttagggactgt

SEQ ID NO: 8475494 - DNA, 22 bp, Homo sapiens
acatttctggagtttctcaaca

SEQ ID NO: 8475495 - DNA, 22 bp, Homo sapiens
acatttcttagcctagttccag

SEQ ID NO: 8475496 - DNA, 22 bp, Homo sapiens
acatttcttagcctagttccag

SEQ ID NO: 8475497 - DNA, 22 bp, Homo sapiens
acatttcttccacatgctgctg

SEQ ID NO: 8475498 - DNA, 22 bp, Homo sapiens
acatttcttagcctagttccag

SEQ ID NO: 8475499 - DNA, 22 bp, Homo sapiens
acatttcttccctttagcagaa

SEQ ID NO: 8475500 - DNA, 22 bp, Homo sapiens
acatttcttccacatgctgctg

SEQ ID NO: 8475501 - DNA, 22 bp, Homo sapiens
acatttcttccctttagcagaa

SEQ ID NO: 8475502 - DNA, 22 bp, Homo sapiens
acatttcttccctttagcagaa

SEQ ID NO: 8475503 - DNA, 22 bp, Homo sapiens
acatttcttccctttagcagaa

SEQ ID NO: 8475504 - DNA, 22 bp, Homo sapiens
acatttcttcctaattatccct

SEQ ID NO: 8475505 - DNA, 22 bp, Homo sapiens
acatttctgagcagggagctgt

SEQ ID NO: 8475506 - DNA, 22 bp, Homo sapiens
acatttctcttgatgtctctat

SEQ ID NO: 8475507 - DNA, 22 bp, Homo sapiens
acatttctcttgatgtctctat

SEQ ID NO: 8475508 - DNA, 22 bp, Homo sapiens
acatttcatttgcagtatggat

SEQ ID NO: 8475509 - DNA, 22 bp, Homo sapiens
acatttctcttgatgtctctat

SEQ ID NO: 8475510 - DNA, 22 bp, Homo sapiens
acatttctgcatgtagggtaat

SEQ ID NO: 8475511 - DNA, 22 bp, Homo sapiens
acatttctgcatctcagagcta

SEQ ID NO: 8475512 - DNA, 22 bp, Homo sapiens
acatttctgcatgtagggtaat

SEQ ID NO: 8475513 - DNA, 22 bp, Homo sapiens
acatttctgcatctcagagcta

SEQ ID NO: 8475514 - DNA, 22 bp, Homo sapiens
acatttctgagcagggagctgt

SEQ ID NO: 8475515 - DNA, 22 bp, Homo sapiens
acatttcatgttttccagagca

SEQ ID NO: 8475516 - DNA, 22 bp, Homo sapiens
aaggctggcaatatatttgtta

SEQ ID NO: 8475517 - DNA, 22 bp, Homo sapiens
aaggctgggaaacatgcaggcc

SEQ ID NO: 8475518 - DNA, 22 bp, Homo sapiens
aaggctgggaaacatgcaggcc

SEQ ID NO: 8475519 - DNA, 22 bp, Homo sapiens
aaggctggcaatatatttgtta

SEQ ID NO: 8475520 - DNA, 22 bp, Homo sapiens
acatttaaatacctatgtttct

SEQ ID NO: 8475521 - DNA, 22 bp, Homo sapiens
acatttaaatacctatgtttct

SEQ ID NO: 8475522 - DNA, 22 bp, Homo sapiens
acatttaaatatgccttatatt

SEQ ID NO: 8475523 - DNA, 22 bp, Homo sapiens
acattgttgtgcaattatagtt

SEQ ID NO: 8475524 - DNA, 22 bp, Homo sapiens
acattgttgtgcaattatagtt

SEQ ID NO: 8475525 - DNA, 22 bp, Homo sapiens
aaggctggagatggttggaatg

SEQ ID NO: 8475526 - DNA, 19 bp, Homo sapiens
aaggctggagaaggcctct

SEQ ID NO: 8475527 - DNA, 21 bp, Homo sapiens
aaggctggagatgcaggtctg

SEQ ID NO: 8475528 - DNA, 21 bp, Homo sapiens
aaggctggagatgcaggtctg

SEQ ID NO: 8475529 - DNA, 22 bp, Homo sapiens
aaggctggacctggatgaatct

SEQ ID NO: 8475530 - DNA, 19 bp, Homo sapiens
aaggctggagaaggcctct

SEQ ID NO: 8475531 - DNA, 19 bp, Homo sapiens
aaggctggagaaggcctct

SEQ ID NO: 8475532 - DNA, 19 bp, Homo sapiens
acatttaaattcagatctc

SEQ ID NO: 8475533 - DNA, 19 bp, Homo sapiens
acatttaaattcagatctc

SEQ ID NO: 8475534 - DNA, 22 bp, Homo sapiens
aaggctgcttttaacatgcata

SEQ ID NO: 8475535 - DNA, 22 bp, Homo sapiens
aaggctggacctggatgaatct

SEQ ID NO: 8475536 - DNA, 19 bp, Homo sapiens
acatttaaattcagatctc

SEQ ID NO: 8475537 - DNA, 19 bp, Homo sapiens
acatttaaattcagatctc

SEQ ID NO: 8475538 - DNA, 22 bp, Homo sapiens
aaggctaaattctgtactgcat

SEQ ID NO: 8475539 - DNA, 22 bp, Homo sapiens
aaggctatgatctttttcatga

SEQ ID NO: 8475540 - DNA, 22 bp, Homo sapiens
aaggctcaattaactaagaagt

SEQ ID NO: 8475541 - DNA, 22 bp, Homo sapiens
aaggctctgcaaaacctccaag

SEQ ID NO: 8475542 - DNA, 22 bp, Homo sapiens
aaggctctgggtttcataggtg

SEQ ID NO: 8475543 - DNA, 22 bp, Homo sapiens
aaggctctgggtttcataggtg

SEQ ID NO: 8475544 - DNA, 22 bp, Homo sapiens
acattgttccagcgatagagaa

SEQ ID NO: 8475545 - DNA, 22 bp, Homo sapiens
aaggctcggcaatgtgcggctc

SEQ ID NO: 8475546 - DNA, 22 bp, Homo sapiens
aaggctctctgatggcagcagt

SEQ ID NO: 8475547 - DNA, 22 bp, Homo sapiens
aaggctctctgatggcagcagt

SEQ ID NO: 8475548 - DNA, 22 bp, Homo sapiens
aaggctctgcaaaacctccaag

SEQ ID NO: 8475549 - DNA, 22 bp, Homo sapiens
aaggctctctgatggcagcagt

SEQ ID NO: 8475550 - DNA, 22 bp, Homo sapiens
aaggcagataagaattcagcaa

SEQ ID NO: 8475551 - DNA, 22 bp, Homo sapiens
aaggcagataagaattcagcaa

SEQ ID NO: 8475552 - DNA, 21 bp, Homo sapiens
aaggcctgcttactgctagtt

SEQ ID NO: 8475553 - DNA, 21 bp, Homo sapiens
aaggcctgcttactgctagtt

SEQ ID NO: 8475554 - DNA, 22 bp, Homo sapiens
aaggcctgctcagctgtctgtg

SEQ ID NO: 8475555 - DNA, 22 bp, Homo sapiens
aaggcctgctcagctgtctgtg

SEQ ID NO: 8475556 - DNA, 22 bp, Homo sapiens
aaggccttgccgaaggatgcca

SEQ ID NO: 8475557 - DNA, 22 bp, Homo sapiens
aaggccttgcctgacagcacca

SEQ ID NO: 8475558 - DNA, 22 bp, Homo sapiens
accaggcttgataccaagaaat

SEQ ID NO: 8475559 - DNA, 19 bp, Homo sapiens
accaggcttatggtcagtg

SEQ ID NO: 8475560 - DNA, 19 bp, Homo sapiens
accaggcttatggtcagtg

SEQ ID NO: 8475561 - DNA, 19 bp, Homo sapiens
accaggcttatggtcagtg

SEQ ID NO: 8475562 - DNA, 22 bp, Homo sapiens
accaggcttaatcctttgctat

SEQ ID NO: 8475563 - DNA, 21 bp, Homo sapiens
acattttctgttttaggaagt

SEQ ID NO: 8475564 - DNA, 21 bp, Homo sapiens
acattttctgttttaggaagt

SEQ ID NO: 8475565 - DNA, 22 bp, Homo sapiens
acattttgaaagggaaattgtt

SEQ ID NO: 8475566 - DNA, 22 bp, Homo sapiens
accaggctgttgggcccagtgt

SEQ ID NO: 8475567 - DNA, 21 bp, Homo sapiens
accaggccaggaggctggcac

SEQ ID NO: 8475568 - DNA, 22 bp, Homo sapiens
acattttaatatgcttagtgtg

SEQ ID NO: 8475569 - DNA, 22 bp, Homo sapiens
acatttgtgcacatgtgcatgg

SEQ ID NO: 8475570 - DNA, 20 bp, Homo sapiens
acatttgtggatctgagaga

SEQ ID NO: 8475571 - DNA, 22 bp, Homo sapiens
acattttacaccaagacttctt

SEQ ID NO: 8475572 - DNA, 22 bp, Homo sapiens
acattttacagttgtctggcta

SEQ ID NO: 8475573 - DNA, 21 bp, Homo sapiens
acattttctgttttaggaagt

SEQ ID NO: 8475574 - DNA, 22 bp, Homo sapiens
accatgttggccaagctggtct

SEQ ID NO: 8475575 - DNA, 22 bp, Homo sapiens
accatgttggccaagctggtct

SEQ ID NO: 8475576 - DNA, 22 bp, Homo sapiens
acccagagcccttagcacagac

SEQ ID NO: 8475577 - DNA, 19 bp, Homo sapiens
acccagagccctttgcagg

SEQ ID NO: 8475578 - DNA, 19 bp, Homo sapiens
acccagagccctttgcagg

SEQ ID NO: 8475579 - DNA, 22 bp, Homo sapiens
acccagagctgggcttggcaaa

SEQ ID NO: 8475580 - DNA, 21 bp, Homo sapiens
accaggcttgtgggagggagc

SEQ ID NO: 8475581 - DNA, 22 bp, Homo sapiens
accaggcttgatgatttgctta

SEQ ID NO: 8475582 - DNA, 22 bp, Homo sapiens
accagggcaaatgtttgtactc

SEQ ID NO: 8475583 - DNA, 21 bp, Homo sapiens
accaggcttgtgggagggagc

SEQ ID NO: 8475584 - DNA, 22 bp, Homo sapiens
aagggctggtctagaaagggag

SEQ ID NO: 8475585 - DNA, 22 bp, Homo sapiens
aagggctgtaagccaagtaaag

SEQ ID NO: 8475586 - DNA, 22 bp, Homo sapiens
accagggcacaggagtctgaag

SEQ ID NO: 8475587 - DNA, 22 bp, Homo sapiens
accagggcacaggagtctgaag

SEQ ID NO: 8475588 - DNA, 22 bp, Homo sapiens
aagggctgggtctggttaaccc

SEQ ID NO: 8475589 - DNA, 22 bp, Homo sapiens
aagggctggtctagaaagggag

SEQ ID NO: 8475590 - DNA, 22 bp, Homo sapiens
accctgaggggtatagcagaag

SEQ ID NO: 8475591 - DNA, 22 bp, Homo sapiens
accctgaggggtatagcagaag

SEQ ID NO: 8475592 - DNA, 22 bp, Homo sapiens
accctgagtcagacagcctgac

SEQ ID NO: 8475593 - DNA, 22 bp, Homo sapiens
accctgagtcactgtctgtctg

SEQ ID NO: 8475594 - DNA, 22 bp, Homo sapiens
accctgagggtgctgggtttct

SEQ ID NO: 8475595 - DNA, 22 bp, Homo sapiens
accctgatataggtccaagagc

SEQ ID NO: 8475596 - DNA, 22 bp, Homo sapiens
accctgagtcagacagcctgac

SEQ ID NO: 8475597 - DNA, 22 bp, Homo sapiens
accctgagtcagacagcctgac

SEQ ID NO: 8475598 - DNA, 22 bp, Homo sapiens
accctgccaaggatggccccga

SEQ ID NO: 8475599 - DNA, 22 bp, Homo sapiens
accctgccgtgggctgcttgtg

SEQ ID NO: 8475600 - DNA, 22 bp, Homo sapiens
accctgccgtgggctgcttgtg

SEQ ID NO: 8475601 - DNA, 21 bp, Homo sapiens
accctttgtttatgaatcagc

SEQ ID NO: 8475602 - DNA, 22 bp, Homo sapiens
accgcagtgacgtgggacttcc

SEQ ID NO: 8475603 - DNA, 22 bp, Homo sapiens
acccaggatgataatgttcaca

SEQ ID NO: 8475604 - DNA, 22 bp, Homo sapiens
acccaggatagagtgctgcagt

SEQ ID NO: 8475605 - DNA, 22 bp, Homo sapiens
acccaggatgataatgttcaca

SEQ ID NO: 8475606 - DNA, 22 bp, Homo sapiens
accctgaagaaacttctaagtg

SEQ ID NO: 8475607 - DNA, 22 bp, Homo sapiens
accctgagaaagtcacatgcat

SEQ ID NO: 8475608 - DNA, 22 bp, Homo sapiens
acccctcagctcttcgtgcccc

SEQ ID NO: 8475609 - DNA, 22 bp, Homo sapiens
accctgaagaaacttctaagtg

SEQ ID NO: 8475610 - DNA, 22 bp, Homo sapiens
accctgaagcaggcactcagct

SEQ ID NO: 8475611 - DNA, 22 bp, Homo sapiens
accctgagaaagtcacatgcat

SEQ ID NO: 8475612 - DNA, 22 bp, Homo sapiens
accctgagaaagtcacatgcat

SEQ ID NO: 8475613 - DNA, 22 bp, Homo sapiens
accctgagaaagtcacatgcat

SEQ ID NO: 8475614 - DNA, 19 bp, Homo sapiens
accctgagaggtggtccgg

SEQ ID NO: 8475615 - DNA, 22 bp, Homo sapiens
accctgagaatgagtgtctcct

SEQ ID NO: 8475616 - DNA, 20 bp, Homo sapiens
accctgaggctccccagcct

SEQ ID NO: 8475617 - DNA, 20 bp, Homo sapiens
accctgaggctccccagcct

SEQ ID NO: 8475618 - DNA, 22 bp, Homo sapiens
acccaggaggtggaggctgcag

SEQ ID NO: 8475619 - DNA, 22 bp, Homo sapiens
acccaggaggtggaggctgcag

SEQ ID NO: 8475620 - DNA, 22 bp, Homo sapiens
acccaggaggtggaggctgcag

SEQ ID NO: 8475621 - DNA, 22 bp, Homo sapiens
acccaggaggtgacacagggct

SEQ ID NO: 8475622 - DNA, 22 bp, Homo sapiens
acccaggaggtgacacagggct

SEQ ID NO: 8475623 - DNA, 22 bp, Homo sapiens
acccaggaggtgacacagggct

SEQ ID NO: 8475624 - DNA, 22 bp, Homo sapiens
acccaggatagagtgctgcagt

SEQ ID NO: 8475625 - DNA, 22 bp, Homo sapiens
acccaggatagagtgctgcagt

SEQ ID NO: 8475626 - DNA, 22 bp, Homo sapiens
acccaggataatctgtgtatct

SEQ ID NO: 8475627 - DNA, 22 bp, Homo sapiens
acccaggatagagtgctgcagt

SEQ ID NO: 8475628 - DNA, 22 bp, Homo sapiens
acccaggataatctgtgtatct

SEQ ID NO: 8475629 - DNA, 22 bp, Homo sapiens
acccaggataatctgtgtatct

SEQ ID NO: 8475630 - DNA, 22 bp, Homo sapiens
acccaggaggcaaggttgcagt

SEQ ID NO: 8475631 - DNA, 22 bp, Homo sapiens
acccaggaggcaaggttgcagt

SEQ ID NO: 8475632 - DNA, 22 bp, Homo sapiens
acccaggaggcagaggttgcag

SEQ ID NO: 8475633 - DNA, 22 bp, Homo sapiens
acccaggaggcagaggttgcag

SEQ ID NO: 8475634 - DNA, 22 bp, Homo sapiens
acccaggagccgtgagaggtta

SEQ ID NO: 8475635 - DNA, 22 bp, Homo sapiens
acccaggagctctggggtcctc

SEQ ID NO: 8475636 - DNA, 22 bp, Homo sapiens
acccaggagctctggggtcctc

SEQ ID NO: 8475637 - DNA, 22 bp, Homo sapiens
acccaggaggcaaggttgcagt

SEQ ID NO: 8475638 - DNA, 22 bp, Homo sapiens
acccaggagccgtgagaggtta

SEQ ID NO: 8475639 - DNA, 22 bp, Homo sapiens
acccaggagccgtgagaggtta

SEQ ID NO: 8475640 - DNA, 22 bp, Homo sapiens
acccagagtcatggcacttagc

SEQ ID NO: 8475641 - DNA, 22 bp, Homo sapiens
acccagagtcatgtttattccc

SEQ ID NO: 8475642 - DNA, 22 bp, Homo sapiens
acccagagtcagacagccatgg

SEQ ID NO: 8475643 - DNA, 22 bp, Homo sapiens
acccagagtcagacagccatgg

SEQ ID NO: 8475644 - DNA, 22 bp, Homo sapiens
acccagagtcagacagccatgg

SEQ ID NO: 8475645 - DNA, 22 bp, Homo sapiens
acccagagtaacagatggattc

SEQ ID NO: 8475646 - DNA, 22 bp, Homo sapiens
acccagaggtgtctagcaagct

SEQ ID NO: 8475647 - DNA, 22 bp, Homo sapiens
acccagagctgggcttggcaaa

SEQ ID NO: 8475648 - DNA, 22 bp, Homo sapiens
acccagagctgggcttggcaaa

SEQ ID NO: 8475649 - DNA, 22 bp, Homo sapiens
acccagaggcggaggttgcagt

SEQ ID NO: 8475650 - DNA, 20 bp, Homo sapiens
acatatgtgtgcatatcttt

SEQ ID NO: 8475651 - DNA, 22 bp, Homo sapiens
acatatgtctatttcatgtaaa

SEQ ID NO: 8475652 - DNA, 22 bp, Homo sapiens
acatatgtctatttcatgtaaa

SEQ ID NO: 8475653 - DNA, 19 bp, Homo sapiens
acatatgtggatatacatg

SEQ ID NO: 8475654 - DNA, 22 bp, Homo sapiens
acatatgctcatctgcattccc

SEQ ID NO: 8475655 - DNA, 22 bp, Homo sapiens
acatatgcgatcataggatgca

SEQ ID NO: 8475656 - DNA, 22 bp, Homo sapiens
acatatgcgatcataggatgca

SEQ ID NO: 8475657 - DNA, 22 bp, Homo sapiens
acatatgcgatcataggatgca

SEQ ID NO: 8475658 - DNA, 22 bp, Homo sapiens
acatatgctcatctgcattccc

SEQ ID NO: 8475659 - DNA, 22 bp, Homo sapiens
acatatgagtactatacagtgc

SEQ ID NO: 8475660 - DNA, 22 bp, Homo sapiens
acatatgcgatcataggatgca

SEQ ID NO: 8475661 - DNA, 22 bp, Homo sapiens
acatatgatattgaggatctca

SEQ ID NO: 8475662 - DNA, 22 bp, Homo sapiens
acatatgtgttgtacatgcatg

SEQ ID NO: 8475663 - DNA, 22 bp, Homo sapiens
aaggcagagattagcagaatga

SEQ ID NO: 8475664 - DNA, 22 bp, Homo sapiens
acatatgtgttgtacatgcatg

SEQ ID NO: 8475665 - DNA, 22 bp, Homo sapiens
aaggcagagattagcagaatga

SEQ ID NO: 8475666 - DNA, 22 bp, Homo sapiens
aaggcagagtctatcttggaag

SEQ ID NO: 8475667 - DNA, 22 bp, Homo sapiens
aaggcagagggctggatcagag

SEQ ID NO: 8475668 - DNA, 22 bp, Homo sapiens
aaggcagagggctggatcagag

SEQ ID NO: 8475669 - DNA, 22 bp, Homo sapiens
aaggcagaggaaggtctagttt

SEQ ID NO: 8475670 - DNA, 22 bp, Homo sapiens
aaggcagaggaaggtctagttt

SEQ ID NO: 8475671 - DNA, 22 bp, Homo sapiens
aaggaggaatttcagggtgaat

SEQ ID NO: 8475672 - DNA, 22 bp, Homo sapiens
aaggaggaattctgagttcatg

SEQ ID NO: 8475673 - DNA, 22 bp, Homo sapiens
aaggaggaatttcagggtgaat

SEQ ID NO: 8475674 - DNA, 22 bp, Homo sapiens
acagtgtttatgtacagattgt

SEQ ID NO: 8475675 - DNA, 22 bp, Homo sapiens
acagtgtttaagagatggcatt

SEQ ID NO: 8475676 - DNA, 22 bp, Homo sapiens
acagtgtttatgtacagattgt

SEQ ID NO: 8475677 - DNA, 22 bp, Homo sapiens
acagtgtttcacttaaccgttt

SEQ ID NO: 8475678 - DNA, 22 bp, Homo sapiens
acagtgtttggcaatgcatgca

SEQ ID NO: 8475679 - DNA, 22 bp, Homo sapiens
acatatctttccctctcctgaa

SEQ ID NO: 8475680 - DNA, 20 bp, Homo sapiens
acatatgaatgatagagcca

SEQ ID NO: 8475681 - DNA, 22 bp, Homo sapiens
aaggaggcagaactcacatgga

SEQ ID NO: 8475682 - DNA, 22 bp, Homo sapiens
acatagaacctggcacatagta

SEQ ID NO: 8475683 - DNA, 22 bp, Homo sapiens
aaggaggagtggggtcctggaa

SEQ ID NO: 8475684 - DNA, 22 bp, Homo sapiens
aaggaggagtggggtcctggaa

SEQ ID NO: 8475685 - DNA, 22 bp, Homo sapiens
aaggaggagcggaggcttgttg

SEQ ID NO: 8475686 - DNA, 22 bp, Homo sapiens
aagctggactctgccatttact

SEQ ID NO: 8475687 - DNA, 22 bp, Homo sapiens
aagctggacattgtagggggga

SEQ ID NO: 8475688 - DNA, 22 bp, Homo sapiens
aagctggacactgacccactgt

SEQ ID NO: 8475689 - DNA, 20 bp, Homo sapiens
aagctggaagaccagcattg

SEQ ID NO: 8475690 - DNA, 22 bp, Homo sapiens
aagctggacactgacccactgt

SEQ ID NO: 8475691 - DNA, 20 bp, Homo sapiens
aagctggaagaccagcattg

SEQ ID NO: 8475692 - DNA, 20 bp, Homo sapiens
aagctggaagaccagcattg

SEQ ID NO: 8475693 - DNA, 22 bp, Homo sapiens
aaggacaggctaacctgacatt

SEQ ID NO: 8475694 - DNA, 22 bp, Homo sapiens
aagctggagagttaggtgaata

SEQ ID NO: 8475695 - DNA, 22 bp, Homo sapiens
aagctggagagttaggtgaata

SEQ ID NO: 8475696 - DNA, 22 bp, Homo sapiens
aaggagacatttgcagagcacc

SEQ ID NO: 8475697 - DNA, 22 bp, Homo sapiens
aaggagagagctttgctggaac

SEQ ID NO: 8475698 - DNA, 17 bp, Homo sapiens
aaggagctgagagatgg

SEQ ID NO: 8475699 - DNA, 21 bp, Homo sapiens
aaggagcctaggaggctcagg

SEQ ID NO: 8475700 - DNA, 22 bp, Homo sapiens
aaggagcgcttagggggcagaa

SEQ ID NO: 8475701 - DNA, 22 bp, Homo sapiens
aaggagctcccggcagaccagg

SEQ ID NO: 8475702 - DNA, 22 bp, Homo sapiens
aaggagctatgcataactgatc

SEQ ID NO: 8475703 - DNA, 17 bp, Homo sapiens
aaggagctgagagatgg

SEQ ID NO: 8475704 - DNA, 22 bp, Homo sapiens
aaggagagtacaggagttggta

SEQ ID NO: 8475705 - DNA, 22 bp, Homo sapiens
acagtctttagagtattgtcct

SEQ ID NO: 8475706 - DNA, 22 bp, Homo sapiens
acagtgttcttgatattacagt

SEQ ID NO: 8475707 - DNA, 22 bp, Homo sapiens
acagtgttcttggcgctgagtg

SEQ ID NO: 8475708 - DNA, 22 bp, Homo sapiens
acagtgttgtggctcttaatag

SEQ ID NO: 8475709 - DNA, 22 bp, Homo sapiens
acagtgttgtatttagtttgat

SEQ ID NO: 8475710 - DNA, 22 bp, Homo sapiens
acagtgttgaggtgcttgtttc

SEQ ID NO: 8475711 - DNA, 22 bp, Homo sapiens
acagtgtttaaaaatcagatct

SEQ ID NO: 8475712 - DNA, 22 bp, Homo sapiens
acagtgtttaaaataatatgct

SEQ ID NO: 8475713 - DNA, 22 bp, Homo sapiens
acagtcttatgcatacactatt

SEQ ID NO: 8475714 - DNA, 22 bp, Homo sapiens
aaggaggaataaagaggtggtg

SEQ ID NO: 8475715 - DNA, 22 bp, Homo sapiens
aaggaggaaaatattgttgctg

SEQ ID NO: 8475716 - DNA, 22 bp, Homo sapiens
acagtctgtcccccaggtgcta

SEQ ID NO: 8475717 - DNA, 22 bp, Homo sapiens
acagtctgtcccccaggtgcta

SEQ ID NO: 8475718 - DNA, 22 bp, Homo sapiens
aaggaggaataaagaggtggtg

SEQ ID NO: 8475719 - DNA, 22 bp, Homo sapiens
acagtctttaatttctttgtgg

SEQ ID NO: 8475720 - DNA, 22 bp, Homo sapiens
acagtcttgctgtatggtcagg

SEQ ID NO: 8475721 - DNA, 22 bp, Homo sapiens
acagtcttcccttattccactc

SEQ ID NO: 8475722 - DNA, 22 bp, Homo sapiens
acagtcttgagcatcagccaga

SEQ ID NO: 8475723 - DNA, 22 bp, Homo sapiens
acagtcttgagcatcagccaga

SEQ ID NO: 8475724 - DNA, 19 bp, Homo sapiens
acagggcagcaataggata

SEQ ID NO: 8475725 - DNA, 18 bp, Homo sapiens
aagctgccctcaggcagg

SEQ ID NO: 8475726 - DNA, 22 bp, Homo sapiens
aagctgccctcattcccagtgc

SEQ ID NO: 8475727 - DNA, 22 bp, Homo sapiens
aagctgccctgtgttagagttc

SEQ ID NO: 8475728 - DNA, 22 bp, Homo sapiens
aagctgccctcattcccagtgc

SEQ ID NO: 8475729 - DNA, 18 bp, Homo sapiens
aagctgccctcaggcagg

SEQ ID NO: 8475730 - DNA, 22 bp, Homo sapiens
aagctgcctagagttgaatgtc

SEQ ID NO: 8475731 - DNA, 22 bp, Homo sapiens
aagctgccctgtgttagagttc

SEQ ID NO: 8475732 - DNA, 22 bp, Homo sapiens
aagctgcctgccacgctagata

SEQ ID NO: 8475733 - DNA, 22 bp, Homo sapiens
aagctgcctgggaggaagggct

SEQ ID NO: 8475734 - DNA, 22 bp, Homo sapiens
aagctggaacatcttgaggaag

SEQ ID NO: 8475735 - DNA, 22 bp, Homo sapiens
aagctgctttgtcaggaatatg

SEQ ID NO: 8475736 - DNA, 22 bp, Homo sapiens
aagctgccttgctgaggagaaa

SEQ ID NO: 8475737 - DNA, 22 bp, Homo sapiens
aagctgcctgggaggaagggct

SEQ ID NO: 8475738 - DNA, 23 bp, Homo sapiens
aagctgccttcgcagttggtctg

SEQ ID NO: 8475739 - DNA, 22 bp, Homo sapiens
aagctgccttgctgaggagaaa

SEQ ID NO: 8475740 - DNA, 22 bp, Homo sapiens
aagctgctggtgactgggctga

SEQ ID NO: 8475741 - DNA, 22 bp, Homo sapiens
aagctgccttccatgtgaggaa

SEQ ID NO: 8475742 - DNA, 23 bp, Homo sapiens
aagctgccttcgcagttggtctg

SEQ ID NO: 8475743 - DNA, 22 bp, Homo sapiens
aagctgccttgctgaggagaaa

SEQ ID NO: 8475744 - DNA, 22 bp, Homo sapiens
aagctgccttccatgtgaggaa

SEQ ID NO: 8475745 - DNA, 22 bp, Homo sapiens
aagctgccttccatgtgaggaa

SEQ ID NO: 8475746 - DNA, 22 bp, Homo sapiens
aagctgcctagagttgaatgtc

SEQ ID NO: 8475747 - DNA, 22 bp, Homo sapiens
aagctgcctgccacgctagata

SEQ ID NO: 8475748 - DNA, 22 bp, Homo sapiens
aagctgcctgggaggaagggct

SEQ ID NO: 8475749 - DNA, 17 bp, Homo sapiens
acagggcagaaacagct

SEQ ID NO: 8475750 - DNA, 22 bp, Homo sapiens
acagggcagaaatgttgcatct

SEQ ID NO: 8475751 - DNA, 22 bp, Homo sapiens
acagggcagaaatgttgcatct

SEQ ID NO: 8475752 - DNA, 22 bp, Homo sapiens
acagggcagagaggcaggcttg

SEQ ID NO: 8475753 - DNA, 22 bp, Homo sapiens
acagggcagagaggcaggcttg

SEQ ID NO: 8475754 - DNA, 22 bp, Homo sapiens
acagggcagagaggcaggcttg

SEQ ID NO: 8475755 - DNA, 22 bp, Homo sapiens
acagggcagcaactttgtgcct

SEQ ID NO: 8475756 - DNA, 22 bp, Homo sapiens
acagggcagagtgaaatgctat

SEQ ID NO: 8475757 - DNA, 22 bp, Homo sapiens
acagggcagcaactttgtgcct

SEQ ID NO: 8475758 - DNA, 22 bp, Homo sapiens
acagggcagagggcagttggta

SEQ ID NO: 8475759 - DNA, 22 bp, Homo sapiens
acagggcagagggcagttggta

SEQ ID NO: 8475760 - DNA, 22 bp, Homo sapiens
acagggcagagtgaaatgctat

SEQ ID NO: 8475761 - DNA, 22 bp, Homo sapiens
acagggcagagggcagttggta

SEQ ID NO: 8475762 - DNA, 22 bp, Homo sapiens
aagctctggggtacacatctgc

SEQ ID NO: 8475763 - DNA, 22 bp, Homo sapiens
aagctctgctcagcagactagg

SEQ ID NO: 8475764 - DNA, 17 bp, Homo sapiens
acagggcagaaacagct

SEQ ID NO: 8475765 - DNA, 17 bp, Homo sapiens
acagggcagaaacagct

SEQ ID NO: 8475766 - DNA, 22 bp, Homo sapiens
acagggaaagggacagcagcag

SEQ ID NO: 8475767 - DNA, 22 bp, Homo sapiens
aagctcagcatgtctcctagaa

SEQ ID NO: 8475768 - DNA, 22 bp, Homo sapiens
aagctcagcatgtctcctagaa

SEQ ID NO: 8475769 - DNA, 22 bp, Homo sapiens
aagctcagagtctcggagggaa

SEQ ID NO: 8475770 - DNA, 22 bp, Homo sapiens
aagctcagagtagctcagcgtc

SEQ ID NO: 8475771 - DNA, 22 bp, Homo sapiens
aagctccccgaaacccacctct

SEQ ID NO: 8475772 - DNA, 19 bp, Homo sapiens
aagctccagcagatccttt

SEQ ID NO: 8475773 - DNA, 22 bp, Homo sapiens
aagctctctgtcccctggactg

SEQ ID NO: 8475774 - DNA, 22 bp, Homo sapiens
aagctccccgaaacccacctct

SEQ ID NO: 8475775 - DNA, 22 bp, Homo sapiens
aagctcaggctggacctggctt

SEQ ID NO: 8475776 - DNA, 22 bp, Homo sapiens
aagctcaggctggacctggctt

SEQ ID NO: 8475777 - DNA, 22 bp, Homo sapiens
aagctcaggaaagagtctggtt

SEQ ID NO: 8475778 - DNA, 22 bp, Homo sapiens
aagctcagtgatgcctccaggg

SEQ ID NO: 8475779 - DNA, 22 bp, Homo sapiens
aagctcagtgatgcctccaggg

SEQ ID NO: 8475780 - DNA, 22 bp, Homo sapiens
aagctcattaattagaagctaa

SEQ ID NO: 8475781 - DNA, 21 bp, Homo sapiens
acagcctgtcatctcatggtc

SEQ ID NO: 8475782 - DNA, 21 bp, Homo sapiens
acagcctgtcatctcatggtc

SEQ ID NO: 8475783 - DNA, 21 bp, Homo sapiens
acagcctgtcatctcatggtc

SEQ ID NO: 8475784 - DNA, 22 bp, Homo sapiens
acagcctgtgtaccagctggga

SEQ ID NO: 8475785 - DNA, 22 bp, Homo sapiens
acagcctggactggctctctgc

SEQ ID NO: 8475786 - DNA, 22 bp, Homo sapiens
acagcctggcctgagttaaggc

SEQ ID NO: 8475787 - DNA, 19 bp, Homo sapiens
acagcctgttggtggggct

SEQ ID NO: 8475788 - DNA, 22 bp, Homo sapiens
acagcctgtgtaccagctggga

SEQ ID NO: 8475789 - DNA, 22 bp, Homo sapiens
acagcctgtgtaccagctggga

SEQ ID NO: 8475790 - DNA, 22 bp, Homo sapiens
acagcctgtgtaccagctggga

SEQ ID NO: 8475791 - DNA, 22 bp, Homo sapiens
acagcctgtttgatctggtgct

SEQ ID NO: 8475792 - DNA, 22 bp, Homo sapiens
acagcctgtttgatctggtgct

SEQ ID NO: 8475793 - DNA, 22 bp, Homo sapiens
acagcctgtttgatctggtgct

SEQ ID NO: 8475794 - DNA, 19 bp, Homo sapiens
acagcctgttggtggggct

SEQ ID NO: 8475795 - DNA, 22 bp, Homo sapiens
aagcattttagataaagcatca

SEQ ID NO: 8475796 - DNA, 22 bp, Homo sapiens
acagccttattgcgagcaaggc

SEQ ID NO: 8475797 - DNA, 22 bp, Homo sapiens
aagcattttagataaagcatca

SEQ ID NO: 8475798 - DNA, 22 bp, Homo sapiens
aagcattttagtaatgaacttg

SEQ ID NO: 8475799 - DNA, 22 bp, Homo sapiens
aagcattttgttttaagaatga

SEQ ID NO: 8475800 - DNA, 22 bp, Homo sapiens
aagcattttgttttaagaatga

SEQ ID NO: 8475801 - DNA, 22 bp, Homo sapiens
aagcattttgccacttgaagtt

SEQ ID NO: 8475802 - DNA, 22 bp, Homo sapiens
aagcattttgttttaagaatga

SEQ ID NO: 8475803 - DNA, 22 bp, Homo sapiens
aagcatttttcacagcaacagc

SEQ ID NO: 8475804 - DNA, 22 bp, Homo sapiens
aagctatattatatttgtgttt

SEQ ID NO: 8475805 - DNA, 22 bp, Homo sapiens
aagctatacaatgcacaaatga

SEQ ID NO: 8475806 - DNA, 19 bp, Homo sapiens
aagcgtttcccacttgctt

SEQ ID NO: 8475807 - DNA, 19 bp, Homo sapiens
aagcgtttcccacttgctt

SEQ ID NO: 8475808 - DNA, 22 bp, Homo sapiens
aagccaagagttaactatttgt

SEQ ID NO: 8475809 - DNA, 22 bp, Homo sapiens
aagcatttttgaaatggtagga

SEQ ID NO: 8475810 - DNA, 22 bp, Homo sapiens
aagccaaaggctccagtgacct

SEQ ID NO: 8475811 - DNA, 22 bp, Homo sapiens
aagccctggctcagctcaccag

SEQ ID NO: 8475812 - DNA, 22 bp, Homo sapiens
aagccctgggatgttcagcagt

SEQ ID NO: 8475813 - DNA, 22 bp, Homo sapiens
aagccttcctgagtgcaaggcc

SEQ ID NO: 8475814 - DNA, 22 bp, Homo sapiens
aagccctgggatgttcagcagt

SEQ ID NO: 8475815 - DNA, 22 bp, Homo sapiens
aagcgactgcaggttaaaacaa

SEQ ID NO: 8475816 - DNA, 22 bp, Homo sapiens
actatacattgaatgttaaggt

SEQ ID NO: 8475817 - DNA, 22 bp, Homo sapiens
actatacattgaatgttaaggt

SEQ ID NO: 8475818 - DNA, 22 bp, Homo sapiens
actatacattgaatgttaaggt

SEQ ID NO: 8475819 - DNA, 22 bp, Homo sapiens
actcactgcactttgaaatgtg

SEQ ID NO: 8475820 - DNA, 22 bp, Homo sapiens
actatacattgaatgttaaggt

SEQ ID NO: 8475821 - DNA, 22 bp, Homo sapiens
actcactagaggtagatccctg

SEQ ID NO: 8475822 - DNA, 22 bp, Homo sapiens
actatacattgaatgttaaggt

SEQ ID NO: 8475823 - DNA, 22 bp, Homo sapiens
actatacagtatgtacgtgcac

SEQ ID NO: 8475824 - DNA, 22 bp, Homo sapiens
actatacagtatgtacgtgcac

SEQ ID NO: 8475825 - DNA, 22 bp, Homo sapiens
actatacagtatgtacgtgcac

SEQ ID NO: 8475826 - DNA, 22 bp, Homo sapiens
actcagaatgactgatgctgtg

SEQ ID NO: 8475827 - DNA, 22 bp, Homo sapiens
actcagaatgtcactgagggac

SEQ ID NO: 8475828 - DNA, 22 bp, Homo sapiens
actcagaatgtcactgagggac

SEQ ID NO: 8475829 - DNA, 22 bp, Homo sapiens
actcagaatgactgatgctgtg

SEQ ID NO: 8475830 - DNA, 22 bp, Homo sapiens
actcagaagatataatgactca

SEQ ID NO: 8475831 - DNA, 22 bp, Homo sapiens
actcagaagatataatgactca

SEQ ID NO: 8475832 - DNA, 22 bp, Homo sapiens
actcagaagatgtgggtagata

SEQ ID NO: 8475833 - DNA, 22 bp, Homo sapiens
actcactgggtcccggaagccc

SEQ ID NO: 8475834 - DNA, 22 bp, Homo sapiens
actcactgggtcccggaagccc

SEQ ID NO: 8475835 - DNA, 22 bp, Homo sapiens
actcactttccattcaagcacc

SEQ ID NO: 8475836 - DNA, 22 bp, Homo sapiens
actcacttcttttactataaaa

SEQ ID NO: 8475837 - DNA, 22 bp, Homo sapiens
actcagaagatataatgactca

SEQ ID NO: 8475838 - DNA, 22 bp, Homo sapiens
actcagaaccatttactctgag

SEQ ID NO: 8475839 - DNA, 22 bp, Homo sapiens
actcagaaccatttactctgag

SEQ ID NO: 8475840 - DNA, 22 bp, Homo sapiens
actacagaagtcttattagaga

SEQ ID NO: 8475841 - DNA, 22 bp, Homo sapiens
actataaaaggataaaccagaa

SEQ ID NO: 8475842 - DNA, 22 bp, Homo sapiens
actataaaaggataaaccagaa

SEQ ID NO: 8475843 - DNA, 22 bp, Homo sapiens
actatacaccaaaatattaagg

SEQ ID NO: 8475844 - DNA, 22 bp, Homo sapiens
actatacaccaaaatattaagg

SEQ ID NO: 8475845 - DNA, 22 bp, Homo sapiens
actataacccatggaatataag

SEQ ID NO: 8475846 - DNA, 22 bp, Homo sapiens
actataacctgttagaatagat

SEQ ID NO: 8475847 - DNA, 23 bp, Homo sapiens
actataaagttgttctgatttac

SEQ ID NO: 8475848 - DNA, 22 bp, Homo sapiens
actctcagagggtggcagcaat

SEQ ID NO: 8475849 - DNA, 22 bp, Homo sapiens
actctataaagatacctcaatt

SEQ ID NO: 8475850 - DNA, 22 bp, Homo sapiens
actctcagggctccagggaaag

SEQ ID NO: 8475851 - DNA, 22 bp, Homo sapiens
actctcagagggtggcagcaat

SEQ ID NO: 8475852 - DNA, 22 bp, Homo sapiens
actctcagggacagggtctggg

SEQ ID NO: 8475853 - DNA, 23 bp, Homo sapiens
actctcaggttctttccagcagg

SEQ ID NO: 8475854 - DNA, 23 bp, Homo sapiens
actccccagtctcttcttgccaa

SEQ ID NO: 8475855 - DNA, 22 bp, Homo sapiens
actctaccatgccactccatag

SEQ ID NO: 8475856 - DNA, 22 bp, Homo sapiens
actctacagaatgaatacctgt

SEQ ID NO: 8475857 - DNA, 19 bp, Homo sapiens
actctacagtgtgtacaac

SEQ ID NO: 8475858 - DNA, 22 bp, Homo sapiens
actcagagaaacagcagggtgt

SEQ ID NO: 8475859 - DNA, 22 bp, Homo sapiens
actcagagaatatctagaagga

SEQ ID NO: 8475860 - DNA, 23 bp, Homo sapiens
actccccagtctcttcttgccaa

SEQ ID NO: 8475861 - DNA, 22 bp, Homo sapiens
acgtagcactgagagatgcagg

SEQ ID NO: 8475862 - DNA, 22 bp, Homo sapiens
acgtatattgaaatatcatgag

SEQ ID NO: 8475863 - DNA, 22 bp, Homo sapiens
acgtagtgtgttgtggaaagag

SEQ ID NO: 8475864 - DNA, 22 bp, Homo sapiens
acgggtggtaatgagaaaagga

SEQ ID NO: 8475865 - DNA, 22 bp, Homo sapiens
acgggtggctgaggaggcctct

SEQ ID NO: 8475866 - DNA, 22 bp, Homo sapiens
acgggtggtaatgagaaaagga

SEQ ID NO: 8475867 - DNA, 22 bp, Homo sapiens
acgggtggctgaggaggcctct

SEQ ID NO: 8475868 - DNA, 22 bp, Homo sapiens
acggggctagagaaggtttctt

SEQ ID NO: 8475869 - DNA, 22 bp, Homo sapiens
acctttatgattcacaatgtat

SEQ ID NO: 8475870 - DNA, 23 bp, Homo sapiens
acctagaaatacgttttacatgg

SEQ ID NO: 8475871 - DNA, 22 bp, Homo sapiens
acctagaaactgacagaatatt

SEQ ID NO: 8475872 - DNA, 22 bp, Homo sapiens
acctagaatttaaaacattgct

SEQ ID NO: 8475873 - DNA, 22 bp, Homo sapiens
acctagaatttaaaacattgct

SEQ ID NO: 8475874 - DNA, 22 bp, Homo sapiens
acctacatggctttaagtaagt

SEQ ID NO: 8475875 - DNA, 22 bp, Homo sapiens
acctaacttacctaggtccaca

SEQ ID NO: 8475876 - DNA, 22 bp, Homo sapiens
accgtttacaccactaccgctt

SEQ ID NO: 8475877 - DNA, 22 bp, Homo sapiens
accgtggatttgtagtcatttc

SEQ ID NO: 8475878 - DNA, 22 bp, Homo sapiens
accgtgtctgacactttgggcg

SEQ ID NO: 8475879 - DNA, 22 bp, Homo sapiens
accgtatatgtttgctgtgccc

SEQ ID NO: 8475880 - DNA, 22 bp, Homo sapiens
accgggctaatttttgtatctt

SEQ ID NO: 8475881 - DNA, 20 bp, Homo sapiens
acgtggccaccagtggctta

SEQ ID NO: 8475882 - DNA, 20 bp, Homo sapiens
acgtggccaccagtggctta

SEQ ID NO: 8475883 - DNA, 20 bp, Homo sapiens
acgtggccaccagtggctta

SEQ ID NO: 8475884 - DNA, 22 bp, Homo sapiens
acgtgcatctttccatatgtgg

SEQ ID NO: 8475885 - DNA, 22 bp, Homo sapiens
acgtgcgtgtgcgcacacatac

SEQ ID NO: 8475886 - DNA, 22 bp, Homo sapiens
acgtggagccacagatggagca

SEQ ID NO: 8475887 - DNA, 22 bp, Homo sapiens
aagtctcatccgtgtagctcca

SEQ ID NO: 8475888 - DNA, 22 bp, Homo sapiens
aagtcgtggcaggcttgcacga

SEQ ID NO: 8475889 - DNA, 22 bp, Homo sapiens
aagtcctttccagtcctgtgat

SEQ ID NO: 8475890 - DNA, 22 bp, Homo sapiens
aagtctctcatggctgacagca

SEQ ID NO: 8475891 - DNA, 22 bp, Homo sapiens
aagtctctttacctctccaggc

SEQ ID NO: 8475892 - DNA, 22 bp, Homo sapiens
actacacagggatgtgactacc

SEQ ID NO: 8475893 - DNA, 22 bp, Homo sapiens
actacactccaattttctaggt

SEQ ID NO: 8475894 - DNA, 22 bp, Homo sapiens
actgcactccagcctgggtaac

SEQ ID NO: 8475895 - DNA, 22 bp, Homo sapiens
actgcactccagcctgggtaac

SEQ ID NO: 8475896 - DNA, 22 bp, Homo sapiens
actgcactccagcctgggtaac

SEQ ID NO: 8475897 - DNA, 22 bp, Homo sapiens
actgcactccagcctcggggtc

SEQ ID NO: 8475898 - DNA, 22 bp, Homo sapiens
actgcactccaacctgggtgac

SEQ ID NO: 8475899 - DNA, 22 bp, Homo sapiens
actgcactccaacctgggtgac

SEQ ID NO: 8475900 - DNA, 22 bp, Homo sapiens
actgcactccaacctgggtgac

SEQ ID NO: 8475901 - DNA, 22 bp, Homo sapiens
actgcactccaacctgggtgac

SEQ ID NO: 8475902 - DNA, 22 bp, Homo sapiens
actgcactccaacctgggtgac

SEQ ID NO: 8475903 - DNA, 22 bp, Homo sapiens
actgataagttgcttgctctca

SEQ ID NO: 8475904 - DNA, 22 bp, Homo sapiens
actgagttatgggtatgccttg

SEQ ID NO: 8475905 - DNA, 22 bp, Homo sapiens
actgatacatctgtggaagtgg

SEQ ID NO: 8475906 - DNA, 22 bp, Homo sapiens
actgatacggttttagagtcca

SEQ ID NO: 8475907 - DNA, 22 bp, Homo sapiens
actgatcaagggtttaatttta

SEQ ID NO: 8475908 - DNA, 22 bp, Homo sapiens
actgatcacagatatgtatatt

SEQ ID NO: 8475909 - DNA, 22 bp, Homo sapiens
actgcactccaacctgggtgac

SEQ ID NO: 8475910 - DNA, 22 bp, Homo sapiens
actgaggttgtagtaggaattc

SEQ ID NO: 8475911 - DNA, 22 bp, Homo sapiens
actgaggttgaaatagtgatgt

SEQ ID NO: 8475912 - DNA, 21 bp, Homo sapiens
actgaggttagatgccttgcc

SEQ ID NO: 8475913 - DNA, 20 bp, Homo sapiens
actgaggttagataacaggt

SEQ ID NO: 8475914 - DNA, 22 bp, Homo sapiens
actgaggttattgcaataaaat

SEQ ID NO: 8475915 - DNA, 22 bp, Homo sapiens
actgagtgtaggactttgagtt

SEQ ID NO: 8475916 - DNA, 22 bp, Homo sapiens
actgagtgggaggtttgtgtga

SEQ ID NO: 8475917 - DNA, 22 bp, Homo sapiens
actgaggtttttagtgttaaat

SEQ ID NO: 8475918 - DNA, 22 bp, Homo sapiens
actgaggtttcattttatcgct

SEQ ID NO: 8475919 - DNA, 22 bp, Homo sapiens
actgaggtttacttgaaggaga

SEQ ID NO: 8475920 - DNA, 22 bp, Homo sapiens
actctggcactgggtacctcag

SEQ ID NO: 8475921 - DNA, 22 bp, Homo sapiens
actctggcaagcttccacttcc

SEQ ID NO: 8475922 - DNA, 22 bp, Homo sapiens
actctggagatggatgtcagga

SEQ ID NO: 8475923 - DNA, 22 bp, Homo sapiens
actctgcttattgctgcaggca

SEQ ID NO: 8475924 - DNA, 22 bp, Homo sapiens
actctgcttgggccatatctgg

SEQ ID NO: 8475925 - DNA, 21 bp, Homo sapiens
actctgctgcgggcttggcct

SEQ ID NO: 8475926 - DNA, 22 bp, Homo sapiens
actctgctcttatagtgttata

SEQ ID NO: 8475927 - DNA, 22 bp, Homo sapiens
actctgctctgtatttcactgt

SEQ ID NO: 8475928 - DNA, 22 bp, Homo sapiens
actctggccatcttggaccttg

SEQ ID NO: 8475929 - DNA, 22 bp, Homo sapiens
actctggccctcctgctgccag

SEQ ID NO: 8475930 - DNA, 22 bp, Homo sapiens
actctggccccaggatctgtgt

SEQ ID NO: 8475931 - DNA, 22 bp, Homo sapiens
actctggctgccttgtgagcat

SEQ ID NO: 8475932 - DNA, 22 bp, Homo sapiens
actgagagaacgggctgctccc

SEQ ID NO: 8475933 - DNA, 20 bp, Homo sapiens
actgaggttagataacaggt

SEQ ID NO: 8475934 - DNA, 22 bp, Homo sapiens
actgaggtggggtctgcttgga

SEQ ID NO: 8475935 - DNA, 22 bp, Homo sapiens
actgaggtctcaggtggggaag

SEQ ID NO: 8475936 - DNA, 22 bp, Homo sapiens
actgaggtctatcatgagccag

SEQ ID NO: 8475937 - DNA, 22 bp, Homo sapiens
actgaggtcatgcatagtttct

SEQ ID NO: 8475938 - DNA, 22 bp, Homo sapiens
actgaggtcaggggtatgtgat

SEQ ID NO: 8475939 - DNA, 22 bp, Homo sapiens
actgaggtagggcacacctagg

SEQ ID NO: 8475940 - DNA, 22 bp, Homo sapiens
actgaggtataattgacataac

SEQ ID NO: 8475941 - DNA, 22 bp, Homo sapiens
actgaggtcaggggtatgtgat

SEQ ID NO: 8475942 - DNA, 23 bp, Homo sapiens
actgaggtactgaggttgtgaca

SEQ ID NO: 8475943 - DNA, 22 bp, Homo sapiens
actggaggggaaaatggtagta

SEQ ID NO: 8475944 - DNA, 22 bp, Homo sapiens
actggactccccaagggccagg

SEQ ID NO: 8475945 - DNA, 22 bp, Homo sapiens
actggactcacgtattcctgag

SEQ ID NO: 8475946 - DNA, 20 bp, Homo sapiens
actggagccatctcagccta

SEQ ID NO: 8475947 - DNA, 18 bp, Homo sapiens
actggagcattagcagct

SEQ ID NO: 8475948 - DNA, 22 bp, Homo sapiens
actggagactgtgtcttttgat

SEQ ID NO: 8475949 - DNA, 22 bp, Homo sapiens
actggagcccgtggaggcgcag

SEQ ID NO: 8475950 - DNA, 22 bp, Homo sapiens
actgcactccagcctgggtgac

SEQ ID NO: 8475951 - DNA, 22 bp, Homo sapiens
actgcactccagcctgggtgac

SEQ ID NO: 8475952 - DNA, 22 bp, Homo sapiens
actgcactccagcctgggtgac

SEQ ID NO: 8475953 - DNA, 22 bp, Homo sapiens
actgcactccagcctgggtgac

SEQ ID NO: 8475954 - DNA, 22 bp, Homo sapiens
actgcactccagcctgggtgac

SEQ ID NO: 8475955 - DNA, 22 bp, Homo sapiens
actggccaggcagcagtagctt

SEQ ID NO: 8475956 - DNA, 22 bp, Homo sapiens
actggccaggcgaaccacactg

SEQ ID NO: 8475957 - DNA, 22 bp, Homo sapiens
actggccaggcacagctgtggg

SEQ ID NO: 8475958 - DNA, 22 bp, Homo sapiens
actggccaggagctggaaatac

SEQ ID NO: 8475959 - DNA, 22 bp, Homo sapiens
actggcccgggagcagaggcct

SEQ ID NO: 8475960 - DNA, 22 bp, Homo sapiens
actggcccttgattgcatcagc

SEQ ID NO: 8475961 - DNA, 22 bp, Homo sapiens
actggcctatcagcatgagtct

SEQ ID NO: 8475962 - DNA, 22 bp, Homo sapiens
aataccagagacagtgtttacc

SEQ ID NO: 8475963 - DNA, 17 bp, Homo sapiens
aatacctgccaattcta

SEQ ID NO: 8475964 - DNA, 22 bp, Homo sapiens
aataccttttcagtgcacaaaa

SEQ ID NO: 8475965 - DNA, 22 bp, Homo sapiens
actggctgaagtttactttttg

SEQ ID NO: 8475966 - DNA, 22 bp, Homo sapiens
aatacatgttttctactattct

SEQ ID NO: 8475967 - DNA, 22 bp, Homo sapiens
aatacagaggaaacatttaata

SEQ ID NO: 8475968 - DNA, 22 bp, Homo sapiens
actttcttctactacttggaga

SEQ ID NO: 8475969 - DNA, 22 bp, Homo sapiens
actttcttatccatgatctcac

SEQ ID NO: 8475970 - DNA, 22 bp, Homo sapiens
actttcttatccatgatctcac

SEQ ID NO: 8475971 - DNA, 22 bp, Homo sapiens
actttcttcttatgcattaagg

SEQ ID NO: 8475972 - DNA, 22 bp, Homo sapiens
actttcttggtcccatgtttga

SEQ ID NO: 8475973 - DNA, 22 bp, Homo sapiens
actttcttcttatgcattaagg

SEQ ID NO: 8475974 - DNA, 21 bp, Homo sapiens
actttctgtgggttcaagcat

SEQ ID NO: 8475975 - DNA, 22 bp, Homo sapiens
actttatttcctattgcatcca

SEQ ID NO: 8475976 - DNA, 22 bp, Homo sapiens
actttctgttagatgaatggat

SEQ ID NO: 8475977 - DNA, 22 bp, Homo sapiens
actttctgtggttaccagggag

SEQ ID NO: 8475978 - DNA, 22 bp, Homo sapiens
actttatttcctattgcatcca

SEQ ID NO: 8475979 - DNA, 22 bp, Homo sapiens
actttatttcctattgcatcca

SEQ ID NO: 8475980 - DNA, 22 bp, Homo sapiens
actttcttaggctgtataaatg

SEQ ID NO: 8475981 - DNA, 22 bp, Homo sapiens
actttcttaggctgtataaatg

SEQ ID NO: 8475982 - DNA, 22 bp, Homo sapiens
actttctgtggttaccagggag

SEQ ID NO: 8475983 - DNA, 22 bp, Homo sapiens
actttctgttagatgaatggat

SEQ ID NO: 8475984 - DNA, 22 bp, Homo sapiens
aatcagaaattctacatcacaa

SEQ ID NO: 8475985 - DNA, 19 bp, Homo sapiens
aatcagaaatatcgaggcc

SEQ ID NO: 8475986 - DNA, 20 bp, Homo sapiens
aatcagaaagtgtgagctct

SEQ ID NO: 8475987 - DNA, 20 bp, Homo sapiens
aatcagaaagtgtgagctct

SEQ ID NO: 8475988 - DNA, 22 bp, Homo sapiens
aatcagaaaggctaaggaagca

SEQ ID NO: 8475989 - DNA, 22 bp, Homo sapiens
aatcagaaaggctaaggaagca

SEQ ID NO: 8475990 - DNA, 22 bp, Homo sapiens
aatcagaaagatcttgatgaga

SEQ ID NO: 8475991 - DNA, 22 bp, Homo sapiens
aatcagaaagaggtcatgttgc

SEQ ID NO: 8475992 - DNA, 22 bp, Homo sapiens
aatcacatgaaaactgtgtgtt

SEQ ID NO: 8475993 - DNA, 22 bp, Homo sapiens
actttcttggtcccatgtttga

SEQ ID NO: 8475994 - DNA, 22 bp, Homo sapiens
actttgaaactaaaattcatta

SEQ ID NO: 8475995 - DNA, 22 bp, Homo sapiens
aatcacatctcattcaacagcc

SEQ ID NO: 8475996 - DNA, 22 bp, Homo sapiens
actgttcatttgtcctgtatct

SEQ ID NO: 8475997 - DNA, 22 bp, Homo sapiens
actgttctcctttggctatatc

SEQ ID NO: 8475998 - DNA, 22 bp, Homo sapiens
actgttctgccaagatcaacgt

SEQ ID NO: 8475999 - DNA, 22 bp, Homo sapiens
actgttcttcccatttatattg

SEQ ID NO: 8476000 - DNA, 23 bp, Homo sapiens
actttattgaccccaggtcagtt

SEQ ID NO: 8476001 - DNA, 23 bp, Homo sapiens
actttattgaccccaggtcagtt

SEQ ID NO: 8476002 - DNA, 22 bp, Homo sapiens
actttatttcctattgcatcca

SEQ ID NO: 8476003 - DNA, 22 bp, Homo sapiens
actttatgctaaactttactct

SEQ ID NO: 8476004 - DNA, 22 bp, Homo sapiens
actttatgtttgatatctatgg

SEQ ID NO: 8476005 - DNA, 23 bp, Homo sapiens
actttattgaccccaggtcagtt

SEQ ID NO: 8476006 - DNA, 20 bp, Homo sapiens
actttatgagttcaattttg

SEQ ID NO: 8476007 - DNA, 22 bp, Homo sapiens
actgttcatttggatttctctg

SEQ ID NO: 8476008 - DNA, 22 bp, Homo sapiens
aatatagttctagaaatatttt

SEQ ID NO: 8476009 - DNA, 22 bp, Homo sapiens
aatatagttctagaaatatttt

SEQ ID NO: 8476010 - DNA, 22 bp, Homo sapiens
aatatagttctagaaatatttt

SEQ ID NO: 8476011 - DNA, 22 bp, Homo sapiens
aatatagttctagaaatatttt

SEQ ID NO: 8476012 - DNA, 22 bp, Homo sapiens
aatatagctcactataccatgg

SEQ ID NO: 8476013 - DNA, 22 bp, Homo sapiens
aatatagctcactataccatgg

SEQ ID NO: 8476014 - DNA, 22 bp, Homo sapiens
aatatagatttactcaagagaa

SEQ ID NO: 8476015 - DNA, 22 bp, Homo sapiens
aatatagcattgtatgactgtg

SEQ ID NO: 8476016 - DNA, 22 bp, Homo sapiens
aatatagaatcactttccttca

SEQ ID NO: 8476017 - DNA, 22 bp, Homo sapiens
aatatactatactactttctgg

SEQ ID NO: 8476018 - DNA, 22 bp, Homo sapiens
aatatactatactactttctgg

SEQ ID NO: 8476019 - DNA, 22 bp, Homo sapiens
aatatagaatcactttccttca

SEQ ID NO: 8476020 - DNA, 19 bp, Homo sapiens
actgggcttgtcctcgtgg

SEQ ID NO: 8476021 - DNA, 22 bp, Homo sapiens
aatagtatttatttggaaaaag

SEQ ID NO: 8476022 - DNA, 22 bp, Homo sapiens
aatagtatttatttggaaaaag

SEQ ID NO: 8476023 - DNA, 22 bp, Homo sapiens
aatagtctctcccacaccatcc

SEQ ID NO: 8476024 - DNA, 22 bp, Homo sapiens
aatataattttattcctagagt

SEQ ID NO: 8476025 - DNA, 22 bp, Homo sapiens
aatagtcctctccttggaattt

SEQ ID NO: 8476026 - DNA, 22 bp, Homo sapiens
aatagtcctgatttaatctggg

SEQ ID NO: 8476027 - DNA, 22 bp, Homo sapiens
actgggctgtggacacccagcg

SEQ ID NO: 8476028 - DNA, 22 bp, Homo sapiens
actgggctgtaaagagaggcaa

SEQ ID NO: 8476029 - DNA, 22 bp, Homo sapiens
actgggcttcacttggcacatc

SEQ ID NO: 8476030 - DNA, 22 bp, Homo sapiens
actgggcttatgctgtggagta

SEQ ID NO: 8476031 - DNA, 22 bp, Homo sapiens
aatactgaattagttgagacaa

SEQ ID NO: 8476032 - DNA, 22 bp, Homo sapiens
actgggctgcttgagtgccttc

SEQ ID NO: 8476033 - DNA, 22 bp, Homo sapiens
aatactatgtagccaaaataat

SEQ ID NO: 8476034 - DNA, 22 bp, Homo sapiens
aatactatgtagccaaaataat

SEQ ID NO: 8476035 - DNA, 22 bp, Homo sapiens
aatactatgtagccaaaataat

SEQ ID NO: 8476036 - DNA, 22 bp, Homo sapiens
aatactatgtagccaaaataat

SEQ ID NO: 8476037 - DNA, 20 bp, Homo sapiens
aatactaaacacaaagcagt

SEQ ID NO: 8476038 - DNA, 22 bp, Homo sapiens
aatactagttattaaagctttt

SEQ ID NO: 8476039 - DNA, 22 bp, Homo sapiens
aatcagagtcccaagatctgta

SEQ ID NO: 8476040 - DNA, 21 bp, Homo sapiens
aatcagaggcttcctagttgg

SEQ ID NO: 8476041 - DNA, 22 bp, Homo sapiens
aatcagagccctctgagcttca

SEQ ID NO: 8476042 - DNA, 22 bp, Homo sapiens
aatcagaccgttctggctgtcc

SEQ ID NO: 8476043 - DNA, 22 bp, Homo sapiens
aatcagactattaaagtctctt

SEQ ID NO: 8476044 - DNA, 22 bp, Homo sapiens
aatcagagccctctgagcttca

SEQ ID NO: 8476045 - DNA, 22 bp, Homo sapiens
aatcagaatttgtcccctgagt

SEQ ID NO: 8476046 - DNA, 22 bp, Homo sapiens
aatcagaactcctaccacagag

SEQ ID NO: 8476047 - DNA, 22 bp, Homo sapiens
aatcagaacttctcagggtggg

SEQ ID NO: 8476048 - DNA, 22 bp, Homo sapiens
aatcagaacgctcgatcttcgg

SEQ ID NO: 8476049 - DNA, 22 bp, Homo sapiens
aatcagaaccttgggtcataac

SEQ ID NO: 8476050 - DNA, 22 bp, Homo sapiens
aatcagaaattgagggtctggt

SEQ ID NO: 8476051 - DNA, 22 bp, Homo sapiens
aatcagaatcagttgacacagc

SEQ ID NO: 8476052 - DNA, 22 bp, Homo sapiens
aatcagaatcagttgacacagc

SEQ ID NO: 8476053 - DNA, 15 bp, Homo sapiens
aatcagaagtgtggc

SEQ ID NO: 8476054 - DNA, 22 bp, Homo sapiens
aatcagaatttattgaatcttt

SEQ ID NO: 8476055 - DNA, 22 bp, Homo sapiens
aatcagaatttattgaatcttt

SEQ ID NO: 8476056 - DNA, 22 bp, Homo sapiens
aatcagcaaatgcttactcagg

SEQ ID NO: 8476057 - DNA, 22 bp, Homo sapiens
aatcagcagaagagaggtctta

SEQ ID NO: 8476058 - DNA, 22 bp, Homo sapiens
aatcagcagaagagaggtctta

SEQ ID NO: 8476059 - DNA, 22 bp, Homo sapiens
aatcagcaaatgcttactcagg

SEQ ID NO: 8476060 - DNA, 22 bp, Homo sapiens
aatcagcaggcttctaaatttt

SEQ ID NO: 8476061 - DNA, 22 bp, Homo sapiens
aatcagcaggcttctaaatttt

SEQ ID NO: 8476062 - DNA, 22 bp, Homo sapiens
aatcagcaggcttctaaatttt

SEQ ID NO: 8476063 - DNA, 22 bp, Homo sapiens
aatcagctaaataaactagtca

SEQ ID NO: 8476064 - DNA, 22 bp, Homo sapiens
aatcagcagttggaattagata

SEQ ID NO: 8476065 - DNA, 23 bp, Homo sapiens
aatcagcatgctctgtggctggc

SEQ ID NO: 8476066 - DNA, 22 bp, Homo sapiens
aatcagcagttggaattagata

SEQ ID NO: 8476067 - DNA, 22 bp, Homo sapiens
aatcaggagtgtgcactttgat

SEQ ID NO: 8476068 - DNA, 22 bp, Homo sapiens
aatcaggatgactgtcatttca

SEQ ID NO: 8476069 - DNA, 22 bp, Homo sapiens
aatcaggcacagcgactgcagc

SEQ ID NO: 8476070 - DNA, 22 bp, Homo sapiens
aatcagttaaatattgagtaca

SEQ ID NO: 8476071 - DNA, 22 bp, Homo sapiens
aatcagttaaatattgagtaca

SEQ ID NO: 8476072 - DNA, 22 bp, Homo sapiens
aatcagtattggtatagaatga

SEQ ID NO: 8476073 - DNA, 22 bp, Homo sapiens
aatcataattcaaataagctta

SEQ ID NO: 8476074 - DNA, 22 bp, Homo sapiens
agaaatactttgtaaatctcac

SEQ ID NO: 8476075 - DNA, 22 bp, Homo sapiens
aatcataattcaaataagctta

SEQ ID NO: 8476076 - DNA, 22 bp, Homo sapiens
aatcagttgttcactctgaaaa

SEQ ID NO: 8476077 - DNA, 22 bp, Homo sapiens
aatcagttgtccaaagttcaca

SEQ ID NO: 8476078 - DNA, 22 bp, Homo sapiens
aatcagttagggtgttaatgag

SEQ ID NO: 8476079 - DNA, 22 bp, Homo sapiens
aatcagttagaaggaagagaat

SEQ ID NO: 8476080 - DNA, 22 bp, Homo sapiens
agaaatagaggaaaggtttgac

SEQ ID NO: 8476081 - DNA, 22 bp, Homo sapiens
agaaatgaaaccaaagcctaga

SEQ ID NO: 8476082 - DNA, 22 bp, Homo sapiens
agaaatgaaaccaaagcctaga

SEQ ID NO: 8476083 - DNA, 22 bp, Homo sapiens
agaaatgaagagagtcaaggtt

SEQ ID NO: 8476084 - DNA, 22 bp, Homo sapiens
agaaatgaaaccaaagcctaga

SEQ ID NO: 8476085 - DNA, 22 bp, Homo sapiens
agaaatgacaagactgatcagg

SEQ ID NO: 8476086 - DNA, 22 bp, Homo sapiens
agaaatgacaagactgatcagg

SEQ ID NO: 8476087 - DNA, 22 bp, Homo sapiens
agaaatgaagcaggagttatta

SEQ ID NO: 8476088 - DNA, 22 bp, Homo sapiens
agaaatgaatatgtagtggtta

SEQ ID NO: 8476089 - DNA, 22 bp, Homo sapiens
agaaatgaagcaggagttatta

SEQ ID NO: 8476090 - DNA, 22 bp, Homo sapiens
aatgatggttaaacactggagg

SEQ ID NO: 8476091 - DNA, 22 bp, Homo sapiens
aatgatggttaaacactggagg

SEQ ID NO: 8476092 - DNA, 22 bp, Homo sapiens
aatgatggtttcatcacttgaa

SEQ ID NO: 8476093 - DNA, 22 bp, Homo sapiens
aatgatgtattagtacaacaca

SEQ ID NO: 8476094 - DNA, 22 bp, Homo sapiens
aatgatgggaaggagaaaagca

SEQ ID NO: 8476095 - DNA, 22 bp, Homo sapiens
aatgatggatttagacaagctg

SEQ ID NO: 8476096 - DNA, 22 bp, Homo sapiens
aatgatgagttctaatagaccc

SEQ ID NO: 8476097 - DNA, 22 bp, Homo sapiens
aatgatgagttctaatagaccc

SEQ ID NO: 8476098 - DNA, 22 bp, Homo sapiens
aatgattgtcattccaaaaagt

SEQ ID NO: 8476099 - DNA, 23 bp, Homo sapiens
aatgatttcatgatgatagcagc

SEQ ID NO: 8476100 - DNA, 22 bp, Homo sapiens
agaagcagaaggaagcagggcc

SEQ ID NO: 8476101 - DNA, 22 bp, Homo sapiens
agaagcagaaggaagcagggcc

SEQ ID NO: 8476102 - DNA, 22 bp, Homo sapiens
agaagcagaaggaagcagggcc

SEQ ID NO: 8476103 - DNA, 22 bp, Homo sapiens
agaagcagaaggaagcagggcc

SEQ ID NO: 8476104 - DNA, 22 bp, Homo sapiens
agaagcagaaggaagcagggcc

SEQ ID NO: 8476105 - DNA, 22 bp, Homo sapiens
agaagcagaaactgggcttgtg

SEQ ID NO: 8476106 - DNA, 22 bp, Homo sapiens
agaagcagaaactgggcttgtg

SEQ ID NO: 8476107 - DNA, 22 bp, Homo sapiens
agaagcagaaactgggcttgtg

SEQ ID NO: 8476108 - DNA, 22 bp, Homo sapiens
agaagcagaaaagggcactttt

SEQ ID NO: 8476109 - DNA, 22 bp, Homo sapiens
aatgatttcccctacacagaag

SEQ ID NO: 8476110 - DNA, 23 bp, Homo sapiens
aatgatttcatgatgatagcagc

SEQ ID NO: 8476111 - DNA, 22 bp, Homo sapiens
aatgcaaacagcccagaatcca

SEQ ID NO: 8476112 - DNA, 22 bp, Homo sapiens
aatgcaaacagcccagaatcca

SEQ ID NO: 8476113 - DNA, 22 bp, Homo sapiens
aatgcaaacagcccagaatcca

SEQ ID NO: 8476114 - DNA, 22 bp, Homo sapiens
aatgatgagaactggagtaatt

SEQ ID NO: 8476115 - DNA, 22 bp, Homo sapiens
aatgatgagttctaatagaccc

SEQ ID NO: 8476116 - DNA, 22 bp, Homo sapiens
aatgataagacatgagtagagg

SEQ ID NO: 8476117 - DNA, 22 bp, Homo sapiens
aatgataagacatgagtagagg

SEQ ID NO: 8476118 - DNA, 22 bp, Homo sapiens
agaaattctaagcatcaatagc

SEQ ID NO: 8476119 - DNA, 22 bp, Homo sapiens
agaaattgccagaatgtcaggc

SEQ ID NO: 8476120 - DNA, 22 bp, Homo sapiens
agaaattgccagaatgtcaggc

SEQ ID NO: 8476121 - DNA, 22 bp, Homo sapiens
agaacaaaattagaggagtgca

SEQ ID NO: 8476122 - DNA, 22 bp, Homo sapiens
agaaatgacacacatgagacat

SEQ ID NO: 8476123 - DNA, 22 bp, Homo sapiens
agaaatgacacacatgagacat

SEQ ID NO: 8476124 - DNA, 22 bp, Homo sapiens
agaaatgacacacatgagacat

SEQ ID NO: 8476125 - DNA, 22 bp, Homo sapiens
agaaatgacacacatgagacat

SEQ ID NO: 8476126 - DNA, 22 bp, Homo sapiens
agaaatgacacacatgagacat

SEQ ID NO: 8476127 - DNA, 22 bp, Homo sapiens
agaaatgacacacatgagacat

SEQ ID NO: 8476128 - DNA, 22 bp, Homo sapiens
agaaattatgcagtagttttat

SEQ ID NO: 8476129 - DNA, 22 bp, Homo sapiens
agaaattatgcagtagttttat

SEQ ID NO: 8476130 - DNA, 22 bp, Homo sapiens
agaaattcctaaggtacacaag

SEQ ID NO: 8476131 - DNA, 22 bp, Homo sapiens
agaaattattagtgaatagtct

SEQ ID NO: 8476132 - DNA, 22 bp, Homo sapiens
acaagaatttacatgtagtgga

SEQ ID NO: 8476133 - DNA, 22 bp, Homo sapiens
acaagagacaagaggttcttct

SEQ ID NO: 8476134 - DNA, 22 bp, Homo sapiens
acaagagattatctacagatga

SEQ ID NO: 8476135 - DNA, 22 bp, Homo sapiens
acaagagtctgcatttctaaca

SEQ ID NO: 8476136 - DNA, 22 bp, Homo sapiens
acaagagtatctttgactttag

SEQ ID NO: 8476137 - DNA, 22 bp, Homo sapiens
acaagagtaatttcaacagagt

SEQ ID NO: 8476138 - DNA, 22 bp, Homo sapiens
acaagataaggtgtcagtgtgt

SEQ ID NO: 8476139 - DNA, 22 bp, Homo sapiens
acaagagtgagattatcatgta

SEQ ID NO: 8476140 - DNA, 22 bp, Homo sapiens
acaagatagcttagaagattca

SEQ ID NO: 8476141 - DNA, 22 bp, Homo sapiens
acaactagcaggtattaatttt

SEQ ID NO: 8476142 - DNA, 23 bp, Homo sapiens
acaaccagcactggagggcacca

SEQ ID NO: 8476143 - DNA, 22 bp, Homo sapiens
acaaccatgtcagttcaaacca

SEQ ID NO: 8476144 - DNA, 22 bp, Homo sapiens
acaacctgttcgtttccacaga

SEQ ID NO: 8476145 - DNA, 22 bp, Homo sapiens
agataatctctaggcttcatgt

SEQ ID NO: 8476146 - DNA, 22 bp, Homo sapiens
agataatgattctgcatttcta

SEQ ID NO: 8476147 - DNA, 22 bp, Homo sapiens
agataacttttgggtattcatg

SEQ ID NO: 8476148 - DNA, 19 bp, Homo sapiens
agataagagttgactgtgg

SEQ ID NO: 8476149 - DNA, 22 bp, Homo sapiens
agataagatagtccagcacaat

SEQ ID NO: 8476150 - DNA, 22 bp, Homo sapiens
agataagtactgttattattgc

SEQ ID NO: 8476151 - DNA, 22 bp, Homo sapiens
acaacaaagacacttgaaatga

SEQ ID NO: 8476152 - DNA, 22 bp, Homo sapiens
agaggggttaagtgctagtccg

SEQ ID NO: 8476153 - DNA, 22 bp, Homo sapiens
agaggggttaagtgctagtccg

SEQ ID NO: 8476154 - DNA, 22 bp, Homo sapiens
acaaattgcctagtctagcatc

SEQ ID NO: 8476155 - DNA, 22 bp, Homo sapiens
acaacacagctttcctcaagtt

SEQ ID NO: 8476156 - DNA, 22 bp, Homo sapiens
acaacacagctttcctcaagtt

SEQ ID NO: 8476157 - DNA, 22 bp, Homo sapiens
acaacaatctaccctagcttct

SEQ ID NO: 8476158 - DNA, 22 bp, Homo sapiens
acaacacagcaaaaccccatct

SEQ ID NO: 8476159 - DNA, 22 bp, Homo sapiens
acaacacagcaaaaccccatct

SEQ ID NO: 8476160 - DNA, 22 bp, Homo sapiens
acaacaatctaccctagcttct

SEQ ID NO: 8476161 - DNA, 22 bp, Homo sapiens
acaacacatgtgtatatgtgtg

SEQ ID NO: 8476162 - DNA, 22 bp, Homo sapiens
acaacacatgtgtatatgtgtg

SEQ ID NO: 8476163 - DNA, 22 bp, Homo sapiens
acaacacatgtgtatatgtgtg

SEQ ID NO: 8476164 - DNA, 22 bp, Homo sapiens
acaacacatgtgtatatgtgtg

SEQ ID NO: 8476165 - DNA, 22 bp, Homo sapiens
acaacacatgtgtatatgtgtg

SEQ ID NO: 8476166 - DNA, 22 bp, Homo sapiens
acaacagagctggactgagagg

SEQ ID NO: 8476167 - DNA, 22 bp, Homo sapiens
agataacatttattgaatgtaa

SEQ ID NO: 8476168 - DNA, 22 bp, Homo sapiens
agataacatgttgcagattctg

SEQ ID NO: 8476169 - DNA, 22 bp, Homo sapiens
acaagattttatgactcttttt

SEQ ID NO: 8476170 - DNA, 23 bp, Homo sapiens
acaagcagcccagtgctctgcct

SEQ ID NO: 8476171 - DNA, 22 bp, Homo sapiens
acaagcagagattaaatgtttt

SEQ ID NO: 8476172 - DNA, 22 bp, Homo sapiens
acaagatgtgtttatacaagct

SEQ ID NO: 8476173 - DNA, 22 bp, Homo sapiens
acaagataggttgagtctagcc

SEQ ID NO: 8476174 - DNA, 23 bp, Homo sapiens
acaagatagggataaaaagataa

SEQ ID NO: 8476175 - DNA, 23 bp, Homo sapiens
acaagatagggataaaaagataa

SEQ ID NO: 8476176 - DNA, 22 bp, Homo sapiens
acaatcacacatgcaattatac

SEQ ID NO: 8476177 - DNA, 22 bp, Homo sapiens
acaatagacaaagtgaatggct

SEQ ID NO: 8476178 - DNA, 22 bp, Homo sapiens
acaatagacaaagtgaatggct

SEQ ID NO: 8476179 - DNA, 22 bp, Homo sapiens
acaagctccttattcagctggg

SEQ ID NO: 8476180 - DNA, 22 bp, Homo sapiens
acaagcgggccacagtgctggt

SEQ ID NO: 8476181 - DNA, 17 bp, Homo sapiens
acaagcagtggccatgg

SEQ ID NO: 8476182 - DNA, 22 bp, Homo sapiens
acaagcataagtgagatgaata

SEQ ID NO: 8476183 - DNA, 22 bp, Homo sapiens
acaagcatcaggttcagcaata

SEQ ID NO: 8476184 - DNA, 22 bp, Homo sapiens
acaagccaattactgtgccagg

SEQ ID NO: 8476185 - DNA, 22 bp, Homo sapiens
acaagcatgtggtaaaaagacc

SEQ ID NO: 8476186 - DNA, 19 bp, Homo sapiens
acaatgaatgtgttctctt

SEQ ID NO: 8476187 - DNA, 22 bp, Homo sapiens
acaatgaatatcatgaagtact

SEQ ID NO: 8476188 - DNA, 22 bp, Homo sapiens
acaatgaatatcatgaagtact

SEQ ID NO: 8476189 - DNA, 22 bp, Homo sapiens
acaatgaagataatgttgcagt

SEQ ID NO: 8476190 - DNA, 22 bp, Homo sapiens
acaatgaagataatgttgcagt

SEQ ID NO: 8476191 - DNA, 22 bp, Homo sapiens
acaatgaagggagacacttgct

SEQ ID NO: 8476192 - DNA, 22 bp, Homo sapiens
acaatgatgcagatgagtaaga

SEQ ID NO: 8476193 - DNA, 22 bp, Homo sapiens
acaatgatgcagatgagtaaga

SEQ ID NO: 8476194 - DNA, 22 bp, Homo sapiens
acaatgaatttaataccttatt

SEQ ID NO: 8476195 - DNA, 19 bp, Homo sapiens
acaatgaatgtgttctctt

SEQ ID NO: 8476196 - DNA, 18 bp, Homo sapiens
acaatctgaaacctgtca

SEQ ID NO: 8476197 - DNA, 22 bp, Homo sapiens
acaatcagcactgagtttatct

SEQ ID NO: 8476198 - DNA, 22 bp, Homo sapiens
acaatcagtatttagacccagg

SEQ ID NO: 8476199 - DNA, 22 bp, Homo sapiens
acaatcattccgttcacaacag

SEQ ID NO: 8476200 - DNA, 22 bp, Homo sapiens
acaatgaaaaaatttactgtgg

SEQ ID NO: 8476201 - DNA, 22 bp, Homo sapiens
acaatgaaaaaatttactgtgg

SEQ ID NO: 8476202 - DNA, 22 bp, Homo sapiens
acaatgaaagcaagaagacggc

SEQ ID NO: 8476203 - DNA, 22 bp, Homo sapiens
acaatgaacgctttttaactgt

SEQ ID NO: 8476204 - DNA, 22 bp, Homo sapiens
acaatgaacgctttttaactgt

SEQ ID NO: 8476205 - DNA, 22 bp, Homo sapiens
acaatgaaccaaatttaccaat

SEQ ID NO: 8476206 - DNA, 22 bp, Homo sapiens
acaatgaacacacaaggaattc

SEQ ID NO: 8476207 - DNA, 22 bp, Homo sapiens
acaatgaacacacaaggaattc

SEQ ID NO: 8476208 - DNA, 22 bp, Homo sapiens
acaatgaaaggtattctgaact

SEQ ID NO: 8476209 - DNA, 22 bp, Homo sapiens
aattcttggaaacattactgga

SEQ ID NO: 8476210 - DNA, 22 bp, Homo sapiens
aattcttcaagtgctttggaga

SEQ ID NO: 8476211 - DNA, 22 bp, Homo sapiens
aattcttaatcccataaagtga

SEQ ID NO: 8476212 - DNA, 22 bp, Homo sapiens
aattctgtgcaggcagagctat

SEQ ID NO: 8476213 - DNA, 22 bp, Homo sapiens
aattgacaaatcatacttgtat

SEQ ID NO: 8476214 - DNA, 20 bp, Homo sapiens
aattgaagcagaggagaggc

SEQ ID NO: 8476215 - DNA, 22 bp, Homo sapiens
aattgaacttgatctttagcta

SEQ ID NO: 8476216 - DNA, 21 bp, Homo sapiens
aattgaagatgtggagccatt

SEQ ID NO: 8476217 - DNA, 22 bp, Homo sapiens
aattgaacaagtaatagaagag

SEQ ID NO: 8476218 - DNA, 22 bp, Homo sapiens
aattgaacaagtaatagaagag

SEQ ID NO: 8476219 - DNA, 22 bp, Homo sapiens
aattgaaattctttgtggtcca

SEQ ID NO: 8476220 - DNA, 22 bp, Homo sapiens
aattgaaaatattgtagaccat

SEQ ID NO: 8476221 - DNA, 22 bp, Homo sapiens
aattgaaaatattgtagaccat

SEQ ID NO: 8476222 - DNA, 22 bp, Homo sapiens
aattgaaagaagtgggattgcc

SEQ ID NO: 8476223 - DNA, 22 bp, Homo sapiens
aattgatggacagagatgaaga

SEQ ID NO: 8476224 - DNA, 22 bp, Homo sapiens
aattgagtgcagccagcccagt

SEQ ID NO: 8476225 - DNA, 22 bp, Homo sapiens
aattgacagaaagtttacgagg

SEQ ID NO: 8476226 - DNA, 22 bp, Homo sapiens
aattgagatgacagaggaatag

SEQ ID NO: 8476227 - DNA, 22 bp, Homo sapiens
aattgctaaagattatgttttc

SEQ ID NO: 8476228 - DNA, 22 bp, Homo sapiens
aattgcatgttaatgactaagt

SEQ ID NO: 8476229 - DNA, 22 bp, Homo sapiens
aattgcactttagcaatggtga

SEQ ID NO: 8476230 - DNA, 22 bp, Homo sapiens
aattgcataaaattcaactctg

SEQ ID NO: 8476231 - DNA, 22 bp, Homo sapiens
aattgcttcattaacatttagg

SEQ ID NO: 8476232 - DNA, 22 bp, Homo sapiens
aattgcttgatgactagtaatt

SEQ ID NO: 8476233 - DNA, 22 bp, Homo sapiens
aattgcttagttgcaactatgc

SEQ ID NO: 8476234 - DNA, 22 bp, Homo sapiens
aattgctagactatactgtaat

SEQ ID NO: 8476235 - DNA, 21 bp, Homo sapiens
agaggccctcggactgggcgt

SEQ ID NO: 8476236 - DNA, 22 bp, Homo sapiens
aattgctttagttaccatagtg

SEQ ID NO: 8476237 - DNA, 22 bp, Homo sapiens
agaggccctctctctcctgatg

SEQ ID NO: 8476238 - DNA, 22 bp, Homo sapiens
agaggccctctctctcctgatg

SEQ ID NO: 8476239 - DNA, 22 bp, Homo sapiens
agaggctgaatgatgtcatcat

SEQ ID NO: 8476240 - DNA, 22 bp, Homo sapiens
agaggctgaatgatgtcatcat

SEQ ID NO: 8476241 - DNA, 22 bp, Homo sapiens
agaggctgaatgatgtcatcat

SEQ ID NO: 8476242 - DNA, 22 bp, Homo sapiens
agaggctgaatgatgtcatcat

SEQ ID NO: 8476243 - DNA, 22 bp, Homo sapiens
agaggctgagaaaccctcttct

SEQ ID NO: 8476244 - DNA, 22 bp, Homo sapiens
agaggctgagaaaccctcttct

SEQ ID NO: 8476245 - DNA, 22 bp, Homo sapiens
agaggctgaatgatgtcatcat

SEQ ID NO: 8476246 - DNA, 22 bp, Homo sapiens
agaggctctttgagctgggaga

SEQ ID NO: 8476247 - DNA, 22 bp, Homo sapiens
agaggctgaatgatgtcatcat

SEQ ID NO: 8476248 - DNA, 22 bp, Homo sapiens
agaggctctggtgcagcatgca

SEQ ID NO: 8476249 - DNA, 22 bp, Homo sapiens
agaggctcttgcccttcccaca

SEQ ID NO: 8476250 - DNA, 22 bp, Homo sapiens
agagggggcagcggaccagtga

SEQ ID NO: 8476251 - DNA, 22 bp, Homo sapiens
agagggggaaaatagaggtgtt

SEQ ID NO: 8476252 - DNA, 22 bp, Homo sapiens
agagggggaaaatagaggtgtt

SEQ ID NO: 8476253 - DNA, 22 bp, Homo sapiens
agagggggaaaatagaggtgtt

SEQ ID NO: 8476254 - DNA, 22 bp, Homo sapiens
agagggggaaaatagaggtgtt

SEQ ID NO: 8476255 - DNA, 22 bp, Homo sapiens
agagggggtgtcagcactgcag

SEQ ID NO: 8476256 - DNA, 22 bp, Homo sapiens
agagggggtgtcagcactgcag

SEQ ID NO: 8476257 - DNA, 22 bp, Homo sapiens
agagggggtgtcagcactgcag

SEQ ID NO: 8476258 - DNA, 22 bp, Homo sapiens
agagggggtgttccagaagcat

SEQ ID NO: 8476259 - DNA, 22 bp, Homo sapiens
acaaagtagtcaaagtagatga

SEQ ID NO: 8476260 - DNA, 22 bp, Homo sapiens
acaaagggggactgcagagggt

SEQ ID NO: 8476261 - DNA, 18 bp, Homo sapiens
acaaaggtctgcaagacc

SEQ ID NO: 8476262 - DNA, 22 bp, Homo sapiens
acaaaggtggaccatgtggctt

SEQ ID NO: 8476263 - DNA, 22 bp, Homo sapiens
acaaaggtgcgtcccttcagct

SEQ ID NO: 8476264 - DNA, 22 bp, Homo sapiens
acaaaggtgagcagaagacaca

SEQ ID NO: 8476265 - DNA, 20 bp, Homo sapiens
agaggcttccttgggaggag

SEQ ID NO: 8476266 - DNA, 20 bp, Homo sapiens
agaggcttccttgggaggag

SEQ ID NO: 8476267 - DNA, 22 bp, Homo sapiens
agaggcttcctgccacctgaga

SEQ ID NO: 8476268 - DNA, 22 bp, Homo sapiens
acaaagaaggaattggtcttta

SEQ ID NO: 8476269 - DNA, 22 bp, Homo sapiens
acaaagaaggaattggtcttta

SEQ ID NO: 8476270 - DNA, 22 bp, Homo sapiens
acaaagaaggaattggtcttta

SEQ ID NO: 8476271 - DNA, 21 bp, Homo sapiens
acaaaggaagtctcttttaag

SEQ ID NO: 8476272 - DNA, 21 bp, Homo sapiens
acaaaggaagtctcttttaag

SEQ ID NO: 8476273 - DNA, 22 bp, Homo sapiens
acaaagcttagacctaagagat

SEQ ID NO: 8476274 - DNA, 19 bp, Homo sapiens
acaaagctgtgagcagctt

SEQ ID NO: 8476275 - DNA, 22 bp, Homo sapiens
acaaagcttagacctaagagat

SEQ ID NO: 8476276 - DNA, 18 bp, Homo sapiens
acaaaggatcatgaggga

SEQ ID NO: 8476277 - DNA, 22 bp, Homo sapiens
agaggctgtgcagagggagtgc

SEQ ID NO: 8476278 - DNA, 22 bp, Homo sapiens
agaggctgagaaaccctcttct

SEQ ID NO: 8476279 - DNA, 22 bp, Homo sapiens
agaggctgatggagtagtgtct

SEQ ID NO: 8476280 - DNA, 22 bp, Homo sapiens
agaggctgagaaaccctcttct

SEQ ID NO: 8476281 - DNA, 22 bp, Homo sapiens
agaggctgtgcccaccaggcaa

SEQ ID NO: 8476282 - DNA, 22 bp, Homo sapiens
agaggctgtgcagagggagtgc

SEQ ID NO: 8476283 - DNA, 22 bp, Homo sapiens
agaggctgtgcccaccaggcaa

SEQ ID NO: 8476284 - DNA, 22 bp, Homo sapiens
agaggctgtgcccaccaggcaa

SEQ ID NO: 8476285 - DNA, 22 bp, Homo sapiens
agaggctgttacactcccagat

SEQ ID NO: 8476286 - DNA, 22 bp, Homo sapiens
agaggctgttacactcccagat

SEQ ID NO: 8476287 - DNA, 22 bp, Homo sapiens
agaggctgtgcccaccaggcaa

SEQ ID NO: 8476288 - DNA, 22 bp, Homo sapiens
agaggctgttacactcccagat

SEQ ID NO: 8476289 - DNA, 22 bp, Homo sapiens
agaggctgttacactcccagat

SEQ ID NO: 8476290 - DNA, 22 bp, Homo sapiens
aatgttttaaaagagattgaga

SEQ ID NO: 8476291 - DNA, 22 bp, Homo sapiens
agacctcaataccaggcaccac

SEQ ID NO: 8476292 - DNA, 22 bp, Homo sapiens
aattaaaaaaggagagcttgct

SEQ ID NO: 8476293 - DNA, 22 bp, Homo sapiens
aattaaaaaaggagagcttgct

SEQ ID NO: 8476294 - DNA, 22 bp, Homo sapiens
aattaaaaaaggagagcttgct

SEQ ID NO: 8476295 - DNA, 22 bp, Homo sapiens
agaccctgttagttccagtctt

SEQ ID NO: 8476296 - DNA, 22 bp, Homo sapiens
agaccctggtaaacactccagg

SEQ ID NO: 8476297 - DNA, 22 bp, Homo sapiens
agaccctggtaaacactccagg

SEQ ID NO: 8476298 - DNA, 22 bp, Homo sapiens
agaccctgtcagtgttaggaaa

SEQ ID NO: 8476299 - DNA, 20 bp, Homo sapiens
agaccctgtgtcctgtggcc

SEQ ID NO: 8476300 - DNA, 20 bp, Homo sapiens
agaccctgtgtcctgtggcc

SEQ ID NO: 8476301 - DNA, 22 bp, Homo sapiens
agaccctgtcagtgttaggaaa

SEQ ID NO: 8476302 - DNA, 22 bp, Homo sapiens
agaccccatacctcagcaggta

SEQ ID NO: 8476303 - DNA, 22 bp, Homo sapiens
aatgtgtaaatgaggagtcttg

SEQ ID NO: 8476304 - DNA, 22 bp, Homo sapiens
aatgtgtacatgacagatagaa

SEQ ID NO: 8476305 - DNA, 22 bp, Homo sapiens
agaccccctttaatggaagtgc

SEQ ID NO: 8476306 - DNA, 22 bp, Homo sapiens
agaccctctcctcatggacatg

SEQ ID NO: 8476307 - DNA, 22 bp, Homo sapiens
aatgtggttaacccatttaaga

SEQ ID NO: 8476308 - DNA, 22 bp, Homo sapiens
aatgtggttaacccatttaaga

SEQ ID NO: 8476309 - DNA, 22 bp, Homo sapiens
aatgtggggaagccatggctga

SEQ ID NO: 8476310 - DNA, 22 bp, Homo sapiens
agaccctggtaaacactccagg

SEQ ID NO: 8476311 - DNA, 22 bp, Homo sapiens
agaccctgcattttccagggtt

SEQ ID NO: 8476312 - DNA, 22 bp, Homo sapiens
agaccctgaagttttctatgat

SEQ ID NO: 8476313 - DNA, 22 bp, Homo sapiens
agaccctgcacctctcgtgggc

SEQ ID NO: 8476314 - DNA, 21 bp, Homo sapiens
agaccctgcatatgttcagta

SEQ ID NO: 8476315 - DNA, 22 bp, Homo sapiens
agaccctgcacctctcgtgggc

SEQ ID NO: 8476316 - DNA, 21 bp, Homo sapiens
agaccctgcatatgttcagta

SEQ ID NO: 8476317 - DNA, 22 bp, Homo sapiens
agaccctgcattttccagggtt

SEQ ID NO: 8476318 - DNA, 22 bp, Homo sapiens
aattaaaagataacccatgagt

SEQ ID NO: 8476319 - DNA, 22 bp, Homo sapiens
aattaaaagataacccatgagt

SEQ ID NO: 8476320 - DNA, 22 bp, Homo sapiens
aattaaaagataacccatgagt

SEQ ID NO: 8476321 - DNA, 22 bp, Homo sapiens
aattaaaaaaggagagcttgct

SEQ ID NO: 8476322 - DNA, 22 bp, Homo sapiens
aattaaaaaaggagagcttgct

SEQ ID NO: 8476323 - DNA, 22 bp, Homo sapiens
aattaaaagataacccatgagt

SEQ ID NO: 8476324 - DNA, 22 bp, Homo sapiens
aattaaaggtcatgttaaaggg

SEQ ID NO: 8476325 - DNA, 22 bp, Homo sapiens
aattaaatgacaggggaagatg

SEQ ID NO: 8476326 - DNA, 22 bp, Homo sapiens
aattaaattggtttagagagga

SEQ ID NO: 8476327 - DNA, 23 bp, Homo sapiens
aattaaattgctagatccagggc

SEQ ID NO: 8476328 - DNA, 22 bp, Homo sapiens
agagacaggagttctgtttcca

SEQ ID NO: 8476329 - DNA, 22 bp, Homo sapiens
agagacaggatatctgctcatg

SEQ ID NO: 8476330 - DNA, 22 bp, Homo sapiens
agagacaggaatggcattaaga

SEQ ID NO: 8476331 - DNA, 22 bp, Homo sapiens
agagacaggagttctgtttcca

SEQ ID NO: 8476332 - DNA, 18 bp, Homo sapiens
agagacagcagcaaaaga

SEQ ID NO: 8476333 - DNA, 22 bp, Homo sapiens
agagacagatctgagggacctc

SEQ ID NO: 8476334 - DNA, 22 bp, Homo sapiens
agagacagatctgagggacctc

SEQ ID NO: 8476335 - DNA, 22 bp, Homo sapiens
agagacagatctgagggacctc

SEQ ID NO: 8476336 - DNA, 22 bp, Homo sapiens
agagacagatctgagggacctc

SEQ ID NO: 8476337 - DNA, 22 bp, Homo sapiens
aattaacaaatgtagctgtgat

SEQ ID NO: 8476338 - DNA, 22 bp, Homo sapiens
aattaacaaatgtagctgtgat

SEQ ID NO: 8476339 - DNA, 22 bp, Homo sapiens
agagacagaggcaatatagctt

SEQ ID NO: 8476340 - DNA, 22 bp, Homo sapiens
aattccatatctgtgattatta

SEQ ID NO: 8476341 - DNA, 22 bp, Homo sapiens
aattccagtctctgctctattt

SEQ ID NO: 8476342 - DNA, 22 bp, Homo sapiens
aattccagggttagctcatttg

SEQ ID NO: 8476343 - DNA, 22 bp, Homo sapiens
aattccatccatttgtttcaac

SEQ ID NO: 8476344 - DNA, 22 bp, Homo sapiens
agagcctggaggttctgctgaa

SEQ ID NO: 8476345 - DNA, 22 bp, Homo sapiens
agagcctggacttttctgagcc

SEQ ID NO: 8476346 - DNA, 22 bp, Homo sapiens
aattccagggggtaccattcat

SEQ ID NO: 8476347 - DNA, 22 bp, Homo sapiens
agagcctggcaaaaggtcctgc

SEQ ID NO: 8476348 - DNA, 22 bp, Homo sapiens
agagcctggaggttctgctgaa

SEQ ID NO: 8476349 - DNA, 22 bp, Homo sapiens
agagcctggaggttctgctgaa

SEQ ID NO: 8476350 - DNA, 22 bp, Homo sapiens
agagcctggcaaaaggtcctgc

SEQ ID NO: 8476351 - DNA, 22 bp, Homo sapiens
agagccagttacaactgtggag

SEQ ID NO: 8476352 - DNA, 22 bp, Homo sapiens
agagccagttacaactgtggag

SEQ ID NO: 8476353 - DNA, 22 bp, Homo sapiens
agagccagttgttaagcactta

SEQ ID NO: 8476354 - DNA, 22 bp, Homo sapiens
agagcctgcatcaggcttgggg

SEQ ID NO: 8476355 - DNA, 22 bp, Homo sapiens
agagcctgcatctagcctcaga

SEQ ID NO: 8476356 - DNA, 22 bp, Homo sapiens
agagcctgcatcaggcttgggg

SEQ ID NO: 8476357 - DNA, 22 bp, Homo sapiens
agagcctgcatctagcctcaga

SEQ ID NO: 8476358 - DNA, 22 bp, Homo sapiens
agagcctggacctgagctacaa

SEQ ID NO: 8476359 - DNA, 22 bp, Homo sapiens
agagcctggacctgggctctga

SEQ ID NO: 8476360 - DNA, 22 bp, Homo sapiens
agagcctggacctgagctacaa

SEQ ID NO: 8476361 - DNA, 22 bp, Homo sapiens
agagcctgctacctcattccag

SEQ ID NO: 8476362 - DNA, 22 bp, Homo sapiens
agagcctgctacctcattccag

SEQ ID NO: 8476363 - DNA, 22 bp, Homo sapiens
agagcctgctgtgtaagtcaca

SEQ ID NO: 8476364 - DNA, 22 bp, Homo sapiens
agagcctgctgtgtaagtcaca

SEQ ID NO: 8476365 - DNA, 20 bp, Homo sapiens
agagcctggaaaaagacatc

SEQ ID NO: 8476366 - DNA, 20 bp, Homo sapiens
agagcctggaaaaagacatc

SEQ ID NO: 8476367 - DNA, 22 bp, Homo sapiens
agagcaggtggcaactctggga

SEQ ID NO: 8476368 - DNA, 22 bp, Homo sapiens
agagcaggtggcaactctggga

SEQ ID NO: 8476369 - DNA, 22 bp, Homo sapiens
agagacaggatatctgctcatg

SEQ ID NO: 8476370 - DNA, 22 bp, Homo sapiens
agagacaggatatctgctcatg

SEQ ID NO: 8476371 - DNA, 22 bp, Homo sapiens
agagacagggttttgccatgtt

SEQ ID NO: 8476372 - DNA, 22 bp, Homo sapiens
agagccaggcggctgggcacct

SEQ ID NO: 8476373 - DNA, 22 bp, Homo sapiens
agagccaggcggctgggcacct

SEQ ID NO: 8476374 - DNA, 22 bp, Homo sapiens
agagccaggctcccatggggca

SEQ ID NO: 8476375 - DNA, 22 bp, Homo sapiens
agagccaggctcccatggggca

SEQ ID NO: 8476376 - DNA, 22 bp, Homo sapiens
agagccaggtgtagtctcggag

SEQ ID NO: 8476377 - DNA, 22 bp, Homo sapiens
agagccaggtgtagtctcggag

SEQ ID NO: 8476378 - DNA, 22 bp, Homo sapiens
agagccaggtgtagtctcggag

SEQ ID NO: 8476379 - DNA, 22 bp, Homo sapiens
agagccaggtgtagtctcggag

SEQ ID NO: 8476380 - DNA, 22 bp, Homo sapiens
agagccagttacaactgtggag

SEQ ID NO: 8476381 - DNA, 22 bp, Homo sapiens
agagccagttacaactgtggag

SEQ ID NO: 8476382 - DNA, 22 bp, Homo sapiens
agagccaggcggctgggcacct

SEQ ID NO: 8476383 - DNA, 22 bp, Homo sapiens
agagccaggctcccatggggca

SEQ ID NO: 8476384 - DNA, 22 bp, Homo sapiens
agagccaggctcccatggggca

SEQ ID NO: 8476385 - DNA, 22 bp, Homo sapiens
agagccaggctcccatggggca

SEQ ID NO: 8476386 - DNA, 22 bp, Homo sapiens
agagccaggtgctgctgtttga

SEQ ID NO: 8476387 - DNA, 22 bp, Homo sapiens
agagccaggctctacctgggtt

SEQ ID NO: 8476388 - DNA, 22 bp, Homo sapiens
agagccaggctctacctgggtt

SEQ ID NO: 8476389 - DNA, 22 bp, Homo sapiens
aatgtgctccaattgtctactt

SEQ ID NO: 8476390 - DNA, 22 bp, Homo sapiens
aatgtgattagcctctactgga

SEQ ID NO: 8476391 - DNA, 22 bp, Homo sapiens
aatgtgattttcccagtagaat

SEQ ID NO: 8476392 - DNA, 22 bp, Homo sapiens
aatgtgagccaatgcccgtggg

SEQ ID NO: 8476393 - DNA, 22 bp, Homo sapiens
aatgtgatcgctttagaagctt

SEQ ID NO: 8476394 - DNA, 22 bp, Homo sapiens
aatgtggactcttgtatttttc

SEQ ID NO: 8476395 - DNA, 17 bp, Homo sapiens
aatgtggaagtacatgc

SEQ ID NO: 8476396 - DNA, 22 bp, Homo sapiens
aatgtaaaatatcttgtacttg

SEQ ID NO: 8476397 - DNA, 22 bp, Homo sapiens
aatgtaaaatatcttgtacttg

SEQ ID NO: 8476398 - DNA, 22 bp, Homo sapiens
aatggttttgtctcatcaatgt

SEQ ID NO: 8476399 - DNA, 18 bp, Homo sapiens
aatgtgaatatttacttc

SEQ ID NO: 8476400 - DNA, 22 bp, Homo sapiens
aatgtcttcagtgtatacatgg

SEQ ID NO: 8476401 - DNA, 22 bp, Homo sapiens
aatgtcttcagtgtatacatgg

SEQ ID NO: 8476402 - DNA, 22 bp, Homo sapiens
aatgggctttggccagtaggag

SEQ ID NO: 8476403 - DNA, 23 bp, Homo sapiens
aatgggtgcaactatccatgaca

SEQ ID NO: 8476404 - DNA, 23 bp, Homo sapiens
aatgggtgcaactatccatgaca

SEQ ID NO: 8476405 - DNA, 22 bp, Homo sapiens
aatgggttgaacatcaaggtct

SEQ ID NO: 8476406 - DNA, 22 bp, Homo sapiens
aatggttttctagaacatgaaa

SEQ ID NO: 8476407 - DNA, 22 bp, Homo sapiens
aatggtttgatggacaaaatga

SEQ ID NO: 8476408 - DNA, 22 bp, Homo sapiens
aatggtttggactattcaatag

SEQ ID NO: 8476409 - DNA, 19 bp, Homo sapiens
aatggtttgatgaagtata

SEQ ID NO: 8476410 - DNA, 22 bp, Homo sapiens
aatggtttcaaacacactaagt

SEQ ID NO: 8476411 - DNA, 22 bp, Homo sapiens
aatggtttagttaagactgagt

SEQ ID NO: 8476412 - DNA, 22 bp, Homo sapiens
aatggcagaggcaaagatggta

SEQ ID NO: 8476413 - DNA, 22 bp, Homo sapiens
aatggcagagactgttgaaata

SEQ ID NO: 8476414 - DNA, 22 bp, Homo sapiens
aatggcagaatgggccagaagc

SEQ ID NO: 8476415 - DNA, 22 bp, Homo sapiens
aatggcagaatgggccagaagc

SEQ ID NO: 8476416 - DNA, 22 bp, Homo sapiens
aatggcagaggcaaagatggta

SEQ ID NO: 8476417 - DNA, 22 bp, Homo sapiens
aatggcagaggcaaagatggta

SEQ ID NO: 8476418 - DNA, 22 bp, Homo sapiens
aatggcatgacttgcccaaggc

SEQ ID NO: 8476419 - DNA, 22 bp, Homo sapiens
aatgggaagtcactactgttac

SEQ ID NO: 8476420 - DNA, 22 bp, Homo sapiens
aatgggagagaacacaaagtcc

SEQ ID NO: 8476421 - DNA, 22 bp, Homo sapiens
aatgggagagaacacaaagtcc

SEQ ID NO: 8476422 - DNA, 22 bp, Homo sapiens
aatgggaggattttctctcttg

SEQ ID NO: 8476423 - DNA, 22 bp, Homo sapiens
aatgggaggtagtatgggaggt

SEQ ID NO: 8476424 - DNA, 22 bp, Homo sapiens
aatgggaggtagtatgggaggt

SEQ ID NO: 8476425 - DNA, 22 bp, Homo sapiens
agacaatgtttggtctacactt

SEQ ID NO: 8476426 - DNA, 22 bp, Homo sapiens
aatggagacttcaaaatggatt

SEQ ID NO: 8476427 - DNA, 22 bp, Homo sapiens
aatggcaagagccacagaggcg

SEQ ID NO: 8476428 - DNA, 22 bp, Homo sapiens
aatggcaagctgaactcagaag

SEQ ID NO: 8476429 - DNA, 22 bp, Homo sapiens
aatggcaaagtgttttcatacc

SEQ ID NO: 8476430 - DNA, 22 bp, Homo sapiens
aatggcaacatggtatagtgag

SEQ ID NO: 8476431 - DNA, 22 bp, Homo sapiens
aatggcaaaaggataacaagga

SEQ ID NO: 8476432 - DNA, 22 bp, Homo sapiens
agaagcagactctgaggcaagg

SEQ ID NO: 8476433 - DNA, 22 bp, Homo sapiens
agaagcagaaggaagcagggcc

SEQ ID NO: 8476434 - DNA, 22 bp, Homo sapiens
agaagcagactctgaggcaagg

SEQ ID NO: 8476435 - DNA, 23 bp, Homo sapiens
agaagcagcttctggagtatcgg

SEQ ID NO: 8476436 - DNA, 23 bp, Homo sapiens
agaagcagcttctggagtatcgg

SEQ ID NO: 8476437 - DNA, 23 bp, Homo sapiens
agaagcagcttctggagtatcgg

SEQ ID NO: 8476438 - DNA, 23 bp, Homo sapiens
agaagcagcttctggagtatcgg

SEQ ID NO: 8476439 - DNA, 22 bp, Homo sapiens
agacaatggctaagtaacctgt

SEQ ID NO: 8476440 - DNA, 22 bp, Homo sapiens
agacaatggagagcagagtact

SEQ ID NO: 8476441 - DNA, 22 bp, Homo sapiens
agacaatggagggaaatacttc

SEQ ID NO: 8476442 - DNA, 22 bp, Homo sapiens
agacaatgtcaaggtgatcatc

SEQ ID NO: 8476443 - DNA, 20 bp, Homo sapiens
agacaatgagtgacagagtt

SEQ ID NO: 8476444 - DNA, 21 bp, Homo sapiens
agacaatgctgtaaaattcag

SEQ ID NO: 8476445 - DNA, 22 bp, Homo sapiens
agacaatggaccaagcaccttc

SEQ ID NO: 8476446 - DNA, 22 bp, Homo sapiens
agacaatggagagcagagtact

SEQ ID NO: 8476447 - DNA, 22 bp, Homo sapiens
acagacaagtagttcagacaag

SEQ ID NO: 8476448 - DNA, 22 bp, Homo sapiens
acagacaagtagttcagacaag

SEQ ID NO: 8476449 - DNA, 22 bp, Homo sapiens
acagaattaggagatcctcttg

SEQ ID NO: 8476450 - DNA, 22 bp, Homo sapiens
acagacacaggcgtggagtcgc

SEQ ID NO: 8476451 - DNA, 20 bp, Homo sapiens
acagaaagagagaatgtcag

SEQ ID NO: 8476452 - DNA, 20 bp, Homo sapiens
acagaaagagagaatgtcag

SEQ ID NO: 8476453 - DNA, 20 bp, Homo sapiens
acagaaagagagaatgtcag

SEQ ID NO: 8476454 - DNA, 22 bp, Homo sapiens
acagaaagataggcacaaggtc

SEQ ID NO: 8476455 - DNA, 22 bp, Homo sapiens
acagaattaatgaaaattacaa

SEQ ID NO: 8476456 - DNA, 22 bp, Homo sapiens
acagaattaatgaaaattacaa

SEQ ID NO: 8476457 - DNA, 22 bp, Homo sapiens
acagaattaatgaaaattacaa

SEQ ID NO: 8476458 - DNA, 18 bp, Homo sapiens
acagacacttagtatgag

SEQ ID NO: 8476459 - DNA, 18 bp, Homo sapiens
acagacacttagtatgag

SEQ ID NO: 8476460 - DNA, 18 bp, Homo sapiens
acagacacttagtatgag

SEQ ID NO: 8476461 - DNA, 22 bp, Homo sapiens
acagacagacagagaactattc

SEQ ID NO: 8476462 - DNA, 22 bp, Homo sapiens
agccaggggattcatcagggac

SEQ ID NO: 8476463 - DNA, 22 bp, Homo sapiens
agccaggggattcatcagggac

SEQ ID NO: 8476464 - DNA, 22 bp, Homo sapiens
acagacagggcacctgcctcct

SEQ ID NO: 8476465 - DNA, 22 bp, Homo sapiens
acagacagggcacctgcctcct

SEQ ID NO: 8476466 - DNA, 22 bp, Homo sapiens
agccaggggattcatcagggac

SEQ ID NO: 8476467 - DNA, 22 bp, Homo sapiens
agccaggggattcatcagggac

SEQ ID NO: 8476468 - DNA, 22 bp, Homo sapiens
acagacagaggctccatgagga

SEQ ID NO: 8476469 - DNA, 22 bp, Homo sapiens
acagacagattttgtctgatgt

SEQ ID NO: 8476470 - DNA, 22 bp, Homo sapiens
acagaaagaaggtgtatttgag

SEQ ID NO: 8476471 - DNA, 22 bp, Homo sapiens
acagaaagaccttgtaacactt

SEQ ID NO: 8476472 - DNA, 22 bp, Homo sapiens
acagaaacccagaaaacctctc

SEQ ID NO: 8476473 - DNA, 22 bp, Homo sapiens
acagaaagaaggtgtatttgag

SEQ ID NO: 8476474 - DNA, 22 bp, Homo sapiens
acagaaaatgccagaagggtgg

SEQ ID NO: 8476475 - DNA, 22 bp, Homo sapiens
acagaaaatgccagaagggtgg

SEQ ID NO: 8476476 - DNA, 22 bp, Homo sapiens
acagaaaatgccagaagggtgg

SEQ ID NO: 8476477 - DNA, 22 bp, Homo sapiens
acagaaacccagaaaacctctc

SEQ ID NO: 8476478 - DNA, 22 bp, Homo sapiens
acagaaaaatgagggagctgga

SEQ ID NO: 8476479 - DNA, 22 bp, Homo sapiens
acacttttgtttgaagtctcca

SEQ ID NO: 8476480 - DNA, 22 bp, Homo sapiens
acacttttgtgtatatccagtt

SEQ ID NO: 8476481 - DNA, 22 bp, Homo sapiens
acagaaaagtttacttttgctc

SEQ ID NO: 8476482 - DNA, 22 bp, Homo sapiens
acagaaaagtttacttttgctc

SEQ ID NO: 8476483 - DNA, 22 bp, Homo sapiens
acagaaaagtttacttttgctc

SEQ ID NO: 8476484 - DNA, 22 bp, Homo sapiens
acagaaaaatgagggagctgga

SEQ ID NO: 8476485 - DNA, 22 bp, Homo sapiens
acactttgggctggataattat

SEQ ID NO: 8476486 - DNA, 22 bp, Homo sapiens
acactttgggctggataattat

SEQ ID NO: 8476487 - DNA, 22 bp, Homo sapiens
acactttgaagatggaaacttg

SEQ ID NO: 8476488 - DNA, 22 bp, Homo sapiens
acactttgatagataatgcagg

SEQ ID NO: 8476489 - DNA, 22 bp, Homo sapiens
acactttgttgtggcatatacg

SEQ ID NO: 8476490 - DNA, 22 bp, Homo sapiens
acactttagatattcccttctg

SEQ ID NO: 8476491 - DNA, 22 bp, Homo sapiens
acactttatcaatattcaaaaa

SEQ ID NO: 8476492 - DNA, 22 bp, Homo sapiens
acactttatcaatattcaaaaa

SEQ ID NO: 8476493 - DNA, 22 bp, Homo sapiens
acactttatcaatattcaaaaa

SEQ ID NO: 8476494 - DNA, 22 bp, Homo sapiens
acactttatctcatctcagaca

SEQ ID NO: 8476495 - DNA, 22 bp, Homo sapiens
acactttatgtctagatctggg

SEQ ID NO: 8476496 - DNA, 23 bp, Homo sapiens
acactttcaaatatgcacagagc

SEQ ID NO: 8476497 - DNA, 22 bp, Homo sapiens
acagactgtttggttcatgtct

SEQ ID NO: 8476498 - DNA, 22 bp, Homo sapiens
acagactgttggcctactgagc

SEQ ID NO: 8476499 - DNA, 22 bp, Homo sapiens
acagacttgttccctagtgagt

SEQ ID NO: 8476500 - DNA, 22 bp, Homo sapiens
acagacttgttccctagtgagt

SEQ ID NO: 8476501 - DNA, 22 bp, Homo sapiens
acagagaaactaaggagtttgg

SEQ ID NO: 8476502 - DNA, 21 bp, Homo sapiens
acagagaaagagcagcctcct

SEQ ID NO: 8476503 - DNA, 22 bp, Homo sapiens
acagagaaagtgggctgaagat

SEQ ID NO: 8476504 - DNA, 23 bp, Homo sapiens
acagactgtattcaaagtaggac

SEQ ID NO: 8476505 - DNA, 22 bp, Homo sapiens
acagactgtgagtatgcatagt

SEQ ID NO: 8476506 - DNA, 23 bp, Homo sapiens
acagacattccataatgtacacc

SEQ ID NO: 8476507 - DNA, 22 bp, Homo sapiens
acagacattcagctaagtctat

SEQ ID NO: 8476508 - DNA, 19 bp, Homo sapiens
agccagggtccagacatgt

SEQ ID NO: 8476509 - DNA, 19 bp, Homo sapiens
agccagggtccagacatgt

SEQ ID NO: 8476510 - DNA, 19 bp, Homo sapiens
agccagggtccagacatgt

SEQ ID NO: 8476511 - DNA, 19 bp, Homo sapiens
agccagggtccagacatgt

SEQ ID NO: 8476512 - DNA, 22 bp, Homo sapiens
agccagggtctctcgctctgtt

SEQ ID NO: 8476513 - DNA, 22 bp, Homo sapiens
agccagggggacgctttctggc

SEQ ID NO: 8476514 - DNA, 22 bp, Homo sapiens
agccagggtaaggtacttagta

SEQ ID NO: 8476515 - DNA, 22 bp, Homo sapiens
agccagggtctctcgctctgtt

SEQ ID NO: 8476516 - DNA, 22 bp, Homo sapiens
agccagggtctctcgctctgtt

SEQ ID NO: 8476517 - DNA, 22 bp, Homo sapiens
agccagggtctctcgctctgtt

SEQ ID NO: 8476518 - DNA, 19 bp, Homo sapiens
agccagggtgagaaggagc

SEQ ID NO: 8476519 - DNA, 19 bp, Homo sapiens
agccagggtgagaaggagc

SEQ ID NO: 8476520 - DNA, 19 bp, Homo sapiens
agccagggtgagaaggagc

SEQ ID NO: 8476521 - DNA, 19 bp, Homo sapiens
agccagggtgagaaggagc

SEQ ID NO: 8476522 - DNA, 22 bp, Homo sapiens
acagagaaagtgggctgaagat

SEQ ID NO: 8476523 - DNA, 22 bp, Homo sapiens
acagagaaagtgggctgaagat

SEQ ID NO: 8476524 - DNA, 22 bp, Homo sapiens
acagagacaggcagacagtctt

SEQ ID NO: 8476525 - DNA, 22 bp, Homo sapiens
acagagacaggcagacagtctt

SEQ ID NO: 8476526 - DNA, 22 bp, Homo sapiens
acagagaccagttacagcgtcc

SEQ ID NO: 8476527 - DNA, 22 bp, Homo sapiens
acagagaccagttacagcgtcc

SEQ ID NO: 8476528 - DNA, 22 bp, Homo sapiens
acagagactgggagcaagaggc

SEQ ID NO: 8476529 - DNA, 22 bp, Homo sapiens
acagagactgggagcaagaggc

SEQ ID NO: 8476530 - DNA, 22 bp, Homo sapiens
acagagactgggatgcctgcct

SEQ ID NO: 8476531 - DNA, 20 bp, Homo sapiens
acagagactgagacacttgc

SEQ ID NO: 8476532 - DNA, 22 bp, Homo sapiens
acagagagctgtgattgagtta

SEQ ID NO: 8476533 - DNA, 22 bp, Homo sapiens
acagatgttacagtatgatctc

SEQ ID NO: 8476534 - DNA, 22 bp, Homo sapiens
acagatgttagcaatgatgatg

SEQ ID NO: 8476535 - DNA, 22 bp, Homo sapiens
acagatgtggagtttgcatgat

SEQ ID NO: 8476536 - DNA, 22 bp, Homo sapiens
acagatgttagcaatgatgatg

SEQ ID NO: 8476537 - DNA, 22 bp, Homo sapiens
acagatgttgcttgtcattctc

SEQ ID NO: 8476538 - DNA, 22 bp, Homo sapiens
acagatgtacactcatatataa

SEQ ID NO: 8476539 - DNA, 22 bp, Homo sapiens
acagatgtaccttagtgatggg

SEQ ID NO: 8476540 - DNA, 21 bp, Homo sapiens
acagatgtgatatgcagtctt

SEQ ID NO: 8476541 - DNA, 21 bp, Homo sapiens
acagatgtgatatgcagtctt

SEQ ID NO: 8476542 - DNA, 22 bp, Homo sapiens
acagatgtggagtttgcatgat

SEQ ID NO: 8476543 - DNA, 22 bp, Homo sapiens
acagattcactgcactggccat

SEQ ID NO: 8476544 - DNA, 22 bp, Homo sapiens
agctcccagaaggccctgcgcc

SEQ ID NO: 8476545 - DNA, 22 bp, Homo sapiens
agctcccagaaggccctgcgcc

SEQ ID NO: 8476546 - DNA, 22 bp, Homo sapiens
agctcccagaaggccctgcgcc

SEQ ID NO: 8476547 - DNA, 22 bp, Homo sapiens
acagattcactgcactggccat

SEQ ID NO: 8476548 - DNA, 22 bp, Homo sapiens
agctcccagagctcgagagtaa

SEQ ID NO: 8476549 - DNA, 19 bp, Homo sapiens
agctcctgattgtgcctcg

SEQ ID NO: 8476550 - DNA, 19 bp, Homo sapiens
agctcctgattgtgcctcg

SEQ ID NO: 8476551 - DNA, 22 bp, Homo sapiens
acagatgtaatctattcacatt

SEQ ID NO: 8476552 - DNA, 22 bp, Homo sapiens
acagatgtaatctattcacatt

SEQ ID NO: 8476553 - DNA, 22 bp, Homo sapiens
acagatgtaatctattcacatt

SEQ ID NO: 8476554 - DNA, 22 bp, Homo sapiens
acagatggttattgtcatttct

SEQ ID NO: 8476555 - DNA, 21 bp, Homo sapiens
acagatgggatgagcacactg

SEQ ID NO: 8476556 - DNA, 22 bp, Homo sapiens
acagatggcactttttaggact

SEQ ID NO: 8476557 - DNA, 22 bp, Homo sapiens
acagatggccatattactatat

SEQ ID NO: 8476558 - DNA, 22 bp, Homo sapiens
acagatggagctactaggtaaa

SEQ ID NO: 8476559 - DNA, 22 bp, Homo sapiens
acagatgcttactggtggttcc

SEQ ID NO: 8476560 - DNA, 22 bp, Homo sapiens
acagcacaatctgagtcccaga

SEQ ID NO: 8476561 - DNA, 22 bp, Homo sapiens
acagcacaatctgagtcccaga

SEQ ID NO: 8476562 - DNA, 22 bp, Homo sapiens
acagcacaatctgagtcccaga

SEQ ID NO: 8476563 - DNA, 22 bp, Homo sapiens
acagcacagagtggtatggctg

SEQ ID NO: 8476564 - DNA, 22 bp, Homo sapiens
agctcctgcttgacagaagagg

SEQ ID NO: 8476565 - DNA, 22 bp, Homo sapiens
agctcctgcttgacagaagagg

SEQ ID NO: 8476566 - DNA, 22 bp, Homo sapiens
agctcctgctctttgtccctaa

SEQ ID NO: 8476567 - DNA, 22 bp, Homo sapiens
agctcctgcacccagccttgag

SEQ ID NO: 8476568 - DNA, 22 bp, Homo sapiens
agctcctgcagactcctgctca

SEQ ID NO: 8476569 - DNA, 22 bp, Homo sapiens
agctcctgcagactcctgctca

SEQ ID NO: 8476570 - DNA, 22 bp, Homo sapiens
agctcctgcgcacggtgcacac

SEQ ID NO: 8476571 - DNA, 17 bp, Homo sapiens
agctcctgcccatggct

SEQ ID NO: 8476572 - DNA, 20 bp, Homo sapiens
agccctgtttcctggagaga

SEQ ID NO: 8476573 - DNA, 22 bp, Homo sapiens
agcctcctgtagccctcaccca

SEQ ID NO: 8476574 - DNA, 22 bp, Homo sapiens
agcctctcaaagaaaccctgta

SEQ ID NO: 8476575 - DNA, 22 bp, Homo sapiens
agcctctcactgtcaccctccc

SEQ ID NO: 8476576 - DNA, 22 bp, Homo sapiens
agcctctcactgtcaccctccc

SEQ ID NO: 8476577 - DNA, 22 bp, Homo sapiens
agcctctctccagcttggcaga

SEQ ID NO: 8476578 - DNA, 22 bp, Homo sapiens
agcctctctgatgtgacagcta

SEQ ID NO: 8476579 - DNA, 22 bp, Homo sapiens
agcctctctgatgtgacagcta

SEQ ID NO: 8476580 - DNA, 22 bp, Homo sapiens
agcctctctgttagtcactggg

SEQ ID NO: 8476581 - DNA, 22 bp, Homo sapiens
agcctctctgttagtcactggg

SEQ ID NO: 8476582 - DNA, 22 bp, Homo sapiens
agcctctccagagcctggcaga

SEQ ID NO: 8476583 - DNA, 22 bp, Homo sapiens
agcctctctccagcttggcaga

SEQ ID NO: 8476584 - DNA, 22 bp, Homo sapiens
agcctctgactgtcagcaaggt

SEQ ID NO: 8476585 - DNA, 22 bp, Homo sapiens
agcctctctttattcccagcta

SEQ ID NO: 8476586 - DNA, 22 bp, Homo sapiens
agcctctctttctggtggctaa

SEQ ID NO: 8476587 - DNA, 22 bp, Homo sapiens
agcctctctttattcccagcta

SEQ ID NO: 8476588 - DNA, 22 bp, Homo sapiens
agcctctgactgtcagcaaggt

SEQ ID NO: 8476589 - DNA, 22 bp, Homo sapiens
agcctctgatggctcccaagga

SEQ ID NO: 8476590 - DNA, 22 bp, Homo sapiens
agcctctgatgatcacaggggg

SEQ ID NO: 8476591 - DNA, 22 bp, Homo sapiens
acagagccactttggtgcctac

SEQ ID NO: 8476592 - DNA, 22 bp, Homo sapiens
acagagccactttggtgcctac

SEQ ID NO: 8476593 - DNA, 22 bp, Homo sapiens
acagagcccttccttgcaccat

SEQ ID NO: 8476594 - DNA, 22 bp, Homo sapiens
acagagcctccaggagtgctgg

SEQ ID NO: 8476595 - DNA, 21 bp, Homo sapiens
acagagccgggcacaaagctg

SEQ ID NO: 8476596 - DNA, 22 bp, Homo sapiens
acagagccaaaaggacatagta

SEQ ID NO: 8476597 - DNA, 22 bp, Homo sapiens
acagatgatgtgcacagataga

SEQ ID NO: 8476598 - DNA, 22 bp, Homo sapiens
acagatgagttaaagcagagtg

SEQ ID NO: 8476599 - DNA, 22 bp, Homo sapiens
acagatgaggcccatcagtctg

SEQ ID NO: 8476600 - DNA, 22 bp, Homo sapiens
acagatgaggcccatcagtctg

SEQ ID NO: 8476601 - DNA, 22 bp, Homo sapiens
acagatgatgtgcacagataga

SEQ ID NO: 8476602 - DNA, 22 bp, Homo sapiens
acagatgatgtgcacagataga

SEQ ID NO: 8476603 - DNA, 22 bp, Homo sapiens
acagatgatttttatgaaaaca

SEQ ID NO: 8476604 - DNA, 22 bp, Homo sapiens
acagatgatttttatgaaaaca

SEQ ID NO: 8476605 - DNA, 22 bp, Homo sapiens
acagatgatttttatgaaaaca

SEQ ID NO: 8476606 - DNA, 22 bp, Homo sapiens
acagatgatttttatgaaaaca

SEQ ID NO: 8476607 - DNA, 22 bp, Homo sapiens
acagatgcaaggaaatgattgc

SEQ ID NO: 8476608 - DNA, 22 bp, Homo sapiens
acagatgcgcttggttgccaga

SEQ ID NO: 8476609 - DNA, 19 bp, Homo sapiens
acagatgcttttgctgccc

SEQ ID NO: 8476610 - DNA, 22 bp, Homo sapiens
acagatggaatgtgttatggga

SEQ ID NO: 8476611 - DNA, 22 bp, Homo sapiens
acagatgctctgatgtctgggt

SEQ ID NO: 8476612 - DNA, 22 bp, Homo sapiens
acagagctcccagccatctcct

SEQ ID NO: 8476613 - DNA, 22 bp, Homo sapiens
acagagctcccagccatctcct

SEQ ID NO: 8476614 - DNA, 19 bp, Homo sapiens
acagagctctctgcttctg

SEQ ID NO: 8476615 - DNA, 19 bp, Homo sapiens
acagagctctctgcttctg

SEQ ID NO: 8476616 - DNA, 17 bp, Homo sapiens
acagagctacatattct

SEQ ID NO: 8476617 - DNA, 22 bp, Homo sapiens
acagagctaaatttcaatccca

SEQ ID NO: 8476618 - DNA, 22 bp, Homo sapiens
acagagctaatgttgcataggc

SEQ ID NO: 8476619 - DNA, 22 bp, Homo sapiens
acagagctaatgttgcataggc

SEQ ID NO: 8476620 - DNA, 22 bp, Homo sapiens
acagagctaatgttgcataggc

SEQ ID NO: 8476621 - DNA, 22 bp, Homo sapiens
acagagctaatgttgcataggc

SEQ ID NO: 8476622 - DNA, 22 bp, Homo sapiens
acagagctgggtgccccctgga

SEQ ID NO: 8476623 - DNA, 22 bp, Homo sapiens
acagagctgggatctgaaccca

SEQ ID NO: 8476624 - DNA, 22 bp, Homo sapiens
acagagctgggatctgaaccca

SEQ ID NO: 8476625 - DNA, 21 bp, Homo sapiens
acagatatttcattgaacatt

SEQ ID NO: 8476626 - DNA, 20 bp, Homo sapiens
acagatatttgattttcagt

SEQ ID NO: 8476627 - DNA, 22 bp, Homo sapiens
acagatgaggcccatcagtctg

SEQ ID NO: 8476628 - DNA, 18 bp, Homo sapiens
agcagagcccatgcattc

SEQ ID NO: 8476629 - DNA, 19 bp, Homo sapiens
agcagagccctgaagatcc

SEQ ID NO: 8476630 - DNA, 19 bp, Homo sapiens
agcagagccctgaagatcc

SEQ ID NO: 8476631 - DNA, 22 bp, Homo sapiens
agcagagcccttccatggcctt

SEQ ID NO: 8476632 - DNA, 22 bp, Homo sapiens
agcagagcctgggctaggggtg

SEQ ID NO: 8476633 - DNA, 22 bp, Homo sapiens
agcagagcccttccatggcctt

SEQ ID NO: 8476634 - DNA, 22 bp, Homo sapiens
agcagagcccttccatggcctt

SEQ ID NO: 8476635 - DNA, 22 bp, Homo sapiens
agcagatgagcctcatgactgg

SEQ ID NO: 8476636 - DNA, 22 bp, Homo sapiens
agcagatgagcctcatgactgg

SEQ ID NO: 8476637 - DNA, 22 bp, Homo sapiens
agcagatgagcctcatgactgg

SEQ ID NO: 8476638 - DNA, 22 bp, Homo sapiens
agcagatgaatcccagataaag

SEQ ID NO: 8476639 - DNA, 22 bp, Homo sapiens
agcagatatttgttgagcactt

SEQ ID NO: 8476640 - DNA, 22 bp, Homo sapiens
agcagagtttctcaacatcagc

SEQ ID NO: 8476641 - DNA, 20 bp, Homo sapiens
agcagatagcgggagagttt

SEQ ID NO: 8476642 - DNA, 22 bp, Homo sapiens
agcagatagtagaacatgtata

SEQ ID NO: 8476643 - DNA, 22 bp, Homo sapiens
agcagatggtgtcatgggatgg

SEQ ID NO: 8476644 - DNA, 22 bp, Homo sapiens
agcagatgtgtctctgcactgt

SEQ ID NO: 8476645 - DNA, 22 bp, Homo sapiens
agcagatggtgtcatgggatgg

SEQ ID NO: 8476646 - DNA, 22 bp, Homo sapiens
agcagatgtgtctctgcactgt

SEQ ID NO: 8476647 - DNA, 22 bp, Homo sapiens
agcagatgtttcagagcaggct

SEQ ID NO: 8476648 - DNA, 22 bp, Homo sapiens
agcagatgcgtctgagtgggag

SEQ ID NO: 8476649 - DNA, 22 bp, Homo sapiens
agcagatgcgtctgagtgggag

SEQ ID NO: 8476650 - DNA, 22 bp, Homo sapiens
agcagatgggagatggagctgc

SEQ ID NO: 8476651 - DNA, 22 bp, Homo sapiens
agcagatggagaatggagtcag

SEQ ID NO: 8476652 - DNA, 22 bp, Homo sapiens
agcagatgagcctcatgactgg

SEQ ID NO: 8476653 - DNA, 22 bp, Homo sapiens
acacagaagatctcttaatgct

SEQ ID NO: 8476654 - DNA, 23 bp, Homo sapiens
agcagcaaaaatttatctttctg

SEQ ID NO: 8476655 - DNA, 22 bp, Homo sapiens
agcagagcatgctaagtgactc

SEQ ID NO: 8476656 - DNA, 19 bp, Homo sapiens
agcagagcagggccgtggg

SEQ ID NO: 8476657 - DNA, 19 bp, Homo sapiens
agcagagcagggccgtggg

SEQ ID NO: 8476658 - DNA, 22 bp, Homo sapiens
agcagagccagaattggaccag

SEQ ID NO: 8476659 - DNA, 22 bp, Homo sapiens
agcagagccaggtctctctgta

SEQ ID NO: 8476660 - DNA, 22 bp, Homo sapiens
agcagagccaggtctctctgta

SEQ ID NO: 8476661 - DNA, 22 bp, Homo sapiens
agcagagccagaattggaccag

SEQ ID NO: 8476662 - DNA, 18 bp, Homo sapiens
agcagagagtgaatggga

SEQ ID NO: 8476663 - DNA, 22 bp, Homo sapiens
agcagagcagaatgtgaaggtg

SEQ ID NO: 8476664 - DNA, 23 bp, Homo sapiens
acaatgcactttaaatggttccc

SEQ ID NO: 8476665 - DNA, 22 bp, Homo sapiens
acaatgcagcctatggatccag

SEQ ID NO: 8476666 - DNA, 22 bp, Homo sapiens
acaatgcaccagcatcttcacc

SEQ ID NO: 8476667 - DNA, 22 bp, Homo sapiens
acaatgcaccagcatcttcacc

SEQ ID NO: 8476668 - DNA, 22 bp, Homo sapiens
acaatgcaccagcatcttcacc

SEQ ID NO: 8476669 - DNA, 22 bp, Homo sapiens
acaatgcacctattttaaaact

SEQ ID NO: 8476670 - DNA, 22 bp, Homo sapiens
acaatgcacctattttaaaact

SEQ ID NO: 8476671 - DNA, 22 bp, Homo sapiens
agcagagaggaggtggccctgt

SEQ ID NO: 8476672 - DNA, 22 bp, Homo sapiens
agcagaacctgcagacctgtct

SEQ ID NO: 8476673 - DNA, 22 bp, Homo sapiens
agcagaactgatgagacttgag

SEQ ID NO: 8476674 - DNA, 21 bp, Homo sapiens
acaatgcatggaactcatggc

SEQ ID NO: 8476675 - DNA, 21 bp, Homo sapiens
acaatgcatggaactcatggc

SEQ ID NO: 8476676 - DNA, 21 bp, Homo sapiens
acaatgcatggaactcatggc

SEQ ID NO: 8476677 - DNA, 21 bp, Homo sapiens
acaatgcatggaactcatggc

SEQ ID NO: 8476678 - DNA, 22 bp, Homo sapiens
acaatgctgcagggaaattagg

SEQ ID NO: 8476679 - DNA, 22 bp, Homo sapiens
acaatgctgcagggaaattagg

SEQ ID NO: 8476680 - DNA, 22 bp, Homo sapiens
acaatgctccctgtagtcagga

SEQ ID NO: 8476681 - DNA, 22 bp, Homo sapiens
acaatgctcatatttatgccaa

SEQ ID NO: 8476682 - DNA, 22 bp, Homo sapiens
acacagagtttgacacatggga

SEQ ID NO: 8476683 - DNA, 22 bp, Homo sapiens
acacagagtttgacacatggga

SEQ ID NO: 8476684 - DNA, 22 bp, Homo sapiens
acacagagtttgacacatggga

SEQ ID NO: 8476685 - DNA, 22 bp, Homo sapiens
acacagagttattatgtgaact

SEQ ID NO: 8476686 - DNA, 22 bp, Homo sapiens
acacagagttattatgtgaact

SEQ ID NO: 8476687 - DNA, 22 bp, Homo sapiens
acacagagtggtttgtagaata

SEQ ID NO: 8476688 - DNA, 22 bp, Homo sapiens
acacagagtccttactgaggta

SEQ ID NO: 8476689 - DNA, 22 bp, Homo sapiens
acacagagtccttactgaggta

SEQ ID NO: 8476690 - DNA, 22 bp, Homo sapiens
acacagagtccttactgaggta

SEQ ID NO: 8476691 - DNA, 22 bp, Homo sapiens
acacagagtccttactgaggta

SEQ ID NO: 8476692 - DNA, 22 bp, Homo sapiens
acacagagtatttagaaggggt

SEQ ID NO: 8476693 - DNA, 22 bp, Homo sapiens
acacagagtatcttttgcctag

SEQ ID NO: 8476694 - DNA, 22 bp, Homo sapiens
acacagagtatttagaaggggt

SEQ ID NO: 8476695 - DNA, 22 bp, Homo sapiens
acacagagggcagaagatacat

SEQ ID NO: 8476696 - DNA, 22 bp, Homo sapiens
acacagaggcatgacagtggct

SEQ ID NO: 8476697 - DNA, 22 bp, Homo sapiens
acacagaggcatgacagtggct

SEQ ID NO: 8476698 - DNA, 22 bp, Homo sapiens
acacagaggctccagagataga

SEQ ID NO: 8476699 - DNA, 22 bp, Homo sapiens
acacagaggtggccactctttt

SEQ ID NO: 8476700 - DNA, 22 bp, Homo sapiens
acacagaggcatgacagtggct

SEQ ID NO: 8476701 - DNA, 21 bp, Homo sapiens
acacagaggcatcatcacttt

SEQ ID NO: 8476702 - DNA, 21 bp, Homo sapiens
acacagaggcatcatcacttt

SEQ ID NO: 8476703 - DNA, 21 bp, Homo sapiens
acacagaggcatcatcacttt

SEQ ID NO: 8476704 - DNA, 22 bp, Homo sapiens
acacagaggaaagtgtgaaggg

SEQ ID NO: 8476705 - DNA, 22 bp, Homo sapiens
acacagaagatctcttaatgct

SEQ ID NO: 8476706 - DNA, 22 bp, Homo sapiens
acacagagcttctcaactggga

SEQ ID NO: 8476707 - DNA, 22 bp, Homo sapiens
agcagctgagccccagctgtga

SEQ ID NO: 8476708 - DNA, 22 bp, Homo sapiens
agcagctggggcctgtgacgat

SEQ ID NO: 8476709 - DNA, 22 bp, Homo sapiens
agcagctggggcctgtgacgat

SEQ ID NO: 8476710 - DNA, 22 bp, Homo sapiens
acacagatgcattacacatcta

SEQ ID NO: 8476711 - DNA, 22 bp, Homo sapiens
acacagatgctatttagtctct

SEQ ID NO: 8476712 - DNA, 22 bp, Homo sapiens
agcagctgagccccagctgtga

SEQ ID NO: 8476713 - DNA, 22 bp, Homo sapiens
acacagatgatgttccaggaac

SEQ ID NO: 8476714 - DNA, 22 bp, Homo sapiens
acacagagtttgacacatggga

SEQ ID NO: 8476715 - DNA, 22 bp, Homo sapiens
acacagatattgtacttgatcc

SEQ ID NO: 8476716 - DNA, 22 bp, Homo sapiens
acacagatattgtacttgatcc

SEQ ID NO: 8476717 - DNA, 22 bp, Homo sapiens
agcagctgggtccggcggagca

SEQ ID NO: 8476718 - DNA, 17 bp, Homo sapiens
agcagctgggttgatct

SEQ ID NO: 8476719 - DNA, 23 bp, Homo sapiens
agcagctggggtgctcttttgtc

SEQ ID NO: 8476720 - DNA, 22 bp, Homo sapiens
agcagctggtaggagtggccac

SEQ ID NO: 8476721 - DNA, 22 bp, Homo sapiens
agcagctggtaggagtggccac

SEQ ID NO: 8476722 - DNA, 22 bp, Homo sapiens
agcagctggtgcaactctaaga

SEQ ID NO: 8476723 - DNA, 22 bp, Homo sapiens
agcagctggtgagcaagctcag

SEQ ID NO: 8476724 - DNA, 22 bp, Homo sapiens
acacatgtatggcacttacatt

SEQ ID NO: 8476725 - DNA, 22 bp, Homo sapiens
acacatgtatggcacttacatt

SEQ ID NO: 8476726 - DNA, 22 bp, Homo sapiens
acacatgtatgttttgtatttg

SEQ ID NO: 8476727 - DNA, 22 bp, Homo sapiens
acacatgtatggcacttacatt

SEQ ID NO: 8476728 - DNA, 22 bp, Homo sapiens
acacatgtatatgcttgtgtgt

SEQ ID NO: 8476729 - DNA, 22 bp, Homo sapiens
acacatgtacagattagtattt

SEQ ID NO: 8476730 - DNA, 19 bp, Homo sapiens
acacatgtaacagtttttc

SEQ ID NO: 8476731 - DNA, 22 bp, Homo sapiens
acacatgtgattctaagacagc

SEQ ID NO: 8476732 - DNA, 22 bp, Homo sapiens
acacatgtgattctaagacagc

SEQ ID NO: 8476733 - DNA, 22 bp, Homo sapiens
acacatgtgattctaagacagc

SEQ ID NO: 8476734 - DNA, 20 bp, Homo sapiens
acacatgtgcgtgttcagta

SEQ ID NO: 8476735 - DNA, 20 bp, Homo sapiens
acacatgtcaagctaaaggc

SEQ ID NO: 8476736 - DNA, 20 bp, Homo sapiens
acacatgtcaagctaaaggc

SEQ ID NO: 8476737 - DNA, 22 bp, Homo sapiens
acacatgtgattctaagacagc

SEQ ID NO: 8476738 - DNA, 22 bp, Homo sapiens
acacatgtatgttttgtatttg

SEQ ID NO: 8476739 - DNA, 22 bp, Homo sapiens
acacatgtatgttttgtatttg

SEQ ID NO: 8476740 - DNA, 22 bp, Homo sapiens
acacatgtttccaaaagcaccc

SEQ ID NO: 8476741 - DNA, 22 bp, Homo sapiens
acacatgtttccaaaagcaccc

SEQ ID NO: 8476742 - DNA, 22 bp, Homo sapiens
acacatgtttgtgtagtcagtt

SEQ ID NO: 8476743 - DNA, 22 bp, Homo sapiens
acacattaaaacgtctacaatg

SEQ ID NO: 8476744 - DNA, 22 bp, Homo sapiens
acacattaaaacgtctacaatg

SEQ ID NO: 8476745 - DNA, 22 bp, Homo sapiens
acacattaaaacgtctacaatg

SEQ ID NO: 8476746 - DNA, 22 bp, Homo sapiens
acacatgtttacagtcttcagt

SEQ ID NO: 8476747 - DNA, 22 bp, Homo sapiens
acacatgttcaagaatgttcag

SEQ ID NO: 8476748 - DNA, 19 bp, Homo sapiens
acacatgtgtgttatgtgc

SEQ ID NO: 8476749 - DNA, 22 bp, Homo sapiens
acacatgtgtctgcatgcagtg

SEQ ID NO: 8476750 - DNA, 22 bp, Homo sapiens
acacatgtgtctgcatgcagtg

SEQ ID NO: 8476751 - DNA, 19 bp, Homo sapiens
acacatgtgtgttatgtgc

SEQ ID NO: 8476752 - DNA, 20 bp, Homo sapiens
acacatgtgcgtgttcagta

SEQ ID NO: 8476753 - DNA, 22 bp, Homo sapiens
acacatgtgattctaagacagc

SEQ ID NO: 8476754 - DNA, 22 bp, Homo sapiens
acacatgtgtctgcatgcagtg

SEQ ID NO: 8476755 - DNA, 22 bp, Homo sapiens
acacagggcggaaagcatgaga

SEQ ID NO: 8476756 - DNA, 22 bp, Homo sapiens
acacagggcggaaagcatgaga

SEQ ID NO: 8476757 - DNA, 22 bp, Homo sapiens
acacatcttagactgaaatatg

SEQ ID NO: 8476758 - DNA, 22 bp, Homo sapiens
acacatgctgataagaatataa

SEQ ID NO: 8476759 - DNA, 22 bp, Homo sapiens
acacatggtctacttcttctca

SEQ ID NO: 8476760 - DNA, 22 bp, Homo sapiens
acacatgtaaaacacttagcaa

SEQ ID NO: 8476761 - DNA, 22 bp, Homo sapiens
acacagggcagagagctggctc

SEQ ID NO: 8476762 - DNA, 22 bp, Homo sapiens
acacagggcagagagctggctc

SEQ ID NO: 8476763 - DNA, 19 bp, Homo sapiens
acacagggatcagagggtt

SEQ ID NO: 8476764 - DNA, 19 bp, Homo sapiens
acacagggatcagagggtt

SEQ ID NO: 8476765 - DNA, 19 bp, Homo sapiens
acacagggatcagagggtt

SEQ ID NO: 8476766 - DNA, 22 bp, Homo sapiens
acacagggcaatgctttgacct

SEQ ID NO: 8476767 - DNA, 22 bp, Homo sapiens
acacagggcaatgctttgacct

SEQ ID NO: 8476768 - DNA, 18 bp, Homo sapiens
acacaggctgacagcacc

SEQ ID NO: 8476769 - DNA, 18 bp, Homo sapiens
acacaggctgacagcacc

SEQ ID NO: 8476770 - DNA, 22 bp, Homo sapiens
acacaggcatagccatacatgt

SEQ ID NO: 8476771 - DNA, 17 bp, Homo sapiens
acacagggagagggagc

SEQ ID NO: 8476772 - DNA, 17 bp, Homo sapiens
acacagggagagggagc

SEQ ID NO: 8476773 - DNA, 17 bp, Homo sapiens
acacagggagagggagc

SEQ ID NO: 8476774 - DNA, 17 bp, Homo sapiens
acacagggagagggagc

SEQ ID NO: 8476775 - DNA, 22 bp, Homo sapiens
acacagggaggaggtgctgtgc

SEQ ID NO: 8476776 - DNA, 22 bp, Homo sapiens
acacagggaggaggtgctgtgc

SEQ ID NO: 8476777 - DNA, 22 bp, Homo sapiens
acacagggatatttcaggtggt

SEQ ID NO: 8476778 - DNA, 22 bp, Homo sapiens
acactgaatgtttaagaacttg

SEQ ID NO: 8476779 - DNA, 22 bp, Homo sapiens
acactgaatgtttaagaacttg

SEQ ID NO: 8476780 - DNA, 22 bp, Homo sapiens
acactgaatgtttaagaacttg

SEQ ID NO: 8476781 - DNA, 22 bp, Homo sapiens
acactgaatgtttaagaacttg

SEQ ID NO: 8476782 - DNA, 22 bp, Homo sapiens
acactgaatgtttaagaacttg

SEQ ID NO: 8476783 - DNA, 19 bp, Homo sapiens
acactgaatgtagaattgg

SEQ ID NO: 8476784 - DNA, 19 bp, Homo sapiens
acactgaatgtagaattgg

SEQ ID NO: 8476785 - DNA, 22 bp, Homo sapiens
acactgaatcagaaattgttgg

SEQ ID NO: 8476786 - DNA, 22 bp, Homo sapiens
acactgagcatctctagaggca

SEQ ID NO: 8476787 - DNA, 22 bp, Homo sapiens
acactgcagatgaaagcataag

SEQ ID NO: 8476788 - DNA, 19 bp, Homo sapiens
acactgatcagatcagcag

SEQ ID NO: 8476789 - DNA, 22 bp, Homo sapiens
acacttcacccctgctcccagt

SEQ ID NO: 8476790 - DNA, 22 bp, Homo sapiens
acactgagttttaccaggcaca

SEQ ID NO: 8476791 - DNA, 21 bp, Homo sapiens
acactgagtgaattagcacat

SEQ ID NO: 8476792 - DNA, 22 bp, Homo sapiens
acactgagctgagcattcttgt

SEQ ID NO: 8476793 - DNA, 22 bp, Homo sapiens
acactttactcttacaccattg

SEQ ID NO: 8476794 - DNA, 22 bp, Homo sapiens
acactttacagcttcctttgca

SEQ ID NO: 8476795 - DNA, 22 bp, Homo sapiens
acacttcagcagtatgcttggg

SEQ ID NO: 8476796 - DNA, 22 bp, Homo sapiens
acacttcacccctgctcccagt

SEQ ID NO: 8476797 - DNA, 22 bp, Homo sapiens
acacttcagcagtatgcttggg

SEQ ID NO: 8476798 - DNA, 22 bp, Homo sapiens
acacttcagcagtatgcttggg

SEQ ID NO: 8476799 - DNA, 22 bp, Homo sapiens
acactttagaaaaaagaatggt

SEQ ID NO: 8476800 - DNA, 22 bp, Homo sapiens
acactttactcttacaccattg

SEQ ID NO: 8476801 - DNA, 22 bp, Homo sapiens
acactttagaaaaaagaatggt

SEQ ID NO: 8476802 - DNA, 22 bp, Homo sapiens
acactgaatatacaatgaatat

SEQ ID NO: 8476803 - DNA, 22 bp, Homo sapiens
acactgaatatacaatgaatat

SEQ ID NO: 8476804 - DNA, 22 bp, Homo sapiens
acactgaatatacaatgaatat

SEQ ID NO: 8476805 - DNA, 22 bp, Homo sapiens
acactgaatatacaatgaatat

SEQ ID NO: 8476806 - DNA, 22 bp, Homo sapiens
acactgaataattgagagttga

SEQ ID NO: 8476807 - DNA, 22 bp, Homo sapiens
acactcttgcattacctgaata

SEQ ID NO: 8476808 - DNA, 22 bp, Homo sapiens
acactgaagagcactttcaaag

SEQ ID NO: 8476809 - DNA, 22 bp, Homo sapiens
acactgaagagcactttcaaag

SEQ ID NO: 8476810 - DNA, 22 bp, Homo sapiens
acactgaaggctacaaggttga

SEQ ID NO: 8476811 - DNA, 22 bp, Homo sapiens
acactcaccctcccactgcctg

SEQ ID NO: 8476812 - DNA, 22 bp, Homo sapiens
acactccagggagggagggaat

SEQ ID NO: 8476813 - DNA, 22 bp, Homo sapiens
acactctacagagcaatctacc

SEQ ID NO: 8476814 - DNA, 22 bp, Homo sapiens
acactctgtaatgtcacactcc

SEQ ID NO: 8476815 - DNA, 22 bp, Homo sapiens
acactctgtaatgtcacactcc

SEQ ID NO: 8476816 - DNA, 22 bp, Homo sapiens
acacattatagagagtataata

SEQ ID NO: 8476817 - DNA, 22 bp, Homo sapiens
acacattaggcagtgcttaaat

SEQ ID NO: 8476818 - DNA, 22 bp, Homo sapiens
acacattagtgctctgtctcat

SEQ ID NO: 8476819 - DNA, 22 bp, Homo sapiens
acacattataggcaatcaaaag

SEQ ID NO: 8476820 - DNA, 22 bp, Homo sapiens
acacccaggaataaggactggg

SEQ ID NO: 8476821 - DNA, 22 bp, Homo sapiens
acacccaggaataaggactggg

SEQ ID NO: 8476822 - DNA, 22 bp, Homo sapiens
acactataagacagatacagca

SEQ ID NO: 8476823 - DNA, 22 bp, Homo sapiens
aagactgtgtctatggctactc

SEQ ID NO: 8476824 - DNA, 22 bp, Homo sapiens
aagactgtcttttctgagtgac

SEQ ID NO: 8476825 - DNA, 22 bp, Homo sapiens
aagactgtctgggacaagatga

SEQ ID NO: 8476826 - DNA, 22 bp, Homo sapiens
aagactgtgtctatggctactc

SEQ ID NO: 8476827 - DNA, 22 bp, Homo sapiens
aaagtttacagtgcacatgggt

SEQ ID NO: 8476828 - DNA, 22 bp, Homo sapiens
aagactgtacattttccagtct

SEQ ID NO: 8476829 - DNA, 22 bp, Homo sapiens
aagactgtacattttccagtct

SEQ ID NO: 8476830 - DNA, 22 bp, Homo sapiens
aagactgtatgagacaatataa

SEQ ID NO: 8476831 - DNA, 22 bp, Homo sapiens
aagactctatctttagagatca

SEQ ID NO: 8476832 - DNA, 22 bp, Homo sapiens
aagactgagttcaaatcacagc

SEQ ID NO: 8476833 - DNA, 22 bp, Homo sapiens
aagaccttgtctaaacatgtag

SEQ ID NO: 8476834 - DNA, 22 bp, Homo sapiens
aagacctgccagcctcatcctg

SEQ ID NO: 8476835 - DNA, 23 bp, Homo sapiens
aagactaattcttaattgcttag

SEQ ID NO: 8476836 - DNA, 22 bp, Homo sapiens
aagactaaatgtgttctaaagt

SEQ ID NO: 8476837 - DNA, 22 bp, Homo sapiens
aagactaaatgtgttctaaagt

SEQ ID NO: 8476838 - DNA, 22 bp, Homo sapiens
aagaccctacccctggagagga

SEQ ID NO: 8476839 - DNA, 22 bp, Homo sapiens
aagacctctgaagtacctggtg

SEQ ID NO: 8476840 - DNA, 22 bp, Homo sapiens
aaagtgacaaccagcaggactt

SEQ ID NO: 8476841 - DNA, 19 bp, Homo sapiens
aaagtgaatgctgttttct

SEQ ID NO: 8476842 - DNA, 23 bp, Homo sapiens
aaagtgacttttataccactaac

SEQ ID NO: 8476843 - DNA, 22 bp, Homo sapiens
aaagtgatgccaggagtctggt

SEQ ID NO: 8476844 - DNA, 22 bp, Homo sapiens
aagaacatggtaggataacaaa

SEQ ID NO: 8476845 - DNA, 22 bp, Homo sapiens
aagaacatggtaggataacaaa

SEQ ID NO: 8476846 - DNA, 22 bp, Homo sapiens
aagaacatgatggccatgtgca

SEQ ID NO: 8476847 - DNA, 22 bp, Homo sapiens
aagaacatggtaggataacaaa

SEQ ID NO: 8476848 - DNA, 22 bp, Homo sapiens
aagaacatgatggccatgtgca

SEQ ID NO: 8476849 - DNA, 22 bp, Homo sapiens
aagaacatgatggccatgtgca

SEQ ID NO: 8476850 - DNA, 22 bp, Homo sapiens
aaagtgcaaggattacaggcat

SEQ ID NO: 8476851 - DNA, 22 bp, Homo sapiens
aaagtgcaatcagttagaccat

SEQ ID NO: 8476852 - DNA, 22 bp, Homo sapiens
aaagtgcaatcagttagaccat

SEQ ID NO: 8476853 - DNA, 22 bp, Homo sapiens
aaagtgatttaagtacctcagg

SEQ ID NO: 8476854 - DNA, 22 bp, Homo sapiens
aaagtgatttaagtacctcagg

SEQ ID NO: 8476855 - DNA, 22 bp, Homo sapiens
aaagtgatttaagtacctcagg

SEQ ID NO: 8476856 - DNA, 22 bp, Homo sapiens
aaagtgcactagaatccagatt

SEQ ID NO: 8476857 - DNA, 22 bp, Homo sapiens
aaagtgcacctgcttcttcttg

SEQ ID NO: 8476858 - DNA, 20 bp, Homo sapiens
aaagtgcacagatacagctc

SEQ ID NO: 8476859 - DNA, 15 bp, Homo sapiens
aaagtgcacccaata

SEQ ID NO: 8476860 - DNA, 22 bp, Homo sapiens
aaagtgcagctgaaaacatcct

SEQ ID NO: 8476861 - DNA, 22 bp, Homo sapiens
aagacagagggaagcaatgatg

SEQ ID NO: 8476862 - DNA, 22 bp, Homo sapiens
aaagtgcagctgaaaacatcct

SEQ ID NO: 8476863 - DNA, 22 bp, Homo sapiens
aaagtgcactctcagtgctgct

SEQ ID NO: 8476864 - DNA, 22 bp, Homo sapiens
aaagtgcactagaatccagatt

SEQ ID NO: 8476865 - DNA, 22 bp, Homo sapiens
aaagtgcactctcagtgctgct

SEQ ID NO: 8476866 - DNA, 22 bp, Homo sapiens
aaagtgcagaactgttctcact

SEQ ID NO: 8476867 - DNA, 22 bp, Homo sapiens
aaagtgcagctgaaaacatcct

SEQ ID NO: 8476868 - DNA, 22 bp, Homo sapiens
aaagtttcaatagaggaagtgg

SEQ ID NO: 8476869 - DNA, 22 bp, Homo sapiens
aaagtttccaagttacaccatt

SEQ ID NO: 8476870 - DNA, 22 bp, Homo sapiens
aaagtttcaatagaggaagtgg

SEQ ID NO: 8476871 - DNA, 22 bp, Homo sapiens
aaagtttcctgctaagtgctat

SEQ ID NO: 8476872 - DNA, 23 bp, Homo sapiens
aaagtttgaagcaacagtagttg

SEQ ID NO: 8476873 - DNA, 22 bp, Homo sapiens
aaagtttgaatgatatattagt

SEQ ID NO: 8476874 - DNA, 22 bp, Homo sapiens
aaagtttgagtgatttgacaca

SEQ ID NO: 8476875 - DNA, 22 bp, Homo sapiens
aaagtttgcaatttatgttaat

SEQ ID NO: 8476876 - DNA, 22 bp, Homo sapiens
aaagttttagaactaggaagca

SEQ ID NO: 8476877 - DNA, 22 bp, Homo sapiens
aagagggaggtgcgggtgcaga

SEQ ID NO: 8476878 - DNA, 22 bp, Homo sapiens
aagagggaggtgcgggtgcaga

SEQ ID NO: 8476879 - DNA, 22 bp, Homo sapiens
aagagggaggtgcgggtgcaga

SEQ ID NO: 8476880 - DNA, 22 bp, Homo sapiens
aagagggaggtgcgggtgcaga

SEQ ID NO: 8476881 - DNA, 22 bp, Homo sapiens
aagagggaggtgcgggtgcaga

SEQ ID NO: 8476882 - DNA, 22 bp, Homo sapiens
aagagggctgcaatcttattgc

SEQ ID NO: 8476883 - DNA, 22 bp, Homo sapiens
aagagggctgcaatcttattgc

SEQ ID NO: 8476884 - DNA, 22 bp, Homo sapiens
aagagggaaattgttggctgct

SEQ ID NO: 8476885 - DNA, 22 bp, Homo sapiens
aagagggaagtcacctggaggt

SEQ ID NO: 8476886 - DNA, 19 bp, Homo sapiens
aagagggaaagtgctatgc

SEQ ID NO: 8476887 - DNA, 18 bp, Homo sapiens
aagaggaggagcaggttg

SEQ ID NO: 8476888 - DNA, 22 bp, Homo sapiens
aagaggaggatgctttacagct

SEQ ID NO: 8476889 - DNA, 22 bp, Homo sapiens
aagaggggtggtctgtgaggat

SEQ ID NO: 8476890 - DNA, 22 bp, Homo sapiens
aagaggggtggtctgtgaggat

SEQ ID NO: 8476891 - DNA, 22 bp, Homo sapiens
aagaggggtgtgtgtcaaccca

SEQ ID NO: 8476892 - DNA, 22 bp, Homo sapiens
aagaggggtggtctgtgaggat

SEQ ID NO: 8476893 - DNA, 22 bp, Homo sapiens
aagaggtaatgactgcttgagt

SEQ ID NO: 8476894 - DNA, 22 bp, Homo sapiens
aagaggtagcagtcacaaaaga

SEQ ID NO: 8476895 - DNA, 22 bp, Homo sapiens
aagaggtaaccatagcaaccac

SEQ ID NO: 8476896 - DNA, 22 bp, Homo sapiens
aagaggtaaccatagcaaccac

SEQ ID NO: 8476897 - DNA, 22 bp, Homo sapiens
aagaggggtgtgtgtcaaccca

SEQ ID NO: 8476898 - DNA, 22 bp, Homo sapiens
aaatacattagacggagagtta

SEQ ID NO: 8476899 - DNA, 22 bp, Homo sapiens
aaatacatttacagtcgtggct

SEQ ID NO: 8476900 - DNA, 23 bp, Homo sapiens
aaatacctgaattagatattatc

SEQ ID NO: 8476901 - DNA, 22 bp, Homo sapiens
aaatactagaattcagagttga

SEQ ID NO: 8476902 - DNA, 22 bp, Homo sapiens
aagatatagatggtggtataaa

SEQ ID NO: 8476903 - DNA, 22 bp, Homo sapiens
aagataaactcttgatttctga

SEQ ID NO: 8476904 - DNA, 22 bp, Homo sapiens
aagataaactcttgatttctga

SEQ ID NO: 8476905 - DNA, 22 bp, Homo sapiens
aaatactctcaataaagaaagt

SEQ ID NO: 8476906 - DNA, 22 bp, Homo sapiens
aaatactgctgctattcctttt

SEQ ID NO: 8476907 - DNA, 22 bp, Homo sapiens
aaatactggcaagtgctaattc

SEQ ID NO: 8476908 - DNA, 22 bp, Homo sapiens
aaatactgctgctattcctttt

SEQ ID NO: 8476909 - DNA, 22 bp, Homo sapiens
aagcaggcattccagagacaat

SEQ ID NO: 8476910 - DNA, 22 bp, Homo sapiens
aaatctcaatttgaattgtagc

SEQ ID NO: 8476911 - DNA, 22 bp, Homo sapiens
aaatctcaatttgaattgtagc

SEQ ID NO: 8476912 - DNA, 22 bp, Homo sapiens
aaatctctgaacttaataatgc

SEQ ID NO: 8476913 - DNA, 22 bp, Homo sapiens
aaatctcaggcctctatttact

SEQ ID NO: 8476914 - DNA, 22 bp, Homo sapiens
aaatctcagtgttctaagcatt

SEQ ID NO: 8476915 - DNA, 22 bp, Homo sapiens
aaatctcactgtagtcaaagtg

SEQ ID NO: 8476916 - DNA, 22 bp, Homo sapiens
aaatctcagcccttattttaga

SEQ ID NO: 8476917 - DNA, 22 bp, Homo sapiens
aaatctcagcccttattttaga

SEQ ID NO: 8476918 - DNA, 22 bp, Homo sapiens
aaatctgtaagcaattgctcag

SEQ ID NO: 8476919 - DNA, 22 bp, Homo sapiens
aaatctgtaagcaattgctcag

SEQ ID NO: 8476920 - DNA, 22 bp, Homo sapiens
aaatctggccccttgcctattt

SEQ ID NO: 8476921 - DNA, 22 bp, Homo sapiens
aaatctctggtcacagaactta

SEQ ID NO: 8476922 - DNA, 22 bp, Homo sapiens
aaatctgagaaatattgtccag

SEQ ID NO: 8476923 - DNA, 22 bp, Homo sapiens
aaatctctggcagaaataaact

SEQ ID NO: 8476924 - DNA, 22 bp, Homo sapiens
aagcccagatgggagcatttca

SEQ ID NO: 8476925 - DNA, 22 bp, Homo sapiens
aagcccagatgggagcatttca

SEQ ID NO: 8476926 - DNA, 22 bp, Homo sapiens
aagcccagatgggagcatttca

SEQ ID NO: 8476927 - DNA, 22 bp, Homo sapiens
aaatctttccctttactatcca

SEQ ID NO: 8476928 - DNA, 22 bp, Homo sapiens
aaatctggttcagtaagtcctc

SEQ ID NO: 8476929 - DNA, 22 bp, Homo sapiens
aaatctgtttcaggtatatttg

SEQ ID NO: 8476930 - DNA, 21 bp, Homo sapiens
aagcctcaagcagaagacaga

SEQ ID NO: 8476931 - DNA, 22 bp, Homo sapiens
aagcctaggcctactctggttt

SEQ ID NO: 8476932 - DNA, 22 bp, Homo sapiens
aagccgggcctgagaaatgaca

SEQ ID NO: 8476933 - DNA, 22 bp, Homo sapiens
aagcccttggcgcacaccgggc

SEQ ID NO: 8476934 - DNA, 22 bp, Homo sapiens
aagcccttggcgcacaccgggc

SEQ ID NO: 8476935 - DNA, 22 bp, Homo sapiens
aagccctgttaggcactgggga

SEQ ID NO: 8476936 - DNA, 22 bp, Homo sapiens
aagccctgttaggcactgggga

SEQ ID NO: 8476937 - DNA, 22 bp, Homo sapiens
aagccctgtccggggggaagaa

SEQ ID NO: 8476938 - DNA, 22 bp, Homo sapiens
aagccctgttctttctctcacc

SEQ ID NO: 8476939 - DNA, 22 bp, Homo sapiens
aagccctgtcaccctgacttca

SEQ ID NO: 8476940 - DNA, 22 bp, Homo sapiens
aagccctgtaaattgcccttaa

SEQ ID NO: 8476941 - DNA, 22 bp, Homo sapiens
aagccctggggttgcacaaggc

SEQ ID NO: 8476942 - DNA, 22 bp, Homo sapiens
aagccctggggttgcacaaggc

SEQ ID NO: 8476943 - DNA, 22 bp, Homo sapiens
aagcctcaccttttagaagcta

SEQ ID NO: 8476944 - DNA, 22 bp, Homo sapiens
aagcctggcacattggagtctg

SEQ ID NO: 8476945 - DNA, 22 bp, Homo sapiens
aaatgcatggctgttttaaagc

SEQ ID NO: 8476946 - DNA, 22 bp, Homo sapiens
aaatgcatggctgttttaaagc

SEQ ID NO: 8476947 - DNA, 22 bp, Homo sapiens
aaatgcatggctgttttaaagc

SEQ ID NO: 8476948 - DNA, 22 bp, Homo sapiens
aaatgcatggctgttttaaagc

SEQ ID NO: 8476949 - DNA, 22 bp, Homo sapiens
aaatgcatggtaaatgattgcc

SEQ ID NO: 8476950 - DNA, 22 bp, Homo sapiens
aaatgcatggtaaatgattgcc

SEQ ID NO: 8476951 - DNA, 22 bp, Homo sapiens
aaatgcatgtagaataatagag

SEQ ID NO: 8476952 - DNA, 22 bp, Homo sapiens
aaatgcatgtagaataatagag

SEQ ID NO: 8476953 - DNA, 22 bp, Homo sapiens
aaatgcatgtagaataatagag

SEQ ID NO: 8476954 - DNA, 22 bp, Homo sapiens
aaatgcatgtagaataatagag

SEQ ID NO: 8476955 - DNA, 22 bp, Homo sapiens
aaatgcatgtagaataatagag

SEQ ID NO: 8476956 - DNA, 23 bp, Homo sapiens
aagatccattcaaattatgtatc

SEQ ID NO: 8476957 - DNA, 22 bp, Homo sapiens
aagatccatgggaatgtttggc

SEQ ID NO: 8476958 - DNA, 22 bp, Homo sapiens
aagatcatggtttatctgggag

SEQ ID NO: 8476959 - DNA, 22 bp, Homo sapiens
aagatcataatatttatctcat

SEQ ID NO: 8476960 - DNA, 22 bp, Homo sapiens
aagatcataatatttatctcat

SEQ ID NO: 8476961 - DNA, 23 bp, Homo sapiens
aagatccattcaaattatgtatc

SEQ ID NO: 8476962 - DNA, 22 bp, Homo sapiens
aagatcctgcttttgcttctgt

SEQ ID NO: 8476963 - DNA, 22 bp, Homo sapiens
aagatgttgcattagaatacct

SEQ ID NO: 8476964 - DNA, 22 bp, Homo sapiens
aagatgtttagatttatacaat

SEQ ID NO: 8476965 - DNA, 22 bp, Homo sapiens
aagattactacggaacatgacc

SEQ ID NO: 8476966 - DNA, 22 bp, Homo sapiens
aagatcagaactttatacagga

SEQ ID NO: 8476967 - DNA, 22 bp, Homo sapiens
aagatcaccttgacatgaaaag

SEQ ID NO: 8476968 - DNA, 22 bp, Homo sapiens
aagatcagctcccgagtctgag

SEQ ID NO: 8476969 - DNA, 22 bp, Homo sapiens
aagatcagctcccgagtctgag

SEQ ID NO: 8476970 - DNA, 22 bp, Homo sapiens
aagatatattttggtgatttca

SEQ ID NO: 8476971 - DNA, 22 bp, Homo sapiens
aagatatgaggtcacctgctgg

SEQ ID NO: 8476972 - DNA, 22 bp, Homo sapiens
aagatattcaaagatttattag

SEQ ID NO: 8476973 - DNA, 22 bp, Homo sapiens
aagatattcaaagatttattag

SEQ ID NO: 8476974 - DNA, 22 bp, Homo sapiens
aagatattttagaacattcact

SEQ ID NO: 8476975 - DNA, 22 bp, Homo sapiens
aagatattcaaagatttattag

SEQ ID NO: 8476976 - DNA, 22 bp, Homo sapiens
aagatcaagatcagagaacagc

SEQ ID NO: 8476977 - DNA, 22 bp, Homo sapiens
aagcagcatatgacagcatcca

SEQ ID NO: 8476978 - DNA, 22 bp, Homo sapiens
aagattctacagtaggtacatt

SEQ ID NO: 8476979 - DNA, 22 bp, Homo sapiens
aagattctagaggaacttctta

SEQ ID NO: 8476980 - DNA, 22 bp, Homo sapiens
aagattcagccaaattgttcat

SEQ ID NO: 8476981 - DNA, 22 bp, Homo sapiens
aagattatggcagataacaatt

SEQ ID NO: 8476982 - DNA, 22 bp, Homo sapiens
aagattatggcagataacaatt

SEQ ID NO: 8476983 - DNA, 22 bp, Homo sapiens
aagcaggcatgggaggccatcc

SEQ ID NO: 8476984 - DNA, 22 bp, Homo sapiens
aactgtaagacaaatgacttct

SEQ ID NO: 8476985 - DNA, 22 bp, Homo sapiens
aactgtaaaggttgagtggtaa

SEQ ID NO: 8476986 - DNA, 22 bp, Homo sapiens
aactgtaaggcttagaacagca

SEQ ID NO: 8476987 - DNA, 22 bp, Homo sapiens
aactgtaatgaattgttcatga

SEQ ID NO: 8476988 - DNA, 22 bp, Homo sapiens
aactgtaatttttacatagtaa

SEQ ID NO: 8476989 - DNA, 22 bp, Homo sapiens
aactgtacgataataaatttgt

SEQ ID NO: 8476990 - DNA, 22 bp, Homo sapiens
aactgtacgataataaatttgt

SEQ ID NO: 8476991 - DNA, 22 bp, Homo sapiens
aactgtatacaattgtcagaca

SEQ ID NO: 8476992 - DNA, 22 bp, Homo sapiens
aactgtagcaaagaacagctct

SEQ ID NO: 8476993 - DNA, 22 bp, Homo sapiens
aactgtctaaggagaatatgaa

SEQ ID NO: 8476994 - DNA, 23 bp, Homo sapiens
aactgtcttgcaagtgtgatacc

SEQ ID NO: 8476995 - DNA, 22 bp, Homo sapiens
aactgtggacttgagactgatg

SEQ ID NO: 8476996 - DNA, 23 bp, Homo sapiens
aactgtcttgcaagtgtgatacc

SEQ ID NO: 8476997 - DNA, 22 bp, Homo sapiens
aaaggttttggtaaggctttaa

SEQ ID NO: 8476998 - DNA, 22 bp, Homo sapiens
aaaggttttctgacccttagta

SEQ ID NO: 8476999 - DNA, 22 bp, Homo sapiens
aaaggttttgccctgggtattc

SEQ ID NO: 8477000 - DNA, 22 bp, Homo sapiens
aactgtgggatgcattaattca

SEQ ID NO: 8477001 - DNA, 22 bp, Homo sapiens
aagaacagttgggaggtgagcc

SEQ ID NO: 8477002 - DNA, 22 bp, Homo sapiens
aagaacataaacagaaggacag

SEQ ID NO: 8477003 - DNA, 22 bp, Homo sapiens
aagaacagtgtcctgggactcg

SEQ ID NO: 8477004 - DNA, 22 bp, Homo sapiens
aagaacagttgggaggtgagcc

SEQ ID NO: 8477005 - DNA, 22 bp, Homo sapiens
aagaacagttgggaggtgagcc

SEQ ID NO: 8477006 - DNA, 22 bp, Homo sapiens
aagaacataacagaagctgtgt

SEQ ID NO: 8477007 - DNA, 22 bp, Homo sapiens
aagaacataacagaagctgtgt

SEQ ID NO: 8477008 - DNA, 22 bp, Homo sapiens
aagaacatgaacctcttctaac

SEQ ID NO: 8477009 - DNA, 22 bp, Homo sapiens
aagaacatgaacctcttctaac

SEQ ID NO: 8477010 - DNA, 22 bp, Homo sapiens
aagaacatgaacctcttctaac

SEQ ID NO: 8477011 - DNA, 22 bp, Homo sapiens
aagaacatgaacacaatgttta

SEQ ID NO: 8477012 - DNA, 22 bp, Homo sapiens
aagaacatgagttatgatgatt

SEQ ID NO: 8477013 - DNA, 22 bp, Homo sapiens
aagaacatgagttatgatgatt

SEQ ID NO: 8477014 - DNA, 22 bp, Homo sapiens
aagaacatgaagtcacaaatgc

SEQ ID NO: 8477015 - DNA, 22 bp, Homo sapiens
aagaacatgagttatgatgatt

SEQ ID NO: 8477016 - DNA, 22 bp, Homo sapiens
aagaacatgagttatgatgatt

SEQ ID NO: 8477017 - DNA, 22 bp, Homo sapiens
aaagtaacctagtaatagtgtc

SEQ ID NO: 8477018 - DNA, 22 bp, Homo sapiens
aaagtaacaataaggttctatt

SEQ ID NO: 8477019 - DNA, 22 bp, Homo sapiens
aaaggtttttcagcagggagat

SEQ ID NO: 8477020 - DNA, 22 bp, Homo sapiens
aaaggttttgttcatcgatttt

SEQ ID NO: 8477021 - DNA, 22 bp, Homo sapiens
aaaggtttttatttatcctgga

SEQ ID NO: 8477022 - DNA, 22 bp, Homo sapiens
aaagtaagaccaagtgatcatt

SEQ ID NO: 8477023 - DNA, 22 bp, Homo sapiens
aagaaataagacttctctgtcc

SEQ ID NO: 8477024 - DNA, 22 bp, Homo sapiens
aagaaataagacttctctgtcc

SEQ ID NO: 8477025 - DNA, 22 bp, Homo sapiens
aagaaataagacttctctgtcc

SEQ ID NO: 8477026 - DNA, 22 bp, Homo sapiens
aagaaataagacttctctgtcc

SEQ ID NO: 8477027 - DNA, 22 bp, Homo sapiens
aaaggcagtgggtatgtggatc

SEQ ID NO: 8477028 - DNA, 22 bp, Homo sapiens
aaaggcagtgggtatgtggatc

SEQ ID NO: 8477029 - DNA, 22 bp, Homo sapiens
aaaggcaggctttcacatctca

SEQ ID NO: 8477030 - DNA, 22 bp, Homo sapiens
aactgcaaagccaatctcagga

SEQ ID NO: 8477031 - DNA, 21 bp, Homo sapiens
aactgcaaatcttagactgca

SEQ ID NO: 8477032 - DNA, 21 bp, Homo sapiens
aactgcaaatgatgctggaga

SEQ ID NO: 8477033 - DNA, 22 bp, Homo sapiens
aactgcaaaataatcaagttgt

SEQ ID NO: 8477034 - DNA, 18 bp, Homo sapiens
aaaggcatatatagaagt

SEQ ID NO: 8477035 - DNA, 22 bp, Homo sapiens
aaaggcagagttgttggaggca

SEQ ID NO: 8477036 - DNA, 22 bp, Homo sapiens
aacccgggaggcagaggttgtg

SEQ ID NO: 8477037 - DNA, 22 bp, Homo sapiens
aaccccaggctggaggagtctc

SEQ ID NO: 8477038 - DNA, 22 bp, Homo sapiens
aacccattaatccttgcaagca

SEQ ID NO: 8477039 - DNA, 22 bp, Homo sapiens
aaccccagtaccccaggatatg

SEQ ID NO: 8477040 - DNA, 22 bp, Homo sapiens
aaccccagtaccccaggatatg

SEQ ID NO: 8477041 - DNA, 22 bp, Homo sapiens
aacccgggaggcagaggttgtg

SEQ ID NO: 8477042 - DNA, 22 bp, Homo sapiens
aacatttgtttggcttcaatta

SEQ ID NO: 8477043 - DNA, 22 bp, Homo sapiens
aacatttgtttcgttatgtgaa

SEQ ID NO: 8477044 - DNA, 22 bp, Homo sapiens
aacatttgtttcgttatgtgaa

SEQ ID NO: 8477045 - DNA, 22 bp, Homo sapiens
aaagcctcccaggttatgagta

SEQ ID NO: 8477046 - DNA, 22 bp, Homo sapiens
aaagcctgggttcctcactatc

SEQ ID NO: 8477047 - DNA, 22 bp, Homo sapiens
aaagcctgggttcctcactatc

SEQ ID NO: 8477048 - DNA, 22 bp, Homo sapiens
aacccatgttggaagcttatca

SEQ ID NO: 8477049 - DNA, 22 bp, Homo sapiens
aacccagggtggaggttgcagt

SEQ ID NO: 8477050 - DNA, 22 bp, Homo sapiens
aacccaggtctttggcttccag

SEQ ID NO: 8477051 - DNA, 22 bp, Homo sapiens
aacccagggtggaggttgcagt

SEQ ID NO: 8477052 - DNA, 22 bp, Homo sapiens
aacccagggtgaggggagtcta

SEQ ID NO: 8477053 - DNA, 22 bp, Homo sapiens
aacccaggagttggaggctgtg

SEQ ID NO: 8477054 - DNA, 22 bp, Homo sapiens
aacccagagctggaggagagta

SEQ ID NO: 8477055 - DNA, 22 bp, Homo sapiens
aacccaggagacaggttgcagt

SEQ ID NO: 8477056 - DNA, 22 bp, Homo sapiens
aacccagccgtgtagctgccgc

SEQ ID NO: 8477057 - DNA, 22 bp, Homo sapiens
aacccaggagacaggttgcagt

SEQ ID NO: 8477058 - DNA, 22 bp, Homo sapiens
aacccaggagacggagtttgtg

SEQ ID NO: 8477059 - DNA, 22 bp, Homo sapiens
aacccaggaggcagaggctgca

SEQ ID NO: 8477060 - DNA, 20 bp, Homo sapiens
aacactgtgcgtggtaggtg

SEQ ID NO: 8477061 - DNA, 20 bp, Homo sapiens
aacactgtgcgtggtaggtg

SEQ ID NO: 8477062 - DNA, 20 bp, Homo sapiens
aacactgtgcgtggtaggtg

SEQ ID NO: 8477063 - DNA, 22 bp, Homo sapiens
aacactgtgctccccaggctgt

SEQ ID NO: 8477064 - DNA, 22 bp, Homo sapiens
aacactgtggtcttttcagtaa

SEQ ID NO: 8477065 - DNA, 22 bp, Homo sapiens
aacactgtggtcttttcagtaa

SEQ ID NO: 8477066 - DNA, 22 bp, Homo sapiens
aacactgtggtcttttcagtaa

SEQ ID NO: 8477067 - DNA, 22 bp, Homo sapiens
aacactgtgctccccaggctgt

SEQ ID NO: 8477068 - DNA, 22 bp, Homo sapiens
aacactgtgcccaccctagtcc

SEQ ID NO: 8477069 - DNA, 22 bp, Homo sapiens
aacactgtgcagtgtaatgctg

SEQ ID NO: 8477070 - DNA, 22 bp, Homo sapiens
aacactgtgcccaccctagtcc

SEQ ID NO: 8477071 - DNA, 22 bp, Homo sapiens
aacactgtgcccaccctagtcc

SEQ ID NO: 8477072 - DNA, 22 bp, Homo sapiens
aacactgtcttatacttcaatg

SEQ ID NO: 8477073 - DNA, 22 bp, Homo sapiens
aacactgtgaggtaatgaccta

SEQ ID NO: 8477074 - DNA, 22 bp, Homo sapiens
aacactgtgcagtgtaatgctg

SEQ ID NO: 8477075 - DNA, 22 bp, Homo sapiens
aacacttctcatcactgcaagc

SEQ ID NO: 8477076 - DNA, 22 bp, Homo sapiens
aacacttcccgaccatatggct

SEQ ID NO: 8477077 - DNA, 22 bp, Homo sapiens
aacacttcccatcagagggaca

SEQ ID NO: 8477078 - DNA, 22 bp, Homo sapiens
aacacttcaagcagaaggttgg

SEQ ID NO: 8477079 - DNA, 22 bp, Homo sapiens
aacacttcccatcagagggaca

SEQ ID NO: 8477080 - DNA, 22 bp, Homo sapiens
aacactgtggtcttttcagtaa

SEQ ID NO: 8477081 - DNA, 22 bp, Homo sapiens
aacactgtggtcttttcagtaa

SEQ ID NO: 8477082 - DNA, 22 bp, Homo sapiens
aaagcaaacagaaccccaagct

SEQ ID NO: 8477083 - DNA, 23 bp, Homo sapiens
aaagcaaggaattggcaacagag

SEQ ID NO: 8477084 - DNA, 22 bp, Homo sapiens
aaagcaagtctctacaaagtac

SEQ ID NO: 8477085 - DNA, 22 bp, Homo sapiens
aacactgtatcagtcttcaata

SEQ ID NO: 8477086 - DNA, 22 bp, Homo sapiens
aacacattttgcctaggcaata

SEQ ID NO: 8477087 - DNA, 22 bp, Homo sapiens
aacacattttgcctaggcaata

SEQ ID NO: 8477088 - DNA, 22 bp, Homo sapiens
aacactgtcttatacttcaatg

SEQ ID NO: 8477089 - DNA, 22 bp, Homo sapiens
aacactgtcttatacttcaatg

SEQ ID NO: 8477090 - DNA, 22 bp, Homo sapiens
aacactgtcttatacttcaatg

SEQ ID NO: 8477091 - DNA, 22 bp, Homo sapiens
aacactgtatcagtcttcaata

SEQ ID NO: 8477092 - DNA, 22 bp, Homo sapiens
aacactgtcagcctttgatgga

SEQ ID NO: 8477093 - DNA, 22 bp, Homo sapiens
aacactgtcagcctttgatgga

SEQ ID NO: 8477094 - DNA, 22 bp, Homo sapiens
aacactgtcagcctttgatgga

SEQ ID NO: 8477095 - DNA, 22 bp, Homo sapiens
aaagatttcagaagcctgtgcc

SEQ ID NO: 8477096 - DNA, 22 bp, Homo sapiens
aaagatttgagttctgcttata

SEQ ID NO: 8477097 - DNA, 22 bp, Homo sapiens
aaagatttaagaataatttgtg

SEQ ID NO: 8477098 - DNA, 22 bp, Homo sapiens
aaagatttaagaataatttgtg

SEQ ID NO: 8477099 - DNA, 22 bp, Homo sapiens
aaagattgatcatgaattgaca

SEQ ID NO: 8477100 - DNA, 22 bp, Homo sapiens
aaagattatggcattgaaatac

SEQ ID NO: 8477101 - DNA, 21 bp, Homo sapiens
aaagatgtttcttttcctcac

SEQ ID NO: 8477102 - DNA, 22 bp, Homo sapiens
aaagatgttttacatagcacct

SEQ ID NO: 8477103 - DNA, 22 bp, Homo sapiens
aaagattaaatcaaattggtca

SEQ ID NO: 8477104 - DNA, 22 bp, Homo sapiens
aacatacttatactaaataatg

SEQ ID NO: 8477105 - DNA, 22 bp, Homo sapiens
aacatacttatactaaataatg

SEQ ID NO: 8477106 - DNA, 23 bp, Homo sapiens
aacatactgtttaatattcacag

SEQ ID NO: 8477107 - DNA, 22 bp, Homo sapiens
aacatacttatactaaataatg

SEQ ID NO: 8477108 - DNA, 22 bp, Homo sapiens
aacatacatatttcagtgtcca

SEQ ID NO: 8477109 - DNA, 22 bp, Homo sapiens
aacatacttgtactatgcatat

SEQ ID NO: 8477110 - DNA, 22 bp, Homo sapiens
aacatacttgtactatgcatat

SEQ ID NO: 8477111 - DNA, 22 bp, Homo sapiens
aacataatgtggccaaagtcac

SEQ ID NO: 8477112 - DNA, 22 bp, Homo sapiens
aacataatgtggccaaagtcac

SEQ ID NO: 8477113 - DNA, 22 bp, Homo sapiens
aacataatgtggccaaagtcac

SEQ ID NO: 8477114 - DNA, 22 bp, Homo sapiens
aacatacatatttcagtgtcca

SEQ ID NO: 8477115 - DNA, 22 bp, Homo sapiens
aacatacatatttcagtgtcca

SEQ ID NO: 8477116 - DNA, 22 bp, Homo sapiens
aacatacagtgagcagtggact

SEQ ID NO: 8477117 - DNA, 22 bp, Homo sapiens
aacatacagtgagcagtggact

SEQ ID NO: 8477118 - DNA, 22 bp, Homo sapiens
aacatacagtgagcagtggact

SEQ ID NO: 8477119 - DNA, 22 bp, Homo sapiens
aacatacagtgagcagtggact

SEQ ID NO: 8477120 - DNA, 22 bp, Homo sapiens
aaagccattacaaaatttcata

SEQ ID NO: 8477121 - DNA, 22 bp, Homo sapiens
aaagccattacaaaatttcata

SEQ ID NO: 8477122 - DNA, 22 bp, Homo sapiens
aaagccattgaactgtacttta

SEQ ID NO: 8477123 - DNA, 22 bp, Homo sapiens
aaagcccatgtggaagtacagg

SEQ ID NO: 8477124 - DNA, 22 bp, Homo sapiens
aaagcccatgtggaagtacagg

SEQ ID NO: 8477125 - DNA, 22 bp, Homo sapiens
aaagcctcccaggttatgagta

SEQ ID NO: 8477126 - DNA, 22 bp, Homo sapiens
aacatagaattgttatattttc

SEQ ID NO: 8477127 - DNA, 22 bp, Homo sapiens
aacatagaattgttatattttc

SEQ ID NO: 8477128 - DNA, 22 bp, Homo sapiens
aacatataaactcttaagttca

SEQ ID NO: 8477129 - DNA, 22 bp, Homo sapiens
aacagtgagttgatgactgaat

SEQ ID NO: 8477130 - DNA, 22 bp, Homo sapiens
aaagcagaggtgatatgactta

SEQ ID NO: 8477131 - DNA, 22 bp, Homo sapiens
aaagcagaggttgcagtgagct

SEQ ID NO: 8477132 - DNA, 22 bp, Homo sapiens
aaagcacttgaaatctggcagt

SEQ ID NO: 8477133 - DNA, 19 bp, Homo sapiens
aaagcagaggagcatctga

SEQ ID NO: 8477134 - DNA, 22 bp, Homo sapiens
aaagcagagatcatggcttgta

SEQ ID NO: 8477135 - DNA, 22 bp, Homo sapiens
aaagcacttcaggagcagtttg

SEQ ID NO: 8477136 - DNA, 22 bp, Homo sapiens
aacactttcctgcctttctgat

SEQ ID NO: 8477137 - DNA, 23 bp, Homo sapiens
aacacttgcatgaacagctacac

SEQ ID NO: 8477138 - DNA, 22 bp, Homo sapiens
aacacttctgttgataataagc

SEQ ID NO: 8477139 - DNA, 22 bp, Homo sapiens
aacactttccgtaggtttagta

SEQ ID NO: 8477140 - DNA, 22 bp, Homo sapiens
aaagactggtgtgttacatata

SEQ ID NO: 8477141 - DNA, 22 bp, Homo sapiens
aaagactgggactgcagcaggc

SEQ ID NO: 8477142 - DNA, 22 bp, Homo sapiens
aaagactggaaggtgaggctgt

SEQ ID NO: 8477143 - DNA, 22 bp, Homo sapiens
aaagactgcaaaaacgcacaga

SEQ ID NO: 8477144 - DNA, 23 bp, Homo sapiens
aaagactgctgagaattttagga

SEQ ID NO: 8477145 - DNA, 22 bp, Homo sapiens
aaagactttcacctagcaaaga

SEQ ID NO: 8477146 - DNA, 22 bp, Homo sapiens
aaagactttcacctagcaaaga

SEQ ID NO: 8477147 - DNA, 22 bp, Homo sapiens
aaagacttgggagcagtatgct

SEQ ID NO: 8477148 - DNA, 22 bp, Homo sapiens
aaagacttgggagcagtatgct

SEQ ID NO: 8477149 - DNA, 22 bp, Homo sapiens
aaagaacagatgtgtggtgcat

SEQ ID NO: 8477150 - DNA, 22 bp, Homo sapiens
aaagacatgacacattggagag

SEQ ID NO: 8477151 - DNA, 22 bp, Homo sapiens
aaagacatgacacattggagag

SEQ ID NO: 8477152 - DNA, 21 bp, Homo sapiens
aaagaacaggcagatgttctt

SEQ ID NO: 8477153 - DNA, 22 bp, Homo sapiens
aaagaacaaattagctgtttta

SEQ ID NO: 8477154 - DNA, 22 bp, Homo sapiens
aaagaacaatgtggaatctcct

SEQ ID NO: 8477155 - DNA, 22 bp, Homo sapiens
aaagaacaatgtggaatctcct

SEQ ID NO: 8477156 - DNA, 22 bp, Homo sapiens
aaagacatgacacattggagag

SEQ ID NO: 8477157 - DNA, 22 bp, Homo sapiens
aaagacatgacacattggagag

SEQ ID NO: 8477158 - DNA, 22 bp, Homo sapiens
aaagactaagaagagtattatt

SEQ ID NO: 8477159 - DNA, 22 bp, Homo sapiens
aaagactacacgggaaagagct

SEQ ID NO: 8477160 - DNA, 22 bp, Homo sapiens
aaagactacacgggaaagagct

SEQ ID NO: 8477161 - DNA, 22 bp, Homo sapiens
aaagactcttaactccctagcg

SEQ ID NO: 8477162 - DNA, 23 bp, Homo sapiens
aaagactgaggaaagtctctgtc

SEQ ID NO: 8477163 - DNA, 22 bp, Homo sapiens
aaagatcagtctgaagcaacat

SEQ ID NO: 8477164 - DNA, 22 bp, Homo sapiens
aaagatcagtctgaagcaacat

SEQ ID NO: 8477165 - DNA, 22 bp, Homo sapiens
aaagatcatgctgttttgtgat

SEQ ID NO: 8477166 - DNA, 22 bp, Homo sapiens
aaagatgttaatagcaccattt

SEQ ID NO: 8477167 - DNA, 22 bp, Homo sapiens
aaagatgttatgaaataactat

SEQ ID NO: 8477168 - DNA, 23 bp, Homo sapiens
aaagatgttcccaaagttcacgt

SEQ ID NO: 8477169 - DNA, 22 bp, Homo sapiens
aaagatcagaggatagctgagt

SEQ ID NO: 8477170 - DNA, 22 bp, Homo sapiens
aaagagatgtgccaaatagcct

SEQ ID NO: 8477171 - DNA, 20 bp, Homo sapiens
aaagagaagcctcaccttgt

SEQ ID NO: 8477172 - DNA, 20 bp, Homo sapiens
aaagagaagcctcaccttgt

SEQ ID NO: 8477173 - DNA, 20 bp, Homo sapiens
aaagagaagcctcaccttgt

SEQ ID NO: 8477174 - DNA, 22 bp, Homo sapiens
aaagagaacttttacccaagaa

SEQ ID NO: 8477175 - DNA, 22 bp, Homo sapiens
aaagagaacttttacccaagaa

SEQ ID NO: 8477176 - DNA, 22 bp, Homo sapiens
aaagagaaaaagatcccggctc

SEQ ID NO: 8477177 - DNA, 22 bp, Homo sapiens
aaagagaaaaagatcccggctc

SEQ ID NO: 8477178 - DNA, 22 bp, Homo sapiens
aaagagaaacttagaagcctga

SEQ ID NO: 8477179 - DNA, 22 bp, Homo sapiens
aaagagaaacttagaagcctga

SEQ ID NO: 8477180 - DNA, 22 bp, Homo sapiens
aaagagaaaatgatctgtacat

SEQ ID NO: 8477181 - DNA, 22 bp, Homo sapiens
aaatagttcagcttgtaaaccc

SEQ ID NO: 8477182 - DNA, 22 bp, Homo sapiens
aaatagttcagcttgtaaaccc

SEQ ID NO: 8477183 - DNA, 22 bp, Homo sapiens
aaatagttcagccacggtgact

SEQ ID NO: 8477184 - DNA, 22 bp, Homo sapiens
aaatagttcagccacggtgact

SEQ ID NO: 8477185 - DNA, 22 bp, Homo sapiens
aaatagttagccctgcatatat

SEQ ID NO: 8477186 - DNA, 22 bp, Homo sapiens
aaactgtgaagcaagtacaagg

SEQ ID NO: 8477187 - DNA, 20 bp, Homo sapiens
aaactgtctgtcagtatcta

SEQ ID NO: 8477188 - DNA, 22 bp, Homo sapiens
aaactgtgaagcaagtacaagg

SEQ ID NO: 8477189 - DNA, 22 bp, Homo sapiens
aaactgtgaagcaagtacaagg

SEQ ID NO: 8477190 - DNA, 22 bp, Homo sapiens
aaatagtcctgggaatagtact

SEQ ID NO: 8477191 - DNA, 22 bp, Homo sapiens
aaatagtcctgggaatagtact

SEQ ID NO: 8477192 - DNA, 22 bp, Homo sapiens
aaactgtgaagcaagtacaagg

SEQ ID NO: 8477193 - DNA, 22 bp, Homo sapiens
aaacttttataaagctgcagat

SEQ ID NO: 8477194 - DNA, 22 bp, Homo sapiens
aaacttttcctgctcttgtcct

SEQ ID NO: 8477195 - DNA, 22 bp, Homo sapiens
aaactttaggaaggaatttaca

SEQ ID NO: 8477196 - DNA, 22 bp, Homo sapiens
aaacttctggctacaagcaata

SEQ ID NO: 8477197 - DNA, 22 bp, Homo sapiens
aaacttcattttcaactgcaaa

SEQ ID NO: 8477198 - DNA, 22 bp, Homo sapiens
aaacttttttaggttcataggc

SEQ ID NO: 8477199 - DNA, 22 bp, Homo sapiens
aaacttttttaggttcataggc

SEQ ID NO: 8477200 - DNA, 22 bp, Homo sapiens
aaacttttttaggttcataggc

SEQ ID NO: 8477201 - DNA, 22 bp, Homo sapiens
aaacttttttaggttcataggc

SEQ ID NO: 8477202 - DNA, 22 bp, Homo sapiens
aaactttttattctaatgtcta

SEQ ID NO: 8477203 - DNA, 22 bp, Homo sapiens
aaacttttggtcctcatgggtt

SEQ ID NO: 8477204 - DNA, 22 bp, Homo sapiens
aaactttttattctaatgtcta

SEQ ID NO: 8477205 - DNA, 22 bp, Homo sapiens
aaactttttcttaggtatgtct

SEQ ID NO: 8477206 - DNA, 22 bp, Homo sapiens
aaactttttattctaatgtcta

SEQ ID NO: 8477207 - DNA, 22 bp, Homo sapiens
aaacttttcttggggacctgcc

SEQ ID NO: 8477208 - DNA, 22 bp, Homo sapiens
aaacttttcctgctcttgtcct

SEQ ID NO: 8477209 - DNA, 16 bp, Homo sapiens
aaagaaacaggtgtcc

SEQ ID NO: 8477210 - DNA, 22 bp, Homo sapiens
aaagaaacctatcagccacatg

SEQ ID NO: 8477211 - DNA, 22 bp, Homo sapiens
aaagaaacctatcagccacatg

SEQ ID NO: 8477212 - DNA, 22 bp, Homo sapiens
aaagaaacctatcagccacatg

SEQ ID NO: 8477213 - DNA, 22 bp, Homo sapiens
aaagaaacctatcagccacatg

SEQ ID NO: 8477214 - DNA, 22 bp, Homo sapiens
aaagaacaaattagctgtttta

SEQ ID NO: 8477215 - DNA, 22 bp, Homo sapiens
aaagaacaaatgatatatggtt

SEQ ID NO: 8477216 - DNA, 21 bp, Homo sapiens
aaagaaatctcccattggtag

SEQ ID NO: 8477217 - DNA, 21 bp, Homo sapiens
aaagaaatctcccattggtag

SEQ ID NO: 8477218 - DNA, 22 bp, Homo sapiens
aaagaaatagatggcatttaaa

SEQ ID NO: 8477219 - DNA, 22 bp, Homo sapiens
aaagaaatagatggcatttaaa

SEQ ID NO: 8477220 - DNA, 22 bp, Homo sapiens
aaagaaatacctttctcagctt

SEQ ID NO: 8477221 - DNA, 22 bp, Homo sapiens
aaagaaatacctttctcagctt

SEQ ID NO: 8477222 - DNA, 22 bp, Homo sapiens
aaagaaatagatggcatttaaa

SEQ ID NO: 8477223 - DNA, 22 bp, Homo sapiens
aaagaaatagatggcatttaaa

SEQ ID NO: 8477224 - DNA, 22 bp, Homo sapiens
aaactgtaaatactagtaagtg

SEQ ID NO: 8477225 - DNA, 22 bp, Homo sapiens
aaactgtaaagcaggtgagtag

SEQ ID NO: 8477226 - DNA, 22 bp, Homo sapiens
aaactgtaaacacagcagtaca

SEQ ID NO: 8477227 - DNA, 22 bp, Homo sapiens
aaactgcaattacttttgcacc

SEQ ID NO: 8477228 - DNA, 22 bp, Homo sapiens
aaactgcaattacttttgcagc

SEQ ID NO: 8477229 - DNA, 22 bp, Homo sapiens
aaactgcaattatgtttgcaga

SEQ ID NO: 8477230 - DNA, 22 bp, Homo sapiens
aaacattgagcacttgctattt

SEQ ID NO: 8477231 - DNA, 22 bp, Homo sapiens
aaacattgacctcatcctggca

SEQ ID NO: 8477232 - DNA, 22 bp, Homo sapiens
aaacattgagcacttgctattt

SEQ ID NO: 8477233 - DNA, 22 bp, Homo sapiens
aaacattccctaatgtgtccgt

SEQ ID NO: 8477234 - DNA, 22 bp, Homo sapiens
aaacattgtaattttagcatgg

SEQ ID NO: 8477235 - DNA, 22 bp, Homo sapiens
aaacattgctaaataatgctgc

SEQ ID NO: 8477236 - DNA, 22 bp, Homo sapiens
aaacattgtaattttagcatgg

SEQ ID NO: 8477237 - DNA, 22 bp, Homo sapiens
aaacattgatgggaagtttaat

SEQ ID NO: 8477238 - DNA, 22 bp, Homo sapiens
aaactgtaagagaataaactac

SEQ ID NO: 8477239 - DNA, 22 bp, Homo sapiens
aaactgtaagagaataaactac

SEQ ID NO: 8477240 - DNA, 22 bp, Homo sapiens
aaactgtaagagaataaactac

SEQ ID NO: 8477241 - DNA, 22 bp, Homo sapiens
aaactgtaggagggaaaggaag

SEQ ID NO: 8477242 - DNA, 22 bp, Homo sapiens
aaactgtagtgcttcgatctga

SEQ ID NO: 8477243 - DNA, 22 bp, Homo sapiens
aaactgtatatttatggcatgt

SEQ ID NO: 8477244 - DNA, 22 bp, Homo sapiens
aaactgtatgttgagatgacag

SEQ ID NO: 8477245 - DNA, 22 bp, Homo sapiens
aaactgtatatttatggcatgt

SEQ ID NO: 8477246 - DNA, 22 bp, Homo sapiens
aaactgtatagggaaaagtaga

SEQ ID NO: 8477247 - DNA, 22 bp, Homo sapiens
aaactgtatagggaaaagtaga

SEQ ID NO: 8477248 - DNA, 22 bp, Homo sapiens
aaactgtcattggatgcatttg

SEQ ID NO: 8477249 - DNA, 22 bp, Homo sapiens
aaactgtcacctaatgtatttt

SEQ ID NO: 8477250 - DNA, 18 bp, Homo sapiens
aaactgtatttctttcta

SEQ ID NO: 8477251 - DNA, 22 bp, Homo sapiens
aaacatgtaattctgcttaaga

SEQ ID NO: 8477252 - DNA, 22 bp, Homo sapiens
aaacatgtagtgcatgaggatc

SEQ ID NO: 8477253 - DNA, 22 bp, Homo sapiens
aaacatgtttagaaagcagctg

SEQ ID NO: 8477254 - DNA, 22 bp, Homo sapiens
aaacatgtaagttcagatcacc

SEQ ID NO: 8477255 - DNA, 22 bp, Homo sapiens
aaacatgtaagttcagatcacc

SEQ ID NO: 8477256 - DNA, 22 bp, Homo sapiens
aaacatgtaagttcagatcacc

SEQ ID NO: 8477257 - DNA, 22 bp, Homo sapiens
aaacatgtaagttcagatcacc

SEQ ID NO: 8477258 - DNA, 22 bp, Homo sapiens
aaacatgtaattctgcttaaga

SEQ ID NO: 8477259 - DNA, 22 bp, Homo sapiens
aaacatgtaagttcagatcacc

SEQ ID NO: 8477260 - DNA, 22 bp, Homo sapiens
aaacatgctggatttagaatat

SEQ ID NO: 8477261 - DNA, 22 bp, Homo sapiens
aaacatgctggatttagaatat

SEQ ID NO: 8477262 - DNA, 22 bp, Homo sapiens
aaacatgcattcaagaaaatct

SEQ ID NO: 8477263 - DNA, 22 bp, Homo sapiens
aaacatgatgtcatatatgcca

SEQ ID NO: 8477264 - DNA, 22 bp, Homo sapiens
aaacatgatgtcatatatgcca

SEQ ID NO: 8477265 - DNA, 20 bp, Homo sapiens
aaacattcatgtacaagtga

SEQ ID NO: 8477266 - DNA, 22 bp, Homo sapiens
aaacattcactctcaattttag

SEQ ID NO: 8477267 - DNA, 22 bp, Homo sapiens
aaacattcacatttgctagtaa

SEQ ID NO: 8477268 - DNA, 20 bp, Homo sapiens
aaacattcatgtacaagtga

SEQ ID NO: 8477269 - DNA, 22 bp, Homo sapiens
aaacattccatttctatgtaag

SEQ ID NO: 8477270 - DNA, 22 bp, Homo sapiens
aaacattccatttctatgtaag

SEQ ID NO: 8477271 - DNA, 22 bp, Homo sapiens
aaacattccatttctatgtaag

SEQ ID NO: 8477272 - DNA, 22 bp, Homo sapiens
aaacattagacaccatatgctc

SEQ ID NO: 8477273 - DNA, 22 bp, Homo sapiens
aaacatgtttagaaagcagctg

SEQ ID NO: 8477274 - DNA, 22 bp, Homo sapiens
aaacagctgggaggtagaggcg

SEQ ID NO: 8477275 - DNA, 22 bp, Homo sapiens
aaacagctgggaggtagaggcg

SEQ ID NO: 8477276 - DNA, 22 bp, Homo sapiens
aaacagctgcactgctgatgtc

SEQ ID NO: 8477277 - DNA, 22 bp, Homo sapiens
aaacagctgcagtacacggcct

SEQ ID NO: 8477278 - DNA, 22 bp, Homo sapiens
aaacagctgcagtacacggcct

SEQ ID NO: 8477279 - DNA, 22 bp, Homo sapiens
aaacagctcaagaagttactct

SEQ ID NO: 8477280 - DNA, 22 bp, Homo sapiens
aaacagctccttagtttccatc

SEQ ID NO: 8477281 - DNA, 22 bp, Homo sapiens
aaacagctccttagtttccatc

SEQ ID NO: 8477282 - DNA, 22 bp, Homo sapiens
aaacagctacttctgtataatg

SEQ ID NO: 8477283 - DNA, 22 bp, Homo sapiens
aaacagctcaagaagttactct

SEQ ID NO: 8477284 - DNA, 22 bp, Homo sapiens
aaacagctcaagaagttactct

SEQ ID NO: 8477285 - DNA, 22 bp, Homo sapiens
aaacatctcaaagaggtatttg

SEQ ID NO: 8477286 - DNA, 22 bp, Homo sapiens
aaacagctggtctcaaatgttc

SEQ ID NO: 8477287 - DNA, 22 bp, Homo sapiens
aaacagctggtctcaaatgttc

SEQ ID NO: 8477288 - DNA, 22 bp, Homo sapiens
aaacagctgtcattgttttaaa

SEQ ID NO: 8477289 - DNA, 22 bp, Homo sapiens
aaacagctgtcattgttttaaa

SEQ ID NO: 8477290 - DNA, 22 bp, Homo sapiens
aaacagctggtctcaaatgttc

SEQ ID NO: 8477291 - DNA, 22 bp, Homo sapiens
aaacatgatgcctgtactaaga

SEQ ID NO: 8477292 - DNA, 21 bp, Homo sapiens
aaacatctctgcttttgtgtc

SEQ ID NO: 8477293 - DNA, 21 bp, Homo sapiens
aaacatctctgcttttgtgtc

SEQ ID NO: 8477294 - DNA, 22 bp, Homo sapiens
aaacagctaagtacattcaagg

SEQ ID NO: 8477295 - DNA, 22 bp, Homo sapiens
aaacagctaagtacattcaagg

SEQ ID NO: 8477296 - DNA, 22 bp, Homo sapiens
aaacagctaatggccaggaata

SEQ ID NO: 8477297 - DNA, 22 bp, Homo sapiens
aaacagctaatggccaggaata

SEQ ID NO: 8477298 - DNA, 22 bp, Homo sapiens
aaacagctacttctgtataatg

SEQ ID NO: 8477299 - DNA, 22 bp, Homo sapiens
aaacagctacttctgtataatg

SEQ ID NO: 8477300 - DNA, 22 bp, Homo sapiens
aaacagctaagtacattcaagg

SEQ ID NO: 8477301 - DNA, 20 bp, Homo sapiens
aaacagctaaaccagctctc

SEQ ID NO: 8477302 - DNA, 22 bp, Homo sapiens
aaacagcaggaacatcttgcca

SEQ ID NO: 8477303 - DNA, 22 bp, Homo sapiens
aaacagcagctgtttaatttgc

SEQ ID NO: 8477304 - DNA, 22 bp, Homo sapiens
aaacagcagctgtttaatttgc

SEQ ID NO: 8477305 - DNA, 22 bp, Homo sapiens
aaacagcaattacttttgcacc

SEQ ID NO: 8477306 - DNA, 22 bp, Homo sapiens
aaacagcaatggagaagccagg

SEQ ID NO: 8477307 - DNA, 22 bp, Homo sapiens
aaacagcaatggagaagccagg

SEQ ID NO: 8477308 - DNA, 22 bp, Homo sapiens
aaacagattgaaattcgtagta

SEQ ID NO: 8477309 - DNA, 22 bp, Homo sapiens
aaacagcaatggagaagccagg

SEQ ID NO: 8477310 - DNA, 22 bp, Homo sapiens
aaacagatgagttataatagcc

SEQ ID NO: 8477311 - DNA, 22 bp, Homo sapiens
aaagccagctctgagctgcacc

SEQ ID NO: 8477312 - DNA, 22 bp, Homo sapiens
aaagccaggaggagggcgctcg

SEQ ID NO: 8477313 - DNA, 22 bp, Homo sapiens
aaagccagctctgagctgcacc

SEQ ID NO: 8477314 - DNA, 22 bp, Homo sapiens
aaagccaggcagccaagccagt

SEQ ID NO: 8477315 - DNA, 22 bp, Homo sapiens
aaagccaggcagccaagccagt

SEQ ID NO: 8477316 - DNA, 22 bp, Homo sapiens
aaagccaggctggcctggggtt

SEQ ID NO: 8477317 - DNA, 22 bp, Homo sapiens
aaacactgtgggacatcttact

SEQ ID NO: 8477318 - DNA, 22 bp, Homo sapiens
aaacagagtttggtaaatagcc

SEQ ID NO: 8477319 - DNA, 22 bp, Homo sapiens
aaacagagggccactgaggctc

SEQ ID NO: 8477320 - DNA, 22 bp, Homo sapiens
aaacagagtttggtaaatagcc

SEQ ID NO: 8477321 - DNA, 22 bp, Homo sapiens
aaacagataatgctataaatgg

SEQ ID NO: 8477322 - DNA, 22 bp, Homo sapiens
aaacactgaagacctatctggt

SEQ ID NO: 8477323 - DNA, 22 bp, Homo sapiens
aaacactgatggatatttttcc

SEQ ID NO: 8477324 - DNA, 22 bp, Homo sapiens
aaacactgaagacctatctggt

SEQ ID NO: 8477325 - DNA, 22 bp, Homo sapiens
aaacactgaagacctatctggt

SEQ ID NO: 8477326 - DNA, 22 bp, Homo sapiens
aaacactgaaaattttggtcat

SEQ ID NO: 8477327 - DNA, 22 bp, Homo sapiens
aaagccagagcaagctgtcaca

SEQ ID NO: 8477328 - DNA, 22 bp, Homo sapiens
aaagccagagcaagctgtcaca

SEQ ID NO: 8477329 - DNA, 22 bp, Homo sapiens
aaagccagaattcgtccagcct

SEQ ID NO: 8477330 - DNA, 22 bp, Homo sapiens
aaagccagaattcgtccagcct

SEQ ID NO: 8477331 - DNA, 22 bp, Homo sapiens
aaagccagaattcgtccagcct

SEQ ID NO: 8477332 - DNA, 22 bp, Homo sapiens
aaagccagagtgtgttagagac

SEQ ID NO: 8477333 - DNA, 22 bp, Homo sapiens
aaagccagcaaggtgagtttca

SEQ ID NO: 8477334 - DNA, 22 bp, Homo sapiens
aaaactctgcagttagtttcta

SEQ ID NO: 8477335 - DNA, 22 bp, Homo sapiens
aaaactctgcagttagtttcta

SEQ ID NO: 8477336 - DNA, 22 bp, Homo sapiens
aaaaccttctagactttatatt

SEQ ID NO: 8477337 - DNA, 22 bp, Homo sapiens
aaaactaaatacgctttgcctc

SEQ ID NO: 8477338 - DNA, 22 bp, Homo sapiens
aaaaccaggcttgctgtgctcg

SEQ ID NO: 8477339 - DNA, 22 bp, Homo sapiens
aaaacataaactgacagcccat

SEQ ID NO: 8477340 - DNA, 22 bp, Homo sapiens
aaaacataaactgacagcccat

SEQ ID NO: 8477341 - DNA, 22 bp, Homo sapiens
aaaacataaactgacagcccat

SEQ ID NO: 8477342 - DNA, 22 bp, Homo sapiens
aaaacataaactgacagcccat

SEQ ID NO: 8477343 - DNA, 22 bp, Homo sapiens
aaaacctgattgaattctattt

SEQ ID NO: 8477344 - DNA, 22 bp, Homo sapiens
aaaacctgattgaattctattt

SEQ ID NO: 8477345 - DNA, 22 bp, Homo sapiens
aaaacccttctgcagactctga

SEQ ID NO: 8477346 - DNA, 22 bp, Homo sapiens
aaaacctgtgaatagttaactc

SEQ ID NO: 8477347 - DNA, 22 bp, Homo sapiens
aaaaccttcaggtttggagttt

SEQ ID NO: 8477348 - DNA, 22 bp, Homo sapiens
aaaacctgattgaattctattt

SEQ ID NO: 8477349 - DNA, 22 bp, Homo sapiens
aaaacctgattgaattctattt

SEQ ID NO: 8477350 - DNA, 22 bp, Homo sapiens
aaaaggatgttttcatgaaaca

SEQ ID NO: 8477351 - DNA, 22 bp, Homo sapiens
aaaaggatgttttcatgaaaca

SEQ ID NO: 8477352 - DNA, 22 bp, Homo sapiens
aaaaggcagtgcaagagagggt

SEQ ID NO: 8477353 - DNA, 22 bp, Homo sapiens
aaaaggcagtgcaagagagggt

SEQ ID NO: 8477354 - DNA, 22 bp, Homo sapiens
aaaaggctcttcaaaatggaag

SEQ ID NO: 8477355 - DNA, 22 bp, Homo sapiens
aaaacagtttttgctaactgct

SEQ ID NO: 8477356 - DNA, 22 bp, Homo sapiens
aaaaggcattttgtcaaccata

SEQ ID NO: 8477357 - DNA, 22 bp, Homo sapiens
aaaaggctaatccagagcaact

SEQ ID NO: 8477358 - DNA, 22 bp, Homo sapiens
aaaaggcatggaggttgatagt

SEQ ID NO: 8477359 - DNA, 22 bp, Homo sapiens
aaaaactgcaattacttttgtc

SEQ ID NO: 8477360 - DNA, 22 bp, Homo sapiens
aaaaactgcaattacttttgtc

SEQ ID NO: 8477361 - DNA, 22 bp, Homo sapiens
aaaaactgcaattacttttgtc

SEQ ID NO: 8477362 - DNA, 22 bp, Homo sapiens
aaaaactggtaactattcccca

SEQ ID NO: 8477363 - DNA, 22 bp, Homo sapiens
aaaaagatgtcctgaagtttag

SEQ ID NO: 8477364 - DNA, 22 bp, Homo sapiens
aaaaagatgtcctgaagtttag

SEQ ID NO: 8477365 - DNA, 21 bp, Homo sapiens
aaaaagctggggcatgcatgc

SEQ ID NO: 8477366 - DNA, 22 bp, Homo sapiens
aaaaagcttaaatgagcagttc

SEQ ID NO: 8477367 - DNA, 22 bp, Homo sapiens
aaaaagcttaaatgagcagttc

SEQ ID NO: 8477368 - DNA, 21 bp, Homo sapiens
aaaaagctggggcatgcatgc

SEQ ID NO: 8477369 - DNA, 22 bp, Homo sapiens
aaaaaggctaagcatcttgtgc

SEQ ID NO: 8477370 - DNA, 22 bp, Homo sapiens
aaaaaggctaagcatcttgtgc

SEQ ID NO: 8477371 - DNA, 22 bp, Homo sapiens
aaaaaggttgatccagattagg

SEQ ID NO: 8477372 - DNA, 22 bp, Homo sapiens
aaaaaggttgatccagattagg

SEQ ID NO: 8477373 - DNA, 22 bp, Homo sapiens
aaaaaggttgatccagattagg

SEQ ID NO: 8477374 - DNA, 21 bp, Homo sapiens
aaaaggaggcaggtgaacagc

SEQ ID NO: 8477375 - DNA, 22 bp, Homo sapiens
aaaaggatcagattttgagcag

SEQ ID NO: 8477376 - DNA, 22 bp, Homo sapiens
aaaaggaggtcactttattcct

SEQ ID NO: 8477377 - DNA, 22 bp, Homo sapiens
aaaaggaggtcactttattcct

SEQ ID NO: 8477378 - DNA, 22 bp, Homo sapiens
aaaaggaggcaaacagcctaga

SEQ ID NO: 8477379 - DNA, 22 bp, Homo sapiens
aaaaatacttcacttctgggtg

SEQ ID NO: 8477380 - DNA, 22 bp, Homo sapiens
aaaaatacttcacttctgggtg

SEQ ID NO: 8477381 - DNA, 22 bp, Homo sapiens
aaaaatacttcacttctgggtg

SEQ ID NO: 8477382 - DNA, 22 bp, Homo sapiens
aaaaagtttcaactgccaactc

SEQ ID NO: 8477383 - DNA, 18 bp, Homo sapiens
aaaaagtgctcaggccta

SEQ ID NO: 8477384 - DNA, 22 bp, Homo sapiens
aaaaagtttcaactgccaactc

SEQ ID NO: 8477385 - DNA, 22 bp, Homo sapiens
aaaaagtttcaactgccaactc

SEQ ID NO: 8477386 - DNA, 22 bp, Homo sapiens
aaaaagtttcaactgccaactc

SEQ ID NO: 8477387 - DNA, 22 bp, Homo sapiens
aaaaagtcatattcttgttcct

SEQ ID NO: 8477388 - DNA, 18 bp, Homo sapiens
aaaaagtgctcaggccta

SEQ ID NO: 8477389 - DNA, 22 bp, Homo sapiens
aaaactgtaggaattgggtgcc

SEQ ID NO: 8477390 - DNA, 22 bp, Homo sapiens
aaaactgaggtttcctgaagaa

SEQ ID NO: 8477391 - DNA, 22 bp, Homo sapiens
aaaactgaaccttgagatcttt

SEQ ID NO: 8477392 - DNA, 22 bp, Homo sapiens
aaaactgaaccttgagatcttt

SEQ ID NO: 8477393 - DNA, 22 bp, Homo sapiens
aaaactgaaccttgagatcttt

SEQ ID NO: 8477394 - DNA, 22 bp, Homo sapiens
aaaactgtatcttcttgggact

SEQ ID NO: 8477395 - DNA, 22 bp, Homo sapiens
aaaactgtatcttcttgggact

SEQ ID NO: 8477396 - DNA, 22 bp, Homo sapiens
aaaactgtatcttcttgggact

SEQ ID NO: 8477397 - DNA, 22 bp, Homo sapiens
aaaactttcagggatacagaaa

SEQ ID NO: 8477398 - DNA, 22 bp, Homo sapiens
aaaatgtgtttatgcatttcgt

SEQ ID NO: 8477399 - DNA, 22 bp, Homo sapiens
aaaatgtgcagtttttaagctg

SEQ ID NO: 8477400 - DNA, 22 bp, Homo sapiens
aaaatgtgcagtttttaagctg

SEQ ID NO: 8477401 - DNA, 22 bp, Homo sapiens
aaaattattcatggcttttgga

SEQ ID NO: 8477402 - DNA, 22 bp, Homo sapiens
aaaattcatagaactgtacgct

SEQ ID NO: 8477403 - DNA, 22 bp, Homo sapiens
aaaattcatggcttgggaaaag

SEQ ID NO: 8477404 - DNA, 22 bp, Homo sapiens
aaaattcatggcttgggaaaag

SEQ ID NO: 8477405 - DNA, 22 bp, Homo sapiens
aaaattcatggcttgggaaaag

SEQ ID NO: 8477406 - DNA, 22 bp, Homo sapiens
aaaattatggagtatcccaaag

SEQ ID NO: 8477407 - DNA, 22 bp, Homo sapiens
aaaattactattgttcctgggc

SEQ ID NO: 8477408 - DNA, 22 bp, Homo sapiens
aaaattaagtgtctgggaagcc

SEQ ID NO: 8477409 - DNA, 22 bp, Homo sapiens
aaaagtaattgcagttttgtca

SEQ ID NO: 8477410 - DNA, 22 bp, Homo sapiens
aaaagtaattgcagttttgtca

SEQ ID NO: 8477411 - DNA, 22 bp, Homo sapiens
aaaagtaattgcagttttgtca

SEQ ID NO: 8477412 - DNA, 22 bp, Homo sapiens
aaaagtaattgcagtttttgcc

SEQ ID NO: 8477413 - DNA, 22 bp, Homo sapiens
aaaagtaattgcagtttttgcc

SEQ ID NO: 8477414 - DNA, 22 bp, Homo sapiens
aaaagtaattgcagtttttgcc

SEQ ID NO: 8477415 - DNA, 22 bp, Homo sapiens
aaaagtaattgcagttttgtca

SEQ ID NO: 8477416 - DNA, 22 bp, Homo sapiens
aaaagtaattgcaattttgtag

SEQ ID NO: 8477417 - DNA, 22 bp, Homo sapiens
aaaagtaattgcagttttcgcc

SEQ ID NO: 8477418 - DNA, 22 bp, Homo sapiens
aaaagtaattgcagttttgcca

SEQ ID NO: 8477419 - DNA, 22 bp, Homo sapiens
aaacagctttcagaatctctca

SEQ ID NO: 8477420 - DNA, 22 bp, Homo sapiens
aaacagctttcagaatctctca

SEQ ID NO: 8477421 - DNA, 22 bp, Homo sapiens
aaacagcttgtttcaggaaagt

SEQ ID NO: 8477422 - DNA, 22 bp, Homo sapiens
aaacagcttgtttcaggaaagt

SEQ ID NO: 8477423 - DNA, 22 bp, Homo sapiens
aaacagcttgtttcaggaaagt

SEQ ID NO: 8477424 - DNA, 22 bp, Homo sapiens
aaacagcttgtttcaggaaagt

SEQ ID NO: 8477425 - DNA, 22 bp, Homo sapiens
aaaagtaattgtggtttttgcc

SEQ ID NO: 8477426 - DNA, 22 bp, Homo sapiens
aaaagtaattgtggtttttgcc

SEQ ID NO: 8477427 - DNA, 22 bp, Homo sapiens
aaaagtaattgtggtttttgcc

SEQ ID NO: 8477428 - DNA, 22 bp, Homo sapiens
aaaagtaattgcggtttttgct

SEQ ID NO: 8477429 - DNA, 22 bp, Homo sapiens
aaaagtaattgcggtttttgct

SEQ ID NO: 8477430 - DNA, 22 bp, Homo sapiens
aaaagtaattgcggtttttgct

SEQ ID NO: 8477431 - DNA, 22 bp, Homo sapiens
aaaagtaattgcggtttttgcc

SEQ ID NO: 8477432 - DNA, 22 bp, Homo sapiens
aaaagtaattgcggtttttgcc

SEQ ID NO: 8477433 - DNA, 22 bp, Homo sapiens
aaaagtaattgcggtttttgcc

SEQ ID NO: 8477434 - DNA, 22 bp, Homo sapiens
aaaaggttttgagtacaaatat

SEQ ID NO: 8477435 - DNA, 22 bp, Homo sapiens
aaaaggtagttgccaaataagg

SEQ ID NO: 8477436 - DNA, 22 bp, Homo sapiens
aaaaggttttgagtacaaatat

SEQ ID NO: 8477437 - DNA, 22 bp, Homo sapiens
aaaagtaattgatgcaatcgta

SEQ ID NO: 8477438 - DNA, 22 bp, Homo sapiens
aaaagtaatcgcagtttttgcc

SEQ ID NO: 8477439 - DNA, 22 bp, Homo sapiens
aaaagtaatcgcagtttttgcc

SEQ ID NO: 8477440 - DNA, 22 bp, Homo sapiens
aaaagtaatcgcagtttttgcc

SEQ ID NO: 8477441 - DNA, 22 bp, Homo sapiens
aaaagtaattgcaattttgtag

SEQ ID NO: 8477442 - DNA, 22 bp, Homo sapiens
aaaagtaattgcaattttgtag

SEQ ID NO: 8477443 - DNA, 22 bp, Homo sapiens
aaaagtaattgcaattttgtag

SEQ ID NO: 8477444 - DNA, 22 bp, Homo sapiens
aaaagtaattgcaattttgtag

SEQ ID NO: 8477445 - DNA, 22 bp, Homo sapiens
aaaagtaattgcaattttgtag

SEQ ID NO: 8477446 - DNA, 22 bp, Homo sapiens
aaaagtaattgcaattttgtag

SEQ ID NO: 8477447 - DNA, 19 bp, Homo sapiens
aaaaggagagatcagagtt

SEQ ID NO: 8477448 - DNA, 19 bp, Homo sapiens
aaaaggagagatcagagtt

SEQ ID NO: 8477449 - DNA, 22 bp, Homo sapiens
aaaagggcaaaaccatcatgga

SEQ ID NO: 8477450 - DNA, 22 bp, Homo sapiens
aaaaggaggacatggttacaga

SEQ ID NO: 8477451 - DNA, 22 bp, Homo sapiens
aaaaggtagttgccaaataagg

SEQ ID NO: 8477452 - DNA, 22 bp, Homo sapiens
aaaaggtagattctccttctat

SEQ ID NO: 8477453 - DNA, 22 bp, Homo sapiens
aaacagtattatcaatatattt

SEQ ID NO: 8477454 - DNA, 22 bp, Homo sapiens
aaacagtattatcaatatattt

SEQ ID NO: 8477455 - DNA, 22 bp, Homo sapiens
aaacagtattatcaatatattt

SEQ ID NO: 8477456 - DNA, 22 bp, Homo sapiens
aaacagtagaagtgtattttat

SEQ ID NO: 8477457 - DNA, 22 bp, Homo sapiens
aaacagtactcgatttttgtag

SEQ ID NO: 8477458 - DNA, 22 bp, Homo sapiens
aaacagtaagttctagtattat

SEQ ID NO: 8477459 - DNA, 22 bp, Homo sapiens
aaacaggcttgcaacatgtttt

SEQ ID NO: 8477460 - DNA, 22 bp, Homo sapiens
aaacaggcttccattagagcaa

SEQ ID NO: 8477461 - DNA, 22 bp, Homo sapiens
aaacaggcttccattagagcaa

SEQ ID NO: 8477462 - DNA, 22 bp, Homo sapiens
aaacagctttcagaatctctca

SEQ ID NO: 8477463 - DNA, 22 bp, Homo sapiens
aaacaggcatcactcagcaaag

SEQ ID NO: 8477464 - DNA, 22 bp, Homo sapiens
aaacaggcatcactcagcaaag

SEQ ID NO: 8477465 - DNA, 20 bp, Homo sapiens
aaaatatgtataactcttct

SEQ ID NO: 8477466 - DNA, 20 bp, Homo sapiens
aaaatatgtataactcttct

SEQ ID NO: 8477467 - DNA, 20 bp, Homo sapiens
aaaatatgtataactcttct

SEQ ID NO: 8477468 - DNA, 22 bp, Homo sapiens
aaaatatgactgtgctccttaa

SEQ ID NO: 8477469 - DNA, 22 bp, Homo sapiens
aaaatatgaagttgtcagtatg

SEQ ID NO: 8477470 - DNA, 22 bp, Homo sapiens
aaaatactgtggagtgttgaaa

SEQ ID NO: 8477471 - DNA, 22 bp, Homo sapiens
aaaatactgtggagtgttgaaa

SEQ ID NO: 8477472 - DNA, 22 bp, Homo sapiens
aaacagtattatcaatatattt

SEQ ID NO: 8477473 - DNA, 22 bp, Homo sapiens
aaacagtcatggttgctgttca

SEQ ID NO: 8477474 - DNA, 22 bp, Homo sapiens
aaacagtcaaaggcctaagcta

SEQ ID NO: 8477475 - DNA, 22 bp, Homo sapiens
aaaatatgaagttgtcagtatg

SEQ ID NO: 8477476 - DNA, 22 bp, Homo sapiens
aaaatatcagcaaagggtgaca

SEQ ID NO: 8477477 - DNA, 22 bp, Homo sapiens
aaaatattttagggccaggaga

SEQ ID NO: 8477478 - DNA, 22 bp, Homo sapiens
aaactgcaattatttttgcaat

SEQ ID NO: 8477479 - DNA, 22 bp, Homo sapiens
aaactgcacaagggtgcatagc

SEQ ID NO: 8477480 - DNA, 22 bp, Homo sapiens
aaaatattttagggccaggaga

SEQ ID NO: 8477481 - DNA, 22 bp, Homo sapiens
aaactgcagagccatggttcaa

SEQ ID NO: 8477482 - DNA, 22 bp, Homo sapiens
aaactgcactttattttgtcaa

SEQ ID NO: 8477483 - DNA, 22 bp, Homo sapiens
aaactgcactttattttgtcaa

SEQ ID NO: 8477484 - DNA, 22 bp, Homo sapiens
aaactgcacatgaggctggtgc

SEQ ID NO: 8477485 - DNA, 22 bp, Homo sapiens
aaactgcacacgatgtgcctga

SEQ ID NO: 8477486 - DNA, 22 bp, Homo sapiens
aaaatattttagggccaggaga

SEQ ID NO: 8477487 - DNA, 22 bp, Homo sapiens
aaaatattttagggccaggaga

SEQ ID NO: 8477488 - DNA, 22 bp, Homo sapiens
aaaatattttagggccaggaga

SEQ ID NO: 8477489 - DNA, 22 bp, Homo sapiens
aaaatattttagggccaggaga

SEQ ID NO: 8477490 - DNA, 22 bp, Homo sapiens
aaaatattttagggccaggaga

SEQ ID NO: 8477491 - DNA, 22 bp, Homo sapiens
aaaatatgtataactcttctgc

SEQ ID NO: 8477492 - DNA, 22 bp, Homo sapiens
aaaatatgtataactcttctgc

SEQ ID NO: 8477493 - DNA, 22 bp, Homo sapiens
aaaatatgtataactcttctgc

SEQ ID NO: 8477494 - DNA, 20 bp, Homo sapiens
aaaatatgtataactcttct

SEQ ID NO: 8477495 - DNA, 22 bp, Homo sapiens
aaactgcaggtcatgacccatt

SEQ ID NO: 8477496 - DNA, 22 bp, Homo sapiens
aaactgcagccttgagttcagg

SEQ ID NO: 8477497 - DNA, 23 bp, Homo sapiens
aaactgcatctctgagcctcagc

SEQ ID NO: 8477498 - DNA, 22 bp, Homo sapiens
aaactgcatgaagctgatttta

SEQ ID NO: 8477499 - DNA, 23 bp, Homo sapiens
aaactgcttccaattcctgccat

SEQ ID NO: 8477500 - DNA, 22 bp, Homo sapiens
aaactgctggttgctggccagc

SEQ ID NO: 8477501 - DNA, 18 bp, Homo sapiens
aaactggcttggcctgtg

SEQ ID NO: 8477502 - DNA, 22 bp, Homo sapiens
aaactgctttccacagtggcta

SEQ ID NO: 8477503 - DNA, 17 bp, Homo sapiens
aaactggggtcaggagc

SEQ ID NO: 8477504 - DNA, 22 bp, Homo sapiens
aaactgggattcttcacaaggt

SEQ ID NO: 8477505 - DNA, 21 bp, Homo sapiens
aaaatgtgagcgtgatgctta

SEQ ID NO: 8477506 - DNA, 22 bp, Homo sapiens
aaactggtaatcggcaagtgag

SEQ ID NO: 8477507 - DNA, 22 bp, Homo sapiens
aaacactagcaggaagcactga

SEQ ID NO: 8477508 - DNA, 22 bp, Homo sapiens
aaacactaataacagtggctgg

SEQ ID NO: 8477509 - DNA, 22 bp, Homo sapiens
aaacactcatgtgttactctcc

SEQ ID NO: 8477510 - DNA, 22 bp, Homo sapiens
aaacactagcaggaagcactga

SEQ ID NO: 8477511 - DNA, 22 bp, Homo sapiens
aaacactagcaggaagcactga

SEQ ID NO: 8477512 - DNA, 22 bp, Homo sapiens
aaacaccagcactgtttacaaa

SEQ ID NO: 8477513 - DNA, 22 bp, Homo sapiens
aaacaccagtcccagtatacac

SEQ ID NO: 8477514 - DNA, 22 bp, Homo sapiens
aaacaccaagagctagctatta

SEQ ID NO: 8477515 - DNA, 22 bp, Homo sapiens
aaacacattttaggaaaatcta

SEQ ID NO: 8477516 - DNA, 22 bp, Homo sapiens
aaacacattagccctgtggaaa

SEQ ID NO: 8477517 - DNA, 22 bp, Homo sapiens
aaacacattttaggaaaatcta

SEQ ID NO: 8477518 - DNA, 22 bp, Homo sapiens
aaacacaagaggcagggtacag

SEQ ID NO: 8477519 - DNA, 22 bp, Homo sapiens
aaacacatcattcatgtcgtca

SEQ ID NO: 8477520 - DNA, 22 bp, Homo sapiens
aaagagcttgcttgctttatat

SEQ ID NO: 8477521 - DNA, 22 bp, Homo sapiens
aaagagctggcatttatagtct

SEQ ID NO: 8477522 - DNA, 22 bp, Homo sapiens
aaagagctcttactctagtgta

SEQ ID NO: 8477523 - DNA, 22 bp, Homo sapiens
aaagagctcacagtccactgga

SEQ ID NO: 8477524 - DNA, 22 bp, Homo sapiens
aaagagctcacagtccactgga

SEQ ID NO: 8477525 - DNA, 22 bp, Homo sapiens
aaagagccgctgatgtcagccc

SEQ ID NO: 8477526 - DNA, 22 bp, Homo sapiens
aaagagctaacattgccgagat

SEQ ID NO: 8477527 - DNA, 22 bp, Homo sapiens
aaagagctaacattgccgagat

SEQ ID NO: 8477528 - DNA, 22 bp, Homo sapiens
aaagagcatggaaagttcagga

SEQ ID NO: 8477529 - DNA, 21 bp, Homo sapiens
aaagagcccgctgagaggttc

SEQ ID NO: 8477530 - DNA, 22 bp, Homo sapiens
aaaattgagagttatagatggt

SEQ ID NO: 8477531 - DNA, 19 bp, Homo sapiens
aaaattgcgtattttgagg

SEQ ID NO: 8477532 - DNA, 22 bp, Homo sapiens
aaaattggacgtagctactcca

SEQ ID NO: 8477533 - DNA, 22 bp, Homo sapiens
aaaattctgtcattaaattgtg

SEQ ID NO: 8477534 - DNA, 22 bp, Homo sapiens
aaaattgaagtgatcaggaact

SEQ ID NO: 8477535 - DNA, 22 bp, Homo sapiens
aaaattgaagtgatcaggaact

SEQ ID NO: 8477536 - DNA, 22 bp, Homo sapiens
aaaattgaagtgatcaggaact

SEQ ID NO: 8477537 - DNA, 22 bp, Homo sapiens
aaaattcattcctcagactgcc

SEQ ID NO: 8477538 - DNA, 22 bp, Homo sapiens
aaaatgtgatctacaaatgcaa

SEQ ID NO: 8477539 - DNA, 22 bp, Homo sapiens
aaaatgtgatctacaaatgcaa

SEQ ID NO: 8477540 - DNA, 22 bp, Homo sapiens
aaaattctcttgatcttgacag

SEQ ID NO: 8477541 - DNA, 22 bp, Homo sapiens
aaaattctcttgatcttgacag

SEQ ID NO: 8477542 - DNA, 22 bp, Homo sapiens
aaaattctaacatgcagccaag

SEQ ID NO: 8477543 - DNA, 22 bp, Homo sapiens
aagaaaacgttttgaggagttt

SEQ ID NO: 8477544 - DNA, 22 bp, Homo sapiens
aagaaaacatgatctaatttaa

SEQ ID NO: 8477545 - DNA, 22 bp, Homo sapiens
aagaaaacaatgacttgccagc

SEQ ID NO: 8477546 - DNA, 22 bp, Homo sapiens
aagaaaacatgatctaatttaa

SEQ ID NO: 8477547 - DNA, 22 bp, Homo sapiens
aagaaaatcagttctggtcagt

SEQ ID NO: 8477548 - DNA, 22 bp, Homo sapiens
aagaaaagaaacctgaggcttt

SEQ ID NO: 8477549 - DNA, 22 bp, Homo sapiens
aagaaaagaaacctgaggcttt

SEQ ID NO: 8477550 - DNA, 22 bp, Homo sapiens
aagaaactgttgcgtgacagcg

SEQ ID NO: 8477551 - DNA, 22 bp, Homo sapiens
aagaaactgttgcgtgacagcg

SEQ ID NO: 8477552 - DNA, 22 bp, Homo sapiens
aagaaactgaaagtggcttcat

SEQ ID NO: 8477553 - DNA, 22 bp, Homo sapiens
aagaaactcactttgggaggca

SEQ ID NO: 8477554 - DNA, 22 bp, Homo sapiens
aagaaacctagtctggagcagc

SEQ ID NO: 8477555 - DNA, 22 bp, Homo sapiens
aagaaacaaccactgctctcct

SEQ ID NO: 8477556 - DNA, 22 bp, Homo sapiens
aagaaacaaccactgctctcct

SEQ ID NO: 8477557 - DNA, 22 bp, Homo sapiens
aagaaacaaccactgctctcct

SEQ ID NO: 8477558 - DNA, 22 bp, Homo sapiens
aactggaaccttttattcagtc

SEQ ID NO: 8477559 - DNA, 22 bp, Homo sapiens
aactggaaagatcagtaggaag

SEQ ID NO: 8477560 - DNA, 17 bp, Homo sapiens
aactgctttttttagcc

SEQ ID NO: 8477561 - DNA, 22 bp, Homo sapiens
aactgcttgtaaataatgttga

SEQ ID NO: 8477562 - DNA, 22 bp, Homo sapiens
aatgggaaagagactagatgct

SEQ ID NO: 8477563 - DNA, 22 bp, Homo sapiens
aactgcttgtaaataatgttga

SEQ ID NO: 8477564 - DNA, 22 bp, Homo sapiens
aactgcttgagatatgtttgtc

SEQ ID NO: 8477565 - DNA, 22 bp, Homo sapiens
aatgggaagccagaagacaagg

SEQ ID NO: 8477566 - DNA, 22 bp, Homo sapiens
aactgcttcttactgctgggca

SEQ ID NO: 8477567 - DNA, 22 bp, Homo sapiens
aatggcttttaaaaatagcatt

SEQ ID NO: 8477568 - DNA, 22 bp, Homo sapiens
aatggcttttgcacttaaatcg

SEQ ID NO: 8477569 - DNA, 22 bp, Homo sapiens
aatggctttgacattttcaaat

SEQ ID NO: 8477570 - DNA, 22 bp, Homo sapiens
aatggctttgacattttcaaat

SEQ ID NO: 8477571 - DNA, 22 bp, Homo sapiens
aatggctttgagtattttctgg

SEQ ID NO: 8477572 - DNA, 22 bp, Homo sapiens
aatggctttggcaggaatttca

SEQ ID NO: 8477573 - DNA, 22 bp, Homo sapiens
aatggctttggtctgggtccca

SEQ ID NO: 8477574 - DNA, 22 bp, Homo sapiens
aactggcatatgaacttgttct

SEQ ID NO: 8477575 - DNA, 22 bp, Homo sapiens
aactggcatatgaacttgttct

SEQ ID NO: 8477576 - DNA, 22 bp, Homo sapiens
aactggaatgaaatttacgatg

SEQ ID NO: 8477577 - DNA, 22 bp, Homo sapiens
aactggagcccctctgccactg

SEQ ID NO: 8477578 - DNA, 22 bp, Homo sapiens
aactttctgtctgagctgcaga

SEQ ID NO: 8477579 - DNA, 22 bp, Homo sapiens
aactttttctgggatggagggt

SEQ ID NO: 8477580 - DNA, 22 bp, Homo sapiens
aattctataggcaagctatttt

SEQ ID NO: 8477581 - DNA, 22 bp, Homo sapiens
aattctacattggttcacattt

SEQ ID NO: 8477582 - DNA, 22 bp, Homo sapiens
aattctacattggttcacattt

SEQ ID NO: 8477583 - DNA, 22 bp, Homo sapiens
aattcctctatctttcttcaag

SEQ ID NO: 8477584 - DNA, 22 bp, Homo sapiens
aattctaaatgtaatttagaat

SEQ ID NO: 8477585 - DNA, 21 bp, Homo sapiens
aattcgtttgcaacactgata

SEQ ID NO: 8477586 - DNA, 22 bp, Homo sapiens
aattctcaggaatttcatctgt

SEQ ID NO: 8477587 - DNA, 22 bp, Homo sapiens
aattctataggcaagctatttt

SEQ ID NO: 8477588 - DNA, 22 bp, Homo sapiens
aattctctccagggtaacatca

SEQ ID NO: 8477589 - DNA, 22 bp, Homo sapiens
aattctgaaagattccttattc

SEQ ID NO: 8477590 - DNA, 20 bp, Homo sapiens
aagaaacttgaaagtacaag

SEQ ID NO: 8477591 - DNA, 20 bp, Homo sapiens
aagaaacttgaaagtacaag

SEQ ID NO: 8477592 - DNA, 20 bp, Homo sapiens
aagaaacttgaaagtacaag

SEQ ID NO: 8477593 - DNA, 20 bp, Homo sapiens
aagaaacttgaaagtacaag

SEQ ID NO: 8477594 - DNA, 22 bp, Homo sapiens
aagaaagataaggtttgcttgg

SEQ ID NO: 8477595 - DNA, 22 bp, Homo sapiens
aagaaagagatcactcctccat

SEQ ID NO: 8477596 - DNA, 22 bp, Homo sapiens
aagaaagataaggtttgcttgg

SEQ ID NO: 8477597 - DNA, 22 bp, Homo sapiens
aattcacaatgtgtagtcatgc

SEQ ID NO: 8477598 - DNA, 22 bp, Homo sapiens
aattcacaattatgttgggaga

SEQ ID NO: 8477599 - DNA, 22 bp, Homo sapiens
aattcccatttgcagaaaatca

SEQ ID NO: 8477600 - DNA, 22 bp, Homo sapiens
aattcccactatatgccaagca

SEQ ID NO: 8477601 - DNA, 21 bp, Homo sapiens
aattcccagaaacagcacaag

SEQ ID NO: 8477602 - DNA, 22 bp, Homo sapiens
aattcccaccttctctcttttg

SEQ ID NO: 8477603 - DNA, 22 bp, Homo sapiens
aagaacaactgctttaaaagca

SEQ ID NO: 8477604 - DNA, 17 bp, Homo sapiens
aagaacactcaatagca

SEQ ID NO: 8477605 - DNA, 17 bp, Homo sapiens
aagaacactcaatagca

SEQ ID NO: 8477606 - DNA, 22 bp, Homo sapiens
aagaacagattcagcctgaact

SEQ ID NO: 8477607 - DNA, 22 bp, Homo sapiens
aatttaaggaggccttcactct

SEQ ID NO: 8477608 - DNA, 22 bp, Homo sapiens
aatttcactggaaaagataatt

SEQ ID NO: 8477609 - DNA, 22 bp, Homo sapiens
aatttcactgtggagcacattt

SEQ ID NO: 8477610 - DNA, 22 bp, Homo sapiens
aagaacaactgctttaaaagca

SEQ ID NO: 8477611 - DNA, 22 bp, Homo sapiens
aagaacaactgctttaaaagca

SEQ ID NO: 8477612 - DNA, 22 bp, Homo sapiens
aagaacaactgctttaaaagca

SEQ ID NO: 8477613 - DNA, 22 bp, Homo sapiens
aagaaattaatgtgccattact

SEQ ID NO: 8477614 - DNA, 22 bp, Homo sapiens
aagaaattaaggaatgcaacga

SEQ ID NO: 8477615 - DNA, 22 bp, Homo sapiens
aagaaattaaggaatgcaacga

SEQ ID NO: 8477616 - DNA, 22 bp, Homo sapiens
aagaaatgtagagcctagtaaa

SEQ ID NO: 8477617 - DNA, 22 bp, Homo sapiens
aagaaatgtagagcctagtaaa

SEQ ID NO: 8477618 - DNA, 22 bp, Homo sapiens
aattttacaaaatacctccgat

SEQ ID NO: 8477619 - DNA, 22 bp, Homo sapiens
aattttaatcagtggtgctgag

SEQ ID NO: 8477620 - DNA, 22 bp, Homo sapiens
aattttaatcagtggtgctgag

SEQ ID NO: 8477621 - DNA, 22 bp, Homo sapiens
aatttgttacacagcaatataa

SEQ ID NO: 8477622 - DNA, 22 bp, Homo sapiens
aatttccagaccccatccacag

SEQ ID NO: 8477623 - DNA, 22 bp, Homo sapiens
aatttccagaccccatccacag

SEQ ID NO: 8477624 - DNA, 22 bp, Homo sapiens
aatttcagcttaagttgtttgg

SEQ ID NO: 8477625 - DNA, 22 bp, Homo sapiens
aattttaagcatatgactggtt

SEQ ID NO: 8477626 - DNA, 22 bp, Homo sapiens
aattttaagcatatgactggtt

SEQ ID NO: 8477627 - DNA, 22 bp, Homo sapiens
aatttgttttcaagtcactgga

SEQ ID NO: 8477628 - DNA, 22 bp, Homo sapiens
aatttgttataacttgggctga

SEQ ID NO: 8477629 - DNA, 22 bp, Homo sapiens
aatttcagttgctaataagttc

SEQ ID NO: 8477630 - DNA, 22 bp, Homo sapiens
aatttcagttgctaataagttc

SEQ ID NO: 8477631 - DNA, 22 bp, Homo sapiens
aatttcagtatgaagtttcaca

SEQ ID NO: 8477632 - DNA, 22 bp, Homo sapiens
aatttcagtatgaagtttcaca

SEQ ID NO: 8477633 - DNA, 22 bp, Homo sapiens
aatttcagatgtcataaatata

SEQ ID NO: 8477634 - DNA, 22 bp, Homo sapiens
aatttcagatgtcataaatata

SEQ ID NO: 8477635 - DNA, 22 bp, Homo sapiens
aatttcagctcaaacttgtgtt

SEQ ID NO: 8477636 - DNA, 22 bp, Homo sapiens
aatttcagctcaaacttgtgtt

SEQ ID NO: 8477637 - DNA, 22 bp, Homo sapiens
aatttcagaggtagagattcta

SEQ ID NO: 8477638 - DNA, 22 bp, Homo sapiens
aatttcagaactatctgggagt

SEQ ID NO: 8477639 - DNA, 22 bp, Homo sapiens
aatttcagatgtcataaatata

SEQ ID NO: 8477640 - DNA, 22 bp, Homo sapiens
aatttcagatattaaagaatga

SEQ ID NO: 8477641 - DNA, 22 bp, Homo sapiens
aatttcagatattaaagaatga

SEQ ID NO: 8477642 - DNA, 22 bp, Homo sapiens
aatttcagaacccaaattagcg

SEQ ID NO: 8477643 - DNA, 22 bp, Homo sapiens
aatttcagaccatttgcaatta

SEQ ID NO: 8477644 - DNA, 22 bp, Homo sapiens
aatttcagaacccaaattagcg

SEQ ID NO: 8477645 - DNA, 22 bp, Homo sapiens
aagagaaagcagactttgtcat

SEQ ID NO: 8477646 - DNA, 22 bp, Homo sapiens
aagagaaagcagactttgtcat

SEQ ID NO: 8477647 - DNA, 22 bp, Homo sapiens
aagactttctcccaaatcctca

SEQ ID NO: 8477648 - DNA, 22 bp, Homo sapiens
aagagaagaaagtgtctacaca

SEQ ID NO: 8477649 - DNA, 22 bp, Homo sapiens
aagagaaggattctgagcctgg

SEQ ID NO: 8477650 - DNA, 20 bp, Homo sapiens
aagagaagaagtctttgaaa

SEQ ID NO: 8477651 - DNA, 20 bp, Homo sapiens
aagagaagaagtctttgaaa

SEQ ID NO: 8477652 - DNA, 22 bp, Homo sapiens
aagaccatttaatggagaaaga

SEQ ID NO: 8477653 - DNA, 22 bp, Homo sapiens
aagacttgaccaggttgaaggc

SEQ ID NO: 8477654 - DNA, 22 bp, Homo sapiens
aagacttgaccaggttgaaggc

SEQ ID NO: 8477655 - DNA, 22 bp, Homo sapiens
aagacttgaccaggttgaaggc

SEQ ID NO: 8477656 - DNA, 22 bp, Homo sapiens
aagactttctcccaaatcctca

SEQ ID NO: 8477657 - DNA, 22 bp, Homo sapiens
aagactttccctcatcagaacg

SEQ ID NO: 8477658 - DNA, 22 bp, Homo sapiens
aagactttcaagtatgcatgca

SEQ ID NO: 8477659 - DNA, 22 bp, Homo sapiens
aattttatctctaagcaggctt

SEQ ID NO: 8477660 - DNA, 22 bp, Homo sapiens
aagaccataatgtaagatgaat

SEQ ID NO: 8477661 - DNA, 22 bp, Homo sapiens
aagaccataatgtaagatgaat

SEQ ID NO: 8477662 - DNA, 20 bp, Homo sapiens
aattttatctccatcctttg

SEQ ID NO: 8477663 - DNA, 20 bp, Homo sapiens
aattttatctccatcctttg

SEQ ID NO: 8477664 - DNA, 20 bp, Homo sapiens
aattttatctccatcctttg

SEQ ID NO: 8477665 - DNA, 20 bp, Homo sapiens
aattttatctccatcctttg

SEQ ID NO: 8477666 - DNA, 20 bp, Homo sapiens
aattttatctccatcctttg

SEQ ID NO: 8477667 - DNA, 21 bp, Homo sapiens
aagagacatttctcatcagca

SEQ ID NO: 8477668 - DNA, 22 bp, Homo sapiens
aagagactatggtgtctatgaa

SEQ ID NO: 8477669 - DNA, 22 bp, Homo sapiens
aagagactaagaaagggcaata

SEQ ID NO: 8477670 - DNA, 22 bp, Homo sapiens
aagagactggaaactagggtca

SEQ ID NO: 8477671 - DNA, 22 bp, Homo sapiens
aagagactggaaactagggtca

SEQ ID NO: 8477672 - DNA, 22 bp, Homo sapiens
acaatgtttctctttagtcatt

SEQ ID NO: 8477673 - DNA, 22 bp, Homo sapiens
aagagacttgtccgaagttgta

SEQ ID NO: 8477674 - DNA, 22 bp, Homo sapiens
aagagactgtaaaggcgtgagt

SEQ ID NO: 8477675 - DNA, 22 bp, Homo sapiens
aagagaattctggttttcctat

SEQ ID NO: 8477676 - DNA, 22 bp, Homo sapiens
aagagaatgacaaggagaacct

SEQ ID NO: 8477677 - DNA, 22 bp, Homo sapiens
aagagacaatgtcttttggata

SEQ ID NO: 8477678 - DNA, 22 bp, Homo sapiens
aagagaatacaagcaggcagga

SEQ ID NO: 8477679 - DNA, 22 bp, Homo sapiens
aagagaaggtgaggaagccggt

SEQ ID NO: 8477680 - DNA, 22 bp, Homo sapiens
aagagaatatcgatagcactct

SEQ ID NO: 8477681 - DNA, 22 bp, Homo sapiens
aagagaaggccctgacccaccc

SEQ ID NO: 8477682 - DNA, 22 bp, Homo sapiens
aagagaaggtgaggaagccggt

SEQ ID NO: 8477683 - DNA, 22 bp, Homo sapiens
aagagaaggattctgagcctgg

SEQ ID NO: 8477684 - DNA, 22 bp, Homo sapiens
aagagcagcctccaggggtgga

SEQ ID NO: 8477685 - DNA, 22 bp, Homo sapiens
aagagcagcctccaggggtgga

SEQ ID NO: 8477686 - DNA, 22 bp, Homo sapiens
aagagcagcctccaggggtgga

SEQ ID NO: 8477687 - DNA, 22 bp, Homo sapiens
aagagcagaagtccttggatcc

SEQ ID NO: 8477688 - DNA, 22 bp, Homo sapiens
aagagcactaacagagctgata

SEQ ID NO: 8477689 - DNA, 22 bp, Homo sapiens
aagagcactaacagagctgata

SEQ ID NO: 8477690 - DNA, 22 bp, Homo sapiens
acacaaattgtaggataattgc

SEQ ID NO: 8477691 - DNA, 22 bp, Homo sapiens
aagagcaacttggaaacactca

SEQ ID NO: 8477692 - DNA, 22 bp, Homo sapiens
aagagcaacttggaaacactca

SEQ ID NO: 8477693 - DNA, 22 bp, Homo sapiens
acacaaactgctagaaaattgg

SEQ ID NO: 8477694 - DNA, 22 bp, Homo sapiens
acacaaagttggatgacaaaat

SEQ ID NO: 8477695 - DNA, 21 bp, Homo sapiens
acacaaacctcctcagcctgg

SEQ ID NO: 8477696 - DNA, 22 bp, Homo sapiens
acacaaacagtctatagcacca

SEQ ID NO: 8477697 - DNA, 22 bp, Homo sapiens
acacaaactgctagaaaattgg

SEQ ID NO: 8477698 - DNA, 22 bp, Homo sapiens
acacaaacagtctatagcacca

SEQ ID NO: 8477699 - DNA, 22 bp, Homo sapiens
acacaaacagtctatagcacca

SEQ ID NO: 8477700 - DNA, 21 bp, Homo sapiens
acagcagagatcaagactaag

SEQ ID NO: 8477701 - DNA, 21 bp, Homo sapiens
acagcagagatcaagactaag

SEQ ID NO: 8477702 - DNA, 22 bp, Homo sapiens
acagcagagcaccagggccact

SEQ ID NO: 8477703 - DNA, 21 bp, Homo sapiens
acagcagagatcaagactaag

SEQ ID NO: 8477704 - DNA, 22 bp, Homo sapiens
acagcagagccagtggctctag

SEQ ID NO: 8477705 - DNA, 22 bp, Homo sapiens
acagcagagccagtggctctag

SEQ ID NO: 8477706 - DNA, 22 bp, Homo sapiens
acagcagagacactcaggaggc

SEQ ID NO: 8477707 - DNA, 22 bp, Homo sapiens
acagcagagaactttagagggt

SEQ ID NO: 8477708 - DNA, 22 bp, Homo sapiens
acagcagagacactcaggaggc

SEQ ID NO: 8477709 - DNA, 22 bp, Homo sapiens
acagcagagacactcaggaggc

SEQ ID NO: 8477710 - DNA, 22 bp, Homo sapiens
acagcagagacactcaggaggc

SEQ ID NO: 8477711 - DNA, 22 bp, Homo sapiens
acagcagagacactcaggaggc

SEQ ID NO: 8477712 - DNA, 22 bp, Homo sapiens
aagcagaggtagggtgtgcagt

SEQ ID NO: 8477713 - DNA, 22 bp, Homo sapiens
aagcagagggtatggccaggtt

SEQ ID NO: 8477714 - DNA, 22 bp, Homo sapiens
acagcaaaagacaagaacttaa

SEQ ID NO: 8477715 - DNA, 22 bp, Homo sapiens
acagcaaaagacaagaacttaa

SEQ ID NO: 8477716 - DNA, 22 bp, Homo sapiens
acagcaaaagacaagaacttaa

SEQ ID NO: 8477717 - DNA, 22 bp, Homo sapiens
aagcagaggaccgacggaggga

SEQ ID NO: 8477718 - DNA, 22 bp, Homo sapiens
aagcagcttaaattagagcctg

SEQ ID NO: 8477719 - DNA, 22 bp, Homo sapiens
aagcagcttaaattagagcctg

SEQ ID NO: 8477720 - DNA, 22 bp, Homo sapiens
aagcagcttaaattagagcctg

SEQ ID NO: 8477721 - DNA, 22 bp, Homo sapiens
aagcagcttaaattagagcctg

SEQ ID NO: 8477722 - DNA, 22 bp, Homo sapiens
aagcagctgtgtgacataatct

SEQ ID NO: 8477723 - DNA, 22 bp, Homo sapiens
acagcagaggaaaagtctgata

SEQ ID NO: 8477724 - DNA, 22 bp, Homo sapiens
acagcagaggaaaagtctgata

SEQ ID NO: 8477725 - DNA, 22 bp, Homo sapiens
acagcagagtagttttccaact

SEQ ID NO: 8477726 - DNA, 22 bp, Homo sapiens
acagcagagtggagatgagcac

SEQ ID NO: 8477727 - DNA, 22 bp, Homo sapiens
acagcctggactggctctctgc

SEQ ID NO: 8477728 - DNA, 22 bp, Homo sapiens
acagccagggcattgtcgccga

SEQ ID NO: 8477729 - DNA, 22 bp, Homo sapiens
aagcagcttccccaaagtgcct

SEQ ID NO: 8477730 - DNA, 22 bp, Homo sapiens
aagcagcttccctggctcctgg

SEQ ID NO: 8477731 - DNA, 22 bp, Homo sapiens
aagcagctttctttcctgtgaa

SEQ ID NO: 8477732 - DNA, 22 bp, Homo sapiens
aagcagctttctttcctgtgaa

SEQ ID NO: 8477733 - DNA, 22 bp, Homo sapiens
aagcagcttttgaagagtgagg

SEQ ID NO: 8477734 - DNA, 22 bp, Homo sapiens
aagcagagccaccagctttgga

SEQ ID NO: 8477735 - DNA, 22 bp, Homo sapiens
aagcagagcctgagacagggat

SEQ ID NO: 8477736 - DNA, 22 bp, Homo sapiens
aagcagaagttgatctaccata

SEQ ID NO: 8477737 - DNA, 22 bp, Homo sapiens
aagcagaaggggaataatattt

SEQ ID NO: 8477738 - DNA, 20 bp, Homo sapiens
aagcagaagctgctctcagc

SEQ ID NO: 8477739 - DNA, 22 bp, Homo sapiens
aagcagaatttaatagaaaggt

SEQ ID NO: 8477740 - DNA, 22 bp, Homo sapiens
aagcagaatttcccactagttg

SEQ ID NO: 8477741 - DNA, 18 bp, Homo sapiens
aagcagacagcagacagt

SEQ ID NO: 8477742 - DNA, 23 bp, Homo sapiens
aagcaatgctgagccagttctga

SEQ ID NO: 8477743 - DNA, 22 bp, Homo sapiens
aagcaatgtgttaatgaatgag

SEQ ID NO: 8477744 - DNA, 22 bp, Homo sapiens
aagcaatgtgttaatgaatgag

SEQ ID NO: 8477745 - DNA, 19 bp, Homo sapiens
aagcaatgttgtgaatcta

SEQ ID NO: 8477746 - DNA, 22 bp, Homo sapiens
aagcaatgtgtttgaaaggcca

SEQ ID NO: 8477747 - DNA, 22 bp, Homo sapiens
aagcaatgttagaggccttagg

SEQ ID NO: 8477748 - DNA, 22 bp, Homo sapiens
aagcacaatgaacatcttagat

SEQ ID NO: 8477749 - DNA, 22 bp, Homo sapiens
aagcaattcacagttcacttaa

SEQ ID NO: 8477750 - DNA, 19 bp, Homo sapiens
aagcaatgttgtgaatcta

SEQ ID NO: 8477751 - DNA, 22 bp, Homo sapiens
aagcacccaatttacagcagtt

SEQ ID NO: 8477752 - DNA, 22 bp, Homo sapiens
aagcacctctatgattgctttt

SEQ ID NO: 8477753 - DNA, 22 bp, Homo sapiens
aagcagaactgggaagtagtgg

SEQ ID NO: 8477754 - DNA, 22 bp, Homo sapiens
aagcacacatctctggctgggt

SEQ ID NO: 8477755 - DNA, 22 bp, Homo sapiens
aagcacacctccctggcaggag

SEQ ID NO: 8477756 - DNA, 22 bp, Homo sapiens
aagcacacagcaaaggggagct

SEQ ID NO: 8477757 - DNA, 22 bp, Homo sapiens
aagagcaggacagaatcagaac

SEQ ID NO: 8477758 - DNA, 22 bp, Homo sapiens
aagagcaggctgctgtggagta

SEQ ID NO: 8477759 - DNA, 22 bp, Homo sapiens
aagagcaggctgctgtggagta

SEQ ID NO: 8477760 - DNA, 22 bp, Homo sapiens
aagagcaggctgtcaatggggc

SEQ ID NO: 8477761 - DNA, 22 bp, Homo sapiens
aagagcaggctgtcaatggggc

SEQ ID NO: 8477762 - DNA, 22 bp, Homo sapiens
acacatcttagactgaaatatg

SEQ ID NO: 8477763 - DNA, 22 bp, Homo sapiens
acacatatatgtcgaagtcctc

SEQ ID NO: 8477764 - DNA, 22 bp, Homo sapiens
acacatatatacatatttgtgc

SEQ ID NO: 8477765 - DNA, 22 bp, Homo sapiens
acacatgaaagacattaaggtg

SEQ ID NO: 8477766 - DNA, 22 bp, Homo sapiens
acacatgaaagacattaaggtg

SEQ ID NO: 8477767 - DNA, 22 bp, Homo sapiens
acacatgaatcactggtggaag

SEQ ID NO: 8477768 - DNA, 22 bp, Homo sapiens
acacatgaatcactggtggaag

SEQ ID NO: 8477769 - DNA, 22 bp, Homo sapiens
acacatgaaataatattatgca

SEQ ID NO: 8477770 - DNA, 22 bp, Homo sapiens
acacatgaaagacattaaggtg

SEQ ID NO: 8477771 - DNA, 22 bp, Homo sapiens
acacatgacctccgcagcagca

SEQ ID NO: 8477772 - DNA, 22 bp, Homo sapiens
acacatgacctccgcagcagca

SEQ ID NO: 8477773 - DNA, 22 bp, Homo sapiens
acacatgagaaacatcagttgt

SEQ ID NO: 8477774 - DNA, 22 bp, Homo sapiens
acacatgagaaacatcagttgt

SEQ ID NO: 8477775 - DNA, 22 bp, Homo sapiens
acacatgagaaacatcagttgt

SEQ ID NO: 8477776 - DNA, 22 bp, Homo sapiens
acacatgagttctcatcttgtg

SEQ ID NO: 8477777 - DNA, 22 bp, Homo sapiens
acacatgagttctcatcttgtg

SEQ ID NO: 8477778 - DNA, 22 bp, Homo sapiens
acacatgaggaaggcctcaccc

SEQ ID NO: 8477779 - DNA, 22 bp, Homo sapiens
acacatgaggaaggcctcaccc

SEQ ID NO: 8477780 - DNA, 22 bp, Homo sapiens
acacatgaggatgaggggatca

SEQ ID NO: 8477781 - DNA, 19 bp, Homo sapiens
acacatgaggagggacccc

SEQ ID NO: 8477782 - DNA, 22 bp, Homo sapiens
acacatgcaggtatacatgttc

SEQ ID NO: 8477783 - DNA, 20 bp, Homo sapiens
acacatgcatagagagagag

SEQ ID NO: 8477784 - DNA, 20 bp, Homo sapiens
acacatgcatagagagagag

SEQ ID NO: 8477785 - DNA, 22 bp, Homo sapiens
acacatgcataagccttccctt

SEQ ID NO: 8477786 - DNA, 22 bp, Homo sapiens
acacatgctcataaataaatag

SEQ ID NO: 8477787 - DNA, 20 bp, Homo sapiens
acacatgcattcatgtgggc

SEQ ID NO: 8477788 - DNA, 22 bp, Homo sapiens
acacatgctcataaataaatag

SEQ ID NO: 8477789 - DNA, 22 bp, Homo sapiens
acacatgctcataaataaatag

SEQ ID NO: 8477790 - DNA, 22 bp, Homo sapiens
acacatgcaggtatacatgttc

SEQ ID NO: 8477791 - DNA, 22 bp, Homo sapiens
acacatgcaggtatacatgttc

SEQ ID NO: 8477792 - DNA, 22 bp, Homo sapiens
acacatgcacaacagttctttc

SEQ ID NO: 8477793 - DNA, 22 bp, Homo sapiens
acacatgattaatgccaagcat

SEQ ID NO: 8477794 - DNA, 22 bp, Homo sapiens
acacatgataagaaagtttaaa

SEQ ID NO: 8477795 - DNA, 22 bp, Homo sapiens
acacatgataagaaagtttaaa

SEQ ID NO: 8477796 - DNA, 22 bp, Homo sapiens
acacatgataagaaagtttaaa

SEQ ID NO: 8477797 - DNA, 22 bp, Homo sapiens
aagatccttctcactgcagtgt

SEQ ID NO: 8477798 - DNA, 22 bp, Homo sapiens
acacatttctaaatttttaccg

SEQ ID NO: 8477799 - DNA, 22 bp, Homo sapiens
aagatatagataaaactatgca

SEQ ID NO: 8477800 - DNA, 22 bp, Homo sapiens
aagatgaaaatttactgtgatg

SEQ ID NO: 8477801 - DNA, 22 bp, Homo sapiens
acacatttctaaatttttaccg

SEQ ID NO: 8477802 - DNA, 22 bp, Homo sapiens
acacatttatggatcgcagaaa

SEQ ID NO: 8477803 - DNA, 22 bp, Homo sapiens
acacatttatggatcgcagaaa

SEQ ID NO: 8477804 - DNA, 22 bp, Homo sapiens
acacattgcagacatctcatta

SEQ ID NO: 8477805 - DNA, 22 bp, Homo sapiens
acacatttacatgtttacgtat

SEQ ID NO: 8477806 - DNA, 22 bp, Homo sapiens
acacattatgagcagttgtctt

SEQ ID NO: 8477807 - DNA, 21 bp, Homo sapiens
acacattatgagcatagactc

SEQ ID NO: 8477808 - DNA, 21 bp, Homo sapiens
acacattatgagcatagactc

SEQ ID NO: 8477809 - DNA, 22 bp, Homo sapiens
acacattcctgcagacatgatg

SEQ ID NO: 8477810 - DNA, 22 bp, Homo sapiens
acacattcctgcagacatgatg

SEQ ID NO: 8477811 - DNA, 22 bp, Homo sapiens
acacattcatgagtgcatgcac

SEQ ID NO: 8477812 - DNA, 22 bp, Homo sapiens
acacatgctgataagaatataa

SEQ ID NO: 8477813 - DNA, 19 bp, Homo sapiens
acacatgctcctggagcct

SEQ ID NO: 8477814 - DNA, 19 bp, Homo sapiens
acacatgctcctggagcct

SEQ ID NO: 8477815 - DNA, 22 bp, Homo sapiens
acacatgctgataagaatataa

SEQ ID NO: 8477816 - DNA, 22 bp, Homo sapiens
acacattatgagcagttgtctt

SEQ ID NO: 8477817 - DNA, 22 bp, Homo sapiens
aagatgtatcagttaagtcttc

SEQ ID NO: 8477818 - DNA, 22 bp, Homo sapiens
aagatggtaaggcagctggcag

SEQ ID NO: 8477819 - DNA, 21 bp, Homo sapiens
aagatggttatgtgctaaaga

SEQ ID NO: 8477820 - DNA, 22 bp, Homo sapiens
aagatgtgaaattgtctctggg

SEQ ID NO: 8477821 - DNA, 23 bp, Homo sapiens
aagatgtatttttaccaaatgtc

SEQ ID NO: 8477822 - DNA, 22 bp, Homo sapiens
aagatgcttccactgcagtggc

SEQ ID NO: 8477823 - DNA, 22 bp, Homo sapiens
aagatgcttgcaaatttctgaa

SEQ ID NO: 8477824 - DNA, 22 bp, Homo sapiens
aagatgcttattgctcctgcag

SEQ ID NO: 8477825 - DNA, 22 bp, Homo sapiens
aagatgctggcaggaatagcta

SEQ ID NO: 8477826 - DNA, 22 bp, Homo sapiens
aagatgatgttgtgttttcact

SEQ ID NO: 8477827 - DNA, 22 bp, Homo sapiens
aagatgataggacttgcttaag

SEQ ID NO: 8477828 - DNA, 22 bp, Homo sapiens
aagatgataggacttgcttaag

SEQ ID NO: 8477829 - DNA, 22 bp, Homo sapiens
aagatgatagatctgtcaatgt

SEQ ID NO: 8477830 - DNA, 22 bp, Homo sapiens
aagatgcagctttacaataagg

SEQ ID NO: 8477831 - DNA, 22 bp, Homo sapiens
aagatgcatgctgaagctggct

SEQ ID NO: 8477832 - DNA, 22 bp, Homo sapiens
aagatgcctgtagcaggaagat

SEQ ID NO: 8477833 - DNA, 22 bp, Homo sapiens
aagatgcggttgaccatggtgt

SEQ ID NO: 8477834 - DNA, 22 bp, Homo sapiens
aagatgcggttgaccatggtgt

SEQ ID NO: 8477835 - DNA, 22 bp, Homo sapiens
aagatgctaattgtggaagttg

SEQ ID NO: 8477836 - DNA, 22 bp, Homo sapiens
aagatgcagcaaactacttttt

SEQ ID NO: 8477837 - DNA, 22 bp, Homo sapiens
aagatgcagctttacaataagg

SEQ ID NO: 8477838 - DNA, 22 bp, Homo sapiens
aagatgcagcttccacttttgc

SEQ ID NO: 8477839 - DNA, 22 bp, Homo sapiens
aagcaagctgttggcaataggg

SEQ ID NO: 8477840 - DNA, 22 bp, Homo sapiens
aagcaaggcaacctatgtccag

SEQ ID NO: 8477841 - DNA, 22 bp, Homo sapiens
aagcaaggcccagagcatcagc

SEQ ID NO: 8477842 - DNA, 22 bp, Homo sapiens
aagcaaggcccagagcatcagc

SEQ ID NO: 8477843 - DNA, 22 bp, Homo sapiens
aagcaaggccggaaggaaactc

SEQ ID NO: 8477844 - DNA, 22 bp, Homo sapiens
aagcaataaataatttttagta

SEQ ID NO: 8477845 - DNA, 22 bp, Homo sapiens
aagatgtgctatcaactggaga

SEQ ID NO: 8477846 - DNA, 22 bp, Homo sapiens
aagatgtgtctcatcagggtgt

SEQ ID NO: 8477847 - DNA, 22 bp, Homo sapiens
aagcaagacagaagttactgcc

SEQ ID NO: 8477848 - DNA, 22 bp, Homo sapiens
aagcaaagacagtttgagtgga

SEQ ID NO: 8477849 - DNA, 22 bp, Homo sapiens
aagcaaagagataaccttttgg

SEQ ID NO: 8477850 - DNA, 22 bp, Homo sapiens
aagcaagacagaagttactgcc

SEQ ID NO: 8477851 - DNA, 22 bp, Homo sapiens
aacatgaaaacctccacagcaa

SEQ ID NO: 8477852 - DNA, 22 bp, Homo sapiens
aacatctttttgtttgctgaaa

SEQ ID NO: 8477853 - DNA, 22 bp, Homo sapiens
aatacatgttttctactattct

SEQ ID NO: 8477854 - DNA, 22 bp, Homo sapiens
aacatgaaaagcccagagaggt

SEQ ID NO: 8477855 - DNA, 22 bp, Homo sapiens
aacatgaaaagcccagagaggt

SEQ ID NO: 8477856 - DNA, 22 bp, Homo sapiens
aacatgaaaagcccagagaggt

SEQ ID NO: 8477857 - DNA, 22 bp, Homo sapiens
aacatcttcagagaagctaagt

SEQ ID NO: 8477858 - DNA, 22 bp, Homo sapiens
aacatcttgtactgcacatttt

SEQ ID NO: 8477859 - DNA, 22 bp, Homo sapiens
aacatcttgtccttagattaaa

SEQ ID NO: 8477860 - DNA, 22 bp, Homo sapiens
aacatcttgtccttagattaaa

SEQ ID NO: 8477861 - DNA, 22 bp, Homo sapiens
aacatcttgtccttagattaaa

SEQ ID NO: 8477862 - DNA, 22 bp, Homo sapiens
aacatctcagaagtgaccctga

SEQ ID NO: 8477863 - DNA, 22 bp, Homo sapiens
aacatctcatggactacattct

SEQ ID NO: 8477864 - DNA, 22 bp, Homo sapiens
aacatctagttcctatataata

SEQ ID NO: 8477865 - DNA, 22 bp, Homo sapiens
aacatctaggttctcatcgata

SEQ ID NO: 8477866 - DNA, 22 bp, Homo sapiens
aacatctccaacctacatccac

SEQ ID NO: 8477867 - DNA, 22 bp, Homo sapiens
aacatctctgtattttatagac

SEQ ID NO: 8477868 - DNA, 22 bp, Homo sapiens
aacatctccaacctacatccac

SEQ ID NO: 8477869 - DNA, 22 bp, Homo sapiens
aacatctgtgaactccgaaaat

SEQ ID NO: 8477870 - DNA, 22 bp, Homo sapiens
aacatgtagcagaaacgactaa

SEQ ID NO: 8477871 - DNA, 22 bp, Homo sapiens
aacatgtacctacaatcagaat

SEQ ID NO: 8477872 - DNA, 22 bp, Homo sapiens
aacatgtagcagaaacgactaa

SEQ ID NO: 8477873 - DNA, 22 bp, Homo sapiens
aacatgtagcagaaacgactaa

SEQ ID NO: 8477874 - DNA, 22 bp, Homo sapiens
aacatgtatcgctttttaatat

SEQ ID NO: 8477875 - DNA, 22 bp, Homo sapiens
aacatgtctgggtattcacaag

SEQ ID NO: 8477876 - DNA, 22 bp, Homo sapiens
aacatgtattttccttggcaac

SEQ ID NO: 8477877 - DNA, 22 bp, Homo sapiens
aacatgtcttactttgctttct

SEQ ID NO: 8477878 - DNA, 22 bp, Homo sapiens
aacatgtctttagagaaacatt

SEQ ID NO: 8477879 - DNA, 22 bp, Homo sapiens
aacatgtcttactttgctttct

SEQ ID NO: 8477880 - DNA, 22 bp, Homo sapiens
aacatgtctgggtattcacaag

SEQ ID NO: 8477881 - DNA, 22 bp, Homo sapiens
aacatgtctgggtattcacaag

SEQ ID NO: 8477882 - DNA, 22 bp, Homo sapiens
aacatgtcttactttgctttct

SEQ ID NO: 8477883 - DNA, 22 bp, Homo sapiens
aacatgtctttagagaaacatt

SEQ ID NO: 8477884 - DNA, 22 bp, Homo sapiens
aacatgtacctacaatcagaat

SEQ ID NO: 8477885 - DNA, 22 bp, Homo sapiens
aacatgtaaccagcattcatct

SEQ ID NO: 8477886 - DNA, 22 bp, Homo sapiens
aacatgtaaccagcattcatct

SEQ ID NO: 8477887 - DNA, 22 bp, Homo sapiens
aatagcaaacactggtaaagtt

SEQ ID NO: 8477888 - DNA, 22 bp, Homo sapiens
aatagattcatggttaagagca

SEQ ID NO: 8477889 - DNA, 22 bp, Homo sapiens
aatagactccagggtctatttt

SEQ ID NO: 8477890 - DNA, 22 bp, Homo sapiens
aatagacaattctagccaacat

SEQ ID NO: 8477891 - DNA, 22 bp, Homo sapiens
aatagatactacttagatgtag

SEQ ID NO: 8477892 - DNA, 22 bp, Homo sapiens
aatagatactacttagatgtag

SEQ ID NO: 8477893 - DNA, 22 bp, Homo sapiens
aatagatactacttagatgtag

SEQ ID NO: 8477894 - DNA, 22 bp, Homo sapiens
aagtgtaaattcacagacttca

SEQ ID NO: 8477895 - DNA, 22 bp, Homo sapiens
aagtggttttaagaggttcctt

SEQ ID NO: 8477896 - DNA, 23 bp, Homo sapiens
aagtggttttgaacccggaccct

SEQ ID NO: 8477897 - DNA, 22 bp, Homo sapiens
aagtggtttgattcagtttatg

SEQ ID NO: 8477898 - DNA, 21 bp, Homo sapiens
aagtggtttaggttaccgggg

SEQ ID NO: 8477899 - DNA, 21 bp, Homo sapiens
aagtggtttacatccagctgt

SEQ ID NO: 8477900 - DNA, 22 bp, Homo sapiens
aagtggttgcttgtgagtcccc

SEQ ID NO: 8477901 - DNA, 22 bp, Homo sapiens
aagtggtagacaaagataattg

SEQ ID NO: 8477902 - DNA, 22 bp, Homo sapiens
aagtggtaggaagagagcactg

SEQ ID NO: 8477903 - DNA, 22 bp, Homo sapiens
aagtggtaggaagagagcactg

SEQ ID NO: 8477904 - DNA, 22 bp, Homo sapiens
aagtggtgtgttggaagaaatc

SEQ ID NO: 8477905 - DNA, 22 bp, Homo sapiens
aagtggttattttgatctagaa

SEQ ID NO: 8477906 - DNA, 22 bp, Homo sapiens
aagtgtatatatgacttataaa

SEQ ID NO: 8477907 - DNA, 22 bp, Homo sapiens
aacagctaccttctcactgtgc

SEQ ID NO: 8477908 - DNA, 22 bp, Homo sapiens
aacagcctgagagaacaatgat

SEQ ID NO: 8477909 - DNA, 22 bp, Homo sapiens
aagtgtctagcacctggatgca

SEQ ID NO: 8477910 - DNA, 22 bp, Homo sapiens
aagtgtctagcacctggatgca

SEQ ID NO: 8477911 - DNA, 22 bp, Homo sapiens
aagtgtctacatttgctaacca

SEQ ID NO: 8477912 - DNA, 22 bp, Homo sapiens
aagtgtctaactggttacttct

SEQ ID NO: 8477913 - DNA, 22 bp, Homo sapiens
aacagctaccttctcactgtgc

SEQ ID NO: 8477914 - DNA, 22 bp, Homo sapiens
aacagctaccttctcactgtgc

SEQ ID NO: 8477915 - DNA, 22 bp, Homo sapiens
aacagctagtggtctagacttt

SEQ ID NO: 8477916 - DNA, 22 bp, Homo sapiens
aacagctagtaccaatccacta

SEQ ID NO: 8477917 - DNA, 22 bp, Homo sapiens
aacagctagtggtctagacttt

SEQ ID NO: 8477918 - DNA, 22 bp, Homo sapiens
aacagctagtaccaatccacta

SEQ ID NO: 8477919 - DNA, 22 bp, Homo sapiens
aacagctattagaacttcatgg

SEQ ID NO: 8477920 - DNA, 22 bp, Homo sapiens
aacagctattagaacttcatgg

SEQ ID NO: 8477921 - DNA, 22 bp, Homo sapiens
aacatctacagtgagatgttag

SEQ ID NO: 8477922 - DNA, 22 bp, Homo sapiens
aacatctactaagtgccaggca

SEQ ID NO: 8477923 - DNA, 22 bp, Homo sapiens
aacatccccttcatgtcatgat

SEQ ID NO: 8477924 - DNA, 22 bp, Homo sapiens
aacatcattatgtccattaatg

SEQ ID NO: 8477925 - DNA, 19 bp, Homo sapiens
aacatcatggctctttcca

SEQ ID NO: 8477926 - DNA, 22 bp, Homo sapiens
aacatcatcatgaacaactaat

SEQ ID NO: 8477927 - DNA, 22 bp, Homo sapiens
aacatcatcatgaacaactaat

SEQ ID NO: 8477928 - DNA, 22 bp, Homo sapiens
aacatcatcatgaacaactaat

SEQ ID NO: 8477929 - DNA, 22 bp, Homo sapiens
aacatcacaatttcatttatgc

SEQ ID NO: 8477930 - DNA, 22 bp, Homo sapiens
aacatcacaatttcatttatgc

SEQ ID NO: 8477931 - DNA, 22 bp, Homo sapiens
aacatcagaagtagaagactca

SEQ ID NO: 8477932 - DNA, 15 bp, Homo sapiens
aacatcactattttg

SEQ ID NO: 8477933 - DNA, 22 bp, Homo sapiens
aacatcagcacacaatagcaag

SEQ ID NO: 8477934 - DNA, 22 bp, Homo sapiens
aacatcagaagtagaagactca

SEQ ID NO: 8477935 - DNA, 22 bp, Homo sapiens
aacatcagaatatccatgttgg

SEQ ID NO: 8477936 - DNA, 22 bp, Homo sapiens
aacatcagtattctcatctgta

SEQ ID NO: 8477937 - DNA, 22 bp, Homo sapiens
aacatcaggatcttgttacagt

SEQ ID NO: 8477938 - DNA, 22 bp, Homo sapiens
aacatcaggatcttgttacagt

SEQ ID NO: 8477939 - DNA, 22 bp, Homo sapiens
aacagctgttcgcagatgtagg

SEQ ID NO: 8477940 - DNA, 22 bp, Homo sapiens
aacagcttactcaatggtgatt

SEQ ID NO: 8477941 - DNA, 22 bp, Homo sapiens
aacagcttagaaatgttgctaa

SEQ ID NO: 8477942 - DNA, 22 bp, Homo sapiens
aacagcttagaaatgttgctaa

SEQ ID NO: 8477943 - DNA, 22 bp, Homo sapiens
aacagcttcatcacatggcata

SEQ ID NO: 8477944 - DNA, 22 bp, Homo sapiens
aacagcttgagactggatatgc

SEQ ID NO: 8477945 - DNA, 22 bp, Homo sapiens
aacagcttcatcacatggcata

SEQ ID NO: 8477946 - DNA, 22 bp, Homo sapiens
aacataaatttgaagtggcaaa

SEQ ID NO: 8477947 - DNA, 22 bp, Homo sapiens
aacataaatttgaagtggcaaa

SEQ ID NO: 8477948 - DNA, 22 bp, Homo sapiens
aacatatcataggatgtcattg

SEQ ID NO: 8477949 - DNA, 22 bp, Homo sapiens
aacatatttggctgatattccc

SEQ ID NO: 8477950 - DNA, 22 bp, Homo sapiens
aacatatttggctgatattccc

SEQ ID NO: 8477951 - DNA, 22 bp, Homo sapiens
aacatatctacggatacgatta

SEQ ID NO: 8477952 - DNA, 22 bp, Homo sapiens
aacatatcataggatgtcattg

SEQ ID NO: 8477953 - DNA, 22 bp, Homo sapiens
aacatattcagatgccaagtcc

SEQ ID NO: 8477954 - DNA, 22 bp, Homo sapiens
aatgaacaacactgaaggaaga

SEQ ID NO: 8477955 - DNA, 23 bp, Homo sapiens
aacgacagctacaggcatcccac

SEQ ID NO: 8477956 - DNA, 22 bp, Homo sapiens
aatgaattcgagtgaaggaaag

SEQ ID NO: 8477957 - DNA, 22 bp, Homo sapiens
aatgaacaagaaagactttgag

SEQ ID NO: 8477958 - DNA, 22 bp, Homo sapiens
aacctttgaggggagctctttc

SEQ ID NO: 8477959 - DNA, 22 bp, Homo sapiens
aacctttatttggtactattct

SEQ ID NO: 8477960 - DNA, 22 bp, Homo sapiens
aacctttcaattatcctcatct

SEQ ID NO: 8477961 - DNA, 22 bp, Homo sapiens
aaccttttgcaagtgccttgac

SEQ ID NO: 8477962 - DNA, 22 bp, Homo sapiens
aacctgttccctggtccttgac

SEQ ID NO: 8477963 - DNA, 22 bp, Homo sapiens
aacctgtaaatccaaacaatct

SEQ ID NO: 8477964 - DNA, 22 bp, Homo sapiens
aacctgttttgattaacaagta

SEQ ID NO: 8477965 - DNA, 22 bp, Homo sapiens
aacctgttttggttgcatttca

SEQ ID NO: 8477966 - DNA, 22 bp, Homo sapiens
aacctgttttcttctcatctag

SEQ ID NO: 8477967 - DNA, 22 bp, Homo sapiens
aacctgttttcttctcatctag

SEQ ID NO: 8477968 - DNA, 22 bp, Homo sapiens
aacctggccctaatcccagtag

SEQ ID NO: 8477969 - DNA, 22 bp, Homo sapiens
aacctggccccagattccccat

SEQ ID NO: 8477970 - DNA, 22 bp, Homo sapiens
aacctggagtgctggtttcact

SEQ ID NO: 8477971 - DNA, 22 bp, Homo sapiens
aacctggaggctgtgtagtctt

SEQ ID NO: 8477972 - DNA, 22 bp, Homo sapiens
aacctggaggctgtgtagtctt

SEQ ID NO: 8477973 - DNA, 22 bp, Homo sapiens
aacctggaggactgcaatccat

SEQ ID NO: 8477974 - DNA, 22 bp, Homo sapiens
aacctggaggactgcaatccat

SEQ ID NO: 8477975 - DNA, 22 bp, Homo sapiens
aacctgagtcttttgatttgct

SEQ ID NO: 8477976 - DNA, 22 bp, Homo sapiens
aacctggaccttttgggtattg

SEQ ID NO: 8477977 - DNA, 22 bp, Homo sapiens
aacctggagcaccctcatatct

SEQ ID NO: 8477978 - DNA, 22 bp, Homo sapiens
aacctggagcaccctcatatct

SEQ ID NO: 8477979 - DNA, 21 bp, Homo sapiens
aacctgagacccacgggacta

SEQ ID NO: 8477980 - DNA, 22 bp, Homo sapiens
aacctgagatactggtctttat

SEQ ID NO: 8477981 - DNA, 22 bp, Homo sapiens
aacctgagatactggtctttat

SEQ ID NO: 8477982 - DNA, 22 bp, Homo sapiens
aacctgagcgcgttgctttcta

SEQ ID NO: 8477983 - DNA, 22 bp, Homo sapiens
aacctgagcgcgttgctttcta

SEQ ID NO: 8477984 - DNA, 20 bp, Homo sapiens
aacctgaggcagtgttccag

SEQ ID NO: 8477985 - DNA, 20 bp, Homo sapiens
aacctgaggcagtgttccag

SEQ ID NO: 8477986 - DNA, 22 bp, Homo sapiens
aacctgagtcttttgatttgct

SEQ ID NO: 8477987 - DNA, 22 bp, Homo sapiens
aacctgagtcttttgatttgct

SEQ ID NO: 8477988 - DNA, 22 bp, Homo sapiens
aacctgaagaaaatatttgctg

SEQ ID NO: 8477989 - DNA, 22 bp, Homo sapiens
aacctctttgtgaatgtcatga

SEQ ID NO: 8477990 - DNA, 22 bp, Homo sapiens
aacctgaaactacattcttgat

SEQ ID NO: 8477991 - DNA, 22 bp, Homo sapiens
aacctgaaagtagtaaaagctg

SEQ ID NO: 8477992 - DNA, 22 bp, Homo sapiens
aacctgaattacttttgcacca

SEQ ID NO: 8477993 - DNA, 22 bp, Homo sapiens
aacctgaatttaattgaaatga

SEQ ID NO: 8477994 - DNA, 22 bp, Homo sapiens
aacctgaatttaattgaaatga

SEQ ID NO: 8477995 - DNA, 23 bp, Homo sapiens
aacctgaactagggtcttgcata

SEQ ID NO: 8477996 - DNA, 22 bp, Homo sapiens
aaccctggccctggaataggca

SEQ ID NO: 8477997 - DNA, 22 bp, Homo sapiens
aaccctggggctgctctgcctg

SEQ ID NO: 8477998 - DNA, 22 bp, Homo sapiens
aaccctggggcagctgctaggg

SEQ ID NO: 8477999 - DNA, 22 bp, Homo sapiens
aaccgttttaccatttgtaact

SEQ ID NO: 8478000 - DNA, 22 bp, Homo sapiens
aacctaagtgctgttgaacgtt

SEQ ID NO: 8478001 - DNA, 22 bp, Homo sapiens
aacctagaagttagagtatcat

SEQ ID NO: 8478002 - DNA, 22 bp, Homo sapiens
aaccggagtgattcccacctct

SEQ ID NO: 8478003 - DNA, 22 bp, Homo sapiens
aaccctgggtcggcaccatttt

SEQ ID NO: 8478004 - DNA, 22 bp, Homo sapiens
aacctagacagggcctctgtta

SEQ ID NO: 8478005 - DNA, 22 bp, Homo sapiens
aacctagagttgccttttttaa

SEQ ID NO: 8478006 - DNA, 22 bp, Homo sapiens
aacctagagttgccttttttaa

SEQ ID NO: 8478007 - DNA, 22 bp, Homo sapiens
aacctaggactatagatatcat

SEQ ID NO: 8478008 - DNA, 23 bp, Homo sapiens
aacctagactacttactatgtgg

SEQ ID NO: 8478009 - DNA, 22 bp, Homo sapiens
aacctcaaactcttgggcttaa

SEQ ID NO: 8478010 - DNA, 22 bp, Homo sapiens
aacctcaaactcttgggcttaa

SEQ ID NO: 8478011 - DNA, 22 bp, Homo sapiens
aacctcgaatgccttcctgagg

SEQ ID NO: 8478012 - DNA, 22 bp, Homo sapiens
aacctctccctttgtgtccctg

SEQ ID NO: 8478013 - DNA, 16 bp, Homo sapiens
aacctctctactgtgg

SEQ ID NO: 8478014 - DNA, 22 bp, Homo sapiens
aacctctctgtgccctgacttt

SEQ ID NO: 8478015 - DNA, 22 bp, Homo sapiens
aacctgaaactacattcttgat

SEQ ID NO: 8478016 - DNA, 22 bp, Homo sapiens
aacctcaaactcttgggcttaa

SEQ ID NO: 8478017 - DNA, 22 bp, Homo sapiens
aacccgggaggcggaggttgtg

SEQ ID NO: 8478018 - DNA, 22 bp, Homo sapiens
aacccgggaggtggaggttatg

SEQ ID NO: 8478019 - DNA, 22 bp, Homo sapiens
aacccgggaggcggaggttgtg

SEQ ID NO: 8478020 - DNA, 22 bp, Homo sapiens
aaccatttgcagttactgagac

SEQ ID NO: 8478021 - DNA, 22 bp, Homo sapiens
aaccatttgccattatcttaag

SEQ ID NO: 8478022 - DNA, 22 bp, Homo sapiens
aacatgttgctttaataatatt

SEQ ID NO: 8478023 - DNA, 22 bp, Homo sapiens
aacatgttgctttaataatatt

SEQ ID NO: 8478024 - DNA, 22 bp, Homo sapiens
aacatgttgctttaataatatt

SEQ ID NO: 8478025 - DNA, 22 bp, Homo sapiens
aacatgttgagttgaaagtagc

SEQ ID NO: 8478026 - DNA, 22 bp, Homo sapiens
aacatgttgagttgaaagtagc

SEQ ID NO: 8478027 - DNA, 22 bp, Homo sapiens
aacatgttgagttgaaagtagc

SEQ ID NO: 8478028 - DNA, 22 bp, Homo sapiens
aacatgtgtcttgcatttcttg

SEQ ID NO: 8478029 - DNA, 22 bp, Homo sapiens
aacatgtgtcttgcatttcttg

SEQ ID NO: 8478030 - DNA, 22 bp, Homo sapiens
aacatgtgtctggctagattgt

SEQ ID NO: 8478031 - DNA, 22 bp, Homo sapiens
aactagaaccacttgtatttcc

SEQ ID NO: 8478032 - DNA, 19 bp, Homo sapiens
aactagaaaggttttgaga

SEQ ID NO: 8478033 - DNA, 22 bp, Homo sapiens
aactagaaccacttgtatttcc

SEQ ID NO: 8478034 - DNA, 22 bp, Homo sapiens
aactagaaagaacatatttcca

SEQ ID NO: 8478035 - DNA, 22 bp, Homo sapiens
aactagaaaacaagatgctgat

SEQ ID NO: 8478036 - DNA, 22 bp, Homo sapiens
aactactaccagtagtagtagt

SEQ ID NO: 8478037 - DNA, 22 bp, Homo sapiens
aatgacatgctttttaattata

SEQ ID NO: 8478038 - DNA, 22 bp, Homo sapiens
aatgacaagacatagtctctga

SEQ ID NO: 8478039 - DNA, 22 bp, Homo sapiens
aatgaattctgaagtcttccaa

SEQ ID NO: 8478040 - DNA, 22 bp, Homo sapiens
aatgacaaatatggaagcctga

SEQ ID NO: 8478041 - DNA, 22 bp, Homo sapiens
aatgacaatggcagaggtagaa

SEQ ID NO: 8478042 - DNA, 22 bp, Homo sapiens
aatgacagagcactgaacttgg

SEQ ID NO: 8478043 - DNA, 22 bp, Homo sapiens
aatgacagagatagaagggatg

SEQ ID NO: 8478044 - DNA, 22 bp, Homo sapiens
aatgacagagcactgaacttgg

SEQ ID NO: 8478045 - DNA, 22 bp, Homo sapiens
aatggctttaggaatccagtgc

SEQ ID NO: 8478046 - DNA, 22 bp, Homo sapiens
aatggctttcagcaaggataga

SEQ ID NO: 8478047 - DNA, 22 bp, Homo sapiens
aatggctttaagtagtctcaca

SEQ ID NO: 8478048 - DNA, 22 bp, Homo sapiens
aatggcttctttttggtataat

SEQ ID NO: 8478049 - DNA, 22 bp, Homo sapiens
aatggcttgcaaatgggtccat

SEQ ID NO: 8478050 - DNA, 22 bp, Homo sapiens
aatggcttcatgtctgtggaaa

SEQ ID NO: 8478051 - DNA, 22 bp, Homo sapiens
aatggcttctgaagcacacttt

SEQ ID NO: 8478052 - DNA, 22 bp, Homo sapiens
aatggcttctgaagcacacttt

SEQ ID NO: 8478053 - DNA, 22 bp, Homo sapiens
aatggcttatgtaatgctgttt

SEQ ID NO: 8478054 - DNA, 20 bp, Homo sapiens
aatggcttatagcatgctac

SEQ ID NO: 8478055 - DNA, 21 bp, Homo sapiens
aatggcttatacagaagtaag

SEQ ID NO: 8478056 - DNA, 22 bp, Homo sapiens
aatggcttaatgataccttatc

SEQ ID NO: 8478057 - DNA, 22 bp, Homo sapiens
aatggcttagcagagttagaag

SEQ ID NO: 8478058 - DNA, 22 bp, Homo sapiens
aatggcttaccctggattgtgt

SEQ ID NO: 8478059 - DNA, 22 bp, Homo sapiens
aatggcttagctcagcgctcag

SEQ ID NO: 8478060 - DNA, 22 bp, Homo sapiens
aatggcttagctcagcgctcag

SEQ ID NO: 8478061 - DNA, 22 bp, Homo sapiens
aatggcttagtgcttcacttct

SEQ ID NO: 8478062 - DNA, 22 bp, Homo sapiens
aatggcttagctcagcgctcag

SEQ ID NO: 8478063 - DNA, 22 bp, Homo sapiens
aatggcttaagtataagtgaga

SEQ ID NO: 8478064 - DNA, 22 bp, Homo sapiens
aatggcctttgagatgaaaggg

SEQ ID NO: 8478065 - DNA, 22 bp, Homo sapiens
aatggctctgatgttgttgtga

SEQ ID NO: 8478066 - DNA, 22 bp, Homo sapiens
aatggctgggagtgtattttgg

SEQ ID NO: 8478067 - DNA, 22 bp, Homo sapiens
aactagtaaaagcaacagtata

SEQ ID NO: 8478068 - DNA, 22 bp, Homo sapiens
aactagtcagtgattctcagaa

SEQ ID NO: 8478069 - DNA, 22 bp, Homo sapiens
aactagagcttccagcttcttg

SEQ ID NO: 8478070 - DNA, 22 bp, Homo sapiens
aactagaacgtctagttgctgg

SEQ ID NO: 8478071 - DNA, 22 bp, Homo sapiens
aactagtttagctttttaagac

SEQ ID NO: 8478072 - DNA, 22 bp, Homo sapiens
aatggcctgtatggaaagtgaa

SEQ ID NO: 8478073 - DNA, 22 bp, Homo sapiens
aatgctttcttataaccactgc

SEQ ID NO: 8478074 - DNA, 22 bp, Homo sapiens
aatgctttcttataaccactgc

SEQ ID NO: 8478075 - DNA, 22 bp, Homo sapiens
aaggcagcaccgcctcctgaaa

SEQ ID NO: 8478076 - DNA, 22 bp, Homo sapiens
aaggcagcaagaattccaggtt

SEQ ID NO: 8478077 - DNA, 22 bp, Homo sapiens
aaggcagatataaagactagag

SEQ ID NO: 8478078 - DNA, 22 bp, Homo sapiens
aaggcagatataaagactagag

SEQ ID NO: 8478079 - DNA, 22 bp, Homo sapiens
aaatgtctacttcccatctgta

SEQ ID NO: 8478080 - DNA, 22 bp, Homo sapiens
aaggcagcaactaatggatctc

SEQ ID NO: 8478081 - DNA, 22 bp, Homo sapiens
aaggcagcagtgcacgactgat

SEQ ID NO: 8478082 - DNA, 22 bp, Homo sapiens
aaggcagcaggatttggtgact

SEQ ID NO: 8478083 - DNA, 22 bp, Homo sapiens
aaggcagcagtgcacgactgat

SEQ ID NO: 8478084 - DNA, 22 bp, Homo sapiens
aaggcagccatagcaccatcca

SEQ ID NO: 8478085 - DNA, 22 bp, Homo sapiens
aaggcagccctggctcagcctg

SEQ ID NO: 8478086 - DNA, 22 bp, Homo sapiens
aaggcagccctggctcagcctg

SEQ ID NO: 8478087 - DNA, 22 bp, Homo sapiens
aaggcagccctggctcagcctg

SEQ ID NO: 8478088 - DNA, 22 bp, Homo sapiens
aaattattcaaaaagctgtgtt

SEQ ID NO: 8478089 - DNA, 22 bp, Homo sapiens
aaggctgagagtcacagtccta

SEQ ID NO: 8478090 - DNA, 22 bp, Homo sapiens
aaggctgagccagggcccctat

SEQ ID NO: 8478091 - DNA, 22 bp, Homo sapiens
aaggctgagccagggcccctat

SEQ ID NO: 8478092 - DNA, 22 bp, Homo sapiens
aaggctgggtaacctgtccact

SEQ ID NO: 8478093 - DNA, 22 bp, Homo sapiens
aaggctgggtaacctgtccact

SEQ ID NO: 8478094 - DNA, 22 bp, Homo sapiens
aaggctgggtttgggatgtgat

SEQ ID NO: 8478095 - DNA, 19 bp, Homo sapiens
aaggctggtaccataggtt

SEQ ID NO: 8478096 - DNA, 22 bp, Homo sapiens
aaggctggtcagatgtggtgaa

SEQ ID NO: 8478097 - DNA, 19 bp, Homo sapiens
aaggctggtaccataggtt

SEQ ID NO: 8478098 - DNA, 19 bp, Homo sapiens
aaggctggtaccataggtt

SEQ ID NO: 8478099 - DNA, 19 bp, Homo sapiens
aaggctggtaccataggtt

SEQ ID NO: 8478100 - DNA, 22 bp, Homo sapiens
aaattattttcagaatggagaa

SEQ ID NO: 8478101 - DNA, 22 bp, Homo sapiens
aaattattctcatgtgtttctt

SEQ ID NO: 8478102 - DNA, 23 bp, Homo sapiens
aaattattgctcttcaattgcct

SEQ ID NO: 8478103 - DNA, 22 bp, Homo sapiens
aaggaagagcaaagaattatgt

SEQ ID NO: 8478104 - DNA, 22 bp, Homo sapiens
aaggaagagaatccttctcaga

SEQ ID NO: 8478105 - DNA, 22 bp, Homo sapiens
aaggaagacttgagaaggttcc

SEQ ID NO: 8478106 - DNA, 22 bp, Homo sapiens
aaggaagacacagatgaagtga

SEQ ID NO: 8478107 - DNA, 22 bp, Homo sapiens
aaggaagacacagatgaagtga

SEQ ID NO: 8478108 - DNA, 22 bp, Homo sapiens
aaggaagacacagatgaagtga

SEQ ID NO: 8478109 - DNA, 22 bp, Homo sapiens
aaatgcatttcactaatgtttc

SEQ ID NO: 8478110 - DNA, 22 bp, Homo sapiens
aaatgcatttcactaatgtttc

SEQ ID NO: 8478111 - DNA, 22 bp, Homo sapiens
aaatgcatttttaattagaccc

SEQ ID NO: 8478112 - DNA, 22 bp, Homo sapiens
aaggaaagacaggacggaattc

SEQ ID NO: 8478113 - DNA, 22 bp, Homo sapiens
aaatgcattggtttctacttgt

SEQ ID NO: 8478114 - DNA, 22 bp, Homo sapiens
aaatgcattggtttctacttgt

SEQ ID NO: 8478115 - DNA, 22 bp, Homo sapiens
aaatgcattggtttctacttgt

SEQ ID NO: 8478116 - DNA, 22 bp, Homo sapiens
aaatgcattggtttctacttgt

SEQ ID NO: 8478117 - DNA, 22 bp, Homo sapiens
aaatgcatttcactaatgtttc

SEQ ID NO: 8478118 - DNA, 22 bp, Homo sapiens
aaatgcattaagtcagaacaat

SEQ ID NO: 8478119 - DNA, 22 bp, Homo sapiens
aaatgcattaagtcagaacaat

SEQ ID NO: 8478120 - DNA, 22 bp, Homo sapiens
aaatgcattaagtcagaacaat

SEQ ID NO: 8478121 - DNA, 22 bp, Homo sapiens
aaatgcattaagtcagaacaat

SEQ ID NO: 8478122 - DNA, 22 bp, Homo sapiens
aaatgcattctgttttcactag

SEQ ID NO: 8478123 - DNA, 22 bp, Homo sapiens
aaatgcattctgttttcactag

SEQ ID NO: 8478124 - DNA, 22 bp, Homo sapiens
aaatgcattctgttttcactag

SEQ ID NO: 8478125 - DNA, 22 bp, Homo sapiens
aaatgcatgtatgtaatatgct

SEQ ID NO: 8478126 - DNA, 22 bp, Homo sapiens
aaatgcatgtatgtaatatgct

SEQ ID NO: 8478127 - DNA, 22 bp, Homo sapiens
aaatgcatgtgctatagatgtg

SEQ ID NO: 8478128 - DNA, 22 bp, Homo sapiens
aaatgcatgtgctatagatgtg

SEQ ID NO: 8478129 - DNA, 22 bp, Homo sapiens
aaatgtcaaggtgatagatgca

SEQ ID NO: 8478130 - DNA, 22 bp, Homo sapiens
aaatgtcaaggtgatagatgca

SEQ ID NO: 8478131 - DNA, 22 bp, Homo sapiens
aaggaagatatatcaagcttaa

SEQ ID NO: 8478132 - DNA, 22 bp, Homo sapiens
aaggaagagtctagaacaggca

SEQ ID NO: 8478133 - DNA, 22 bp, Homo sapiens
aaatgtcatatttaagtaggaa

SEQ ID NO: 8478134 - DNA, 22 bp, Homo sapiens
aaatgtccattgaatggatgag

SEQ ID NO: 8478135 - DNA, 22 bp, Homo sapiens
aaatgtcctgagattcaactta

SEQ ID NO: 8478136 - DNA, 22 bp, Homo sapiens
aaatgtccttagagaaaagtca

SEQ ID NO: 8478137 - DNA, 22 bp, Homo sapiens
aaatgtcagaagctttacttct

SEQ ID NO: 8478138 - DNA, 22 bp, Homo sapiens
aaatgtcagaggaacatattga

SEQ ID NO: 8478139 - DNA, 22 bp, Homo sapiens
aaatgtcagaaaacatggagtg

SEQ ID NO: 8478140 - DNA, 22 bp, Homo sapiens
aaatgtcagaaaacatggagtg

SEQ ID NO: 8478141 - DNA, 22 bp, Homo sapiens
aaatgtcagaaaacatggagtg

SEQ ID NO: 8478142 - DNA, 22 bp, Homo sapiens
aaatgtcagaagctttacttct

SEQ ID NO: 8478143 - DNA, 22 bp, Homo sapiens
aaatgtcagaagctttacttct

SEQ ID NO: 8478144 - DNA, 20 bp, Homo sapiens
aacacactggtggcatcagg

SEQ ID NO: 8478145 - DNA, 20 bp, Homo sapiens
aacacactggtggcatcagg

SEQ ID NO: 8478146 - DNA, 22 bp, Homo sapiens
aacacaatcttccagtttgctg

SEQ ID NO: 8478147 - DNA, 22 bp, Homo sapiens
aacacagacatagtgattacag

SEQ ID NO: 8478148 - DNA, 22 bp, Homo sapiens
aacacagaagtgccaagagcca

SEQ ID NO: 8478149 - DNA, 22 bp, Homo sapiens
aacacagagtatttgaagcatt

SEQ ID NO: 8478150 - DNA, 22 bp, Homo sapiens
aacacagacatagtgattacag

SEQ ID NO: 8478151 - DNA, 22 bp, Homo sapiens
aacacagacatagtgattacag

SEQ ID NO: 8478152 - DNA, 20 bp, Homo sapiens
aacacagataccaaaggttg

SEQ ID NO: 8478153 - DNA, 20 bp, Homo sapiens
aacacagataccaaaggttg

SEQ ID NO: 8478154 - DNA, 22 bp, Homo sapiens
aacacagggggttacaaattgt

SEQ ID NO: 8478155 - DNA, 22 bp, Homo sapiens
aacacagggactcccaggagaa

SEQ ID NO: 8478156 - DNA, 22 bp, Homo sapiens
aacacaggccagcctgtgcagt

SEQ ID NO: 8478157 - DNA, 22 bp, Homo sapiens
aacacagctaatttctgtcaat

SEQ ID NO: 8478158 - DNA, 22 bp, Homo sapiens
aacacagatcaaaatatttcct

SEQ ID NO: 8478159 - DNA, 22 bp, Homo sapiens
aacacagatcaaaatatttcct

SEQ ID NO: 8478160 - DNA, 22 bp, Homo sapiens
aacacagctaatttctgtcaat

SEQ ID NO: 8478161 - DNA, 22 bp, Homo sapiens
aacacagatcaaaatatttcct

SEQ ID NO: 8478162 - DNA, 22 bp, Homo sapiens
aacacagatcaaaatatttcct

SEQ ID NO: 8478163 - DNA, 22 bp, Homo sapiens
aaggctggttccatccctggtg

SEQ ID NO: 8478164 - DNA, 22 bp, Homo sapiens
aaggctggtggattatgaggtc

SEQ ID NO: 8478165 - DNA, 22 bp, Homo sapiens
aaggctggtggattatgaggtc

SEQ ID NO: 8478166 - DNA, 22 bp, Homo sapiens
aaatttctaagtcaagaagaac

SEQ ID NO: 8478167 - DNA, 22 bp, Homo sapiens
aaggctggtttccttgatgttt

SEQ ID NO: 8478168 - DNA, 22 bp, Homo sapiens
aaggctggttccatccctggtg

SEQ ID NO: 8478169 - DNA, 22 bp, Homo sapiens
aaatttctaagtcaagaagaac

SEQ ID NO: 8478170 - DNA, 22 bp, Homo sapiens
aaatttctaagtcaagaagaac

SEQ ID NO: 8478171 - DNA, 22 bp, Homo sapiens
aaatttctggaagtgtcagagt

SEQ ID NO: 8478172 - DNA, 22 bp, Homo sapiens
aaatttctggaagtgtcagagt

SEQ ID NO: 8478173 - DNA, 22 bp, Homo sapiens
aacaatgtctcatcctatgtgg

SEQ ID NO: 8478174 - DNA, 22 bp, Homo sapiens
aacaatgtcctgtgagatgata

SEQ ID NO: 8478175 - DNA, 22 bp, Homo sapiens
aaattttaaggctggaacttaa

SEQ ID NO: 8478176 - DNA, 22 bp, Homo sapiens
aaattttaaggctggaacttaa

SEQ ID NO: 8478177 - DNA, 22 bp, Homo sapiens
aacaatgcttgccaagtgtgat

SEQ ID NO: 8478178 - DNA, 22 bp, Homo sapiens
aaatttgataagccattgttac

SEQ ID NO: 8478179 - DNA, 22 bp, Homo sapiens
aaatttgataagccattgttac

SEQ ID NO: 8478180 - DNA, 22 bp, Homo sapiens
aaatttctgttgttttgagcca

SEQ ID NO: 8478181 - DNA, 22 bp, Homo sapiens
aaatttctgttgttttgagcca

SEQ ID NO: 8478182 - DNA, 22 bp, Homo sapiens
aacagaattgtacaccagggag

SEQ ID NO: 8478183 - DNA, 22 bp, Homo sapiens
aacagaattgctgctgccaatg

SEQ ID NO: 8478184 - DNA, 22 bp, Homo sapiens
aacagaattgctgctgccaatg

SEQ ID NO: 8478185 - DNA, 22 bp, Homo sapiens
aacagaatgcaggggatgctgc

SEQ ID NO: 8478186 - DNA, 22 bp, Homo sapiens
aacagacaactcctgtggctca

SEQ ID NO: 8478187 - DNA, 22 bp, Homo sapiens
aacagacaactcctgtggctca

SEQ ID NO: 8478188 - DNA, 22 bp, Homo sapiens
aacagacaactcctgtggctca

SEQ ID NO: 8478189 - DNA, 22 bp, Homo sapiens
aacagacagaaaaatgtgatct

SEQ ID NO: 8478190 - DNA, 22 bp, Homo sapiens
aacagacagaaaaatgtgatct

SEQ ID NO: 8478191 - DNA, 22 bp, Homo sapiens
aacagacagaaaaatgtgatct

SEQ ID NO: 8478192 - DNA, 22 bp, Homo sapiens
aacagacatatttttaatatgc

SEQ ID NO: 8478193 - DNA, 22 bp, Homo sapiens
aacagacatatttttaatatgc

SEQ ID NO: 8478194 - DNA, 22 bp, Homo sapiens
aacagaacccgagtgtgaatct

SEQ ID NO: 8478195 - DNA, 22 bp, Homo sapiens
aacagaagggggtatttacatt

SEQ ID NO: 8478196 - DNA, 22 bp, Homo sapiens
aacagaaaaggtaggtggcttt

SEQ ID NO: 8478197 - DNA, 22 bp, Homo sapiens
aacagaaaaggtaggtggcttt

SEQ ID NO: 8478198 - DNA, 22 bp, Homo sapiens
aacagaaaaggtaggtggcttt

SEQ ID NO: 8478199 - DNA, 22 bp, Homo sapiens
aacagaaatcatttagggctct

SEQ ID NO: 8478200 - DNA, 22 bp, Homo sapiens
aacagaaatcatttagggctct

SEQ ID NO: 8478201 - DNA, 22 bp, Homo sapiens
aacagaaatcatttagggctct

SEQ ID NO: 8478202 - DNA, 22 bp, Homo sapiens
aacagaaaaggtaggtggcttt

SEQ ID NO: 8478203 - DNA, 22 bp, Homo sapiens
aacagaatagttgatgtacagt

SEQ ID NO: 8478204 - DNA, 22 bp, Homo sapiens
aacagaatagttgatgtacagt

SEQ ID NO: 8478205 - DNA, 22 bp, Homo sapiens
aacagaatgcaggggatgctgc

SEQ ID NO: 8478206 - DNA, 22 bp, Homo sapiens
aacagaatcttgggttcttttc

SEQ ID NO: 8478207 - DNA, 22 bp, Homo sapiens
aacagaatcttgggttcttttc

SEQ ID NO: 8478208 - DNA, 22 bp, Homo sapiens
aacagaatcttgggttcttttc

SEQ ID NO: 8478209 - DNA, 22 bp, Homo sapiens
aacagaatattttgcctttctc

SEQ ID NO: 8478210 - DNA, 22 bp, Homo sapiens
aacagaatatcaaaagattatg

SEQ ID NO: 8478211 - DNA, 20 bp, Homo sapiens
aacacagggttaccatcaga

SEQ ID NO: 8478212 - DNA, 22 bp, Homo sapiens
aacacagggggttacaaattgt

SEQ ID NO: 8478213 - DNA, 22 bp, Homo sapiens
aacactgtatcagtcttcaata

SEQ ID NO: 8478214 - DNA, 22 bp, Homo sapiens
aacacagttttccaaaatagag

SEQ ID NO: 8478215 - DNA, 22 bp, Homo sapiens
aacactgtatcagtcttcaata

SEQ ID NO: 8478216 - DNA, 22 bp, Homo sapiens
aacactgtatcagtcttcaata

SEQ ID NO: 8478217 - DNA, 22 bp, Homo sapiens
aacacagtttctgcattggtag

SEQ ID NO: 8478218 - DNA, 22 bp, Homo sapiens
aacacagttttccaaaatagag

SEQ ID NO: 8478219 - DNA, 22 bp, Homo sapiens
aacacagttttccaaaatagag

SEQ ID NO: 8478220 - DNA, 22 bp, Homo sapiens
aacactttttatatattgtatc

SEQ ID NO: 8478221 - DNA, 22 bp, Homo sapiens
aacactttttcctcctgtctgg

SEQ ID NO: 8478222 - DNA, 22 bp, Homo sapiens
aacactttgttgcctatgaacg

SEQ ID NO: 8478223 - DNA, 22 bp, Homo sapiens
aacactttttagtaaagattga

SEQ ID NO: 8478224 - DNA, 22 bp, Homo sapiens
aacactttttagtaaagattga

SEQ ID NO: 8478225 - DNA, 22 bp, Homo sapiens
aacactttcttccttgctcagg

SEQ ID NO: 8478226 - DNA, 22 bp, Homo sapiens
aacactttctattattatggtt

SEQ ID NO: 8478227 - DNA, 22 bp, Homo sapiens
aacactttcttccttgctcagg

SEQ ID NO: 8478228 - DNA, 22 bp, Homo sapiens
aacactttggaatagagatagg

SEQ ID NO: 8478229 - DNA, 22 bp, Homo sapiens
aacactttggaatagagatagg

SEQ ID NO: 8478230 - DNA, 22 bp, Homo sapiens
acaggcctcaagacacccaggt

SEQ ID NO: 8478231 - DNA, 22 bp, Homo sapiens
acaggcctcaagacacccaggt

SEQ ID NO: 8478232 - DNA, 18 bp, Homo sapiens
acaggcctcagtcctgca

SEQ ID NO: 8478233 - DNA, 22 bp, Homo sapiens
acaggcctcaaatagggtgcct

SEQ ID NO: 8478234 - DNA, 22 bp, Homo sapiens
acaggcctacgaagtcaggtgc

SEQ ID NO: 8478235 - DNA, 22 bp, Homo sapiens
acaggcctagctaatgctttcc

SEQ ID NO: 8478236 - DNA, 22 bp, Homo sapiens
acaggcctcccatccggagccc

SEQ ID NO: 8478237 - DNA, 22 bp, Homo sapiens
acaggcctgacacacagagggc

SEQ ID NO: 8478238 - DNA, 22 bp, Homo sapiens
acaggcctgagattttgcattt

SEQ ID NO: 8478239 - DNA, 17 bp, Homo sapiens
acaggcctgcttgcact

SEQ ID NO: 8478240 - DNA, 22 bp, Homo sapiens
acaggcctggaaaggaaggagt

SEQ ID NO: 8478241 - DNA, 22 bp, Homo sapiens
acaggcctggaaaggaaggagt

SEQ ID NO: 8478242 - DNA, 22 bp, Homo sapiens
agctttatatttaatgaattct

SEQ ID NO: 8478243 - DNA, 22 bp, Homo sapiens
agctttatcacaatattggcta

SEQ ID NO: 8478244 - DNA, 22 bp, Homo sapiens
agctttatgcttcctacaagct

SEQ ID NO: 8478245 - DNA, 22 bp, Homo sapiens
agctgggtcttgggccaggaga

SEQ ID NO: 8478246 - DNA, 22 bp, Homo sapiens
acagctgtattcaagttgcaag

SEQ ID NO: 8478247 - DNA, 22 bp, Homo sapiens
acagctgtgaaaatccacagga

SEQ ID NO: 8478248 - DNA, 22 bp, Homo sapiens
acagctgtgatttctatcatga

SEQ ID NO: 8478249 - DNA, 22 bp, Homo sapiens
acagctgtggccacttgcatcc

SEQ ID NO: 8478250 - DNA, 22 bp, Homo sapiens
acagctgtgggctctgcatata

SEQ ID NO: 8478251 - DNA, 22 bp, Homo sapiens
acagctgtgggctctgcatata

SEQ ID NO: 8478252 - DNA, 22 bp, Homo sapiens
acagctgtgggctctgcatata

SEQ ID NO: 8478253 - DNA, 22 bp, Homo sapiens
acagctgtgacttagagaagtt

SEQ ID NO: 8478254 - DNA, 22 bp, Homo sapiens
acagctgtgaagcaagcactct

SEQ ID NO: 8478255 - DNA, 22 bp, Homo sapiens
acagctgtgagggtcacttgta

SEQ ID NO: 8478256 - DNA, 22 bp, Homo sapiens
acagctgtgacttagagaagtt

SEQ ID NO: 8478257 - DNA, 22 bp, Homo sapiens
acagctgtgttttataatcagc

SEQ ID NO: 8478258 - DNA, 22 bp, Homo sapiens
acagctgtggggactcttgccc

SEQ ID NO: 8478259 - DNA, 22 bp, Homo sapiens
acagctgtggggactcttgccc

SEQ ID NO: 8478260 - DNA, 22 bp, Homo sapiens
acagctgtggggactcttgccc

SEQ ID NO: 8478261 - DNA, 22 bp, Homo sapiens
acaggcaggtaatttacatatt

SEQ ID NO: 8478262 - DNA, 22 bp, Homo sapiens
acagcttcgaggatctcatccc

SEQ ID NO: 8478263 - DNA, 22 bp, Homo sapiens
acaggccataaaggcaggccct

SEQ ID NO: 8478264 - DNA, 22 bp, Homo sapiens
acaggccagcctggggtaaggt

SEQ ID NO: 8478265 - DNA, 22 bp, Homo sapiens
acaggcccagctcttcaccaga

SEQ ID NO: 8478266 - DNA, 18 bp, Homo sapiens
acaggctgtgggaatggt

SEQ ID NO: 8478267 - DNA, 18 bp, Homo sapiens
acaggctgtgggaatggt

SEQ ID NO: 8478268 - DNA, 18 bp, Homo sapiens
acaggctgtgggaatggt

SEQ ID NO: 8478269 - DNA, 22 bp, Homo sapiens
acaggctggtttgtaaaagatg

SEQ ID NO: 8478270 - DNA, 22 bp, Homo sapiens
acaggctggtttgtaaaagatg

SEQ ID NO: 8478271 - DNA, 22 bp, Homo sapiens
acaggctggtggtcctggccat

SEQ ID NO: 8478272 - DNA, 22 bp, Homo sapiens
acaggctgtacttctaatcatc

SEQ ID NO: 8478273 - DNA, 22 bp, Homo sapiens
acaggctgtacttctaatcatc

SEQ ID NO: 8478274 - DNA, 22 bp, Homo sapiens
acaggctgttggggtccagggt

SEQ ID NO: 8478275 - DNA, 22 bp, Homo sapiens
aggaagggctgtttctccaaga

SEQ ID NO: 8478276 - DNA, 22 bp, Homo sapiens
aggaagggctgtttctccaaga

SEQ ID NO: 8478277 - DNA, 22 bp, Homo sapiens
aggaagggctgtttctccaaga

SEQ ID NO: 8478278 - DNA, 22 bp, Homo sapiens
aggaatgacttgtagctctgag

SEQ ID NO: 8478279 - DNA, 22 bp, Homo sapiens
aggaatgatagtaaaagagaat

SEQ ID NO: 8478280 - DNA, 22 bp, Homo sapiens
aggaatgattcaagacttggct

SEQ ID NO: 8478281 - DNA, 22 bp, Homo sapiens
aggaatgtaatagtgtggctca

SEQ ID NO: 8478282 - DNA, 22 bp, Homo sapiens
aggaatgtagtttgagtagaaa

SEQ ID NO: 8478283 - DNA, 22 bp, Homo sapiens
aggaatgtcatagaataatcat

SEQ ID NO: 8478284 - DNA, 19 bp, Homo sapiens
aggaatggaattaattctg

SEQ ID NO: 8478285 - DNA, 21 bp, Homo sapiens
aggaatgctgaggctcacttt

SEQ ID NO: 8478286 - DNA, 19 bp, Homo sapiens
aggaatggaattaattctg

SEQ ID NO: 8478287 - DNA, 19 bp, Homo sapiens
aggaatggaattaattctg

SEQ ID NO: 8478288 - DNA, 22 bp, Homo sapiens
aggaatggttatggggatagta

SEQ ID NO: 8478289 - DNA, 23 bp, Homo sapiens
aggaatggctagaagtgtgaccc

SEQ ID NO: 8478290 - DNA, 22 bp, Homo sapiens
acaggctgctgggctccgtgct

SEQ ID NO: 8478291 - DNA, 22 bp, Homo sapiens
acaggctgctgggctccgtgct

SEQ ID NO: 8478292 - DNA, 22 bp, Homo sapiens
acaggctggaggaggaccaaga

SEQ ID NO: 8478293 - DNA, 22 bp, Homo sapiens
acaggctgctgggctccgtgct

SEQ ID NO: 8478294 - DNA, 22 bp, Homo sapiens
acaggctgggcgcttcctgcgg

SEQ ID NO: 8478295 - DNA, 22 bp, Homo sapiens
acaggctgggcgcttcctgcgg

SEQ ID NO: 8478296 - DNA, 22 bp, Homo sapiens
acaggctggtggtcctggccat

SEQ ID NO: 8478297 - DNA, 22 bp, Homo sapiens
acaggctggtggtcctggccat

SEQ ID NO: 8478298 - DNA, 22 bp, Homo sapiens
acaggctgcccgctccccacct

SEQ ID NO: 8478299 - DNA, 22 bp, Homo sapiens
acaggctgcctaccaagtatca

SEQ ID NO: 8478300 - DNA, 22 bp, Homo sapiens
acaggctgcccgctccccacct

SEQ ID NO: 8478301 - DNA, 22 bp, Homo sapiens
acaggctgcccgctccccacct

SEQ ID NO: 8478302 - DNA, 22 bp, Homo sapiens
acaggctgcccgctccccacct

SEQ ID NO: 8478303 - DNA, 22 bp, Homo sapiens
acaggctgcctaccaagtatca

SEQ ID NO: 8478304 - DNA, 22 bp, Homo sapiens
acaggctgctgagccatttgct

SEQ ID NO: 8478305 - DNA, 22 bp, Homo sapiens
acaggctgctgagccatttgct

SEQ ID NO: 8478306 - DNA, 22 bp, Homo sapiens
agctttatgggagcttagataa

SEQ ID NO: 8478307 - DNA, 22 bp, Homo sapiens
acaggctgccacttgcatccaa

SEQ ID NO: 8478308 - DNA, 22 bp, Homo sapiens
acaggctctggggcaggatggc

SEQ ID NO: 8478309 - DNA, 22 bp, Homo sapiens
acagctctccctcagagaaatg

SEQ ID NO: 8478310 - DNA, 22 bp, Homo sapiens
acagctctgagatattactatt

SEQ ID NO: 8478311 - DNA, 22 bp, Homo sapiens
acagctctgagatattactatt

SEQ ID NO: 8478312 - DNA, 22 bp, Homo sapiens
acagctctgagatattactatt

SEQ ID NO: 8478313 - DNA, 22 bp, Homo sapiens
acagctctccctcagagaaatg

SEQ ID NO: 8478314 - DNA, 22 bp, Homo sapiens
acagctctgcatggcagttatt

SEQ ID NO: 8478315 - DNA, 22 bp, Homo sapiens
acagctctgcattttgggttaa

SEQ ID NO: 8478316 - DNA, 22 bp, Homo sapiens
acagctctgggtgcaggaggtg

SEQ ID NO: 8478317 - DNA, 22 bp, Homo sapiens
acagctgacattggcagctatt

SEQ ID NO: 8478318 - DNA, 22 bp, Homo sapiens
acagctgatagttacctctgtc

SEQ ID NO: 8478319 - DNA, 22 bp, Homo sapiens
acagctcttcttcaagcctggc

SEQ ID NO: 8478320 - DNA, 22 bp, Homo sapiens
acagctcttcttcaagcctggc

SEQ ID NO: 8478321 - DNA, 22 bp, Homo sapiens
acagctcttaggcagaaccaac

SEQ ID NO: 8478322 - DNA, 22 bp, Homo sapiens
acagctcttaggcagaaccaac

SEQ ID NO: 8478323 - DNA, 22 bp, Homo sapiens
acagctcttaggcagaaccaac

SEQ ID NO: 8478324 - DNA, 22 bp, Homo sapiens
acagctctgtgtattgtcatct

SEQ ID NO: 8478325 - DNA, 22 bp, Homo sapiens
acagctctgttgccagatctgc

SEQ ID NO: 8478326 - DNA, 22 bp, Homo sapiens
acagctacatcaaactcagaag

SEQ ID NO: 8478327 - DNA, 22 bp, Homo sapiens
acagctaatccccctagattct

SEQ ID NO: 8478328 - DNA, 22 bp, Homo sapiens
acagctaagggcacaggtcacc

SEQ ID NO: 8478329 - DNA, 22 bp, Homo sapiens
acagctaagctcccacaacctg

SEQ ID NO: 8478330 - DNA, 21 bp, Homo sapiens
acagccttgtgatggagacag

SEQ ID NO: 8478331 - DNA, 22 bp, Homo sapiens
acagctaacttaaactaaccta

SEQ ID NO: 8478332 - DNA, 22 bp, Homo sapiens
acagctatgacagatggataat

SEQ ID NO: 8478333 - DNA, 22 bp, Homo sapiens
acagctcagacatcactgctct

SEQ ID NO: 8478334 - DNA, 22 bp, Homo sapiens
acagctcatttgtaaaacggag

SEQ ID NO: 8478335 - DNA, 22 bp, Homo sapiens
acagctcatttgtaaaacggag

SEQ ID NO: 8478336 - DNA, 22 bp, Homo sapiens
acagctatagacgatgtataga

SEQ ID NO: 8478337 - DNA, 22 bp, Homo sapiens
acagctatagacgatgtataga

SEQ ID NO: 8478338 - DNA, 22 bp, Homo sapiens
acagctatctgactttgactca

SEQ ID NO: 8478339 - DNA, 22 bp, Homo sapiens
acagctactctgcagataaatc

SEQ ID NO: 8478340 - DNA, 22 bp, Homo sapiens
acagctactctgcagataaatc

SEQ ID NO: 8478341 - DNA, 22 bp, Homo sapiens
agctgggtactgatgtcttcag

SEQ ID NO: 8478342 - DNA, 22 bp, Homo sapiens
agctgggtacagcctgtgccta

SEQ ID NO: 8478343 - DNA, 22 bp, Homo sapiens
agctggggctgcagagaacagg

SEQ ID NO: 8478344 - DNA, 19 bp, Homo sapiens
agctggggcggtgtgtgtt

SEQ ID NO: 8478345 - DNA, 22 bp, Homo sapiens
agctggggctgcagagaacagg

SEQ ID NO: 8478346 - DNA, 23 bp, Homo sapiens
agctgggcaaggatccgggctcc

SEQ ID NO: 8478347 - DNA, 23 bp, Homo sapiens
agctgggcaaggatccgggctcc

SEQ ID NO: 8478348 - DNA, 20 bp, Homo sapiens
agctgggcaattatgactat

SEQ ID NO: 8478349 - DNA, 23 bp, Homo sapiens
agctgggcaaggatccgggctcc

SEQ ID NO: 8478350 - DNA, 22 bp, Homo sapiens
acagctgcattcttaacaggaa

SEQ ID NO: 8478351 - DNA, 23 bp, Homo sapiens
acagctgcacctggccgcctggc

SEQ ID NO: 8478352 - DNA, 22 bp, Homo sapiens
acagcctgctgcctgcttcttg

SEQ ID NO: 8478353 - DNA, 22 bp, Homo sapiens
acagcctgctgcctgcttcttg

SEQ ID NO: 8478354 - DNA, 22 bp, Homo sapiens
acagcctgctgcctgcttcttg

SEQ ID NO: 8478355 - DNA, 23 bp, Homo sapiens
acagccttctggggcttctgggc

SEQ ID NO: 8478356 - DNA, 22 bp, Homo sapiens
acagccttctcttcactgtgtc

SEQ ID NO: 8478357 - DNA, 22 bp, Homo sapiens
acagccttgggttctctggggg

SEQ ID NO: 8478358 - DNA, 22 bp, Homo sapiens
agctgccttccctctcattagg

SEQ ID NO: 8478359 - DNA, 22 bp, Homo sapiens
agctgccttccctctcattagg

SEQ ID NO: 8478360 - DNA, 17 bp, Homo sapiens
agctgccttgcttgagc

SEQ ID NO: 8478361 - DNA, 17 bp, Homo sapiens
agctgccttgcttgagc

SEQ ID NO: 8478362 - DNA, 17 bp, Homo sapiens
agctgccttgcttgagc

SEQ ID NO: 8478363 - DNA, 21 bp, Homo sapiens
agctgcctttagagagaacca

SEQ ID NO: 8478364 - DNA, 21 bp, Homo sapiens
agctgcctttagagagaacca

SEQ ID NO: 8478365 - DNA, 22 bp, Homo sapiens
agctgccttttgagaaagctca

SEQ ID NO: 8478366 - DNA, 22 bp, Homo sapiens
agctgcctttgcatcactttaa

SEQ ID NO: 8478367 - DNA, 22 bp, Homo sapiens
agctgctactgctctgccagag

SEQ ID NO: 8478368 - DNA, 22 bp, Homo sapiens
agctgctatgacaacaccagcc

SEQ ID NO: 8478369 - DNA, 22 bp, Homo sapiens
agctgcctgtgctgggagccca

SEQ ID NO: 8478370 - DNA, 22 bp, Homo sapiens
agctgcctgtgtagaaccatct

SEQ ID NO: 8478371 - DNA, 19 bp, Homo sapiens
agctgcctgtgcgcgcccg

SEQ ID NO: 8478372 - DNA, 22 bp, Homo sapiens
agctgcctgtcctaggccatca

SEQ ID NO: 8478373 - DNA, 22 bp, Homo sapiens
agctgcctgtcctaggccatca

SEQ ID NO: 8478374 - DNA, 22 bp, Homo sapiens
agctgcctgtcctaggccatca

SEQ ID NO: 8478375 - DNA, 20 bp, Homo sapiens
agctgccttcattttctaga

SEQ ID NO: 8478376 - DNA, 22 bp, Homo sapiens
agctgccttatggagtatgaaa

SEQ ID NO: 8478377 - DNA, 22 bp, Homo sapiens
agctgccttatggagtatgaaa

SEQ ID NO: 8478378 - DNA, 22 bp, Homo sapiens
agctgccttatggagtatgaaa

SEQ ID NO: 8478379 - DNA, 22 bp, Homo sapiens
agctgccttaaattactttgtg

SEQ ID NO: 8478380 - DNA, 22 bp, Homo sapiens
agctgccttaaattactttgtg

SEQ ID NO: 8478381 - DNA, 22 bp, Homo sapiens
agctgcctgtgtagaaccatct

SEQ ID NO: 8478382 - DNA, 22 bp, Homo sapiens
agctgcctgtaaaatgtgtgat

SEQ ID NO: 8478383 - DNA, 22 bp, Homo sapiens
agctgcctgggcttgtacacct

SEQ ID NO: 8478384 - DNA, 15 bp, Homo sapiens
agctgcctgggtgct

SEQ ID NO: 8478385 - DNA, 22 bp, Homo sapiens
agctgcctgggcttgtacacct

SEQ ID NO: 8478386 - DNA, 22 bp, Homo sapiens
agctgccccatgagaggcaggt

SEQ ID NO: 8478387 - DNA, 22 bp, Homo sapiens
agctgccccatgagaggcaggt

SEQ ID NO: 8478388 - DNA, 22 bp, Homo sapiens
agctgcccaggttcattgggcc

SEQ ID NO: 8478389 - DNA, 22 bp, Homo sapiens
acagcacttgggttttcctgtt

SEQ ID NO: 8478390 - DNA, 22 bp, Homo sapiens
acagcagacacaggcacgctgt

SEQ ID NO: 8478391 - DNA, 22 bp, Homo sapiens
acagcagacacaggcacgctgt

SEQ ID NO: 8478392 - DNA, 22 bp, Homo sapiens
acagcacaggagttgaatgggc

SEQ ID NO: 8478393 - DNA, 21 bp, Homo sapiens
acagcagacaggcttaggacc

SEQ ID NO: 8478394 - DNA, 22 bp, Homo sapiens
acagcagacagtcggcttcctg

SEQ ID NO: 8478395 - DNA, 22 bp, Homo sapiens
acagcagacagtcggcttcctg

SEQ ID NO: 8478396 - DNA, 22 bp, Homo sapiens
agctgccagcatcccggaaggg

SEQ ID NO: 8478397 - DNA, 22 bp, Homo sapiens
agctgccagcatcccggaaggg

SEQ ID NO: 8478398 - DNA, 22 bp, Homo sapiens
agctgccagcatcccggaaggg

SEQ ID NO: 8478399 - DNA, 22 bp, Homo sapiens
agctgcaggcccatgctcagtc

SEQ ID NO: 8478400 - DNA, 22 bp, Homo sapiens
agctgcaggcccatgctcagtc

SEQ ID NO: 8478401 - DNA, 22 bp, Homo sapiens
agctgccatcagcctttggatg

SEQ ID NO: 8478402 - DNA, 22 bp, Homo sapiens
agctgccatcctgttcagcacc

SEQ ID NO: 8478403 - DNA, 22 bp, Homo sapiens
agctgccatccgaggtgtcaga

SEQ ID NO: 8478404 - DNA, 17 bp, Homo sapiens
agctgccagggagtgtg

SEQ ID NO: 8478405 - DNA, 17 bp, Homo sapiens
agctgccagggagtgtg

SEQ ID NO: 8478406 - DNA, 22 bp, Homo sapiens
agctgccaggcccctgagaacc

SEQ ID NO: 8478407 - DNA, 22 bp, Homo sapiens
agctgccagggactgggcatgg

SEQ ID NO: 8478408 - DNA, 22 bp, Homo sapiens
agctgccatctgaagaactgca

SEQ ID NO: 8478409 - DNA, 22 bp, Homo sapiens
agctgcccaatcctgcagggcg

SEQ ID NO: 8478410 - DNA, 22 bp, Homo sapiens
agctgcccaatcctgcagggcg

SEQ ID NO: 8478411 - DNA, 21 bp, Homo sapiens
agctgcccagagtagggaagg

SEQ ID NO: 8478412 - DNA, 22 bp, Homo sapiens
agctgcccaatcctgcagggcg

SEQ ID NO: 8478413 - DNA, 22 bp, Homo sapiens
agctgcccagctaggaagaagg

SEQ ID NO: 8478414 - DNA, 22 bp, Homo sapiens
acataaaggtgactaacatctt

SEQ ID NO: 8478415 - DNA, 22 bp, Homo sapiens
acagttttttcaacattggaat

SEQ ID NO: 8478416 - DNA, 22 bp, Homo sapiens
acagttttttcaacattggaat

SEQ ID NO: 8478417 - DNA, 22 bp, Homo sapiens
acagttttttcaacattggaat

SEQ ID NO: 8478418 - DNA, 21 bp, Homo sapiens
acagttttaaggagcacatgg

SEQ ID NO: 8478419 - DNA, 22 bp, Homo sapiens
aggcagctggcaaattctagag

SEQ ID NO: 8478420 - DNA, 22 bp, Homo sapiens
acataaatagattattgggagg

SEQ ID NO: 8478421 - DNA, 22 bp, Homo sapiens
acataaatagattattgggagg

SEQ ID NO: 8478422 - DNA, 22 bp, Homo sapiens
aggcaggcaagttcatatgagg

SEQ ID NO: 8478423 - DNA, 22 bp, Homo sapiens
aggcaggcaaccacctgggaag

SEQ ID NO: 8478424 - DNA, 22 bp, Homo sapiens
aggcaggcaaccacctgggaag

SEQ ID NO: 8478425 - DNA, 21 bp, Homo sapiens
aggcaggattcaaacacagag

SEQ ID NO: 8478426 - DNA, 22 bp, Homo sapiens
aggcagcatgggcccagagtcc

SEQ ID NO: 8478427 - DNA, 22 bp, Homo sapiens
aggcagcatgggccccagctcc

SEQ ID NO: 8478428 - DNA, 22 bp, Homo sapiens
aggcagcatgggccccagctcc

SEQ ID NO: 8478429 - DNA, 16 bp, Homo sapiens
aggcagcatgttagtg

SEQ ID NO: 8478430 - DNA, 22 bp, Homo sapiens
acagtttggcgtgattgatagt

SEQ ID NO: 8478431 - DNA, 19 bp, Homo sapiens
acagtttgggaaatgagca

SEQ ID NO: 8478432 - DNA, 22 bp, Homo sapiens
aggcagcatccagaggagaatg

SEQ ID NO: 8478433 - DNA, 22 bp, Homo sapiens
aggcagcagtgataagatagga

SEQ ID NO: 8478434 - DNA, 22 bp, Homo sapiens
aggcagcagtgataagatagga

SEQ ID NO: 8478435 - DNA, 22 bp, Homo sapiens
aggcagcaattgaaatcattgt

SEQ ID NO: 8478436 - DNA, 22 bp, Homo sapiens
aggcagcatgctctgcttctac

SEQ ID NO: 8478437 - DNA, 22 bp, Homo sapiens
aggcagcatgctctgcttctac

SEQ ID NO: 8478438 - DNA, 21 bp, Homo sapiens
aggcagcatctgatttatatg

SEQ ID NO: 8478439 - DNA, 21 bp, Homo sapiens
aggcagcatctgatttatatg

SEQ ID NO: 8478440 - DNA, 22 bp, Homo sapiens
aggcagcatccagaggagaatg

SEQ ID NO: 8478441 - DNA, 22 bp, Homo sapiens
acagttaataagtagtaagtca

SEQ ID NO: 8478442 - DNA, 22 bp, Homo sapiens
acagttaagcagtatgatcaca

SEQ ID NO: 8478443 - DNA, 22 bp, Homo sapiens
acagttaccacttagcagttac

SEQ ID NO: 8478444 - DNA, 22 bp, Homo sapiens
acagttaggtcctaaaattctg

SEQ ID NO: 8478445 - DNA, 22 bp, Homo sapiens
acagttagggactataatcatt

SEQ ID NO: 8478446 - DNA, 23 bp, Homo sapiens
acagttatagctgtgaataacat

SEQ ID NO: 8478447 - DNA, 23 bp, Homo sapiens
acagttatagctgtgaataacat

SEQ ID NO: 8478448 - DNA, 22 bp, Homo sapiens
acagttatatacatgtagctgt

SEQ ID NO: 8478449 - DNA, 22 bp, Homo sapiens
acagttattctttatgcaacca

SEQ ID NO: 8478450 - DNA, 22 bp, Homo sapiens
acagttattctttatgcaacca

SEQ ID NO: 8478451 - DNA, 22 bp, Homo sapiens
acagttcaagtcttagacaaca

SEQ ID NO: 8478452 - DNA, 22 bp, Homo sapiens
acagttattttcccagcattta

SEQ ID NO: 8478453 - DNA, 20 bp, Homo sapiens
acagtgtttttgagtagagc

SEQ ID NO: 8478454 - DNA, 20 bp, Homo sapiens
acagtgtttttgagtagagc

SEQ ID NO: 8478455 - DNA, 22 bp, Homo sapiens
acagtgttttgtctggcagggc

SEQ ID NO: 8478456 - DNA, 22 bp, Homo sapiens
acagtgttttcttaaggagaaa

SEQ ID NO: 8478457 - DNA, 22 bp, Homo sapiens
acagtgttttagaaaagcttga

SEQ ID NO: 8478458 - DNA, 22 bp, Homo sapiens
acagtgttttatgagaattgtt

SEQ ID NO: 8478459 - DNA, 22 bp, Homo sapiens
acagtgttttagaaaagcttga

SEQ ID NO: 8478460 - DNA, 22 bp, Homo sapiens
acagtgcacatcctgagtgatt

SEQ ID NO: 8478461 - DNA, 22 bp, Homo sapiens
acagtgttctgctttttaatcc

SEQ ID NO: 8478462 - DNA, 22 bp, Homo sapiens
acagtgatttcatccttctggg

SEQ ID NO: 8478463 - DNA, 22 bp, Homo sapiens
acagtgattggtttgggggtga

SEQ ID NO: 8478464 - DNA, 18 bp, Homo sapiens
acagtgattgttctatgc

SEQ ID NO: 8478465 - DNA, 22 bp, Homo sapiens
acagtgattggggtatctgcag

SEQ ID NO: 8478466 - DNA, 22 bp, Homo sapiens
acagtgatcagttactgtctgt

SEQ ID NO: 8478467 - DNA, 22 bp, Homo sapiens
acagtgaggacagggactgtgt

SEQ ID NO: 8478468 - DNA, 22 bp, Homo sapiens
acagtgattattagttggtggt

SEQ ID NO: 8478469 - DNA, 22 bp, Homo sapiens
acagtgatgagggaattttgtg

SEQ ID NO: 8478470 - DNA, 22 bp, Homo sapiens
acagtgatgagccggctgaggc

SEQ ID NO: 8478471 - DNA, 22 bp, Homo sapiens
acaggtgcatgctaccatgtct

SEQ ID NO: 8478472 - DNA, 22 bp, Homo sapiens
acagggttgtggccttaaaggc

SEQ ID NO: 8478473 - DNA, 22 bp, Homo sapiens
acaggtggacacagcagcagtc

SEQ ID NO: 8478474 - DNA, 22 bp, Homo sapiens
acagggcacctgaggtaggaag

SEQ ID NO: 8478475 - DNA, 22 bp, Homo sapiens
acagggttgaagagcataaagt

SEQ ID NO: 8478476 - DNA, 22 bp, Homo sapiens
acaggtggcataggcagtttga

SEQ ID NO: 8478477 - DNA, 22 bp, Homo sapiens
acaggtggaggctttaggaggt

SEQ ID NO: 8478478 - DNA, 22 bp, Homo sapiens
acaggtggagtggttagcaggc

SEQ ID NO: 8478479 - DNA, 22 bp, Homo sapiens
acaggtggacacagcagcagtc

SEQ ID NO: 8478480 - DNA, 18 bp, Homo sapiens
acagggatggggtaagtg

SEQ ID NO: 8478481 - DNA, 18 bp, Homo sapiens
acagggatggggtaagtg

SEQ ID NO: 8478482 - DNA, 22 bp, Homo sapiens
acagggattttccaggctaccc

SEQ ID NO: 8478483 - DNA, 22 bp, Homo sapiens
acagggcaacctctgggagact

SEQ ID NO: 8478484 - DNA, 22 bp, Homo sapiens
acagggcaacctctgggagact

SEQ ID NO: 8478485 - DNA, 22 bp, Homo sapiens
acagggcaacctctgggagact

SEQ ID NO: 8478486 - DNA, 22 bp, Homo sapiens
acagggcaacctctgggagact

SEQ ID NO: 8478487 - DNA, 22 bp, Homo sapiens
acagggcaacctctgggagact

SEQ ID NO: 8478488 - DNA, 18 bp, Homo sapiens
acagggagggcgctgggg

SEQ ID NO: 8478489 - DNA, 18 bp, Homo sapiens
acagggagggcgctgggg

SEQ ID NO: 8478490 - DNA, 22 bp, Homo sapiens
acagggagtgcaattcatattg

SEQ ID NO: 8478491 - DNA, 22 bp, Homo sapiens
acagggagtctgaggggatagt

SEQ ID NO: 8478492 - DNA, 22 bp, Homo sapiens
acagggagtctgaggggatagt

SEQ ID NO: 8478493 - DNA, 22 bp, Homo sapiens
acagggagtctgaggggatagt

SEQ ID NO: 8478494 - DNA, 22 bp, Homo sapiens
acaggtggtaaaatggactgtc

SEQ ID NO: 8478495 - DNA, 22 bp, Homo sapiens
acaggtggtaaaatggactgtc

SEQ ID NO: 8478496 - DNA, 22 bp, Homo sapiens
acaggtgggcttaagagtcggc

SEQ ID NO: 8478497 - DNA, 22 bp, Homo sapiens
acaggtgggcttaagagtcggc

SEQ ID NO: 8478498 - DNA, 22 bp, Homo sapiens
acaggtggggaggctgaggttc

SEQ ID NO: 8478499 - DNA, 22 bp, Homo sapiens
acaggtggggaggctgaggttc

SEQ ID NO: 8478500 - DNA, 22 bp, Homo sapiens
acaggtggcttattggctgatt

SEQ ID NO: 8478501 - DNA, 22 bp, Homo sapiens
acaggtggcttattggctgatt

SEQ ID NO: 8478502 - DNA, 22 bp, Homo sapiens
acaggtggcttattggctgatt

SEQ ID NO: 8478503 - DNA, 22 bp, Homo sapiens
acaggtgggcttaagagtcggc

SEQ ID NO: 8478504 - DNA, 22 bp, Homo sapiens
acaggtggcttattggctgatt

SEQ ID NO: 8478505 - DNA, 22 bp, Homo sapiens
acaggtggccccgagggagtgg

SEQ ID NO: 8478506 - DNA, 21 bp, Homo sapiens
aggagctgtgttagctggtcg

SEQ ID NO: 8478507 - DNA, 21 bp, Homo sapiens
aggagctgtgttagctggtcg

SEQ ID NO: 8478508 - DNA, 21 bp, Homo sapiens
aggagctgtgttagctggtcg

SEQ ID NO: 8478509 - DNA, 21 bp, Homo sapiens
aggagctgtgttagctggtcg

SEQ ID NO: 8478510 - DNA, 21 bp, Homo sapiens
aggagctgtgttagctggtcg

SEQ ID NO: 8478511 - DNA, 22 bp, Homo sapiens
aggagcttcagagagaacctgg

SEQ ID NO: 8478512 - DNA, 22 bp, Homo sapiens
aggagctgttttgttcagcaaa

SEQ ID NO: 8478513 - DNA, 22 bp, Homo sapiens
aggagctggagtccaggcaagt

SEQ ID NO: 8478514 - DNA, 22 bp, Homo sapiens
acaggtggtctttgctcctttt

SEQ ID NO: 8478515 - DNA, 22 bp, Homo sapiens
aggagggtgatccgggctggtc

SEQ ID NO: 8478516 - DNA, 22 bp, Homo sapiens
aggagggtgatccgggctggtc

SEQ ID NO: 8478517 - DNA, 22 bp, Homo sapiens
aggagtcagatatgggaaagtt

SEQ ID NO: 8478518 - DNA, 22 bp, Homo sapiens
aggagtcactcagggcttcatc

SEQ ID NO: 8478519 - DNA, 22 bp, Homo sapiens
aggagtcactcagggcttcatc

SEQ ID NO: 8478520 - DNA, 22 bp, Homo sapiens
aggagtcaggaccaaatggaaa

SEQ ID NO: 8478521 - DNA, 22 bp, Homo sapiens
aggagtcagattgtttgaatgt

SEQ ID NO: 8478522 - DNA, 22 bp, Homo sapiens
acagtacaaaacccaccagagg

SEQ ID NO: 8478523 - DNA, 22 bp, Homo sapiens
aggagggtgatccgggctggtc

SEQ ID NO: 8478524 - DNA, 17 bp, Homo sapiens
aggagtctcagatgagc

SEQ ID NO: 8478525 - DNA, 17 bp, Homo sapiens
aggagtctcagatgagc

SEQ ID NO: 8478526 - DNA, 17 bp, Homo sapiens
aggagtctcagatgagc

SEQ ID NO: 8478527 - DNA, 22 bp, Homo sapiens
aggagtgcaaatagtccagaga

SEQ ID NO: 8478528 - DNA, 22 bp, Homo sapiens
aggagtgagctttggggtcaga

SEQ ID NO: 8478529 - DNA, 22 bp, Homo sapiens
aggagtggaattactgggttct

SEQ ID NO: 8478530 - DNA, 22 bp, Homo sapiens
acagtgaggacagggactgtgt

SEQ ID NO: 8478531 - DNA, 22 bp, Homo sapiens
acagtgaggacagggactgtgt

SEQ ID NO: 8478532 - DNA, 22 bp, Homo sapiens
aggaggaactcagaaagaaggt

SEQ ID NO: 8478533 - DNA, 21 bp, Homo sapiens
aggaggaacccgtggctgggc

SEQ ID NO: 8478534 - DNA, 20 bp, Homo sapiens
aggaggaaaaaatgacgagc

SEQ ID NO: 8478535 - DNA, 22 bp, Homo sapiens
acagtaacacctactctgtccc

SEQ ID NO: 8478536 - DNA, 22 bp, Homo sapiens
acagtaactcttttaccctcct

SEQ ID NO: 8478537 - DNA, 22 bp, Homo sapiens
acagtaagcggggttggagggc

SEQ ID NO: 8478538 - DNA, 22 bp, Homo sapiens
acagtaagggtaaataagaaca

SEQ ID NO: 8478539 - DNA, 17 bp, Homo sapiens
acagtaactatgttatg

SEQ ID NO: 8478540 - DNA, 17 bp, Homo sapiens
acagtaactatgttatg

SEQ ID NO: 8478541 - DNA, 22 bp, Homo sapiens
acagtaatattgatgctcgtca

SEQ ID NO: 8478542 - DNA, 22 bp, Homo sapiens
acagtaataagtgttggtgagg

SEQ ID NO: 8478543 - DNA, 22 bp, Homo sapiens
acagtaatattgatgctcgtca

SEQ ID NO: 8478544 - DNA, 22 bp, Homo sapiens
acagtaatgattctgagtctct

SEQ ID NO: 8478545 - DNA, 22 bp, Homo sapiens
acagtaatgattctgagtctct

SEQ ID NO: 8478546 - DNA, 22 bp, Homo sapiens
acagtaatgcatacaagttagt

SEQ ID NO: 8478547 - DNA, 22 bp, Homo sapiens
acagtaattaaaatggatctgc

SEQ ID NO: 8478548 - DNA, 22 bp, Homo sapiens
acagtaattaaaatggatctgc

SEQ ID NO: 8478549 - DNA, 22 bp, Homo sapiens
acagtaattaaacattctgatt

SEQ ID NO: 8478550 - DNA, 22 bp, Homo sapiens
acagtaatgcatacaagttagt

SEQ ID NO: 8478551 - DNA, 22 bp, Homo sapiens
accctcaacaaattcactctat

SEQ ID NO: 8478552 - DNA, 22 bp, Homo sapiens
accctcagacagctgtggccag

SEQ ID NO: 8478553 - DNA, 22 bp, Homo sapiens
accctcagacatattccatcat

SEQ ID NO: 8478554 - DNA, 22 bp, Homo sapiens
accctcagacatattccatcat

SEQ ID NO: 8478555 - DNA, 22 bp, Homo sapiens
accctcagacagctgtggccag

SEQ ID NO: 8478556 - DNA, 16 bp, Homo sapiens
accctcagaaactgct

SEQ ID NO: 8478557 - DNA, 22 bp, Homo sapiens
acccgggaggcaggagtcatag

SEQ ID NO: 8478558 - DNA, 22 bp, Homo sapiens
acccgggaggcaggagtcatag

SEQ ID NO: 8478559 - DNA, 22 bp, Homo sapiens
acccggagtcggaggttgcagt

SEQ ID NO: 8478560 - DNA, 22 bp, Homo sapiens
acccggagtcggaggttgcagt

SEQ ID NO: 8478561 - DNA, 22 bp, Homo sapiens
acccgggaggcaggagtcatag

SEQ ID NO: 8478562 - DNA, 22 bp, Homo sapiens
agggcctggtgacctgggtcct

SEQ ID NO: 8478563 - DNA, 22 bp, Homo sapiens
agggcctgggtctgtactcctc

SEQ ID NO: 8478564 - DNA, 22 bp, Homo sapiens
agggcctggggtagcttactgc

SEQ ID NO: 8478565 - DNA, 22 bp, Homo sapiens
agggcctgggccagcacccttt

SEQ ID NO: 8478566 - DNA, 22 bp, Homo sapiens
accccaggaagtggaggtcatg

SEQ ID NO: 8478567 - DNA, 22 bp, Homo sapiens
accccaggaagtggaggtcatg

SEQ ID NO: 8478568 - DNA, 22 bp, Homo sapiens
accccaggaagtggaggtcatg

SEQ ID NO: 8478569 - DNA, 22 bp, Homo sapiens
acccgatgttggtgctctagta

SEQ ID NO: 8478570 - DNA, 22 bp, Homo sapiens
acccgccctcagccttaccgtg

SEQ ID NO: 8478571 - DNA, 22 bp, Homo sapiens
accccagctctgagccacacca

SEQ ID NO: 8478572 - DNA, 18 bp, Homo sapiens
acccaggctcatggtcct

SEQ ID NO: 8478573 - DNA, 22 bp, Homo sapiens
acccaggctagggtgcagtggc

SEQ ID NO: 8478574 - DNA, 22 bp, Homo sapiens
acccaggctagagtgcagtggt

SEQ ID NO: 8478575 - DNA, 22 bp, Homo sapiens
acccaggcgggagtgcagtgtc

SEQ ID NO: 8478576 - DNA, 22 bp, Homo sapiens
acccaggcctgagagacaggag

SEQ ID NO: 8478577 - DNA, 22 bp, Homo sapiens
acccaggcctgagagacaggag

SEQ ID NO: 8478578 - DNA, 22 bp, Homo sapiens
acccaggctggagtgcagtagc

SEQ ID NO: 8478579 - DNA, 22 bp, Homo sapiens
acccaggctgcttctcagtggc

SEQ ID NO: 8478580 - DNA, 22 bp, Homo sapiens
agggcctgggccagcacccttt

SEQ ID NO: 8478581 - DNA, 22 bp, Homo sapiens
agggcctgggccagcacccttt

SEQ ID NO: 8478582 - DNA, 22 bp, Homo sapiens
agggcctgggccagcacccttt

SEQ ID NO: 8478583 - DNA, 22 bp, Homo sapiens
agggcctgggatgtcctcctag

SEQ ID NO: 8478584 - DNA, 22 bp, Homo sapiens
agggcctgggaagaggaaccct

SEQ ID NO: 8478585 - DNA, 23 bp, Homo sapiens
agggcatgaagcagaggacgtgg

SEQ ID NO: 8478586 - DNA, 22 bp, Homo sapiens
agggcatgaagcagtggacagc

SEQ ID NO: 8478587 - DNA, 22 bp, Homo sapiens
agggcatgaagcagtggacagc

SEQ ID NO: 8478588 - DNA, 22 bp, Homo sapiens
acccaggagcaggctgggcagt

SEQ ID NO: 8478589 - DNA, 22 bp, Homo sapiens
acccaggagcaggctgggcagt

SEQ ID NO: 8478590 - DNA, 22 bp, Homo sapiens
acccaggagcaggctgggcagt

SEQ ID NO: 8478591 - DNA, 22 bp, Homo sapiens
agggcatctctaacagtctcct

SEQ ID NO: 8478592 - DNA, 22 bp, Homo sapiens
agggcatgaaatgggcagaagc

SEQ ID NO: 8478593 - DNA, 22 bp, Homo sapiens
acccacacctccgtatatcact

SEQ ID NO: 8478594 - DNA, 22 bp, Homo sapiens
acccacagaacctgtgacaaca

SEQ ID NO: 8478595 - DNA, 22 bp, Homo sapiens
acccacagaacctgtgacaaca

SEQ ID NO: 8478596 - DNA, 20 bp, Homo sapiens
agggcagcttgaggagccgg

SEQ ID NO: 8478597 - DNA, 20 bp, Homo sapiens
agggcagcttgaggagccgg

SEQ ID NO: 8478598 - DNA, 20 bp, Homo sapiens
agggcagcttgaggagccgg

SEQ ID NO: 8478599 - DNA, 20 bp, Homo sapiens
agggcagcttgaggagccgg

SEQ ID NO: 8478600 - DNA, 22 bp, Homo sapiens
acccaaagcaatattcatcagt

SEQ ID NO: 8478601 - DNA, 22 bp, Homo sapiens
accattttgggtattttcagag

SEQ ID NO: 8478602 - DNA, 22 bp, Homo sapiens
accatttaataagtatttccat

SEQ ID NO: 8478603 - DNA, 22 bp, Homo sapiens
accatttactcccattggaagt

SEQ ID NO: 8478604 - DNA, 22 bp, Homo sapiens
acccacacatctctaattcagt

SEQ ID NO: 8478605 - DNA, 22 bp, Homo sapiens
agggagctcgatgcctgagtgt

SEQ ID NO: 8478606 - DNA, 22 bp, Homo sapiens
agggagctcagttggaagcggt

SEQ ID NO: 8478607 - DNA, 22 bp, Homo sapiens
agggagctatttcagggttatt

SEQ ID NO: 8478608 - DNA, 22 bp, Homo sapiens
agggagctatttcagggttatt

SEQ ID NO: 8478609 - DNA, 22 bp, Homo sapiens
agggagctctgggggcacacgg

SEQ ID NO: 8478610 - DNA, 22 bp, Homo sapiens
agggagctctaagtagagggac

SEQ ID NO: 8478611 - DNA, 22 bp, Homo sapiens
agggagctctaagtagagggac

SEQ ID NO: 8478612 - DNA, 22 bp, Homo sapiens
accatgttggccaagctggtct

SEQ ID NO: 8478613 - DNA, 20 bp, Homo sapiens
accattaatgtaagctttgt

SEQ ID NO: 8478614 - DNA, 22 bp, Homo sapiens
accattaagaatctggtttcct

SEQ ID NO: 8478615 - DNA, 22 bp, Homo sapiens
accatgttggccaagctggtct

SEQ ID NO: 8478616 - DNA, 22 bp, Homo sapiens
accatgttggccaagctggtct

SEQ ID NO: 8478617 - DNA, 22 bp, Homo sapiens
accattaacatgattttgggga

SEQ ID NO: 8478618 - DNA, 22 bp, Homo sapiens
accattctttacatcagcacag

SEQ ID NO: 8478619 - DNA, 22 bp, Homo sapiens
accattgatataactcagtctc

SEQ ID NO: 8478620 - DNA, 22 bp, Homo sapiens
accattgccccctagtgtctgt

SEQ ID NO: 8478621 - DNA, 22 bp, Homo sapiens
accattgccccctagtgtctgt

SEQ ID NO: 8478622 - DNA, 22 bp, Homo sapiens
accattgccccctagtgtctgt

SEQ ID NO: 8478623 - DNA, 22 bp, Homo sapiens
aggctggagtgtgcagtggcgc

SEQ ID NO: 8478624 - DNA, 22 bp, Homo sapiens
aggctggagtgtgcagtggcgc

SEQ ID NO: 8478625 - DNA, 22 bp, Homo sapiens
aggctggagtgtgcagtggcgc

SEQ ID NO: 8478626 - DNA, 22 bp, Homo sapiens
aggctggatgtgcctcaccgag

SEQ ID NO: 8478627 - DNA, 19 bp, Homo sapiens
aggctggatgcccatctta

SEQ ID NO: 8478628 - DNA, 22 bp, Homo sapiens
aggctggatttatggggacttc

SEQ ID NO: 8478629 - DNA, 22 bp, Homo sapiens
aggctggatctctgttgccttc

SEQ ID NO: 8478630 - DNA, 20 bp, Homo sapiens
aggctggcactcctggccag

SEQ ID NO: 8478631 - DNA, 20 bp, Homo sapiens
aggctggcactcctggccag

SEQ ID NO: 8478632 - DNA, 20 bp, Homo sapiens
aggctggcactcctggccag

SEQ ID NO: 8478633 - DNA, 22 bp, Homo sapiens
aggctggatttatggggacttc

SEQ ID NO: 8478634 - DNA, 22 bp, Homo sapiens
aggctggcaaggcagatgtgtg

SEQ ID NO: 8478635 - DNA, 22 bp, Homo sapiens
aggctggcaaggcagatgtgtg

SEQ ID NO: 8478636 - DNA, 22 bp, Homo sapiens
aggctggcaaggcagatgtgtg

SEQ ID NO: 8478637 - DNA, 22 bp, Homo sapiens
agggaagaatcactgggatgtt

SEQ ID NO: 8478638 - DNA, 22 bp, Homo sapiens
agggaagagcttgcaagaaacc

SEQ ID NO: 8478639 - DNA, 22 bp, Homo sapiens
agggaagagcttgcaagaaacc

SEQ ID NO: 8478640 - DNA, 22 bp, Homo sapiens
agggaagagcttgcaagaaacc

SEQ ID NO: 8478641 - DNA, 22 bp, Homo sapiens
agggaagaatcactgggatgtt

SEQ ID NO: 8478642 - DNA, 22 bp, Homo sapiens
aggctggcagccacctcagcag

SEQ ID NO: 8478643 - DNA, 22 bp, Homo sapiens
aggctttactgcctcaggactc

SEQ ID NO: 8478644 - DNA, 22 bp, Homo sapiens
acattttttagagtcccacatt

SEQ ID NO: 8478645 - DNA, 22 bp, Homo sapiens
acattttttagagtcccacatt

SEQ ID NO: 8478646 - DNA, 22 bp, Homo sapiens
acatttttgggttgatgtctga

SEQ ID NO: 8478647 - DNA, 22 bp, Homo sapiens
acatttttgggttgatgtctga

SEQ ID NO: 8478648 - DNA, 22 bp, Homo sapiens
acatttttgggttgatgtctga

SEQ ID NO: 8478649 - DNA, 21 bp, Homo sapiens
accaaaacctatactttctgt

SEQ ID NO: 8478650 - DNA, 22 bp, Homo sapiens
accaaaacctgctactaaagga

SEQ ID NO: 8478651 - DNA, 22 bp, Homo sapiens
accaaaacctgctactaaagga

SEQ ID NO: 8478652 - DNA, 22 bp, Homo sapiens
acatttttactgggcatctgca

SEQ ID NO: 8478653 - DNA, 22 bp, Homo sapiens
acatttttactgggcatctgca

SEQ ID NO: 8478654 - DNA, 22 bp, Homo sapiens
acatttgtcttctttcagatta

SEQ ID NO: 8478655 - DNA, 22 bp, Homo sapiens
aggctgcagaacagtcaggtgc

SEQ ID NO: 8478656 - DNA, 22 bp, Homo sapiens
acatttttattcatcaaagcag

SEQ ID NO: 8478657 - DNA, 22 bp, Homo sapiens
acatttttattcatcaaagcag

SEQ ID NO: 8478658 - DNA, 22 bp, Homo sapiens
acatttttatcctgagtgccag

SEQ ID NO: 8478659 - DNA, 22 bp, Homo sapiens
acatttttatcctgagtgccag

SEQ ID NO: 8478660 - DNA, 22 bp, Homo sapiens
acatttttattcatcaaagcag

SEQ ID NO: 8478661 - DNA, 22 bp, Homo sapiens
acatttttctaggaggcaaggt

SEQ ID NO: 8478662 - DNA, 22 bp, Homo sapiens
acatttttctaggaggcaaggt

SEQ ID NO: 8478663 - DNA, 22 bp, Homo sapiens
acatttttctaggaggcaaggt

SEQ ID NO: 8478664 - DNA, 22 bp, Homo sapiens
acatttttcacatttgtagggt

SEQ ID NO: 8478665 - DNA, 22 bp, Homo sapiens
acatttttcacatttgtagggt

SEQ ID NO: 8478666 - DNA, 22 bp, Homo sapiens
acatttttcacatttgtagggt

SEQ ID NO: 8478667 - DNA, 22 bp, Homo sapiens
accaggcccgctgctatggtgg

SEQ ID NO: 8478668 - DNA, 20 bp, Homo sapiens
accaggccccgggccctgca

SEQ ID NO: 8478669 - DNA, 20 bp, Homo sapiens
accaggccccgggccctgca

SEQ ID NO: 8478670 - DNA, 22 bp, Homo sapiens
accaggcccatgtggattacta

SEQ ID NO: 8478671 - DNA, 22 bp, Homo sapiens
accaggagttttgaccaggggc

SEQ ID NO: 8478672 - DNA, 22 bp, Homo sapiens
accaggcccaccgcatgctcct

SEQ ID NO: 8478673 - DNA, 22 bp, Homo sapiens
accaggagttgggggtgggacc

SEQ ID NO: 8478674 - DNA, 22 bp, Homo sapiens
accaggccctccagctgcgtgg

SEQ ID NO: 8478675 - DNA, 20 bp, Homo sapiens
accaggcccggtgtctcctc

SEQ ID NO: 8478676 - DNA, 22 bp, Homo sapiens
accaggcctagcaagtacatta

SEQ ID NO: 8478677 - DNA, 22 bp, Homo sapiens
accaggcctagcaagtacatta

SEQ ID NO: 8478678 - DNA, 23 bp, Homo sapiens
agggagctaaaaggctggagcag

SEQ ID NO: 8478679 - DNA, 21 bp, Homo sapiens
agggagctatttatagtaagc

SEQ ID NO: 8478680 - DNA, 23 bp, Homo sapiens
agggagctaaaaggctggagcag

SEQ ID NO: 8478681 - DNA, 22 bp, Homo sapiens
agggacacgaggtcctgctggg

SEQ ID NO: 8478682 - DNA, 22 bp, Homo sapiens
agggacactgatgagaaattct

SEQ ID NO: 8478683 - DNA, 21 bp, Homo sapiens
agggacacacaggatggggct

SEQ ID NO: 8478684 - DNA, 22 bp, Homo sapiens
agggacacactccagtgttatt

SEQ ID NO: 8478685 - DNA, 22 bp, Homo sapiens
agggacacactccagtgttatt

SEQ ID NO: 8478686 - DNA, 22 bp, Homo sapiens
agggacacatgtgattatttat

SEQ ID NO: 8478687 - DNA, 22 bp, Homo sapiens
agggaattcactggaacgccct

SEQ ID NO: 8478688 - DNA, 22 bp, Homo sapiens
agggaattcactggaacgccct

SEQ ID NO: 8478689 - DNA, 22 bp, Homo sapiens
agggacagatgaatgactgagt

SEQ ID NO: 8478690 - DNA, 22 bp, Homo sapiens
agggacagatgaatgactgagt

SEQ ID NO: 8478691 - DNA, 22 bp, Homo sapiens
agggacagatgaatgactgagt

SEQ ID NO: 8478692 - DNA, 22 bp, Homo sapiens
agggacagatgaatgactgagt

SEQ ID NO: 8478693 - DNA, 22 bp, Homo sapiens
agggaagccctggctgagaccc

SEQ ID NO: 8478694 - DNA, 22 bp, Homo sapiens
agggaagccctggctgagaccc

SEQ ID NO: 8478695 - DNA, 22 bp, Homo sapiens
agggaagccaagccttagagaa

SEQ ID NO: 8478696 - DNA, 22 bp, Homo sapiens
agggaagccccgaggaggcacc

SEQ ID NO: 8478697 - DNA, 22 bp, Homo sapiens
agggaagcttgttactgagaag

SEQ ID NO: 8478698 - DNA, 22 bp, Homo sapiens
agggaatgtagcaagatgccaa

SEQ ID NO: 8478699 - DNA, 22 bp, Homo sapiens
agggaagctgctgggtccacct

SEQ ID NO: 8478700 - DNA, 22 bp, Homo sapiens
agggaagaggaccagagtctct

SEQ ID NO: 8478701 - DNA, 22 bp, Homo sapiens
agggaagaggaccagagtctct

SEQ ID NO: 8478702 - DNA, 22 bp, Homo sapiens
agggaagaggaccagagtctct

SEQ ID NO: 8478703 - DNA, 22 bp, Homo sapiens
agggaagaggcaaggtttatgg

SEQ ID NO: 8478704 - DNA, 22 bp, Homo sapiens
agggaagaggaccagagtctct

SEQ ID NO: 8478705 - DNA, 22 bp, Homo sapiens
agggaagcaatattagatatca

SEQ ID NO: 8478706 - DNA, 22 bp, Homo sapiens
agggaagcaatgattattattc

SEQ ID NO: 8478707 - DNA, 22 bp, Homo sapiens
agggaagcaggaatagctctga

SEQ ID NO: 8478708 - DNA, 22 bp, Homo sapiens
agggaagcagcagccgcctgtc

SEQ ID NO: 8478709 - DNA, 22 bp, Homo sapiens
aggcaggctggtctgaagagtg

SEQ ID NO: 8478710 - DNA, 22 bp, Homo sapiens
aggcaggctggtctgaagagtg

SEQ ID NO: 8478711 - DNA, 22 bp, Homo sapiens
aggcaggcactccggaagtgtc

SEQ ID NO: 8478712 - DNA, 17 bp, Homo sapiens
aggcaggcagagcggga

SEQ ID NO: 8478713 - DNA, 17 bp, Homo sapiens
aggcaggcagagcggga

SEQ ID NO: 8478714 - DNA, 22 bp, Homo sapiens
aggcaggcagggctcactgtct

SEQ ID NO: 8478715 - DNA, 22 bp, Homo sapiens
aggcaggggagctggaagggta

SEQ ID NO: 8478716 - DNA, 22 bp, Homo sapiens
aggcaggggagctggaagggta

SEQ ID NO: 8478717 - DNA, 22 bp, Homo sapiens
acatgacttttctcttccagag

SEQ ID NO: 8478718 - DNA, 22 bp, Homo sapiens
acatgaaagttattctgagttg

SEQ ID NO: 8478719 - DNA, 22 bp, Homo sapiens
acatgaaagttattctgagttg

SEQ ID NO: 8478720 - DNA, 22 bp, Homo sapiens
acatgattcttgataggcattg

SEQ ID NO: 8478721 - DNA, 22 bp, Homo sapiens
acatgatcttatgtagaagatc

SEQ ID NO: 8478722 - DNA, 22 bp, Homo sapiens
acatgattaaaagattttaaag

SEQ ID NO: 8478723 - DNA, 22 bp, Homo sapiens
acatgattggactccttcccct

SEQ ID NO: 8478724 - DNA, 22 bp, Homo sapiens
acatgatttcagggaattctca

SEQ ID NO: 8478725 - DNA, 22 bp, Homo sapiens
acatgatattaatgtcttattt

SEQ ID NO: 8478726 - DNA, 22 bp, Homo sapiens
acatgatatatgggaaatgctt

SEQ ID NO: 8478727 - DNA, 22 bp, Homo sapiens
acatgatcccacctgcctataa

SEQ ID NO: 8478728 - DNA, 22 bp, Homo sapiens
acatgatctgacttgcttttta

SEQ ID NO: 8478729 - DNA, 22 bp, Homo sapiens
acatgatcttatgtagaagatc

SEQ ID NO: 8478730 - DNA, 22 bp, Homo sapiens
acatgagtacagatggatgtaa

SEQ ID NO: 8478731 - DNA, 23 bp, Homo sapiens
acatgatacacaattagcaaacc

SEQ ID NO: 8478732 - DNA, 22 bp, Homo sapiens
acatgagaggctgtggagtaca

SEQ ID NO: 8478733 - DNA, 22 bp, Homo sapiens
acatgagaggctgtggagtaca

SEQ ID NO: 8478734 - DNA, 22 bp, Homo sapiens
acatgagattagctcacccact

SEQ ID NO: 8478735 - DNA, 22 bp, Homo sapiens
acatgaggtgctataggtctac

SEQ ID NO: 8478736 - DNA, 22 bp, Homo sapiens
acatgaggtgctataggtctac

SEQ ID NO: 8478737 - DNA, 22 bp, Homo sapiens
acatgaggtgctataggtctac

SEQ ID NO: 8478738 - DNA, 22 bp, Homo sapiens
acatgcaatattgagactttct

SEQ ID NO: 8478739 - DNA, 22 bp, Homo sapiens
acatgcacacctatatacatgt

SEQ ID NO: 8478740 - DNA, 22 bp, Homo sapiens
acatgcaagcccctgaacacat

SEQ ID NO: 8478741 - DNA, 22 bp, Homo sapiens
acatgcaagcagccgtgcagat

SEQ ID NO: 8478742 - DNA, 22 bp, Homo sapiens
acatgcaagcccctgaacacat

SEQ ID NO: 8478743 - DNA, 22 bp, Homo sapiens
acatgcacagcaagggtgagag

SEQ ID NO: 8478744 - DNA, 22 bp, Homo sapiens
acatgcacacctatatacatgt

SEQ ID NO: 8478745 - DNA, 22 bp, Homo sapiens
acatgcacacgattcagtctgg

SEQ ID NO: 8478746 - DNA, 22 bp, Homo sapiens
acatgcacacgattcagtctgg

SEQ ID NO: 8478747 - DNA, 22 bp, Homo sapiens
acatgcaaatgtgcatgcatgt

SEQ ID NO: 8478748 - DNA, 23 bp, Homo sapiens
acatgcaaaaatcacagtctcct

SEQ ID NO: 8478749 - DNA, 22 bp, Homo sapiens
acatgcaaaaatatatttatga

SEQ ID NO: 8478750 - DNA, 22 bp, Homo sapiens
acatgattttagtatcataata

SEQ ID NO: 8478751 - DNA, 22 bp, Homo sapiens
acatgattttagtatcataata

SEQ ID NO: 8478752 - DNA, 22 bp, Homo sapiens
acatgattttagtatcataata

SEQ ID NO: 8478753 - DNA, 22 bp, Homo sapiens
acatggaagcaaagttctattt

SEQ ID NO: 8478754 - DNA, 22 bp, Homo sapiens
acatggaagcaaagttctattt

SEQ ID NO: 8478755 - DNA, 22 bp, Homo sapiens
acatggaagcaaagttctattt

SEQ ID NO: 8478756 - DNA, 22 bp, Homo sapiens
acatggaatgtgtactaagtta

SEQ ID NO: 8478757 - DNA, 22 bp, Homo sapiens
acatggaaagtactccacaatt

SEQ ID NO: 8478758 - DNA, 22 bp, Homo sapiens
acatggaagataaaaatactca

SEQ ID NO: 8478759 - DNA, 22 bp, Homo sapiens
acatggaagataaaaatactca

SEQ ID NO: 8478760 - DNA, 22 bp, Homo sapiens
aggccctgttatgagccactgt

SEQ ID NO: 8478761 - DNA, 22 bp, Homo sapiens
aggccctgttgtagcattttgg

SEQ ID NO: 8478762 - DNA, 22 bp, Homo sapiens
aggcccttggactcatgctcga

SEQ ID NO: 8478763 - DNA, 22 bp, Homo sapiens
acatggaaaactaactgctttt

SEQ ID NO: 8478764 - DNA, 22 bp, Homo sapiens
acatggaaaactaactgctttt

SEQ ID NO: 8478765 - DNA, 22 bp, Homo sapiens
acatggaaaactaactgctttt

SEQ ID NO: 8478766 - DNA, 22 bp, Homo sapiens
aggccgaagtggatgggcatct

SEQ ID NO: 8478767 - DNA, 22 bp, Homo sapiens
acatggatcaacctattttctt

SEQ ID NO: 8478768 - DNA, 20 bp, Homo sapiens
acatggatcaaatgtcagtt

SEQ ID NO: 8478769 - DNA, 22 bp, Homo sapiens
acatggagaccagatggaagta

SEQ ID NO: 8478770 - DNA, 22 bp, Homo sapiens
acatggagaccagatggaagta

SEQ ID NO: 8478771 - DNA, 19 bp, Homo sapiens
acatggcatcccaggaggt

SEQ ID NO: 8478772 - DNA, 22 bp, Homo sapiens
acatggcaggaatcatgtgttt

SEQ ID NO: 8478773 - DNA, 22 bp, Homo sapiens
aggccctgtccatggtgctgaa

SEQ ID NO: 8478774 - DNA, 22 bp, Homo sapiens
aggccctgtccatggtgctgaa

SEQ ID NO: 8478775 - DNA, 22 bp, Homo sapiens
aggccctgttatgagccactgt

SEQ ID NO: 8478776 - DNA, 22 bp, Homo sapiens
aggccctgttatgagccactgt

SEQ ID NO: 8478777 - DNA, 20 bp, Homo sapiens
aggccctgtgcatcttgttt

SEQ ID NO: 8478778 - DNA, 22 bp, Homo sapiens
aggccctgttatgagccactgt

SEQ ID NO: 8478779 - DNA, 22 bp, Homo sapiens
aggccctggtcaggtctggctg

SEQ ID NO: 8478780 - DNA, 22 bp, Homo sapiens
aggccctgtaaggtgtggagat

SEQ ID NO: 8478781 - DNA, 20 bp, Homo sapiens
aggccctgccagggacggag

SEQ ID NO: 8478782 - DNA, 20 bp, Homo sapiens
acatgcagtggtcatttcag

SEQ ID NO: 8478783 - DNA, 22 bp, Homo sapiens
acatgcataaactacttcttat

SEQ ID NO: 8478784 - DNA, 22 bp, Homo sapiens
acatgcagtgaggatcttagaa

SEQ ID NO: 8478785 - DNA, 22 bp, Homo sapiens
acatgcactctcactgtgctct

SEQ ID NO: 8478786 - DNA, 22 bp, Homo sapiens
acatgcactggttgaggggttt

SEQ ID NO: 8478787 - DNA, 22 bp, Homo sapiens
acatgcactgctcagggttccg

SEQ ID NO: 8478788 - DNA, 20 bp, Homo sapiens
acatgcacgtgtgtatatat

SEQ ID NO: 8478789 - DNA, 22 bp, Homo sapiens
acatgcacccagttacactctc

SEQ ID NO: 8478790 - DNA, 22 bp, Homo sapiens
acatgcacggcaccatcttctg

SEQ ID NO: 8478791 - DNA, 22 bp, Homo sapiens
acatgcagacgggatcctggca

SEQ ID NO: 8478792 - DNA, 22 bp, Homo sapiens
acatgcagaattcttagagagc

SEQ ID NO: 8478793 - DNA, 22 bp, Homo sapiens
acatgcaggaaaatgcacagat

SEQ ID NO: 8478794 - DNA, 22 bp, Homo sapiens
acatgcaggaaaatgcacagat

SEQ ID NO: 8478795 - DNA, 22 bp, Homo sapiens
acatgcagaattcttagagagc

SEQ ID NO: 8478796 - DNA, 22 bp, Homo sapiens
acatgcactggttgaggggttt

SEQ ID NO: 8478797 - DNA, 19 bp, Homo sapiens
aggctgcaaggtggtgggc

SEQ ID NO: 8478798 - DNA, 22 bp, Homo sapiens
aggctgatgctggctgaggctg

SEQ ID NO: 8478799 - DNA, 22 bp, Homo sapiens
aggctgagtttctcattctcgc

SEQ ID NO: 8478800 - DNA, 22 bp, Homo sapiens
aggctgagtttctcattctcgc

SEQ ID NO: 8478801 - DNA, 22 bp, Homo sapiens
aggctgagtgctcccctagatg

SEQ ID NO: 8478802 - DNA, 22 bp, Homo sapiens
aggctgagggctcctgagggca

SEQ ID NO: 8478803 - DNA, 22 bp, Homo sapiens
aggctgagggctcctgagggca

SEQ ID NO: 8478804 - DNA, 22 bp, Homo sapiens
aggctgagtttctcattctcgc

SEQ ID NO: 8478805 - DNA, 20 bp, Homo sapiens
aggctgagttctatgcactt

SEQ ID NO: 8478806 - DNA, 22 bp, Homo sapiens
aggctgagtgctcccctagatg

SEQ ID NO: 8478807 - DNA, 22 bp, Homo sapiens
aggctgaggctggcagctccag

SEQ ID NO: 8478808 - DNA, 22 bp, Homo sapiens
aggctgaggctggcagctccag

SEQ ID NO: 8478809 - DNA, 22 bp, Homo sapiens
aggctgaggctggcagctccag

SEQ ID NO: 8478810 - DNA, 22 bp, Homo sapiens
acatttcactgttcacagcagg

SEQ ID NO: 8478811 - DNA, 22 bp, Homo sapiens
aggctgaggctttccttggaga

SEQ ID NO: 8478812 - DNA, 22 bp, Homo sapiens
aggctgagggctcctgagggca

SEQ ID NO: 8478813 - DNA, 22 bp, Homo sapiens
aggctgaggctttccttggaga

SEQ ID NO: 8478814 - DNA, 22 bp, Homo sapiens
aggctgaggctttccttggaga

SEQ ID NO: 8478815 - DNA, 22 bp, Homo sapiens
aggctgagggctcctgagggca

SEQ ID NO: 8478816 - DNA, 22 bp, Homo sapiens
aggctgagggctcctgagggca

SEQ ID NO: 8478817 - DNA, 22 bp, Homo sapiens
acatttatataactcactagga

SEQ ID NO: 8478818 - DNA, 22 bp, Homo sapiens
acatttatataactcactagga

SEQ ID NO: 8478819 - DNA, 22 bp, Homo sapiens
acatttatataactcactagga

SEQ ID NO: 8478820 - DNA, 22 bp, Homo sapiens
acatttatataactcactagga

SEQ ID NO: 8478821 - DNA, 23 bp, Homo sapiens
acatttcaatactgagggtctga

SEQ ID NO: 8478822 - DNA, 22 bp, Homo sapiens
acatttattttggcacggcaca

SEQ ID NO: 8478823 - DNA, 22 bp, Homo sapiens
acatttaggatgttttgagaga

SEQ ID NO: 8478824 - DNA, 22 bp, Homo sapiens
acatttagtatgagtctctgta

SEQ ID NO: 8478825 - DNA, 18 bp, Homo sapiens
acatttaggagagtcaat

SEQ ID NO: 8478826 - DNA, 18 bp, Homo sapiens
acatttaggagagtcaat

SEQ ID NO: 8478827 - DNA, 19 bp, Homo sapiens
acatttagaatgtacttgc

SEQ ID NO: 8478828 - DNA, 22 bp, Homo sapiens
acatttagctgtacaatctatg

SEQ ID NO: 8478829 - DNA, 22 bp, Homo sapiens
acatttagatggtgttatagta

SEQ ID NO: 8478830 - DNA, 22 bp, Homo sapiens
acatttacagtgctagacaatc

SEQ ID NO: 8478831 - DNA, 22 bp, Homo sapiens
acatttaatgatcctactgtga

SEQ ID NO: 8478832 - DNA, 22 bp, Homo sapiens
acatttacagtgctagacaatc

SEQ ID NO: 8478833 - DNA, 22 bp, Homo sapiens
acatttaccctggaacattgga

SEQ ID NO: 8478834 - DNA, 22 bp, Homo sapiens
acatttacctagttaagtcaat

SEQ ID NO: 8478835 - DNA, 22 bp, Homo sapiens
acatttacctagttaagtcaat

SEQ ID NO: 8478836 - DNA, 22 bp, Homo sapiens
aggcgcagaaggccaggggcct

SEQ ID NO: 8478837 - DNA, 22 bp, Homo sapiens
aggcgcagaaggccaggggcct

SEQ ID NO: 8478838 - DNA, 22 bp, Homo sapiens
aggcgcagaaggccaggggcct

SEQ ID NO: 8478839 - DNA, 22 bp, Homo sapiens
aggcgcagaaggccaggggcct

SEQ ID NO: 8478840 - DNA, 22 bp, Homo sapiens
aggcgcagacatacagggtctg

SEQ ID NO: 8478841 - DNA, 22 bp, Homo sapiens
aggcgcagacatacagggtctg

SEQ ID NO: 8478842 - DNA, 22 bp, Homo sapiens
aggcgcagacatacagggtctg

SEQ ID NO: 8478843 - DNA, 22 bp, Homo sapiens
aggcgcacagggtgttgatgtg

SEQ ID NO: 8478844 - DNA, 22 bp, Homo sapiens
aggcgcagcacgtgagagttgg

SEQ ID NO: 8478845 - DNA, 22 bp, Homo sapiens
aggcgcagggtttggacccagg

SEQ ID NO: 8478846 - DNA, 22 bp, Homo sapiens
aggcgcagggtttggacccagg

SEQ ID NO: 8478847 - DNA, 22 bp, Homo sapiens
aggccttgtgagaagcagagaa

SEQ ID NO: 8478848 - DNA, 22 bp, Homo sapiens
aggccttcctcggagacaggga

SEQ ID NO: 8478849 - DNA, 22 bp, Homo sapiens
aggctaggggaacactagaatc

SEQ ID NO: 8478850 - DNA, 22 bp, Homo sapiens
aggctagggccatggctggtga

SEQ ID NO: 8478851 - DNA, 22 bp, Homo sapiens
aggctaggggaacactagaatc

SEQ ID NO: 8478852 - DNA, 22 bp, Homo sapiens
aggctagtcaagtcaagcagtg

SEQ ID NO: 8478853 - DNA, 22 bp, Homo sapiens
aggctagggtaacagatgtggc

SEQ ID NO: 8478854 - DNA, 22 bp, Homo sapiens
aggctatttccactcttctcat

SEQ ID NO: 8478855 - DNA, 22 bp, Homo sapiens
aggctatttccactcttctcat

SEQ ID NO: 8478856 - DNA, 22 bp, Homo sapiens
aggctatttccactcttctcat

SEQ ID NO: 8478857 - DNA, 22 bp, Homo sapiens
acattgtgatccgactgattaa

SEQ ID NO: 8478858 - DNA, 22 bp, Homo sapiens
acatttaaccaaactgtttaat

SEQ ID NO: 8478859 - DNA, 22 bp, Homo sapiens
acatttaaccaaactgtttaat

SEQ ID NO: 8478860 - DNA, 22 bp, Homo sapiens
acatttaacctttgaggaactg

SEQ ID NO: 8478861 - DNA, 22 bp, Homo sapiens
acatttaatgatcctactgtga

SEQ ID NO: 8478862 - DNA, 22 bp, Homo sapiens
acatttaagttaaaacctcagt

SEQ ID NO: 8478863 - DNA, 22 bp, Homo sapiens
agtttctaacatatagcattgg

SEQ ID NO: 8478864 - DNA, 22 bp, Homo sapiens
agtttccttgggcatttgttta

SEQ ID NO: 8478865 - DNA, 22 bp, Homo sapiens
agtttccttgggcatttgttta

SEQ ID NO: 8478866 - DNA, 22 bp, Homo sapiens
agtttccttggattcaatttgg

SEQ ID NO: 8478867 - DNA, 22 bp, Homo sapiens
agtttccttggattcaatttgg

SEQ ID NO: 8478868 - DNA, 22 bp, Homo sapiens
agtttcctgggagattcttaca

SEQ ID NO: 8478869 - DNA, 22 bp, Homo sapiens
actgtgtatgatatgtactggg

SEQ ID NO: 8478870 - DNA, 20 bp, Homo sapiens
actgtgtaaacatgattcat

SEQ ID NO: 8478871 - DNA, 22 bp, Homo sapiens
actgtgtattctaatgactaaa

SEQ ID NO: 8478872 - DNA, 18 bp, Homo sapiens
actgtggtttatgtgtag

SEQ ID NO: 8478873 - DNA, 21 bp, Homo sapiens
actgtgactgggtgtatgggt

SEQ ID NO: 8478874 - DNA, 22 bp, Homo sapiens
agtttcatgtagccatatttac

SEQ ID NO: 8478875 - DNA, 22 bp, Homo sapiens
actgtgagagaggttcttggta

SEQ ID NO: 8478876 - DNA, 23 bp, Homo sapiens
agtttccacccagggtagaaggg

SEQ ID NO: 8478877 - DNA, 22 bp, Homo sapiens
agtttccaaatattgttttagc

SEQ ID NO: 8478878 - DNA, 21 bp, Homo sapiens
agtttcctcaactgcagaagg

SEQ ID NO: 8478879 - DNA, 21 bp, Homo sapiens
agtttcctcaactgcagaagg

SEQ ID NO: 8478880 - DNA, 21 bp, Homo sapiens
agtttcctcaactgcagaagg

SEQ ID NO: 8478881 - DNA, 21 bp, Homo sapiens
agtttcctcatctgcatagga

SEQ ID NO: 8478882 - DNA, 22 bp, Homo sapiens
agtttcctcatctgtaaaatga

SEQ ID NO: 8478883 - DNA, 22 bp, Homo sapiens
agtttcccccttcacagcttaa

SEQ ID NO: 8478884 - DNA, 22 bp, Homo sapiens
actgtaaattttggttgcaggt

SEQ ID NO: 8478885 - DNA, 22 bp, Homo sapiens
actgtcatcttgtaagcaatgt

SEQ ID NO: 8478886 - DNA, 22 bp, Homo sapiens
actgtcatcttgtaagcaatgt

SEQ ID NO: 8478887 - DNA, 22 bp, Homo sapiens
actgtcatgacgtttgtcaccc

SEQ ID NO: 8478888 - DNA, 22 bp, Homo sapiens
actgtcatgatcgaagatgtca

SEQ ID NO: 8478889 - DNA, 22 bp, Homo sapiens
actgtaaaggtttgtagcccag

SEQ ID NO: 8478890 - DNA, 22 bp, Homo sapiens
actgtctgctggcccctggtta

SEQ ID NO: 8478891 - DNA, 22 bp, Homo sapiens
actgtcatgatcgaagatgtca

SEQ ID NO: 8478892 - DNA, 22 bp, Homo sapiens
actgtctgtcctgctctccgtg

SEQ ID NO: 8478893 - DNA, 22 bp, Homo sapiens
actgtcttcaaatgaatatatt

SEQ ID NO: 8478894 - DNA, 22 bp, Homo sapiens
actgtcttcaaatgaatatatt

SEQ ID NO: 8478895 - DNA, 22 bp, Homo sapiens
actgtgaacggactgaagccca

SEQ ID NO: 8478896 - DNA, 17 bp, Homo sapiens
actgtcttttacaccct

SEQ ID NO: 8478897 - DNA, 22 bp, Homo sapiens
actgtgaatcactactagtaga

SEQ ID NO: 8478898 - DNA, 20 bp, Homo sapiens
actgtgaatgctgaattagc

SEQ ID NO: 8478899 - DNA, 22 bp, Homo sapiens
actgtctttattagaatcttat

SEQ ID NO: 8478900 - DNA, 17 bp, Homo sapiens
actgtcttttacaccct

SEQ ID NO: 8478901 - DNA, 22 bp, Homo sapiens
actgtcttgttccaagactaaa

SEQ ID NO: 8478902 - DNA, 22 bp, Homo sapiens
actgtcttccaggtctggaggt

SEQ ID NO: 8478903 - DNA, 22 bp, Homo sapiens
actgtcttcatatctgtgtctc

SEQ ID NO: 8478904 - DNA, 22 bp, Homo sapiens
actggcagtagagggagcgcat

SEQ ID NO: 8478905 - DNA, 22 bp, Homo sapiens
actggcagtggcagcagaaaga

SEQ ID NO: 8478906 - DNA, 22 bp, Homo sapiens
actggcagtggcagcagaaaga

SEQ ID NO: 8478907 - DNA, 22 bp, Homo sapiens
actggcagtggcagcagaaaga

SEQ ID NO: 8478908 - DNA, 22 bp, Homo sapiens
actggcaggctgctggccggcg

SEQ ID NO: 8478909 - DNA, 20 bp, Homo sapiens
actggcagcctgcctgctgt

SEQ ID NO: 8478910 - DNA, 22 bp, Homo sapiens
actggcagctgtaggatgcatg

SEQ ID NO: 8478911 - DNA, 19 bp, Homo sapiens
actggcagtttctgcatgg

SEQ ID NO: 8478912 - DNA, 22 bp, Homo sapiens
actggcagtgtcgtttacatga

SEQ ID NO: 8478913 - DNA, 22 bp, Homo sapiens
actggcagtttgagaatgcatt

SEQ ID NO: 8478914 - DNA, 22 bp, Homo sapiens
actggcagtttgagaatgcatt

SEQ ID NO: 8478915 - DNA, 22 bp, Homo sapiens
agttgcagccttcaggagaccc

SEQ ID NO: 8478916 - DNA, 22 bp, Homo sapiens
agttgctcaatgtggctgtgga

SEQ ID NO: 8478917 - DNA, 22 bp, Homo sapiens
agtttacagttctcatcgcaac

SEQ ID NO: 8478918 - DNA, 22 bp, Homo sapiens
agtttacagatgctacaggagc

SEQ ID NO: 8478919 - DNA, 22 bp, Homo sapiens
agtttacacttttgattcttat

SEQ ID NO: 8478920 - DNA, 22 bp, Homo sapiens
agtttacactatgaaaagacta

SEQ ID NO: 8478921 - DNA, 22 bp, Homo sapiens
agtttacactatgaaaagacta

SEQ ID NO: 8478922 - DNA, 22 bp, Homo sapiens
actgtaaaatacataagtattg

SEQ ID NO: 8478923 - DNA, 22 bp, Homo sapiens
actgtaaaactgctttggaaac

SEQ ID NO: 8478924 - DNA, 22 bp, Homo sapiens
actgtaaaatgagatatgtata

SEQ ID NO: 8478925 - DNA, 22 bp, Homo sapiens
actgtaaaatgagatatgtata

SEQ ID NO: 8478926 - DNA, 22 bp, Homo sapiens
actgtaaagaagtaagtatggg

SEQ ID NO: 8478927 - DNA, 22 bp, Homo sapiens
actgtaaaacaggtttcatcat

SEQ ID NO: 8478928 - DNA, 22 bp, Homo sapiens
agtttagagttcaaattagttc

SEQ ID NO: 8478929 - DNA, 22 bp, Homo sapiens
agtttatagcccagattcatgg

SEQ ID NO: 8478930 - DNA, 22 bp, Homo sapiens
agtttatgaaacacagatttga

SEQ ID NO: 8478931 - DNA, 22 bp, Homo sapiens
agtttacatcttcaatctcatt

SEQ ID NO: 8478932 - DNA, 22 bp, Homo sapiens
agtttacatcttcaatctcatt

SEQ ID NO: 8478933 - DNA, 22 bp, Homo sapiens
agtttacataaaaaggcagagg

SEQ ID NO: 8478934 - DNA, 22 bp, Homo sapiens
agtttacatcttcaatctcatt

SEQ ID NO: 8478935 - DNA, 22 bp, Homo sapiens
agtttacatgacgtgtatttca

SEQ ID NO: 8478936 - DNA, 22 bp, Homo sapiens
agtttacatgacgtgtatttca

SEQ ID NO: 8478937 - DNA, 22 bp, Homo sapiens
acttgggaaagaagtttcaccg

SEQ ID NO: 8478938 - DNA, 22 bp, Homo sapiens
acttggcttttccatctctgca

SEQ ID NO: 8478939 - DNA, 21 bp, Homo sapiens
acttggccaggcccccacctg

SEQ ID NO: 8478940 - DNA, 22 bp, Homo sapiens
acttggccttatttccacagaa

SEQ ID NO: 8478941 - DNA, 22 bp, Homo sapiens
acttggatatgttcactagacc

SEQ ID NO: 8478942 - DNA, 22 bp, Homo sapiens
acttggagggagctgggtggaa

SEQ ID NO: 8478943 - DNA, 23 bp, Homo sapiens
acttggaagcagtgaacaacttt

SEQ ID NO: 8478944 - DNA, 23 bp, Homo sapiens
acttggaagcagtgaacaacttt

SEQ ID NO: 8478945 - DNA, 22 bp, Homo sapiens
acttggagagataatcccatat

SEQ ID NO: 8478946 - DNA, 22 bp, Homo sapiens
acttggagagataatcccatat

SEQ ID NO: 8478947 - DNA, 22 bp, Homo sapiens
acttggagagcattgctgggga

SEQ ID NO: 8478948 - DNA, 22 bp, Homo sapiens
acttggagagcattgctgggga

SEQ ID NO: 8478949 - DNA, 22 bp, Homo sapiens
acttggagggagctgggtggaa

SEQ ID NO: 8478950 - DNA, 22 bp, Homo sapiens
acttggagagcattgctgggga

SEQ ID NO: 8478951 - DNA, 20 bp, Homo sapiens
acttggaactcatttttctt

SEQ ID NO: 8478952 - DNA, 22 bp, Homo sapiens
acttggaaagatgcaacacagt

SEQ ID NO: 8478953 - DNA, 22 bp, Homo sapiens
acttggaaagatgcaacacagt

SEQ ID NO: 8478954 - DNA, 22 bp, Homo sapiens
acttggaaaattcaaaatggca

SEQ ID NO: 8478955 - DNA, 22 bp, Homo sapiens
acttggaaaattcaaaatggca

SEQ ID NO: 8478956 - DNA, 22 bp, Homo sapiens
acttgctggtggcatttacagt

SEQ ID NO: 8478957 - DNA, 20 bp, Homo sapiens
acttgctgggctttgttacc

SEQ ID NO: 8478958 - DNA, 22 bp, Homo sapiens
acttgccccagaattgctgctg

SEQ ID NO: 8478959 - DNA, 22 bp, Homo sapiens
acttgccataaatgaaaatact

SEQ ID NO: 8478960 - DNA, 22 bp, Homo sapiens
acttgcattatatttatcacaa

SEQ ID NO: 8478961 - DNA, 22 bp, Homo sapiens
acttcatgaactaagggatcgg

SEQ ID NO: 8478962 - DNA, 22 bp, Homo sapiens
acttcatgcagaagagagctgt

SEQ ID NO: 8478963 - DNA, 22 bp, Homo sapiens
acttcatgctttagagagatga

SEQ ID NO: 8478964 - DNA, 22 bp, Homo sapiens
acttcatgaacatgtggcctgt

SEQ ID NO: 8478965 - DNA, 22 bp, Homo sapiens
acttcatgcagaagagagctgt

SEQ ID NO: 8478966 - DNA, 22 bp, Homo sapiens
acttcatgctttagagagatga

SEQ ID NO: 8478967 - DNA, 23 bp, Homo sapiens
acttcatggcactgtcttagagg

SEQ ID NO: 8478968 - DNA, 22 bp, Homo sapiens
acttcagtaggtgatatgtgca

SEQ ID NO: 8478969 - DNA, 22 bp, Homo sapiens
acttcagccaagaaaactcagt

SEQ ID NO: 8478970 - DNA, 22 bp, Homo sapiens
acttcagcccagaggaagggat

SEQ ID NO: 8478971 - DNA, 22 bp, Homo sapiens
acttcattgtaatattatagca

SEQ ID NO: 8478972 - DNA, 22 bp, Homo sapiens
acttcatgtagtccatcaggtt

SEQ ID NO: 8478973 - DNA, 22 bp, Homo sapiens
acttcatgtactgttcaaggcc

SEQ ID NO: 8478974 - DNA, 22 bp, Homo sapiens
acttcatgttgctcttggctat

SEQ ID NO: 8478975 - DNA, 22 bp, Homo sapiens
acttcatgttgtttacaactta

SEQ ID NO: 8478976 - DNA, 22 bp, Homo sapiens
acttcatgtttctattagctca

SEQ ID NO: 8478977 - DNA, 22 bp, Homo sapiens
acttcattcattttcacgaatg

SEQ ID NO: 8478978 - DNA, 22 bp, Homo sapiens
acttgcagcagcagctattggc

SEQ ID NO: 8478979 - DNA, 22 bp, Homo sapiens
acttctttcacaatgtttctag

SEQ ID NO: 8478980 - DNA, 22 bp, Homo sapiens
acttgatttttataataaatgg

SEQ ID NO: 8478981 - DNA, 22 bp, Homo sapiens
acttgattttgaacctttctac

SEQ ID NO: 8478982 - DNA, 22 bp, Homo sapiens
acttgatttttataataaatgg

SEQ ID NO: 8478983 - DNA, 22 bp, Homo sapiens
acttccagatggccccatctaa

SEQ ID NO: 8478984 - DNA, 22 bp, Homo sapiens
acttctttcacaatgtttctag

SEQ ID NO: 8478985 - DNA, 18 bp, Homo sapiens
actgttatctgataaggc

SEQ ID NO: 8478986 - DNA, 22 bp, Homo sapiens
actgttatagttcacttttccc

SEQ ID NO: 8478987 - DNA, 22 bp, Homo sapiens
actgttatgatttacacagtcc

SEQ ID NO: 8478988 - DNA, 22 bp, Homo sapiens
actgttatgatttacacagtcc

SEQ ID NO: 8478989 - DNA, 22 bp, Homo sapiens
actgttatgttattacccatgt

SEQ ID NO: 8478990 - DNA, 22 bp, Homo sapiens
actgttatgttattacccatgt

SEQ ID NO: 8478991 - DNA, 22 bp, Homo sapiens
acttagaattaaatatttttgg

SEQ ID NO: 8478992 - DNA, 22 bp, Homo sapiens
acttagaattaaatatttttgg

SEQ ID NO: 8478993 - DNA, 22 bp, Homo sapiens
acttatttcatggatcataatg

SEQ ID NO: 8478994 - DNA, 22 bp, Homo sapiens
acttcaaacaattaacagagaa

SEQ ID NO: 8478995 - DNA, 22 bp, Homo sapiens
acttcaaacaattaacagagaa

SEQ ID NO: 8478996 - DNA, 19 bp, Homo sapiens
acttcaaatcttagagaaa

SEQ ID NO: 8478997 - DNA, 22 bp, Homo sapiens
acttcagagttagttatagacc

SEQ ID NO: 8478998 - DNA, 22 bp, Homo sapiens
acttcagagaaagagggaattc

SEQ ID NO: 8478999 - DNA, 22 bp, Homo sapiens
acttcacatttgcaagtcttgg

SEQ ID NO: 8479000 - DNA, 22 bp, Homo sapiens
acttcacagatatttatttggt

SEQ ID NO: 8479001 - DNA, 22 bp, Homo sapiens
acttcacaggttttcataaaac

SEQ ID NO: 8479002 - DNA, 22 bp, Homo sapiens
acttcacaggttttcataaaac

SEQ ID NO: 8479003 - DNA, 22 bp, Homo sapiens
acttcacattagctaaaaggga

SEQ ID NO: 8479004 - DNA, 22 bp, Homo sapiens
acttcaaattttcagaagaaat

SEQ ID NO: 8479005 - DNA, 22 bp, Homo sapiens
acttcacagaaattttatgagg

SEQ ID NO: 8479006 - DNA, 22 bp, Homo sapiens
acttcacacagcaaatttatct

SEQ ID NO: 8479007 - DNA, 22 bp, Homo sapiens
acttcacaaagagatcatctaa

SEQ ID NO: 8479008 - DNA, 22 bp, Homo sapiens
acttcacaaagagatcatctaa

SEQ ID NO: 8479009 - DNA, 22 bp, Homo sapiens
acttcacaactgtacatggcag

SEQ ID NO: 8479010 - DNA, 20 bp, Homo sapiens
actgtgtgatctggaaagct

SEQ ID NO: 8479011 - DNA, 22 bp, Homo sapiens
actgtgtgaggctgggtgagtc

SEQ ID NO: 8479012 - DNA, 22 bp, Homo sapiens
actgtgtgactgttattactgt

SEQ ID NO: 8479013 - DNA, 18 bp, Homo sapiens
actgtgtgaattagctcc

SEQ ID NO: 8479014 - DNA, 22 bp, Homo sapiens
actgtgtgaggctgggtgagtc

SEQ ID NO: 8479015 - DNA, 22 bp, Homo sapiens
actgtgtgccaggcgctggtct

SEQ ID NO: 8479016 - DNA, 22 bp, Homo sapiens
actgtgtgccctgacgccaggg

SEQ ID NO: 8479017 - DNA, 22 bp, Homo sapiens
actgtgtgccctgacgccaggg

SEQ ID NO: 8479018 - DNA, 22 bp, Homo sapiens
actgtgtgccctgacgccaggg

SEQ ID NO: 8479019 - DNA, 22 bp, Homo sapiens
actgtgtgctggacatgatgtt

SEQ ID NO: 8479020 - DNA, 22 bp, Homo sapiens
actgtgtggaaatttgtgaggg

SEQ ID NO: 8479021 - DNA, 22 bp, Homo sapiens
actgtgtggaaatttgtgaggg

SEQ ID NO: 8479022 - DNA, 22 bp, Homo sapiens
actgtgtggaaatttgtgaggg

SEQ ID NO: 8479023 - DNA, 19 bp, Homo sapiens
actgtgtggaagtgtgatt

SEQ ID NO: 8479024 - DNA, 19 bp, Homo sapiens
actgtgtggaagtgtgatt

SEQ ID NO: 8479025 - DNA, 22 bp, Homo sapiens
actgtgtcctcatgtggcagaa

SEQ ID NO: 8479026 - DNA, 22 bp, Homo sapiens
actgtgtcctatttccttgaca

SEQ ID NO: 8479027 - DNA, 22 bp, Homo sapiens
actgtgtgaaacatcaatgtgt

SEQ ID NO: 8479028 - DNA, 22 bp, Homo sapiens
actgtgtgaaacatcaatgtgt

SEQ ID NO: 8479029 - DNA, 18 bp, Homo sapiens
actgtgtgaattagctcc

SEQ ID NO: 8479030 - DNA, 22 bp, Homo sapiens
actgtgtgaaacatcaatgtgt

SEQ ID NO: 8479031 - DNA, 22 bp, Homo sapiens
actgtgtgaaacatcaatgtgt

SEQ ID NO: 8479032 - DNA, 18 bp, Homo sapiens
actgtgtgaattagctcc

SEQ ID NO: 8479033 - DNA, 22 bp, Homo sapiens
actgtgtgactgttattactgt

SEQ ID NO: 8479034 - DNA, 22 bp, Homo sapiens
actgtgtgactgttattactgt

SEQ ID NO: 8479035 - DNA, 22 bp, Homo sapiens
actgtgtgtttgtctagcacag

SEQ ID NO: 8479036 - DNA, 22 bp, Homo sapiens
actgtgtggaccactctgaggc

SEQ ID NO: 8479037 - DNA, 19 bp, Homo sapiens
actgtgtggaagtgtgatt

SEQ ID NO: 8479038 - DNA, 22 bp, Homo sapiens
actgtgtggaccactctgaggc

SEQ ID NO: 8479039 - DNA, 22 bp, Homo sapiens
actgtgtgggccgctcactggg

SEQ ID NO: 8479040 - DNA, 22 bp, Homo sapiens
actgtgtggaccactctgaggc

SEQ ID NO: 8479041 - DNA, 22 bp, Homo sapiens
actgtgtggaccactctgaggc

SEQ ID NO: 8479042 - DNA, 22 bp, Homo sapiens
actgtgtgtttgtctagcacag

SEQ ID NO: 8479043 - DNA, 22 bp, Homo sapiens
actgtgtgggccgctcactggg

SEQ ID NO: 8479044 - DNA, 22 bp, Homo sapiens
actgtgtgggccgctcactggg

SEQ ID NO: 8479045 - DNA, 22 bp, Homo sapiens
actgttacagagcaggaaattg

SEQ ID NO: 8479046 - DNA, 22 bp, Homo sapiens
actgttaattcaatcaacaggt

SEQ ID NO: 8479047 - DNA, 22 bp, Homo sapiens
actgttaagtatgaagtaaggc

SEQ ID NO: 8479048 - DNA, 22 bp, Homo sapiens
actgttacagggcactgaacat

SEQ ID NO: 8479049 - DNA, 22 bp, Homo sapiens
actgttacagagcaggaaattg

SEQ ID NO: 8479050 - DNA, 22 bp, Homo sapiens
actgttacagggcactgaacat

SEQ ID NO: 8479051 - DNA, 22 bp, Homo sapiens
actgttaacggtatgatgctcg

SEQ ID NO: 8479052 - DNA, 21 bp, Homo sapiens
actgttaagacgtagctgggg

SEQ ID NO: 8479053 - DNA, 22 bp, Homo sapiens
actgttaaagtaattaattgtc

SEQ ID NO: 8479054 - DNA, 22 bp, Homo sapiens
agaaaattagattttactgtgt

SEQ ID NO: 8479055 - DNA, 22 bp, Homo sapiens
agaaaattagattttactgtgt

SEQ ID NO: 8479056 - DNA, 22 bp, Homo sapiens
agaaaataaattgatggtggaa

SEQ ID NO: 8479057 - DNA, 22 bp, Homo sapiens
agaaaataaattgatggtggaa

SEQ ID NO: 8479058 - DNA, 22 bp, Homo sapiens
agaaaataaattgatggtggaa

SEQ ID NO: 8479059 - DNA, 22 bp, Homo sapiens
atatgaaaagaagtcaccattg

SEQ ID NO: 8479060 - DNA, 22 bp, Homo sapiens
atatcttttagagcaagcttgt

SEQ ID NO: 8479061 - DNA, 22 bp, Homo sapiens
atatgaaaagaagtcaccattg

SEQ ID NO: 8479062 - DNA, 22 bp, Homo sapiens
atatctttgtatggttcagcag

SEQ ID NO: 8479063 - DNA, 22 bp, Homo sapiens
atatctttgtttttgccaagat

SEQ ID NO: 8479064 - DNA, 22 bp, Homo sapiens
agaaacaaggtgtaggttgacc

SEQ ID NO: 8479065 - DNA, 22 bp, Homo sapiens
agaaacaaggtgtaggttgacc

SEQ ID NO: 8479066 - DNA, 22 bp, Homo sapiens
agaaacagaaccaggtgtcatt

SEQ ID NO: 8479067 - DNA, 22 bp, Homo sapiens
agaaacaaggtgtaggttgacc

SEQ ID NO: 8479068 - DNA, 22 bp, Homo sapiens
agaaacaacttgtttctcttgc

SEQ ID NO: 8479069 - DNA, 22 bp, Homo sapiens
agaaaatttaaagagacacaca

SEQ ID NO: 8479070 - DNA, 22 bp, Homo sapiens
agaaaatttaaagagacacaca

SEQ ID NO: 8479071 - DNA, 22 bp, Homo sapiens
agaaaatttaaagagacacaca

SEQ ID NO: 8479072 - DNA, 22 bp, Homo sapiens
agaaaatttattcatgttagtt

SEQ ID NO: 8479073 - DNA, 22 bp, Homo sapiens
atatccagcagcaggtgagtat

SEQ ID NO: 8479074 - DNA, 22 bp, Homo sapiens
atatattttgaatagcctctgt

SEQ ID NO: 8479075 - DNA, 22 bp, Homo sapiens
atatcttctttattttgtgagg

SEQ ID NO: 8479076 - DNA, 22 bp, Homo sapiens
atatatttgagaatattcatga

SEQ ID NO: 8479077 - DNA, 22 bp, Homo sapiens
atatatttactctcctgttgca

SEQ ID NO: 8479078 - DNA, 22 bp, Homo sapiens
atatatttgagaatattcatga

SEQ ID NO: 8479079 - DNA, 22 bp, Homo sapiens
atatatttgagaatattcatga

SEQ ID NO: 8479080 - DNA, 22 bp, Homo sapiens
atatatttgagaatattcatga

SEQ ID NO: 8479081 - DNA, 22 bp, Homo sapiens
atatatttgagaatattcatga

SEQ ID NO: 8479082 - DNA, 22 bp, Homo sapiens
atatatttgagaatattcatga

SEQ ID NO: 8479083 - DNA, 22 bp, Homo sapiens
atatatttgagaatattcatga

SEQ ID NO: 8479084 - DNA, 22 bp, Homo sapiens
actttgggtaagccaggtgcta

SEQ ID NO: 8479085 - DNA, 22 bp, Homo sapiens
actttggggaacttttctcctc

SEQ ID NO: 8479086 - DNA, 21 bp, Homo sapiens
actttgggcactttcctgccc

SEQ ID NO: 8479087 - DNA, 20 bp, Homo sapiens
actttggggtctttctcaga

SEQ ID NO: 8479088 - DNA, 20 bp, Homo sapiens
actttggggtctttctcaga

SEQ ID NO: 8479089 - DNA, 22 bp, Homo sapiens
atatataacctggataaggctt

SEQ ID NO: 8479090 - DNA, 22 bp, Homo sapiens
atatataacctggataaggctt

SEQ ID NO: 8479091 - DNA, 22 bp, Homo sapiens
actttgtataagacaataaaga

SEQ ID NO: 8479092 - DNA, 22 bp, Homo sapiens
atatattcttaaagaatctgac

SEQ ID NO: 8479093 - DNA, 22 bp, Homo sapiens
atatattacaaaagaggaagga

SEQ ID NO: 8479094 - DNA, 22 bp, Homo sapiens
atatattacaaaagaggaagga

SEQ ID NO: 8479095 - DNA, 22 bp, Homo sapiens
actttgtaggtttcagtgaaac

SEQ ID NO: 8479096 - DNA, 22 bp, Homo sapiens
atatacaaagggcaacctcgct

SEQ ID NO: 8479097 - DNA, 22 bp, Homo sapiens
atatacaaagggcaacctcgct

SEQ ID NO: 8479098 - DNA, 22 bp, Homo sapiens
atatacaaagggcaacctcgct

SEQ ID NO: 8479099 - DNA, 22 bp, Homo sapiens
atataatagtttcataaaggct

SEQ ID NO: 8479100 - DNA, 22 bp, Homo sapiens
atataatagtttcataaaggct

SEQ ID NO: 8479101 - DNA, 22 bp, Homo sapiens
atataatagtttcataaaggct

SEQ ID NO: 8479102 - DNA, 22 bp, Homo sapiens
atataatagtttcataaaggct

SEQ ID NO: 8479103 - DNA, 22 bp, Homo sapiens
atagttgtgtggggattctggt

SEQ ID NO: 8479104 - DNA, 22 bp, Homo sapiens
acttgggatttcagatgctgtg

SEQ ID NO: 8479105 - DNA, 18 bp, Homo sapiens
acttgggacttttgcatt

SEQ ID NO: 8479106 - DNA, 22 bp, Homo sapiens
acttggtggaacgtgtatttta

SEQ ID NO: 8479107 - DNA, 22 bp, Homo sapiens
acttgggtcacatgacctacct

SEQ ID NO: 8479108 - DNA, 22 bp, Homo sapiens
acttgggtcaagtagctcacag

SEQ ID NO: 8479109 - DNA, 22 bp, Homo sapiens
acttgggtcaagtagctcacag

SEQ ID NO: 8479110 - DNA, 22 bp, Homo sapiens
atccacttggctggttgttcta

SEQ ID NO: 8479111 - DNA, 22 bp, Homo sapiens
atccagaacacctgtatcacca

SEQ ID NO: 8479112 - DNA, 22 bp, Homo sapiens
atccagagacccaaggacagaa

SEQ ID NO: 8479113 - DNA, 22 bp, Homo sapiens
atccagagacccaaggacagaa

SEQ ID NO: 8479114 - DNA, 22 bp, Homo sapiens
atcatttccctttagatcacaa

SEQ ID NO: 8479115 - DNA, 22 bp, Homo sapiens
atccactctcccattcatgcat

SEQ ID NO: 8479116 - DNA, 22 bp, Homo sapiens
atccacttgccactgtatagtt

SEQ ID NO: 8479117 - DNA, 22 bp, Homo sapiens
atccactctaagatctgtggtg

SEQ ID NO: 8479118 - DNA, 22 bp, Homo sapiens
atccactctcccattcatgcat

SEQ ID NO: 8479119 - DNA, 22 bp, Homo sapiens
atccagagaggttaggtgacat

SEQ ID NO: 8479120 - DNA, 22 bp, Homo sapiens
atccagagtaatacagaatgca

SEQ ID NO: 8479121 - DNA, 22 bp, Homo sapiens
atccagcacttgttcatgtgaa

SEQ ID NO: 8479122 - DNA, 22 bp, Homo sapiens
atccagctttgtctggtcttcg

SEQ ID NO: 8479123 - DNA, 22 bp, Homo sapiens
agaagaaatgaggccgttctgc

SEQ ID NO: 8479124 - DNA, 22 bp, Homo sapiens
agaacctttctttagaaattca

SEQ ID NO: 8479125 - DNA, 22 bp, Homo sapiens
agaacctttctttagaaattca

SEQ ID NO: 8479126 - DNA, 21 bp, Homo sapiens
atcagcaaatgcctgtctccc

SEQ ID NO: 8479127 - DNA, 22 bp, Homo sapiens
atcagcaagattgtgtcttgta

SEQ ID NO: 8479128 - DNA, 22 bp, Homo sapiens
atcagcaagatgtaatttctat

SEQ ID NO: 8479129 - DNA, 22 bp, Homo sapiens
atcagcaagcatttattgagtg

SEQ ID NO: 8479130 - DNA, 22 bp, Homo sapiens
atcagcaagcatggttaggtgt

SEQ ID NO: 8479131 - DNA, 20 bp, Homo sapiens
atcatctttacaatgtcagt

SEQ ID NO: 8479132 - DNA, 20 bp, Homo sapiens
atcatctttacaatgtcagt

SEQ ID NO: 8479133 - DNA, 22 bp, Homo sapiens
atcattctctgcttgagcactc

SEQ ID NO: 8479134 - DNA, 22 bp, Homo sapiens
atcattctgatggtcaatgcta

SEQ ID NO: 8479135 - DNA, 22 bp, Homo sapiens
atcatcttgctttctgtttact

SEQ ID NO: 8479136 - DNA, 20 bp, Homo sapiens
atcatctttacaatgtcagt

SEQ ID NO: 8479137 - DNA, 22 bp, Homo sapiens
atcagcaagatgtaatttctat

SEQ ID NO: 8479138 - DNA, 19 bp, Homo sapiens
atcagcaaggtaggatgtg

SEQ ID NO: 8479139 - DNA, 22 bp, Homo sapiens
atcatttatgccccaattagat

SEQ ID NO: 8479140 - DNA, 22 bp, Homo sapiens
atcatttacaaactcagcattg

SEQ ID NO: 8479141 - DNA, 22 bp, Homo sapiens
atcatttacaaactcagcattg

SEQ ID NO: 8479142 - DNA, 22 bp, Homo sapiens
atcatttacaaactcagcattg

SEQ ID NO: 8479143 - DNA, 22 bp, Homo sapiens
atcattgaatataagtgctatt

SEQ ID NO: 8479144 - DNA, 22 bp, Homo sapiens
atcattgaatataagtgctatt

SEQ ID NO: 8479145 - DNA, 22 bp, Homo sapiens
atcattgagattttttacaact

SEQ ID NO: 8479146 - DNA, 22 bp, Homo sapiens
atcattgaattgctttgttctt

SEQ ID NO: 8479147 - DNA, 22 bp, Homo sapiens
atcattgaaatgtagtttcatc

SEQ ID NO: 8479148 - DNA, 22 bp, Homo sapiens
atcatttaaaacaagtctctat

SEQ ID NO: 8479149 - DNA, 22 bp, Homo sapiens
atcatttaaaacaagtctctat

SEQ ID NO: 8479150 - DNA, 22 bp, Homo sapiens
atcattggaggcactgtgcagt

SEQ ID NO: 8479151 - DNA, 19 bp, Homo sapiens
atcattgatcttcacccct

SEQ ID NO: 8479152 - DNA, 22 bp, Homo sapiens
atcattgagtaaaatgaataca

SEQ ID NO: 8479153 - DNA, 22 bp, Homo sapiens
atcactgtggcccaaaacctca

SEQ ID NO: 8479154 - DNA, 22 bp, Homo sapiens
atcactgtgtatgtatatgcag

SEQ ID NO: 8479155 - DNA, 22 bp, Homo sapiens
atcactgtggcccaaaacctca

SEQ ID NO: 8479156 - DNA, 22 bp, Homo sapiens
atcactgtcgtcatctgagatt

SEQ ID NO: 8479157 - DNA, 22 bp, Homo sapiens
atcactgtcgtcatctgagatt

SEQ ID NO: 8479158 - DNA, 22 bp, Homo sapiens
atcagagtcagaggctagagct

SEQ ID NO: 8479159 - DNA, 20 bp, Homo sapiens
atcagaggatagggaagtgg

SEQ ID NO: 8479160 - DNA, 22 bp, Homo sapiens
atcagaggacctagttgggcag

SEQ ID NO: 8479161 - DNA, 22 bp, Homo sapiens
atcaccaggcaaaatgtcagag

SEQ ID NO: 8479162 - DNA, 22 bp, Homo sapiens
atcaccattgaaaaacaggttt

SEQ ID NO: 8479163 - DNA, 23 bp, Homo sapiens
atcaccagcggaagctgcagacc

SEQ ID NO: 8479164 - DNA, 23 bp, Homo sapiens
atcaccagcggaagctgcagacc

SEQ ID NO: 8479165 - DNA, 22 bp, Homo sapiens
atcacattgttagcatagactg

SEQ ID NO: 8479166 - DNA, 22 bp, Homo sapiens
atcacattgttagcatagactg

SEQ ID NO: 8479167 - DNA, 22 bp, Homo sapiens
atcacatttatagtggcacgca

SEQ ID NO: 8479168 - DNA, 22 bp, Homo sapiens
atcaccactacaaacatcattg

SEQ ID NO: 8479169 - DNA, 22 bp, Homo sapiens
atcaccaaggctttaggaattt

SEQ ID NO: 8479170 - DNA, 22 bp, Homo sapiens
atcactgagcttcagtgctggc

SEQ ID NO: 8479171 - DNA, 22 bp, Homo sapiens
atcacctgcacaaatgtgttcc

SEQ ID NO: 8479172 - DNA, 22 bp, Homo sapiens
atcacctggccattgggttaac

SEQ ID NO: 8479173 - DNA, 19 bp, Homo sapiens
atcacctggtgtttccttg

SEQ ID NO: 8479174 - DNA, 20 bp, Homo sapiens
atcacctgtaggttctttgt

SEQ ID NO: 8479175 - DNA, 22 bp, Homo sapiens
atcacgtgctgagagtgttatt

SEQ ID NO: 8479176 - DNA, 22 bp, Homo sapiens
agaaacatcgcttagtcctcat

SEQ ID NO: 8479177 - DNA, 22 bp, Homo sapiens
agaaacatcctgctttccattt

SEQ ID NO: 8479178 - DNA, 22 bp, Homo sapiens
agaaacatcctgctttccattt

SEQ ID NO: 8479179 - DNA, 21 bp, Homo sapiens
agaaacatgatcaaaggaacc

SEQ ID NO: 8479180 - DNA, 22 bp, Homo sapiens
agaaacatttagattatatgtc

SEQ ID NO: 8479181 - DNA, 22 bp, Homo sapiens
agaaacatttagattatatgtc

SEQ ID NO: 8479182 - DNA, 22 bp, Homo sapiens
agaaacatttagattatatgtc

SEQ ID NO: 8479183 - DNA, 21 bp, Homo sapiens
atcacattggctgttattatt

SEQ ID NO: 8479184 - DNA, 21 bp, Homo sapiens
atcacattggctgttattatt

SEQ ID NO: 8479185 - DNA, 21 bp, Homo sapiens
atcacattggctgttattatt

SEQ ID NO: 8479186 - DNA, 22 bp, Homo sapiens
atcacaaaggctgcttcatgat

SEQ ID NO: 8479187 - DNA, 22 bp, Homo sapiens
atcacattgccagtgattaccc

SEQ ID NO: 8479188 - DNA, 22 bp, Homo sapiens
atcacaaaggctgcttcatgat

SEQ ID NO: 8479189 - DNA, 22 bp, Homo sapiens
agaaacatcattggaacacaag

SEQ ID NO: 8479190 - DNA, 22 bp, Homo sapiens
agaaacatcattggaacacaag

SEQ ID NO: 8479191 - DNA, 22 bp, Homo sapiens
agaaacatattcagtgagtaat

SEQ ID NO: 8479192 - DNA, 22 bp, Homo sapiens
agaaacatattcagtgagtaat

SEQ ID NO: 8479193 - DNA, 22 bp, Homo sapiens
agaaacagcattagcatcaatt

SEQ ID NO: 8479194 - DNA, 22 bp, Homo sapiens
agaaacagcattagcatcaatt

SEQ ID NO: 8479195 - DNA, 22 bp, Homo sapiens
agaaacatcattgtttggtatt

SEQ ID NO: 8479196 - DNA, 22 bp, Homo sapiens
agaaacatcattgtttggtatt

SEQ ID NO: 8479197 - DNA, 22 bp, Homo sapiens
agaaacatcattggaacacaag

SEQ ID NO: 8479198 - DNA, 20 bp, Homo sapiens
agaaacagcacaattctgtt

SEQ ID NO: 8479199 - DNA, 20 bp, Homo sapiens
agaaacagcacaattctgtt

SEQ ID NO: 8479200 - DNA, 22 bp, Homo sapiens
agaaacagaagggaaagctttt

SEQ ID NO: 8479201 - DNA, 22 bp, Homo sapiens
agaaacagaagggaaagctttt

SEQ ID NO: 8479202 - DNA, 22 bp, Homo sapiens
agaaacagaagggaaagctttt

SEQ ID NO: 8479203 - DNA, 22 bp, Homo sapiens
agaaacagaagggaaagctttt

SEQ ID NO: 8479204 - DNA, 22 bp, Homo sapiens
agaaacagcattagcatcaatt

SEQ ID NO: 8479205 - DNA, 20 bp, Homo sapiens
agaaacagcacaattctgtt

SEQ ID NO: 8479206 - DNA, 20 bp, Homo sapiens
agaaacagcacaattctgtt

SEQ ID NO: 8479207 - DNA, 22 bp, Homo sapiens
agaaacagcattagcatcaatt

SEQ ID NO: 8479208 - DNA, 22 bp, Homo sapiens
agtcggaagctgtgcgtaaatc

SEQ ID NO: 8479209 - DNA, 22 bp, Homo sapiens
agtctacaaagggaagcccttt

SEQ ID NO: 8479210 - DNA, 22 bp, Homo sapiens
agtctctgaggttcagatgcct

SEQ ID NO: 8479211 - DNA, 19 bp, Homo sapiens
agtctctgaggcctaagtt

SEQ ID NO: 8479212 - DNA, 22 bp, Homo sapiens
actccagggcttctatgatggt

SEQ ID NO: 8479213 - DNA, 22 bp, Homo sapiens
actccagggctgaacgaggccc

SEQ ID NO: 8479214 - DNA, 22 bp, Homo sapiens
actccagggctgaacgaggccc

SEQ ID NO: 8479215 - DNA, 22 bp, Homo sapiens
actccagggctccatcccttgt

SEQ ID NO: 8479216 - DNA, 22 bp, Homo sapiens
actccagggctccatcccttgt

SEQ ID NO: 8479217 - DNA, 22 bp, Homo sapiens
actccagggctccatcccttgt

SEQ ID NO: 8479218 - DNA, 22 bp, Homo sapiens
actccagggctgaacgaggccc

SEQ ID NO: 8479219 - DNA, 22 bp, Homo sapiens
actccagggctccaccccagat

SEQ ID NO: 8479220 - DNA, 22 bp, Homo sapiens
actccagggctccaccccagat

SEQ ID NO: 8479221 - DNA, 22 bp, Homo sapiens
actccagggctccatcccttgt

SEQ ID NO: 8479222 - DNA, 22 bp, Homo sapiens
agtctctgcatgatgcagcaca

SEQ ID NO: 8479223 - DNA, 22 bp, Homo sapiens
agtctctgcacagtaagaagca

SEQ ID NO: 8479224 - DNA, 22 bp, Homo sapiens
agtctctgcatgcctgctgtgc

SEQ ID NO: 8479225 - DNA, 22 bp, Homo sapiens
agtctctgcatgcctgctgtgc

SEQ ID NO: 8479226 - DNA, 22 bp, Homo sapiens
agtctctgctggttgtgcctat

SEQ ID NO: 8479227 - DNA, 22 bp, Homo sapiens
agtctctgccagcttgtcctct

SEQ ID NO: 8479228 - DNA, 22 bp, Homo sapiens
agtctctgccagcttgtcctct

SEQ ID NO: 8479229 - DNA, 22 bp, Homo sapiens
agtctctgccagcttgtcctct

SEQ ID NO: 8479230 - DNA, 22 bp, Homo sapiens
agtctctgctggttgtgcctat

SEQ ID NO: 8479231 - DNA, 20 bp, Homo sapiens
agtctctgtagtgcctgaga

SEQ ID NO: 8479232 - DNA, 22 bp, Homo sapiens
agtctctgggcatggttgtgac

SEQ ID NO: 8479233 - DNA, 22 bp, Homo sapiens
agtctcttaatgggcagaaagt

SEQ ID NO: 8479234 - DNA, 22 bp, Homo sapiens
agtctctgtcgtagatcagcgt

SEQ ID NO: 8479235 - DNA, 22 bp, Homo sapiens
agtctctgtgagctcccaatgg

SEQ ID NO: 8479236 - DNA, 22 bp, Homo sapiens
agtctctgtcgtagatcagcgt

SEQ ID NO: 8479237 - DNA, 22 bp, Homo sapiens
actcatttttactgcaattgag

SEQ ID NO: 8479238 - DNA, 22 bp, Homo sapiens
actcattttataacactgtagt

SEQ ID NO: 8479239 - DNA, 22 bp, Homo sapiens
actcattttataacactgtagt

SEQ ID NO: 8479240 - DNA, 22 bp, Homo sapiens
actcatttaaacatttactgaa

SEQ ID NO: 8479241 - DNA, 20 bp, Homo sapiens
actcatttccagcatctgat

SEQ ID NO: 8479242 - DNA, 22 bp, Homo sapiens
actcatttgacactttaaactg

SEQ ID NO: 8479243 - DNA, 22 bp, Homo sapiens
actcatttgcatgatgtgctat

SEQ ID NO: 8479244 - DNA, 22 bp, Homo sapiens
actcatttgcatgatgtgctat

SEQ ID NO: 8479245 - DNA, 21 bp, Homo sapiens
actccaaacaagttaagctgt

SEQ ID NO: 8479246 - DNA, 22 bp, Homo sapiens
actccaaggccacatgcattcc

SEQ ID NO: 8479247 - DNA, 22 bp, Homo sapiens
actccacaccacgggggccgcc

SEQ ID NO: 8479248 - DNA, 22 bp, Homo sapiens
actccacaccacgggggccgcc

SEQ ID NO: 8479249 - DNA, 22 bp, Homo sapiens
actccacaccacgggggccgcc

SEQ ID NO: 8479250 - DNA, 22 bp, Homo sapiens
actccacatttgaacacagttc

SEQ ID NO: 8479251 - DNA, 22 bp, Homo sapiens
actccacatttgaacacagttc

SEQ ID NO: 8479252 - DNA, 22 bp, Homo sapiens
actccaggatgtagaatcagag

SEQ ID NO: 8479253 - DNA, 22 bp, Homo sapiens
actccaggatgtagaatcagag

SEQ ID NO: 8479254 - DNA, 22 bp, Homo sapiens
actccaggaaacttaggggaaa

SEQ ID NO: 8479255 - DNA, 22 bp, Homo sapiens
actccagacacagacactatga

SEQ ID NO: 8479256 - DNA, 22 bp, Homo sapiens
actccagaggcagctgtgctga

SEQ ID NO: 8479257 - DNA, 19 bp, Homo sapiens
actccagggatgacagaag

SEQ ID NO: 8479258 - DNA, 22 bp, Homo sapiens
actccagggaggtgagtgtgcg

SEQ ID NO: 8479259 - DNA, 19 bp, Homo sapiens
actccagggatgacagaag

SEQ ID NO: 8479260 - DNA, 19 bp, Homo sapiens
actccagggatgacagaag

SEQ ID NO: 8479261 - DNA, 22 bp, Homo sapiens
actccaggcatctgcttctgct

SEQ ID NO: 8479262 - DNA, 22 bp, Homo sapiens
actccaggcatctgcttctgct

SEQ ID NO: 8479263 - DNA, 22 bp, Homo sapiens
actccaggcatctgcttctgct

SEQ ID NO: 8479264 - DNA, 22 bp, Homo sapiens
actgaaggaaacttttgtgttt

SEQ ID NO: 8479265 - DNA, 22 bp, Homo sapiens
actgaagcacatttgccatgaa

SEQ ID NO: 8479266 - DNA, 23 bp, Homo sapiens
actgaagatgtcttagtggccct

SEQ ID NO: 8479267 - DNA, 22 bp, Homo sapiens
actgaagcttgggtggaactta

SEQ ID NO: 8479268 - DNA, 21 bp, Homo sapiens
actgaacttgtgttctagagg

SEQ ID NO: 8479269 - DNA, 22 bp, Homo sapiens
actgaagaacgcatcagtggtt

SEQ ID NO: 8479270 - DNA, 22 bp, Homo sapiens
actgaacagcctttcaaactta

SEQ ID NO: 8479271 - DNA, 22 bp, Homo sapiens
actgaacatccataagattttt

SEQ ID NO: 8479272 - DNA, 18 bp, Homo sapiens
actgaagatgcaagacct

SEQ ID NO: 8479273 - DNA, 22 bp, Homo sapiens
actcttcattcaagtatgcaaa

SEQ ID NO: 8479274 - DNA, 22 bp, Homo sapiens
actgaaaatgaattagaaacag

SEQ ID NO: 8479275 - DNA, 22 bp, Homo sapiens
actgaaaatgaattagaaacag

SEQ ID NO: 8479276 - DNA, 22 bp, Homo sapiens
actgaaaatgaattagaaacag

SEQ ID NO: 8479277 - DNA, 22 bp, Homo sapiens
actgaaagtccagcatggtaca

SEQ ID NO: 8479278 - DNA, 22 bp, Homo sapiens
actgaaatactgctcttggatt

SEQ ID NO: 8479279 - DNA, 22 bp, Homo sapiens
actgaaatatttagaagtgaag

SEQ ID NO: 8479280 - DNA, 22 bp, Homo sapiens
actgaaatatttagaagtgaag

SEQ ID NO: 8479281 - DNA, 22 bp, Homo sapiens
actgaaatgaaatctatcatct

SEQ ID NO: 8479282 - DNA, 22 bp, Homo sapiens
actgaaatggggacagtcctta

SEQ ID NO: 8479283 - DNA, 22 bp, Homo sapiens
actgaaatgaaatctatcatct

SEQ ID NO: 8479284 - DNA, 22 bp, Homo sapiens
actgaaatgaaatctatcatct

SEQ ID NO: 8479285 - DNA, 22 bp, Homo sapiens
actgaacacacctgcagcacgt

SEQ ID NO: 8479286 - DNA, 22 bp, Homo sapiens
actgaacaccatttataacatt

SEQ ID NO: 8479287 - DNA, 22 bp, Homo sapiens
actgaacagaccattttgtcct

SEQ ID NO: 8479288 - DNA, 22 bp, Homo sapiens
actgaacacttttgaaagatta

SEQ ID NO: 8479289 - DNA, 22 bp, Homo sapiens
agtctgggatgtataaactgaa

SEQ ID NO: 8479290 - DNA, 22 bp, Homo sapiens
agtctggggtctggtagaacga

SEQ ID NO: 8479291 - DNA, 22 bp, Homo sapiens
agtctgggctgtctgcaggagt

SEQ ID NO: 8479292 - DNA, 22 bp, Homo sapiens
agtctgggtgtgaatgaacttg

SEQ ID NO: 8479293 - DNA, 22 bp, Homo sapiens
agtctgggtggctgagctacag

SEQ ID NO: 8479294 - DNA, 22 bp, Homo sapiens
agtctgggtgtgaatgaacttg

SEQ ID NO: 8479295 - DNA, 22 bp, Homo sapiens
agtctgggtggctgagctacag

SEQ ID NO: 8479296 - DNA, 22 bp, Homo sapiens
actcttcatacagtcatctaat

SEQ ID NO: 8479297 - DNA, 22 bp, Homo sapiens
actcttcatgctatgctcaact

SEQ ID NO: 8479298 - DNA, 19 bp, Homo sapiens
agtctcttcggaggaggtt

SEQ ID NO: 8479299 - DNA, 22 bp, Homo sapiens
agtctcttacccaagcagaatg

SEQ ID NO: 8479300 - DNA, 22 bp, Homo sapiens
agtctcttattccctattgctg

SEQ ID NO: 8479301 - DNA, 22 bp, Homo sapiens
agtctcttccttcaaggctggt

SEQ ID NO: 8479302 - DNA, 22 bp, Homo sapiens
agtctgggagaaggtgagatta

SEQ ID NO: 8479303 - DNA, 17 bp, Homo sapiens
agtctgggacctgcgtg

SEQ ID NO: 8479304 - DNA, 22 bp, Homo sapiens
agtctgggagaaggtgagatta

SEQ ID NO: 8479305 - DNA, 22 bp, Homo sapiens
agtctgggaggcttataaacag

SEQ ID NO: 8479306 - DNA, 22 bp, Homo sapiens
agtctgggaggcttataaacag

SEQ ID NO: 8479307 - DNA, 22 bp, Homo sapiens
agtctggccttgccttgtcgag

SEQ ID NO: 8479308 - DNA, 20 bp, Homo sapiens
agtctggcacctattcctgt

SEQ ID NO: 8479309 - DNA, 20 bp, Homo sapiens
agtctggcacctattcctgt

SEQ ID NO: 8479310 - DNA, 22 bp, Homo sapiens
agtggctgctatgatcaggaca

SEQ ID NO: 8479311 - DNA, 22 bp, Homo sapiens
agtggctgctatgatcaggaca

SEQ ID NO: 8479312 - DNA, 22 bp, Homo sapiens
agtggctgccaagagcaatgct

SEQ ID NO: 8479313 - DNA, 22 bp, Homo sapiens
agtggctgccaagatataattc

SEQ ID NO: 8479314 - DNA, 22 bp, Homo sapiens
agtggctgccaagagcaatgct

SEQ ID NO: 8479315 - DNA, 22 bp, Homo sapiens
agtggctgctgactttaataca

SEQ ID NO: 8479316 - DNA, 22 bp, Homo sapiens
agtggctgctgactttaataca

SEQ ID NO: 8479317 - DNA, 22 bp, Homo sapiens
agtggctgctggagtggagatg

SEQ ID NO: 8479318 - DNA, 22 bp, Homo sapiens
agtggctgctggagtggagatg

SEQ ID NO: 8479319 - DNA, 22 bp, Homo sapiens
agtggctgcttctggttgctcc

SEQ ID NO: 8479320 - DNA, 22 bp, Homo sapiens
actggacagaggaaatatggag

SEQ ID NO: 8479321 - DNA, 22 bp, Homo sapiens
actggacagaggaaatatggag

SEQ ID NO: 8479322 - DNA, 22 bp, Homo sapiens
actggatgaggggaaagagaca

SEQ ID NO: 8479323 - DNA, 22 bp, Homo sapiens
actggatggtgtcatgagcagc

SEQ ID NO: 8479324 - DNA, 22 bp, Homo sapiens
actggattgggaaagtacttca

SEQ ID NO: 8479325 - DNA, 22 bp, Homo sapiens
actggcagcagcagcccttggg

SEQ ID NO: 8479326 - DNA, 22 bp, Homo sapiens
actggcagccacaactggcagg

SEQ ID NO: 8479327 - DNA, 22 bp, Homo sapiens
actggcagccacaactggcagg

SEQ ID NO: 8479328 - DNA, 22 bp, Homo sapiens
actggcagaggttggacaccat

SEQ ID NO: 8479329 - DNA, 22 bp, Homo sapiens
actggcagaggatagcactaat

SEQ ID NO: 8479330 - DNA, 22 bp, Homo sapiens
actggcagagaccctgatggcc

SEQ ID NO: 8479331 - DNA, 22 bp, Homo sapiens
actggcagaattgaatagttgt

SEQ ID NO: 8479332 - DNA, 22 bp, Homo sapiens
agtggctgatgtaggcagtggg

SEQ ID NO: 8479333 - DNA, 20 bp, Homo sapiens
agtggctgatggaaagaagc

SEQ ID NO: 8479334 - DNA, 22 bp, Homo sapiens
agtggctgattacaaactgagt

SEQ ID NO: 8479335 - DNA, 22 bp, Homo sapiens
agtggctgatgtaggcagtggg

SEQ ID NO: 8479336 - DNA, 22 bp, Homo sapiens
agtggctgagtgactgtgactc

SEQ ID NO: 8479337 - DNA, 22 bp, Homo sapiens
agtggctgagtgactgtgactc

SEQ ID NO: 8479338 - DNA, 23 bp, Homo sapiens
agtggctgagagtgtttcatatg

SEQ ID NO: 8479339 - DNA, 22 bp, Homo sapiens
actgcttacaaaaggaaagaat

SEQ ID NO: 8479340 - DNA, 22 bp, Homo sapiens
actgcttacccggcctgacttc

SEQ ID NO: 8479341 - DNA, 22 bp, Homo sapiens
actgcttctccaatgaattaga

SEQ ID NO: 8479342 - DNA, 22 bp, Homo sapiens
actgcttcctgagaaatcaaca

SEQ ID NO: 8479343 - DNA, 20 bp, Homo sapiens
actgcttctttctctgacct

SEQ ID NO: 8479344 - DNA, 20 bp, Homo sapiens
actgcttctttctctgacct

SEQ ID NO: 8479345 - DNA, 23 bp, Homo sapiens
agtggctgagagtgtttcatatg

SEQ ID NO: 8479346 - DNA, 22 bp, Homo sapiens
actgctgattttaggactgtta

SEQ ID NO: 8479347 - DNA, 22 bp, Homo sapiens
actgctgatttagctttgtggg

SEQ ID NO: 8479348 - DNA, 22 bp, Homo sapiens
actgctgattattgaagtagag

SEQ ID NO: 8479349 - DNA, 22 bp, Homo sapiens
actgctgatataagaaaagatt

SEQ ID NO: 8479350 - DNA, 22 bp, Homo sapiens
actgctgattatgaaagtgaca

SEQ ID NO: 8479351 - DNA, 22 bp, Homo sapiens
actgctgtgatctgatgtaatt

SEQ ID NO: 8479352 - DNA, 22 bp, Homo sapiens
actgctgcaggtccagcccctt

SEQ ID NO: 8479353 - DNA, 22 bp, Homo sapiens
actgctgagcacacaagagtgt

SEQ ID NO: 8479354 - DNA, 22 bp, Homo sapiens
actgctctgttttcatatgttt

SEQ ID NO: 8479355 - DNA, 22 bp, Homo sapiens
actgctctctttgcaggggcta

SEQ ID NO: 8479356 - DNA, 22 bp, Homo sapiens
actgctgacctcaggtcatcct

SEQ ID NO: 8479357 - DNA, 22 bp, Homo sapiens
actgctctgttttcatatgttt

SEQ ID NO: 8479358 - DNA, 22 bp, Homo sapiens
actgctctctgcaagtagatgg

SEQ ID NO: 8479359 - DNA, 22 bp, Homo sapiens
actgctcaaggatctggtaggg

SEQ ID NO: 8479360 - DNA, 22 bp, Homo sapiens
actgctcacgcattacttgagc

SEQ ID NO: 8479361 - DNA, 22 bp, Homo sapiens
actgcacagaattatggttggt

SEQ ID NO: 8479362 - DNA, 22 bp, Homo sapiens
actgcctgtagctcttcatctc

SEQ ID NO: 8479363 - DNA, 23 bp, Homo sapiens
actgcctgtgccgatctctctca

SEQ ID NO: 8479364 - DNA, 22 bp, Homo sapiens
actgcctgtgcactggtctttt

SEQ ID NO: 8479365 - DNA, 22 bp, Homo sapiens
actgcctgtgcactggtctttt

SEQ ID NO: 8479366 - DNA, 22 bp, Homo sapiens
actgcacagaaccttagaatat

SEQ ID NO: 8479367 - DNA, 22 bp, Homo sapiens
actgcacacttagcatctggga

SEQ ID NO: 8479368 - DNA, 22 bp, Homo sapiens
actgcaatctggatcctagaag

SEQ ID NO: 8479369 - DNA, 22 bp, Homo sapiens
actgcaattatttgttcaccaa

SEQ ID NO: 8479370 - DNA, 22 bp, Homo sapiens
actgcacaaggcctggacacac

SEQ ID NO: 8479371 - DNA, 22 bp, Homo sapiens
actgcacacatgtttaagtgga

SEQ ID NO: 8479372 - DNA, 22 bp, Homo sapiens
actgcacacatgtttaagtgga

SEQ ID NO: 8479373 - DNA, 22 bp, Homo sapiens
actgcacacatgtttaagtgga

SEQ ID NO: 8479374 - DNA, 22 bp, Homo sapiens
actgcacacacagaatttaggg

SEQ ID NO: 8479375 - DNA, 22 bp, Homo sapiens
actgcaacctccgcctgccagg

SEQ ID NO: 8479376 - DNA, 22 bp, Homo sapiens
actgcaacctccgcctgccagg

SEQ ID NO: 8479377 - DNA, 21 bp, Homo sapiens
actgcaaacagcagagactga

SEQ ID NO: 8479378 - DNA, 22 bp, Homo sapiens
actgcaaagggaagccctttct

SEQ ID NO: 8479379 - DNA, 22 bp, Homo sapiens
actgcaaagggaagccctttct

SEQ ID NO: 8479380 - DNA, 22 bp, Homo sapiens
actgcaacctccacctcctggg

SEQ ID NO: 8479381 - DNA, 22 bp, Homo sapiens
actgcaacctccacctcctggg

SEQ ID NO: 8479382 - DNA, 22 bp, Homo sapiens
actgcaacctccacctcctggg

SEQ ID NO: 8479383 - DNA, 22 bp, Homo sapiens
actgcaacctccacctcctggg

SEQ ID NO: 8479384 - DNA, 22 bp, Homo sapiens
actgcaacctccacctcctggg

SEQ ID NO: 8479385 - DNA, 22 bp, Homo sapiens
actgcaacacctcctgggttca

SEQ ID NO: 8479386 - DNA, 22 bp, Homo sapiens
actgaggtaattgtgaggatta

SEQ ID NO: 8479387 - DNA, 22 bp, Homo sapiens
actgatcacagatatgtatatt

SEQ ID NO: 8479388 - DNA, 22 bp, Homo sapiens
actgatgaaaactaataaatta

SEQ ID NO: 8479389 - DNA, 22 bp, Homo sapiens
actgatgaaaactaataaatta

SEQ ID NO: 8479390 - DNA, 23 bp, Homo sapiens
actgattcttgaagttgacaagt

SEQ ID NO: 8479391 - DNA, 22 bp, Homo sapiens
actgattatgcgtactctctac

SEQ ID NO: 8479392 - DNA, 22 bp, Homo sapiens
actgatttcagggatgagaaga

SEQ ID NO: 8479393 - DNA, 22 bp, Homo sapiens
actgaatatattccattgcatg

SEQ ID NO: 8479394 - DNA, 22 bp, Homo sapiens
actgaatagtgctgcattgtac

SEQ ID NO: 8479395 - DNA, 22 bp, Homo sapiens
actgagggtgcacaggcaggca

SEQ ID NO: 8479396 - DNA, 22 bp, Homo sapiens
actgaataaggtgaatgctctg

SEQ ID NO: 8479397 - DNA, 22 bp, Homo sapiens
actgaagttcatacaacagact

SEQ ID NO: 8479398 - DNA, 22 bp, Homo sapiens
actgaatagcccttctgtctcc

SEQ ID NO: 8479399 - DNA, 22 bp, Homo sapiens
actgaatagaaatgctcatagg

SEQ ID NO: 8479400 - DNA, 22 bp, Homo sapiens
actgaataatggtctgtgatct

SEQ ID NO: 8479401 - DNA, 22 bp, Homo sapiens
actgaagtccacacatgtagga

SEQ ID NO: 8479402 - DNA, 22 bp, Homo sapiens
actaaaaactactgccaatagc

SEQ ID NO: 8479403 - DNA, 22 bp, Homo sapiens
acgttatatctgaaaaaagtga

SEQ ID NO: 8479404 - DNA, 22 bp, Homo sapiens
acgttttattcccatgcagcat

SEQ ID NO: 8479405 - DNA, 22 bp, Homo sapiens
acgtggcggccgccgtgagcgg

SEQ ID NO: 8479406 - DNA, 22 bp, Homo sapiens
acgtgtgtatgagtgtacatat

SEQ ID NO: 8479407 - DNA, 22 bp, Homo sapiens
acgggccttctcttcaggcgag

SEQ ID NO: 8479408 - DNA, 22 bp, Homo sapiens
acgggccttctcttcaggcgag

SEQ ID NO: 8479409 - DNA, 22 bp, Homo sapiens
acgtgtgttggtcagggggccc

SEQ ID NO: 8479410 - DNA, 22 bp, Homo sapiens
acgtgtgtgacattgggaacgt

SEQ ID NO: 8479411 - DNA, 20 bp, Homo sapiens
acgtgtgtgtgcacgcgcgc

SEQ ID NO: 8479412 - DNA, 22 bp, Homo sapiens
acgtgtgttggtcagggggccc

SEQ ID NO: 8479413 - DNA, 22 bp, Homo sapiens
acgtgtgtttaacaaacctgca

SEQ ID NO: 8479414 - DNA, 22 bp, Homo sapiens
acgttaaacatttagcatagta

SEQ ID NO: 8479415 - DNA, 22 bp, Homo sapiens
actaaaacagtggctagtagac

SEQ ID NO: 8479416 - DNA, 22 bp, Homo sapiens
actaaaacagtggctagtagac

SEQ ID NO: 8479417 - DNA, 22 bp, Homo sapiens
actaaagatgtctaaatatatt

SEQ ID NO: 8479418 - DNA, 22 bp, Homo sapiens
actaaagaagccaaagttttct

SEQ ID NO: 8479419 - DNA, 22 bp, Homo sapiens
actaaagtatggaagtgaataa

SEQ ID NO: 8479420 - DNA, 22 bp, Homo sapiens
actaaagctcacagagttgaac

SEQ ID NO: 8479421 - DNA, 22 bp, Homo sapiens
actaaagctcacagagttgaac

SEQ ID NO: 8479422 - DNA, 22 bp, Homo sapiens
accttatttggaaatataatta

SEQ ID NO: 8479423 - DNA, 22 bp, Homo sapiens
accttattcttgcccttagatg

SEQ ID NO: 8479424 - DNA, 22 bp, Homo sapiens
accttcagacatcaactatctc

SEQ ID NO: 8479425 - DNA, 22 bp, Homo sapiens
accttcagacatcaactatctc

SEQ ID NO: 8479426 - DNA, 20 bp, Homo sapiens
accttcaggaacttatcagc

SEQ ID NO: 8479427 - DNA, 22 bp, Homo sapiens
accttcaggtgagcacacagat

SEQ ID NO: 8479428 - DNA, 22 bp, Homo sapiens
accttcaggtgagcacacagat

SEQ ID NO: 8479429 - DNA, 22 bp, Homo sapiens
accttcaggtgagcacacagat

SEQ ID NO: 8479430 - DNA, 21 bp, Homo sapiens
accttcagtgttctcagctgc

SEQ ID NO: 8479431 - DNA, 21 bp, Homo sapiens
accttcagtgttctcagctgc

SEQ ID NO: 8479432 - DNA, 22 bp, Homo sapiens
acgggcagacagagctactcgc

SEQ ID NO: 8479433 - DNA, 22 bp, Homo sapiens
acctgtttacctgcacctgttt

SEQ ID NO: 8479434 - DNA, 22 bp, Homo sapiens
accttagaaaatcaaaattaga

SEQ ID NO: 8479435 - DNA, 22 bp, Homo sapiens
accttaaatgtgacatagtcta

SEQ ID NO: 8479436 - DNA, 22 bp, Homo sapiens
accttaaaactgacacatggag

SEQ ID NO: 8479437 - DNA, 22 bp, Homo sapiens
accttaaaggccgaagtaaaga

SEQ ID NO: 8479438 - DNA, 22 bp, Homo sapiens
accttaaaggccgaagtaaaga

SEQ ID NO: 8479439 - DNA, 19 bp, Homo sapiens
actcaagtctaatgaaatc

SEQ ID NO: 8479440 - DNA, 22 bp, Homo sapiens
actcaagatagggaaagtacaa

SEQ ID NO: 8479441 - DNA, 23 bp, Homo sapiens
actcaaaatttggcatttgagga

SEQ ID NO: 8479442 - DNA, 22 bp, Homo sapiens
actatttactcaaatgaggttg

SEQ ID NO: 8479443 - DNA, 22 bp, Homo sapiens
actatttactcaaatgaggttg

SEQ ID NO: 8479444 - DNA, 22 bp, Homo sapiens
actatttgtaaagagcaaacgg

SEQ ID NO: 8479445 - DNA, 22 bp, Homo sapiens
actattcaagtgctcattcaga

SEQ ID NO: 8479446 - DNA, 22 bp, Homo sapiens
actcatgttttctctagctgga

SEQ ID NO: 8479447 - DNA, 22 bp, Homo sapiens
actcattgaaacttaagatcta

SEQ ID NO: 8479448 - DNA, 22 bp, Homo sapiens
actcattgggaaagtgctctct

SEQ ID NO: 8479449 - DNA, 22 bp, Homo sapiens
actcatttaaacatttactgaa

SEQ ID NO: 8479450 - DNA, 19 bp, Homo sapiens
actcaggcttcctctgagg

SEQ ID NO: 8479451 - DNA, 22 bp, Homo sapiens
actcacaggactctgcatatag

SEQ ID NO: 8479452 - DNA, 22 bp, Homo sapiens
actcacagcatgagcttggcag

SEQ ID NO: 8479453 - DNA, 22 bp, Homo sapiens
actcacagcatgagcttggcag

SEQ ID NO: 8479454 - DNA, 23 bp, Homo sapiens
actcacaaagcaggatcatgttg

SEQ ID NO: 8479455 - DNA, 22 bp, Homo sapiens
actcacaagtgatgtgaatggc

SEQ ID NO: 8479456 - DNA, 23 bp, Homo sapiens
actcacaaagcaggatcatgttg

SEQ ID NO: 8479457 - DNA, 22 bp, Homo sapiens
actcacagcagactatgaggga

SEQ ID NO: 8479458 - DNA, 22 bp, Homo sapiens
actcacagcagactatgaggga

SEQ ID NO: 8479459 - DNA, 22 bp, Homo sapiens
actcacagactgcaggtttatt

SEQ ID NO: 8479460 - DNA, 22 bp, Homo sapiens
actaaagtcctgttgtagcata

SEQ ID NO: 8479461 - DNA, 22 bp, Homo sapiens
actaaagtcatcaaagaacttt

SEQ ID NO: 8479462 - DNA, 22 bp, Homo sapiens
actaaagtgttggagaatgagg

SEQ ID NO: 8479463 - DNA, 22 bp, Homo sapiens
actaaagtgttggagaatgagg

SEQ ID NO: 8479464 - DNA, 22 bp, Homo sapiens
actaaatagcctctggtagttg

SEQ ID NO: 8479465 - DNA, 22 bp, Homo sapiens
actaaatagcctctggtagttg

SEQ ID NO: 8479466 - DNA, 22 bp, Homo sapiens
actaaatagttttgacagaaca

SEQ ID NO: 8479467 - DNA, 22 bp, Homo sapiens
actaaatagttttgacagaaca

SEQ ID NO: 8479468 - DNA, 22 bp, Homo sapiens
actaaatacacacatttgttca

SEQ ID NO: 8479469 - DNA, 22 bp, Homo sapiens
actaaatacacacatttgttca

SEQ ID NO: 8479470 - DNA, 22 bp, Homo sapiens
actatactgtctcttatagata

SEQ ID NO: 8479471 - DNA, 22 bp, Homo sapiens
actaaatagttttgacagaaca

SEQ ID NO: 8479472 - DNA, 22 bp, Homo sapiens
actagtgtccttatataagagg

SEQ ID NO: 8479473 - DNA, 22 bp, Homo sapiens
actaaatatttgagaggtgtag

SEQ ID NO: 8479474 - DNA, 22 bp, Homo sapiens
actatatacacattatcttgtt

SEQ ID NO: 8479475 - DNA, 22 bp, Homo sapiens
actatatacacattatcttgtt

SEQ ID NO: 8479476 - DNA, 22 bp, Homo sapiens
actatagctcgggttataatgt

SEQ ID NO: 8479477 - DNA, 20 bp, Homo sapiens
actatgaagttagccctcca

SEQ ID NO: 8479478 - DNA, 22 bp, Homo sapiens
actattagcatatcatgaatgg

SEQ ID NO: 8479479 - DNA, 21 bp, Homo sapiens
actatgtcatttaagtcactg

SEQ ID NO: 8479480 - DNA, 18 bp, Homo sapiens
actatgctgaataaatgg

SEQ ID NO: 8479481 - DNA, 18 bp, Homo sapiens
actatgctgaataaatgg

SEQ ID NO: 8479482 - DNA, 22 bp, Homo sapiens
acctgccttctcaaggacatga

SEQ ID NO: 8479483 - DNA, 22 bp, Homo sapiens
acctgcccacatatatatgtat

SEQ ID NO: 8479484 - DNA, 22 bp, Homo sapiens
acctccctggccttctgattcc

SEQ ID NO: 8479485 - DNA, 22 bp, Homo sapiens
acctgccttctcaaggacatga

SEQ ID NO: 8479486 - DNA, 23 bp, Homo sapiens
acctgctccatgtcaccttcact

SEQ ID NO: 8479487 - DNA, 22 bp, Homo sapiens
acctgctcaactggcttctcgc

SEQ ID NO: 8479488 - DNA, 22 bp, Homo sapiens
acctgctagaagcaaatgtctg

SEQ ID NO: 8479489 - DNA, 22 bp, Homo sapiens
acctgctcaactggcttctcgc

SEQ ID NO: 8479490 - DNA, 22 bp, Homo sapiens
acctggaagtgggtgctatggc

SEQ ID NO: 8479491 - DNA, 22 bp, Homo sapiens
acctggaagtgggtgctatggc

SEQ ID NO: 8479492 - DNA, 22 bp, Homo sapiens
acctggacacctgctgtcatct

SEQ ID NO: 8479493 - DNA, 22 bp, Homo sapiens
acctggacacctgctgtcatct

SEQ ID NO: 8479494 - DNA, 22 bp, Homo sapiens
acctggacttgaatcctgactt

SEQ ID NO: 8479495 - DNA, 22 bp, Homo sapiens
acctggacctgccacctatgag

SEQ ID NO: 8479496 - DNA, 22 bp, Homo sapiens
acctggagaaagcctctccctg

SEQ ID NO: 8479497 - DNA, 22 bp, Homo sapiens
acctggagaaagcctctccctg

SEQ ID NO: 8479498 - DNA, 20 bp, Homo sapiens
acctggagacagcactctgg

SEQ ID NO: 8479499 - DNA, 22 bp, Homo sapiens
acctggagaaagcctctccctg

SEQ ID NO: 8479500 - DNA, 20 bp, Homo sapiens
acctggagacagcactctgg

SEQ ID NO: 8479501 - DNA, 17 bp, Homo sapiens
acctggagaccaagtcc

SEQ ID NO: 8479502 - DNA, 20 bp, Homo sapiens
acctggagacagcactctgg

SEQ ID NO: 8479503 - DNA, 20 bp, Homo sapiens
acctggagacagcactctgg

SEQ ID NO: 8479504 - DNA, 20 bp, Homo sapiens
acctggagacagcactctgg

SEQ ID NO: 8479505 - DNA, 20 bp, Homo sapiens
acctggagagattattacca

SEQ ID NO: 8479506 - DNA, 22 bp, Homo sapiens
acctggagatccatggtgtcga

SEQ ID NO: 8479507 - DNA, 17 bp, Homo sapiens
acctggagaccaagtcc

SEQ ID NO: 8479508 - DNA, 20 bp, Homo sapiens
acctggagagattattacca

SEQ ID NO: 8479509 - DNA, 22 bp, Homo sapiens
aggtacagtagacagacagtta

SEQ ID NO: 8479510 - DNA, 21 bp, Homo sapiens
aggtacaggtcttgtgagtct

SEQ ID NO: 8479511 - DNA, 22 bp, Homo sapiens
acctggagcttccaactcaact

SEQ ID NO: 8479512 - DNA, 22 bp, Homo sapiens
acctggagatccatggtgtcga

SEQ ID NO: 8479513 - DNA, 22 bp, Homo sapiens
acctggagcttccaactcaact

SEQ ID NO: 8479514 - DNA, 22 bp, Homo sapiens
acctggagatccatggtgtcga

SEQ ID NO: 8479515 - DNA, 22 bp, Homo sapiens
aggtagaggcctccaggcagca

SEQ ID NO: 8479516 - DNA, 22 bp, Homo sapiens
aggtagaggcctccaggcagca

SEQ ID NO: 8479517 - DNA, 22 bp, Homo sapiens
aggtagaagagcaaggaataac

SEQ ID NO: 8479518 - DNA, 22 bp, Homo sapiens
aggtactgaaaaaatgtttgca

SEQ ID NO: 8479519 - DNA, 22 bp, Homo sapiens
aggtagagctccagtagaaaat

SEQ ID NO: 8479520 - DNA, 22 bp, Homo sapiens
aggtagaaggaccagaatttat

SEQ ID NO: 8479521 - DNA, 22 bp, Homo sapiens
aggtactaccagggattttcag

SEQ ID NO: 8479522 - DNA, 22 bp, Homo sapiens
aggtacatttgataaaaatagc

SEQ ID NO: 8479523 - DNA, 22 bp, Homo sapiens
aggtacatctatggggatagaa

SEQ ID NO: 8479524 - DNA, 22 bp, Homo sapiens
aggtacatggggtgtgtgcacg

SEQ ID NO: 8479525 - DNA, 22 bp, Homo sapiens
acctgtgttttccctcagtttc

SEQ ID NO: 8479526 - DNA, 22 bp, Homo sapiens
acctgtggatcagattcttgta

SEQ ID NO: 8479527 - DNA, 21 bp, Homo sapiens
acctgtgaatagccactgcac

SEQ ID NO: 8479528 - DNA, 22 bp, Homo sapiens
acctgtgcaaagactggtcagg

SEQ ID NO: 8479529 - DNA, 22 bp, Homo sapiens
acctgtctgggctacatttgca

SEQ ID NO: 8479530 - DNA, 22 bp, Homo sapiens
acctgtcaacccatcacctagg

SEQ ID NO: 8479531 - DNA, 22 bp, Homo sapiens
acctgtcatcccggctgcaccg

SEQ ID NO: 8479532 - DNA, 22 bp, Homo sapiens
acctgtcatgtcaatgttcagt

SEQ ID NO: 8479533 - DNA, 22 bp, Homo sapiens
acctgtcatgtcaatgttcagt

SEQ ID NO: 8479534 - DNA, 22 bp, Homo sapiens
acctgtcaagtccagcgcaaca

SEQ ID NO: 8479535 - DNA, 22 bp, Homo sapiens
acctgtcaacccatcacctagg

SEQ ID NO: 8479536 - DNA, 22 bp, Homo sapiens
acctggtaacctgcctgactaa

SEQ ID NO: 8479537 - DNA, 23 bp, Homo sapiens
acctggctgctcaacctgcaggg

SEQ ID NO: 8479538 - DNA, 22 bp, Homo sapiens
aggtagctatccagacgctgaa

SEQ ID NO: 8479539 - DNA, 22 bp, Homo sapiens
acctccctccatctggacacta

SEQ ID NO: 8479540 - DNA, 22 bp, Homo sapiens
acctccctcgccgtccactctg

SEQ ID NO: 8479541 - DNA, 20 bp, Homo sapiens
acctccctctgtgggtggga

SEQ ID NO: 8479542 - DNA, 22 bp, Homo sapiens
acctccctcgccgtccactctg

SEQ ID NO: 8479543 - DNA, 22 bp, Homo sapiens
acctccccattaggtcacccac

SEQ ID NO: 8479544 - DNA, 22 bp, Homo sapiens
agggtggggtgctacatcttta

SEQ ID NO: 8479545 - DNA, 22 bp, Homo sapiens
agggtggggtgctacatcttta

SEQ ID NO: 8479546 - DNA, 22 bp, Homo sapiens
agggtggggtgctacatcttta

SEQ ID NO: 8479547 - DNA, 20 bp, Homo sapiens
agggtggggacgttctgact

SEQ ID NO: 8479548 - DNA, 22 bp, Homo sapiens
agggtggtatttaacaactgga

SEQ ID NO: 8479549 - DNA, 22 bp, Homo sapiens
agggtggggtgctacatcttta

SEQ ID NO: 8479550 - DNA, 22 bp, Homo sapiens
agggtggggtgctacatcttta

SEQ ID NO: 8479551 - DNA, 22 bp, Homo sapiens
agggtggtggcgatgaggacat

SEQ ID NO: 8479552 - DNA, 22 bp, Homo sapiens
agggtggtggcgatgaggacat

SEQ ID NO: 8479553 - DNA, 19 bp, Homo sapiens
agggttacccgctgccacc

SEQ ID NO: 8479554 - DNA, 22 bp, Homo sapiens
acctcccagctctgagcttggg

SEQ ID NO: 8479555 - DNA, 22 bp, Homo sapiens
agggttaattggtgtcctgagg

SEQ ID NO: 8479556 - DNA, 22 bp, Homo sapiens
acctcccagctctgagcttggg

SEQ ID NO: 8479557 - DNA, 22 bp, Homo sapiens
acctcccagctctgagcttggg

SEQ ID NO: 8479558 - DNA, 22 bp, Homo sapiens
agggtgtgttctcctatgagaa

SEQ ID NO: 8479559 - DNA, 22 bp, Homo sapiens
agggtgtgttctcctatgagaa

SEQ ID NO: 8479560 - DNA, 22 bp, Homo sapiens
agggtgcgttctatgagaatct

SEQ ID NO: 8479561 - DNA, 22 bp, Homo sapiens
agggtgcctggaagccactcac

SEQ ID NO: 8479562 - DNA, 22 bp, Homo sapiens
agggtgggctagactcttcccc

SEQ ID NO: 8479563 - DNA, 22 bp, Homo sapiens
agggtgggctagactcttcccc

SEQ ID NO: 8479564 - DNA, 22 bp, Homo sapiens
agggtgggctagactcttcccc

SEQ ID NO: 8479565 - DNA, 20 bp, Homo sapiens
agggtggggacgttctgact

SEQ ID NO: 8479566 - DNA, 20 bp, Homo sapiens
agggtggggacgttctgact

SEQ ID NO: 8479567 - DNA, 20 bp, Homo sapiens
agggtggggacgttctgact

SEQ ID NO: 8479568 - DNA, 20 bp, Homo sapiens
agggtggggacgttctgact

SEQ ID NO: 8479569 - DNA, 20 bp, Homo sapiens
agggtggggacgttctgact

SEQ ID NO: 8479570 - DNA, 22 bp, Homo sapiens
agggtgcctgctgcaggttcag

SEQ ID NO: 8479571 - DNA, 22 bp, Homo sapiens
agggtgcctggaagccactcac

SEQ ID NO: 8479572 - DNA, 22 bp, Homo sapiens
agggcttgttaacatagagatt

SEQ ID NO: 8479573 - DNA, 22 bp, Homo sapiens
accctcaggcagaatgtattct

SEQ ID NO: 8479574 - DNA, 22 bp, Homo sapiens
accctcagcttcttggattaat

SEQ ID NO: 8479575 - DNA, 22 bp, Homo sapiens
accctcagctggagattgaatt

SEQ ID NO: 8479576 - DNA, 22 bp, Homo sapiens
accctcagagtaggcactgctg

SEQ ID NO: 8479577 - DNA, 22 bp, Homo sapiens
agggctggtatgtccatgaaag

SEQ ID NO: 8479578 - DNA, 22 bp, Homo sapiens
agggctggtatgtccatgaaag

SEQ ID NO: 8479579 - DNA, 22 bp, Homo sapiens
agggctggtatgtccatgaaag

SEQ ID NO: 8479580 - DNA, 22 bp, Homo sapiens
agggctggtatgtccatgaaag

SEQ ID NO: 8479581 - DNA, 22 bp, Homo sapiens
agggctgtgtttgcaccctctg

SEQ ID NO: 8479582 - DNA, 22 bp, Homo sapiens
agggctgtttttggcacctggg

SEQ ID NO: 8479583 - DNA, 22 bp, Homo sapiens
cacagtccagactcctggagtt

SEQ ID NO: 8479584 - DNA, 22 bp, Homo sapiens
cacagtccagactcctggagtt

SEQ ID NO: 8479585 - DNA, 22 bp, Homo sapiens
cacagtcccattcgagagtaat

SEQ ID NO: 8479586 - DNA, 22 bp, Homo sapiens
cacagtccagactcctggagtt

SEQ ID NO: 8479587 - DNA, 22 bp, Homo sapiens
agcagggcagtgcttcagctct

SEQ ID NO: 8479588 - DNA, 22 bp, Homo sapiens
agcagggcctctggcactggtc

SEQ ID NO: 8479589 - DNA, 22 bp, Homo sapiens
cacagtcaccttatcaggatgt

SEQ ID NO: 8479590 - DNA, 22 bp, Homo sapiens
cacagtcaccttatcaggatgt

SEQ ID NO: 8479591 - DNA, 22 bp, Homo sapiens
cacagtcaatgtagaaatatga

SEQ ID NO: 8479592 - DNA, 22 bp, Homo sapiens
cacagtatttgtttttctgagt

SEQ ID NO: 8479593 - DNA, 22 bp, Homo sapiens
cacagtattcactgggcagatt

SEQ ID NO: 8479594 - DNA, 20 bp, Homo sapiens
cacagtattcttccttaaaa

SEQ ID NO: 8479595 - DNA, 22 bp, Homo sapiens
agcagggctcctgaaagccgcg

SEQ ID NO: 8479596 - DNA, 16 bp, Homo sapiens
agcagggcgggaagga

SEQ ID NO: 8479597 - DNA, 16 bp, Homo sapiens
agcagggcgggaagga

SEQ ID NO: 8479598 - DNA, 22 bp, Homo sapiens
agcagggcctggcactcctggg

SEQ ID NO: 8479599 - DNA, 22 bp, Homo sapiens
agcagggcctgagtgacctaac

SEQ ID NO: 8479600 - DNA, 22 bp, Homo sapiens
cacatctgctctgggcagcact

SEQ ID NO: 8479601 - DNA, 22 bp, Homo sapiens
agcaggtatgacatagatatgt

SEQ ID NO: 8479602 - DNA, 21 bp, Homo sapiens
agcaggtaggcattcatactg

SEQ ID NO: 8479603 - DNA, 23 bp, Homo sapiens
agcaggtaggttgaaattttcct

SEQ ID NO: 8479604 - DNA, 22 bp, Homo sapiens
cacatgaacatgctggaaaagc

SEQ ID NO: 8479605 - DNA, 22 bp, Homo sapiens
agcaggtgatcgcgtgtgctcc

SEQ ID NO: 8479606 - DNA, 22 bp, Homo sapiens
agcaggtgatgtgagtctggaa

SEQ ID NO: 8479607 - DNA, 22 bp, Homo sapiens
cacatctactgatattccagga

SEQ ID NO: 8479608 - DNA, 22 bp, Homo sapiens
cacatccttcatactcagctct

SEQ ID NO: 8479609 - DNA, 22 bp, Homo sapiens
cacatccttcatactcagctct

SEQ ID NO: 8479610 - DNA, 22 bp, Homo sapiens
cacatccttcagctgagcccag

SEQ ID NO: 8479611 - DNA, 22 bp, Homo sapiens
cacatccttcagctgagcccag

SEQ ID NO: 8479612 - DNA, 23 bp, Homo sapiens
cacatcagtttaggtcagatttt

SEQ ID NO: 8479613 - DNA, 22 bp, Homo sapiens
cacatcaggtagacctacagag

SEQ ID NO: 8479614 - DNA, 22 bp, Homo sapiens
cacatcctatcagtcacggttt

SEQ ID NO: 8479615 - DNA, 22 bp, Homo sapiens
cacatccctggagttacccagt

SEQ ID NO: 8479616 - DNA, 22 bp, Homo sapiens
cacatcagggctgcttgggggt

SEQ ID NO: 8479617 - DNA, 19 bp, Homo sapiens
cacatcagcagggctgtgg

SEQ ID NO: 8479618 - DNA, 22 bp, Homo sapiens
cacatatttgatgaagctttgt

SEQ ID NO: 8479619 - DNA, 22 bp, Homo sapiens
cacatattgtagttcaccagga

SEQ ID NO: 8479620 - DNA, 22 bp, Homo sapiens
agcataaaggtcaacgttttag

SEQ ID NO: 8479621 - DNA, 22 bp, Homo sapiens
agcagttttcctgagctcctca

SEQ ID NO: 8479622 - DNA, 22 bp, Homo sapiens
agcataaactcagggacacaca

SEQ ID NO: 8479623 - DNA, 22 bp, Homo sapiens
agcataaactcagggacacaca

SEQ ID NO: 8479624 - DNA, 22 bp, Homo sapiens
agcagttttcctgagctcctca

SEQ ID NO: 8479625 - DNA, 22 bp, Homo sapiens
cactctgcagctgaagggctgg

SEQ ID NO: 8479626 - DNA, 22 bp, Homo sapiens
cactctgcagctgaagggctgg

SEQ ID NO: 8479627 - DNA, 22 bp, Homo sapiens
cactctgggggctgccgctgcc

SEQ ID NO: 8479628 - DNA, 22 bp, Homo sapiens
cactctgggctcttgtttcaga

SEQ ID NO: 8479629 - DNA, 22 bp, Homo sapiens
cactctgagcccaagcaggctg

SEQ ID NO: 8479630 - DNA, 22 bp, Homo sapiens
agcataagttggtacagccact

SEQ ID NO: 8479631 - DNA, 22 bp, Homo sapiens
agcataaaggtcaacgttttag

SEQ ID NO: 8479632 - DNA, 22 bp, Homo sapiens
caccaggctggagtgcagtggc

SEQ ID NO: 8479633 - DNA, 22 bp, Homo sapiens
caccaggctggagtgcagtggc

SEQ ID NO: 8479634 - DNA, 22 bp, Homo sapiens
caccaggctggagtgcagtggc

SEQ ID NO: 8479635 - DNA, 22 bp, Homo sapiens
caccaggctggagtgcagtggc

SEQ ID NO: 8479636 - DNA, 22 bp, Homo sapiens
caccagggacaatgctaggggt

SEQ ID NO: 8479637 - DNA, 22 bp, Homo sapiens
caccagggacaatgctaggggt

SEQ ID NO: 8479638 - DNA, 22 bp, Homo sapiens
caccagggacaatgctaggggt

SEQ ID NO: 8479639 - DNA, 22 bp, Homo sapiens
agcaggtgccaggtgtacccgc

SEQ ID NO: 8479640 - DNA, 21 bp, Homo sapiens
agcaggtgctgttggaggaaa

SEQ ID NO: 8479641 - DNA, 22 bp, Homo sapiens
agcagtggcctggggctctgtg

SEQ ID NO: 8479642 - DNA, 22 bp, Homo sapiens
agcagtggctgaagatgttcct

SEQ ID NO: 8479643 - DNA, 22 bp, Homo sapiens
agcagtggcctggggctctgtg

SEQ ID NO: 8479644 - DNA, 22 bp, Homo sapiens
agcagttgagtgggaatcaggc

SEQ ID NO: 8479645 - DNA, 22 bp, Homo sapiens
agcagttgtagtcatggaaaat

SEQ ID NO: 8479646 - DNA, 22 bp, Homo sapiens
caccagggccccaggctgtgcc

SEQ ID NO: 8479647 - DNA, 22 bp, Homo sapiens
caccagggcagcagcctagtct

SEQ ID NO: 8479648 - DNA, 22 bp, Homo sapiens
caccagggcagcagcctagtct

SEQ ID NO: 8479649 - DNA, 22 bp, Homo sapiens
caccagggctctgagctctgaa

SEQ ID NO: 8479650 - DNA, 22 bp, Homo sapiens
caccagggctctgagctctgaa

SEQ ID NO: 8479651 - DNA, 22 bp, Homo sapiens
caccagggtacaatttcgcaga

SEQ ID NO: 8479652 - DNA, 22 bp, Homo sapiens
caccaggggcagagaccaaagt

SEQ ID NO: 8479653 - DNA, 22 bp, Homo sapiens
caccagggtacaatttcgcaga

SEQ ID NO: 8479654 - DNA, 22 bp, Homo sapiens
cacagtatcttttgagtaagca

SEQ ID NO: 8479655 - DNA, 22 bp, Homo sapiens
cacagtatccctctttctcccc

SEQ ID NO: 8479656 - DNA, 22 bp, Homo sapiens
cacagtacttaattctctaaat

SEQ ID NO: 8479657 - DNA, 22 bp, Homo sapiens
cacagtattcactgggcagatt

SEQ ID NO: 8479658 - DNA, 22 bp, Homo sapiens
cacagtattcactgggcagatt

SEQ ID NO: 8479659 - DNA, 22 bp, Homo sapiens
cacagtatgatctaaagtaagt

SEQ ID NO: 8479660 - DNA, 22 bp, Homo sapiens
cacagtatgatctaaagtaagt

SEQ ID NO: 8479661 - DNA, 22 bp, Homo sapiens
cacagtatcttttgagtaagca

SEQ ID NO: 8479662 - DNA, 22 bp, Homo sapiens
cacagtatgatctaaagtaagt

SEQ ID NO: 8479663 - DNA, 22 bp, Homo sapiens
cacagtatgatctaaagtaagt

SEQ ID NO: 8479664 - DNA, 22 bp, Homo sapiens
cacagggctaaatgaagggttg

SEQ ID NO: 8479665 - DNA, 22 bp, Homo sapiens
cacagggcttctcatggggtgc

SEQ ID NO: 8479666 - DNA, 22 bp, Homo sapiens
cacagggcttctcatggggtgc

SEQ ID NO: 8479667 - DNA, 22 bp, Homo sapiens
cacagggctaaatgaagggttg

SEQ ID NO: 8479668 - DNA, 22 bp, Homo sapiens
cacagggctttgatggctgagt

SEQ ID NO: 8479669 - DNA, 22 bp, Homo sapiens
cacagggctttgatggctgagt

SEQ ID NO: 8479670 - DNA, 22 bp, Homo sapiens
cacagggcttctcatggggtgc

SEQ ID NO: 8479671 - DNA, 22 bp, Homo sapiens
cacagggcctggggcagctgct

SEQ ID NO: 8479672 - DNA, 22 bp, Homo sapiens
cacagggcctggggcagctgct

SEQ ID NO: 8479673 - DNA, 22 bp, Homo sapiens
cacagggccttgtgtgactgca

SEQ ID NO: 8479674 - DNA, 22 bp, Homo sapiens
cacagggccttgtgtgactgca

SEQ ID NO: 8479675 - DNA, 22 bp, Homo sapiens
cacagggcctggggcagctgct

SEQ ID NO: 8479676 - DNA, 22 bp, Homo sapiens
cacagggcctggggcagctgct

SEQ ID NO: 8479677 - DNA, 22 bp, Homo sapiens
cacagggcctggggcagctgct

SEQ ID NO: 8479678 - DNA, 22 bp, Homo sapiens
cacagggcctggggcagctgct

SEQ ID NO: 8479679 - DNA, 22 bp, Homo sapiens
cacagggcctggggcagctgct

SEQ ID NO: 8479680 - DNA, 22 bp, Homo sapiens
cacagggcagtgctgcccactc

SEQ ID NO: 8479681 - DNA, 22 bp, Homo sapiens
cacagggcagtgctgcccactc

SEQ ID NO: 8479682 - DNA, 22 bp, Homo sapiens
cacagggccactttcccagtaa

SEQ ID NO: 8479683 - DNA, 22 bp, Homo sapiens
cacagggccactttcccagtaa

SEQ ID NO: 8479684 - DNA, 23 bp, Homo sapiens
cacaggctgcgcataagcttctc

SEQ ID NO: 8479685 - DNA, 22 bp, Homo sapiens
cacagggcaggtactctcagag

SEQ ID NO: 8479686 - DNA, 19 bp, Homo sapiens
cacagggcaggtctcatgt

SEQ ID NO: 8479687 - DNA, 19 bp, Homo sapiens
cacagggcaggtctcatgt

SEQ ID NO: 8479688 - DNA, 22 bp, Homo sapiens
cacaggctgcccgcagctggga

SEQ ID NO: 8479689 - DNA, 19 bp, Homo sapiens
cacagggcaggtctcatgt

SEQ ID NO: 8479690 - DNA, 22 bp, Homo sapiens
cacagggcagtgattgtccaca

SEQ ID NO: 8479691 - DNA, 22 bp, Homo sapiens
cacagggcagtgattgtccaca

SEQ ID NO: 8479692 - DNA, 22 bp, Homo sapiens
cacagggcagtgctgcccactc

SEQ ID NO: 8479693 - DNA, 22 bp, Homo sapiens
agcaggagcatttccatgattc

SEQ ID NO: 8479694 - DNA, 22 bp, Homo sapiens
cacaggctgcccgcagctggga

SEQ ID NO: 8479695 - DNA, 22 bp, Homo sapiens
agcaggagatggggcgtgatgt

SEQ ID NO: 8479696 - DNA, 22 bp, Homo sapiens
agcaggagatggggcgtgatgt

SEQ ID NO: 8479697 - DNA, 22 bp, Homo sapiens
agcaggagatggggcgtgatgt

SEQ ID NO: 8479698 - DNA, 22 bp, Homo sapiens
agcaggagagcagtgcgtggtc

SEQ ID NO: 8479699 - DNA, 22 bp, Homo sapiens
agcaggagagcagtgcgtggtc

SEQ ID NO: 8479700 - DNA, 22 bp, Homo sapiens
agcaggagagcagtgcgtggtc

SEQ ID NO: 8479701 - DNA, 22 bp, Homo sapiens
agcaggagagcagtgcgtggtc

SEQ ID NO: 8479702 - DNA, 22 bp, Homo sapiens
agcaggagagcagtgcgtggtc

SEQ ID NO: 8479703 - DNA, 22 bp, Homo sapiens
agcaggagagcagtgcgtggtc

SEQ ID NO: 8479704 - DNA, 22 bp, Homo sapiens
agcaggagacatgggggtggtg

SEQ ID NO: 8479705 - DNA, 22 bp, Homo sapiens
agcaggagaacactgtggctct

SEQ ID NO: 8479706 - DNA, 22 bp, Homo sapiens
agcaggagaacactgtggctct

SEQ ID NO: 8479707 - DNA, 22 bp, Homo sapiens
agcaggagaacactgtggctct

SEQ ID NO: 8479708 - DNA, 22 bp, Homo sapiens
cacaggagggagcgggcagcca

SEQ ID NO: 8479709 - DNA, 22 bp, Homo sapiens
cacaggagggagcgggcagcca

SEQ ID NO: 8479710 - DNA, 22 bp, Homo sapiens
cacaggagggagcgggcagcca

SEQ ID NO: 8479711 - DNA, 22 bp, Homo sapiens
cacaggaggaggccagagcgta

SEQ ID NO: 8479712 - DNA, 22 bp, Homo sapiens
cacaggaggaggccagagcgta

SEQ ID NO: 8479713 - DNA, 22 bp, Homo sapiens
cacaggaggcaatggtaagatt

SEQ ID NO: 8479714 - DNA, 22 bp, Homo sapiens
cacaggaggaggtgcccgggcc

SEQ ID NO: 8479715 - DNA, 22 bp, Homo sapiens
cacaggaggaggtgcccgggcc

SEQ ID NO: 8479716 - DNA, 22 bp, Homo sapiens
cacaggaggaggtgcccgggcc

SEQ ID NO: 8479717 - DNA, 23 bp, Homo sapiens
agcagctgtggagttttgcattt

SEQ ID NO: 8479718 - DNA, 18 bp, Homo sapiens
agcagctgtgccacactg

SEQ ID NO: 8479719 - DNA, 18 bp, Homo sapiens
agcagctgtgccacactg

SEQ ID NO: 8479720 - DNA, 22 bp, Homo sapiens
agcagctgtggaaaagtaacta

SEQ ID NO: 8479721 - DNA, 22 bp, Homo sapiens
agcagctgtggaaaagtaacta

SEQ ID NO: 8479722 - DNA, 18 bp, Homo sapiens
agcagctgtcagaatgcc

SEQ ID NO: 8479723 - DNA, 18 bp, Homo sapiens
agcagctgtcagaatgcc

SEQ ID NO: 8479724 - DNA, 18 bp, Homo sapiens
agcagctgtcagaatgcc

SEQ ID NO: 8479725 - DNA, 22 bp, Homo sapiens
agcagctgtcccttaacatcag

SEQ ID NO: 8479726 - DNA, 22 bp, Homo sapiens
caatgacatggataatcatatt

SEQ ID NO: 8479727 - DNA, 22 bp, Homo sapiens
caatgacactctgcacagtgct

SEQ ID NO: 8479728 - DNA, 22 bp, Homo sapiens
caatgacactctgcacagtgct

SEQ ID NO: 8479729 - DNA, 22 bp, Homo sapiens
caatgacactctgcacagtgct

SEQ ID NO: 8479730 - DNA, 22 bp, Homo sapiens
caatgacatctccctgctctaa

SEQ ID NO: 8479731 - DNA, 22 bp, Homo sapiens
caatgaaattgagatccagaga

SEQ ID NO: 8479732 - DNA, 22 bp, Homo sapiens
caatgaacacagcaatttcata

SEQ ID NO: 8479733 - DNA, 22 bp, Homo sapiens
caatgacactctgcacagtgct

SEQ ID NO: 8479734 - DNA, 22 bp, Homo sapiens
agcagctgtactttcatctgtt

SEQ ID NO: 8479735 - DNA, 22 bp, Homo sapiens
agcagctgggctcagagctggg

SEQ ID NO: 8479736 - DNA, 22 bp, Homo sapiens
agcagctgggctcagagctggg

SEQ ID NO: 8479737 - DNA, 22 bp, Homo sapiens
agcagctgtactttcatctgtt

SEQ ID NO: 8479738 - DNA, 22 bp, Homo sapiens
cacaggagccctgaggcctccc

SEQ ID NO: 8479739 - DNA, 22 bp, Homo sapiens
cacaggagccctgaggcctccc

SEQ ID NO: 8479740 - DNA, 22 bp, Homo sapiens
cacaggagctgtggggcagtgt

SEQ ID NO: 8479741 - DNA, 22 bp, Homo sapiens
cacaggagctgtggggcagtgt

SEQ ID NO: 8479742 - DNA, 22 bp, Homo sapiens
cacaggagctgtggggcagtgt

SEQ ID NO: 8479743 - DNA, 22 bp, Homo sapiens
cacaggagctgtggggcagtgt

SEQ ID NO: 8479744 - DNA, 22 bp, Homo sapiens
cacaggaagctgactgctggca

SEQ ID NO: 8479745 - DNA, 22 bp, Homo sapiens
cacaggaagcaagcctggggcc

SEQ ID NO: 8479746 - DNA, 22 bp, Homo sapiens
agcagcttctttcactcctgga

SEQ ID NO: 8479747 - DNA, 22 bp, Homo sapiens
agcagcttcagaggcgggcgca

SEQ ID NO: 8479748 - DNA, 22 bp, Homo sapiens
agcagcttacatgtggcctatc

SEQ ID NO: 8479749 - DNA, 22 bp, Homo sapiens
agcagctgtttgttgaattggt

SEQ ID NO: 8479750 - DNA, 20 bp, Homo sapiens
agcagctgtgttttcatcct

SEQ ID NO: 8479751 - DNA, 20 bp, Homo sapiens
agcagctgtgttttcatcct

SEQ ID NO: 8479752 - DNA, 22 bp, Homo sapiens
agcagctgtggggacaagggta

SEQ ID NO: 8479753 - DNA, 22 bp, Homo sapiens
caaatgatagagccgattatca

SEQ ID NO: 8479754 - DNA, 22 bp, Homo sapiens
caaatgatagagccgattatca

SEQ ID NO: 8479755 - DNA, 22 bp, Homo sapiens
caaatgatccttgcaagctgtg

SEQ ID NO: 8479756 - DNA, 22 bp, Homo sapiens
caaatgatccttgcaagctgtg

SEQ ID NO: 8479757 - DNA, 22 bp, Homo sapiens
caaatgatactgtttttagtct

SEQ ID NO: 8479758 - DNA, 22 bp, Homo sapiens
caaatgatactgtttttagtct

SEQ ID NO: 8479759 - DNA, 22 bp, Homo sapiens
caaatgatactgtttttagtct

SEQ ID NO: 8479760 - DNA, 22 bp, Homo sapiens
caaatattccaggtacatccct

SEQ ID NO: 8479761 - DNA, 22 bp, Homo sapiens
caaatattccaggtacatccct

SEQ ID NO: 8479762 - DNA, 22 bp, Homo sapiens
caaatgcagtccctttgttgct

SEQ ID NO: 8479763 - DNA, 22 bp, Homo sapiens
caaatgatgcatggctagtgag

SEQ ID NO: 8479764 - DNA, 22 bp, Homo sapiens
caaatgatgcatggctagtgag

SEQ ID NO: 8479765 - DNA, 22 bp, Homo sapiens
caaatgcagattcaggagttct

SEQ ID NO: 8479766 - DNA, 22 bp, Homo sapiens
caaatgcaaaatataaccctgt

SEQ ID NO: 8479767 - DNA, 22 bp, Homo sapiens
caaatgtttggtggcattttgt

SEQ ID NO: 8479768 - DNA, 22 bp, Homo sapiens
agcagaagtgccttagcaatca

SEQ ID NO: 8479769 - DNA, 22 bp, Homo sapiens
agcagaagaaagccacatgact

SEQ ID NO: 8479770 - DNA, 17 bp, Homo sapiens
agcagaagtcagaggga

SEQ ID NO: 8479771 - DNA, 17 bp, Homo sapiens
agcagaagtcagaggga

SEQ ID NO: 8479772 - DNA, 22 bp, Homo sapiens
agcagaagaaagccacatgact

SEQ ID NO: 8479773 - DNA, 22 bp, Homo sapiens
agcagaagaaagccacatgact

SEQ ID NO: 8479774 - DNA, 22 bp, Homo sapiens
agcactgttatgggatgactta

SEQ ID NO: 8479775 - DNA, 22 bp, Homo sapiens
agcactgttatgggatgactta

SEQ ID NO: 8479776 - DNA, 22 bp, Homo sapiens
caaattaatgtgtctcaaaata

SEQ ID NO: 8479777 - DNA, 22 bp, Homo sapiens
attttctgagtccagaatttac

SEQ ID NO: 8479778 - DNA, 22 bp, Homo sapiens
attttctgagtccagaatttac

SEQ ID NO: 8479779 - DNA, 22 bp, Homo sapiens
attttctggttgaggtttaaca

SEQ ID NO: 8479780 - DNA, 22 bp, Homo sapiens
attttctgtaactatttctata

SEQ ID NO: 8479781 - DNA, 23 bp, Homo sapiens
agcacagactagaaaggtctttc

SEQ ID NO: 8479782 - DNA, 23 bp, Homo sapiens
agcacagactagaaaggtctttc

SEQ ID NO: 8479783 - DNA, 22 bp, Homo sapiens
agcacagagaaactaagacatt

SEQ ID NO: 8479784 - DNA, 22 bp, Homo sapiens
agcacagagaaactaagacatt

SEQ ID NO: 8479785 - DNA, 23 bp, Homo sapiens
agcacagactagaaaggtctttc

SEQ ID NO: 8479786 - DNA, 22 bp, Homo sapiens
attttctctcaaaccttaaaat

SEQ ID NO: 8479787 - DNA, 22 bp, Homo sapiens
attttctctcaaaccttaaaat

SEQ ID NO: 8479788 - DNA, 22 bp, Homo sapiens
attttctcacaatcctatgggg

SEQ ID NO: 8479789 - DNA, 22 bp, Homo sapiens
attttctcacaatgcagaagga

SEQ ID NO: 8479790 - DNA, 22 bp, Homo sapiens
attttctgagcacgtgacagca

SEQ ID NO: 8479791 - DNA, 22 bp, Homo sapiens
attttctctttgtatatgctag

SEQ ID NO: 8479792 - DNA, 21 bp, Homo sapiens
attttctctggatgatggtca

SEQ ID NO: 8479793 - DNA, 21 bp, Homo sapiens
attttctctggatgatggtca

SEQ ID NO: 8479794 - DNA, 21 bp, Homo sapiens
attttctctggatgatggtca

SEQ ID NO: 8479795 - DNA, 22 bp, Homo sapiens
attttctatgttgtaattgtta

SEQ ID NO: 8479796 - DNA, 22 bp, Homo sapiens
attttctatgttgtaattgtta

SEQ ID NO: 8479797 - DNA, 22 bp, Homo sapiens
attttctattctgctggtttag

SEQ ID NO: 8479798 - DNA, 22 bp, Homo sapiens
attttctattctgctggtttag

SEQ ID NO: 8479799 - DNA, 22 bp, Homo sapiens
agcacagataacatggagtgga

SEQ ID NO: 8479800 - DNA, 22 bp, Homo sapiens
agcacagagttgcagagagcgt

SEQ ID NO: 8479801 - DNA, 22 bp, Homo sapiens
agcacagagttgctcactgccg

SEQ ID NO: 8479802 - DNA, 22 bp, Homo sapiens
agcacagattctgaagagtcct

SEQ ID NO: 8479803 - DNA, 22 bp, Homo sapiens
agcacagatgtgagtggaggct

SEQ ID NO: 8479804 - DNA, 22 bp, Homo sapiens
agcacagatttgtcaacataga

SEQ ID NO: 8479805 - DNA, 22 bp, Homo sapiens
agcacagattctgaagagtcct

SEQ ID NO: 8479806 - DNA, 22 bp, Homo sapiens
agcacagattctgaagagtcct

SEQ ID NO: 8479807 - DNA, 22 bp, Homo sapiens
agcacagagttgcagagagcgt

SEQ ID NO: 8479808 - DNA, 22 bp, Homo sapiens
agcacagagttgcagagagcgt

SEQ ID NO: 8479809 - DNA, 22 bp, Homo sapiens
agcacagagttgcagagagcgt

SEQ ID NO: 8479810 - DNA, 22 bp, Homo sapiens
agcacagagttgcagagagcgt

SEQ ID NO: 8479811 - DNA, 22 bp, Homo sapiens
agcacagagattatttacaaga

SEQ ID NO: 8479812 - DNA, 22 bp, Homo sapiens
agcacagagaagatttcaatta

SEQ ID NO: 8479813 - DNA, 22 bp, Homo sapiens
agcacagagaagatttcaatta

SEQ ID NO: 8479814 - DNA, 22 bp, Homo sapiens
agcacagagaaactaagacatt

SEQ ID NO: 8479815 - DNA, 22 bp, Homo sapiens
caaggcatgaaaggagtgagtg

SEQ ID NO: 8479816 - DNA, 22 bp, Homo sapiens
caaggcatgaaaggagtgagtg

SEQ ID NO: 8479817 - DNA, 22 bp, Homo sapiens
agcagcagggtgtaattgggca

SEQ ID NO: 8479818 - DNA, 22 bp, Homo sapiens
agcagcatagaagctgggagga

SEQ ID NO: 8479819 - DNA, 22 bp, Homo sapiens
agcagcatagaagctgggagga

SEQ ID NO: 8479820 - DNA, 22 bp, Homo sapiens
agcagcatatcagagaaagtca

SEQ ID NO: 8479821 - DNA, 22 bp, Homo sapiens
agcagcatccccggcctccacc

SEQ ID NO: 8479822 - DNA, 22 bp, Homo sapiens
caaggcaggcagttcacttgag

SEQ ID NO: 8479823 - DNA, 22 bp, Homo sapiens
caaggcaggtctgaggaggttg

SEQ ID NO: 8479824 - DNA, 22 bp, Homo sapiens
caaggcagtccctactccctgc

SEQ ID NO: 8479825 - DNA, 22 bp, Homo sapiens
caaggcagtgggctaggaacct

SEQ ID NO: 8479826 - DNA, 22 bp, Homo sapiens
agcagcatcttctaagtaaggc

SEQ ID NO: 8479827 - DNA, 22 bp, Homo sapiens
agcagcatgatgacagagtctc

SEQ ID NO: 8479828 - DNA, 22 bp, Homo sapiens
agcagcatggctgactaaagac

SEQ ID NO: 8479829 - DNA, 22 bp, Homo sapiens
agcagcatgtatgagggtgaac

SEQ ID NO: 8479830 - DNA, 22 bp, Homo sapiens
agcagcatgttgggatgtgaaa

SEQ ID NO: 8479831 - DNA, 22 bp, Homo sapiens
agcagcatgttgggatgtgaaa

SEQ ID NO: 8479832 - DNA, 22 bp, Homo sapiens
agcagcatgttgggatgtgaaa

SEQ ID NO: 8479833 - DNA, 20 bp, Homo sapiens
agcagcattgttctagagca

SEQ ID NO: 8479834 - DNA, 22 bp, Homo sapiens
agcagcattctctggtatgggg

SEQ ID NO: 8479835 - DNA, 22 bp, Homo sapiens
caatgaaaatgaggactcctgt

SEQ ID NO: 8479836 - DNA, 22 bp, Homo sapiens
caatcttagtggcttacaaaga

SEQ ID NO: 8479837 - DNA, 22 bp, Homo sapiens
caatgaaaatttaagttgcagc

SEQ ID NO: 8479838 - DNA, 22 bp, Homo sapiens
caatgaaaatttaagttgcagc

SEQ ID NO: 8479839 - DNA, 22 bp, Homo sapiens
caatgaaaatgaggactcctgt

SEQ ID NO: 8479840 - DNA, 22 bp, Homo sapiens
caatgaaattgagatccagaga

SEQ ID NO: 8479841 - DNA, 22 bp, Homo sapiens
caatgaaagcaactgcctataa

SEQ ID NO: 8479842 - DNA, 22 bp, Homo sapiens
agcagcacgagtccacaaatcc

SEQ ID NO: 8479843 - DNA, 22 bp, Homo sapiens
agcagcagaaagttgatggcag

SEQ ID NO: 8479844 - DNA, 22 bp, Homo sapiens
agcagcagaaagttgatggcag

SEQ ID NO: 8479845 - DNA, 22 bp, Homo sapiens
agcagcagaaagttgatggcag

SEQ ID NO: 8479846 - DNA, 22 bp, Homo sapiens
agcagcacccagagccatgtct

SEQ ID NO: 8479847 - DNA, 22 bp, Homo sapiens
agcagcacatggggctggcaac

SEQ ID NO: 8479848 - DNA, 22 bp, Homo sapiens
agcagcacctgtcctcgctgct

SEQ ID NO: 8479849 - DNA, 22 bp, Homo sapiens
agcagcagaagggagacccagg

SEQ ID NO: 8479850 - DNA, 22 bp, Homo sapiens
agcagcagaagggagacccagg

SEQ ID NO: 8479851 - DNA, 22 bp, Homo sapiens
caaggcaggcagttcacttgag

SEQ ID NO: 8479852 - DNA, 22 bp, Homo sapiens
agcagcagaaggtttgcaccca

SEQ ID NO: 8479853 - DNA, 22 bp, Homo sapiens
caaggcaggaagcctgtcttat

SEQ ID NO: 8479854 - DNA, 22 bp, Homo sapiens
agcagagtgtgaaggcagggct

SEQ ID NO: 8479855 - DNA, 22 bp, Homo sapiens
agcagcaagcagtgcacgggtt

SEQ ID NO: 8479856 - DNA, 22 bp, Homo sapiens
agcagcaaggaagcgaggatgg

SEQ ID NO: 8479857 - DNA, 22 bp, Homo sapiens
agcagcaaggaacagaatggac

SEQ ID NO: 8479858 - DNA, 22 bp, Homo sapiens
agcagagtgccccatcacaagg

SEQ ID NO: 8479859 - DNA, 21 bp, Homo sapiens
agcagagtgctttgactttgt

SEQ ID NO: 8479860 - DNA, 21 bp, Homo sapiens
agcagagtgctttgactttgt

SEQ ID NO: 8479861 - DNA, 22 bp, Homo sapiens
caacttcaccagggttcctaga

SEQ ID NO: 8479862 - DNA, 22 bp, Homo sapiens
caacttcactgtgcctctagtt

SEQ ID NO: 8479863 - DNA, 22 bp, Homo sapiens
agcagcaatggaaagcaacaca

SEQ ID NO: 8479864 - DNA, 22 bp, Homo sapiens
agcagcaatggaaagcaacaca

SEQ ID NO: 8479865 - DNA, 22 bp, Homo sapiens
agcagcacacgggagaaagaca

SEQ ID NO: 8479866 - DNA, 22 bp, Homo sapiens
agcagcaattttcactgtcaat

SEQ ID NO: 8479867 - DNA, 22 bp, Homo sapiens
agcagaatctgtccttggaaga

SEQ ID NO: 8479868 - DNA, 22 bp, Homo sapiens
agcagacaacccagatgaccca

SEQ ID NO: 8479869 - DNA, 22 bp, Homo sapiens
agcagacaacccagatgaccca

SEQ ID NO: 8479870 - DNA, 18 bp, Homo sapiens
agcagaattctagggttc

SEQ ID NO: 8479871 - DNA, 21 bp, Homo sapiens
agcagacacttgtgaccttcc

SEQ ID NO: 8479872 - DNA, 22 bp, Homo sapiens
agcagacaattgcctggatgga

SEQ ID NO: 8479873 - DNA, 22 bp, Homo sapiens
agcagacaattgcctggatgga

SEQ ID NO: 8479874 - DNA, 22 bp, Homo sapiens
caactgaactgatatcaactat

SEQ ID NO: 8479875 - DNA, 22 bp, Homo sapiens
caactgaactgatatcaactat

SEQ ID NO: 8479876 - DNA, 22 bp, Homo sapiens
caactgaaaagattctacgcag

SEQ ID NO: 8479877 - DNA, 22 bp, Homo sapiens
caactcctggctgttaggcaca

SEQ ID NO: 8479878 - DNA, 22 bp, Homo sapiens
caactcctccccagcatgccaa

SEQ ID NO: 8479879 - DNA, 22 bp, Homo sapiens
caactgttataaatcaacagag

SEQ ID NO: 8479880 - DNA, 22 bp, Homo sapiens
caactgtgaattttatgatacc

SEQ ID NO: 8479881 - DNA, 17 bp, Homo sapiens
caacttcacaaactgtc

SEQ ID NO: 8479882 - DNA, 22 bp, Homo sapiens
caacttcactgtgcctctagtt

SEQ ID NO: 8479883 - DNA, 22 bp, Homo sapiens
caactgccatacagctccatgg

SEQ ID NO: 8479884 - DNA, 22 bp, Homo sapiens
caactgctgacaccatcactcc

SEQ ID NO: 8479885 - DNA, 22 bp, Homo sapiens
agccaggatggtctcgatcggc

SEQ ID NO: 8479886 - DNA, 22 bp, Homo sapiens
agccaggattggctgagcctta

SEQ ID NO: 8479887 - DNA, 21 bp, Homo sapiens
agccaggcaagcacccccact

SEQ ID NO: 8479888 - DNA, 21 bp, Homo sapiens
agccaggcaagcacccccact

SEQ ID NO: 8479889 - DNA, 22 bp, Homo sapiens
agccaggcagactctctttctt

SEQ ID NO: 8479890 - DNA, 22 bp, Homo sapiens
cagacagaaggctccttgaggt

SEQ ID NO: 8479891 - DNA, 22 bp, Homo sapiens
cagacagacagccgtggccacc

SEQ ID NO: 8479892 - DNA, 22 bp, Homo sapiens
agccaggcagggctctcgctct

SEQ ID NO: 8479893 - DNA, 22 bp, Homo sapiens
agccaggcagactctctttctt

SEQ ID NO: 8479894 - DNA, 22 bp, Homo sapiens
cagaagctttgctcataaccat

SEQ ID NO: 8479895 - DNA, 22 bp, Homo sapiens
agccagctccctcccctgcagg

SEQ ID NO: 8479896 - DNA, 22 bp, Homo sapiens
agccaggatggtctcgatcggc

SEQ ID NO: 8479897 - DNA, 22 bp, Homo sapiens
agccaggatcacccggggctgt

SEQ ID NO: 8479898 - DNA, 22 bp, Homo sapiens
agccaggatggtctcgatcggc

SEQ ID NO: 8479899 - DNA, 22 bp, Homo sapiens
agccaggacgttgctcagctcc

SEQ ID NO: 8479900 - DNA, 22 bp, Homo sapiens
cagaagcctgcctcagatgcac

SEQ ID NO: 8479901 - DNA, 22 bp, Homo sapiens
cagaagcctgcctcagatgcac

SEQ ID NO: 8479902 - DNA, 22 bp, Homo sapiens
cagaagcattccagcaaatagt

SEQ ID NO: 8479903 - DNA, 22 bp, Homo sapiens
cagaagcattgactccttgctc

SEQ ID NO: 8479904 - DNA, 22 bp, Homo sapiens
cagaagcattgactccttgctc

SEQ ID NO: 8479905 - DNA, 22 bp, Homo sapiens
cagaagcattccagcaaatagt

SEQ ID NO: 8479906 - DNA, 22 bp, Homo sapiens
cagaagcattgactccttgctc

SEQ ID NO: 8479907 - DNA, 22 bp, Homo sapiens
cagaagaatggtgtctgagctc

SEQ ID NO: 8479908 - DNA, 22 bp, Homo sapiens
cagaagacagagcacttctctt

SEQ ID NO: 8479909 - DNA, 22 bp, Homo sapiens
cagaagacagctgtttcactcg

SEQ ID NO: 8479910 - DNA, 23 bp, Homo sapiens
cagaagacagtctcaagacaagg

SEQ ID NO: 8479911 - DNA, 22 bp, Homo sapiens
cagaagaatggtgtctgagctc

SEQ ID NO: 8479912 - DNA, 22 bp, Homo sapiens
cagaagaatggtgtctgagctc

SEQ ID NO: 8479913 - DNA, 22 bp, Homo sapiens
cagaagcagtgagagatgtgca

SEQ ID NO: 8479914 - DNA, 22 bp, Homo sapiens
cagaagactgcagggaagggac

SEQ ID NO: 8479915 - DNA, 22 bp, Homo sapiens
cagaagaaatcattatctggac

SEQ ID NO: 8479916 - DNA, 22 bp, Homo sapiens
cagaagaaatcattatctggac

SEQ ID NO: 8479917 - DNA, 22 bp, Homo sapiens
cagaagaaagtggggagacaag

SEQ ID NO: 8479918 - DNA, 22 bp, Homo sapiens
cagaagaaagtggggagacaag

SEQ ID NO: 8479919 - DNA, 22 bp, Homo sapiens
cagaagaaagtggggagacaag

SEQ ID NO: 8479920 - DNA, 22 bp, Homo sapiens
cagaacttcatattgacgttag

SEQ ID NO: 8479921 - DNA, 22 bp, Homo sapiens
cagaacttggcaaagccgactg

SEQ ID NO: 8479922 - DNA, 22 bp, Homo sapiens
agccacagagagggagctgcaa

SEQ ID NO: 8479923 - DNA, 22 bp, Homo sapiens
agccacagagcaggagaccttt

SEQ ID NO: 8479924 - DNA, 22 bp, Homo sapiens
agccacagagcaggagaccttt

SEQ ID NO: 8479925 - DNA, 22 bp, Homo sapiens
agccacagagcaggagaccttt

SEQ ID NO: 8479926 - DNA, 22 bp, Homo sapiens
agccacagagcaggagaccttt

SEQ ID NO: 8479927 - DNA, 22 bp, Homo sapiens
agccacagaggttgatgtggtt

SEQ ID NO: 8479928 - DNA, 22 bp, Homo sapiens
agccacagaggttgatgtggtt

SEQ ID NO: 8479929 - DNA, 22 bp, Homo sapiens
agccacagagagggagctgcaa

SEQ ID NO: 8479930 - DNA, 22 bp, Homo sapiens
agccacagagagggagctgcaa

SEQ ID NO: 8479931 - DNA, 19 bp, Homo sapiens
agccacagaacttgcagga

SEQ ID NO: 8479932 - DNA, 19 bp, Homo sapiens
agccacagaacttgcagga

SEQ ID NO: 8479933 - DNA, 22 bp, Homo sapiens
agccaagctgatctcctgctga

SEQ ID NO: 8479934 - DNA, 21 bp, Homo sapiens
agccaagccttgggagccagg

SEQ ID NO: 8479935 - DNA, 22 bp, Homo sapiens
agccacaaaggcttgcctcgga

SEQ ID NO: 8479936 - DNA, 22 bp, Homo sapiens
agccacacagcttaatgacaga

SEQ ID NO: 8479937 - DNA, 22 bp, Homo sapiens
agccacacctgtcctgccagct

SEQ ID NO: 8479938 - DNA, 22 bp, Homo sapiens
agccacacctgtcctgccagct

SEQ ID NO: 8479939 - DNA, 22 bp, Homo sapiens
cactgaaatattaatatcttat

SEQ ID NO: 8479940 - DNA, 22 bp, Homo sapiens
cactgaaatcgaaaaatgtagg

SEQ ID NO: 8479941 - DNA, 22 bp, Homo sapiens
cactgaaaggcaatgctgacag

SEQ ID NO: 8479942 - DNA, 22 bp, Homo sapiens
cactgaaaggaaaccagagcat

SEQ ID NO: 8479943 - DNA, 22 bp, Homo sapiens
cactgaaacaggtattgctggt

SEQ ID NO: 8479944 - DNA, 22 bp, Homo sapiens
agccacagcccacaggactctt

SEQ ID NO: 8479945 - DNA, 22 bp, Homo sapiens
agccacagcccacaggactctt

SEQ ID NO: 8479946 - DNA, 22 bp, Homo sapiens
agccacagcatgtgtgtatgta

SEQ ID NO: 8479947 - DNA, 22 bp, Homo sapiens
agccacagcatgtgtgtatgta

SEQ ID NO: 8479948 - DNA, 22 bp, Homo sapiens
agccacagcatgtgtgtatgta

SEQ ID NO: 8479949 - DNA, 22 bp, Homo sapiens
agccacagcacattgtaagaaa

SEQ ID NO: 8479950 - DNA, 22 bp, Homo sapiens
agccacagcacattgtaagaaa

SEQ ID NO: 8479951 - DNA, 22 bp, Homo sapiens
agccacagcacattgtaagaaa

SEQ ID NO: 8479952 - DNA, 22 bp, Homo sapiens
agccacagcacattgtaagaaa

SEQ ID NO: 8479953 - DNA, 22 bp, Homo sapiens
agccacagcaacaagtgcaatt

SEQ ID NO: 8479954 - DNA, 22 bp, Homo sapiens
agccacagcaacaagtgcaatt

SEQ ID NO: 8479955 - DNA, 22 bp, Homo sapiens
agccacagcaacaagtgcaatt

SEQ ID NO: 8479956 - DNA, 22 bp, Homo sapiens
cagaaccaggaactgatggaga

SEQ ID NO: 8479957 - DNA, 22 bp, Homo sapiens
cagaacctgagagcacaatcct

SEQ ID NO: 8479958 - DNA, 22 bp, Homo sapiens
cagaactgggcagggagcagag

SEQ ID NO: 8479959 - DNA, 22 bp, Homo sapiens
agccacagcctgacttaactgt

SEQ ID NO: 8479960 - DNA, 22 bp, Homo sapiens
agccacagcgaacctctcttcc

SEQ ID NO: 8479961 - DNA, 22 bp, Homo sapiens
agccacagctccttggtggaga

SEQ ID NO: 8479962 - DNA, 22 bp, Homo sapiens
agccacagctccttggtggaga

SEQ ID NO: 8479963 - DNA, 22 bp, Homo sapiens
cagaaatgacaaagtaagagga

SEQ ID NO: 8479964 - DNA, 22 bp, Homo sapiens
cagaaatgacaaagtaagagga

SEQ ID NO: 8479965 - DNA, 22 bp, Homo sapiens
agccagtagatcgggaggatgt

SEQ ID NO: 8479966 - DNA, 22 bp, Homo sapiens
agccagtgacatacgattggga

SEQ ID NO: 8479967 - DNA, 22 bp, Homo sapiens
cagagaggatggattccatagc

SEQ ID NO: 8479968 - DNA, 22 bp, Homo sapiens
cagagagggagcagtagtctct

SEQ ID NO: 8479969 - DNA, 22 bp, Homo sapiens
cagagagggagcagtagtctct

SEQ ID NO: 8479970 - DNA, 22 bp, Homo sapiens
agccagtgatgaagactctgga

SEQ ID NO: 8479971 - DNA, 22 bp, Homo sapiens
agccagtgatgaagactctgga

SEQ ID NO: 8479972 - DNA, 22 bp, Homo sapiens
cagagagggagcagtagtctct

SEQ ID NO: 8479973 - DNA, 22 bp, Homo sapiens
cagagatggggccagctgctcc

SEQ ID NO: 8479974 - DNA, 22 bp, Homo sapiens
cagagataccattgctaaaatt

SEQ ID NO: 8479975 - DNA, 22 bp, Homo sapiens
cagagagggcggccctggcttc

SEQ ID NO: 8479976 - DNA, 22 bp, Homo sapiens
cagagagggcggccctggcttc

SEQ ID NO: 8479977 - DNA, 22 bp, Homo sapiens
cagagagggcggccctggcttc

SEQ ID NO: 8479978 - DNA, 22 bp, Homo sapiens
cagagagggcggccctggcttc

SEQ ID NO: 8479979 - DNA, 22 bp, Homo sapiens
cagagcaacaccctttacatcg

SEQ ID NO: 8479980 - DNA, 22 bp, Homo sapiens
cagagcacacatgcatagagtg

SEQ ID NO: 8479981 - DNA, 22 bp, Homo sapiens
agccaggtgcagtggcacacac

SEQ ID NO: 8479982 - DNA, 20 bp, Homo sapiens
agccagggttctggatgcac

SEQ ID NO: 8479983 - DNA, 20 bp, Homo sapiens
agccagggttctggatgcac

SEQ ID NO: 8479984 - DNA, 23 bp, Homo sapiens
agccaggggatcttgggccctgg

SEQ ID NO: 8479985 - DNA, 22 bp, Homo sapiens
agccagggtgggtgaatgctat

SEQ ID NO: 8479986 - DNA, 22 bp, Homo sapiens
cagacagctgctttcttgctgt

SEQ ID NO: 8479987 - DNA, 22 bp, Homo sapiens
agccaggggagtcagctgctgg

SEQ ID NO: 8479988 - DNA, 17 bp, Homo sapiens
cagacagatatcctggg

SEQ ID NO: 8479989 - DNA, 22 bp, Homo sapiens
cagacagagtcttcccatcagt

SEQ ID NO: 8479990 - DNA, 17 bp, Homo sapiens
cagacagatatcctggg

SEQ ID NO: 8479991 - DNA, 22 bp, Homo sapiens
cagacagagtcttcccatcagt

SEQ ID NO: 8479992 - DNA, 22 bp, Homo sapiens
cagacagacctgcaagggcaca

SEQ ID NO: 8479993 - DNA, 22 bp, Homo sapiens
cagacagaggctgtatgagggc

SEQ ID NO: 8479994 - DNA, 22 bp, Homo sapiens
cagacagagctcacaagtcttt

SEQ ID NO: 8479995 - DNA, 22 bp, Homo sapiens
cagacagagctcacaagtcttt

SEQ ID NO: 8479996 - DNA, 22 bp, Homo sapiens
cagacagagctcacaagtcttt

SEQ ID NO: 8479997 - DNA, 22 bp, Homo sapiens
cagacagagctcacaagtcttt

SEQ ID NO: 8479998 - DNA, 22 bp, Homo sapiens
agcccaggagtttgaggctgtg

SEQ ID NO: 8479999 - DNA, 22 bp, Homo sapiens
agcccaggagtttgaggctgtg

SEQ ID NO: 8480000 - DNA, 22 bp, Homo sapiens
agcccaggagtccttaaggacc

SEQ ID NO: 8480001 - DNA, 22 bp, Homo sapiens
agcccaggagtttgaggctgtg

SEQ ID NO: 8480002 - DNA, 22 bp, Homo sapiens
agcccaggagtttgaggctgtg

SEQ ID NO: 8480003 - DNA, 22 bp, Homo sapiens
agcccaggagtttgaggctgtg

SEQ ID NO: 8480004 - DNA, 22 bp, Homo sapiens
cagagctggacttaaatatatt

SEQ ID NO: 8480005 - DNA, 22 bp, Homo sapiens
cagagctggagaagtggattta

SEQ ID NO: 8480006 - DNA, 22 bp, Homo sapiens
cagagctggagaagtggattta

SEQ ID NO: 8480007 - DNA, 22 bp, Homo sapiens
cagagctgcttcccagtttgtg

SEQ ID NO: 8480008 - DNA, 22 bp, Homo sapiens
cagagctggagcttgaatggag

SEQ ID NO: 8480009 - DNA, 22 bp, Homo sapiens
cagagctggagaagtggattta

SEQ ID NO: 8480010 - DNA, 22 bp, Homo sapiens
cagagctggagcttgaatggag

SEQ ID NO: 8480011 - DNA, 22 bp, Homo sapiens
cagagctggagcttgaatggag

SEQ ID NO: 8480012 - DNA, 22 bp, Homo sapiens
agcccaggagcctttggagggt

SEQ ID NO: 8480013 - DNA, 22 bp, Homo sapiens
agcccaggaggtggaggttgca

SEQ ID NO: 8480014 - DNA, 22 bp, Homo sapiens
agcccaggaagttgaggcttgc

SEQ ID NO: 8480015 - DNA, 22 bp, Homo sapiens
agcccaggaatctgcatcttga

SEQ ID NO: 8480016 - DNA, 22 bp, Homo sapiens
agcccagccggattcccagttc

SEQ ID NO: 8480017 - DNA, 22 bp, Homo sapiens
agcccagctttgaaccatatca

SEQ ID NO: 8480018 - DNA, 22 bp, Homo sapiens
agcccagctttgaaccatatca

SEQ ID NO: 8480019 - DNA, 22 bp, Homo sapiens
agcccaggaagttgaggcttgc

SEQ ID NO: 8480020 - DNA, 22 bp, Homo sapiens
cagagctggcggtgagaagaca

SEQ ID NO: 8480021 - DNA, 22 bp, Homo sapiens
cagagctggcggtgagaagaca

SEQ ID NO: 8480022 - DNA, 22 bp, Homo sapiens
cagagctggcggtgagaagaca

SEQ ID NO: 8480023 - DNA, 22 bp, Homo sapiens
cagagctggcctgtgatttttg

SEQ ID NO: 8480024 - DNA, 22 bp, Homo sapiens
cagagctggagggaaccctggc

SEQ ID NO: 8480025 - DNA, 22 bp, Homo sapiens
cagagctggagggaaccctggc

SEQ ID NO: 8480026 - DNA, 22 bp, Homo sapiens
cagagctggagggaaccctggc

SEQ ID NO: 8480027 - DNA, 22 bp, Homo sapiens
cagagctggagggaaccctggc

SEQ ID NO: 8480028 - DNA, 22 bp, Homo sapiens
cagagctggagggaaccctggc

SEQ ID NO: 8480029 - DNA, 23 bp, Homo sapiens
cagagctggctcagagctgcctg

SEQ ID NO: 8480030 - DNA, 22 bp, Homo sapiens
agccccttgcacttccccacgc

SEQ ID NO: 8480031 - DNA, 22 bp, Homo sapiens
agcccggcttccccggttgcta

SEQ ID NO: 8480032 - DNA, 22 bp, Homo sapiens
agcccggcttccccggttgcta

SEQ ID NO: 8480033 - DNA, 22 bp, Homo sapiens
agccctagagaaccagcctgtg

SEQ ID NO: 8480034 - DNA, 22 bp, Homo sapiens
agccctcatggaacagctccta

SEQ ID NO: 8480035 - DNA, 22 bp, Homo sapiens
agccctcatggaacagctccta

SEQ ID NO: 8480036 - DNA, 22 bp, Homo sapiens
agccctcatggaacagctccta

SEQ ID NO: 8480037 - DNA, 22 bp, Homo sapiens
agccctcatggaacagctccta

SEQ ID NO: 8480038 - DNA, 22 bp, Homo sapiens
agccctcaggctttgctgggcc

SEQ ID NO: 8480039 - DNA, 22 bp, Homo sapiens
agccctagagctggaggtcagt

SEQ ID NO: 8480040 - DNA, 22 bp, Homo sapiens
agcccggcttccccggttgcta

SEQ ID NO: 8480041 - DNA, 22 bp, Homo sapiens
agccccttgtgggcgcacagca

SEQ ID NO: 8480042 - DNA, 22 bp, Homo sapiens
agcccgagcgcacctgtggaaa

SEQ ID NO: 8480043 - DNA, 22 bp, Homo sapiens
agccccttggaacacagggctg

SEQ ID NO: 8480044 - DNA, 22 bp, Homo sapiens
agctcaatgcaacctccgcctc

SEQ ID NO: 8480045 - DNA, 22 bp, Homo sapiens
agctcaatgcaacctccgcctc

SEQ ID NO: 8480046 - DNA, 22 bp, Homo sapiens
agctaggagattttgtgaggct

SEQ ID NO: 8480047 - DNA, 22 bp, Homo sapiens
agctaggataagcagagactgg

SEQ ID NO: 8480048 - DNA, 22 bp, Homo sapiens
agctcacagaaatcctgcagga

SEQ ID NO: 8480049 - DNA, 18 bp, Homo sapiens
agctcacagatctgtttt

SEQ ID NO: 8480050 - DNA, 22 bp, Homo sapiens
agctcaatgcaacctccgcctc

SEQ ID NO: 8480051 - DNA, 22 bp, Homo sapiens
agctcaatgcaacctccgcctc

SEQ ID NO: 8480052 - DNA, 22 bp, Homo sapiens
cagcaggaggtgagatgtgacc

SEQ ID NO: 8480053 - DNA, 23 bp, Homo sapiens
cagcaggagggtgcctgggctgc

SEQ ID NO: 8480054 - DNA, 22 bp, Homo sapiens
agctcagaactgcagacatgtg

SEQ ID NO: 8480055 - DNA, 22 bp, Homo sapiens
agctcagaactgcagacatgtg

SEQ ID NO: 8480056 - DNA, 22 bp, Homo sapiens
agctcagaactgcagacatgtg

SEQ ID NO: 8480057 - DNA, 22 bp, Homo sapiens
agctcagaactgcagacatgtg

SEQ ID NO: 8480058 - DNA, 22 bp, Homo sapiens
agctcagaagcctatgcatagt

SEQ ID NO: 8480059 - DNA, 22 bp, Homo sapiens
agctcagaagggaggaaatgag

SEQ ID NO: 8480060 - DNA, 22 bp, Homo sapiens
agctcagaaatgccagtaggta

SEQ ID NO: 8480061 - DNA, 22 bp, Homo sapiens
agctcagaacctcctcatccca

SEQ ID NO: 8480062 - DNA, 22 bp, Homo sapiens
agctcacagtgtccttcctcaa

SEQ ID NO: 8480063 - DNA, 22 bp, Homo sapiens
agctcacagtgtccttcctcaa

SEQ ID NO: 8480064 - DNA, 22 bp, Homo sapiens
agctcacattctcatcagatgt

SEQ ID NO: 8480065 - DNA, 21 bp, Homo sapiens
agctcacagttctgtcctgtc

SEQ ID NO: 8480066 - DNA, 22 bp, Homo sapiens
agccttctaggatgtcatctgc

SEQ ID NO: 8480067 - DNA, 22 bp, Homo sapiens
agccttctctgaaattctgttt

SEQ ID NO: 8480068 - DNA, 23 bp, Homo sapiens
agccttggaggttgaggctgcag

SEQ ID NO: 8480069 - DNA, 22 bp, Homo sapiens
agccttggccgtaaggtatgct

SEQ ID NO: 8480070 - DNA, 22 bp, Homo sapiens
agccttggccgtaaggtatgct

SEQ ID NO: 8480071 - DNA, 22 bp, Homo sapiens
agcctttaacacttcacattga

SEQ ID NO: 8480072 - DNA, 22 bp, Homo sapiens
cagcaggagcagtcagactcct

SEQ ID NO: 8480073 - DNA, 22 bp, Homo sapiens
agctcccagctcctttgagaga

SEQ ID NO: 8480074 - DNA, 22 bp, Homo sapiens
agctcccaggcagtcatgagga

SEQ ID NO: 8480075 - DNA, 22 bp, Homo sapiens
agctcccagcagagctggccac

SEQ ID NO: 8480076 - DNA, 22 bp, Homo sapiens
agctcccagcagagctggccac

SEQ ID NO: 8480077 - DNA, 22 bp, Homo sapiens
agctcccagagtcctctgccca

SEQ ID NO: 8480078 - DNA, 23 bp, Homo sapiens
agctccagggaacaggcagtagg

SEQ ID NO: 8480079 - DNA, 22 bp, Homo sapiens
agctcccagggctgggcaagtt

SEQ ID NO: 8480080 - DNA, 22 bp, Homo sapiens
agctcccaggcagtcatgagga

SEQ ID NO: 8480081 - DNA, 22 bp, Homo sapiens
agctcccaggcagtcatgagga

SEQ ID NO: 8480082 - DNA, 22 bp, Homo sapiens
agctcccagtctcctctccatg

SEQ ID NO: 8480083 - DNA, 22 bp, Homo sapiens
agctcccagtctcctctccatg

SEQ ID NO: 8480084 - DNA, 22 bp, Homo sapiens
agctcccagtctcctctccatg

SEQ ID NO: 8480085 - DNA, 22 bp, Homo sapiens
agctcccattatcttctgaaac

SEQ ID NO: 8480086 - DNA, 22 bp, Homo sapiens
agctcccctcgtttctctccat

SEQ ID NO: 8480087 - DNA, 22 bp, Homo sapiens
agctccctgagatgccacagca

SEQ ID NO: 8480088 - DNA, 22 bp, Homo sapiens
cagccagctgaatgtaccatga

SEQ ID NO: 8480089 - DNA, 22 bp, Homo sapiens
cagccagcctctcaaccatgca

SEQ ID NO: 8480090 - DNA, 22 bp, Homo sapiens
cagccagcctctcaaccatgca

SEQ ID NO: 8480091 - DNA, 22 bp, Homo sapiens
cagccagatcaaactcagatgt

SEQ ID NO: 8480092 - DNA, 22 bp, Homo sapiens
cagccagatcagggcaggggtt

SEQ ID NO: 8480093 - DNA, 22 bp, Homo sapiens
cagccagcctctcaaccatgca

SEQ ID NO: 8480094 - DNA, 22 bp, Homo sapiens
cagccagagaaagggcactgcc

SEQ ID NO: 8480095 - DNA, 22 bp, Homo sapiens
cagccagagaggaaggaatgca

SEQ ID NO: 8480096 - DNA, 22 bp, Homo sapiens
cagccagaggggccagagtcgg

SEQ ID NO: 8480097 - DNA, 22 bp, Homo sapiens
cagccagaggctgcgaggggcc

SEQ ID NO: 8480098 - DNA, 22 bp, Homo sapiens
cagccctggcgcccccagatct

SEQ ID NO: 8480099 - DNA, 22 bp, Homo sapiens
cagccctggcgcccccagatct

SEQ ID NO: 8480100 - DNA, 22 bp, Homo sapiens
cagccctggctagggcgagggc

SEQ ID NO: 8480101 - DNA, 22 bp, Homo sapiens
cagccctggcgcccccagatct

SEQ ID NO: 8480102 - DNA, 22 bp, Homo sapiens
cagccctggctagggcgagggc

SEQ ID NO: 8480103 - DNA, 22 bp, Homo sapiens
cagccctggctagggcgagggc

SEQ ID NO: 8480104 - DNA, 22 bp, Homo sapiens
cagccctggctagggcgagggc

SEQ ID NO: 8480105 - DNA, 22 bp, Homo sapiens
cagccctggctagggcgagggc

SEQ ID NO: 8480106 - DNA, 22 bp, Homo sapiens
cagccctgggagttggggccga

SEQ ID NO: 8480107 - DNA, 22 bp, Homo sapiens
cagccctgggagttggggccga

SEQ ID NO: 8480108 - DNA, 22 bp, Homo sapiens
cagccctgggatcttagtgcct

SEQ ID NO: 8480109 - DNA, 22 bp, Homo sapiens
agctcctgtgtgaagcctccct

SEQ ID NO: 8480110 - DNA, 22 bp, Homo sapiens
cagccctgggtccctgccctgg

SEQ ID NO: 8480111 - DNA, 22 bp, Homo sapiens
cagccctgggtccctgccctgg

SEQ ID NO: 8480112 - DNA, 22 bp, Homo sapiens
cagccctgggtccctgccctgg

SEQ ID NO: 8480113 - DNA, 22 bp, Homo sapiens
agctcctcctgtgccaggccag

SEQ ID NO: 8480114 - DNA, 22 bp, Homo sapiens
agctcctcctgtgccaggccag

SEQ ID NO: 8480115 - DNA, 22 bp, Homo sapiens
cagccctggccccaggtggtct

SEQ ID NO: 8480116 - DNA, 22 bp, Homo sapiens
cagccctggccccaggtggtct

SEQ ID NO: 8480117 - DNA, 22 bp, Homo sapiens
cagccctggccccaggtggtct

SEQ ID NO: 8480118 - DNA, 22 bp, Homo sapiens
cagccctggccccaggtggtct

SEQ ID NO: 8480119 - DNA, 22 bp, Homo sapiens
cagccctggcctcttcgctttc

SEQ ID NO: 8480120 - DNA, 22 bp, Homo sapiens
cagccctggcgcccccagatct

SEQ ID NO: 8480121 - DNA, 22 bp, Homo sapiens
cagccctggcctcttcgctttc

SEQ ID NO: 8480122 - DNA, 22 bp, Homo sapiens
agctccctgcacgaccctgccc

SEQ ID NO: 8480123 - DNA, 21 bp, Homo sapiens
agctccctgtttcctcactct

SEQ ID NO: 8480124 - DNA, 21 bp, Homo sapiens
agctccctgtttcctcactct

SEQ ID NO: 8480125 - DNA, 22 bp, Homo sapiens
agctcctcctgagtgtctggga

SEQ ID NO: 8480126 - DNA, 20 bp, Homo sapiens
agctcctcatcactggaggt

SEQ ID NO: 8480127 - DNA, 22 bp, Homo sapiens
cagcagagcttattaactaaaa

SEQ ID NO: 8480128 - DNA, 22 bp, Homo sapiens
cagcagaggaaagcaaatctaa

SEQ ID NO: 8480129 - DNA, 22 bp, Homo sapiens
cagcagaggaaagcaaatctaa

SEQ ID NO: 8480130 - DNA, 22 bp, Homo sapiens
cagcagagggagccattgaaat

SEQ ID NO: 8480131 - DNA, 22 bp, Homo sapiens
cagcagagggagccattgaaat

SEQ ID NO: 8480132 - DNA, 22 bp, Homo sapiens
cagcagaggtggttcacattgt

SEQ ID NO: 8480133 - DNA, 22 bp, Homo sapiens
cagcagaggttggaacagttct

SEQ ID NO: 8480134 - DNA, 22 bp, Homo sapiens
cagcagaggttggaacagttct

SEQ ID NO: 8480135 - DNA, 22 bp, Homo sapiens
cagcagaggttggaacagttct

SEQ ID NO: 8480136 - DNA, 22 bp, Homo sapiens
agcctccatcccatgcacaaag

SEQ ID NO: 8480137 - DNA, 22 bp, Homo sapiens
cagcagagcttatgttgggtca

SEQ ID NO: 8480138 - DNA, 20 bp, Homo sapiens
cagcagaaatggggtgggaa

SEQ ID NO: 8480139 - DNA, 22 bp, Homo sapiens
cagcagagcttattaactaaaa

SEQ ID NO: 8480140 - DNA, 22 bp, Homo sapiens
agcctcagtgtcaccatctacc

SEQ ID NO: 8480141 - DNA, 22 bp, Homo sapiens
agcctcagtgtcaccatctacc

SEQ ID NO: 8480142 - DNA, 21 bp, Homo sapiens
agcctcaggttgttggttctt

SEQ ID NO: 8480143 - DNA, 22 bp, Homo sapiens
agcctcagtgtcaccatctacc

SEQ ID NO: 8480144 - DNA, 22 bp, Homo sapiens
agcctcagtttcaggcctcctc

SEQ ID NO: 8480145 - DNA, 22 bp, Homo sapiens
agcctcagtgtcaccatctacc

SEQ ID NO: 8480146 - DNA, 22 bp, Homo sapiens
agcctccaaatgtcaggtcccg

SEQ ID NO: 8480147 - DNA, 22 bp, Homo sapiens
agcctcagtttcaggcctcctc

SEQ ID NO: 8480148 - DNA, 22 bp, Homo sapiens
agcctccagtagctgaagagac

SEQ ID NO: 8480149 - DNA, 22 bp, Homo sapiens
agcctccacagatgcaaagggc

SEQ ID NO: 8480150 - DNA, 22 bp, Homo sapiens
cagcagcagtggctgcagaaca

SEQ ID NO: 8480151 - DNA, 22 bp, Homo sapiens
cagcagcagtggctgcagaaca

SEQ ID NO: 8480152 - DNA, 22 bp, Homo sapiens
cagcagcagtggctgcagaaca

SEQ ID NO: 8480153 - DNA, 22 bp, Homo sapiens
cagcagcagtggctgcagaaca

SEQ ID NO: 8480154 - DNA, 22 bp, Homo sapiens
cagcagcagtggctgcagaaca

SEQ ID NO: 8480155 - DNA, 22 bp, Homo sapiens
cagcagcagtggctgcagaaca

SEQ ID NO: 8480156 - DNA, 22 bp, Homo sapiens
cagcagaggttttgctccatga

SEQ ID NO: 8480157 - DNA, 22 bp, Homo sapiens
cagcagcagccccaggaaggtt

SEQ ID NO: 8480158 - DNA, 22 bp, Homo sapiens
cagcagcagccccaggaaggtt

SEQ ID NO: 8480159 - DNA, 22 bp, Homo sapiens
cagcagcagcttagtggtcccc

SEQ ID NO: 8480160 - DNA, 22 bp, Homo sapiens
agccttcataatcttgggcttt

SEQ ID NO: 8480161 - DNA, 22 bp, Homo sapiens
agccttcagcagttcaggtgcc

SEQ ID NO: 8480162 - DNA, 23 bp, Homo sapiens
agccttcaggcaatgtcagtaga

SEQ ID NO: 8480163 - DNA, 22 bp, Homo sapiens
agccttcagtaaatccactgtg

SEQ ID NO: 8480164 - DNA, 22 bp, Homo sapiens
agcctgtccagaggacagggct

SEQ ID NO: 8480165 - DNA, 22 bp, Homo sapiens
agcctggtttaagcattttata

SEQ ID NO: 8480166 - DNA, 22 bp, Homo sapiens
agcctggtttaagcattttata

SEQ ID NO: 8480167 - DNA, 22 bp, Homo sapiens
agcctggtttaagcattttata

SEQ ID NO: 8480168 - DNA, 22 bp, Homo sapiens
cagcagcatcaggtctgtggtt

SEQ ID NO: 8480169 - DNA, 22 bp, Homo sapiens
cagcagcatcaggtctgtggtt

SEQ ID NO: 8480170 - DNA, 22 bp, Homo sapiens
cagcagcatgaattcgagccac

SEQ ID NO: 8480171 - DNA, 22 bp, Homo sapiens
cagcacaggaagtgggccttca

SEQ ID NO: 8480172 - DNA, 22 bp, Homo sapiens
cagcacaggaagtgggccttca

SEQ ID NO: 8480173 - DNA, 22 bp, Homo sapiens
cagcacaggaatatggtggaca

SEQ ID NO: 8480174 - DNA, 22 bp, Homo sapiens
cagcacaggaatatggtggaca

SEQ ID NO: 8480175 - DNA, 22 bp, Homo sapiens
cagcacaggaagtgggccttca

SEQ ID NO: 8480176 - DNA, 22 bp, Homo sapiens
cagcacaggcaggggaactata

SEQ ID NO: 8480177 - DNA, 22 bp, Homo sapiens
cagcacagctgaggggctgtct

SEQ ID NO: 8480178 - DNA, 22 bp, Homo sapiens
cagcacagctgaggggctgtct

SEQ ID NO: 8480179 - DNA, 22 bp, Homo sapiens
cagcacagctgaggggctgtct

SEQ ID NO: 8480180 - DNA, 22 bp, Homo sapiens
cagcacagcacagcggtgactc

SEQ ID NO: 8480181 - DNA, 22 bp, Homo sapiens
cagcacagctgaggggctgtct

SEQ ID NO: 8480182 - DNA, 22 bp, Homo sapiens
cagcacagctgaggggctgtct

SEQ ID NO: 8480183 - DNA, 22 bp, Homo sapiens
cagcacagctggctctggaagc

SEQ ID NO: 8480184 - DNA, 22 bp, Homo sapiens
cagcacaggaagtgggccttca

SEQ ID NO: 8480185 - DNA, 22 bp, Homo sapiens
cagcacagctggctctggaagc

SEQ ID NO: 8480186 - DNA, 22 bp, Homo sapiens
cagcacaggcccctctctccca

SEQ ID NO: 8480187 - DNA, 22 bp, Homo sapiens
cagcacaggcaggggaactata

SEQ ID NO: 8480188 - DNA, 22 bp, Homo sapiens
cagcacagggacaatagcagat

SEQ ID NO: 8480189 - DNA, 22 bp, Homo sapiens
cagcacaggcctgtctttgtct

SEQ ID NO: 8480190 - DNA, 22 bp, Homo sapiens
cagcacagggacaatagcagat

SEQ ID NO: 8480191 - DNA, 22 bp, Homo sapiens
cagcacagggacaatagcagat

SEQ ID NO: 8480192 - DNA, 22 bp, Homo sapiens
cagcacagggacaatagcagat

SEQ ID NO: 8480193 - DNA, 22 bp, Homo sapiens
agcctcagcacgcagctctgtg

SEQ ID NO: 8480194 - DNA, 22 bp, Homo sapiens
cagcacagtacaaggcacggat

SEQ ID NO: 8480195 - DNA, 22 bp, Homo sapiens
cagcacagtacaaggcacggat

SEQ ID NO: 8480196 - DNA, 22 bp, Homo sapiens
cagcacaggtcagttttttaag

SEQ ID NO: 8480197 - DNA, 22 bp, Homo sapiens
cagcacagggcttgagaggtgt

SEQ ID NO: 8480198 - DNA, 22 bp, Homo sapiens
cagcacagggcttgagaggtgt

SEQ ID NO: 8480199 - DNA, 22 bp, Homo sapiens
cagcacagggcttgagaggtgt

SEQ ID NO: 8480200 - DNA, 22 bp, Homo sapiens
cagcacagggcttgagaggtgt

SEQ ID NO: 8480201 - DNA, 22 bp, Homo sapiens
agcctcagggctctgcgcagac

SEQ ID NO: 8480202 - DNA, 22 bp, Homo sapiens
agcctcagggctctgcgcagac

SEQ ID NO: 8480203 - DNA, 22 bp, Homo sapiens
agcctcagggctctgcgcagac

SEQ ID NO: 8480204 - DNA, 22 bp, Homo sapiens
agcctcagggctctgcgcagac

SEQ ID NO: 8480205 - DNA, 22 bp, Homo sapiens
agcctcagggctctgcgcagac

SEQ ID NO: 8480206 - DNA, 23 bp, Homo sapiens
agcctcagccggtggcagaagtg

SEQ ID NO: 8480207 - DNA, 23 bp, Homo sapiens
agcctcagccggtggcagaagtg

SEQ ID NO: 8480208 - DNA, 23 bp, Homo sapiens
agcctcagccggtggcagaagtg

SEQ ID NO: 8480209 - DNA, 22 bp, Homo sapiens
agcctcagcacgcagctctgtg

SEQ ID NO: 8480210 - DNA, 22 bp, Homo sapiens
agcctcagcacgcagctctgtg

SEQ ID NO: 8480211 - DNA, 22 bp, Homo sapiens
agccctccaaaggttgggggag

SEQ ID NO: 8480212 - DNA, 22 bp, Homo sapiens
agccctcctcacatcagcgtcc

SEQ ID NO: 8480213 - DNA, 22 bp, Homo sapiens
cagaggcgaggcagctgaacct

SEQ ID NO: 8480214 - DNA, 22 bp, Homo sapiens
cagaggctaagagtgtccaaag

SEQ ID NO: 8480215 - DNA, 22 bp, Homo sapiens
cagaggcctttctacagtgata

SEQ ID NO: 8480216 - DNA, 22 bp, Homo sapiens
cagaggcctttctacagtgata

SEQ ID NO: 8480217 - DNA, 22 bp, Homo sapiens
cagaggctagactgtgcttcct

SEQ ID NO: 8480218 - DNA, 22 bp, Homo sapiens
cagaggctaagggtagcttggg

SEQ ID NO: 8480219 - DNA, 22 bp, Homo sapiens
cagaggctaagggtagcttggg

SEQ ID NO: 8480220 - DNA, 22 bp, Homo sapiens
cagaggctaagatgagtgggtg

SEQ ID NO: 8480221 - DNA, 22 bp, Homo sapiens
cagaggctaagatgagtgggtg

SEQ ID NO: 8480222 - DNA, 22 bp, Homo sapiens
cagaggctaagatgagtgggtg

SEQ ID NO: 8480223 - DNA, 22 bp, Homo sapiens
cagaggctaagatgagtgggtg

SEQ ID NO: 8480224 - DNA, 19 bp, Homo sapiens
cagcaagaatgaaggcata

SEQ ID NO: 8480225 - DNA, 19 bp, Homo sapiens
cagcaagaatgaaggcata

SEQ ID NO: 8480226 - DNA, 22 bp, Homo sapiens
cagcacacagtgactcgcacct

SEQ ID NO: 8480227 - DNA, 22 bp, Homo sapiens
cagcacagcacagcggtgactc

SEQ ID NO: 8480228 - DNA, 22 bp, Homo sapiens
cagcacagagtattttattgat

SEQ ID NO: 8480229 - DNA, 20 bp, Homo sapiens
cagcacagagcttggctcta

SEQ ID NO: 8480230 - DNA, 22 bp, Homo sapiens
cagaggctcagatggccctggc

SEQ ID NO: 8480231 - DNA, 22 bp, Homo sapiens
cagaggctcaccagcctttcac

SEQ ID NO: 8480232 - DNA, 22 bp, Homo sapiens
cagaggctcaccagcctttcac

SEQ ID NO: 8480233 - DNA, 22 bp, Homo sapiens
cagaggctcaccagcctttcac

SEQ ID NO: 8480234 - DNA, 22 bp, Homo sapiens
cagaggctcagatggccctggc

SEQ ID NO: 8480235 - DNA, 22 bp, Homo sapiens
cagaggctcttcctcactgccc

SEQ ID NO: 8480236 - DNA, 22 bp, Homo sapiens
agcaaacagtgtgctaagaaat

SEQ ID NO: 8480237 - DNA, 22 bp, Homo sapiens
agcaaaataaggtaatttattg

SEQ ID NO: 8480238 - DNA, 22 bp, Homo sapiens
agcaaaataaggtaatttattg

SEQ ID NO: 8480239 - DNA, 17 bp, Homo sapiens
agcaaaagtatcaaagc

SEQ ID NO: 8480240 - DNA, 17 bp, Homo sapiens
agcaaaagtatcaaagc

SEQ ID NO: 8480241 - DNA, 22 bp, Homo sapiens
agatttcaggttggggcagaag

SEQ ID NO: 8480242 - DNA, 22 bp, Homo sapiens
agatttcaatgtgagcattagt

SEQ ID NO: 8480243 - DNA, 22 bp, Homo sapiens
agatttcacatgctgctctatt

SEQ ID NO: 8480244 - DNA, 22 bp, Homo sapiens
agatttcaatgtgagcattagt

SEQ ID NO: 8480245 - DNA, 22 bp, Homo sapiens
agatttcacatgctgctctatt

SEQ ID NO: 8480246 - DNA, 22 bp, Homo sapiens
atttgcttcatagatctgtgga

SEQ ID NO: 8480247 - DNA, 22 bp, Homo sapiens
atttgcttgtaaatgtatgcct

SEQ ID NO: 8480248 - DNA, 23 bp, Homo sapiens
agatgtcttagaaactgaagctg

SEQ ID NO: 8480249 - DNA, 22 bp, Homo sapiens
agatgtctgtaattctaagcat

SEQ ID NO: 8480250 - DNA, 19 bp, Homo sapiens
agatgtctatttgactatc

SEQ ID NO: 8480251 - DNA, 22 bp, Homo sapiens
agatgtagtagtgggtctttta

SEQ ID NO: 8480252 - DNA, 19 bp, Homo sapiens
agatgtctatttgactatc

SEQ ID NO: 8480253 - DNA, 22 bp, Homo sapiens
agatgtggaacactagactgct

SEQ ID NO: 8480254 - DNA, 22 bp, Homo sapiens
atttgctggtgaaatagtgaca

SEQ ID NO: 8480255 - DNA, 22 bp, Homo sapiens
atttccaaaaccacttattgcc

SEQ ID NO: 8480256 - DNA, 21 bp, Homo sapiens
atttccaagggtacctaagat

SEQ ID NO: 8480257 - DNA, 19 bp, Homo sapiens
atttccaagaattggagag

SEQ ID NO: 8480258 - DNA, 19 bp, Homo sapiens
atttccaagaattggagag

SEQ ID NO: 8480259 - DNA, 22 bp, Homo sapiens
atttccaagaaagctttaggat

SEQ ID NO: 8480260 - DNA, 22 bp, Homo sapiens
atttccaccggctcaggaagtt

SEQ ID NO: 8480261 - DNA, 22 bp, Homo sapiens
atttccaatctctgcatatggg

SEQ ID NO: 8480262 - DNA, 22 bp, Homo sapiens
atttccacataagggaaataag

SEQ ID NO: 8480263 - DNA, 22 bp, Homo sapiens
atttccaatttcatccatgtcc

SEQ ID NO: 8480264 - DNA, 19 bp, Homo sapiens
agatggggaagagtgtgag

SEQ ID NO: 8480265 - DNA, 22 bp, Homo sapiens
agatggtaatcacatttatctg

SEQ ID NO: 8480266 - DNA, 22 bp, Homo sapiens
agatgggcgccctggactgagg

SEQ ID NO: 8480267 - DNA, 22 bp, Homo sapiens
agatggttgtcgcaaatgaatg

SEQ ID NO: 8480268 - DNA, 20 bp, Homo sapiens
agatggtgggctggaacacc

SEQ ID NO: 8480269 - DNA, 22 bp, Homo sapiens
agatgtaagaccttcatgaggg

SEQ ID NO: 8480270 - DNA, 22 bp, Homo sapiens
agatgtaagaccttcatgaggg

SEQ ID NO: 8480271 - DNA, 22 bp, Homo sapiens
agatgtaacggtaggtggcatt

SEQ ID NO: 8480272 - DNA, 22 bp, Homo sapiens
agatcttttggttattataaga

SEQ ID NO: 8480273 - DNA, 22 bp, Homo sapiens
agatgaaaagataagcagcaat

SEQ ID NO: 8480274 - DNA, 22 bp, Homo sapiens
agatgaaaatacgtgactttaa

SEQ ID NO: 8480275 - DNA, 22 bp, Homo sapiens
agatgaaaagataagcagcaat

SEQ ID NO: 8480276 - DNA, 21 bp, Homo sapiens
agatccagtgccataaggccc

SEQ ID NO: 8480277 - DNA, 22 bp, Homo sapiens
agatccaggatgtcccaaaata

SEQ ID NO: 8480278 - DNA, 22 bp, Homo sapiens
agatccagggttggatttgcat

SEQ ID NO: 8480279 - DNA, 22 bp, Homo sapiens
agatgaaaatacgtgactttaa

SEQ ID NO: 8480280 - DNA, 22 bp, Homo sapiens
agatgaaagatttttatagaga

SEQ ID NO: 8480281 - DNA, 22 bp, Homo sapiens
agatgaaagatttttatagaga

SEQ ID NO: 8480282 - DNA, 22 bp, Homo sapiens
agatgaaatttgtgttgagttg

SEQ ID NO: 8480283 - DNA, 23 bp, Homo sapiens
agatgaaagcttcccatcacagt

SEQ ID NO: 8480284 - DNA, 23 bp, Homo sapiens
agatgaaagcttcccatcacagt

SEQ ID NO: 8480285 - DNA, 22 bp, Homo sapiens
agatgaagactcaggagcaggt

SEQ ID NO: 8480286 - DNA, 22 bp, Homo sapiens
agatgaagatatctgcaggggc

SEQ ID NO: 8480287 - DNA, 22 bp, Homo sapiens
agatgaagactcaggagcaggt

SEQ ID NO: 8480288 - DNA, 22 bp, Homo sapiens
agatgaatccacacatggcaaa

SEQ ID NO: 8480289 - DNA, 22 bp, Homo sapiens
atttcattgaagttaattcttc

SEQ ID NO: 8480290 - DNA, 22 bp, Homo sapiens
agatgaagatgccactaagacc

SEQ ID NO: 8480291 - DNA, 22 bp, Homo sapiens
atttcattgaagttaattcttc

SEQ ID NO: 8480292 - DNA, 22 bp, Homo sapiens
atttcattgaagttaattcttc

SEQ ID NO: 8480293 - DNA, 22 bp, Homo sapiens
atttcattgaagttaattcttc

SEQ ID NO: 8480294 - DNA, 22 bp, Homo sapiens
atttcattgaagttaattcttc

SEQ ID NO: 8480295 - DNA, 22 bp, Homo sapiens
atttaacaagacagagaactgg

SEQ ID NO: 8480296 - DNA, 22 bp, Homo sapiens
atttaaattttctgatggagag

SEQ ID NO: 8480297 - DNA, 22 bp, Homo sapiens
atttaaattttctgatggagag

SEQ ID NO: 8480298 - DNA, 22 bp, Homo sapiens
atttaaattttctgatggagag

SEQ ID NO: 8480299 - DNA, 22 bp, Homo sapiens
atttaaattttctgatggagag

SEQ ID NO: 8480300 - DNA, 22 bp, Homo sapiens
attgttaataactattacattg

SEQ ID NO: 8480301 - DNA, 19 bp, Homo sapiens
attcttctcttcctgctgt

SEQ ID NO: 8480302 - DNA, 19 bp, Homo sapiens
attcttctcttcctgctgt

SEQ ID NO: 8480303 - DNA, 19 bp, Homo sapiens
attcttctcttcctgctgt

SEQ ID NO: 8480304 - DNA, 18 bp, Homo sapiens
attgttaatagagtactt

SEQ ID NO: 8480305 - DNA, 22 bp, Homo sapiens
atttaagactgacttcaccagt

SEQ ID NO: 8480306 - DNA, 22 bp, Homo sapiens
atttaagactgacttcaccagt

SEQ ID NO: 8480307 - DNA, 22 bp, Homo sapiens
atttaactttcagcccctcttc

SEQ ID NO: 8480308 - DNA, 22 bp, Homo sapiens
atttaagaggctgctagagtat

SEQ ID NO: 8480309 - DNA, 22 bp, Homo sapiens
atttaagattgcgtattcatgt

SEQ ID NO: 8480310 - DNA, 22 bp, Homo sapiens
atttaagattgcgtattcatgt

SEQ ID NO: 8480311 - DNA, 22 bp, Homo sapiens
agagtggcctcagagaaataca

SEQ ID NO: 8480312 - DNA, 22 bp, Homo sapiens
agagtggcctggcctggggcat

SEQ ID NO: 8480313 - DNA, 23 bp, Homo sapiens
atttaatgctgagttgaatgtta

SEQ ID NO: 8480314 - DNA, 22 bp, Homo sapiens
atttaagggatttggagaccaa

SEQ ID NO: 8480315 - DNA, 18 bp, Homo sapiens
atttaatgaactgaaagc

SEQ ID NO: 8480316 - DNA, 18 bp, Homo sapiens
atttaatgaactgaaagc

SEQ ID NO: 8480317 - DNA, 22 bp, Homo sapiens
agagggtgggcacgtgatggat

SEQ ID NO: 8480318 - DNA, 22 bp, Homo sapiens
agagggtgggcacgtgatggat

SEQ ID NO: 8480319 - DNA, 22 bp, Homo sapiens
agagggtggtgaggcctggttc

SEQ ID NO: 8480320 - DNA, 22 bp, Homo sapiens
agaggtagaaaataatggagag

SEQ ID NO: 8480321 - DNA, 22 bp, Homo sapiens
agaggtagaggttgcagtgagc

SEQ ID NO: 8480322 - DNA, 22 bp, Homo sapiens
agaggtatatattctccatatt

SEQ ID NO: 8480323 - DNA, 22 bp, Homo sapiens
agaggtagaggttgcagtgagc

SEQ ID NO: 8480324 - DNA, 22 bp, Homo sapiens
agaggtatatattctccatatt

SEQ ID NO: 8480325 - DNA, 22 bp, Homo sapiens
agaggtatgtgtcagtgcttat

SEQ ID NO: 8480326 - DNA, 22 bp, Homo sapiens
attcttcatacagacaagtcct

SEQ ID NO: 8480327 - DNA, 22 bp, Homo sapiens
attcttcatgttgaagctgtca

SEQ ID NO: 8480328 - DNA, 22 bp, Homo sapiens
attcttcatgttgaagctgtca

SEQ ID NO: 8480329 - DNA, 23 bp, Homo sapiens
attcttcattatcttctagaaaa

SEQ ID NO: 8480330 - DNA, 23 bp, Homo sapiens
attcttcattatcttctagaaaa

SEQ ID NO: 8480331 - DNA, 22 bp, Homo sapiens
attcttctaatatgatcgtgtt

SEQ ID NO: 8480332 - DNA, 22 bp, Homo sapiens
attcttcattgttgattcatgt

SEQ ID NO: 8480333 - DNA, 22 bp, Homo sapiens
attcttcattgttgattcatgt

SEQ ID NO: 8480334 - DNA, 22 bp, Homo sapiens
attcttctctgggttgggttca

SEQ ID NO: 8480335 - DNA, 22 bp, Homo sapiens
attcttctaatatgatcgtgtt

SEQ ID NO: 8480336 - DNA, 19 bp, Homo sapiens
attcttctcaaatatccat

SEQ ID NO: 8480337 - DNA, 19 bp, Homo sapiens
attcttctcaaatatccat

SEQ ID NO: 8480338 - DNA, 22 bp, Homo sapiens
atttattattgtggttacttct

SEQ ID NO: 8480339 - DNA, 22 bp, Homo sapiens
atttattattgtggttacttct

SEQ ID NO: 8480340 - DNA, 22 bp, Homo sapiens
atttattattgtggttacttct

SEQ ID NO: 8480341 - DNA, 22 bp, Homo sapiens
atttattgaacactgactatgt

SEQ ID NO: 8480342 - DNA, 22 bp, Homo sapiens
atttagtgtgtattgctattat

SEQ ID NO: 8480343 - DNA, 22 bp, Homo sapiens
atttagtgacctgaactgaaac

SEQ ID NO: 8480344 - DNA, 17 bp, Homo sapiens
atttagcaagtagacag

SEQ ID NO: 8480345 - DNA, 22 bp, Homo sapiens
atttagtcatcactcatgtgtt

SEQ ID NO: 8480346 - DNA, 22 bp, Homo sapiens
atttagtctcccttatcaagga

SEQ ID NO: 8480347 - DNA, 22 bp, Homo sapiens
atttagtctgtaacagtacagt

SEQ ID NO: 8480348 - DNA, 22 bp, Homo sapiens
atttagtgaaacccataaagca

SEQ ID NO: 8480349 - DNA, 22 bp, Homo sapiens
agagtgggacacgggcgctgtc

SEQ ID NO: 8480350 - DNA, 22 bp, Homo sapiens
agagtgggacacgggcgctgtc

SEQ ID NO: 8480351 - DNA, 22 bp, Homo sapiens
agagtgggcaggagcctcgact

SEQ ID NO: 8480352 - DNA, 22 bp, Homo sapiens
agagtgggacacgggcgctgtc

SEQ ID NO: 8480353 - DNA, 22 bp, Homo sapiens
agagtgggacacgggcgctgtc

SEQ ID NO: 8480354 - DNA, 22 bp, Homo sapiens
agagtggcttctttgacatgct

SEQ ID NO: 8480355 - DNA, 22 bp, Homo sapiens
agagtggggaaggtgttgagaa

SEQ ID NO: 8480356 - DNA, 22 bp, Homo sapiens
agagtggggaaggtgttgagaa

SEQ ID NO: 8480357 - DNA, 22 bp, Homo sapiens
agagtggggaaggtgttgagaa

SEQ ID NO: 8480358 - DNA, 22 bp, Homo sapiens
agagtgggcaggagcctcgact

SEQ ID NO: 8480359 - DNA, 22 bp, Homo sapiens
agagtgggcctctgagtcccag

SEQ ID NO: 8480360 - DNA, 22 bp, Homo sapiens
agagtgggcctctgagtcccag

SEQ ID NO: 8480361 - DNA, 22 bp, Homo sapiens
atttagaagttggagggcaaga

SEQ ID NO: 8480362 - DNA, 22 bp, Homo sapiens
atttagaagttggagggcaaga

SEQ ID NO: 8480363 - DNA, 22 bp, Homo sapiens
atttagacttcttgcaggtaat

SEQ ID NO: 8480364 - DNA, 23 bp, Homo sapiens
atttacaggttaaatgaaatcag

SEQ ID NO: 8480365 - DNA, 23 bp, Homo sapiens
atttacaggttaaatgaaatcag

SEQ ID NO: 8480366 - DNA, 22 bp, Homo sapiens
atttagagaataagacataaat

SEQ ID NO: 8480367 - DNA, 22 bp, Homo sapiens
atttagcaaaaaatgatgaagc

SEQ ID NO: 8480368 - DNA, 17 bp, Homo sapiens
atttagcaagtagacag

SEQ ID NO: 8480369 - DNA, 22 bp, Homo sapiens
atttagcaagagtacaaaataa

SEQ ID NO: 8480370 - DNA, 22 bp, Homo sapiens
attaaacaatgtaaagttcttg

SEQ ID NO: 8480371 - DNA, 22 bp, Homo sapiens
attaaacaatgtaaagttcttg

SEQ ID NO: 8480372 - DNA, 22 bp, Homo sapiens
attaaacaatgtaaagttcttg

SEQ ID NO: 8480373 - DNA, 22 bp, Homo sapiens
attaaacaatgtaaagttcttg

SEQ ID NO: 8480374 - DNA, 22 bp, Homo sapiens
attaaactgagcaaattaacat

SEQ ID NO: 8480375 - DNA, 22 bp, Homo sapiens
attaaaccccagttctcttact

SEQ ID NO: 8480376 - DNA, 22 bp, Homo sapiens
attaaactgagcaaattaacat

SEQ ID NO: 8480377 - DNA, 22 bp, Homo sapiens
attaaagtgaagttctcagatg

SEQ ID NO: 8480378 - DNA, 22 bp, Homo sapiens
attaaagtgaagttctcagatg

SEQ ID NO: 8480379 - DNA, 22 bp, Homo sapiens
attaaagctatccagtcatgaa

SEQ ID NO: 8480380 - DNA, 22 bp, Homo sapiens
attaaagacagcagatggatgg

SEQ ID NO: 8480381 - DNA, 22 bp, Homo sapiens
attaaagacagcagatggatgg

SEQ ID NO: 8480382 - DNA, 22 bp, Homo sapiens
attaaagaaacccagcatgtga

SEQ ID NO: 8480383 - DNA, 22 bp, Homo sapiens
attaaagaaacccagcatgtga

SEQ ID NO: 8480384 - DNA, 22 bp, Homo sapiens
atgttttaaatatgtgtgtaaa

SEQ ID NO: 8480385 - DNA, 22 bp, Homo sapiens
attacagtggacagctatgcac

SEQ ID NO: 8480386 - DNA, 22 bp, Homo sapiens
attacagtgccacctcgtggtc

SEQ ID NO: 8480387 - DNA, 22 bp, Homo sapiens
attacagtaggattggaaagga

SEQ ID NO: 8480388 - DNA, 22 bp, Homo sapiens
attacagtggacagctatgcac

SEQ ID NO: 8480389 - DNA, 22 bp, Homo sapiens
attacagtagcaaaagaccgga

SEQ ID NO: 8480390 - DNA, 22 bp, Homo sapiens
attaaagtgaagttctcagatg

SEQ ID NO: 8480391 - DNA, 22 bp, Homo sapiens
attaaagttgaaattgaactga

SEQ ID NO: 8480392 - DNA, 22 bp, Homo sapiens
attagcaacatggtgaatatgt

SEQ ID NO: 8480393 - DNA, 22 bp, Homo sapiens
attagcaacatggtgaatatgt

SEQ ID NO: 8480394 - DNA, 22 bp, Homo sapiens
attagattgtaaatgttttcac

SEQ ID NO: 8480395 - DNA, 22 bp, Homo sapiens
attagcatgccaagcttttaga

SEQ ID NO: 8480396 - DNA, 22 bp, Homo sapiens
attagctatatgctatgtgcca

SEQ ID NO: 8480397 - DNA, 22 bp, Homo sapiens
attagctgttgtgaaaggggtg

SEQ ID NO: 8480398 - DNA, 22 bp, Homo sapiens
attagctgacctctaaggagcc

SEQ ID NO: 8480399 - DNA, 22 bp, Homo sapiens
attagctgacctctaaggagcc

SEQ ID NO: 8480400 - DNA, 22 bp, Homo sapiens
attagcatattaaatagtcatt

SEQ ID NO: 8480401 - DNA, 22 bp, Homo sapiens
attagcagctttctggtctcta

SEQ ID NO: 8480402 - DNA, 22 bp, Homo sapiens
attagcaattgtgcatctagta

SEQ ID NO: 8480403 - DNA, 22 bp, Homo sapiens
atgttacaatccaacaaaatta

SEQ ID NO: 8480404 - DNA, 22 bp, Homo sapiens
atgttacacataggcataaatg

SEQ ID NO: 8480405 - DNA, 22 bp, Homo sapiens
atgtttatgttgggctatattt

SEQ ID NO: 8480406 - DNA, 22 bp, Homo sapiens
atgtttatgttgggctatattt

SEQ ID NO: 8480407 - DNA, 22 bp, Homo sapiens
atgtttatgttgggctatattt

SEQ ID NO: 8480408 - DNA, 22 bp, Homo sapiens
atgtttctgaagtttacagata

SEQ ID NO: 8480409 - DNA, 22 bp, Homo sapiens
atgtttctgagtgtatatacat

SEQ ID NO: 8480410 - DNA, 22 bp, Homo sapiens
atgtttctgaagtttacagata

SEQ ID NO: 8480411 - DNA, 22 bp, Homo sapiens
atgtttctgtcctacgagataa

SEQ ID NO: 8480412 - DNA, 22 bp, Homo sapiens
atgtttctgtcctacgagataa

SEQ ID NO: 8480413 - DNA, 22 bp, Homo sapiens
atgtttgactgagtttggcaga

SEQ ID NO: 8480414 - DNA, 22 bp, Homo sapiens
atgttaactgaagccattctcg

SEQ ID NO: 8480415 - DNA, 22 bp, Homo sapiens
atgttaaatggtttattattaa

SEQ ID NO: 8480416 - DNA, 22 bp, Homo sapiens
atgttaaatggtttattattaa

SEQ ID NO: 8480417 - DNA, 22 bp, Homo sapiens
atgttaaatggtttattattaa

SEQ ID NO: 8480418 - DNA, 17 bp, Homo sapiens
atgttaatttcacattt

SEQ ID NO: 8480419 - DNA, 22 bp, Homo sapiens
atgttaaatggtttattattaa

SEQ ID NO: 8480420 - DNA, 22 bp, Homo sapiens
atgttaaatggtttattattaa

SEQ ID NO: 8480421 - DNA, 22 bp, Homo sapiens
atgttaaatagccatttgtttg

SEQ ID NO: 8480422 - DNA, 22 bp, Homo sapiens
atgttaaatagccatttgtttg

SEQ ID NO: 8480423 - DNA, 20 bp, Homo sapiens
atgttaaatagcatttagag

SEQ ID NO: 8480424 - DNA, 20 bp, Homo sapiens
atgttaaatagcatttagag

SEQ ID NO: 8480425 - DNA, 22 bp, Homo sapiens
atgttaaatagccatttgtttg

SEQ ID NO: 8480426 - DNA, 20 bp, Homo sapiens
atgttaaatagcatttagag

SEQ ID NO: 8480427 - DNA, 22 bp, Homo sapiens
atgtgtgcatcaatgatagatc

SEQ ID NO: 8480428 - DNA, 22 bp, Homo sapiens
atgtgtgcatcaatgatagatc

SEQ ID NO: 8480429 - DNA, 22 bp, Homo sapiens
atgtgtgcaatgctattttggc

SEQ ID NO: 8480430 - DNA, 22 bp, Homo sapiens
atgtgtgcatattctgccacct

SEQ ID NO: 8480431 - DNA, 22 bp, Homo sapiens
atgtgtgcatgttagagagagt

SEQ ID NO: 8480432 - DNA, 22 bp, Homo sapiens
atgtgtgccccttttactcttt

SEQ ID NO: 8480433 - DNA, 22 bp, Homo sapiens
atgtgtgccccttttactcttt

SEQ ID NO: 8480434 - DNA, 22 bp, Homo sapiens
atgtgtgcctgagtgatggact

SEQ ID NO: 8480435 - DNA, 22 bp, Homo sapiens
atgtgtgcctgagtgatggact

SEQ ID NO: 8480436 - DNA, 22 bp, Homo sapiens
atgtgtgcgggaaggaaagtga

SEQ ID NO: 8480437 - DNA, 22 bp, Homo sapiens
atgtgtgctacaggtgtgggaa

SEQ ID NO: 8480438 - DNA, 22 bp, Homo sapiens
atgtgtctttcaaggtatagaa

SEQ ID NO: 8480439 - DNA, 22 bp, Homo sapiens
atgtgtatgagtgtgcttcttt

SEQ ID NO: 8480440 - DNA, 18 bp, Homo sapiens
atgtgtctttcttgtttg

SEQ ID NO: 8480441 - DNA, 22 bp, Homo sapiens
atgtgtctttgagactctgcta

SEQ ID NO: 8480442 - DNA, 22 bp, Homo sapiens
atgtgtatccatctgtctattt

SEQ ID NO: 8480443 - DNA, 22 bp, Homo sapiens
atgtgtatccatctgtctattt

SEQ ID NO: 8480444 - DNA, 22 bp, Homo sapiens
atgtgtatctaaggtgttctat

SEQ ID NO: 8480445 - DNA, 22 bp, Homo sapiens
atgtcttctaagctctaagctg

SEQ ID NO: 8480446 - DNA, 22 bp, Homo sapiens
atgtcttctaagctctaagctg

SEQ ID NO: 8480447 - DNA, 22 bp, Homo sapiens
atgtgtatccatctgtctattt

SEQ ID NO: 8480448 - DNA, 22 bp, Homo sapiens
atgtgtgctcttgagccttcac

SEQ ID NO: 8480449 - DNA, 18 bp, Homo sapiens
atgtgtggcttggggtcc

SEQ ID NO: 8480450 - DNA, 22 bp, Homo sapiens
atgtgtgctcttgagccttcac

SEQ ID NO: 8480451 - DNA, 22 bp, Homo sapiens
atgtgtgctacaggtgtgggaa

SEQ ID NO: 8480452 - DNA, 21 bp, Homo sapiens
atgtgtgctagaggactactg

SEQ ID NO: 8480453 - DNA, 22 bp, Homo sapiens
atgtgtggtttaagaattgaat

SEQ ID NO: 8480454 - DNA, 23 bp, Homo sapiens
atgtgtgggaggtcagagagcca

SEQ ID NO: 8480455 - DNA, 23 bp, Homo sapiens
atgtgtgggaggtcagagagcca

SEQ ID NO: 8480456 - DNA, 22 bp, Homo sapiens
atgtgtggtacagtcccgttta

SEQ ID NO: 8480457 - DNA, 23 bp, Homo sapiens
atgtgtgggaggtcagagagcca

SEQ ID NO: 8480458 - DNA, 22 bp, Homo sapiens
atgtgtgtaaacaagtataatt

SEQ ID NO: 8480459 - DNA, 22 bp, Homo sapiens
atgtgtggtttgtaaatgattt

SEQ ID NO: 8480460 - DNA, 22 bp, Homo sapiens
atgttaaataatcccttaaagc

SEQ ID NO: 8480461 - DNA, 22 bp, Homo sapiens
atgttaaataatcccttaaagc

SEQ ID NO: 8480462 - DNA, 22 bp, Homo sapiens
atgtgtgtacacacgtgactct

SEQ ID NO: 8480463 - DNA, 22 bp, Homo sapiens
atgtgtgtacacacgtgactct

SEQ ID NO: 8480464 - DNA, 22 bp, Homo sapiens
atgtgtgtacacacgtgactct

SEQ ID NO: 8480465 - DNA, 22 bp, Homo sapiens
atgtgtgtaaacaagtataatt

SEQ ID NO: 8480466 - DNA, 22 bp, Homo sapiens
atgtgtgtaaacaagtataatt

SEQ ID NO: 8480467 - DNA, 22 bp, Homo sapiens
atgtgtgtaaacaagtataatt

SEQ ID NO: 8480468 - DNA, 22 bp, Homo sapiens
atgtgtgtacacacgtgactct

SEQ ID NO: 8480469 - DNA, 22 bp, Homo sapiens
agaggggctcatatcctgtcat

SEQ ID NO: 8480470 - DNA, 22 bp, Homo sapiens
agagggcagcagcaacaactct

SEQ ID NO: 8480471 - DNA, 22 bp, Homo sapiens
agaggggctcatatcctgtcat

SEQ ID NO: 8480472 - DNA, 22 bp, Homo sapiens
agagggtgaatgagatagaaaa

SEQ ID NO: 8480473 - DNA, 22 bp, Homo sapiens
agagggtgaatgagatagaaaa

SEQ ID NO: 8480474 - DNA, 22 bp, Homo sapiens
agagggtgaatgagatagaaaa

SEQ ID NO: 8480475 - DNA, 22 bp, Homo sapiens
agagggtgagcaggtacacatg

SEQ ID NO: 8480476 - DNA, 23 bp, Homo sapiens
agagggtgcaacatggggatcta

SEQ ID NO: 8480477 - DNA, 23 bp, Homo sapiens
agagggtgcaacatggggatcta

SEQ ID NO: 8480478 - DNA, 22 bp, Homo sapiens
agagggtgctggagagacattg

SEQ ID NO: 8480479 - DNA, 22 bp, Homo sapiens
agagggtgctggagagacattg

SEQ ID NO: 8480480 - DNA, 22 bp, Homo sapiens
agagggtgggcacgtgatggat

SEQ ID NO: 8480481 - DNA, 22 bp, Homo sapiens
agagggagcccagtcatagctg

SEQ ID NO: 8480482 - DNA, 22 bp, Homo sapiens
agagggagcccagtcatagctg

SEQ ID NO: 8480483 - DNA, 23 bp, Homo sapiens
agagggagatgtttttctcaaga

SEQ ID NO: 8480484 - DNA, 22 bp, Homo sapiens
agagggatcaccctgtttctgg

SEQ ID NO: 8480485 - DNA, 22 bp, Homo sapiens
agagggagtgaaatggaataga

SEQ ID NO: 8480486 - DNA, 22 bp, Homo sapiens
agagggatcaccctgtttctgg

SEQ ID NO: 8480487 - DNA, 22 bp, Homo sapiens
agagggatcaccctgtttctgg

SEQ ID NO: 8480488 - DNA, 22 bp, Homo sapiens
agagggatcaccctgtttctgg

SEQ ID NO: 8480489 - DNA, 22 bp, Homo sapiens
attctctgttcaaggatggtga

SEQ ID NO: 8480490 - DNA, 22 bp, Homo sapiens
attctggacaaggcaagctcct

SEQ ID NO: 8480491 - DNA, 22 bp, Homo sapiens
attctctgtggtgatgctggtg

SEQ ID NO: 8480492 - DNA, 22 bp, Homo sapiens
attcagcattggcaccatggat

SEQ ID NO: 8480493 - DNA, 22 bp, Homo sapiens
attctggacaatgagaaactgg

SEQ ID NO: 8480494 - DNA, 22 bp, Homo sapiens
attctggacaaggcaagctcct

SEQ ID NO: 8480495 - DNA, 22 bp, Homo sapiens
attctggattatcagtccacca

SEQ ID NO: 8480496 - DNA, 22 bp, Homo sapiens
attctggatattacttatctat

SEQ ID NO: 8480497 - DNA, 22 bp, Homo sapiens
attctgggaggtagaactgaaa

SEQ ID NO: 8480498 - DNA, 22 bp, Homo sapiens
attctgggagtgtaggatggtt

SEQ ID NO: 8480499 - DNA, 22 bp, Homo sapiens
attctgggactccttcctcccc

SEQ ID NO: 8480500 - DNA, 22 bp, Homo sapiens
attctggattatcagtccacca

SEQ ID NO: 8480501 - DNA, 22 bp, Homo sapiens
attctgtcagatcttactggat

SEQ ID NO: 8480502 - DNA, 21 bp, Homo sapiens
agagggagagtggcccttcca

SEQ ID NO: 8480503 - DNA, 21 bp, Homo sapiens
agagggagagtggcccttcca

SEQ ID NO: 8480504 - DNA, 22 bp, Homo sapiens
attctgggtttgctgtacaaag

SEQ ID NO: 8480505 - DNA, 22 bp, Homo sapiens
attctgggtttttgtcttctgt

SEQ ID NO: 8480506 - DNA, 22 bp, Homo sapiens
attctgtaattgaactgtgttg

SEQ ID NO: 8480507 - DNA, 22 bp, Homo sapiens
attctgggcaagccttcttata

SEQ ID NO: 8480508 - DNA, 22 bp, Homo sapiens
attctgggccccatcccagacc

SEQ ID NO: 8480509 - DNA, 22 bp, Homo sapiens
attctgggtctgggtgtgatca

SEQ ID NO: 8480510 - DNA, 22 bp, Homo sapiens
attctggggctggttattttga

SEQ ID NO: 8480511 - DNA, 22 bp, Homo sapiens
attctgggaactttgtctctca

SEQ ID NO: 8480512 - DNA, 22 bp, Homo sapiens
attctgggcgcctatggctgca

SEQ ID NO: 8480513 - DNA, 22 bp, Homo sapiens
attctgggtgactacgtgatca

SEQ ID NO: 8480514 - DNA, 22 bp, Homo sapiens
attctgggttcatgagtgagct

SEQ ID NO: 8480515 - DNA, 22 bp, Homo sapiens
attcacagtttcctcatattct

SEQ ID NO: 8480516 - DNA, 22 bp, Homo sapiens
attcacagtttcctcatattct

SEQ ID NO: 8480517 - DNA, 22 bp, Homo sapiens
attcacagttcattagctgtaa

SEQ ID NO: 8480518 - DNA, 22 bp, Homo sapiens
attcacagttcattagctgtaa

SEQ ID NO: 8480519 - DNA, 22 bp, Homo sapiens
attcacagttcattagctgtaa

SEQ ID NO: 8480520 - DNA, 22 bp, Homo sapiens
attcacagttactgctgaacca

SEQ ID NO: 8480521 - DNA, 22 bp, Homo sapiens
attcacagttactgctgaacca

SEQ ID NO: 8480522 - DNA, 22 bp, Homo sapiens
attcacagggacaatgggagag

SEQ ID NO: 8480523 - DNA, 22 bp, Homo sapiens
attcacagggacaatgggagag

SEQ ID NO: 8480524 - DNA, 22 bp, Homo sapiens
attcacagggacaatgggagag

SEQ ID NO: 8480525 - DNA, 20 bp, Homo sapiens
attcacaggcacaaaaccct

SEQ ID NO: 8480526 - DNA, 22 bp, Homo sapiens
attcacagggctttccgcatgg

SEQ ID NO: 8480527 - DNA, 21 bp, Homo sapiens
attcacaggtatcctctccct

SEQ ID NO: 8480528 - DNA, 22 bp, Homo sapiens
attcacagtatggacgaaatga

SEQ ID NO: 8480529 - DNA, 22 bp, Homo sapiens
attcacagggggagaagggtat

SEQ ID NO: 8480530 - DNA, 22 bp, Homo sapiens
attcacagggggagaagggtat

SEQ ID NO: 8480531 - DNA, 22 bp, Homo sapiens
attcagcatgcaattaggtaat

SEQ ID NO: 8480532 - DNA, 22 bp, Homo sapiens
attcagcattcattatgcgcca

SEQ ID NO: 8480533 - DNA, 19 bp, Homo sapiens
attcagcattctgcacttc

SEQ ID NO: 8480534 - DNA, 19 bp, Homo sapiens
attcagcattctgcacttc

SEQ ID NO: 8480535 - DNA, 22 bp, Homo sapiens
attcagcagttcctgcttcagt

SEQ ID NO: 8480536 - DNA, 22 bp, Homo sapiens
attcagcataatcagtagcttg

SEQ ID NO: 8480537 - DNA, 22 bp, Homo sapiens
attcagcagttcctgcttcagt

SEQ ID NO: 8480538 - DNA, 22 bp, Homo sapiens
attcagcataatcagtagcttg

SEQ ID NO: 8480539 - DNA, 22 bp, Homo sapiens
attcagcagttcctgcttcagt

SEQ ID NO: 8480540 - DNA, 22 bp, Homo sapiens
attcagcagccatggcttctga

SEQ ID NO: 8480541 - DNA, 22 bp, Homo sapiens
attcagcagccatggcttctga

SEQ ID NO: 8480542 - DNA, 22 bp, Homo sapiens
attcagcacatctttgtacagc

SEQ ID NO: 8480543 - DNA, 22 bp, Homo sapiens
attcagattggtttaagctagt

SEQ ID NO: 8480544 - DNA, 22 bp, Homo sapiens
attcagattggtttaagctagt

SEQ ID NO: 8480545 - DNA, 22 bp, Homo sapiens
attcagcaaacatttattgtgt

SEQ ID NO: 8480546 - DNA, 22 bp, Homo sapiens
attcagcaaacatttattatct

SEQ ID NO: 8480547 - DNA, 22 bp, Homo sapiens
attcagcaatgagcttggattt

SEQ ID NO: 8480548 - DNA, 22 bp, Homo sapiens
attcagcacaatttggccaata

SEQ ID NO: 8480549 - DNA, 22 bp, Homo sapiens
attcagcacatctttgtacagc

SEQ ID NO: 8480550 - DNA, 22 bp, Homo sapiens
attcacacacatttagagcaga

SEQ ID NO: 8480551 - DNA, 22 bp, Homo sapiens
attcacagaatagttttaccag

SEQ ID NO: 8480552 - DNA, 22 bp, Homo sapiens
attcacagagtggttagtggta

SEQ ID NO: 8480553 - DNA, 22 bp, Homo sapiens
attcacaattagaagtagataa

SEQ ID NO: 8480554 - DNA, 22 bp, Homo sapiens
attatagagggttacagttaat

SEQ ID NO: 8480555 - DNA, 22 bp, Homo sapiens
attatagagggttacagttaat

SEQ ID NO: 8480556 - DNA, 22 bp, Homo sapiens
attcaaagcccagtaaacattg

SEQ ID NO: 8480557 - DNA, 22 bp, Homo sapiens
attataaagaacatgtgtgtgg

SEQ ID NO: 8480558 - DNA, 22 bp, Homo sapiens
attataaagaacatgtgtgtgg

SEQ ID NO: 8480559 - DNA, 22 bp, Homo sapiens
attataaagaacatgtgtgtgg

SEQ ID NO: 8480560 - DNA, 22 bp, Homo sapiens
attataaacctttgagggtggg

SEQ ID NO: 8480561 - DNA, 22 bp, Homo sapiens
attataaagaacatgtgtgtgg

SEQ ID NO: 8480562 - DNA, 22 bp, Homo sapiens
attataaagaacatgtgtgtgg

SEQ ID NO: 8480563 - DNA, 22 bp, Homo sapiens
attataaacctttgagggtggg

SEQ ID NO: 8480564 - DNA, 22 bp, Homo sapiens
attataaatattttctaggggt

SEQ ID NO: 8480565 - DNA, 22 bp, Homo sapiens
attataaagaacatgtgtgtgg

SEQ ID NO: 8480566 - DNA, 22 bp, Homo sapiens
attataaatattttctaggggt

SEQ ID NO: 8480567 - DNA, 22 bp, Homo sapiens
attataaatattttctaggggt

SEQ ID NO: 8480568 - DNA, 22 bp, Homo sapiens
attatacaaggctggtgcctaa

SEQ ID NO: 8480569 - DNA, 22 bp, Homo sapiens
attatacattttgtgtagagat

SEQ ID NO: 8480570 - DNA, 22 bp, Homo sapiens
atggcagagggattgaacagct

SEQ ID NO: 8480571 - DNA, 22 bp, Homo sapiens
atggcagatggctggagcaggt

SEQ ID NO: 8480572 - DNA, 22 bp, Homo sapiens
atggcagcaaatgtctggctgg

SEQ ID NO: 8480573 - DNA, 22 bp, Homo sapiens
atggcagatggctggagcaggt

SEQ ID NO: 8480574 - DNA, 22 bp, Homo sapiens
atggcagatggctggagcaggt

SEQ ID NO: 8480575 - DNA, 22 bp, Homo sapiens
atggcagatggctggagcaggt

SEQ ID NO: 8480576 - DNA, 22 bp, Homo sapiens
atggcagatggctggagcaggt

SEQ ID NO: 8480577 - DNA, 22 bp, Homo sapiens
atggataacccagttcatttct

SEQ ID NO: 8480578 - DNA, 22 bp, Homo sapiens
atggagtttggggtcaaatact

SEQ ID NO: 8480579 - DNA, 22 bp, Homo sapiens
atggagttctgccagcgctgct

SEQ ID NO: 8480580 - DNA, 22 bp, Homo sapiens
atggataagaacaaatatctga

SEQ ID NO: 8480581 - DNA, 22 bp, Homo sapiens
atggataatggtgatagttgca

SEQ ID NO: 8480582 - DNA, 22 bp, Homo sapiens
atggataagtcaaagagtatcc

SEQ ID NO: 8480583 - DNA, 22 bp, Homo sapiens
atggataagaacaaatatctga

SEQ ID NO: 8480584 - DNA, 22 bp, Homo sapiens
atggagtggggactgcagtgga

SEQ ID NO: 8480585 - DNA, 20 bp, Homo sapiens
atggagtgaagagtgaaagc

SEQ ID NO: 8480586 - DNA, 22 bp, Homo sapiens
atggagtaatattaacatgtta

SEQ ID NO: 8480587 - DNA, 20 bp, Homo sapiens
atggaggtggatgtgactgc

SEQ ID NO: 8480588 - DNA, 22 bp, Homo sapiens
atggaggtggaagaatgagtta

SEQ ID NO: 8480589 - DNA, 22 bp, Homo sapiens
atggaggtgccaggtgtgaggg

SEQ ID NO: 8480590 - DNA, 22 bp, Homo sapiens
atggctggtctcccatggaaaa

SEQ ID NO: 8480591 - DNA, 21 bp, Homo sapiens
atggctggtggctcagcctcc

SEQ ID NO: 8480592 - DNA, 22 bp, Homo sapiens
atggctggtgatactggagtga

SEQ ID NO: 8480593 - DNA, 22 bp, Homo sapiens
atggctgggtcaccatcagggt

SEQ ID NO: 8480594 - DNA, 22 bp, Homo sapiens
atggctgggatttcctttgcgt

SEQ ID NO: 8480595 - DNA, 22 bp, Homo sapiens
atggctgggcttttagtcagat

SEQ ID NO: 8480596 - DNA, 22 bp, Homo sapiens
atggctgggtcaccatcagggt

SEQ ID NO: 8480597 - DNA, 18 bp, Homo sapiens
atggctcaggaatggctt

SEQ ID NO: 8480598 - DNA, 22 bp, Homo sapiens
atggctcagcgcctttctgtgg

SEQ ID NO: 8480599 - DNA, 22 bp, Homo sapiens
agactcatgacacttcctatga

SEQ ID NO: 8480600 - DNA, 16 bp, Homo sapiens
agactcagtgcacttt

SEQ ID NO: 8480601 - DNA, 22 bp, Homo sapiens
agactattacctaaaagataca

SEQ ID NO: 8480602 - DNA, 22 bp, Homo sapiens
agactattacctaaaagataca

SEQ ID NO: 8480603 - DNA, 22 bp, Homo sapiens
agactacatatgccacatgaag

SEQ ID NO: 8480604 - DNA, 22 bp, Homo sapiens
agactacatatgccacatgaag

SEQ ID NO: 8480605 - DNA, 22 bp, Homo sapiens
agactctgagacatgaaccatc

SEQ ID NO: 8480606 - DNA, 22 bp, Homo sapiens
agacggattacctgaggtcagg

SEQ ID NO: 8480607 - DNA, 22 bp, Homo sapiens
agactaagcggttcttttcaat

SEQ ID NO: 8480608 - DNA, 22 bp, Homo sapiens
agactaaatagttacaggtagg

SEQ ID NO: 8480609 - DNA, 22 bp, Homo sapiens
agactaaaagaaggaagctacc

SEQ ID NO: 8480610 - DNA, 22 bp, Homo sapiens
atggaaatccaagtcaccgtag

SEQ ID NO: 8480611 - DNA, 22 bp, Homo sapiens
atggaaatcaggttcatccaag

SEQ ID NO: 8480612 - DNA, 22 bp, Homo sapiens
atggaaatcaggttcatccaag

SEQ ID NO: 8480613 - DNA, 22 bp, Homo sapiens
atggaaatatctttagagctta

SEQ ID NO: 8480614 - DNA, 22 bp, Homo sapiens
atgcagggattaaatgactgcc

SEQ ID NO: 8480615 - DNA, 22 bp, Homo sapiens
atgcaggggccgcctggccagg

SEQ ID NO: 8480616 - DNA, 22 bp, Homo sapiens
atgcaggggcagcagagcctgg

SEQ ID NO: 8480617 - DNA, 22 bp, Homo sapiens
atgcttggatgctgccatggga

SEQ ID NO: 8480618 - DNA, 22 bp, Homo sapiens
atgcttggcagagttctttttc

SEQ ID NO: 8480619 - DNA, 23 bp, Homo sapiens
atgcagggttacagggctgactt

SEQ ID NO: 8480620 - DNA, 22 bp, Homo sapiens
atgcagggtctccgtgtgacga

SEQ ID NO: 8480621 - DNA, 22 bp, Homo sapiens
atgcagggtctccgtgtgacga

SEQ ID NO: 8480622 - DNA, 23 bp, Homo sapiens
atggaaatagcatgtgtcattta

SEQ ID NO: 8480623 - DNA, 19 bp, Homo sapiens
atggaaaatgccagactga

SEQ ID NO: 8480624 - DNA, 22 bp, Homo sapiens
atggaaaagggtctttcatttc

SEQ ID NO: 8480625 - DNA, 22 bp, Homo sapiens
atggaaaagggtctttcatttc

SEQ ID NO: 8480626 - DNA, 19 bp, Homo sapiens
atggaaaatgccagactga

SEQ ID NO: 8480627 - DNA, 19 bp, Homo sapiens
atggaaaatgccagactga

SEQ ID NO: 8480628 - DNA, 19 bp, Homo sapiens
atggaaaattgtactcaat

SEQ ID NO: 8480629 - DNA, 19 bp, Homo sapiens
atggaaaattgtactcaat

SEQ ID NO: 8480630 - DNA, 22 bp, Homo sapiens
atgggaggcagcagagcccagc

SEQ ID NO: 8480631 - DNA, 22 bp, Homo sapiens
atgggaggcagcagagcccagc

SEQ ID NO: 8480632 - DNA, 22 bp, Homo sapiens
atgggaggcagacactaagttc

SEQ ID NO: 8480633 - DNA, 22 bp, Homo sapiens
atgggaggcagcagagcccagc

SEQ ID NO: 8480634 - DNA, 22 bp, Homo sapiens
atgggaggcagacactaagttc

SEQ ID NO: 8480635 - DNA, 22 bp, Homo sapiens
atgggaggcagacactaagttc

SEQ ID NO: 8480636 - DNA, 22 bp, Homo sapiens
atgggaggcagacactaagttc

SEQ ID NO: 8480637 - DNA, 22 bp, Homo sapiens
atgggaggcagacactaagttc

SEQ ID NO: 8480638 - DNA, 22 bp, Homo sapiens
atgggaggcagcagagcccagc

SEQ ID NO: 8480639 - DNA, 22 bp, Homo sapiens
atgggaggcaggctcagaaccg

SEQ ID NO: 8480640 - DNA, 22 bp, Homo sapiens
atgggtggagggtgacacggat

SEQ ID NO: 8480641 - DNA, 22 bp, Homo sapiens
atgggaggcaggctcagaaccg

SEQ ID NO: 8480642 - DNA, 22 bp, Homo sapiens
atgggaggcaggctcagaaccg

SEQ ID NO: 8480643 - DNA, 22 bp, Homo sapiens
atgggaggcaggctcagaaccg

SEQ ID NO: 8480644 - DNA, 22 bp, Homo sapiens
atgggaggcaaagatcgcagaa

SEQ ID NO: 8480645 - DNA, 22 bp, Homo sapiens
atgggaggcaaagatcgcagaa

SEQ ID NO: 8480646 - DNA, 22 bp, Homo sapiens
atgggaggcagacactaagttc

SEQ ID NO: 8480647 - DNA, 22 bp, Homo sapiens
atgggaggcaaagatcgcagaa

SEQ ID NO: 8480648 - DNA, 22 bp, Homo sapiens
atgggaggcaaagatcgcagaa

SEQ ID NO: 8480649 - DNA, 22 bp, Homo sapiens
atgggaggatgctcgggtgctc

SEQ ID NO: 8480650 - DNA, 22 bp, Homo sapiens
atgggaggatgctcgggtgctc

SEQ ID NO: 8480651 - DNA, 22 bp, Homo sapiens
atgggaggatgctcgggtgctc

SEQ ID NO: 8480652 - DNA, 22 bp, Homo sapiens
atgggaggatgctcgggtgctc

SEQ ID NO: 8480653 - DNA, 22 bp, Homo sapiens
atggctgtaaattcagagatgg

SEQ ID NO: 8480654 - DNA, 22 bp, Homo sapiens
atggctgtagtcatctgaaggc

SEQ ID NO: 8480655 - DNA, 22 bp, Homo sapiens
atggctgtcacgccactgtgag

SEQ ID NO: 8480656 - DNA, 22 bp, Homo sapiens
atggctgtcacgccactgtgag

SEQ ID NO: 8480657 - DNA, 22 bp, Homo sapiens
atggctgtccagtttctagaga

SEQ ID NO: 8480658 - DNA, 22 bp, Homo sapiens
atggctgtggtatcagacgcag

SEQ ID NO: 8480659 - DNA, 22 bp, Homo sapiens
atggctgtgcagagattgggaa

SEQ ID NO: 8480660 - DNA, 22 bp, Homo sapiens
atggctgtgttagatgctaagt

SEQ ID NO: 8480661 - DNA, 22 bp, Homo sapiens
atggctgtgtgactgagttcta

SEQ ID NO: 8480662 - DNA, 22 bp, Homo sapiens
atggctgtgtgcttctccccat

SEQ ID NO: 8480663 - DNA, 22 bp, Homo sapiens
atggctgtgaaggtcacaccct

SEQ ID NO: 8480664 - DNA, 22 bp, Homo sapiens
atggctgtgagacaaagagctg

SEQ ID NO: 8480665 - DNA, 22 bp, Homo sapiens
atggctgtgaaatggtaggtgg

SEQ ID NO: 8480666 - DNA, 22 bp, Homo sapiens
atggctgtgagcaggcagcttc

SEQ ID NO: 8480667 - DNA, 22 bp, Homo sapiens
atgggaggatcacttgaggcca

SEQ ID NO: 8480668 - DNA, 22 bp, Homo sapiens
atgggaggatcacttgaggcca

SEQ ID NO: 8480669 - DNA, 22 bp, Homo sapiens
atgggaggaaggaggcccttga

SEQ ID NO: 8480670 - DNA, 22 bp, Homo sapiens
atgggaggaaggaggcccttga

SEQ ID NO: 8480671 - DNA, 22 bp, Homo sapiens
atgggaggatcacttgaggcca

SEQ ID NO: 8480672 - DNA, 22 bp, Homo sapiens
atgggaggaaggaggcccttga

SEQ ID NO: 8480673 - DNA, 22 bp, Homo sapiens
atgggaggaagagaagatgtct

SEQ ID NO: 8480674 - DNA, 22 bp, Homo sapiens
atgggaggaaggaggcccttga

SEQ ID NO: 8480675 - DNA, 22 bp, Homo sapiens
atgggaggaaggaggcccttga

SEQ ID NO: 8480676 - DNA, 22 bp, Homo sapiens
atgggaggaagagaagatgtct

SEQ ID NO: 8480677 - DNA, 22 bp, Homo sapiens
atggctgtgttgttcctctgaa

SEQ ID NO: 8480678 - DNA, 19 bp, Homo sapiens
atggctgtgttccagtaaa

SEQ ID NO: 8480679 - DNA, 22 bp, Homo sapiens
atgtaaactttaccagctctga

SEQ ID NO: 8480680 - DNA, 22 bp, Homo sapiens
atgtacacacacatctttgcgt

SEQ ID NO: 8480681 - DNA, 22 bp, Homo sapiens
atgtacacatgcatgcatgtgc

SEQ ID NO: 8480682 - DNA, 22 bp, Homo sapiens
atgtacacatgcatgcatgtgc

SEQ ID NO: 8480683 - DNA, 22 bp, Homo sapiens
atgtacaccaggtgaagatgaa

SEQ ID NO: 8480684 - DNA, 20 bp, Homo sapiens
atgtaaaattataaggctga

SEQ ID NO: 8480685 - DNA, 20 bp, Homo sapiens
atgtaaaattataaggctga

SEQ ID NO: 8480686 - DNA, 22 bp, Homo sapiens
atgtaaactactgactacacta

SEQ ID NO: 8480687 - DNA, 20 bp, Homo sapiens
atgtaaaagacagggagtag

SEQ ID NO: 8480688 - DNA, 20 bp, Homo sapiens
atgtaaaagacagggagtag

SEQ ID NO: 8480689 - DNA, 22 bp, Homo sapiens
atggttttatttctctatagct

SEQ ID NO: 8480690 - DNA, 22 bp, Homo sapiens
atggtttatcctttaccagtcg

SEQ ID NO: 8480691 - DNA, 23 bp, Homo sapiens
atggtttatgttgttgtgaagca

SEQ ID NO: 8480692 - DNA, 22 bp, Homo sapiens
atggtttattagctgcacaggc

SEQ ID NO: 8480693 - DNA, 23 bp, Homo sapiens
atggtttatgtcacacttttgat

SEQ ID NO: 8480694 - DNA, 22 bp, Homo sapiens
atggtttattagctgcacaggc

SEQ ID NO: 8480695 - DNA, 22 bp, Homo sapiens
atggtttcacaaacaaaaggtt

SEQ ID NO: 8480696 - DNA, 22 bp, Homo sapiens
atgggtgtgaaaatggtcatct

SEQ ID NO: 8480697 - DNA, 22 bp, Homo sapiens
atgggtggccccgtgtgcagtc

SEQ ID NO: 8480698 - DNA, 22 bp, Homo sapiens
atgggtggagggtgacacggat

SEQ ID NO: 8480699 - DNA, 22 bp, Homo sapiens
atgggtggagggtgacacggat

SEQ ID NO: 8480700 - DNA, 22 bp, Homo sapiens
atgtacagtttctagactcaaa

SEQ ID NO: 8480701 - DNA, 22 bp, Homo sapiens
atgtacagtttctagactcaaa

SEQ ID NO: 8480702 - DNA, 22 bp, Homo sapiens
atgtacagtggaaactaacaaa

SEQ ID NO: 8480703 - DNA, 22 bp, Homo sapiens
atgtacaggtcttggcaaaggg

SEQ ID NO: 8480704 - DNA, 22 bp, Homo sapiens
atgtacagccacttcacagtta

SEQ ID NO: 8480705 - DNA, 22 bp, Homo sapiens
atgtacactttggaagagtcac

SEQ ID NO: 8480706 - DNA, 22 bp, Homo sapiens
atgtccagagaacatttgcttt

SEQ ID NO: 8480707 - DNA, 22 bp, Homo sapiens
atgtcaaatcagttttatcaga

SEQ ID NO: 8480708 - DNA, 22 bp, Homo sapiens
atgtccagaggtgagtcagagc

SEQ ID NO: 8480709 - DNA, 22 bp, Homo sapiens
atgtccagagtaaagcacattc

SEQ ID NO: 8480710 - DNA, 22 bp, Homo sapiens
atgtccagctcatgatactatc

SEQ ID NO: 8480711 - DNA, 21 bp, Homo sapiens
atgtctgttctttctggcagg

SEQ ID NO: 8480712 - DNA, 21 bp, Homo sapiens
atgtctgttctgattggtgcg

SEQ ID NO: 8480713 - DNA, 22 bp, Homo sapiens
atgtctgtttatccttcaagat

SEQ ID NO: 8480714 - DNA, 19 bp, Homo sapiens
atgtctgttgaatttcata

SEQ ID NO: 8480715 - DNA, 22 bp, Homo sapiens
atgtcttcatagcttatatcca

SEQ ID NO: 8480716 - DNA, 22 bp, Homo sapiens
atgtctgtttgctgagcccggc

SEQ ID NO: 8480717 - DNA, 22 bp, Homo sapiens
atgtctgttttcatatcagata

SEQ ID NO: 8480718 - DNA, 18 bp, Homo sapiens
atgtctgtgcactggata

SEQ ID NO: 8480719 - DNA, 22 bp, Homo sapiens
atgtctgtctatagccatgaga

SEQ ID NO: 8480720 - DNA, 22 bp, Homo sapiens
atgtctgtctttgtactccaca

SEQ ID NO: 8480721 - DNA, 22 bp, Homo sapiens
atgtctgtggcaattgttgatg

SEQ ID NO: 8480722 - DNA, 22 bp, Homo sapiens
atgtctgtgttatctgtagaat

SEQ ID NO: 8480723 - DNA, 22 bp, Homo sapiens
atgtctgttaatcgaccctaat

SEQ ID NO: 8480724 - DNA, 22 bp, Homo sapiens
atgtctgttcattattaactgc

SEQ ID NO: 8480725 - DNA, 22 bp, Homo sapiens
atgtctgtggcattatatgttt

SEQ ID NO: 8480726 - DNA, 22 bp, Homo sapiens
atgtctgtggcattatatgttt

SEQ ID NO: 8480727 - DNA, 22 bp, Homo sapiens
atgtctgtgtgatcttggataa

SEQ ID NO: 8480728 - DNA, 22 bp, Homo sapiens
atgtctgtatgtggagaggggt

SEQ ID NO: 8480729 - DNA, 22 bp, Homo sapiens
atgtctgtcatcttccaggaag

SEQ ID NO: 8480730 - DNA, 22 bp, Homo sapiens
atgtctgtcccctagccctgat

SEQ ID NO: 8480731 - DNA, 22 bp, Homo sapiens
atgtctgtccaaccctgcaggg

SEQ ID NO: 8480732 - DNA, 22 bp, Homo sapiens
atgtcccaagatacagctagag

SEQ ID NO: 8480733 - DNA, 22 bp, Homo sapiens
atgtcccaagatacagctagag

SEQ ID NO: 8480734 - DNA, 19 bp, Homo sapiens
atgtcccaccgcccctgag

SEQ ID NO: 8480735 - DNA, 22 bp, Homo sapiens
atgtcccagacactttatctta

SEQ ID NO: 8480736 - DNA, 22 bp, Homo sapiens
atgtcccagctgagagacaact

SEQ ID NO: 8480737 - DNA, 22 bp, Homo sapiens
atgtctgtacgagttacaatgg

SEQ ID NO: 8480738 - DNA, 23 bp, Homo sapiens
atgtccagtttacttcaggatga

SEQ ID NO: 8480739 - DNA, 22 bp, Homo sapiens
atgtccagtacttctaaatggt

SEQ ID NO: 8480740 - DNA, 21 bp, Homo sapiens
agaattcttaagtattctaat

SEQ ID NO: 8480741 - DNA, 22 bp, Homo sapiens
agaattctgttcttcgggtgtg

SEQ ID NO: 8480742 - DNA, 22 bp, Homo sapiens
agaattctggagttgggaggaa

SEQ ID NO: 8480743 - DNA, 22 bp, Homo sapiens
agacaatacatttattcccttt

SEQ ID NO: 8480744 - DNA, 20 bp, Homo sapiens
agaattcttaccctttgatg

SEQ ID NO: 8480745 - DNA, 22 bp, Homo sapiens
agaattctgacaatagaattgg

SEQ ID NO: 8480746 - DNA, 22 bp, Homo sapiens
agaattctcttccattgaaaca

SEQ ID NO: 8480747 - DNA, 22 bp, Homo sapiens
agaattctccttcagggcagga

SEQ ID NO: 8480748 - DNA, 22 bp, Homo sapiens
agaattacagcttttagaatag

SEQ ID NO: 8480749 - DNA, 22 bp, Homo sapiens
agaattacataaatacatgaat

SEQ ID NO: 8480750 - DNA, 21 bp, Homo sapiens
agaattaaattggatttgtgt

SEQ ID NO: 8480751 - DNA, 22 bp, Homo sapiens
agaattagtcacaattatagga

SEQ ID NO: 8480752 - DNA, 22 bp, Homo sapiens
agaattagtcacaattatagga

SEQ ID NO: 8480753 - DNA, 18 bp, Homo sapiens
agaattattcttgtcctc

SEQ ID NO: 8480754 - DNA, 22 bp, Homo sapiens
agaattcagaatgcatttctaa

SEQ ID NO: 8480755 - DNA, 22 bp, Homo sapiens
agacacagaagttgctgttggg

SEQ ID NO: 8480756 - DNA, 22 bp, Homo sapiens
agacacagaagttgctgttggg

SEQ ID NO: 8480757 - DNA, 22 bp, Homo sapiens
agacacagaagttgctgttggg

SEQ ID NO: 8480758 - DNA, 22 bp, Homo sapiens
agacacagaagttgctgttggg

SEQ ID NO: 8480759 - DNA, 22 bp, Homo sapiens
agacacagcaataactactgtt

SEQ ID NO: 8480760 - DNA, 22 bp, Homo sapiens
agacacagattttggaaaagat

SEQ ID NO: 8480761 - DNA, 19 bp, Homo sapiens
agacacacttgatatgtgt

SEQ ID NO: 8480762 - DNA, 22 bp, Homo sapiens
agacacagaacacaaaagcata

SEQ ID NO: 8480763 - DNA, 22 bp, Homo sapiens
agacaatatataattttagttg

SEQ ID NO: 8480764 - DNA, 22 bp, Homo sapiens
agacaatttttggttttgcaag

SEQ ID NO: 8480765 - DNA, 22 bp, Homo sapiens
agaatgcttcctttgaaactga

SEQ ID NO: 8480766 - DNA, 22 bp, Homo sapiens
agaatgtagtcttggagattta

SEQ ID NO: 8480767 - DNA, 22 bp, Homo sapiens
agaatgggggctacaggccaca

SEQ ID NO: 8480768 - DNA, 22 bp, Homo sapiens
agaatgcattttgtgtagctat

SEQ ID NO: 8480769 - DNA, 22 bp, Homo sapiens
agaatgcattttgtgtagctat

SEQ ID NO: 8480770 - DNA, 22 bp, Homo sapiens
agaatgtgttattagagaagga

SEQ ID NO: 8480771 - DNA, 22 bp, Homo sapiens
agaatgtgttattagagaagga

SEQ ID NO: 8480772 - DNA, 22 bp, Homo sapiens
agaatgtgttttaacatgggaa

SEQ ID NO: 8480773 - DNA, 22 bp, Homo sapiens
agaatgtcaacagcctctcaag

SEQ ID NO: 8480774 - DNA, 22 bp, Homo sapiens
agaatgtctaagtgttcagccc

SEQ ID NO: 8480775 - DNA, 22 bp, Homo sapiens
agaatgtgaagattttgaatta

SEQ ID NO: 8480776 - DNA, 22 bp, Homo sapiens
agaatgtgggggaaaagagtgt

SEQ ID NO: 8480777 - DNA, 22 bp, Homo sapiens
agaatgtgtgattgaagctctt

SEQ ID NO: 8480778 - DNA, 22 bp, Homo sapiens
agaatcaggaagacagcctggc

SEQ ID NO: 8480779 - DNA, 22 bp, Homo sapiens
agaatgaattaatcaactggaa

SEQ ID NO: 8480780 - DNA, 22 bp, Homo sapiens
agaatgataatgccatgatgga

SEQ ID NO: 8480781 - DNA, 22 bp, Homo sapiens
agaatgatagctagtatttact

SEQ ID NO: 8480782 - DNA, 22 bp, Homo sapiens
agaatgcagtttgaaataaggt

SEQ ID NO: 8480783 - DNA, 22 bp, Homo sapiens
agaatgcagcttgccagtatct

SEQ ID NO: 8480784 - DNA, 22 bp, Homo sapiens
agaatgcatctaaaagcagaga

SEQ ID NO: 8480785 - DNA, 22 bp, Homo sapiens
agaatgcagtttgaaataaggt

SEQ ID NO: 8480786 - DNA, 22 bp, Homo sapiens
agaatgcatctaaaagcagaga

SEQ ID NO: 8480787 - DNA, 22 bp, Homo sapiens
agaatgcaagataaactttatt

SEQ ID NO: 8480788 - DNA, 17 bp, Homo sapiens
agaatgcaaagcaggct

SEQ ID NO: 8480789 - DNA, 22 bp, Homo sapiens
agacagtatgatatatgaatac

SEQ ID NO: 8480790 - DNA, 22 bp, Homo sapiens
agacagtgaggcagagcttccg

SEQ ID NO: 8480791 - DNA, 22 bp, Homo sapiens
agacagtgagaatgagttgaaa

SEQ ID NO: 8480792 - DNA, 22 bp, Homo sapiens
agacagtgaggcagagcttccg

SEQ ID NO: 8480793 - DNA, 22 bp, Homo sapiens
agacagtgaggcagagcttccg

SEQ ID NO: 8480794 - DNA, 17 bp, Homo sapiens
agacagtgagtgccttg

SEQ ID NO: 8480795 - DNA, 22 bp, Homo sapiens
agacagtgatggacaggcagac

SEQ ID NO: 8480796 - DNA, 22 bp, Homo sapiens
agacagtgatggacaggcagac

SEQ ID NO: 8480797 - DNA, 22 bp, Homo sapiens
agacagtgatgtaagcaggagt

SEQ ID NO: 8480798 - DNA, 22 bp, Homo sapiens
agacaggtgctcgcccaagtcc

SEQ ID NO: 8480799 - DNA, 21 bp, Homo sapiens
agacaggtcagggagaggtga

SEQ ID NO: 8480800 - DNA, 22 bp, Homo sapiens
agacaggtagcaggacagatat

SEQ ID NO: 8480801 - DNA, 22 bp, Homo sapiens
agacagtaataaaataggtaag

SEQ ID NO: 8480802 - DNA, 22 bp, Homo sapiens
agacagtatgatatatgaatac

SEQ ID NO: 8480803 - DNA, 22 bp, Homo sapiens
agacagtgcaagaagagcaggc

SEQ ID NO: 8480804 - DNA, 22 bp, Homo sapiens
agacagtgatgtaagcaggagt

SEQ ID NO: 8480805 - DNA, 22 bp, Homo sapiens
agacagtgatgtaagcaggagt

SEQ ID NO: 8480806 - DNA, 22 bp, Homo sapiens
agacagtgctatcccatctgtg

SEQ ID NO: 8480807 - DNA, 22 bp, Homo sapiens
atgcaggagttggaaaaaatga

SEQ ID NO: 8480808 - DNA, 22 bp, Homo sapiens
agacagtgcaagaagagcaggc

SEQ ID NO: 8480809 - DNA, 22 bp, Homo sapiens
agacagtgcaagaagagcaggc

SEQ ID NO: 8480810 - DNA, 22 bp, Homo sapiens
atgcagggacctttgctttggt

SEQ ID NO: 8480811 - DNA, 22 bp, Homo sapiens
atgcagggaggtaagaggtgcc

SEQ ID NO: 8480812 - DNA, 22 bp, Homo sapiens
agacacagtctgtctggaggag

SEQ ID NO: 8480813 - DNA, 22 bp, Homo sapiens
agacacagtctgtctggaggag

SEQ ID NO: 8480814 - DNA, 22 bp, Homo sapiens
agacacagtataagcacaacaa

SEQ ID NO: 8480815 - DNA, 22 bp, Homo sapiens
agacacagtataagcacaacaa

SEQ ID NO: 8480816 - DNA, 22 bp, Homo sapiens
agacacagctgcaggaggtggg

SEQ ID NO: 8480817 - DNA, 21 bp, Homo sapiens
agacacaggggttgctggggt

SEQ ID NO: 8480818 - DNA, 22 bp, Homo sapiens
agacacagctgcaggaggtggg

SEQ ID NO: 8480819 - DNA, 22 bp, Homo sapiens
agacacagtgttgaaggctagt

SEQ ID NO: 8480820 - DNA, 22 bp, Homo sapiens
agacacagtgctgggtgctgag

SEQ ID NO: 8480821 - DNA, 22 bp, Homo sapiens
agacacagtgctgggtgctgag

SEQ ID NO: 8480822 - DNA, 22 bp, Homo sapiens
agacacagtgctgggtgctgag

SEQ ID NO: 8480823 - DNA, 22 bp, Homo sapiens
agacacagtctgtctggaggag

SEQ ID NO: 8480824 - DNA, 23 bp, Homo sapiens
agacacataggagcagctattgg

SEQ ID NO: 8480825 - DNA, 22 bp, Homo sapiens
agacacataggaccacactgtg

SEQ ID NO: 8480826 - DNA, 22 bp, Homo sapiens
agacacagtttgggatgggttg

SEQ ID NO: 8480827 - DNA, 22 bp, Homo sapiens
agacacataggaccacactgtg

SEQ ID NO: 8480828 - DNA, 19 bp, Homo sapiens
agacacatcacatttctcc

SEQ ID NO: 8480829 - DNA, 22 bp, Homo sapiens
agacaggcagaggctgcagagg

SEQ ID NO: 8480830 - DNA, 22 bp, Homo sapiens
agaaggctgagactgggatgaa

SEQ ID NO: 8480831 - DNA, 22 bp, Homo sapiens
agaagtttggtccttttcaagg

SEQ ID NO: 8480832 - DNA, 22 bp, Homo sapiens
agaagtttggtccttttcaagg

SEQ ID NO: 8480833 - DNA, 19 bp, Homo sapiens
agaaggctcctgttggaga

SEQ ID NO: 8480834 - DNA, 22 bp, Homo sapiens
agaaggctgagactgggatgaa

SEQ ID NO: 8480835 - DNA, 22 bp, Homo sapiens
agaatacagtatgcaaaaagat

SEQ ID NO: 8480836 - DNA, 22 bp, Homo sapiens
agaatacaattgttcagtaata

SEQ ID NO: 8480837 - DNA, 22 bp, Homo sapiens
agaatacaattgttcagtaata

SEQ ID NO: 8480838 - DNA, 21 bp, Homo sapiens
agaataatggtatcatttgct

SEQ ID NO: 8480839 - DNA, 22 bp, Homo sapiens
agaagtttgttatgtaaacaaa

SEQ ID NO: 8480840 - DNA, 22 bp, Homo sapiens
agaaggccctgtgtggtctgag

SEQ ID NO: 8480841 - DNA, 22 bp, Homo sapiens
agaaggcctaacttgggggcaa

SEQ ID NO: 8480842 - DNA, 22 bp, Homo sapiens
agaaggcatcagaagtgtgtag

SEQ ID NO: 8480843 - DNA, 22 bp, Homo sapiens
agaaggcatcagaagtgtgtag

SEQ ID NO: 8480844 - DNA, 21 bp, Homo sapiens
atctttattacgcagagaaga

SEQ ID NO: 8480845 - DNA, 20 bp, Homo sapiens
atctttgtctctgtagttgt

SEQ ID NO: 8480846 - DNA, 22 bp, Homo sapiens
atctttgtcactctactgtcta

SEQ ID NO: 8480847 - DNA, 22 bp, Homo sapiens
atctttgtgctaatgtagttct

SEQ ID NO: 8480848 - DNA, 22 bp, Homo sapiens
atctttgtgaatctcaacttgg

SEQ ID NO: 8480849 - DNA, 22 bp, Homo sapiens
agaatagaattctcatagaatt

SEQ ID NO: 8480850 - DNA, 22 bp, Homo sapiens
agaatacatcaatctattttct

SEQ ID NO: 8480851 - DNA, 22 bp, Homo sapiens
agaatacatctagtgctgcatg

SEQ ID NO: 8480852 - DNA, 22 bp, Homo sapiens
agaagagaactgccaaacactt

SEQ ID NO: 8480853 - DNA, 22 bp, Homo sapiens
agaagagccctttaagggggaa

SEQ ID NO: 8480854 - DNA, 22 bp, Homo sapiens
agaagagccctttaagggggaa

SEQ ID NO: 8480855 - DNA, 22 bp, Homo sapiens
agaagatgactttggagttgga

SEQ ID NO: 8480856 - DNA, 22 bp, Homo sapiens
agaagatgttgcagttgatgcg

SEQ ID NO: 8480857 - DNA, 22 bp, Homo sapiens
agaagatgttgcagttgatgcg

SEQ ID NO: 8480858 - DNA, 22 bp, Homo sapiens
agaagatgtcactgcagacagc

SEQ ID NO: 8480859 - DNA, 22 bp, Homo sapiens
agaagagaaatagtgccactgt

SEQ ID NO: 8480860 - DNA, 22 bp, Homo sapiens
agaagagaactgccaaacactt

SEQ ID NO: 8480861 - DNA, 22 bp, Homo sapiens
agaagacagagtctacattcta

SEQ ID NO: 8480862 - DNA, 22 bp, Homo sapiens
agaagacagagtctacattcta

SEQ ID NO: 8480863 - DNA, 22 bp, Homo sapiens
agaagacagagtctacattcta

SEQ ID NO: 8480864 - DNA, 22 bp, Homo sapiens
agaagacagagtctacattcta

SEQ ID NO: 8480865 - DNA, 22 bp, Homo sapiens
agaagaatacttgatgttcatg

SEQ ID NO: 8480866 - DNA, 22 bp, Homo sapiens
agaagaatacttgatgttcatg

SEQ ID NO: 8480867 - DNA, 22 bp, Homo sapiens
agaagaatacttgatgttcatg

SEQ ID NO: 8480868 - DNA, 22 bp, Homo sapiens
agaagaatacttgatgttcatg

SEQ ID NO: 8480869 - DNA, 22 bp, Homo sapiens
agaagaatttctctcatgattt

SEQ ID NO: 8480870 - DNA, 22 bp, Homo sapiens
agaagaaatgtgaaggccactg

SEQ ID NO: 8480871 - DNA, 22 bp, Homo sapiens
agaagaaatgtgaaggccactg

SEQ ID NO: 8480872 - DNA, 22 bp, Homo sapiens
agaagaacttagctttctatct

SEQ ID NO: 8480873 - DNA, 22 bp, Homo sapiens
agaagcacaccagtagacaggg

SEQ ID NO: 8480874 - DNA, 22 bp, Homo sapiens
agaagatttaggttgacgctat

SEQ ID NO: 8480875 - DNA, 23 bp, Homo sapiens
agaagcaatgctttttttcctct

SEQ ID NO: 8480876 - DNA, 22 bp, Homo sapiens
atcttgtgctgacaaaacacat

SEQ ID NO: 8480877 - DNA, 22 bp, Homo sapiens
atcttgtgtgatgatgagaaag

SEQ ID NO: 8480878 - DNA, 22 bp, Homo sapiens
atcttggggactgtctcttgta

SEQ ID NO: 8480879 - DNA, 22 bp, Homo sapiens
atcttattgctgttgccagata

SEQ ID NO: 8480880 - DNA, 20 bp, Homo sapiens
atcttgggattgagattgcc

SEQ ID NO: 8480881 - DNA, 22 bp, Homo sapiens
atcttatgagacccataaagat

SEQ ID NO: 8480882 - DNA, 22 bp, Homo sapiens
atcttatgttgtattcaaaatc

SEQ ID NO: 8480883 - DNA, 22 bp, Homo sapiens
atctttagtagaggaatatatt

SEQ ID NO: 8480884 - DNA, 22 bp, Homo sapiens
atctttactttcagtgctgagc

SEQ ID NO: 8480885 - DNA, 22 bp, Homo sapiens
atctttagcattactttattca

SEQ ID NO: 8480886 - DNA, 22 bp, Homo sapiens
atcttgttataagagataatgg

SEQ ID NO: 8480887 - DNA, 22 bp, Homo sapiens
atcttgttataagagataatgg

SEQ ID NO: 8480888 - DNA, 22 bp, Homo sapiens
atctttacaagaaattctttta

SEQ ID NO: 8480889 - DNA, 22 bp, Homo sapiens
atctttacagtgtaagtgcaga

SEQ ID NO: 8480890 - DNA, 22 bp, Homo sapiens
atctttaccaccaaagaatgct

SEQ ID NO: 8480891 - DNA, 22 bp, Homo sapiens
atctttaccaccaaagaatgct

SEQ ID NO: 8480892 - DNA, 22 bp, Homo sapiens
atctttaaagacatgtgaactt

SEQ ID NO: 8480893 - DNA, 22 bp, Homo sapiens
atctttaatttggatcagggcc

SEQ ID NO: 8480894 - DNA, 19 bp, Homo sapiens
aggcagaggcttggctagc

SEQ ID NO: 8480895 - DNA, 19 bp, Homo sapiens
aggcagcacccagtccttg

SEQ ID NO: 8480896 - DNA, 19 bp, Homo sapiens
aggcagaggcttggctagc

SEQ ID NO: 8480897 - DNA, 19 bp, Homo sapiens
aggcagcacccagtccttg

SEQ ID NO: 8480898 - DNA, 19 bp, Homo sapiens
aggcagcacccagtccttg

SEQ ID NO: 8480899 - DNA, 21 bp, Homo sapiens
cattcctcggctcatagagga

SEQ ID NO: 8480900 - DNA, 22 bp, Homo sapiens
cattccttaacgtggggagtct

SEQ ID NO: 8480901 - DNA, 22 bp, Homo sapiens
cattccctgtctcttcaatcct

SEQ ID NO: 8480902 - DNA, 22 bp, Homo sapiens
cattcccttggggagttcatgc

SEQ ID NO: 8480903 - DNA, 22 bp, Homo sapiens
cattcctattatgtccctagtg

SEQ ID NO: 8480904 - DNA, 22 bp, Homo sapiens
cattccaagtatatacatgata

SEQ ID NO: 8480905 - DNA, 18 bp, Homo sapiens
cattccaagttctacctc

SEQ ID NO: 8480906 - DNA, 22 bp, Homo sapiens
cattccaagtatatacatgata

SEQ ID NO: 8480907 - DNA, 18 bp, Homo sapiens
cattccaagttctacctc

SEQ ID NO: 8480908 - DNA, 22 bp, Homo sapiens
cattccagatgaggccaggccc

SEQ ID NO: 8480909 - DNA, 22 bp, Homo sapiens
cattccagctctcatactctgg

SEQ ID NO: 8480910 - DNA, 22 bp, Homo sapiens
cattccagagctgcctctgcta

SEQ ID NO: 8480911 - DNA, 22 bp, Homo sapiens
cattcccacgtgttctttgctt

SEQ ID NO: 8480912 - DNA, 22 bp, Homo sapiens
cattcccacgtgttctttgctt

SEQ ID NO: 8480913 - DNA, 22 bp, Homo sapiens
cattcccatgactcctgctcag

SEQ ID NO: 8480914 - DNA, 22 bp, Homo sapiens
cattcaaagcaggaaaggcctt

SEQ ID NO: 8480915 - DNA, 22 bp, Homo sapiens
cattcaaagcaggaaaggcctt

SEQ ID NO: 8480916 - DNA, 22 bp, Homo sapiens
cattcaaaagctccatgtttgt

SEQ ID NO: 8480917 - DNA, 22 bp, Homo sapiens
cattcaaaatgggctgacctgt

SEQ ID NO: 8480918 - DNA, 22 bp, Homo sapiens
cattatctcttctatatgctag

SEQ ID NO: 8480919 - DNA, 22 bp, Homo sapiens
cattatctgagagtgtcctaca

SEQ ID NO: 8480920 - DNA, 22 bp, Homo sapiens
cattatctcttctatatgctag

SEQ ID NO: 8480921 - DNA, 22 bp, Homo sapiens
cattatctgccattgacaccat

SEQ ID NO: 8480922 - DNA, 22 bp, Homo sapiens
cattatctgagagtgtcctaca

SEQ ID NO: 8480923 - DNA, 22 bp, Homo sapiens
cattatgaagcatcatcttatt

SEQ ID NO: 8480924 - DNA, 22 bp, Homo sapiens
cattatgcaaagaacacttgag

SEQ ID NO: 8480925 - DNA, 22 bp, Homo sapiens
cattatggaagacagtgtggtg

SEQ ID NO: 8480926 - DNA, 22 bp, Homo sapiens
cattatggaagtgaagagctct

SEQ ID NO: 8480927 - DNA, 20 bp, Homo sapiens
cattatggttgggcacagtg

SEQ ID NO: 8480928 - DNA, 20 bp, Homo sapiens
cattatggttgggcacagtg

SEQ ID NO: 8480929 - DNA, 22 bp, Homo sapiens
cattatggcagccaggatattg

SEQ ID NO: 8480930 - DNA, 22 bp, Homo sapiens
cattatggcagccaggatattg

SEQ ID NO: 8480931 - DNA, 18 bp, Homo sapiens
cattatgtggttatagaa

SEQ ID NO: 8480932 - DNA, 22 bp, Homo sapiens
cattatgtgggaaaatgttctt

SEQ ID NO: 8480933 - DNA, 22 bp, Homo sapiens
cattattaattcagcacatgct

SEQ ID NO: 8480934 - DNA, 22 bp, Homo sapiens
cattattaattcagcacatgct

SEQ ID NO: 8480935 - DNA, 22 bp, Homo sapiens
cattatgttcagtagcttaaaa

SEQ ID NO: 8480936 - DNA, 22 bp, Homo sapiens
catggccctcttctggagcaat

SEQ ID NO: 8480937 - DNA, 22 bp, Homo sapiens
catggcctcaaaggactgcaga

SEQ ID NO: 8480938 - DNA, 22 bp, Homo sapiens
catggcctctctcctggaatgg

SEQ ID NO: 8480939 - DNA, 22 bp, Homo sapiens
catggcctgcctcctcctggtg

SEQ ID NO: 8480940 - DNA, 22 bp, Homo sapiens
catggcctgcctcctcctggtg

SEQ ID NO: 8480941 - DNA, 22 bp, Homo sapiens
catggcctgcctcctcctggtg

SEQ ID NO: 8480942 - DNA, 22 bp, Homo sapiens
catggccttgagtgactgcact

SEQ ID NO: 8480943 - DNA, 22 bp, Homo sapiens
cattaacactttggatttagac

SEQ ID NO: 8480944 - DNA, 22 bp, Homo sapiens
cattaagatttttttctactgg

SEQ ID NO: 8480945 - DNA, 19 bp, Homo sapiens
aggcagcattctggggctt

SEQ ID NO: 8480946 - DNA, 19 bp, Homo sapiens
aggcagcattctggggctt

SEQ ID NO: 8480947 - DNA, 22 bp, Homo sapiens
aggcagcatttctgcttatcca

SEQ ID NO: 8480948 - DNA, 22 bp, Homo sapiens
aggcagcatttctgcttatcca

SEQ ID NO: 8480949 - DNA, 22 bp, Homo sapiens
aggcagcatttctgcttatcca

SEQ ID NO: 8480950 - DNA, 19 bp, Homo sapiens
aggcagcattctggggctt

SEQ ID NO: 8480951 - DNA, 22 bp, Homo sapiens
aggcagcagtcatgaggaaaga

SEQ ID NO: 8480952 - DNA, 22 bp, Homo sapiens
catttacatttaaggttaatat

SEQ ID NO: 8480953 - DNA, 22 bp, Homo sapiens
catttacatttaaggttaatat

SEQ ID NO: 8480954 - DNA, 22 bp, Homo sapiens
catttacatttaaggttaatat

SEQ ID NO: 8480955 - DNA, 22 bp, Homo sapiens
aggcagcatttgaatccaggtc

SEQ ID NO: 8480956 - DNA, 22 bp, Homo sapiens
aggcagcatttgaatccaggtc

SEQ ID NO: 8480957 - DNA, 22 bp, Homo sapiens
aggcagcatttgaatccaggtc

SEQ ID NO: 8480958 - DNA, 22 bp, Homo sapiens
aggcagccaatcagaggctgac

SEQ ID NO: 8480959 - DNA, 22 bp, Homo sapiens
aggcagccaatcagaggctgac

SEQ ID NO: 8480960 - DNA, 22 bp, Homo sapiens
aggcagccacatgagctcctga

SEQ ID NO: 8480961 - DNA, 22 bp, Homo sapiens
aggcagccacatgagctcctga

SEQ ID NO: 8480962 - DNA, 22 bp, Homo sapiens
aggcagccaatcagaggctgac

SEQ ID NO: 8480963 - DNA, 22 bp, Homo sapiens
aggcagccagatggcagcctgc

SEQ ID NO: 8480964 - DNA, 22 bp, Homo sapiens
aggcagccagatggcagcctgc

SEQ ID NO: 8480965 - DNA, 22 bp, Homo sapiens
aggcagccagttcaggtttctt

SEQ ID NO: 8480966 - DNA, 18 bp, Homo sapiens
aggcagcagcatcttctc

SEQ ID NO: 8480967 - DNA, 22 bp, Homo sapiens
aggcagcagccacaaggcctga

SEQ ID NO: 8480968 - DNA, 22 bp, Homo sapiens
aggcagcagaggttgaggaaag

SEQ ID NO: 8480969 - DNA, 22 bp, Homo sapiens
aggcagcagaggttgaggaaag

SEQ ID NO: 8480970 - DNA, 22 bp, Homo sapiens
aggcagcagaaaacaaatggtt

SEQ ID NO: 8480971 - DNA, 22 bp, Homo sapiens
aggcagcagactgttaatcaga

SEQ ID NO: 8480972 - DNA, 22 bp, Homo sapiens
aggcagcagactgttaatcaga

SEQ ID NO: 8480973 - DNA, 21 bp, Homo sapiens
aggcagcaggatccagggaca

SEQ ID NO: 8480974 - DNA, 22 bp, Homo sapiens
aggcagcagcttgctggttgcc

SEQ ID NO: 8480975 - DNA, 22 bp, Homo sapiens
catttacagcagactgatgaaa

SEQ ID NO: 8480976 - DNA, 22 bp, Homo sapiens
catttacagcagactgatgaaa

SEQ ID NO: 8480977 - DNA, 22 bp, Homo sapiens
catttacagtgagagtttttac

SEQ ID NO: 8480978 - DNA, 22 bp, Homo sapiens
catttacagtgagagtttttac

SEQ ID NO: 8480979 - DNA, 22 bp, Homo sapiens
catttacagtgagagtttttac

SEQ ID NO: 8480980 - DNA, 21 bp, Homo sapiens
catttacatgacagattggtt

SEQ ID NO: 8480981 - DNA, 22 bp, Homo sapiens
catttacataacagtaacgctg

SEQ ID NO: 8480982 - DNA, 22 bp, Homo sapiens
catttacataacagtaacgctg

SEQ ID NO: 8480983 - DNA, 22 bp, Homo sapiens
catttacagtgagagtttttac

SEQ ID NO: 8480984 - DNA, 22 bp, Homo sapiens
catgaaatgttagaattagaca

SEQ ID NO: 8480985 - DNA, 22 bp, Homo sapiens
aggaggtgcgtggtgatcccct

SEQ ID NO: 8480986 - DNA, 22 bp, Homo sapiens
aggaggtgcgtggtgatcccct

SEQ ID NO: 8480987 - DNA, 22 bp, Homo sapiens
catgaaatgtgttaatctcttg

SEQ ID NO: 8480988 - DNA, 22 bp, Homo sapiens
aggaggcactcactctcagggt

SEQ ID NO: 8480989 - DNA, 17 bp, Homo sapiens
catctttaaaatcctga

SEQ ID NO: 8480990 - DNA, 22 bp, Homo sapiens
catgaaatattagtaactgttt

SEQ ID NO: 8480991 - DNA, 22 bp, Homo sapiens
catgaaaatgtcaagttctgct

SEQ ID NO: 8480992 - DNA, 22 bp, Homo sapiens
catgaaacttccaaagctgacc

SEQ ID NO: 8480993 - DNA, 22 bp, Homo sapiens
catgaggtgataaagctgggat

SEQ ID NO: 8480994 - DNA, 22 bp, Homo sapiens
catgagtatgattatacccagt

SEQ ID NO: 8480995 - DNA, 22 bp, Homo sapiens
aggaggtgttgatagaaggttt

SEQ ID NO: 8480996 - DNA, 22 bp, Homo sapiens
catgcacagagcttggtcattg

SEQ ID NO: 8480997 - DNA, 22 bp, Homo sapiens
catgcacagagcttggtcattg

SEQ ID NO: 8480998 - DNA, 22 bp, Homo sapiens
catgcacagagcttggtcattg

SEQ ID NO: 8480999 - DNA, 22 bp, Homo sapiens
catgcacttacctgaaattcaa

SEQ ID NO: 8481000 - DNA, 22 bp, Homo sapiens
catgcacatgtggctatgtaat

SEQ ID NO: 8481001 - DNA, 22 bp, Homo sapiens
catgcacattattcaaagccca

SEQ ID NO: 8481002 - DNA, 22 bp, Homo sapiens
catgcacatgtggctatgtaat

SEQ ID NO: 8481003 - DNA, 22 bp, Homo sapiens
catgcacagtgatatctgaaga

SEQ ID NO: 8481004 - DNA, 22 bp, Homo sapiens
catgcacagtgatatctgaaga

SEQ ID NO: 8481005 - DNA, 22 bp, Homo sapiens
catgcacagtgatatctgaaga

SEQ ID NO: 8481006 - DNA, 22 bp, Homo sapiens
catgcacatgcaatagtgcttt

SEQ ID NO: 8481007 - DNA, 22 bp, Homo sapiens
catgcacatgcaatagtgcttt

SEQ ID NO: 8481008 - DNA, 22 bp, Homo sapiens
aggaggtgctagagaagatgtt

SEQ ID NO: 8481009 - DNA, 22 bp, Homo sapiens
aggaggtgctgtttgtcctgga

SEQ ID NO: 8481010 - DNA, 22 bp, Homo sapiens
aggaggtgtagatttcctgtca

SEQ ID NO: 8481011 - DNA, 22 bp, Homo sapiens
aggcacaaaagcagggtgacca

SEQ ID NO: 8481012 - DNA, 22 bp, Homo sapiens
aggcacagcctcccttcacatg

SEQ ID NO: 8481013 - DNA, 22 bp, Homo sapiens
aggcacaggaacaggaaaagag

SEQ ID NO: 8481014 - DNA, 22 bp, Homo sapiens
aggcacaggaacaggaaaagag

SEQ ID NO: 8481015 - DNA, 22 bp, Homo sapiens
aggcacaggaggtggtaagaag

SEQ ID NO: 8481016 - DNA, 22 bp, Homo sapiens
aggcacaggaggtggtaagaag

SEQ ID NO: 8481017 - DNA, 22 bp, Homo sapiens
aggcacaggaatgtcatccagt

SEQ ID NO: 8481018 - DNA, 22 bp, Homo sapiens
aggcacaggaatgtcatccagt

SEQ ID NO: 8481019 - DNA, 22 bp, Homo sapiens
aggcacaggaatgtcatccagt

SEQ ID NO: 8481020 - DNA, 22 bp, Homo sapiens
catggccaggcccagggcccag

SEQ ID NO: 8481021 - DNA, 22 bp, Homo sapiens
aggcacaggcctcagcacccag

SEQ ID NO: 8481022 - DNA, 22 bp, Homo sapiens
catggccaggccaagagagtac

SEQ ID NO: 8481023 - DNA, 22 bp, Homo sapiens
catgccagggcttgctgcctgg

SEQ ID NO: 8481024 - DNA, 23 bp, Homo sapiens
catgccagtttgtgcaggcagat

SEQ ID NO: 8481025 - DNA, 22 bp, Homo sapiens
catgccagttttgagatgcacc

SEQ ID NO: 8481026 - DNA, 22 bp, Homo sapiens
catgccatttacttggaggaga

SEQ ID NO: 8481027 - DNA, 22 bp, Homo sapiens
catgccatgtgtgaggagagga

SEQ ID NO: 8481028 - DNA, 20 bp, Homo sapiens
catgcctgctggtatctggc

SEQ ID NO: 8481029 - DNA, 22 bp, Homo sapiens
catgcctgtaatcccagctctt

SEQ ID NO: 8481030 - DNA, 22 bp, Homo sapiens
catgcagatgtcatgaggcatg

SEQ ID NO: 8481031 - DNA, 22 bp, Homo sapiens
catgcagaggtgccacgaggct

SEQ ID NO: 8481032 - DNA, 21 bp, Homo sapiens
catgcagattctggagccaga

SEQ ID NO: 8481033 - DNA, 22 bp, Homo sapiens
catgcagatttgctgagataat

SEQ ID NO: 8481034 - DNA, 22 bp, Homo sapiens
catgcagatgtcatgaggcatg

SEQ ID NO: 8481035 - DNA, 22 bp, Homo sapiens
catgcagcaggatctcattccc

SEQ ID NO: 8481036 - DNA, 22 bp, Homo sapiens
catgcagcagaataatgactat

SEQ ID NO: 8481037 - DNA, 22 bp, Homo sapiens
catgcaggaggaaaaagcagct

SEQ ID NO: 8481038 - DNA, 22 bp, Homo sapiens
catgcagcggcgtttggtttaa

SEQ ID NO: 8481039 - DNA, 22 bp, Homo sapiens
catgcagcctgtgaacagtgtc

SEQ ID NO: 8481040 - DNA, 22 bp, Homo sapiens
catgcaggcctatggagcagtg

SEQ ID NO: 8481041 - DNA, 22 bp, Homo sapiens
cagtcctgagccaatcatgatg

SEQ ID NO: 8481042 - DNA, 17 bp, Homo sapiens
cagtcctctgctctaag

SEQ ID NO: 8481043 - DNA, 18 bp, Homo sapiens
cagtcccaaaccttagga

SEQ ID NO: 8481044 - DNA, 18 bp, Homo sapiens
cagtcccaaaccttagga

SEQ ID NO: 8481045 - DNA, 18 bp, Homo sapiens
cagtcccaaaccttagga

SEQ ID NO: 8481046 - DNA, 22 bp, Homo sapiens
cagtcctctgcaacaccccttc

SEQ ID NO: 8481047 - DNA, 22 bp, Homo sapiens
cagtcctgaggaagagctgctg

SEQ ID NO: 8481048 - DNA, 22 bp, Homo sapiens
cagtcctgagctcctgggctga

SEQ ID NO: 8481049 - DNA, 22 bp, Homo sapiens
cagtcctgcccaggctgacaga

SEQ ID NO: 8481050 - DNA, 22 bp, Homo sapiens
cagtcctgctagtgtgaaaagc

SEQ ID NO: 8481051 - DNA, 22 bp, Homo sapiens
cagtcctgctagtgtgaaaagc

SEQ ID NO: 8481052 - DNA, 22 bp, Homo sapiens
aggacagcagtgctggcacttg

SEQ ID NO: 8481053 - DNA, 22 bp, Homo sapiens
cagtcctgggcacagccctggg

SEQ ID NO: 8481054 - DNA, 22 bp, Homo sapiens
aggaagctgctaagaaacaatg

SEQ ID NO: 8481055 - DNA, 22 bp, Homo sapiens
aggaagctgggaaactgacatt

SEQ ID NO: 8481056 - DNA, 20 bp, Homo sapiens
aggaagctgagatgtagagg

SEQ ID NO: 8481057 - DNA, 22 bp, Homo sapiens
aggaagctgcctgggatgggaa

SEQ ID NO: 8481058 - DNA, 22 bp, Homo sapiens
aggaagcttggggcagggctac

SEQ ID NO: 8481059 - DNA, 22 bp, Homo sapiens
aggaagcttggggcagggctac

SEQ ID NO: 8481060 - DNA, 22 bp, Homo sapiens
aggaagctggggtgttcttcat

SEQ ID NO: 8481061 - DNA, 22 bp, Homo sapiens
aggaagctggtgtgaggatgaa

SEQ ID NO: 8481062 - DNA, 20 bp, Homo sapiens
aggaaggaagtttgcatgga

SEQ ID NO: 8481063 - DNA, 22 bp, Homo sapiens
aggaaggactgcagcatttggt

SEQ ID NO: 8481064 - DNA, 23 bp, Homo sapiens
aggagaagagatttccacatgca

SEQ ID NO: 8481065 - DNA, 23 bp, Homo sapiens
aggagaagagatttccacatgca

SEQ ID NO: 8481066 - DNA, 23 bp, Homo sapiens
aggagaagagatttccacatgca

SEQ ID NO: 8481067 - DNA, 23 bp, Homo sapiens
aggagaagagatttccacatgca

SEQ ID NO: 8481068 - DNA, 23 bp, Homo sapiens
aggagaagagatttccacatgca

SEQ ID NO: 8481069 - DNA, 19 bp, Homo sapiens
aggagaagactctctcccc

SEQ ID NO: 8481070 - DNA, 22 bp, Homo sapiens
cagtctctctccttgcaggcgt

SEQ ID NO: 8481071 - DNA, 22 bp, Homo sapiens
aggagaagccaagttgtgagca

SEQ ID NO: 8481072 - DNA, 22 bp, Homo sapiens
aggagaagccaagttgtgagca

SEQ ID NO: 8481073 - DNA, 22 bp, Homo sapiens
aggagaagccaagttgtgagca

SEQ ID NO: 8481074 - DNA, 23 bp, Homo sapiens
aggagaagagatttccacatgca

SEQ ID NO: 8481075 - DNA, 23 bp, Homo sapiens
aggagaagagatttccacatgca

SEQ ID NO: 8481076 - DNA, 22 bp, Homo sapiens
cagtctctcttgtagtgcagct

SEQ ID NO: 8481077 - DNA, 22 bp, Homo sapiens
cagtctctcttgtagtgcagct

SEQ ID NO: 8481078 - DNA, 22 bp, Homo sapiens
cagtctctctgaagtattaaga

SEQ ID NO: 8481079 - DNA, 22 bp, Homo sapiens
cagtctctgtgccagatcctgg

SEQ ID NO: 8481080 - DNA, 22 bp, Homo sapiens
cagtctctgtcatctcatggga

SEQ ID NO: 8481081 - DNA, 22 bp, Homo sapiens
cagtctctggcagctgctggcc

SEQ ID NO: 8481082 - DNA, 22 bp, Homo sapiens
cagtctcttgcttcattagttg

SEQ ID NO: 8481083 - DNA, 22 bp, Homo sapiens
cagtctcttttcagctccatcc

SEQ ID NO: 8481084 - DNA, 22 bp, Homo sapiens
aggagaattaggaactcaagat

SEQ ID NO: 8481085 - DNA, 22 bp, Homo sapiens
aggagacagccaggggcctgag

SEQ ID NO: 8481086 - DNA, 21 bp, Homo sapiens
aggacaggaactggctgaata

SEQ ID NO: 8481087 - DNA, 21 bp, Homo sapiens
aggacaggaactggctgaata

SEQ ID NO: 8481088 - DNA, 21 bp, Homo sapiens
aggacaggaactggctgaata

SEQ ID NO: 8481089 - DNA, 21 bp, Homo sapiens
aggacaggaactggctgaata

SEQ ID NO: 8481090 - DNA, 21 bp, Homo sapiens
aggacaggaactggctgaata

SEQ ID NO: 8481091 - DNA, 21 bp, Homo sapiens
aggacaggaactggctgaata

SEQ ID NO: 8481092 - DNA, 21 bp, Homo sapiens
aggacaggaactggctgaata

SEQ ID NO: 8481093 - DNA, 22 bp, Homo sapiens
aggacagcagttggtgaggttc

SEQ ID NO: 8481094 - DNA, 22 bp, Homo sapiens
aggagaaaacagtgttttgcct

SEQ ID NO: 8481095 - DNA, 22 bp, Homo sapiens
aggacaggattccttgccttgc

SEQ ID NO: 8481096 - DNA, 22 bp, Homo sapiens
aggactgacttttgccatgaaa

SEQ ID NO: 8481097 - DNA, 22 bp, Homo sapiens
aggactttagagccagaaagac

SEQ ID NO: 8481098 - DNA, 22 bp, Homo sapiens
aggactgacttttgccatgaaa

SEQ ID NO: 8481099 - DNA, 18 bp, Homo sapiens
aggagaaagggaccaggg

SEQ ID NO: 8481100 - DNA, 18 bp, Homo sapiens
aggagaaagggaccaggg

SEQ ID NO: 8481101 - DNA, 22 bp, Homo sapiens
aggagaaagactggacagccaa

SEQ ID NO: 8481102 - DNA, 22 bp, Homo sapiens
aggagaaagactggacagccaa

SEQ ID NO: 8481103 - DNA, 22 bp, Homo sapiens
aggagaaatccatcgagaatgg

SEQ ID NO: 8481104 - DNA, 20 bp, Homo sapiens
aggagaaattcgggacacct

SEQ ID NO: 8481105 - DNA, 22 bp, Homo sapiens
aggaggaggtaagaaaagcata

SEQ ID NO: 8481106 - DNA, 22 bp, Homo sapiens
aggaggaggtaagaaaagcata

SEQ ID NO: 8481107 - DNA, 22 bp, Homo sapiens
aggaggaggtgggacacagtga

SEQ ID NO: 8481108 - DNA, 20 bp, Homo sapiens
aggaggcaatgtagataagc

SEQ ID NO: 8481109 - DNA, 17 bp, Homo sapiens
aggaggatcagagagta

SEQ ID NO: 8481110 - DNA, 22 bp, Homo sapiens
aggaggagcagctttttgtctc

SEQ ID NO: 8481111 - DNA, 21 bp, Homo sapiens
aggaggagagcttggcctacc

SEQ ID NO: 8481112 - DNA, 21 bp, Homo sapiens
aggaggagagcttggcctacc

SEQ ID NO: 8481113 - DNA, 21 bp, Homo sapiens
aggaggagagcttggcctacc

SEQ ID NO: 8481114 - DNA, 22 bp, Homo sapiens
aggaggaatacaatccagcagc

SEQ ID NO: 8481115 - DNA, 22 bp, Homo sapiens
aggaggaatacaatccagcagc

SEQ ID NO: 8481116 - DNA, 22 bp, Homo sapiens
aggagctgaaacttctcatatg

SEQ ID NO: 8481117 - DNA, 22 bp, Homo sapiens
aggagctgaaacttctcatatg

SEQ ID NO: 8481118 - DNA, 22 bp, Homo sapiens
aggagctgaaacttctcatatg

SEQ ID NO: 8481119 - DNA, 22 bp, Homo sapiens
aggagctcttgatgcttgaggg

SEQ ID NO: 8481120 - DNA, 22 bp, Homo sapiens
aggagctgaagtctctgcactc

SEQ ID NO: 8481121 - DNA, 22 bp, Homo sapiens
aggagctgaagtctctgcactc

SEQ ID NO: 8481122 - DNA, 22 bp, Homo sapiens
aggagctgaaacttctcatatg

SEQ ID NO: 8481123 - DNA, 20 bp, Homo sapiens
aggagctgaattagagggtt

SEQ ID NO: 8481124 - DNA, 20 bp, Homo sapiens
aggagctgaattagagggtt

SEQ ID NO: 8481125 - DNA, 22 bp, Homo sapiens
aggagctgaagtctctgcactc

SEQ ID NO: 8481126 - DNA, 22 bp, Homo sapiens
aggagctgaagtctctgcactc

SEQ ID NO: 8481127 - DNA, 22 bp, Homo sapiens
aggagctgacttgtaaagcatt

SEQ ID NO: 8481128 - DNA, 20 bp, Homo sapiens
aggagctgaattagagggtt

SEQ ID NO: 8481129 - DNA, 22 bp, Homo sapiens
aggagctgataaaagggggtca

SEQ ID NO: 8481130 - DNA, 22 bp, Homo sapiens
aggagctgataaaagggggtca

SEQ ID NO: 8481131 - DNA, 22 bp, Homo sapiens
aggagctgataaaagggggtca

SEQ ID NO: 8481132 - DNA, 22 bp, Homo sapiens
aggagctgagtcagcccgacag

SEQ ID NO: 8481133 - DNA, 22 bp, Homo sapiens
aggagctgagggagcgcccttg

SEQ ID NO: 8481134 - DNA, 22 bp, Homo sapiens
aggagctgagggagcgcccttg

SEQ ID NO: 8481135 - DNA, 22 bp, Homo sapiens
aggagctgtgaatgggaggggt

SEQ ID NO: 8481136 - DNA, 22 bp, Homo sapiens
aggagaggtctcccttccccag

SEQ ID NO: 8481137 - DNA, 22 bp, Homo sapiens
aggagaggtctcccttccccag

SEQ ID NO: 8481138 - DNA, 22 bp, Homo sapiens
aggagagggtggcattaagttt

SEQ ID NO: 8481139 - DNA, 22 bp, Homo sapiens
aggagagggtggcattaagttt

SEQ ID NO: 8481140 - DNA, 22 bp, Homo sapiens
aggagagttcacactggtcaga

SEQ ID NO: 8481141 - DNA, 22 bp, Homo sapiens
aggagagtcttgagtcactggt

SEQ ID NO: 8481142 - DNA, 22 bp, Homo sapiens
aggagagtaccattgggccgca

SEQ ID NO: 8481143 - DNA, 22 bp, Homo sapiens
aggagagtcttgagtcactggt

SEQ ID NO: 8481144 - DNA, 22 bp, Homo sapiens
aggagatcagcttagggaaggt

SEQ ID NO: 8481145 - DNA, 22 bp, Homo sapiens
aggagccatgagcaggaggcaa

SEQ ID NO: 8481146 - DNA, 22 bp, Homo sapiens
aggagccatgagcaggaggcaa

SEQ ID NO: 8481147 - DNA, 22 bp, Homo sapiens
aggagagttcacactggtcaga

SEQ ID NO: 8481148 - DNA, 22 bp, Homo sapiens
aggagatcagcctccctgcaac

SEQ ID NO: 8481149 - DNA, 22 bp, Homo sapiens
aggagcctggctggcccacagg

SEQ ID NO: 8481150 - DNA, 22 bp, Homo sapiens
aggagccatgagcaggaggcaa

SEQ ID NO: 8481151 - DNA, 22 bp, Homo sapiens
aggagctcagcctgcagggagc

SEQ ID NO: 8481152 - DNA, 22 bp, Homo sapiens
aggagctccagcccagggaagt

SEQ ID NO: 8481153 - DNA, 22 bp, Homo sapiens
aggagctcccgtgaggagacca

SEQ ID NO: 8481154 - DNA, 19 bp, Homo sapiens
aggagccttgagcagtgag

SEQ ID NO: 8481155 - DNA, 22 bp, Homo sapiens
aggagcctgtgcctggcactcc

SEQ ID NO: 8481156 - DNA, 22 bp, Homo sapiens
aggagctagccaggcatatgca

SEQ ID NO: 8481157 - DNA, 18 bp, Homo sapiens
aggagcctttgcactgga

SEQ ID NO: 8481158 - DNA, 22 bp, Homo sapiens
aggagagaggttttaaatgggg

SEQ ID NO: 8481159 - DNA, 22 bp, Homo sapiens
aggagagagaacacttgggtcc

SEQ ID NO: 8481160 - DNA, 22 bp, Homo sapiens
aggagagaatgttccaggcttg

SEQ ID NO: 8481161 - DNA, 22 bp, Homo sapiens
aggagagaatgttccaggcttg

SEQ ID NO: 8481162 - DNA, 22 bp, Homo sapiens
aggagagaatgttccaggcttg

SEQ ID NO: 8481163 - DNA, 22 bp, Homo sapiens
aggagagaatgttccaggcttg

SEQ ID NO: 8481164 - DNA, 22 bp, Homo sapiens
aggagactcagagacctggccg

SEQ ID NO: 8481165 - DNA, 22 bp, Homo sapiens
aggagaggctctaactctgtgt

SEQ ID NO: 8481166 - DNA, 22 bp, Homo sapiens
aggagaggctctaactctgtgt

SEQ ID NO: 8481167 - DNA, 22 bp, Homo sapiens
aggagaggctctaactctgtgt

SEQ ID NO: 8481168 - DNA, 22 bp, Homo sapiens
aggagaggggtaggattaattt

SEQ ID NO: 8481169 - DNA, 22 bp, Homo sapiens
aggagaggggtaggattaattt

SEQ ID NO: 8481170 - DNA, 22 bp, Homo sapiens
aggagaggggtaggattaattt

SEQ ID NO: 8481171 - DNA, 22 bp, Homo sapiens
aggagaggaatcattattacaa

SEQ ID NO: 8481172 - DNA, 22 bp, Homo sapiens
aggagaggaatcattattacaa

SEQ ID NO: 8481173 - DNA, 22 bp, Homo sapiens
aggagagctggtgtctggaatc

SEQ ID NO: 8481174 - DNA, 22 bp, Homo sapiens
aggagaggcatcaagaaaatcg

SEQ ID NO: 8481175 - DNA, 22 bp, Homo sapiens
aggagaggcatcaagaaaatcg

SEQ ID NO: 8481176 - DNA, 22 bp, Homo sapiens
caggaaaaggagactttagcac

SEQ ID NO: 8481177 - DNA, 21 bp, Homo sapiens
caggaaaagcggaagtctagc

SEQ ID NO: 8481178 - DNA, 22 bp, Homo sapiens
agctgcctggccggagccactg

SEQ ID NO: 8481179 - DNA, 22 bp, Homo sapiens
agctgctccaatttttaccatt

SEQ ID NO: 8481180 - DNA, 21 bp, Homo sapiens
agctgctccagggagctcagg

SEQ ID NO: 8481181 - DNA, 22 bp, Homo sapiens
agctgctccctatcctttcctt

SEQ ID NO: 8481182 - DNA, 21 bp, Homo sapiens
agctgctccagggagctcagg

SEQ ID NO: 8481183 - DNA, 22 bp, Homo sapiens
agctgctccttggctgtggttc

SEQ ID NO: 8481184 - DNA, 22 bp, Homo sapiens
agctgctcctttcctgcaggcg

SEQ ID NO: 8481185 - DNA, 22 bp, Homo sapiens
agctgctcctttcctgcaggcg

SEQ ID NO: 8481186 - DNA, 22 bp, Homo sapiens
agctgctcctttcctgcaggcg

SEQ ID NO: 8481187 - DNA, 22 bp, Homo sapiens
agctgctcgaagccggtggccc

SEQ ID NO: 8481188 - DNA, 22 bp, Homo sapiens
agctgctctcactggacgcctg

SEQ ID NO: 8481189 - DNA, 22 bp, Homo sapiens
agctgctcttcatttcccccca

SEQ ID NO: 8481190 - DNA, 22 bp, Homo sapiens
agctgctcttgggtgacttcaa

SEQ ID NO: 8481191 - DNA, 22 bp, Homo sapiens
agctgctcttgggtgacttcaa

SEQ ID NO: 8481192 - DNA, 22 bp, Homo sapiens
agctgctctgataaacctactt

SEQ ID NO: 8481193 - DNA, 22 bp, Homo sapiens
agctgctctgagccctgattct

SEQ ID NO: 8481194 - DNA, 20 bp, Homo sapiens
agctgctctcatccagacct

SEQ ID NO: 8481195 - DNA, 22 bp, Homo sapiens
agctgctgagccaggctgatgt

SEQ ID NO: 8481196 - DNA, 22 bp, Homo sapiens
agctgctgagagtctgccgggc

SEQ ID NO: 8481197 - DNA, 22 bp, Homo sapiens
agctgctctttgaaggacactt

SEQ ID NO: 8481198 - DNA, 22 bp, Homo sapiens
agctgctctttgaaggacactt

SEQ ID NO: 8481199 - DNA, 22 bp, Homo sapiens
agctgctgaagtgagagaattg

SEQ ID NO: 8481200 - DNA, 22 bp, Homo sapiens
caggacagagcccagactgtgt

SEQ ID NO: 8481201 - DNA, 22 bp, Homo sapiens
caggacagagcccagactgtgt

SEQ ID NO: 8481202 - DNA, 22 bp, Homo sapiens
agctggaggataactcacttct

SEQ ID NO: 8481203 - DNA, 22 bp, Homo sapiens
agctggaggataactcacttct

SEQ ID NO: 8481204 - DNA, 23 bp, Homo sapiens
agctggaggctgtctactcccaa

SEQ ID NO: 8481205 - DNA, 22 bp, Homo sapiens
agctggcatactttgctaggaa

SEQ ID NO: 8481206 - DNA, 22 bp, Homo sapiens
agctggcagtatgactggtgac

SEQ ID NO: 8481207 - DNA, 22 bp, Homo sapiens
agctggcagtcggccttgatgc

SEQ ID NO: 8481208 - DNA, 22 bp, Homo sapiens
agctggcagtcatcctagtgag

SEQ ID NO: 8481209 - DNA, 22 bp, Homo sapiens
caggacagacagaatgcctaac

SEQ ID NO: 8481210 - DNA, 22 bp, Homo sapiens
caggacagaaataaggaatata

SEQ ID NO: 8481211 - DNA, 22 bp, Homo sapiens
caggacagaaataaggaatata

SEQ ID NO: 8481212 - DNA, 22 bp, Homo sapiens
caggacagagcccagactgtgt

SEQ ID NO: 8481213 - DNA, 22 bp, Homo sapiens
caggacagaccaagatcgtgct

SEQ ID NO: 8481214 - DNA, 22 bp, Homo sapiens
caggacagaccaagatcgtgct

SEQ ID NO: 8481215 - DNA, 22 bp, Homo sapiens
caggaggttggtagcagtagat

SEQ ID NO: 8481216 - DNA, 22 bp, Homo sapiens
caggaggttgtaagagcaggcc

SEQ ID NO: 8481217 - DNA, 22 bp, Homo sapiens
caggaggttggtagcagtagat

SEQ ID NO: 8481218 - DNA, 22 bp, Homo sapiens
caggaggttgtaagagcaggcc

SEQ ID NO: 8481219 - DNA, 22 bp, Homo sapiens
caggagtccagagtgtcatttt

SEQ ID NO: 8481220 - DNA, 22 bp, Homo sapiens
caggaggtgacttccaggggtt

SEQ ID NO: 8481221 - DNA, 22 bp, Homo sapiens
caggaggtgaaggagaaccagt

SEQ ID NO: 8481222 - DNA, 22 bp, Homo sapiens
caggaggtgacttccaggggtt

SEQ ID NO: 8481223 - DNA, 22 bp, Homo sapiens
caggaggtacatagattcagat

SEQ ID NO: 8481224 - DNA, 22 bp, Homo sapiens
caggaggttgagggtgcagtga

SEQ ID NO: 8481225 - DNA, 22 bp, Homo sapiens
caggaggttgagggtgcagtga

SEQ ID NO: 8481226 - DNA, 22 bp, Homo sapiens
caggaggtggagctcaagtggt

SEQ ID NO: 8481227 - DNA, 22 bp, Homo sapiens
agctggcatactttgctaggaa

SEQ ID NO: 8481228 - DNA, 22 bp, Homo sapiens
agctggcatactttgctaggaa

SEQ ID NO: 8481229 - DNA, 22 bp, Homo sapiens
agctggcattacaggagcatgc

SEQ ID NO: 8481230 - DNA, 22 bp, Homo sapiens
agctggccagcacctccaggtc

SEQ ID NO: 8481231 - DNA, 22 bp, Homo sapiens
agctggccagcacctccaggtc

SEQ ID NO: 8481232 - DNA, 22 bp, Homo sapiens
agctggccagcacctccaggtc

SEQ ID NO: 8481233 - DNA, 22 bp, Homo sapiens
agctggcattgcagggagctgc

SEQ ID NO: 8481234 - DNA, 22 bp, Homo sapiens
agctggcattgcagggagctgc

SEQ ID NO: 8481235 - DNA, 22 bp, Homo sapiens
agctggccagatgtcccaaaga

SEQ ID NO: 8481236 - DNA, 22 bp, Homo sapiens
agctggctgggtgccagtctcc

SEQ ID NO: 8481237 - DNA, 22 bp, Homo sapiens
agctggctgggtgccagtctcc

SEQ ID NO: 8481238 - DNA, 22 bp, Homo sapiens
agctggcttctctgcagacatt

SEQ ID NO: 8481239 - DNA, 22 bp, Homo sapiens
agctggcttctctgcagacatt

SEQ ID NO: 8481240 - DNA, 22 bp, Homo sapiens
agctggcttctctgcagacatt

SEQ ID NO: 8481241 - DNA, 22 bp, Homo sapiens
agctggcttctctgcagacatt

SEQ ID NO: 8481242 - DNA, 22 bp, Homo sapiens
agctggctttgagctgggaggt

SEQ ID NO: 8481243 - DNA, 22 bp, Homo sapiens
agctggctttgagctgggaggt

SEQ ID NO: 8481244 - DNA, 22 bp, Homo sapiens
agctggctttatggttggctaa

SEQ ID NO: 8481245 - DNA, 22 bp, Homo sapiens
agctggctggccccttcctgcc

SEQ ID NO: 8481246 - DNA, 22 bp, Homo sapiens
agctggctgccttctccttagg

SEQ ID NO: 8481247 - DNA, 22 bp, Homo sapiens
agctggctgccttctccttagg

SEQ ID NO: 8481248 - DNA, 22 bp, Homo sapiens
agctggctgccttctccttagg

SEQ ID NO: 8481249 - DNA, 21 bp, Homo sapiens
agctggcctggtttgagctcc

SEQ ID NO: 8481250 - DNA, 21 bp, Homo sapiens
agctggcctggtttgagctcc

SEQ ID NO: 8481251 - DNA, 21 bp, Homo sapiens
agctggcctggtttgagctcc

SEQ ID NO: 8481252 - DNA, 22 bp, Homo sapiens
agctggcctccgggtgcctggg

SEQ ID NO: 8481253 - DNA, 22 bp, Homo sapiens
agctggcctccgggtgcctggg

SEQ ID NO: 8481254 - DNA, 22 bp, Homo sapiens
caggagtctgttcctcatttgt

SEQ ID NO: 8481255 - DNA, 22 bp, Homo sapiens
caggagtcctgaaatctgatga

SEQ ID NO: 8481256 - DNA, 22 bp, Homo sapiens
caggagtccctctggccagcat

SEQ ID NO: 8481257 - DNA, 22 bp, Homo sapiens
agctgcaggcccatgctcagtc

SEQ ID NO: 8481258 - DNA, 22 bp, Homo sapiens
agctgcaggcctctcctgggga

SEQ ID NO: 8481259 - DNA, 23 bp, Homo sapiens
agctgaggctgtgggtgtcagag

SEQ ID NO: 8481260 - DNA, 23 bp, Homo sapiens
agctgaggctgtgggtgtcagag

SEQ ID NO: 8481261 - DNA, 22 bp, Homo sapiens
agctgaggctctgagagggaag

SEQ ID NO: 8481262 - DNA, 22 bp, Homo sapiens
agctgaggctctgagagggaag

SEQ ID NO: 8481263 - DNA, 22 bp, Homo sapiens
agctgaggctctgagagggaag

SEQ ID NO: 8481264 - DNA, 22 bp, Homo sapiens
agctgaggctctgagagggaag

SEQ ID NO: 8481265 - DNA, 22 bp, Homo sapiens
agctgaggcctgatttcgccgt

SEQ ID NO: 8481266 - DNA, 22 bp, Homo sapiens
agctgaggcctgatttcgccgt

SEQ ID NO: 8481267 - DNA, 22 bp, Homo sapiens
agctgaggccacgagtgaaggg

SEQ ID NO: 8481268 - DNA, 22 bp, Homo sapiens
agctgaggccacgagtgaaggg

SEQ ID NO: 8481269 - DNA, 22 bp, Homo sapiens
agctgaggcatggacaggctgc

SEQ ID NO: 8481270 - DNA, 22 bp, Homo sapiens
agctgaggcatggacaggctgc

SEQ ID NO: 8481271 - DNA, 22 bp, Homo sapiens
agctgaggcatggacaggctgc

SEQ ID NO: 8481272 - DNA, 22 bp, Homo sapiens
agctgaggcatgatgctatcag

SEQ ID NO: 8481273 - DNA, 22 bp, Homo sapiens
agctgaggcatgatgctatcag

SEQ ID NO: 8481274 - DNA, 22 bp, Homo sapiens
agctgaggcatggacaggctgc

SEQ ID NO: 8481275 - DNA, 22 bp, Homo sapiens
cagcttctttgggattctttat

SEQ ID NO: 8481276 - DNA, 23 bp, Homo sapiens
cagcttctttgggattctttata

SEQ ID NO: 8481277 - DNA, 23 bp, Homo sapiens
agctgaggcagaggggcattctc

SEQ ID NO: 8481278 - DNA, 23 bp, Homo sapiens
agctgaggcagaggggcattctc

SEQ ID NO: 8481279 - DNA, 22 bp, Homo sapiens
agctgcagtaaagctctccagg

SEQ ID NO: 8481280 - DNA, 22 bp, Homo sapiens
agctgcaggttcagcattccac

SEQ ID NO: 8481281 - DNA, 22 bp, Homo sapiens
agctgcaggcctctcctgggga

SEQ ID NO: 8481282 - DNA, 21 bp, Homo sapiens
agctgcagtcaagccagaggt

SEQ ID NO: 8481283 - DNA, 21 bp, Homo sapiens
agctgcagtcaagccagaggt

SEQ ID NO: 8481284 - DNA, 21 bp, Homo sapiens
agctgcagtcaagccagaggt

SEQ ID NO: 8481285 - DNA, 22 bp, Homo sapiens
agctgcagtcaagctgggccac

SEQ ID NO: 8481286 - DNA, 22 bp, Homo sapiens
agctgcagtcaagctgggccac

SEQ ID NO: 8481287 - DNA, 22 bp, Homo sapiens
cagcttttggcaggatgaccag

SEQ ID NO: 8481288 - DNA, 22 bp, Homo sapiens
cagctttttagaatctagggca

SEQ ID NO: 8481289 - DNA, 22 bp, Homo sapiens
cagcttttaggactgtgagaaa

SEQ ID NO: 8481290 - DNA, 22 bp, Homo sapiens
cagctttgtgcaatgcagtctc

SEQ ID NO: 8481291 - DNA, 22 bp, Homo sapiens
cagctttggagtgtgagtgctg

SEQ ID NO: 8481292 - DNA, 22 bp, Homo sapiens
cagctttgcaggctggtcagtg

SEQ ID NO: 8481293 - DNA, 22 bp, Homo sapiens
cagctcctgttggtcttgagga

SEQ ID NO: 8481294 - DNA, 22 bp, Homo sapiens
cagctcctgttggtcttgagga

SEQ ID NO: 8481295 - DNA, 22 bp, Homo sapiens
cagctctcacaccctcctccca

SEQ ID NO: 8481296 - DNA, 22 bp, Homo sapiens
cagctctcacacttagcttcta

SEQ ID NO: 8481297 - DNA, 22 bp, Homo sapiens
cagctctgaagaaaggtgtcta

SEQ ID NO: 8481298 - DNA, 22 bp, Homo sapiens
cagctctgaagaaaggtgtcta

SEQ ID NO: 8481299 - DNA, 22 bp, Homo sapiens
cagctctctaaggtcttgcttt

SEQ ID NO: 8481300 - DNA, 22 bp, Homo sapiens
cagctctctaaggtcttgcttt

SEQ ID NO: 8481301 - DNA, 22 bp, Homo sapiens
cagctctgacacagtacaaaat

SEQ ID NO: 8481302 - DNA, 22 bp, Homo sapiens
cagctgttgtcacctcacatcc

SEQ ID NO: 8481303 - DNA, 22 bp, Homo sapiens
cagctgttgtctctcacatatt

SEQ ID NO: 8481304 - DNA, 22 bp, Homo sapiens
cagcttctgtctgattagcaag

SEQ ID NO: 8481305 - DNA, 22 bp, Homo sapiens
cagctgttgtgatccatttacg

SEQ ID NO: 8481306 - DNA, 22 bp, Homo sapiens
cagcttctgtcctagaaactgg

SEQ ID NO: 8481307 - DNA, 22 bp, Homo sapiens
agctctgcaggcacagctgagg

SEQ ID NO: 8481308 - DNA, 22 bp, Homo sapiens
agctctggaactcccggctgct

SEQ ID NO: 8481309 - DNA, 23 bp, Homo sapiens
agctctgctcgggcatgccctgc

SEQ ID NO: 8481310 - DNA, 22 bp, Homo sapiens
agctctgctactctgtggggtg

SEQ ID NO: 8481311 - DNA, 22 bp, Homo sapiens
cagctcctgcctgggcagctgt

SEQ ID NO: 8481312 - DNA, 22 bp, Homo sapiens
cagctcctgggccatctcctag

SEQ ID NO: 8481313 - DNA, 22 bp, Homo sapiens
agctctggaactcccggctgct

SEQ ID NO: 8481314 - DNA, 22 bp, Homo sapiens
cagctcctgcctgggcagctgt

SEQ ID NO: 8481315 - DNA, 22 bp, Homo sapiens
agctctctgataaattgataaa

SEQ ID NO: 8481316 - DNA, 22 bp, Homo sapiens
agctctctgataaattgataaa

SEQ ID NO: 8481317 - DNA, 18 bp, Homo sapiens
agctctcccccacatgcc

SEQ ID NO: 8481318 - DNA, 22 bp, Homo sapiens
agctctcccatagggcaagatc

SEQ ID NO: 8481319 - DNA, 22 bp, Homo sapiens
agctcctgtgtgaagcctccct

SEQ ID NO: 8481320 - DNA, 22 bp, Homo sapiens
agctctgagaaagttagaaagt

SEQ ID NO: 8481321 - DNA, 22 bp, Homo sapiens
agctctgacaaggattttctgc

SEQ ID NO: 8481322 - DNA, 22 bp, Homo sapiens
agctctgatccataatttatac

SEQ ID NO: 8481323 - DNA, 22 bp, Homo sapiens
agctctgatgactttacaactt

SEQ ID NO: 8481324 - DNA, 22 bp, Homo sapiens
aggaagctcaaagccatgatgt

SEQ ID NO: 8481325 - DNA, 18 bp, Homo sapiens
aggaagcaggaggaaggc

SEQ ID NO: 8481326 - DNA, 22 bp, Homo sapiens
aggaactggtgggaggtgattg

SEQ ID NO: 8481327 - DNA, 22 bp, Homo sapiens
aggaactgtcatgtattgctca

SEQ ID NO: 8481328 - DNA, 22 bp, Homo sapiens
aggaagctcaaagccatgatgt

SEQ ID NO: 8481329 - DNA, 22 bp, Homo sapiens
aggaagctcattttgacatatc

SEQ ID NO: 8481330 - DNA, 22 bp, Homo sapiens
aggaagctcggagagggcaaat

SEQ ID NO: 8481331 - DNA, 22 bp, Homo sapiens
aggaagctcggagagggcaaat

SEQ ID NO: 8481332 - DNA, 22 bp, Homo sapiens
aggaagctcctggagagccagt

SEQ ID NO: 8481333 - DNA, 22 bp, Homo sapiens
aggaagctcctggagagccagt

SEQ ID NO: 8481334 - DNA, 23 bp, Homo sapiens
aggaactgcttcatttttgaaag

SEQ ID NO: 8481335 - DNA, 20 bp, Homo sapiens
aggaactggaagggaggaaa

SEQ ID NO: 8481336 - DNA, 22 bp, Homo sapiens
aggaactgggctcagcaaacat

SEQ ID NO: 8481337 - DNA, 22 bp, Homo sapiens
aggaactgatgagcagccaggg

SEQ ID NO: 8481338 - DNA, 22 bp, Homo sapiens
aggaactgatgagcagccaggg

SEQ ID NO: 8481339 - DNA, 22 bp, Homo sapiens
aggaactgatgagcagccaggg

SEQ ID NO: 8481340 - DNA, 22 bp, Homo sapiens
aggaaaggggtaggtgtggacg

SEQ ID NO: 8481341 - DNA, 23 bp, Homo sapiens
cagggccaggcagcagctgtcac

SEQ ID NO: 8481342 - DNA, 22 bp, Homo sapiens
cagggccagcgcccaggcccag

SEQ ID NO: 8481343 - DNA, 22 bp, Homo sapiens
cagggccagcgtctcgggctat

SEQ ID NO: 8481344 - DNA, 22 bp, Homo sapiens
aggaaataggaccagacaaagc

SEQ ID NO: 8481345 - DNA, 22 bp, Homo sapiens
aggaaatgctgatgctcctgga

SEQ ID NO: 8481346 - DNA, 22 bp, Homo sapiens
aggaaatgctgatgctcctgga

SEQ ID NO: 8481347 - DNA, 22 bp, Homo sapiens
aggaaatgccgcggctctcttt

SEQ ID NO: 8481348 - DNA, 22 bp, Homo sapiens
aggaaatgccgcggctctcttt

SEQ ID NO: 8481349 - DNA, 22 bp, Homo sapiens
aggaacacaacttcctgagagc

SEQ ID NO: 8481350 - DNA, 22 bp, Homo sapiens
aggaacaactgattcagtcaac

SEQ ID NO: 8481351 - DNA, 22 bp, Homo sapiens
aggaacaattgataaactcaca

SEQ ID NO: 8481352 - DNA, 22 bp, Homo sapiens
aggaacaagggagccttttctc

SEQ ID NO: 8481353 - DNA, 22 bp, Homo sapiens
aggaacaagggagccttttctc

SEQ ID NO: 8481354 - DNA, 22 bp, Homo sapiens
aggaaatgtagtcctcatctcc

SEQ ID NO: 8481355 - DNA, 22 bp, Homo sapiens
aggaaagccaatctctcttgac

SEQ ID NO: 8481356 - DNA, 22 bp, Homo sapiens
aggaaagcaatggctgagaaca

SEQ ID NO: 8481357 - DNA, 23 bp, Homo sapiens
aggaaagcattcatttttaccat

SEQ ID NO: 8481358 - DNA, 22 bp, Homo sapiens
aggaaagcaatggctgagaaca

SEQ ID NO: 8481359 - DNA, 22 bp, Homo sapiens
aggaaagatggaaggaggataa

SEQ ID NO: 8481360 - DNA, 22 bp, Homo sapiens
aggaaagactggggccccagaa

SEQ ID NO: 8481361 - DNA, 22 bp, Homo sapiens
aggaaagactggggccccagaa

SEQ ID NO: 8481362 - DNA, 20 bp, Homo sapiens
aggaaagcctgtgtgagtct

SEQ ID NO: 8481363 - DNA, 22 bp, Homo sapiens
aggaaagctcccagtagggctc

SEQ ID NO: 8481364 - DNA, 22 bp, Homo sapiens
aggaaagcttggcaaactaaat

SEQ ID NO: 8481365 - DNA, 21 bp, Homo sapiens
aggaaaggaagtccccagggt

SEQ ID NO: 8481366 - DNA, 21 bp, Homo sapiens
aggaaaggaagtccccagggt

SEQ ID NO: 8481367 - DNA, 22 bp, Homo sapiens
cagggccagagagggctggctg

SEQ ID NO: 8481368 - DNA, 22 bp, Homo sapiens
cagggccagagagggctggctg

SEQ ID NO: 8481369 - DNA, 22 bp, Homo sapiens
cagggccactgtagatgaggag

SEQ ID NO: 8481370 - DNA, 22 bp, Homo sapiens
cagggccactgtagatgaggag

SEQ ID NO: 8481371 - DNA, 22 bp, Homo sapiens
cagggccagccatcctgctggg

SEQ ID NO: 8481372 - DNA, 22 bp, Homo sapiens
cagggccagccgcagcatccac

SEQ ID NO: 8481373 - DNA, 18 bp, Homo sapiens
aggaaagacgaagagggc

SEQ ID NO: 8481374 - DNA, 18 bp, Homo sapiens
aggaaagacgaagagggc

SEQ ID NO: 8481375 - DNA, 18 bp, Homo sapiens
aggaaagacgaagagggc

SEQ ID NO: 8481376 - DNA, 18 bp, Homo sapiens
aggaaagacgaagagggc

SEQ ID NO: 8481377 - DNA, 17 bp, Homo sapiens
aggaaacattttctttc

SEQ ID NO: 8481378 - DNA, 22 bp, Homo sapiens
agctttatataaaagagtacat

SEQ ID NO: 8481379 - DNA, 22 bp, Homo sapiens
agcttgttgttactgatgcatt

SEQ ID NO: 8481380 - DNA, 22 bp, Homo sapiens
agctttaaaaatccaatatcca

SEQ ID NO: 8481381 - DNA, 22 bp, Homo sapiens
agcttgtgtttttctaagtatc

SEQ ID NO: 8481382 - DNA, 22 bp, Homo sapiens
agcttgttagaaatgtagactc

SEQ ID NO: 8481383 - DNA, 21 bp, Homo sapiens
agcttgtgtgtatcacagtgt

SEQ ID NO: 8481384 - DNA, 22 bp, Homo sapiens
agctttaaagcatatttctaag

SEQ ID NO: 8481385 - DNA, 22 bp, Homo sapiens
agctttaaatcaatccagtgag

SEQ ID NO: 8481386 - DNA, 22 bp, Homo sapiens
agctttacctgccttggggcac

SEQ ID NO: 8481387 - DNA, 22 bp, Homo sapiens
caggcctggcccccggcacacc

SEQ ID NO: 8481388 - DNA, 22 bp, Homo sapiens
caggcctccactccacgcagac

SEQ ID NO: 8481389 - DNA, 22 bp, Homo sapiens
caggcctcccggtgcacactga

SEQ ID NO: 8481390 - DNA, 22 bp, Homo sapiens
caggcctcccggtgcacactga

SEQ ID NO: 8481391 - DNA, 22 bp, Homo sapiens
caggcctcccggtgcacactga

SEQ ID NO: 8481392 - DNA, 22 bp, Homo sapiens
caggcctgggcttcggggctga

SEQ ID NO: 8481393 - DNA, 22 bp, Homo sapiens
caggcctgggcttcggggctga

SEQ ID NO: 8481394 - DNA, 22 bp, Homo sapiens
caggcctggcccccggcacacc

SEQ ID NO: 8481395 - DNA, 22 bp, Homo sapiens
caggcctggctgcagctcgcct

SEQ ID NO: 8481396 - DNA, 22 bp, Homo sapiens
caggcctggctgcagctcgcct

SEQ ID NO: 8481397 - DNA, 22 bp, Homo sapiens
caggcctgggcttcggggctga

SEQ ID NO: 8481398 - DNA, 22 bp, Homo sapiens
caggcctggggctggcttccag

SEQ ID NO: 8481399 - DNA, 22 bp, Homo sapiens
caggcctggttgagccctgaga

SEQ ID NO: 8481400 - DNA, 22 bp, Homo sapiens
agctgtgtcctgaagacactgc

SEQ ID NO: 8481401 - DNA, 22 bp, Homo sapiens
agctgtgtgacctagggcaagc

SEQ ID NO: 8481402 - DNA, 22 bp, Homo sapiens
agctgtgtgactctaagcaagt

SEQ ID NO: 8481403 - DNA, 22 bp, Homo sapiens
agctgtgtgcatttgggtctca

SEQ ID NO: 8481404 - DNA, 22 bp, Homo sapiens
agctgtgtgcatttgggtctca

SEQ ID NO: 8481405 - DNA, 22 bp, Homo sapiens
agctgtggcagcagccgtggca

SEQ ID NO: 8481406 - DNA, 22 bp, Homo sapiens
agctgtgtagggaatcagagaa

SEQ ID NO: 8481407 - DNA, 22 bp, Homo sapiens
agctgtgtagggaatcagagaa

SEQ ID NO: 8481408 - DNA, 22 bp, Homo sapiens
agctgtgtcatcctggaaaatg

SEQ ID NO: 8481409 - DNA, 22 bp, Homo sapiens
agctgggaagagttttctgcag

SEQ ID NO: 8481410 - DNA, 22 bp, Homo sapiens
agctgggaagagttttctgcag

SEQ ID NO: 8481411 - DNA, 22 bp, Homo sapiens
agctgggaagagttttctgcag

SEQ ID NO: 8481412 - DNA, 22 bp, Homo sapiens
agctgggacagacaactatgtt

SEQ ID NO: 8481413 - DNA, 22 bp, Homo sapiens
caggccccattcctcttgggac

SEQ ID NO: 8481414 - DNA, 23 bp, Homo sapiens
agctgggaattttctgaagcttt

SEQ ID NO: 8481415 - DNA, 23 bp, Homo sapiens
agctgggaattttctgaagcttt

SEQ ID NO: 8481416 - DNA, 23 bp, Homo sapiens
agctgggaattttctgaagcttt

SEQ ID NO: 8481417 - DNA, 22 bp, Homo sapiens
caggcctcagagagtggcgggg

SEQ ID NO: 8481418 - DNA, 22 bp, Homo sapiens
caggcctcaccagcggagctgc

SEQ ID NO: 8481419 - DNA, 22 bp, Homo sapiens
caggccggtgattctggatgta

SEQ ID NO: 8481420 - DNA, 21 bp, Homo sapiens
caggccgggtgagcaggcagc

SEQ ID NO: 8481421 - DNA, 22 bp, Homo sapiens
caggcctcaggggctcaggctg

SEQ ID NO: 8481422 - DNA, 22 bp, Homo sapiens
caggcctcaggggctcaggctg

SEQ ID NO: 8481423 - DNA, 22 bp, Homo sapiens
caggcctcaggggctcaggctg

SEQ ID NO: 8481424 - DNA, 22 bp, Homo sapiens
caggcctccactccacgcagac

SEQ ID NO: 8481425 - DNA, 22 bp, Homo sapiens
agctgttttcttctaggaagac

SEQ ID NO: 8481426 - DNA, 22 bp, Homo sapiens
agctgttttctaatgcatttga

SEQ ID NO: 8481427 - DNA, 22 bp, Homo sapiens
agctgttttcctggttagagac

SEQ ID NO: 8481428 - DNA, 22 bp, Homo sapiens
agctgtttgtacttagatagta

SEQ ID NO: 8481429 - DNA, 21 bp, Homo sapiens
agctgtttgaagctatattgg

SEQ ID NO: 8481430 - DNA, 22 bp, Homo sapiens
agctgttgttaattaactcatt

SEQ ID NO: 8481431 - DNA, 22 bp, Homo sapiens
agctgtttaaatgacttacttt

SEQ ID NO: 8481432 - DNA, 18 bp, Homo sapiens
agctgttgttgactctgt

SEQ ID NO: 8481433 - DNA, 22 bp, Homo sapiens
agctgtttaaatgacttacttt

SEQ ID NO: 8481434 - DNA, 20 bp, Homo sapiens
agctgtttacatggatttct

SEQ ID NO: 8481435 - DNA, 22 bp, Homo sapiens
agctgtgtgtttgtcatgggcg

SEQ ID NO: 8481436 - DNA, 22 bp, Homo sapiens
agctgtgtgtttgtcatgggcg

SEQ ID NO: 8481437 - DNA, 22 bp, Homo sapiens
agctgtgttaggatgttaataa

SEQ ID NO: 8481438 - DNA, 22 bp, Homo sapiens
agctgtgtgtttccactgagct

SEQ ID NO: 8481439 - DNA, 22 bp, Homo sapiens
agctgtgtgtttccactgagct

SEQ ID NO: 8481440 - DNA, 22 bp, Homo sapiens
agctgtgtgtgcttgggattat

SEQ ID NO: 8481441 - DNA, 22 bp, Homo sapiens
agctgtgtgtgaatttggccta

SEQ ID NO: 8481442 - DNA, 22 bp, Homo sapiens
agctgtgtggtttgggcaaatt

SEQ ID NO: 8481443 - DNA, 22 bp, Homo sapiens
agctgtgtggtgtctgacagct

SEQ ID NO: 8481444 - DNA, 22 bp, Homo sapiens
agctgtgtggtgtctgacagct

SEQ ID NO: 8481445 - DNA, 22 bp, Homo sapiens
agctgtgtggtgtctgacagct

SEQ ID NO: 8481446 - DNA, 22 bp, Homo sapiens
agctgtgtgccaggggagatgt

SEQ ID NO: 8481447 - DNA, 23 bp, Homo sapiens
agctgtgtggccttgggcaagtt

SEQ ID NO: 8481448 - DNA, 22 bp, Homo sapiens
agctgtgtgcccatggtggagg

SEQ ID NO: 8481449 - DNA, 23 bp, Homo sapiens
agctgtgtgcgcgtccgggttct

SEQ ID NO: 8481450 - DNA, 22 bp, Homo sapiens
agctgttggctggctgagctct

SEQ ID NO: 8481451 - DNA, 22 bp, Homo sapiens
agctgtgttattagaaacctgc

SEQ ID NO: 8481452 - DNA, 22 bp, Homo sapiens
agctgtgttctggttgattcac

SEQ ID NO: 8481453 - DNA, 22 bp, Homo sapiens
agctgtgttctggttgattcac

SEQ ID NO: 8481454 - DNA, 22 bp, Homo sapiens
agctgtgtttccagatggtagc

SEQ ID NO: 8481455 - DNA, 22 bp, Homo sapiens
agctgttccaggcctcattgct

SEQ ID NO: 8481456 - DNA, 22 bp, Homo sapiens
agctgttccctcactgcagtca

SEQ ID NO: 8481457 - DNA, 22 bp, Homo sapiens
agcttggtgttgcctgcttgag

SEQ ID NO: 8481458 - DNA, 22 bp, Homo sapiens
agcttgggtgtgcctgcgagct

SEQ ID NO: 8481459 - DNA, 18 bp, Homo sapiens
agcttgcctcaagctttt

SEQ ID NO: 8481460 - DNA, 22 bp, Homo sapiens
agcttgagttttggatgaagtg

SEQ ID NO: 8481461 - DNA, 22 bp, Homo sapiens
agcttgcctcttaatcacctca

SEQ ID NO: 8481462 - DNA, 22 bp, Homo sapiens
agcttgcctccccctcttagga

SEQ ID NO: 8481463 - DNA, 17 bp, Homo sapiens
agcttggagcagcatga

SEQ ID NO: 8481464 - DNA, 23 bp, Homo sapiens
agcttgcttttcccagtactgca

SEQ ID NO: 8481465 - DNA, 22 bp, Homo sapiens
agcttaaactctttgaagttat

SEQ ID NO: 8481466 - DNA, 22 bp, Homo sapiens
agcttacagttcaatgacaaag

SEQ ID NO: 8481467 - DNA, 22 bp, Homo sapiens
agcttacaccccccaagattct

SEQ ID NO: 8481468 - DNA, 22 bp, Homo sapiens
agcttcttaagttcctgcagca

SEQ ID NO: 8481469 - DNA, 22 bp, Homo sapiens
agcttcttttacagctcatgct

SEQ ID NO: 8481470 - DNA, 22 bp, Homo sapiens
agcttctgttcatcttccaggc

SEQ ID NO: 8481471 - DNA, 22 bp, Homo sapiens
agcttacagttcaatgacaaag

SEQ ID NO: 8481472 - DNA, 22 bp, Homo sapiens
agggagaaggtttagctgtgag

SEQ ID NO: 8481473 - DNA, 22 bp, Homo sapiens
agggagaaggtttagctgtgag

SEQ ID NO: 8481474 - DNA, 22 bp, Homo sapiens
agggagaatgaccaaggtatat

SEQ ID NO: 8481475 - DNA, 22 bp, Homo sapiens
agggagaggttgaaacctcagt

SEQ ID NO: 8481476 - DNA, 19 bp, Homo sapiens
agggaatccggctgaggga

SEQ ID NO: 8481477 - DNA, 22 bp, Homo sapiens
agggaagtgaatgacagatatc

SEQ ID NO: 8481478 - DNA, 22 bp, Homo sapiens
agggaagggcagggtctatgca

SEQ ID NO: 8481479 - DNA, 23 bp, Homo sapiens
agggaagggggcttattccacag

SEQ ID NO: 8481480 - DNA, 23 bp, Homo sapiens
agggaagggggcttattccacag

SEQ ID NO: 8481481 - DNA, 22 bp, Homo sapiens
agggaagggcagggtctatgca

SEQ ID NO: 8481482 - DNA, 22 bp, Homo sapiens
agggaagggcagggtctatgca

SEQ ID NO: 8481483 - DNA, 19 bp, Homo sapiens
agggaaggattctgtcatt

SEQ ID NO: 8481484 - DNA, 19 bp, Homo sapiens
agggaaggattctgtcatt

SEQ ID NO: 8481485 - DNA, 19 bp, Homo sapiens
agggaaggattctgtcatt

SEQ ID NO: 8481486 - DNA, 22 bp, Homo sapiens
agggaaggcttttgacatttcc

SEQ ID NO: 8481487 - DNA, 22 bp, Homo sapiens
agggaaggaggccatgtgtccc

SEQ ID NO: 8481488 - DNA, 22 bp, Homo sapiens
agggaagcttgttactgagaag

SEQ ID NO: 8481489 - DNA, 22 bp, Homo sapiens
agggaagaatcactgggatgtt

SEQ ID NO: 8481490 - DNA, 22 bp, Homo sapiens
agggaaggaaaagctgtcgctt

SEQ ID NO: 8481491 - DNA, 22 bp, Homo sapiens
agggaaggaaaagctgtcgctt

SEQ ID NO: 8481492 - DNA, 22 bp, Homo sapiens
agggaaggaggccatgtgtccc

SEQ ID NO: 8481493 - DNA, 22 bp, Homo sapiens
agggaaggaaaagctgtcgctt

SEQ ID NO: 8481494 - DNA, 22 bp, Homo sapiens
aggcttagaaattcagctgagt

SEQ ID NO: 8481495 - DNA, 22 bp, Homo sapiens
aggcttaatgagttaaatcact

SEQ ID NO: 8481496 - DNA, 22 bp, Homo sapiens
agggaagaagctggtagtaggt

SEQ ID NO: 8481497 - DNA, 22 bp, Homo sapiens
agggaagaagctggtagtaggt

SEQ ID NO: 8481498 - DNA, 22 bp, Homo sapiens
agggaggaaggaactccttcta

SEQ ID NO: 8481499 - DNA, 22 bp, Homo sapiens
agggagctttttcatgtgtcta

SEQ ID NO: 8481500 - DNA, 22 bp, Homo sapiens
ccccatggcaactgctgggggt

SEQ ID NO: 8481501 - DNA, 22 bp, Homo sapiens
ccccatgctgggatctgacacc

SEQ ID NO: 8481502 - DNA, 22 bp, Homo sapiens
ccccatcctattcatgtttctg

SEQ ID NO: 8481503 - DNA, 22 bp, Homo sapiens
ccccagggtcagtgtgtggagg

SEQ ID NO: 8481504 - DNA, 22 bp, Homo sapiens
ccccagggtcagtgtgtggagg

SEQ ID NO: 8481505 - DNA, 22 bp, Homo sapiens
ccccaggtggatggctcgcata

SEQ ID NO: 8481506 - DNA, 19 bp, Homo sapiens
ccccagggtaggctagggg

SEQ ID NO: 8481507 - DNA, 19 bp, Homo sapiens
ccccagggtaggctagggg

SEQ ID NO: 8481508 - DNA, 19 bp, Homo sapiens
ccccagggtaggctagggg

SEQ ID NO: 8481509 - DNA, 19 bp, Homo sapiens
ccccagggtaggctagggg

SEQ ID NO: 8481510 - DNA, 22 bp, Homo sapiens
ccccagggactggtttcatgga

SEQ ID NO: 8481511 - DNA, 22 bp, Homo sapiens
ccccagggaagctttgcttact

SEQ ID NO: 8481512 - DNA, 19 bp, Homo sapiens
ccccagggtaggctagggg

SEQ ID NO: 8481513 - DNA, 22 bp, Homo sapiens
ccccagcagactcagggcaggt

SEQ ID NO: 8481514 - DNA, 22 bp, Homo sapiens
ccccagcagactcagggcaggt

SEQ ID NO: 8481515 - DNA, 22 bp, Homo sapiens
agggagcagcagccacaggatg

SEQ ID NO: 8481516 - DNA, 22 bp, Homo sapiens
agggagcagcagccacaggatg

SEQ ID NO: 8481517 - DNA, 22 bp, Homo sapiens
agggagcagcagccacaggatg

SEQ ID NO: 8481518 - DNA, 22 bp, Homo sapiens
agggagcagcagccacaggatg

SEQ ID NO: 8481519 - DNA, 22 bp, Homo sapiens
agggagcagcagccacaggatg

SEQ ID NO: 8481520 - DNA, 22 bp, Homo sapiens
agggagcagcagccacaggatg

SEQ ID NO: 8481521 - DNA, 22 bp, Homo sapiens
agggagcagggctcctttgggt

SEQ ID NO: 8481522 - DNA, 22 bp, Homo sapiens
agggagcagggctcctttgggt

SEQ ID NO: 8481523 - DNA, 18 bp, Homo sapiens
agggagcatctggttgcc

SEQ ID NO: 8481524 - DNA, 18 bp, Homo sapiens
agggagcatctggttgcc

SEQ ID NO: 8481525 - DNA, 22 bp, Homo sapiens
agggagagtttgatgtttcctc

SEQ ID NO: 8481526 - DNA, 23 bp, Homo sapiens
agggagatgccacaaagatgccc

SEQ ID NO: 8481527 - DNA, 22 bp, Homo sapiens
agggagccaggaacgcaggtcg

SEQ ID NO: 8481528 - DNA, 22 bp, Homo sapiens
agggagccagagttgggagctc

SEQ ID NO: 8481529 - DNA, 22 bp, Homo sapiens
agggagccagagttgggagctc

SEQ ID NO: 8481530 - DNA, 22 bp, Homo sapiens
agggagccagagttgggagctc

SEQ ID NO: 8481531 - DNA, 21 bp, Homo sapiens
agggagcatgttagctttcga

SEQ ID NO: 8481532 - DNA, 22 bp, Homo sapiens
agggagcatgggtgaagcaggc

SEQ ID NO: 8481533 - DNA, 21 bp, Homo sapiens
agggagcatgttagctttcga

SEQ ID NO: 8481534 - DNA, 22 bp, Homo sapiens
agggagcattgtgacatatcac

SEQ ID NO: 8481535 - DNA, 22 bp, Homo sapiens
agggagccagagttgggagctc

SEQ ID NO: 8481536 - DNA, 22 bp, Homo sapiens
agggagcatgggtgaagcaggc

SEQ ID NO: 8481537 - DNA, 22 bp, Homo sapiens
agggagcatgggtgaagcaggc

SEQ ID NO: 8481538 - DNA, 22 bp, Homo sapiens
agggagcatgggtgaagcaggc

SEQ ID NO: 8481539 - DNA, 22 bp, Homo sapiens
agggagcatgggtgaagcaggc

SEQ ID NO: 8481540 - DNA, 22 bp, Homo sapiens
cccagcatcctcagggagcggg

SEQ ID NO: 8481541 - DNA, 22 bp, Homo sapiens
cccagcatcctcagggagcggg

SEQ ID NO: 8481542 - DNA, 22 bp, Homo sapiens
cccagcatcccagtgggcagca

SEQ ID NO: 8481543 - DNA, 22 bp, Homo sapiens
cccagcatcccagtgggcagca

SEQ ID NO: 8481544 - DNA, 22 bp, Homo sapiens
cccagcatcccagtgggcagca

SEQ ID NO: 8481545 - DNA, 22 bp, Homo sapiens
cccagcatcccagtgggcagca

SEQ ID NO: 8481546 - DNA, 22 bp, Homo sapiens
cccagcatctccaggcatggcc

SEQ ID NO: 8481547 - DNA, 22 bp, Homo sapiens
cccagcctcagctttacttcca

SEQ ID NO: 8481548 - DNA, 22 bp, Homo sapiens
cccagcctcagctttacttcca

SEQ ID NO: 8481549 - DNA, 22 bp, Homo sapiens
cccagcagtggttctcaaactt

SEQ ID NO: 8481550 - DNA, 22 bp, Homo sapiens
cccagcagtggttctcaaactt

SEQ ID NO: 8481551 - DNA, 22 bp, Homo sapiens
cccagcagttgttggtgcacat

SEQ ID NO: 8481552 - DNA, 22 bp, Homo sapiens
cccagcagttgttggtgcacat

SEQ ID NO: 8481553 - DNA, 22 bp, Homo sapiens
cccagcagttgttggtgcacat

SEQ ID NO: 8481554 - DNA, 22 bp, Homo sapiens
cccagcagttgttggtgcacat

SEQ ID NO: 8481555 - DNA, 22 bp, Homo sapiens
cccagcagtttgcttagagtga

SEQ ID NO: 8481556 - DNA, 22 bp, Homo sapiens
cccagcagtgacccagtgatac

SEQ ID NO: 8481557 - DNA, 22 bp, Homo sapiens
cccagcagtacccaagcccttg

SEQ ID NO: 8481558 - DNA, 22 bp, Homo sapiens
cccagcagtacccaagcccttg

SEQ ID NO: 8481559 - DNA, 22 bp, Homo sapiens
cccagcagtagagctcatatgg

SEQ ID NO: 8481560 - DNA, 22 bp, Homo sapiens
cccagcagtaaccagtggaaat

SEQ ID NO: 8481561 - DNA, 22 bp, Homo sapiens
cccagcagtacccaagcccttg

SEQ ID NO: 8481562 - DNA, 22 bp, Homo sapiens
cccagcacaggcaattccatac

SEQ ID NO: 8481563 - DNA, 22 bp, Homo sapiens
ccatgaattcactccatgctag

SEQ ID NO: 8481564 - DNA, 22 bp, Homo sapiens
ccatgagtagcgatttcatttt

SEQ ID NO: 8481565 - DNA, 22 bp, Homo sapiens
ccatctccactgtccctgtcaa

SEQ ID NO: 8481566 - DNA, 22 bp, Homo sapiens
ccatcctgtctgtggcctcagg

SEQ ID NO: 8481567 - DNA, 21 bp, Homo sapiens
ccataatcttaggatcaaaat

SEQ ID NO: 8481568 - DNA, 21 bp, Homo sapiens
ccataattttgtttcagaagt

SEQ ID NO: 8481569 - DNA, 21 bp, Homo sapiens
ccataattttgtttcagaagt

SEQ ID NO: 8481570 - DNA, 22 bp, Homo sapiens
ccatcctgtctgtggcctcagg

SEQ ID NO: 8481571 - DNA, 22 bp, Homo sapiens
ccatcctgtctgtggcctcagg

SEQ ID NO: 8481572 - DNA, 22 bp, Homo sapiens
ccagtttttccagtgctttctg

SEQ ID NO: 8481573 - DNA, 22 bp, Homo sapiens
cccagcctgatctcggccagct

SEQ ID NO: 8481574 - DNA, 22 bp, Homo sapiens
cccagcctggtgcactgtgggg

SEQ ID NO: 8481575 - DNA, 22 bp, Homo sapiens
cccagcctgatctcggccagct

SEQ ID NO: 8481576 - DNA, 22 bp, Homo sapiens
cccagcctgatctcggccagct

SEQ ID NO: 8481577 - DNA, 22 bp, Homo sapiens
cccagcctggtgcactgtgggg

SEQ ID NO: 8481578 - DNA, 22 bp, Homo sapiens
cccagctccttggatgggcagg

SEQ ID NO: 8481579 - DNA, 22 bp, Homo sapiens
cccagctccttggatgggcagg

SEQ ID NO: 8481580 - DNA, 22 bp, Homo sapiens
cccagctccttggatgggcagg

SEQ ID NO: 8481581 - DNA, 22 bp, Homo sapiens
cccagctccttggatgggcagg

SEQ ID NO: 8481582 - DNA, 22 bp, Homo sapiens
cccagctccttgtttgcatctc

SEQ ID NO: 8481583 - DNA, 22 bp, Homo sapiens
cccagctccttgtttgcatctc

SEQ ID NO: 8481584 - DNA, 22 bp, Homo sapiens
cccagctccttgtttgcatctc

SEQ ID NO: 8481585 - DNA, 22 bp, Homo sapiens
cccagctcgccgccgatgtgcg

SEQ ID NO: 8481586 - DNA, 22 bp, Homo sapiens
cccagctctaggagtggtggca

SEQ ID NO: 8481587 - DNA, 22 bp, Homo sapiens
cccagctctaggagtggtggca

SEQ ID NO: 8481588 - DNA, 22 bp, Homo sapiens
cccagctcgccgccgatgtgcg

SEQ ID NO: 8481589 - DNA, 22 bp, Homo sapiens
cccagcctctgggttctgccgg

SEQ ID NO: 8481590 - DNA, 22 bp, Homo sapiens
cccagcctctgggttctgccgg

SEQ ID NO: 8481591 - DNA, 22 bp, Homo sapiens
cccagcctctgggctcacccaa

SEQ ID NO: 8481592 - DNA, 22 bp, Homo sapiens
cccagcctctgtttgctcctct

SEQ ID NO: 8481593 - DNA, 22 bp, Homo sapiens
cccagcctctgtttgctcctct

SEQ ID NO: 8481594 - DNA, 22 bp, Homo sapiens
cccagcctctgtttgctcctct

SEQ ID NO: 8481595 - DNA, 22 bp, Homo sapiens
cccagcctctgtttgctcctct

SEQ ID NO: 8481596 - DNA, 22 bp, Homo sapiens
cccagcctctggattctgccct

SEQ ID NO: 8481597 - DNA, 22 bp, Homo sapiens
cccagcctctgggctcacccaa

SEQ ID NO: 8481598 - DNA, 22 bp, Homo sapiens
cccagcctctgggctcacccaa

SEQ ID NO: 8481599 - DNA, 22 bp, Homo sapiens
cccagcctctggattctgccct

SEQ ID NO: 8481600 - DNA, 18 bp, Homo sapiens
cccagcctctcctttcta

SEQ ID NO: 8481601 - DNA, 22 bp, Homo sapiens
cccagctctgcagacctgccct

SEQ ID NO: 8481602 - DNA, 22 bp, Homo sapiens
cccagctctgcagacctgccct

SEQ ID NO: 8481603 - DNA, 22 bp, Homo sapiens
cccagctctgcagacctgccct

SEQ ID NO: 8481604 - DNA, 22 bp, Homo sapiens
cccagctctgccatctacccac

SEQ ID NO: 8481605 - DNA, 22 bp, Homo sapiens
cccagctctgcagacctgccct

SEQ ID NO: 8481606 - DNA, 22 bp, Homo sapiens
cccagctctgccatctacccac

SEQ ID NO: 8481607 - DNA, 22 bp, Homo sapiens
cccagctctggaaggtggggga

SEQ ID NO: 8481608 - DNA, 22 bp, Homo sapiens
cccagctctgccatctacccac

SEQ ID NO: 8481609 - DNA, 22 bp, Homo sapiens
cccagctctggaaggtggggga

SEQ ID NO: 8481610 - DNA, 22 bp, Homo sapiens
aggctgtggtgggctttgagcc

SEQ ID NO: 8481611 - DNA, 22 bp, Homo sapiens
cccagctctcgcacttactagc

SEQ ID NO: 8481612 - DNA, 19 bp, Homo sapiens
cccagctctcgtggtgtgc

SEQ ID NO: 8481613 - DNA, 19 bp, Homo sapiens
cccagctctcgtggtgtgc

SEQ ID NO: 8481614 - DNA, 22 bp, Homo sapiens
cccagctctctcagttctgctt

SEQ ID NO: 8481615 - DNA, 22 bp, Homo sapiens
cccagctctcgcacttactagc

SEQ ID NO: 8481616 - DNA, 22 bp, Homo sapiens
cccagctctcgcacttactagc

SEQ ID NO: 8481617 - DNA, 22 bp, Homo sapiens
cccagctctctgctcttagcct

SEQ ID NO: 8481618 - DNA, 22 bp, Homo sapiens
cccagctctctgctcttagcct

SEQ ID NO: 8481619 - DNA, 22 bp, Homo sapiens
cccagctctctcagttctgctt

SEQ ID NO: 8481620 - DNA, 22 bp, Homo sapiens
cccagctctctcagttctgctt

SEQ ID NO: 8481621 - DNA, 22 bp, Homo sapiens
cccagctctctgctcttagcct

SEQ ID NO: 8481622 - DNA, 22 bp, Homo sapiens
aggctgtgtttcccctggagct

SEQ ID NO: 8481623 - DNA, 22 bp, Homo sapiens
aggctgtgtttcccctggagct

SEQ ID NO: 8481624 - DNA, 22 bp, Homo sapiens
aggctgtgtttcccctggagct

SEQ ID NO: 8481625 - DNA, 22 bp, Homo sapiens
aggctgtgtttcttgcgttttc

SEQ ID NO: 8481626 - DNA, 22 bp, Homo sapiens
aggcttaaatgctcatatcagt

SEQ ID NO: 8481627 - DNA, 22 bp, Homo sapiens
aggcttaatgagttaaatcact

SEQ ID NO: 8481628 - DNA, 22 bp, Homo sapiens
aggctgtgtttaagtggtaatg

SEQ ID NO: 8481629 - DNA, 22 bp, Homo sapiens
aggctgtgtttaagtggtaatg

SEQ ID NO: 8481630 - DNA, 22 bp, Homo sapiens
aggctgtgttctggttcttagc

SEQ ID NO: 8481631 - DNA, 22 bp, Homo sapiens
aggctgtgttctgccctctccc

SEQ ID NO: 8481632 - DNA, 22 bp, Homo sapiens
aggctgtgtggtcatggtggct

SEQ ID NO: 8481633 - DNA, 22 bp, Homo sapiens
aggctgtgtggtcatggtggct

SEQ ID NO: 8481634 - DNA, 22 bp, Homo sapiens
aggctgtgtggatgagtcttac

SEQ ID NO: 8481635 - DNA, 22 bp, Homo sapiens
aggctgtgtaaagtgctttccc

SEQ ID NO: 8481636 - DNA, 22 bp, Homo sapiens
aggctgtgtcctcattttatat

SEQ ID NO: 8481637 - DNA, 22 bp, Homo sapiens
aggctgtgtggataatattggg

SEQ ID NO: 8481638 - DNA, 22 bp, Homo sapiens
aggctgtgtgctccttatgaga

SEQ ID NO: 8481639 - DNA, 22 bp, Homo sapiens
agggccaggctcccatgtcagg

SEQ ID NO: 8481640 - DNA, 19 bp, Homo sapiens
agggccaggattctggaac

SEQ ID NO: 8481641 - DNA, 19 bp, Homo sapiens
agggccaggattctggaac

SEQ ID NO: 8481642 - DNA, 22 bp, Homo sapiens
agggccaggatcacagccaaga

SEQ ID NO: 8481643 - DNA, 22 bp, Homo sapiens
agggccaggatcacagccaaga

SEQ ID NO: 8481644 - DNA, 18 bp, Homo sapiens
agggccagctgtgagtag

SEQ ID NO: 8481645 - DNA, 22 bp, Homo sapiens
agggccaggaacacctgaaggg

SEQ ID NO: 8481646 - DNA, 18 bp, Homo sapiens
agggccagctgtgagtag

SEQ ID NO: 8481647 - DNA, 22 bp, Homo sapiens
agggccaggaacacctgaaggg

SEQ ID NO: 8481648 - DNA, 22 bp, Homo sapiens
agggccaggaacacctgaaggg

SEQ ID NO: 8481649 - DNA, 22 bp, Homo sapiens
agggccaggaacacctgaaggg

SEQ ID NO: 8481650 - DNA, 22 bp, Homo sapiens
agggccaggaacacctgaaggg

SEQ ID NO: 8481651 - DNA, 22 bp, Homo sapiens
agggccagctgatgagaatgag

SEQ ID NO: 8481652 - DNA, 22 bp, Homo sapiens
agggccagctgatgagaatgag

SEQ ID NO: 8481653 - DNA, 22 bp, Homo sapiens
agggccagctgatgagaatgag

SEQ ID NO: 8481654 - DNA, 22 bp, Homo sapiens
agggccagctgcagaattagca

SEQ ID NO: 8481655 - DNA, 22 bp, Homo sapiens
agggccagctgatgagaatgag

SEQ ID NO: 8481656 - DNA, 22 bp, Homo sapiens
agggccagctgatgagaatgag

SEQ ID NO: 8481657 - DNA, 22 bp, Homo sapiens
agggccagccgacttccagcct

SEQ ID NO: 8481658 - DNA, 22 bp, Homo sapiens
agggccagctagagccctcgcc

SEQ ID NO: 8481659 - DNA, 22 bp, Homo sapiens
agggccagccgacttccagcct

SEQ ID NO: 8481660 - DNA, 22 bp, Homo sapiens
agggccagctagagccctcgcc

SEQ ID NO: 8481661 - DNA, 22 bp, Homo sapiens
agggccagctagagccctcgcc

SEQ ID NO: 8481662 - DNA, 22 bp, Homo sapiens
agggccagctagagccctcgcc

SEQ ID NO: 8481663 - DNA, 22 bp, Homo sapiens
ccctgggattgccttggccttg

SEQ ID NO: 8481664 - DNA, 22 bp, Homo sapiens
ccctgggattgccttggccttg

SEQ ID NO: 8481665 - DNA, 22 bp, Homo sapiens
ccctgggcaagccctattttcc

SEQ ID NO: 8481666 - DNA, 22 bp, Homo sapiens
ccctgggcagtctgcacttcag

SEQ ID NO: 8481667 - DNA, 22 bp, Homo sapiens
ccctgggctcagagcaggtagc

SEQ ID NO: 8481668 - DNA, 22 bp, Homo sapiens
ccctgggctcagagcaggtagc

SEQ ID NO: 8481669 - DNA, 22 bp, Homo sapiens
ccctgggctcagagcaggtagc

SEQ ID NO: 8481670 - DNA, 22 bp, Homo sapiens
ccctggggagcaggcgaaggag

SEQ ID NO: 8481671 - DNA, 22 bp, Homo sapiens
ccctggggagcaggcgaaggag

SEQ ID NO: 8481672 - DNA, 22 bp, Homo sapiens
agggccagggaaacgatcagca

SEQ ID NO: 8481673 - DNA, 22 bp, Homo sapiens
agggccagggaagctgtatttt

SEQ ID NO: 8481674 - DNA, 22 bp, Homo sapiens
ccctgggatggattggcaggaa

SEQ ID NO: 8481675 - DNA, 22 bp, Homo sapiens
ccctggcccctcactccgaggc

SEQ ID NO: 8481676 - DNA, 22 bp, Homo sapiens
ccctgggatggattggcaggaa

SEQ ID NO: 8481677 - DNA, 22 bp, Homo sapiens
agggccagagtctgtgtagata

SEQ ID NO: 8481678 - DNA, 22 bp, Homo sapiens
agggccagagtctgtgtagata

SEQ ID NO: 8481679 - DNA, 22 bp, Homo sapiens
agggccagagtggcaaaagcct

SEQ ID NO: 8481680 - DNA, 21 bp, Homo sapiens
agggccagatcaccaaggagc

SEQ ID NO: 8481681 - DNA, 22 bp, Homo sapiens
agggcagctctcacctctggcc

SEQ ID NO: 8481682 - DNA, 22 bp, Homo sapiens
agggcagctggaaggtggcttc

SEQ ID NO: 8481683 - DNA, 22 bp, Homo sapiens
agggcagcctctcagcctaggt

SEQ ID NO: 8481684 - DNA, 22 bp, Homo sapiens
agggcagcctgagtgctggccc

SEQ ID NO: 8481685 - DNA, 22 bp, Homo sapiens
agggcagctaaggtgctgactg

SEQ ID NO: 8481686 - DNA, 22 bp, Homo sapiens
agggcagcggtgcttgtgttat

SEQ ID NO: 8481687 - DNA, 22 bp, Homo sapiens
agggcagctctcacctctggcc

SEQ ID NO: 8481688 - DNA, 22 bp, Homo sapiens
agggcagctctcacctctggcc

SEQ ID NO: 8481689 - DNA, 22 bp, Homo sapiens
agggaggaccaatgtgtggtta

SEQ ID NO: 8481690 - DNA, 22 bp, Homo sapiens
agggaggaccaatgtgtggtta

SEQ ID NO: 8481691 - DNA, 22 bp, Homo sapiens
agggaggaccaatgtgtggtta

SEQ ID NO: 8481692 - DNA, 22 bp, Homo sapiens
agggaggaaggatgttccaaag

SEQ ID NO: 8481693 - DNA, 22 bp, Homo sapiens
agggaggaaggatgttccaaag

SEQ ID NO: 8481694 - DNA, 22 bp, Homo sapiens
agggaggaaggatgttccaaag

SEQ ID NO: 8481695 - DNA, 22 bp, Homo sapiens
agggaggagaatggactccttc

SEQ ID NO: 8481696 - DNA, 22 bp, Homo sapiens
agggaggagaatggactccttc

SEQ ID NO: 8481697 - DNA, 22 bp, Homo sapiens
agggaggagtcctcaaagtcat

SEQ ID NO: 8481698 - DNA, 22 bp, Homo sapiens
agggaggagtcctcaaagtcat

SEQ ID NO: 8481699 - DNA, 22 bp, Homo sapiens
agggcagagggtgcctcacctg

SEQ ID NO: 8481700 - DNA, 22 bp, Homo sapiens
agggcagagggtgcctcacctg

SEQ ID NO: 8481701 - DNA, 22 bp, Homo sapiens
agggcagcattgcctttctcca

SEQ ID NO: 8481702 - DNA, 22 bp, Homo sapiens
agggcagcattgcctttctcca

SEQ ID NO: 8481703 - DNA, 22 bp, Homo sapiens
agggcagcattgcctttctcca

SEQ ID NO: 8481704 - DNA, 22 bp, Homo sapiens
agggcagcattgcctttctcca

SEQ ID NO: 8481705 - DNA, 22 bp, Homo sapiens
agggcagatggaacttccccga

SEQ ID NO: 8481706 - DNA, 22 bp, Homo sapiens
agggcagcagctcctcctagct

SEQ ID NO: 8481707 - DNA, 22 bp, Homo sapiens
agggcagccattgagggattct

SEQ ID NO: 8481708 - DNA, 22 bp, Homo sapiens
agggcagccattgagggattct

SEQ ID NO: 8481709 - DNA, 22 bp, Homo sapiens
agggcagccattgagggattct

SEQ ID NO: 8481710 - DNA, 22 bp, Homo sapiens
agggcagcccttctgggagggc

SEQ ID NO: 8481711 - DNA, 22 bp, Homo sapiens
agggcagccatgagccttcagg

SEQ ID NO: 8481712 - DNA, 22 bp, Homo sapiens
agggcagccatgagccttcagg

SEQ ID NO: 8481713 - DNA, 22 bp, Homo sapiens
agggcagccatgagccttcagg

SEQ ID NO: 8481714 - DNA, 22 bp, Homo sapiens
cctcaaattggcattaattaag

SEQ ID NO: 8481715 - DNA, 20 bp, Homo sapiens
cctcaagcagactgacagct

SEQ ID NO: 8481716 - DNA, 22 bp, Homo sapiens
cctcaagtcaattctgtctcgc

SEQ ID NO: 8481717 - DNA, 22 bp, Homo sapiens
cctcacacagttatctcttcat

SEQ ID NO: 8481718 - DNA, 22 bp, Homo sapiens
cctcacacagttatctcttcat

SEQ ID NO: 8481719 - DNA, 18 bp, Homo sapiens
cctcacagacttccatgt

SEQ ID NO: 8481720 - DNA, 22 bp, Homo sapiens
cctcagaatagtcctcagatca

SEQ ID NO: 8481721 - DNA, 22 bp, Homo sapiens
cctcagacccctgctgagcttc

SEQ ID NO: 8481722 - DNA, 22 bp, Homo sapiens
cctcagagaaatgtctattcaa

SEQ ID NO: 8481723 - DNA, 22 bp, Homo sapiens
cctcagagacagtaactggaat

SEQ ID NO: 8481724 - DNA, 22 bp, Homo sapiens
cctcagagaaaggtatggctga

SEQ ID NO: 8481725 - DNA, 22 bp, Homo sapiens
cctcagagactgcatcttccct

SEQ ID NO: 8481726 - DNA, 22 bp, Homo sapiens
cctcagagcagcacccagatga

SEQ ID NO: 8481727 - DNA, 22 bp, Homo sapiens
cctcagagcctccagaaggaat

SEQ ID NO: 8481728 - DNA, 22 bp, Homo sapiens
ccctgtgtcttcttgcctttgt

SEQ ID NO: 8481729 - DNA, 21 bp, Homo sapiens
ccctgtgttccacagcagaca

SEQ ID NO: 8481730 - DNA, 22 bp, Homo sapiens
ccctgttaatgtcaacctgcct

SEQ ID NO: 8481731 - DNA, 22 bp, Homo sapiens
ccctgttgggaagagagatggc

SEQ ID NO: 8481732 - DNA, 21 bp, Homo sapiens
ccctgtgttccacagcagaca

SEQ ID NO: 8481733 - DNA, 22 bp, Homo sapiens
ccctgggttctggctgggctgc

SEQ ID NO: 8481734 - DNA, 22 bp, Homo sapiens
ccctgggttctggctgggctgc

SEQ ID NO: 8481735 - DNA, 22 bp, Homo sapiens
ccctggggctgagggatggccg

SEQ ID NO: 8481736 - DNA, 22 bp, Homo sapiens
ccctggggctgagggatggccg

SEQ ID NO: 8481737 - DNA, 22 bp, Homo sapiens
ccctggggctgagggatggccg

SEQ ID NO: 8481738 - DNA, 22 bp, Homo sapiens
ccctggggctgagggatggccg

SEQ ID NO: 8481739 - DNA, 19 bp, Homo sapiens
ccctgggggtttctggtac

SEQ ID NO: 8481740 - DNA, 22 bp, Homo sapiens
cccttcagctgagtgggacagc

SEQ ID NO: 8481741 - DNA, 22 bp, Homo sapiens
cccttcagctgagtgggacagc

SEQ ID NO: 8481742 - DNA, 22 bp, Homo sapiens
cccttcagggttaagtagaggg

SEQ ID NO: 8481743 - DNA, 23 bp, Homo sapiens
cccttcagcgagggcattaaggt

SEQ ID NO: 8481744 - DNA, 22 bp, Homo sapiens
cccttagctcaatttcttgccc

SEQ ID NO: 8481745 - DNA, 22 bp, Homo sapiens
cccttagctccaaggggtttgg

SEQ ID NO: 8481746 - DNA, 22 bp, Homo sapiens
cctcaaaggcctggcaccagaa

SEQ ID NO: 8481747 - DNA, 22 bp, Homo sapiens
cccttcagtgcgtgagaatgag

SEQ ID NO: 8481748 - DNA, 22 bp, Homo sapiens
cctccccacccacggctggtgg

SEQ ID NO: 8481749 - DNA, 22 bp, Homo sapiens
cctccccacccacggctggtgg

SEQ ID NO: 8481750 - DNA, 22 bp, Homo sapiens
cctcgcggcactcgggccggat

SEQ ID NO: 8481751 - DNA, 22 bp, Homo sapiens
cctctccttgcacccgtcccgc

SEQ ID NO: 8481752 - DNA, 22 bp, Homo sapiens
cctctctccaagggaaatccta

SEQ ID NO: 8481753 - DNA, 21 bp, Homo sapiens
cctctctcattgtaatgaagt

SEQ ID NO: 8481754 - DNA, 22 bp, Homo sapiens
cctctccttgcacccgtcccgc

SEQ ID NO: 8481755 - DNA, 22 bp, Homo sapiens
cctctctcagcttgctgcaact

SEQ ID NO: 8481756 - DNA, 22 bp, Homo sapiens
cctcccagtgcctccagagcag

SEQ ID NO: 8481757 - DNA, 22 bp, Homo sapiens
cctcccagtgcctccagagcag

SEQ ID NO: 8481758 - DNA, 22 bp, Homo sapiens
cctcccagtgccggggccggct

SEQ ID NO: 8481759 - DNA, 22 bp, Homo sapiens
cctcccagtgcctccagagcag

SEQ ID NO: 8481760 - DNA, 22 bp, Homo sapiens
cctcccagtgcctccagagcag

SEQ ID NO: 8481761 - DNA, 22 bp, Homo sapiens
cctcccatggagctctgtccat

SEQ ID NO: 8481762 - DNA, 22 bp, Homo sapiens
cctccccacagcccaggagact

SEQ ID NO: 8481763 - DNA, 22 bp, Homo sapiens
cctccccacagcccaggagact

SEQ ID NO: 8481764 - DNA, 23 bp, Homo sapiens
cctccccaccagactctaacata

SEQ ID NO: 8481765 - DNA, 22 bp, Homo sapiens
cctccccacagcccaggagact

SEQ ID NO: 8481766 - DNA, 20 bp, Homo sapiens
cctccaggcacacccatgtg

SEQ ID NO: 8481767 - DNA, 20 bp, Homo sapiens
cctccaggcacacccatgtg

SEQ ID NO: 8481768 - DNA, 20 bp, Homo sapiens
cctccaggcacacccatgtg

SEQ ID NO: 8481769 - DNA, 20 bp, Homo sapiens
cctccaggcacacccatgtg

SEQ ID NO: 8481770 - DNA, 20 bp, Homo sapiens
cctccaggcacacccatgtg

SEQ ID NO: 8481771 - DNA, 22 bp, Homo sapiens
cctccaggataagtcagggcct

SEQ ID NO: 8481772 - DNA, 22 bp, Homo sapiens
cctccaggataagtcagggcct

SEQ ID NO: 8481773 - DNA, 22 bp, Homo sapiens
cctccaggataagtcagggcct

SEQ ID NO: 8481774 - DNA, 22 bp, Homo sapiens
cctccaggataagtcagggcct

SEQ ID NO: 8481775 - DNA, 22 bp, Homo sapiens
cctccaggataagtcagggcct

SEQ ID NO: 8481776 - DNA, 23 bp, Homo sapiens
cctcccaggctgcgagtcccgag

SEQ ID NO: 8481777 - DNA, 23 bp, Homo sapiens
cctcccaggctgcgagtcccgag

SEQ ID NO: 8481778 - DNA, 22 bp, Homo sapiens
cctccaggctgaatatctagaa

SEQ ID NO: 8481779 - DNA, 22 bp, Homo sapiens
cctccaggccttgcaggttaac

SEQ ID NO: 8481780 - DNA, 22 bp, Homo sapiens
cctccaggccttgcaggttaac

SEQ ID NO: 8481781 - DNA, 22 bp, Homo sapiens
cctccaggctgaatatctagaa

SEQ ID NO: 8481782 - DNA, 22 bp, Homo sapiens
cctccaggctgaatatctagaa

SEQ ID NO: 8481783 - DNA, 22 bp, Homo sapiens
cctccaggccttgcaggttaac

SEQ ID NO: 8481784 - DNA, 22 bp, Homo sapiens
cctcagtgacctattgcattca

SEQ ID NO: 8481785 - DNA, 22 bp, Homo sapiens
cctcagtcttgaattagccaga

SEQ ID NO: 8481786 - DNA, 22 bp, Homo sapiens
cctccagctgcctcagtctctt

SEQ ID NO: 8481787 - DNA, 22 bp, Homo sapiens
cctccaggaacttgagagacac

SEQ ID NO: 8481788 - DNA, 22 bp, Homo sapiens
cctccaggaacttgagagacac

SEQ ID NO: 8481789 - DNA, 22 bp, Homo sapiens
cctccaggaacttgagagacac

SEQ ID NO: 8481790 - DNA, 22 bp, Homo sapiens
cctccaggaacttgagagacac

SEQ ID NO: 8481791 - DNA, 21 bp, Homo sapiens
cctccaggagcagagccctga

SEQ ID NO: 8481792 - DNA, 22 bp, Homo sapiens
cctccaggaggaaatggaacac

SEQ ID NO: 8481793 - DNA, 22 bp, Homo sapiens
cctccaggaggaaatggaacac

SEQ ID NO: 8481794 - DNA, 22 bp, Homo sapiens
cctccaggaacttgagagacac

SEQ ID NO: 8481795 - DNA, 21 bp, Homo sapiens
cctccaggagcagagccctga

SEQ ID NO: 8481796 - DNA, 21 bp, Homo sapiens
cctccaggagcagagccctga

SEQ ID NO: 8481797 - DNA, 21 bp, Homo sapiens
cctccaggagcagagccctga

SEQ ID NO: 8481798 - DNA, 21 bp, Homo sapiens
cctccaggagcagagccctga

SEQ ID NO: 8481799 - DNA, 22 bp, Homo sapiens
ccagttctaaacataaagctaa

SEQ ID NO: 8481800 - DNA, 22 bp, Homo sapiens
ccagttctgagatgaatatcca

SEQ ID NO: 8481801 - DNA, 22 bp, Homo sapiens
ccagttctttctgtgtgcaaca

SEQ ID NO: 8481802 - DNA, 22 bp, Homo sapiens
ccagttggtttcaatgggacag

SEQ ID NO: 8481803 - DNA, 22 bp, Homo sapiens
ccagtttaggtactaggctcta

SEQ ID NO: 8481804 - DNA, 22 bp, Homo sapiens
ccagtttaagacttatctcaat

SEQ ID NO: 8481805 - DNA, 22 bp, Homo sapiens
ccagtttataagaaagaaaacc

SEQ ID NO: 8481806 - DNA, 22 bp, Homo sapiens
ccagtgtgccaatttacagctg

SEQ ID NO: 8481807 - DNA, 22 bp, Homo sapiens
ccagttatccagcatgctgtct

SEQ ID NO: 8481808 - DNA, 22 bp, Homo sapiens
aggctgaggcgggaggatcact

SEQ ID NO: 8481809 - DNA, 22 bp, Homo sapiens
ccagtgtgcattatcatgtgtc

SEQ ID NO: 8481810 - DNA, 22 bp, Homo sapiens
ccagtgtgcattatcatgtgtc

SEQ ID NO: 8481811 - DNA, 22 bp, Homo sapiens
ccagtgcaccatttccctctgt

SEQ ID NO: 8481812 - DNA, 22 bp, Homo sapiens
ccagtgcaccaagaggcctaga

SEQ ID NO: 8481813 - DNA, 22 bp, Homo sapiens
aggctgaggcaggtggatcact

SEQ ID NO: 8481814 - DNA, 22 bp, Homo sapiens
aggctgaggcaggtggatcact

SEQ ID NO: 8481815 - DNA, 22 bp, Homo sapiens
aggctgaggcaggtggatcact

SEQ ID NO: 8481816 - DNA, 22 bp, Homo sapiens
aggctgaggcaggtggatcatt

SEQ ID NO: 8481817 - DNA, 22 bp, Homo sapiens
aggctgaggcaggtggatcatt

SEQ ID NO: 8481818 - DNA, 22 bp, Homo sapiens
aggctgaggcaggtggatcatt

SEQ ID NO: 8481819 - DNA, 22 bp, Homo sapiens
aggctgaggcgggaggatcact

SEQ ID NO: 8481820 - DNA, 22 bp, Homo sapiens
ccagtctggcaggagggggaac

SEQ ID NO: 8481821 - DNA, 22 bp, Homo sapiens
ccagtctgtactttgctctgtt

SEQ ID NO: 8481822 - DNA, 22 bp, Homo sapiens
ccagtctgtactttgctctgtt

SEQ ID NO: 8481823 - DNA, 22 bp, Homo sapiens
ccagtcactctgtgagagctac

SEQ ID NO: 8481824 - DNA, 23 bp, Homo sapiens
aggctgagctctcccagcttcag

SEQ ID NO: 8481825 - DNA, 23 bp, Homo sapiens
aggctgagctctcccagcttcag

SEQ ID NO: 8481826 - DNA, 22 bp, Homo sapiens
aggctgagcggggtcccagagc

SEQ ID NO: 8481827 - DNA, 22 bp, Homo sapiens
aggctgagcggggtcccagagc

SEQ ID NO: 8481828 - DNA, 22 bp, Homo sapiens
aggctgagcctgggcgtggtgg

SEQ ID NO: 8481829 - DNA, 22 bp, Homo sapiens
aggctgagcctgggcgtggtgg

SEQ ID NO: 8481830 - DNA, 22 bp, Homo sapiens
ccagtgcacagccaggcaggtg

SEQ ID NO: 8481831 - DNA, 23 bp, Homo sapiens
ccagtgattgcctggaaggaggt

SEQ ID NO: 8481832 - DNA, 23 bp, Homo sapiens
ccagtgattgcctggaaggaggt

SEQ ID NO: 8481833 - DNA, 23 bp, Homo sapiens
ccagtgattgcctggaaggaggt

SEQ ID NO: 8481834 - DNA, 22 bp, Homo sapiens
ccagtctgttctcacctctgag

SEQ ID NO: 8481835 - DNA, 22 bp, Homo sapiens
ccagtctgtgtgccagcctgcg

SEQ ID NO: 8481836 - DNA, 22 bp, Homo sapiens
ccagtctgtgtgccagcctgcg

SEQ ID NO: 8481837 - DNA, 22 bp, Homo sapiens
ccagtctgtgtgccagcctgcg

SEQ ID NO: 8481838 - DNA, 22 bp, Homo sapiens
ccagtctgtgtgccagcctgcg

SEQ ID NO: 8481839 - DNA, 22 bp, Homo sapiens
aggctgagactgtgcattagtg

SEQ ID NO: 8481840 - DNA, 22 bp, Homo sapiens
aggctgagactgtgcattagtg

SEQ ID NO: 8481841 - DNA, 22 bp, Homo sapiens
aggctgagagcaacgtgtcaga

SEQ ID NO: 8481842 - DNA, 22 bp, Homo sapiens
aggctctgccaattccttcctc

SEQ ID NO: 8481843 - DNA, 22 bp, Homo sapiens
aggctctgccaattccttcctc

SEQ ID NO: 8481844 - DNA, 22 bp, Homo sapiens
aggctgagataggtggatcatt

SEQ ID NO: 8481845 - DNA, 22 bp, Homo sapiens
aggctgagataggtggatcatt

SEQ ID NO: 8481846 - DNA, 22 bp, Homo sapiens
aggctgagagcaacgtgtcaga

SEQ ID NO: 8481847 - DNA, 22 bp, Homo sapiens
aggctgagataggtggatcatt

SEQ ID NO: 8481848 - DNA, 22 bp, Homo sapiens
aggctgagccacggggctggct

SEQ ID NO: 8481849 - DNA, 22 bp, Homo sapiens
aggctgagcaaagggccttacc

SEQ ID NO: 8481850 - DNA, 22 bp, Homo sapiens
aggctgagcaaagggccttacc

SEQ ID NO: 8481851 - DNA, 22 bp, Homo sapiens
aggctgagccacggggctggct

SEQ ID NO: 8481852 - DNA, 22 bp, Homo sapiens
aggctgagccacggggctggct

SEQ ID NO: 8481853 - DNA, 19 bp, Homo sapiens
aggctctgagctcctggag

SEQ ID NO: 8481854 - DNA, 22 bp, Homo sapiens
aggctctgagtctggtgtctgc

SEQ ID NO: 8481855 - DNA, 22 bp, Homo sapiens
aggctctgagtagagctgccag

SEQ ID NO: 8481856 - DNA, 22 bp, Homo sapiens
aggctctgcagaccccagctgt

SEQ ID NO: 8481857 - DNA, 22 bp, Homo sapiens
aggctctgcagaccccagctgt

SEQ ID NO: 8481858 - DNA, 22 bp, Homo sapiens
aggctctgcagtccatcccgtg

SEQ ID NO: 8481859 - DNA, 22 bp, Homo sapiens
aggctctgcagtgctggaggac

SEQ ID NO: 8481860 - DNA, 22 bp, Homo sapiens
aggctctgcagtccatcccgtg

SEQ ID NO: 8481861 - DNA, 20 bp, Homo sapiens
aggctctgcatttctgagtg

SEQ ID NO: 8481862 - DNA, 22 bp, Homo sapiens
ccaggcagtcagggttgtgtgt

SEQ ID NO: 8481863 - DNA, 22 bp, Homo sapiens
ccaggcatccattgcttcctct

SEQ ID NO: 8481864 - DNA, 22 bp, Homo sapiens
ccaggcatcacgggcatgtggc

SEQ ID NO: 8481865 - DNA, 22 bp, Homo sapiens
ccaggcatccattgcttcctct

SEQ ID NO: 8481866 - DNA, 21 bp, Homo sapiens
ccaggcatgactgcagagagc

SEQ ID NO: 8481867 - DNA, 21 bp, Homo sapiens
ccaggcatgactgcagagagc

SEQ ID NO: 8481868 - DNA, 22 bp, Homo sapiens
ccaggccaaattcagtcagcag

SEQ ID NO: 8481869 - DNA, 22 bp, Homo sapiens
ccaggccaaattcagtcagcag

SEQ ID NO: 8481870 - DNA, 22 bp, Homo sapiens
ccaggccaaattcagtcagcag

SEQ ID NO: 8481871 - DNA, 22 bp, Homo sapiens
ccaggcatggggagagccagat

SEQ ID NO: 8481872 - DNA, 22 bp, Homo sapiens
ccaggcattgtgagtgggcagg

SEQ ID NO: 8481873 - DNA, 23 bp, Homo sapiens
ccaggcagtagctattgaagtga

SEQ ID NO: 8481874 - DNA, 23 bp, Homo sapiens
ccaggcagtagctattgaagtga

SEQ ID NO: 8481875 - DNA, 22 bp, Homo sapiens
ccaggcagggctcaaggaacct

SEQ ID NO: 8481876 - DNA, 22 bp, Homo sapiens
ccaggcagggagctgtttggcc

SEQ ID NO: 8481877 - DNA, 22 bp, Homo sapiens
aggcctctgagcagcactcatg

SEQ ID NO: 8481878 - DNA, 22 bp, Homo sapiens
aggcctctgagcagcactcatg

SEQ ID NO: 8481879 - DNA, 22 bp, Homo sapiens
aggcctcctggctccaggcctt

SEQ ID NO: 8481880 - DNA, 22 bp, Homo sapiens
aggcctcctgcagggatgagtg

SEQ ID NO: 8481881 - DNA, 22 bp, Homo sapiens
aggcctcctggctccaggcctt

SEQ ID NO: 8481882 - DNA, 22 bp, Homo sapiens
aggcctcctggctccaggcctt

SEQ ID NO: 8481883 - DNA, 22 bp, Homo sapiens
aggcctagaggaatggccaggg

SEQ ID NO: 8481884 - DNA, 22 bp, Homo sapiens
aggcctcacattgggcttcaag

SEQ ID NO: 8481885 - DNA, 22 bp, Homo sapiens
aggcctccagccacatgccagt

SEQ ID NO: 8481886 - DNA, 22 bp, Homo sapiens
aggcctcatagtagacctgccc

SEQ ID NO: 8481887 - DNA, 22 bp, Homo sapiens
aggcctcctgcagggatgagtg

SEQ ID NO: 8481888 - DNA, 22 bp, Homo sapiens
aggcctcctgcagggatgagtg

SEQ ID NO: 8481889 - DNA, 21 bp, Homo sapiens
aggcctccctgttgacagggc

SEQ ID NO: 8481890 - DNA, 17 bp, Homo sapiens
aggcctccctccaggcc

SEQ ID NO: 8481891 - DNA, 22 bp, Homo sapiens
aggcctccagctgagttttgct

SEQ ID NO: 8481892 - DNA, 22 bp, Homo sapiens
aggcctccagccacatgccagt

SEQ ID NO: 8481893 - DNA, 22 bp, Homo sapiens
aggcctccagccacatgccagt

SEQ ID NO: 8481894 - DNA, 22 bp, Homo sapiens
ccaggctctgcaaaatcaggct

SEQ ID NO: 8481895 - DNA, 22 bp, Homo sapiens
ccaggctctgccaggcccttga

SEQ ID NO: 8481896 - DNA, 22 bp, Homo sapiens
aggctccttgctcacaggctca

SEQ ID NO: 8481897 - DNA, 22 bp, Homo sapiens
aggctccttgctcacaggctca

SEQ ID NO: 8481898 - DNA, 22 bp, Homo sapiens
ccaggctctgcgctggacatgg

SEQ ID NO: 8481899 - DNA, 22 bp, Homo sapiens
ccaggctctgcgctggacatgg

SEQ ID NO: 8481900 - DNA, 22 bp, Homo sapiens
ccaggctctgcaaaatcaggct

SEQ ID NO: 8481901 - DNA, 22 bp, Homo sapiens
ccaggctctgagcctcactctt

SEQ ID NO: 8481902 - DNA, 22 bp, Homo sapiens
ccaggctctgagcctcactctt

SEQ ID NO: 8481903 - DNA, 22 bp, Homo sapiens
ccaggctctgagaggaatgtga

SEQ ID NO: 8481904 - DNA, 22 bp, Homo sapiens
ccaggctctgacatagatggga

SEQ ID NO: 8481905 - DNA, 21 bp, Homo sapiens
aggctcccagaaatgggcatc

SEQ ID NO: 8481906 - DNA, 21 bp, Homo sapiens
aggctcccagaaatgggcatc

SEQ ID NO: 8481907 - DNA, 21 bp, Homo sapiens
aggctcccagaaatgggcatc

SEQ ID NO: 8481908 - DNA, 22 bp, Homo sapiens
aggctcccatggtgtggcagga

SEQ ID NO: 8481909 - DNA, 21 bp, Homo sapiens
ccaggctcctgaggctggtca

SEQ ID NO: 8481910 - DNA, 21 bp, Homo sapiens
ccaggctcctgaggctggtca

SEQ ID NO: 8481911 - DNA, 22 bp, Homo sapiens
aggctcccatggtgtggcagga

SEQ ID NO: 8481912 - DNA, 22 bp, Homo sapiens
aggctcccatggtgtggcagga

SEQ ID NO: 8481913 - DNA, 22 bp, Homo sapiens
aggctcccatggtgtggcagga

SEQ ID NO: 8481914 - DNA, 22 bp, Homo sapiens
ccaggctctatccctccttctt

SEQ ID NO: 8481915 - DNA, 22 bp, Homo sapiens
ccaggctctatccctccttctt

SEQ ID NO: 8481916 - DNA, 22 bp, Homo sapiens
aggctcccaagcactgacccca

SEQ ID NO: 8481917 - DNA, 22 bp, Homo sapiens
aggctccattttcctgcagctg

SEQ ID NO: 8481918 - DNA, 22 bp, Homo sapiens
aggctccattttcctgcagctg

SEQ ID NO: 8481919 - DNA, 22 bp, Homo sapiens
aggctccattttcctgcagctg

SEQ ID NO: 8481920 - DNA, 22 bp, Homo sapiens
aggctccattccaggagctaga

SEQ ID NO: 8481921 - DNA, 22 bp, Homo sapiens
aggctccattccaggagctaga

SEQ ID NO: 8481922 - DNA, 22 bp, Homo sapiens
aggctccattccaggagctaga

SEQ ID NO: 8481923 - DNA, 22 bp, Homo sapiens
aggctccattccaggagctaga

SEQ ID NO: 8481924 - DNA, 22 bp, Homo sapiens
aggctccattcatgtgaaggca

SEQ ID NO: 8481925 - DNA, 22 bp, Homo sapiens
aggctccatgctaagcgatatg

SEQ ID NO: 8481926 - DNA, 22 bp, Homo sapiens
aggctccatgcaaaggctgttt

SEQ ID NO: 8481927 - DNA, 22 bp, Homo sapiens
aggctccatgcaaaggctgttt

SEQ ID NO: 8481928 - DNA, 22 bp, Homo sapiens
aggctccatgcaaaggctgttt

SEQ ID NO: 8481929 - DNA, 22 bp, Homo sapiens
aggctccatgcaaaggctgttt

SEQ ID NO: 8481930 - DNA, 22 bp, Homo sapiens
aggctccacggcaggatgctgt

SEQ ID NO: 8481931 - DNA, 22 bp, Homo sapiens
aggctccacggtcactggctct

SEQ ID NO: 8481932 - DNA, 22 bp, Homo sapiens
aggctccacggcaggatgctgt

SEQ ID NO: 8481933 - DNA, 22 bp, Homo sapiens
ccaggcctcacctgcccaccta

SEQ ID NO: 8481934 - DNA, 22 bp, Homo sapiens
ccaggcctcacctgcccaccta

SEQ ID NO: 8481935 - DNA, 22 bp, Homo sapiens
ccaggcctagcccctgagggta

SEQ ID NO: 8481936 - DNA, 22 bp, Homo sapiens
ccaggcccgttcccttctccag

SEQ ID NO: 8481937 - DNA, 22 bp, Homo sapiens
ccaggcccgttcccttctccag

SEQ ID NO: 8481938 - DNA, 22 bp, Homo sapiens
ccaggccctgcctgtggttcct

SEQ ID NO: 8481939 - DNA, 22 bp, Homo sapiens
ccaggccctgctcctcacacca

SEQ ID NO: 8481940 - DNA, 22 bp, Homo sapiens
ccaggcccttgcaagtcccacc

SEQ ID NO: 8481941 - DNA, 22 bp, Homo sapiens
ccaggccctgctcctcacacca

SEQ ID NO: 8481942 - DNA, 22 bp, Homo sapiens
ccaggcctagcccctgagggta

SEQ ID NO: 8481943 - DNA, 22 bp, Homo sapiens
ccaggcctagcccctgagggta

SEQ ID NO: 8481944 - DNA, 19 bp, Homo sapiens
aggcagtcattggaatata

SEQ ID NO: 8481945 - DNA, 22 bp, Homo sapiens
aggcagcctttttggaaacata

SEQ ID NO: 8481946 - DNA, 22 bp, Homo sapiens
aggcagcctggtttgaatggaa

SEQ ID NO: 8481947 - DNA, 22 bp, Homo sapiens
aggcagcctttagacagtctgc

SEQ ID NO: 8481948 - DNA, 22 bp, Homo sapiens
aggcaggttggtgagaagactg

SEQ ID NO: 8481949 - DNA, 22 bp, Homo sapiens
aggcagcctatggggagctcag

SEQ ID NO: 8481950 - DNA, 22 bp, Homo sapiens
aggcagcctatggggagctcag

SEQ ID NO: 8481951 - DNA, 22 bp, Homo sapiens
aggcagccctgtgctggatgct

SEQ ID NO: 8481952 - DNA, 22 bp, Homo sapiens
aggcagcccacaggacacagga

SEQ ID NO: 8481953 - DNA, 22 bp, Homo sapiens
aggcagcccacaggacacagga

SEQ ID NO: 8481954 - DNA, 22 bp, Homo sapiens
aggcagccattaccaagggcat

SEQ ID NO: 8481955 - DNA, 22 bp, Homo sapiens
aggcagccattaccaagggcat

SEQ ID NO: 8481956 - DNA, 22 bp, Homo sapiens
aggcagcccacaggacacagga

SEQ ID NO: 8481957 - DNA, 22 bp, Homo sapiens
aggcagccatccaggaggctca

SEQ ID NO: 8481958 - DNA, 22 bp, Homo sapiens
aggcagccatctgcaggaagga

SEQ ID NO: 8481959 - DNA, 22 bp, Homo sapiens
aggcagccatctgcaggaagga

SEQ ID NO: 8481960 - DNA, 22 bp, Homo sapiens
aggcagccatccaggaggctca

SEQ ID NO: 8481961 - DNA, 22 bp, Homo sapiens
aggcagccatccaggaggctca

SEQ ID NO: 8481962 - DNA, 22 bp, Homo sapiens
aggcagtggagctggaataggc

SEQ ID NO: 8481963 - DNA, 22 bp, Homo sapiens
aggcagtggagaaggtttgtga

SEQ ID NO: 8481964 - DNA, 22 bp, Homo sapiens
aggcagtggaaggagaaagcaa

SEQ ID NO: 8481965 - DNA, 22 bp, Homo sapiens
aggcagtgctgtgccctgaacc

SEQ ID NO: 8481966 - DNA, 22 bp, Homo sapiens
aggcagtggctgagaccagggg

SEQ ID NO: 8481967 - DNA, 22 bp, Homo sapiens
aggcagtggatgtcaggaatgg

SEQ ID NO: 8481968 - DNA, 22 bp, Homo sapiens
aggcagtggatgtcaggaatgg

SEQ ID NO: 8481969 - DNA, 22 bp, Homo sapiens
aggcagtggagctggaataggc

SEQ ID NO: 8481970 - DNA, 22 bp, Homo sapiens
aggcagtgcagagtcctcttct

SEQ ID NO: 8481971 - DNA, 22 bp, Homo sapiens
aggcagtgcagagtcctcttct

SEQ ID NO: 8481972 - DNA, 22 bp, Homo sapiens
aggcagtgcctggaccccagct

SEQ ID NO: 8481973 - DNA, 22 bp, Homo sapiens
aggcagtgcatgcaaaggtcgg

SEQ ID NO: 8481974 - DNA, 22 bp, Homo sapiens
aggcagtgctcaagacagcagc

SEQ ID NO: 8481975 - DNA, 22 bp, Homo sapiens
aggcagtgctcaagacagcagc

SEQ ID NO: 8481976 - DNA, 22 bp, Homo sapiens
aggcagtgctcaagacagcagc

SEQ ID NO: 8481977 - DNA, 22 bp, Homo sapiens
aggcagtgctcaagacagcagc

SEQ ID NO: 8481978 - DNA, 22 bp, Homo sapiens
aggcagtgcagagtcctcttct

SEQ ID NO: 8481979 - DNA, 22 bp, Homo sapiens
aggcagtgatgagtcatgaata

SEQ ID NO: 8481980 - DNA, 22 bp, Homo sapiens
aggcagtgagcagggtgtcatg

SEQ ID NO: 8481981 - DNA, 22 bp, Homo sapiens
aggcagtgagtgtgacttcaca

SEQ ID NO: 8481982 - DNA, 22 bp, Homo sapiens
aggcagtgagaaatagcaagat

SEQ ID NO: 8481983 - DNA, 22 bp, Homo sapiens
ccactgctctgccaggagctgg

SEQ ID NO: 8481984 - DNA, 21 bp, Homo sapiens
ccactgctcttccctagggcc

SEQ ID NO: 8481985 - DNA, 22 bp, Homo sapiens
ccactgctctgccaggagctgg

SEQ ID NO: 8481986 - DNA, 22 bp, Homo sapiens
ccactggaagatgctgaggtca

SEQ ID NO: 8481987 - DNA, 22 bp, Homo sapiens
ccactgctgttacttacgcaaa

SEQ ID NO: 8481988 - DNA, 22 bp, Homo sapiens
ccactgctgttacttacgcaaa

SEQ ID NO: 8481989 - DNA, 22 bp, Homo sapiens
ccactggcagttggctagcctt

SEQ ID NO: 8481990 - DNA, 22 bp, Homo sapiens
ccactggctgtcagcaggactc

SEQ ID NO: 8481991 - DNA, 22 bp, Homo sapiens
ccactggcatccagctgccatc

SEQ ID NO: 8481992 - DNA, 22 bp, Homo sapiens
ccactggagactggtctctgtg

SEQ ID NO: 8481993 - DNA, 22 bp, Homo sapiens
ccactggcaaccccgcctcata

SEQ ID NO: 8481994 - DNA, 22 bp, Homo sapiens
ccactggcaaccccgcctcata

SEQ ID NO: 8481995 - DNA, 22 bp, Homo sapiens
ccactggcttttcctaggtctc

SEQ ID NO: 8481996 - DNA, 22 bp, Homo sapiens
ccactgggcgtttctgtccaat

SEQ ID NO: 8481997 - DNA, 22 bp, Homo sapiens
aggcattctagaagtagaagta

SEQ ID NO: 8481998 - DNA, 22 bp, Homo sapiens
aggcatgtgaccctggactcag

SEQ ID NO: 8481999 - DNA, 22 bp, Homo sapiens
aggcatttcctatgggcagaga

SEQ ID NO: 8482000 - DNA, 23 bp, Homo sapiens
aggcagtggtggtaacatgtcaa

SEQ ID NO: 8482001 - DNA, 23 bp, Homo sapiens
aggcagtggtggtaacatgtcaa

SEQ ID NO: 8482002 - DNA, 23 bp, Homo sapiens
aggcagtgggggccactttgctt

SEQ ID NO: 8482003 - DNA, 22 bp, Homo sapiens
aggcagtggcttttgttgtgtt

SEQ ID NO: 8482004 - DNA, 22 bp, Homo sapiens
aggcagtggctgagaccagggg

SEQ ID NO: 8482005 - DNA, 22 bp, Homo sapiens
aggcatatactctcagaaaaaa

SEQ ID NO: 8482006 - DNA, 22 bp, Homo sapiens
aggcatcaggagtatagccaga

SEQ ID NO: 8482007 - DNA, 22 bp, Homo sapiens
aggcataaccttttatctggat

SEQ ID NO: 8482008 - DNA, 22 bp, Homo sapiens
aggcatctatacattatgttca

SEQ ID NO: 8482009 - DNA, 22 bp, Homo sapiens
aggcatctgagtttgcaagctt

SEQ ID NO: 8482010 - DNA, 22 bp, Homo sapiens
ccactgctagagatgcatcccc

SEQ ID NO: 8482011 - DNA, 17 bp, Homo sapiens
aggcatgaggcatcact

SEQ ID NO: 8482012 - DNA, 22 bp, Homo sapiens
aggcatgactttggctgaagaa

SEQ ID NO: 8482013 - DNA, 22 bp, Homo sapiens
aggccctgggttagggcccact

SEQ ID NO: 8482014 - DNA, 22 bp, Homo sapiens
aggccctgggttagggcccact

SEQ ID NO: 8482015 - DNA, 22 bp, Homo sapiens
aggccgcctggggagaggccct

SEQ ID NO: 8482016 - DNA, 22 bp, Homo sapiens
aggccctgaagtcggcccctca

SEQ ID NO: 8482017 - DNA, 22 bp, Homo sapiens
aggccctgaagtcggcccctca

SEQ ID NO: 8482018 - DNA, 22 bp, Homo sapiens
aggccctattcaatggggccca

SEQ ID NO: 8482019 - DNA, 22 bp, Homo sapiens
aggccctcacagtctattgtga

SEQ ID NO: 8482020 - DNA, 22 bp, Homo sapiens
aggcccagttatcctacttgtt

SEQ ID NO: 8482021 - DNA, 22 bp, Homo sapiens
aggcccagtgtggcttcctgga

SEQ ID NO: 8482022 - DNA, 22 bp, Homo sapiens
aggcccagtgtggcttcctgga

SEQ ID NO: 8482023 - DNA, 22 bp, Homo sapiens
aggccagcttctaccctctgtt

SEQ ID NO: 8482024 - DNA, 22 bp, Homo sapiens
aggccagcttctaccctctgtt

SEQ ID NO: 8482025 - DNA, 22 bp, Homo sapiens
aggccagcttctaccctctgtt

SEQ ID NO: 8482026 - DNA, 20 bp, Homo sapiens
aggccaggaaatgtagttct

SEQ ID NO: 8482027 - DNA, 20 bp, Homo sapiens
aggccaggaaatgtagttct

SEQ ID NO: 8482028 - DNA, 20 bp, Homo sapiens
aggccaggaaatgtagttct

SEQ ID NO: 8482029 - DNA, 22 bp, Homo sapiens
aggccaggaatccttgtcccag

SEQ ID NO: 8482030 - DNA, 22 bp, Homo sapiens
aggccaggaatccttgtcccag

SEQ ID NO: 8482031 - DNA, 22 bp, Homo sapiens
aggccaggaatccttgtcccag

SEQ ID NO: 8482032 - DNA, 22 bp, Homo sapiens
aggccaggacacttaagtaaga

SEQ ID NO: 8482033 - DNA, 22 bp, Homo sapiens
aggcccagtagtgctgccttta

SEQ ID NO: 8482034 - DNA, 22 bp, Homo sapiens
aggccaggatagcatggatcag

SEQ ID NO: 8482035 - DNA, 22 bp, Homo sapiens
aggccaggatagcatggatcag

SEQ ID NO: 8482036 - DNA, 22 bp, Homo sapiens
aggccaggatagcatggatcag

SEQ ID NO: 8482037 - DNA, 22 bp, Homo sapiens
aggccaggatagcatggatcag

SEQ ID NO: 8482038 - DNA, 23 bp, Homo sapiens
aggccagcgcagacaccgagcac

SEQ ID NO: 8482039 - DNA, 23 bp, Homo sapiens
aggccagcgcagacaccgagcac

SEQ ID NO: 8482040 - DNA, 22 bp, Homo sapiens
aggccagccttgtaaatgcctc

SEQ ID NO: 8482041 - DNA, 22 bp, Homo sapiens
aggccagcgctgctagctcccg

SEQ ID NO: 8482042 - DNA, 22 bp, Homo sapiens
aggccagcgctgctagctcccg

SEQ ID NO: 8482043 - DNA, 22 bp, Homo sapiens
aggccagctatgactctgctcc

SEQ ID NO: 8482044 - DNA, 22 bp, Homo sapiens
aggccagatgtcgggctagaag

SEQ ID NO: 8482045 - DNA, 22 bp, Homo sapiens
aggccacaagaaaatgcttcat

SEQ ID NO: 8482046 - DNA, 22 bp, Homo sapiens
aggccacaaccaccctgtgccc

SEQ ID NO: 8482047 - DNA, 22 bp, Homo sapiens
aggccacaagaaaatgcttcat

SEQ ID NO: 8482048 - DNA, 22 bp, Homo sapiens
aggccagatgtcgggctagaag

SEQ ID NO: 8482049 - DNA, 22 bp, Homo sapiens
aggccagcctcaggcagggacc

SEQ ID NO: 8482050 - DNA, 22 bp, Homo sapiens
aggccagctctacccttggact

SEQ ID NO: 8482051 - DNA, 22 bp, Homo sapiens
aggccagctctacccttggact

SEQ ID NO: 8482052 - DNA, 22 bp, Homo sapiens
aggccagctcaccctggctcct

SEQ ID NO: 8482053 - DNA, 22 bp, Homo sapiens
aggccagctcaccctggctcct

SEQ ID NO: 8482054 - DNA, 22 bp, Homo sapiens
aggccagcttccagaggggcag

SEQ ID NO: 8482055 - DNA, 22 bp, Homo sapiens
aggccagcttccagaggggcag

SEQ ID NO: 8482056 - DNA, 22 bp, Homo sapiens
aggccagctgttactagagcca

SEQ ID NO: 8482057 - DNA, 22 bp, Homo sapiens
aggccagctgttactagagcca

SEQ ID NO: 8482058 - DNA, 22 bp, Homo sapiens
aggccagctgttactagagcca

SEQ ID NO: 8482059 - DNA, 22 bp, Homo sapiens
aggccagctgccacccggtccg

SEQ ID NO: 8482060 - DNA, 22 bp, Homo sapiens
aggccagctgccacccggtccg

SEQ ID NO: 8482061 - DNA, 22 bp, Homo sapiens
aggccagctgttactagagcca

SEQ ID NO: 8482062 - DNA, 22 bp, Homo sapiens
aggccacaaccaccctgtgccc

SEQ ID NO: 8482063 - DNA, 22 bp, Homo sapiens
aggccacaaccaccctgtgccc

SEQ ID NO: 8482064 - DNA, 22 bp, Homo sapiens
aggccaagttacttgggaaagc

SEQ ID NO: 8482065 - DNA, 22 bp, Homo sapiens
aggccaagtgctgggacaggtg

SEQ ID NO: 8482066 - DNA, 22 bp, Homo sapiens
aggccaagtagctagcattgaa

SEQ ID NO: 8482067 - DNA, 22 bp, Homo sapiens
aggccaagtagctagcattgaa

SEQ ID NO: 8482068 - DNA, 22 bp, Homo sapiens
aggccaagtagccgctgtccta

SEQ ID NO: 8482069 - DNA, 22 bp, Homo sapiens
aggccaagtagccgctgtccta

SEQ ID NO: 8482070 - DNA, 22 bp, Homo sapiens
aggccaagggcaaagcggagag

SEQ ID NO: 8482071 - DNA, 22 bp, Homo sapiens
aggccaagattttggatcagct

SEQ ID NO: 8482072 - DNA, 22 bp, Homo sapiens
aggccaagattttggatcagct

SEQ ID NO: 8482073 - DNA, 22 bp, Homo sapiens
aggccaagctcccagagaagct

SEQ ID NO: 8482074 - DNA, 22 bp, Homo sapiens
aggccaagctcccagagaagct

SEQ ID NO: 8482075 - DNA, 22 bp, Homo sapiens
aggcatttttgttaatctttgg

SEQ ID NO: 8482076 - DNA, 22 bp, Homo sapiens
aggccaaagcacagagctggaa

SEQ ID NO: 8482077 - DNA, 22 bp, Homo sapiens
agtcccagatgacccagctact

SEQ ID NO: 8482078 - DNA, 22 bp, Homo sapiens
agtcccagcccagtcctgtaag

SEQ ID NO: 8482079 - DNA, 22 bp, Homo sapiens
agtcccagcctaggctgtgctg

SEQ ID NO: 8482080 - DNA, 22 bp, Homo sapiens
agtcccagcctaggctgtgctg

SEQ ID NO: 8482081 - DNA, 22 bp, Homo sapiens
agtcccagcccagtcctgtaag

SEQ ID NO: 8482082 - DNA, 22 bp, Homo sapiens
agtcccagcctaggctgtgctg

SEQ ID NO: 8482083 - DNA, 22 bp, Homo sapiens
agtcccagcctgtaggattggg

SEQ ID NO: 8482084 - DNA, 22 bp, Homo sapiens
ctcaccaggaacagctgcggag

SEQ ID NO: 8482085 - DNA, 20 bp, Homo sapiens
agtcccagatcaaatttctg

SEQ ID NO: 8482086 - DNA, 22 bp, Homo sapiens
agtcccagagaggtcggggcca

SEQ ID NO: 8482087 - DNA, 22 bp, Homo sapiens
agtcccagatctacaggaggga

SEQ ID NO: 8482088 - DNA, 22 bp, Homo sapiens
agtcccagatctacaggaggga

SEQ ID NO: 8482089 - DNA, 22 bp, Homo sapiens
agtcccagatctacaggaggga

SEQ ID NO: 8482090 - DNA, 22 bp, Homo sapiens
agtcccagatctccattcggtc

SEQ ID NO: 8482091 - DNA, 22 bp, Homo sapiens
agtcccagatgacccagctact

SEQ ID NO: 8482092 - DNA, 22 bp, Homo sapiens
agtcccagatgacccagctact

SEQ ID NO: 8482093 - DNA, 22 bp, Homo sapiens
agtcccagatctacaggaggga

SEQ ID NO: 8482094 - DNA, 22 bp, Homo sapiens
ctcagaagaacaaaggctctac

SEQ ID NO: 8482095 - DNA, 22 bp, Homo sapiens
ctcagaaatcccactctgtgta

SEQ ID NO: 8482096 - DNA, 22 bp, Homo sapiens
ctcagaaagtgacaggggggtg

SEQ ID NO: 8482097 - DNA, 22 bp, Homo sapiens
ctcaccatatgactttactaac

SEQ ID NO: 8482098 - DNA, 22 bp, Homo sapiens
ctcagaaattacaaaagggaca

SEQ ID NO: 8482099 - DNA, 22 bp, Homo sapiens
ctcagaaattacaaaagggaca

SEQ ID NO: 8482100 - DNA, 22 bp, Homo sapiens
ctcagaagccttcagtcttggc

SEQ ID NO: 8482101 - DNA, 22 bp, Homo sapiens
ctcagaagttcagcctagagta

SEQ ID NO: 8482102 - DNA, 22 bp, Homo sapiens
ctcagaattacatcccatttta

SEQ ID NO: 8482103 - DNA, 22 bp, Homo sapiens
ctcagaatttagggctctgagg

SEQ ID NO: 8482104 - DNA, 22 bp, Homo sapiens
ctcagacaaatgattaaggtta

SEQ ID NO: 8482105 - DNA, 21 bp, Homo sapiens
ctcagacagggaggctctggg

SEQ ID NO: 8482106 - DNA, 21 bp, Homo sapiens
ctcagaccacagctcacaccc

SEQ ID NO: 8482107 - DNA, 22 bp, Homo sapiens
ctcagacatttgtagaaagtgc

SEQ ID NO: 8482108 - DNA, 21 bp, Homo sapiens
ctcagacagggaggctctggg

SEQ ID NO: 8482109 - DNA, 22 bp, Homo sapiens
ctcagacatctgaaatgggtta

SEQ ID NO: 8482110 - DNA, 22 bp, Homo sapiens
ctcagacttgctttttatggaa

SEQ ID NO: 8482111 - DNA, 22 bp, Homo sapiens
ctcagaggtcaagagcagagct

SEQ ID NO: 8482112 - DNA, 22 bp, Homo sapiens
ctcagaggtcaagagcagagct

SEQ ID NO: 8482113 - DNA, 22 bp, Homo sapiens
ctcagaggtcaagagcagagct

SEQ ID NO: 8482114 - DNA, 22 bp, Homo sapiens
ctcagagggtacaggtgaaccc

SEQ ID NO: 8482115 - DNA, 22 bp, Homo sapiens
ctcagaggggatgcttggagaa

SEQ ID NO: 8482116 - DNA, 22 bp, Homo sapiens
ctcagagaaaaggagcaagggt

SEQ ID NO: 8482117 - DNA, 22 bp, Homo sapiens
ctcagaggtcaagagcagagct

SEQ ID NO: 8482118 - DNA, 22 bp, Homo sapiens
ctcagaggtggatgccttgtgg

SEQ ID NO: 8482119 - DNA, 23 bp, Homo sapiens
ctcagaggtgtttttcacttact

SEQ ID NO: 8482120 - DNA, 23 bp, Homo sapiens
ctcagaggtgtttttcacttact

SEQ ID NO: 8482121 - DNA, 22 bp, Homo sapiens
ctcagagtggggctccctgagg

SEQ ID NO: 8482122 - DNA, 22 bp, Homo sapiens
ctcagagtccccacatctgggt

SEQ ID NO: 8482123 - DNA, 22 bp, Homo sapiens
ctcagcaaccctagaacatttg

SEQ ID NO: 8482124 - DNA, 22 bp, Homo sapiens
ctcagcaacccacacacggtct

SEQ ID NO: 8482125 - DNA, 22 bp, Homo sapiens
ctcagcaagattaagcagcttg

SEQ ID NO: 8482126 - DNA, 22 bp, Homo sapiens
agtcccagactccagttttctg

SEQ ID NO: 8482127 - DNA, 22 bp, Homo sapiens
agtcccagactccagttttctg

SEQ ID NO: 8482128 - DNA, 22 bp, Homo sapiens
agtcccagagaggtcggggcca

SEQ ID NO: 8482129 - DNA, 22 bp, Homo sapiens
agtcccaacagcttacaaggaa

SEQ ID NO: 8482130 - DNA, 22 bp, Homo sapiens
agtcccaacagcttacaaggaa

SEQ ID NO: 8482131 - DNA, 23 bp, Homo sapiens
ctcaaccctagtaagggagtagg

SEQ ID NO: 8482132 - DNA, 23 bp, Homo sapiens
ctcaaccctagtaagggagtagg

SEQ ID NO: 8482133 - DNA, 23 bp, Homo sapiens
ctcaaccctagtaagggagtagg

SEQ ID NO: 8482134 - DNA, 22 bp, Homo sapiens
ctcaagaaggatgagctattgc

SEQ ID NO: 8482135 - DNA, 22 bp, Homo sapiens
ctcaagaagagggagacctaca

SEQ ID NO: 8482136 - DNA, 22 bp, Homo sapiens
ctcaaatatgtggtcagaaagc

SEQ ID NO: 8482137 - DNA, 21 bp, Homo sapiens
ctcaaatgccagttttattta

SEQ ID NO: 8482138 - DNA, 22 bp, Homo sapiens
ctcaaatagaactgatctataa

SEQ ID NO: 8482139 - DNA, 22 bp, Homo sapiens
ctcaaatacctctccatgtgac

SEQ ID NO: 8482140 - DNA, 22 bp, Homo sapiens
ctcaaaatggttaattttaata

SEQ ID NO: 8482141 - DNA, 22 bp, Homo sapiens
ctatttatgtccaagtgtttta

SEQ ID NO: 8482142 - DNA, 22 bp, Homo sapiens
ctatttatgtccaagtgtttta

SEQ ID NO: 8482143 - DNA, 22 bp, Homo sapiens
ctatttatctatttctgaatga

SEQ ID NO: 8482144 - DNA, 22 bp, Homo sapiens
ctcaaaatggttaattttaata

SEQ ID NO: 8482145 - DNA, 22 bp, Homo sapiens
cggggttcatccatgctgtggc

SEQ ID NO: 8482146 - DNA, 22 bp, Homo sapiens
cggggttcatccatgctgtggc

SEQ ID NO: 8482147 - DNA, 22 bp, Homo sapiens
cggggttcatccatgctgtggc

SEQ ID NO: 8482148 - DNA, 22 bp, Homo sapiens
cggggttcatccatgctgtggc

SEQ ID NO: 8482149 - DNA, 22 bp, Homo sapiens
cggggtggcactctaaatagaa

SEQ ID NO: 8482150 - DNA, 22 bp, Homo sapiens
cggggtgggaatagacctgtct

SEQ ID NO: 8482151 - DNA, 22 bp, Homo sapiens
cgggttcacgccattctcctgc

SEQ ID NO: 8482152 - DNA, 22 bp, Homo sapiens
cgggttcacgccattctcctgc

SEQ ID NO: 8482153 - DNA, 22 bp, Homo sapiens
cgggttcacgccattctcctgc

SEQ ID NO: 8482154 - DNA, 22 bp, Homo sapiens
cgggttcacgccattctcctgc

SEQ ID NO: 8482155 - DNA, 22 bp, Homo sapiens
cgggttcacgccattctcctgc

SEQ ID NO: 8482156 - DNA, 23 bp, Homo sapiens
cgggttcacgccattctcctgcc

SEQ ID NO: 8482157 - DNA, 22 bp, Homo sapiens
cgggttcacgccattctcctgc

SEQ ID NO: 8482158 - DNA, 22 bp, Homo sapiens
cgggttcacgccattctcctgc

SEQ ID NO: 8482159 - DNA, 22 bp, Homo sapiens
agtatcatgttggaattaatca

SEQ ID NO: 8482160 - DNA, 22 bp, Homo sapiens
agtatcatctccatttcactga

SEQ ID NO: 8482161 - DNA, 21 bp, Homo sapiens
agtatcataatgaatagttct

SEQ ID NO: 8482162 - DNA, 22 bp, Homo sapiens
agtatctgcatgattttgagaa

SEQ ID NO: 8482163 - DNA, 22 bp, Homo sapiens
agtatcttcaagtttcttctag

SEQ ID NO: 8482164 - DNA, 22 bp, Homo sapiens
agtatctttacttaaatagtca

SEQ ID NO: 8482165 - DNA, 22 bp, Homo sapiens
agtatgaacggaaggcctggga

SEQ ID NO: 8482166 - DNA, 22 bp, Homo sapiens
agtatgaagaatacatagatga

SEQ ID NO: 8482167 - DNA, 22 bp, Homo sapiens
cgggggcacccacaaatgagga

SEQ ID NO: 8482168 - DNA, 22 bp, Homo sapiens
agtctccacactggcagatgcc

SEQ ID NO: 8482169 - DNA, 22 bp, Homo sapiens
agtctcatcaggcatgtagtca

SEQ ID NO: 8482170 - DNA, 22 bp, Homo sapiens
agtctccacaacagccctgata

SEQ ID NO: 8482171 - DNA, 22 bp, Homo sapiens
agtctcatcaggcatgtagtca

SEQ ID NO: 8482172 - DNA, 19 bp, Homo sapiens
agtctcagtgtacagaggc

SEQ ID NO: 8482173 - DNA, 22 bp, Homo sapiens
agtctcaggcagaggaaggcta

SEQ ID NO: 8482174 - DNA, 22 bp, Homo sapiens
agtctcaggcagaggaaggcta

SEQ ID NO: 8482175 - DNA, 23 bp, Homo sapiens
agtctcagctggaaacatgtgtc

SEQ ID NO: 8482176 - DNA, 22 bp, Homo sapiens
agtctccagaaatatagcagtg

SEQ ID NO: 8482177 - DNA, 22 bp, Homo sapiens
agtctccttaaatatttcccag

SEQ ID NO: 8482178 - DNA, 22 bp, Homo sapiens
agtctccttggcctcaatgcct

SEQ ID NO: 8482179 - DNA, 21 bp, Homo sapiens
ctcaggcatttgaggagagtc

SEQ ID NO: 8482180 - DNA, 22 bp, Homo sapiens
ctcaggccaataagctccagcc

SEQ ID NO: 8482181 - DNA, 22 bp, Homo sapiens
ctcagggaggccctgggaccct

SEQ ID NO: 8482182 - DNA, 22 bp, Homo sapiens
ctcagggacgttagaggacagg

SEQ ID NO: 8482183 - DNA, 22 bp, Homo sapiens
ctcagggacaaggggagacccc

SEQ ID NO: 8482184 - DNA, 22 bp, Homo sapiens
ctcagcctgtgaagagcagagg

SEQ ID NO: 8482185 - DNA, 22 bp, Homo sapiens
ctcagcctgtgaagagcagagg

SEQ ID NO: 8482186 - DNA, 20 bp, Homo sapiens
ctcagctaaacaacactgac

SEQ ID NO: 8482187 - DNA, 22 bp, Homo sapiens
ctcagctagtaacgtacatgtc

SEQ ID NO: 8482188 - DNA, 22 bp, Homo sapiens
ctcagctacgctttcaccagct

SEQ ID NO: 8482189 - DNA, 22 bp, Homo sapiens
ctcagctagggaaggttagctt

SEQ ID NO: 8482190 - DNA, 22 bp, Homo sapiens
ctcagctacttgggaagcttag

SEQ ID NO: 8482191 - DNA, 16 bp, Homo sapiens
ctcagctaaggagagg

SEQ ID NO: 8482192 - DNA, 22 bp, Homo sapiens
ctcagctccagccctcagcagc

SEQ ID NO: 8482193 - DNA, 22 bp, Homo sapiens
ctcagctccagccctcagcagc

SEQ ID NO: 8482194 - DNA, 22 bp, Homo sapiens
ctcagctccaggtgtgcatctt

SEQ ID NO: 8482195 - DNA, 22 bp, Homo sapiens
ctcagctcattgtggatccggt

SEQ ID NO: 8482196 - DNA, 22 bp, Homo sapiens
ctcagctccagccctcagcagc

SEQ ID NO: 8482197 - DNA, 22 bp, Homo sapiens
ctcagctccaggtgtgcatctt

SEQ ID NO: 8482198 - DNA, 22 bp, Homo sapiens
ctcagctccaggtgtgcatctt

SEQ ID NO: 8482199 - DNA, 22 bp, Homo sapiens
ctcagctctgacaggaggcatc

SEQ ID NO: 8482200 - DNA, 17 bp, Homo sapiens
ctcagctgaaccccaga

SEQ ID NO: 8482201 - DNA, 22 bp, Homo sapiens
ctcagctctttatactagctgt

SEQ ID NO: 8482202 - DNA, 20 bp, Homo sapiens
ctcagctcttcagggcaagt

SEQ ID NO: 8482203 - DNA, 22 bp, Homo sapiens
agtctcagccacacagacctat

SEQ ID NO: 8482204 - DNA, 20 bp, Homo sapiens
ctcagtgtggcctgagtgtt

SEQ ID NO: 8482205 - DNA, 22 bp, Homo sapiens
ctcagtgtgagtgagaagtgca

SEQ ID NO: 8482206 - DNA, 22 bp, Homo sapiens
ctcagtggttgagagcctgggc

SEQ ID NO: 8482207 - DNA, 22 bp, Homo sapiens
ctcagtggtggtcacttggtgg

SEQ ID NO: 8482208 - DNA, 22 bp, Homo sapiens
agtgaattctgcactactgaag

SEQ ID NO: 8482209 - DNA, 22 bp, Homo sapiens
agtgaattgttgccacagagac

SEQ ID NO: 8482210 - DNA, 17 bp, Homo sapiens
agtgaaatttacattgc

SEQ ID NO: 8482211 - DNA, 17 bp, Homo sapiens
agtgaaatttacattgc

SEQ ID NO: 8482212 - DNA, 17 bp, Homo sapiens
agtgaaatttacattgc

SEQ ID NO: 8482213 - DNA, 22 bp, Homo sapiens
agtgacaaggcctgaagctcct

SEQ ID NO: 8482214 - DNA, 22 bp, Homo sapiens
ctccagacagatcttctagcag

SEQ ID NO: 8482215 - DNA, 22 bp, Homo sapiens
ctccagagacacttctcatgat

SEQ ID NO: 8482216 - DNA, 22 bp, Homo sapiens
ctccagagacacttctcatgat

SEQ ID NO: 8482217 - DNA, 22 bp, Homo sapiens
ctccagagacacttctcatgat

SEQ ID NO: 8482218 - DNA, 22 bp, Homo sapiens
ctccagagagaaaggaggccgc

SEQ ID NO: 8482219 - DNA, 22 bp, Homo sapiens
ctccagagagaaaggaggccgc

SEQ ID NO: 8482220 - DNA, 22 bp, Homo sapiens
ctccagaagacccatcctcatg

SEQ ID NO: 8482221 - DNA, 19 bp, Homo sapiens
ctccagaatacatgttcct

SEQ ID NO: 8482222 - DNA, 22 bp, Homo sapiens
ctccactctggggtgggtgaga

SEQ ID NO: 8482223 - DNA, 22 bp, Homo sapiens
ctccagaaattcaacagcaaat

SEQ ID NO: 8482224 - DNA, 22 bp, Homo sapiens
ctccagaaattcaacagcaaat

SEQ ID NO: 8482225 - DNA, 22 bp, Homo sapiens
ctccagaaatttggatgcagca

SEQ ID NO: 8482226 - DNA, 21 bp, Homo sapiens
agtgacagaggaaggtgcata

SEQ ID NO: 8482227 - DNA, 21 bp, Homo sapiens
agtgacagaggaaggtgcata

SEQ ID NO: 8482228 - DNA, 22 bp, Homo sapiens
agtgacacggagagacagcatg

SEQ ID NO: 8482229 - DNA, 22 bp, Homo sapiens
agtgacagctgggaaggtgaaa

SEQ ID NO: 8482230 - DNA, 22 bp, Homo sapiens
agtgacagctgggaaggtgaaa

SEQ ID NO: 8482231 - DNA, 22 bp, Homo sapiens
agtgacagccaaatccatccat

SEQ ID NO: 8482232 - DNA, 22 bp, Homo sapiens
agtgacagattaccggcagagc

SEQ ID NO: 8482233 - DNA, 22 bp, Homo sapiens
agtgacaggggaggcaggtgtg

SEQ ID NO: 8482234 - DNA, 22 bp, Homo sapiens
ctccactcaccagatgccagga

SEQ ID NO: 8482235 - DNA, 22 bp, Homo sapiens
ctccactcaggtgcttaagttg

SEQ ID NO: 8482236 - DNA, 22 bp, Homo sapiens
ctccactcaggtgcttaagttg

SEQ ID NO: 8482237 - DNA, 22 bp, Homo sapiens
ctccactcaccgaggcagagca

SEQ ID NO: 8482238 - DNA, 22 bp, Homo sapiens
ctcgcaggacagtgctaggact

SEQ ID NO: 8482239 - DNA, 22 bp, Homo sapiens
ctcgcatgccctgcctcatcca

SEQ ID NO: 8482240 - DNA, 22 bp, Homo sapiens
ctcgcaggacagtgctaggact

SEQ ID NO: 8482241 - DNA, 22 bp, Homo sapiens
ctcggagatgctggctgagatc

SEQ ID NO: 8482242 - DNA, 22 bp, Homo sapiens
ctcggaatggaacaacagcggt

SEQ ID NO: 8482243 - DNA, 22 bp, Homo sapiens
ctcggagatgctggctgagatc

SEQ ID NO: 8482244 - DNA, 22 bp, Homo sapiens
ctcgcctgcctgtgtctctccc

SEQ ID NO: 8482245 - DNA, 22 bp, Homo sapiens
ctccttggtgtagtactgagca

SEQ ID NO: 8482246 - DNA, 18 bp, Homo sapiens
ctcctttccctacacctc

SEQ ID NO: 8482247 - DNA, 22 bp, Homo sapiens
ctcctgccaccgcggtgtcctg

SEQ ID NO: 8482248 - DNA, 22 bp, Homo sapiens
ctccttctgggcctggcagtgg

SEQ ID NO: 8482249 - DNA, 22 bp, Homo sapiens
ctccttctgggcctggcagtgg

SEQ ID NO: 8482250 - DNA, 22 bp, Homo sapiens
ctcctggttcagagagctgaga

SEQ ID NO: 8482251 - DNA, 22 bp, Homo sapiens
ctcctgagtctccacgccccgt

SEQ ID NO: 8482252 - DNA, 22 bp, Homo sapiens
ctcctgagtagtagcattgtca

SEQ ID NO: 8482253 - DNA, 22 bp, Homo sapiens
ctcctgagtagtagcattgtca

SEQ ID NO: 8482254 - DNA, 22 bp, Homo sapiens
ctcctgaggggacaggactcat

SEQ ID NO: 8482255 - DNA, 22 bp, Homo sapiens
ctcctgaggggacaggactcat

SEQ ID NO: 8482256 - DNA, 22 bp, Homo sapiens
ctccagagagtccagctctggg

SEQ ID NO: 8482257 - DNA, 22 bp, Homo sapiens
ctccagagagtccagctctggg

SEQ ID NO: 8482258 - DNA, 22 bp, Homo sapiens
ctccagagagtccagctctggg

SEQ ID NO: 8482259 - DNA, 22 bp, Homo sapiens
agtgctatcgagttctaatgct

SEQ ID NO: 8482260 - DNA, 22 bp, Homo sapiens
agtgctatcgagttctaatgct

SEQ ID NO: 8482261 - DNA, 23 bp, Homo sapiens
agtgctgaattgaaagctccagg

SEQ ID NO: 8482262 - DNA, 22 bp, Homo sapiens
agtgctgactctgggcacagtg

SEQ ID NO: 8482263 - DNA, 22 bp, Homo sapiens
agtgctgagtgattgcaaagga

SEQ ID NO: 8482264 - DNA, 23 bp, Homo sapiens
agtgctggagaagcttctggctt

SEQ ID NO: 8482265 - DNA, 23 bp, Homo sapiens
agtgctggagaagcttctggctt

SEQ ID NO: 8482266 - DNA, 22 bp, Homo sapiens
ctcctgaggacttctattgggt

SEQ ID NO: 8482267 - DNA, 22 bp, Homo sapiens
ctcctgagggatgcttaggctt

SEQ ID NO: 8482268 - DNA, 22 bp, Homo sapiens
ctcctgaggaaaagcttggtca

SEQ ID NO: 8482269 - DNA, 22 bp, Homo sapiens
ctcctgagctgcagccttgtgt

SEQ ID NO: 8482270 - DNA, 22 bp, Homo sapiens
agtgctggattacaggcgtgag

SEQ ID NO: 8482271 - DNA, 22 bp, Homo sapiens
agtgctggattacaggcgtgag

SEQ ID NO: 8482272 - DNA, 22 bp, Homo sapiens
agtgctggattacaggcgtgag

SEQ ID NO: 8482273 - DNA, 22 bp, Homo sapiens
agtgctggagggaggcaggttc

SEQ ID NO: 8482274 - DNA, 22 bp, Homo sapiens
agtgctggattacaggcgtgag

SEQ ID NO: 8482275 - DNA, 22 bp, Homo sapiens
ctctccattccctacagttttc

SEQ ID NO: 8482276 - DNA, 20 bp, Homo sapiens
ctctcccagcacagcttcct

SEQ ID NO: 8482277 - DNA, 20 bp, Homo sapiens
ctctcccagcacagcttcct

SEQ ID NO: 8482278 - DNA, 20 bp, Homo sapiens
ctctcccagcacagcttcct

SEQ ID NO: 8482279 - DNA, 22 bp, Homo sapiens
ctctcccagtcaggctcaggat

SEQ ID NO: 8482280 - DNA, 17 bp, Homo sapiens
ctctccttcctctgagg

SEQ ID NO: 8482281 - DNA, 22 bp, Homo sapiens
ctctcccagtcaggctcaggat

SEQ ID NO: 8482282 - DNA, 22 bp, Homo sapiens
ctctcccagtcaggctcaggat

SEQ ID NO: 8482283 - DNA, 22 bp, Homo sapiens
ctctcccagtcaggctcaggat

SEQ ID NO: 8482284 - DNA, 22 bp, Homo sapiens
ctctctaacgacattcccattc

SEQ ID NO: 8482285 - DNA, 22 bp, Homo sapiens
ctctcgccagcggggctgcgct

SEQ ID NO: 8482286 - DNA, 22 bp, Homo sapiens
ctctcgccagcggggctgcgct

SEQ ID NO: 8482287 - DNA, 22 bp, Homo sapiens
ctctctagaggcccaccttgag

SEQ ID NO: 8482288 - DNA, 22 bp, Homo sapiens
ctctctatggatgcagtttttc

SEQ ID NO: 8482289 - DNA, 19 bp, Homo sapiens
ctctctccagtggctggct

SEQ ID NO: 8482290 - DNA, 22 bp, Homo sapiens
ctctctcagtgtaatacaggat

SEQ ID NO: 8482291 - DNA, 22 bp, Homo sapiens
ctctcctttactgcagagagcg

SEQ ID NO: 8482292 - DNA, 22 bp, Homo sapiens
ctctcctttcactaaatattct

SEQ ID NO: 8482293 - DNA, 22 bp, Homo sapiens
agtgctgggattacaggcataa

SEQ ID NO: 8482294 - DNA, 22 bp, Homo sapiens
agtgctgggattgcaggcatga

SEQ ID NO: 8482295 - DNA, 22 bp, Homo sapiens
agtgctgggattgcaggcatga

SEQ ID NO: 8482296 - DNA, 22 bp, Homo sapiens
agtgctggcccatagctgctgg

SEQ ID NO: 8482297 - DNA, 22 bp, Homo sapiens
agtgctgggattacaggcataa

SEQ ID NO: 8482298 - DNA, 22 bp, Homo sapiens
agtgctggcccatagctgctgg

SEQ ID NO: 8482299 - DNA, 22 bp, Homo sapiens
agtgctgggattacaggcataa

SEQ ID NO: 8482300 - DNA, 22 bp, Homo sapiens
ctcggcaggtggaggttgtagt

SEQ ID NO: 8482301 - DNA, 22 bp, Homo sapiens
ctcggcaggtggaggttgtagt

SEQ ID NO: 8482302 - DNA, 22 bp, Homo sapiens
agtgctggcccatagctgctgg

SEQ ID NO: 8482303 - DNA, 22 bp, Homo sapiens
agtgctggcccatagctgctgg

SEQ ID NO: 8482304 - DNA, 22 bp, Homo sapiens
ctctccagttatagctgatttg

SEQ ID NO: 8482305 - DNA, 23 bp, Homo sapiens
ctctccaccttcccacccaggga

SEQ ID NO: 8482306 - DNA, 22 bp, Homo sapiens
ctctccatctgtgtgacctccc

SEQ ID NO: 8482307 - DNA, 22 bp, Homo sapiens
ctctccatctgtgtgacctccc

SEQ ID NO: 8482308 - DNA, 22 bp, Homo sapiens
ctctccattccctacagttttc

SEQ ID NO: 8482309 - DNA, 22 bp, Homo sapiens
agtgctgggattgcaggcatga

SEQ ID NO: 8482310 - DNA, 19 bp, Homo sapiens
ctctccacctaacaggtat

SEQ ID NO: 8482311 - DNA, 23 bp, Homo sapiens
ctctccaccttcccacccaggga

SEQ ID NO: 8482312 - DNA, 22 bp, Homo sapiens
agtgctgggctatctactgcta

SEQ ID NO: 8482313 - DNA, 22 bp, Homo sapiens
agtgctgggctatctactgcta

SEQ ID NO: 8482314 - DNA, 22 bp, Homo sapiens
ctctgtcctatgcttgatagaa

SEQ ID NO: 8482315 - DNA, 22 bp, Homo sapiens
ctctgtcctggtttatactggc

SEQ ID NO: 8482316 - DNA, 22 bp, Homo sapiens
ctctgtcctccacctgctttca

SEQ ID NO: 8482317 - DNA, 22 bp, Homo sapiens
ctctgtcctccacctgctttca

SEQ ID NO: 8482318 - DNA, 22 bp, Homo sapiens
ctctgtcccagacccacctctc

SEQ ID NO: 8482319 - DNA, 22 bp, Homo sapiens
ctctgtcccagacccacctctc

SEQ ID NO: 8482320 - DNA, 22 bp, Homo sapiens
ctctgtccacaggtttgtccct

SEQ ID NO: 8482321 - DNA, 18 bp, Homo sapiens
ctctgtcataagtgtcat

SEQ ID NO: 8482322 - DNA, 22 bp, Homo sapiens
ctctgtgaacccctcctttctt

SEQ ID NO: 8482323 - DNA, 22 bp, Homo sapiens
ctctgtgagggtctgtacagaa

SEQ ID NO: 8482324 - DNA, 22 bp, Homo sapiens
ctctgtgagggtctgtacagaa

SEQ ID NO: 8482325 - DNA, 22 bp, Homo sapiens
ctctgtctatcccattctgtgc

SEQ ID NO: 8482326 - DNA, 22 bp, Homo sapiens
ctctgtccttgcacagttccta

SEQ ID NO: 8482327 - DNA, 22 bp, Homo sapiens
ctctgtgagggtctgtacagaa

SEQ ID NO: 8482328 - DNA, 22 bp, Homo sapiens
agtggtctccccagtagaataa

SEQ ID NO: 8482329 - DNA, 18 bp, Homo sapiens
agtggtctgttatatcat

SEQ ID NO: 8482330 - DNA, 22 bp, Homo sapiens
agtggtctgggctaaatgaggt

SEQ ID NO: 8482331 - DNA, 22 bp, Homo sapiens
agtggtctgcctgcctcagcct

SEQ ID NO: 8482332 - DNA, 21 bp, Homo sapiens
agtggtctttttcacccagtg

SEQ ID NO: 8482333 - DNA, 22 bp, Homo sapiens
agtggtgctgcgcgcggagctc

SEQ ID NO: 8482334 - DNA, 22 bp, Homo sapiens
agtggtggagagatgaggacac

SEQ ID NO: 8482335 - DNA, 22 bp, Homo sapiens
agtgtacaaaatgatagataaa

SEQ ID NO: 8482336 - DNA, 22 bp, Homo sapiens
agtggtggagccaggaaatgtg

SEQ ID NO: 8482337 - DNA, 22 bp, Homo sapiens
agtggtggagccaggaaatgtg

SEQ ID NO: 8482338 - DNA, 22 bp, Homo sapiens
ctcttagctgctgttctttgag

SEQ ID NO: 8482339 - DNA, 22 bp, Homo sapiens
ctcttcttggcccccatgaggg

SEQ ID NO: 8482340 - DNA, 22 bp, Homo sapiens
ctcttcttgtctctggttagaa

SEQ ID NO: 8482341 - DNA, 22 bp, Homo sapiens
ctcttgccagagatgagactct

SEQ ID NO: 8482342 - DNA, 21 bp, Homo sapiens
ctcttgctgatgtctccttta

SEQ ID NO: 8482343 - DNA, 21 bp, Homo sapiens
ctcttgtctttgctcagtagc

SEQ ID NO: 8482344 - DNA, 22 bp, Homo sapiens
ctctggagaggttcccatggga

SEQ ID NO: 8482345 - DNA, 22 bp, Homo sapiens
ctctggacttgtacatactcag

SEQ ID NO: 8482346 - DNA, 22 bp, Homo sapiens
ctctggagaactccttgtgtct

SEQ ID NO: 8482347 - DNA, 22 bp, Homo sapiens
ctctggagaactccttgtgtct

SEQ ID NO: 8482348 - DNA, 22 bp, Homo sapiens
agtggctgtgaaatacatggga

SEQ ID NO: 8482349 - DNA, 22 bp, Homo sapiens
agtggctgtgaaatacatggga

SEQ ID NO: 8482350 - DNA, 22 bp, Homo sapiens
ctctggagatggttctcaattg

SEQ ID NO: 8482351 - DNA, 22 bp, Homo sapiens
ctctggagatggttctcaattg

SEQ ID NO: 8482352 - DNA, 22 bp, Homo sapiens
ctctggagcaccgggctatcca

SEQ ID NO: 8482353 - DNA, 22 bp, Homo sapiens
ctctggagatggttctcaattg

SEQ ID NO: 8482354 - DNA, 22 bp, Homo sapiens
ctctggagatggttctcaattg

SEQ ID NO: 8482355 - DNA, 22 bp, Homo sapiens
ctctggagaggttcccatggga

SEQ ID NO: 8482356 - DNA, 22 bp, Homo sapiens
ctctgctgcaggaaggcgtgca

SEQ ID NO: 8482357 - DNA, 20 bp, Homo sapiens
ctctctccatctcagtggcc

SEQ ID NO: 8482358 - DNA, 20 bp, Homo sapiens
ctctctccatctcagtggcc

SEQ ID NO: 8482359 - DNA, 19 bp, Homo sapiens
ctctctccagtggctggct

SEQ ID NO: 8482360 - DNA, 19 bp, Homo sapiens
ctctctccagtggctggct

SEQ ID NO: 8482361 - DNA, 22 bp, Homo sapiens
ctctggacagcaggtgctgtgg

SEQ ID NO: 8482362 - DNA, 22 bp, Homo sapiens
ctctggacactggcatggggtc

SEQ ID NO: 8482363 - DNA, 22 bp, Homo sapiens
ctctggaccctcctgctgagag

SEQ ID NO: 8482364 - DNA, 22 bp, Homo sapiens
ctctggaccctcctgctgagag

SEQ ID NO: 8482365 - DNA, 22 bp, Homo sapiens
ctctggacccagacaaacctgg

SEQ ID NO: 8482366 - DNA, 22 bp, Homo sapiens
ctctggacagccctccaggaag

SEQ ID NO: 8482367 - DNA, 22 bp, Homo sapiens
ctctggacagccctccaggaag

SEQ ID NO: 8482368 - DNA, 22 bp, Homo sapiens
ctctggacctcagctacagact

SEQ ID NO: 8482369 - DNA, 22 bp, Homo sapiens
ctctgtcacttctccagctgag

SEQ ID NO: 8482370 - DNA, 22 bp, Homo sapiens
ctctgtcagagtgttgtcccca

SEQ ID NO: 8482371 - DNA, 22 bp, Homo sapiens
ctctgtcacttctccagctgag

SEQ ID NO: 8482372 - DNA, 22 bp, Homo sapiens
ctctgtcaggctgcagatgctc

SEQ ID NO: 8482373 - DNA, 22 bp, Homo sapiens
ctctgtcaggctgcagatgctc

SEQ ID NO: 8482374 - DNA, 22 bp, Homo sapiens
ctctgtacaggagacatctcta

SEQ ID NO: 8482375 - DNA, 22 bp, Homo sapiens
ctctgtacctggcatagcaacc

SEQ ID NO: 8482376 - DNA, 22 bp, Homo sapiens
ctctgtagaaagagcccaggtg

SEQ ID NO: 8482377 - DNA, 22 bp, Homo sapiens
ctctgtagaaacagggcagaag

SEQ ID NO: 8482378 - DNA, 22 bp, Homo sapiens
ctctgtagaaacagggcagaag

SEQ ID NO: 8482379 - DNA, 22 bp, Homo sapiens
ctctgtagaaagagcccaggtg

SEQ ID NO: 8482380 - DNA, 22 bp, Homo sapiens
agtgggagaatgaataagggcc

SEQ ID NO: 8482381 - DNA, 22 bp, Homo sapiens
agtgggagaatgaataagggcc

SEQ ID NO: 8482382 - DNA, 22 bp, Homo sapiens
agtgggagaatgaataagggcc

SEQ ID NO: 8482383 - DNA, 22 bp, Homo sapiens
agtgggagaatgaataagggcc

SEQ ID NO: 8482384 - DNA, 22 bp, Homo sapiens
agtgggagagaagcaagtagta

SEQ ID NO: 8482385 - DNA, 22 bp, Homo sapiens
agtgggagagaagcaagtagta

SEQ ID NO: 8482386 - DNA, 22 bp, Homo sapiens
ctctggggttagatctgatgct

SEQ ID NO: 8482387 - DNA, 22 bp, Homo sapiens
ctctgggtcaggacacaaaagt

SEQ ID NO: 8482388 - DNA, 22 bp, Homo sapiens
agtggctttttagtggcagatg

SEQ ID NO: 8482389 - DNA, 22 bp, Homo sapiens
agtggcttggctgcactacagg

SEQ ID NO: 8482390 - DNA, 22 bp, Homo sapiens
agtggcttggctgcactacagg

SEQ ID NO: 8482391 - DNA, 22 bp, Homo sapiens
agtggctgtttataggtgggta

SEQ ID NO: 8482392 - DNA, 22 bp, Homo sapiens
agtggctgttccaggtgaggac

SEQ ID NO: 8482393 - DNA, 22 bp, Homo sapiens
agtggctgttccaggtgaggac

SEQ ID NO: 8482394 - DNA, 22 bp, Homo sapiens
agtggctgttcattttacacaa

SEQ ID NO: 8482395 - DNA, 22 bp, Homo sapiens
agtggctgtttataggtgggta

SEQ ID NO: 8482396 - DNA, 22 bp, Homo sapiens
agtggcttatgtttagaatcat

SEQ ID NO: 8482397 - DNA, 22 bp, Homo sapiens
agtggcttcatttctgccagaa

SEQ ID NO: 8482398 - DNA, 22 bp, Homo sapiens
ccttggagcggtcagcactggt

SEQ ID NO: 8482399 - DNA, 22 bp, Homo sapiens
ccttggagcggtcagcactggt

SEQ ID NO: 8482400 - DNA, 22 bp, Homo sapiens
ccttggagcggtcagcactggt

SEQ ID NO: 8482401 - DNA, 22 bp, Homo sapiens
ccttggaggactgctgcttctt

SEQ ID NO: 8482402 - DNA, 22 bp, Homo sapiens
ccttggaggactgctgcttctt

SEQ ID NO: 8482403 - DNA, 19 bp, Homo sapiens
ccttggagttccaggtgga

SEQ ID NO: 8482404 - DNA, 19 bp, Homo sapiens
ccttggagttccaggtgga

SEQ ID NO: 8482405 - DNA, 22 bp, Homo sapiens
ccttggagacctgggtctgtgc

SEQ ID NO: 8482406 - DNA, 22 bp, Homo sapiens
ccttggagacaggtttgctttc

SEQ ID NO: 8482407 - DNA, 22 bp, Homo sapiens
ccttggagacctgggtctgtgc

SEQ ID NO: 8482408 - DNA, 22 bp, Homo sapiens
ccttggagaagacagtgccagg

SEQ ID NO: 8482409 - DNA, 22 bp, Homo sapiens
ccttgctgcgtgctagcacaga

SEQ ID NO: 8482410 - DNA, 22 bp, Homo sapiens
ccttggagaagacagtgccagg

SEQ ID NO: 8482411 - DNA, 22 bp, Homo sapiens
ccttgctcatcccccagtgcct

SEQ ID NO: 8482412 - DNA, 22 bp, Homo sapiens
ccttgctgaccatcacctttga

SEQ ID NO: 8482413 - DNA, 22 bp, Homo sapiens
ccttgctcaagctagtgacggg

SEQ ID NO: 8482414 - DNA, 22 bp, Homo sapiens
ccttgcgttttacagcttctag

SEQ ID NO: 8482415 - DNA, 22 bp, Homo sapiens
ccttggagttctgtttggctta

SEQ ID NO: 8482416 - DNA, 22 bp, Homo sapiens
ccttggattttgtgcccacgcc

SEQ ID NO: 8482417 - DNA, 22 bp, Homo sapiens
ccttggcaaaccagggcagctg

SEQ ID NO: 8482418 - DNA, 22 bp, Homo sapiens
ccttggcaagacagtggagggt

SEQ ID NO: 8482419 - DNA, 22 bp, Homo sapiens
ccttggcatgtggcatgtggct

SEQ ID NO: 8482420 - DNA, 22 bp, Homo sapiens
ccttggccctagcctcaggcaa

SEQ ID NO: 8482421 - DNA, 22 bp, Homo sapiens
aggtggggctgggaaagattcc

SEQ ID NO: 8482422 - DNA, 22 bp, Homo sapiens
aggtgggaacccagcagggccc

SEQ ID NO: 8482423 - DNA, 22 bp, Homo sapiens
aggtgggaacccagcagggccc

SEQ ID NO: 8482424 - DNA, 22 bp, Homo sapiens
aggtgggacccgtggggtgcga

SEQ ID NO: 8482425 - DNA, 22 bp, Homo sapiens
ccttctctctgaagaccccaaa

SEQ ID NO: 8482426 - DNA, 22 bp, Homo sapiens
ccttctctgcaggtagttggct

SEQ ID NO: 8482427 - DNA, 21 bp, Homo sapiens
aggtgggagaccatgtaggtc

SEQ ID NO: 8482428 - DNA, 21 bp, Homo sapiens
aggtgggagaccatgtaggtc

SEQ ID NO: 8482429 - DNA, 21 bp, Homo sapiens
aggtgggagaccatgtaggtc

SEQ ID NO: 8482430 - DNA, 22 bp, Homo sapiens
aggtgggacccgtggggtgcga

SEQ ID NO: 8482431 - DNA, 22 bp, Homo sapiens
aggtgggacccgtggggtgcga

SEQ ID NO: 8482432 - DNA, 22 bp, Homo sapiens
aggtgggacccgtggggtgcga

SEQ ID NO: 8482433 - DNA, 21 bp, Homo sapiens
aggtgggagaccatgtaggtc

SEQ ID NO: 8482434 - DNA, 21 bp, Homo sapiens
aggtggctgcatcctcagaag

SEQ ID NO: 8482435 - DNA, 21 bp, Homo sapiens
aggtggctgcatcctcagaag

SEQ ID NO: 8482436 - DNA, 20 bp, Homo sapiens
aggtggctcttcctgggctt

SEQ ID NO: 8482437 - DNA, 22 bp, Homo sapiens
aggtggctggtccaggctgcag

SEQ ID NO: 8482438 - DNA, 17 bp, Homo sapiens
aggtggctgctgcgcct

SEQ ID NO: 8482439 - DNA, 22 bp, Homo sapiens
aggtggcagttgtggaaccatc

SEQ ID NO: 8482440 - DNA, 22 bp, Homo sapiens
aggtgctgtttgtcagcagttt

SEQ ID NO: 8482441 - DNA, 22 bp, Homo sapiens
aggtggctctgacagctctggt

SEQ ID NO: 8482442 - DNA, 22 bp, Homo sapiens
aggtggctctgacagctctggt

SEQ ID NO: 8482443 - DNA, 22 bp, Homo sapiens
aggtggctctgacagctctggt

SEQ ID NO: 8482444 - DNA, 22 bp, Homo sapiens
aggtgctgtgctatgcacttgt

SEQ ID NO: 8482445 - DNA, 19 bp, Homo sapiens
aggtgctggtgagggtgtt

SEQ ID NO: 8482446 - DNA, 22 bp, Homo sapiens
aggtgctgtttgtcagcagttt

SEQ ID NO: 8482447 - DNA, 22 bp, Homo sapiens
aggtgctgccccgagaaggatg

SEQ ID NO: 8482448 - DNA, 17 bp, Homo sapiens
aggtgctggagcatcag

SEQ ID NO: 8482449 - DNA, 17 bp, Homo sapiens
aggtgctggagcatcag

SEQ ID NO: 8482450 - DNA, 22 bp, Homo sapiens
aggtgctggagtagaagaaaaa

SEQ ID NO: 8482451 - DNA, 22 bp, Homo sapiens
aggtgctgggcagcagtcattg

SEQ ID NO: 8482452 - DNA, 22 bp, Homo sapiens
aggtgctggagtctgggcagga

SEQ ID NO: 8482453 - DNA, 22 bp, Homo sapiens
aggtgccagctctcaggcagga

SEQ ID NO: 8482454 - DNA, 22 bp, Homo sapiens
aggtgccagctctcaggcagga

SEQ ID NO: 8482455 - DNA, 22 bp, Homo sapiens
aggtgcaggagctgtgcaggga

SEQ ID NO: 8482456 - DNA, 22 bp, Homo sapiens
aggtgcaggagctgtgcaggga

SEQ ID NO: 8482457 - DNA, 23 bp, Homo sapiens
aggtgcccagggcaggtttactg

SEQ ID NO: 8482458 - DNA, 22 bp, Homo sapiens
aggtgccagtgctgtggtcccc

SEQ ID NO: 8482459 - DNA, 22 bp, Homo sapiens
aggtgccagtgctgtggtcccc

SEQ ID NO: 8482460 - DNA, 22 bp, Homo sapiens
aggtgcctatctggtctctgca

SEQ ID NO: 8482461 - DNA, 18 bp, Homo sapiens
aggtgccctccttacact

SEQ ID NO: 8482462 - DNA, 22 bp, Homo sapiens
aggtgcccatcacctcacagtc

SEQ ID NO: 8482463 - DNA, 22 bp, Homo sapiens
aggtgcccatcacctcacagtc

SEQ ID NO: 8482464 - DNA, 18 bp, Homo sapiens
aggtgctcaaatgggaaa

SEQ ID NO: 8482465 - DNA, 22 bp, Homo sapiens
aggtgcctgggagctccctgag

SEQ ID NO: 8482466 - DNA, 22 bp, Homo sapiens
cctgggacctcgcgggaagcgg

SEQ ID NO: 8482467 - DNA, 22 bp, Homo sapiens
cctgggacctcgcgggaagcgg

SEQ ID NO: 8482468 - DNA, 22 bp, Homo sapiens
cctgggactcggccaggacaga

SEQ ID NO: 8482469 - DNA, 19 bp, Homo sapiens
cctgggacttaggctgggt

SEQ ID NO: 8482470 - DNA, 22 bp, Homo sapiens
cctgggactcggccaggacaga

SEQ ID NO: 8482471 - DNA, 22 bp, Homo sapiens
cctgggagaactgctgggttgg

SEQ ID NO: 8482472 - DNA, 22 bp, Homo sapiens
cctgggagaactgctgggttgg

SEQ ID NO: 8482473 - DNA, 22 bp, Homo sapiens
cctgggagaactgctgggttgg

SEQ ID NO: 8482474 - DNA, 21 bp, Homo sapiens
cggagctgggcagggcatccc

SEQ ID NO: 8482475 - DNA, 22 bp, Homo sapiens
cggaggcaaactcacctggctc

SEQ ID NO: 8482476 - DNA, 22 bp, Homo sapiens
cggagctgcgccgggacacggg

SEQ ID NO: 8482477 - DNA, 22 bp, Homo sapiens
cggagctggcgtctgtgtggac

SEQ ID NO: 8482478 - DNA, 22 bp, Homo sapiens
cggagctgcctgccaagcctgc

SEQ ID NO: 8482479 - DNA, 22 bp, Homo sapiens
cggagctgcctgccaagcctgc

SEQ ID NO: 8482480 - DNA, 22 bp, Homo sapiens
cggagcagaaggcgccgccggc

SEQ ID NO: 8482481 - DNA, 22 bp, Homo sapiens
cggagaggtgggggcagcatct

SEQ ID NO: 8482482 - DNA, 22 bp, Homo sapiens
cggagcagagccactcgggccg

SEQ ID NO: 8482483 - DNA, 22 bp, Homo sapiens
cggagcctgcttgttgcagctg

SEQ ID NO: 8482484 - DNA, 22 bp, Homo sapiens
cggccaagccggggccccgaag

SEQ ID NO: 8482485 - DNA, 22 bp, Homo sapiens
cggccaggcacagtggcccacg

SEQ ID NO: 8482486 - DNA, 22 bp, Homo sapiens
cggccaagccggggccccgaag

SEQ ID NO: 8482487 - DNA, 22 bp, Homo sapiens
cggccaagccggggccccgaag

SEQ ID NO: 8482488 - DNA, 22 bp, Homo sapiens
cggcatgggcgtccccctcact

SEQ ID NO: 8482489 - DNA, 22 bp, Homo sapiens
cggcatgggcgtccccctcact

SEQ ID NO: 8482490 - DNA, 22 bp, Homo sapiens
cggaggggtttgaacagaggag

SEQ ID NO: 8482491 - DNA, 22 bp, Homo sapiens
cggaggggtttgaacagaggag

SEQ ID NO: 8482492 - DNA, 22 bp, Homo sapiens
cggaggggtttgaacagaggag

SEQ ID NO: 8482493 - DNA, 22 bp, Homo sapiens
cggaggggatacattttctgaa

SEQ ID NO: 8482494 - DNA, 22 bp, Homo sapiens
cggaggggtttgaacagaggag

SEQ ID NO: 8482495 - DNA, 22 bp, Homo sapiens
cggaggggatacattttctgaa

SEQ ID NO: 8482496 - DNA, 22 bp, Homo sapiens
cggctcactgcagctccgcctc

SEQ ID NO: 8482497 - DNA, 22 bp, Homo sapiens
cggctcactgcagctccgcctc

SEQ ID NO: 8482498 - DNA, 22 bp, Homo sapiens
cggctcactgcagctccgcctc

SEQ ID NO: 8482499 - DNA, 22 bp, Homo sapiens
cggctcactgcagctccgcctc

SEQ ID NO: 8482500 - DNA, 22 bp, Homo sapiens
cggccctggcggaggcgggaga

SEQ ID NO: 8482501 - DNA, 22 bp, Homo sapiens
cggccctgctgagcttgtctgg

SEQ ID NO: 8482502 - DNA, 22 bp, Homo sapiens
cggccctgaccagaccttagtt

SEQ ID NO: 8482503 - DNA, 22 bp, Homo sapiens
cggccgcgtccagggccgccag

SEQ ID NO: 8482504 - DNA, 22 bp, Homo sapiens
agtatatagtggcgctgtatgc

SEQ ID NO: 8482505 - DNA, 22 bp, Homo sapiens
agtatatgccagagagatagct

SEQ ID NO: 8482506 - DNA, 22 bp, Homo sapiens
agtatatctgcttctgggtccc

SEQ ID NO: 8482507 - DNA, 22 bp, Homo sapiens
agtatattgctcttaatcatag

SEQ ID NO: 8482508 - DNA, 22 bp, Homo sapiens
agtatcaaggatctccagcacc

SEQ ID NO: 8482509 - DNA, 22 bp, Homo sapiens
agtatattttgattgtatgtgt

SEQ ID NO: 8482510 - DNA, 22 bp, Homo sapiens
agtatatttgttaagattattc

SEQ ID NO: 8482511 - DNA, 22 bp, Homo sapiens
agtatatttgttaagattattc

SEQ ID NO: 8482512 - DNA, 22 bp, Homo sapiens
agtatatttgttaagattattc

SEQ ID NO: 8482513 - DNA, 22 bp, Homo sapiens
agtatattgctcttaatcatag

SEQ ID NO: 8482514 - DNA, 22 bp, Homo sapiens
agtatattggtgttattcctca

SEQ ID NO: 8482515 - DNA, 22 bp, Homo sapiens
agtatattggtgttattcctca

SEQ ID NO: 8482516 - DNA, 22 bp, Homo sapiens
agtatatttaccattgggtggg

SEQ ID NO: 8482517 - DNA, 20 bp, Homo sapiens
cgaggccaaggggctgggcc

SEQ ID NO: 8482518 - DNA, 20 bp, Homo sapiens
cgaggccaaggggctgggcc

SEQ ID NO: 8482519 - DNA, 22 bp, Homo sapiens
cgaggccaatgtgttttatgaa

SEQ ID NO: 8482520 - DNA, 22 bp, Homo sapiens
cgaggccacacctgcttctggg

SEQ ID NO: 8482521 - DNA, 22 bp, Homo sapiens
cgaggccagctctaagccctac

SEQ ID NO: 8482522 - DNA, 22 bp, Homo sapiens
cgaggccaccgtggtttccgag

SEQ ID NO: 8482523 - DNA, 22 bp, Homo sapiens
ccttttatactctgtcctctgg

SEQ ID NO: 8482524 - DNA, 22 bp, Homo sapiens
ccttttatatggctcatcacag

SEQ ID NO: 8482525 - DNA, 22 bp, Homo sapiens
cgagcatgatgacggctgtggc

SEQ ID NO: 8482526 - DNA, 22 bp, Homo sapiens
cgaggaagaagtttgagtcaag

SEQ ID NO: 8482527 - DNA, 22 bp, Homo sapiens
cgaggaagaagtttgagtcaag

SEQ ID NO: 8482528 - DNA, 22 bp, Homo sapiens
ccttttaagggagactagagat

SEQ ID NO: 8482529 - DNA, 22 bp, Homo sapiens
cctttggtcacctccactctta

SEQ ID NO: 8482530 - DNA, 22 bp, Homo sapiens
cctttggtcttgatgaactgtt

SEQ ID NO: 8482531 - DNA, 22 bp, Homo sapiens
cctttggtggttttcagagatc

SEQ ID NO: 8482532 - DNA, 19 bp, Homo sapiens
cctttggtttccatgacat

SEQ ID NO: 8482533 - DNA, 22 bp, Homo sapiens
aggtgggggctgtgtccttgac

SEQ ID NO: 8482534 - DNA, 22 bp, Homo sapiens
aggtggggtgagctgcagacta

SEQ ID NO: 8482535 - DNA, 22 bp, Homo sapiens
aggtgggggctgtgtccttgac

SEQ ID NO: 8482536 - DNA, 22 bp, Homo sapiens
cctttattcaattagtcctaat

SEQ ID NO: 8482537 - DNA, 22 bp, Homo sapiens
aggtggggtgttggatgtttat

SEQ ID NO: 8482538 - DNA, 22 bp, Homo sapiens
aggtggggtgagctgcagacta

SEQ ID NO: 8482539 - DNA, 22 bp, Homo sapiens
aggtggggtgagctgcagacta

SEQ ID NO: 8482540 - DNA, 22 bp, Homo sapiens
cctgccctagagatgacacaat

SEQ ID NO: 8482541 - DNA, 22 bp, Homo sapiens
cctgccctagagatgacacaat

SEQ ID NO: 8482542 - DNA, 22 bp, Homo sapiens
cctgccctatgaccagcttcac

SEQ ID NO: 8482543 - DNA, 22 bp, Homo sapiens
cctgccctatgaccagcttcac

SEQ ID NO: 8482544 - DNA, 22 bp, Homo sapiens
cctgcccagggtcaccacagag

SEQ ID NO: 8482545 - DNA, 22 bp, Homo sapiens
cctgcccctcaaggcctggtgc

SEQ ID NO: 8482546 - DNA, 22 bp, Homo sapiens
cctgcccctcaaggcctggtgc

SEQ ID NO: 8482547 - DNA, 22 bp, Homo sapiens
cctgcccctcaaggcctggtgc

SEQ ID NO: 8482548 - DNA, 22 bp, Homo sapiens
cctgcccaggagtctctctgtg

SEQ ID NO: 8482549 - DNA, 22 bp, Homo sapiens
cctgcccagcttcccgagtgca

SEQ ID NO: 8482550 - DNA, 19 bp, Homo sapiens
cctctgccagcccgcctct

SEQ ID NO: 8482551 - DNA, 19 bp, Homo sapiens
cctctgccagcccgcctct

SEQ ID NO: 8482552 - DNA, 22 bp, Homo sapiens
cctgccaggacattgcttgaag

SEQ ID NO: 8482553 - DNA, 22 bp, Homo sapiens
cctctgcaaagaatttgtctcc

SEQ ID NO: 8482554 - DNA, 22 bp, Homo sapiens
cctctgcagcagagagccagag

SEQ ID NO: 8482555 - DNA, 22 bp, Homo sapiens
cctctgcacttcaccttagctc

SEQ ID NO: 8482556 - DNA, 22 bp, Homo sapiens
cctctgcatctggctgctgcag

SEQ ID NO: 8482557 - DNA, 22 bp, Homo sapiens
cctctgccacctcccacgaggc

SEQ ID NO: 8482558 - DNA, 22 bp, Homo sapiens
cctctgccacctcccacgaggc

SEQ ID NO: 8482559 - DNA, 22 bp, Homo sapiens
cctctctcttgtagtccctgcc

SEQ ID NO: 8482560 - DNA, 22 bp, Homo sapiens
cctctctctgcatctggagggc

SEQ ID NO: 8482561 - DNA, 22 bp, Homo sapiens
cctctctctgcatctggagggc

SEQ ID NO: 8482562 - DNA, 22 bp, Homo sapiens
cctctctccaattttcacctca

SEQ ID NO: 8482563 - DNA, 22 bp, Homo sapiens
cctctctccaattttcacctca

SEQ ID NO: 8482564 - DNA, 22 bp, Homo sapiens
agggtctgacaatgtgacttag

SEQ ID NO: 8482565 - DNA, 22 bp, Homo sapiens
agggtctgaccaccagtaggga

SEQ ID NO: 8482566 - DNA, 20 bp, Homo sapiens
agggtctggccctgttcctt

SEQ ID NO: 8482567 - DNA, 22 bp, Homo sapiens
agggtctgactcctctggcaag

SEQ ID NO: 8482568 - DNA, 22 bp, Homo sapiens
agggtctgactcctctggcaag

SEQ ID NO: 8482569 - DNA, 22 bp, Homo sapiens
agggtctgactgaatggaaaag

SEQ ID NO: 8482570 - DNA, 23 bp, Homo sapiens
agggtgagcaagctatggagacc

SEQ ID NO: 8482571 - DNA, 20 bp, Homo sapiens
agggtgagacatgagcctcc

SEQ ID NO: 8482572 - DNA, 20 bp, Homo sapiens
agggtgagacatgagcctcc

SEQ ID NO: 8482573 - DNA, 22 bp, Homo sapiens
agggtgaatctcacaactctta

SEQ ID NO: 8482574 - DNA, 22 bp, Homo sapiens
agggtgaatctcacaactctta

SEQ ID NO: 8482575 - DNA, 22 bp, Homo sapiens
agggtgaatctcacaactctta

SEQ ID NO: 8482576 - DNA, 22 bp, Homo sapiens
agggtgaatctcacaactctta

SEQ ID NO: 8482577 - DNA, 22 bp, Homo sapiens
agggtctgtggatgcatctggg

SEQ ID NO: 8482578 - DNA, 22 bp, Homo sapiens
agggtctgtggatgcatctggg

SEQ ID NO: 8482579 - DNA, 22 bp, Homo sapiens
agggtcttgaggatctgaactg

SEQ ID NO: 8482580 - DNA, 22 bp, Homo sapiens
agggtcttcccaccattcctgc

SEQ ID NO: 8482581 - DNA, 20 bp, Homo sapiens
agggtcagtagcacagagct

SEQ ID NO: 8482582 - DNA, 20 bp, Homo sapiens
agggtcagtagcacagagct

SEQ ID NO: 8482583 - DNA, 22 bp, Homo sapiens
agggtcaggttaagggagtcat

SEQ ID NO: 8482584 - DNA, 17 bp, Homo sapiens
agggtcaggtgaagttc

SEQ ID NO: 8482585 - DNA, 22 bp, Homo sapiens
agggtcaggttaagggagtcat

SEQ ID NO: 8482586 - DNA, 20 bp, Homo sapiens
agggtcagtagcacagagct

SEQ ID NO: 8482587 - DNA, 20 bp, Homo sapiens
agggtcagtagcacagagct

SEQ ID NO: 8482588 - DNA, 20 bp, Homo sapiens
agggtcagtagcacagagct

SEQ ID NO: 8482589 - DNA, 22 bp, Homo sapiens
agggtcaggagacactggcaac

SEQ ID NO: 8482590 - DNA, 22 bp, Homo sapiens
agggtcaggagacactggcaac

SEQ ID NO: 8482591 - DNA, 19 bp, Homo sapiens
agggtcaggacaaggactt

SEQ ID NO: 8482592 - DNA, 22 bp, Homo sapiens
agggtcagggagtgagtattta

SEQ ID NO: 8482593 - DNA, 17 bp, Homo sapiens
agggtcaggtgaagttc

SEQ ID NO: 8482594 - DNA, 22 bp, Homo sapiens
cctgccctgctcactgtcggta

SEQ ID NO: 8482595 - DNA, 20 bp, Homo sapiens
agggtcagagagcgtgagtg

SEQ ID NO: 8482596 - DNA, 20 bp, Homo sapiens
agggtcagagagcgtgagtg

SEQ ID NO: 8482597 - DNA, 20 bp, Homo sapiens
agggtcagagagcgtgagtg

SEQ ID NO: 8482598 - DNA, 22 bp, Homo sapiens
agggtcagagatcggccatgtg

SEQ ID NO: 8482599 - DNA, 22 bp, Homo sapiens
agggtcagagatcggccatgtg

SEQ ID NO: 8482600 - DNA, 22 bp, Homo sapiens
agggtcagagtcaggtgcagta

SEQ ID NO: 8482601 - DNA, 22 bp, Homo sapiens
agggtcagagtcaggtgcagta

SEQ ID NO: 8482602 - DNA, 22 bp, Homo sapiens
agggtcagagtcaggtgcagta

SEQ ID NO: 8482603 - DNA, 21 bp, Homo sapiens
agggtcaggaaccagggtacc

SEQ ID NO: 8482604 - DNA, 22 bp, Homo sapiens
agggtcagctggctgtcagggg

SEQ ID NO: 8482605 - DNA, 21 bp, Homo sapiens
agggtcaggaaccagggtacc

SEQ ID NO: 8482606 - DNA, 21 bp, Homo sapiens
agggtcaggaaccagggtacc

SEQ ID NO: 8482607 - DNA, 21 bp, Homo sapiens
agggtcaggaaccagggtacc

SEQ ID NO: 8482608 - DNA, 19 bp, Homo sapiens
agggtcaggacaaggactt

SEQ ID NO: 8482609 - DNA, 19 bp, Homo sapiens
agggtcaggacaaggactt

SEQ ID NO: 8482610 - DNA, 20 bp, Homo sapiens
cctggaagagctccccaggc

SEQ ID NO: 8482611 - DNA, 20 bp, Homo sapiens
cctggaagagctccccaggc

SEQ ID NO: 8482612 - DNA, 22 bp, Homo sapiens
cctggaaggacaatagatagtg

SEQ ID NO: 8482613 - DNA, 22 bp, Homo sapiens
cctggaagattcaccactacca

SEQ ID NO: 8482614 - DNA, 22 bp, Homo sapiens
cctggaagattcaccactacca

SEQ ID NO: 8482615 - DNA, 22 bp, Homo sapiens
cctggaaggcaggcatggattg

SEQ ID NO: 8482616 - DNA, 22 bp, Homo sapiens
cctggaaggtgatggtacagca

SEQ ID NO: 8482617 - DNA, 22 bp, Homo sapiens
cctggaagttggaggttgcagt

SEQ ID NO: 8482618 - DNA, 22 bp, Homo sapiens
cctggacacccattccttggct

SEQ ID NO: 8482619 - DNA, 22 bp, Homo sapiens
cctggacaatgagatgtcaggg

SEQ ID NO: 8482620 - DNA, 22 bp, Homo sapiens
cctggacagagggcagcggcca

SEQ ID NO: 8482621 - DNA, 22 bp, Homo sapiens
cctggcagcgtgccgagctgcg

SEQ ID NO: 8482622 - DNA, 22 bp, Homo sapiens
cctggcagcgtgccgagctgcg

SEQ ID NO: 8482623 - DNA, 22 bp, Homo sapiens
cctggcagcgtgccgagctgcg

SEQ ID NO: 8482624 - DNA, 22 bp, Homo sapiens
cctggcagcgtgccgagctgcg

SEQ ID NO: 8482625 - DNA, 22 bp, Homo sapiens
cctggcagcgccgaagctggcc

SEQ ID NO: 8482626 - DNA, 22 bp, Homo sapiens
cctggcagcgccgaagctggcc

SEQ ID NO: 8482627 - DNA, 22 bp, Homo sapiens
cctggcagcgccgaagctggcc

SEQ ID NO: 8482628 - DNA, 22 bp, Homo sapiens
cctggcagcgccgaagctggcc

SEQ ID NO: 8482629 - DNA, 22 bp, Homo sapiens
cctggcacagatccttcataca

SEQ ID NO: 8482630 - DNA, 22 bp, Homo sapiens
cctggaccaaacactggcctgg

SEQ ID NO: 8482631 - DNA, 22 bp, Homo sapiens
cctggcacataatagtggctca

SEQ ID NO: 8482632 - DNA, 22 bp, Homo sapiens
cctggcacataatagtggctca

SEQ ID NO: 8482633 - DNA, 22 bp, Homo sapiens
cctggcacataatagtggctca

SEQ ID NO: 8482634 - DNA, 22 bp, Homo sapiens
cctgctctgccaagtcctcttt

SEQ ID NO: 8482635 - DNA, 22 bp, Homo sapiens
cctgctctgccaagtcctcttt

SEQ ID NO: 8482636 - DNA, 22 bp, Homo sapiens
cctgctctggtttagtcagtct

SEQ ID NO: 8482637 - DNA, 22 bp, Homo sapiens
cctgctctggtttagtcagtct

SEQ ID NO: 8482638 - DNA, 22 bp, Homo sapiens
cctgctctggtttagtcagtct

SEQ ID NO: 8482639 - DNA, 22 bp, Homo sapiens
cctgctctggtttagtcagtct

SEQ ID NO: 8482640 - DNA, 22 bp, Homo sapiens
cctgctctgccaagtcctcttt

SEQ ID NO: 8482641 - DNA, 22 bp, Homo sapiens
cctgctctgccaagtcctcttt

SEQ ID NO: 8482642 - DNA, 22 bp, Homo sapiens
cctgctctgccaagtcctcttt

SEQ ID NO: 8482643 - DNA, 22 bp, Homo sapiens
cctgcctggcttccagaagaga

SEQ ID NO: 8482644 - DNA, 22 bp, Homo sapiens
cctgcctggcttccagaagaga

SEQ ID NO: 8482645 - DNA, 22 bp, Homo sapiens
cctgcctggcttccagaagaga

SEQ ID NO: 8482646 - DNA, 22 bp, Homo sapiens
cctgctctagactctgggaagg

SEQ ID NO: 8482647 - DNA, 20 bp, Homo sapiens
agggtgagacatgagcctcc

SEQ ID NO: 8482648 - DNA, 22 bp, Homo sapiens
cctgctctaaatctcatggaac

SEQ ID NO: 8482649 - DNA, 22 bp, Homo sapiens
cctgctctccatacactttcta

SEQ ID NO: 8482650 - DNA, 22 bp, Homo sapiens
cctgctctagactctgggaagg

SEQ ID NO: 8482651 - DNA, 22 bp, Homo sapiens
cctgctcttatagctgtttcca

SEQ ID NO: 8482652 - DNA, 22 bp, Homo sapiens
cctgctgaggtcagccacccaa

SEQ ID NO: 8482653 - DNA, 19 bp, Homo sapiens
cctgctgcaccacttgtta

SEQ ID NO: 8482654 - DNA, 22 bp, Homo sapiens
cctgctgctatgaaggtgacag

SEQ ID NO: 8482655 - DNA, 22 bp, Homo sapiens
cctggaaagctgccctgtgaca

SEQ ID NO: 8482656 - DNA, 22 bp, Homo sapiens
cctggcagctaagtgctttgag

SEQ ID NO: 8482657 - DNA, 22 bp, Homo sapiens
cctggcagctcctccccggcgg

SEQ ID NO: 8482658 - DNA, 22 bp, Homo sapiens
cctggcagctcctccccggcgg

SEQ ID NO: 8482659 - DNA, 22 bp, Homo sapiens
cctggcagctcctccccggcgg

SEQ ID NO: 8482660 - DNA, 22 bp, Homo sapiens
cctggcagctgtttggcttggc

SEQ ID NO: 8482661 - DNA, 22 bp, Homo sapiens
cctggcagctgtttggcttggc

SEQ ID NO: 8482662 - DNA, 22 bp, Homo sapiens
cctggccaatctagggctgtta

SEQ ID NO: 8482663 - DNA, 22 bp, Homo sapiens
cctggccaatctagggctgtta

SEQ ID NO: 8482664 - DNA, 21 bp, Homo sapiens
cctggccaatctgatagggtt

SEQ ID NO: 8482665 - DNA, 22 bp, Homo sapiens
cctggccactcaggtgtggggc

SEQ ID NO: 8482666 - DNA, 22 bp, Homo sapiens
cctggccactcaggtgtggggc

SEQ ID NO: 8482667 - DNA, 22 bp, Homo sapiens
cctggccactcaggtgtggggc

SEQ ID NO: 8482668 - DNA, 19 bp, Homo sapiens
cctggccagacttctgccc

SEQ ID NO: 8482669 - DNA, 22 bp, Homo sapiens
cctggccagaggcgtgcctgtg

SEQ ID NO: 8482670 - DNA, 22 bp, Homo sapiens
cctggccagaggcgtgcctgtg

SEQ ID NO: 8482671 - DNA, 22 bp, Homo sapiens
cctggccagaggcgtgcctgtg

SEQ ID NO: 8482672 - DNA, 22 bp, Homo sapiens
cctggccacagggctctgcatt

SEQ ID NO: 8482673 - DNA, 21 bp, Homo sapiens
cctggccaatctgatagggtt

SEQ ID NO: 8482674 - DNA, 20 bp, Homo sapiens
cctggccaatgagataggaa

SEQ ID NO: 8482675 - DNA, 20 bp, Homo sapiens
cctggccaatgagataggaa

SEQ ID NO: 8482676 - DNA, 20 bp, Homo sapiens
cctggccaatgagataggaa

SEQ ID NO: 8482677 - DNA, 22 bp, Homo sapiens
cctggctggtggcagcgacaag

SEQ ID NO: 8482678 - DNA, 22 bp, Homo sapiens
cctggctggtggcagcgacaag

SEQ ID NO: 8482679 - DNA, 22 bp, Homo sapiens
cctggctggggtagaagtgagg

SEQ ID NO: 8482680 - DNA, 17 bp, Homo sapiens
cctggctgggaatctga

SEQ ID NO: 8482681 - DNA, 22 bp, Homo sapiens
cctggctgggcctgatttctca

SEQ ID NO: 8482682 - DNA, 22 bp, Homo sapiens
cctggctggcaagatcgtgaag

SEQ ID NO: 8482683 - DNA, 23 bp, Homo sapiens
cctggctggattctctgcattca

SEQ ID NO: 8482684 - DNA, 23 bp, Homo sapiens
cctggctggattctctgcattca

SEQ ID NO: 8482685 - DNA, 19 bp, Homo sapiens
cctggctgctgtgggatgc

SEQ ID NO: 8482686 - DNA, 22 bp, Homo sapiens
cctggctgcttcctctgccatg

SEQ ID NO: 8482687 - DNA, 22 bp, Homo sapiens
cctggctggatggagcccctgg

SEQ ID NO: 8482688 - DNA, 22 bp, Homo sapiens
cctggctggatggagcccctgg

SEQ ID NO: 8482689 - DNA, 22 bp, Homo sapiens
cctggctggactggaccgtggc

SEQ ID NO: 8482690 - DNA, 22 bp, Homo sapiens
cctggctggactggaccgtggc

SEQ ID NO: 8482691 - DNA, 22 bp, Homo sapiens
cctggctgctttcactatggag

SEQ ID NO: 8482692 - DNA, 22 bp, Homo sapiens
cctggctgctttcactatggag

SEQ ID NO: 8482693 - DNA, 22 bp, Homo sapiens
cctggctgctttcactatggag

SEQ ID NO: 8482694 - DNA, 22 bp, Homo sapiens
cctggctggactggaccgtggc

SEQ ID NO: 8482695 - DNA, 22 bp, Homo sapiens
ataatacatggttgatcttttc

SEQ ID NO: 8482696 - DNA, 22 bp, Homo sapiens
ataatacatggttgatcttttc

SEQ ID NO: 8482697 - DNA, 22 bp, Homo sapiens
ataatacatggttgatcttttc

SEQ ID NO: 8482698 - DNA, 22 bp, Homo sapiens
ctgctctgtatatgagcaggaa

SEQ ID NO: 8482699 - DNA, 22 bp, Homo sapiens
ataatacatggttaacctcttt

SEQ ID NO: 8482700 - DNA, 22 bp, Homo sapiens
ataatacatggttaacctcttt

SEQ ID NO: 8482701 - DNA, 22 bp, Homo sapiens
ctgctctggggaagccagatgt

SEQ ID NO: 8482702 - DNA, 22 bp, Homo sapiens
ctgctctggggaagccagatgt

SEQ ID NO: 8482703 - DNA, 21 bp, Homo sapiens
ctgctctggggaccggctgtg

SEQ ID NO: 8482704 - DNA, 22 bp, Homo sapiens
ctgctctggtctcttcatgttt

SEQ ID NO: 8482705 - DNA, 21 bp, Homo sapiens
ctgctctggggaccggctgtg

SEQ ID NO: 8482706 - DNA, 21 bp, Homo sapiens
ctgctctggggaccggctgtg

SEQ ID NO: 8482707 - DNA, 22 bp, Homo sapiens
ctgctctggctgtgtacttcag

SEQ ID NO: 8482708 - DNA, 22 bp, Homo sapiens
ctgctctggcgtactcggcatc

SEQ ID NO: 8482709 - DNA, 22 bp, Homo sapiens
ctgctctggcgtactcggcatc

SEQ ID NO: 8482710 - DNA, 22 bp, Homo sapiens
ctgctctggctgtgtacttcag

SEQ ID NO: 8482711 - DNA, 22 bp, Homo sapiens
ctgctctggctgtgtacttcag

SEQ ID NO: 8482712 - DNA, 22 bp, Homo sapiens
ctgctctggctgtgtacttcag

SEQ ID NO: 8482713 - DNA, 22 bp, Homo sapiens
ctgctctggcgtactcggcatc

SEQ ID NO: 8482714 - DNA, 22 bp, Homo sapiens
ctgctctggcgtactcggcatc

SEQ ID NO: 8482715 - DNA, 20 bp, Homo sapiens
ctgctctgctttgcaggtgg

SEQ ID NO: 8482716 - DNA, 20 bp, Homo sapiens
ctgctctgctttgcaggtgg

SEQ ID NO: 8482717 - DNA, 22 bp, Homo sapiens
ctgctctgctgatcagtgtctc

SEQ ID NO: 8482718 - DNA, 22 bp, Homo sapiens
ctgctctgctgatcagtgtctc

SEQ ID NO: 8482719 - DNA, 22 bp, Homo sapiens
ctgctctgctgatcagtgtctc

SEQ ID NO: 8482720 - DNA, 22 bp, Homo sapiens
ctgctctgctgatcagtgtctc

SEQ ID NO: 8482721 - DNA, 22 bp, Homo sapiens
ctgctctgctgatcagtgtctc

SEQ ID NO: 8482722 - DNA, 22 bp, Homo sapiens
ctgctctgcagcttggactccc

SEQ ID NO: 8482723 - DNA, 22 bp, Homo sapiens
ctgctctgcagcttggactccc

SEQ ID NO: 8482724 - DNA, 22 bp, Homo sapiens
ctgctctgcaaggcacagtgat

SEQ ID NO: 8482725 - DNA, 22 bp, Homo sapiens
ctgctctgcagcttggactccc

SEQ ID NO: 8482726 - DNA, 22 bp, Homo sapiens
ctgctctgcagcttggactccc

SEQ ID NO: 8482727 - DNA, 22 bp, Homo sapiens
ctgctctgcagcttggactccc

SEQ ID NO: 8482728 - DNA, 22 bp, Homo sapiens
ctgctctgagtattaacggagg

SEQ ID NO: 8482729 - DNA, 22 bp, Homo sapiens
ctgctctgcaaggcacagtgat

SEQ ID NO: 8482730 - DNA, 22 bp, Homo sapiens
ctgctctgcaaggcacagtgat

SEQ ID NO: 8482731 - DNA, 22 bp, Homo sapiens
ctgcccagaagccagatgggca

SEQ ID NO: 8482732 - DNA, 22 bp, Homo sapiens
ctgcccacttggccaccttcta

SEQ ID NO: 8482733 - DNA, 22 bp, Homo sapiens
ctgcccagaagcttagagctta

SEQ ID NO: 8482734 - DNA, 22 bp, Homo sapiens
ctgcccagaatcactcactcga

SEQ ID NO: 8482735 - DNA, 22 bp, Homo sapiens
ctgcccagaagcttagagctta

SEQ ID NO: 8482736 - DNA, 22 bp, Homo sapiens
ctgcccagaatcactcactcga

SEQ ID NO: 8482737 - DNA, 18 bp, Homo sapiens
ctgcccagagcacttgtg

SEQ ID NO: 8482738 - DNA, 19 bp, Homo sapiens
ctgctcaggtcagtctgtc

SEQ ID NO: 8482739 - DNA, 22 bp, Homo sapiens
ctgctctgagaggctcttccta

SEQ ID NO: 8482740 - DNA, 22 bp, Homo sapiens
ctgcccaccacacctgctcctg

SEQ ID NO: 8482741 - DNA, 22 bp, Homo sapiens
ctgcccaccgtgtgcacgtgcg

SEQ ID NO: 8482742 - DNA, 22 bp, Homo sapiens
ctgcccactatgttgtcatggg

SEQ ID NO: 8482743 - DNA, 20 bp, Homo sapiens
ctgcccactagaactacctg

SEQ ID NO: 8482744 - DNA, 22 bp, Homo sapiens
ctgcccaccgtgtgcacgtgcg

SEQ ID NO: 8482745 - DNA, 22 bp, Homo sapiens
ataaatatcactgttgtccctc

SEQ ID NO: 8482746 - DNA, 22 bp, Homo sapiens
ataaatatcactgttgtccctc

SEQ ID NO: 8482747 - DNA, 22 bp, Homo sapiens
ataaatatcactgttgtccctc

SEQ ID NO: 8482748 - DNA, 22 bp, Homo sapiens
ataaatatcactgttgtccctc

SEQ ID NO: 8482749 - DNA, 22 bp, Homo sapiens
ctgcccacagttctctgccatg

SEQ ID NO: 8482750 - DNA, 22 bp, Homo sapiens
ataaatctattggacatgtgtg

SEQ ID NO: 8482751 - DNA, 22 bp, Homo sapiens
ctgcccacagttctctgccatg

SEQ ID NO: 8482752 - DNA, 22 bp, Homo sapiens
atacaagactcagcacagacgg

SEQ ID NO: 8482753 - DNA, 22 bp, Homo sapiens
atacaagactcagcacagacgg

SEQ ID NO: 8482754 - DNA, 22 bp, Homo sapiens
atacaagactcagcacagacgg

SEQ ID NO: 8482755 - DNA, 18 bp, Homo sapiens
atacaagatcaagtgttc

SEQ ID NO: 8482756 - DNA, 22 bp, Homo sapiens
atacaagatcactccagaaaat

SEQ ID NO: 8482757 - DNA, 22 bp, Homo sapiens
atacaagatcactccagaaaat

SEQ ID NO: 8482758 - DNA, 18 bp, Homo sapiens
atacaagctctgttactt

SEQ ID NO: 8482759 - DNA, 18 bp, Homo sapiens
atacaagcagcagagatt

SEQ ID NO: 8482760 - DNA, 22 bp, Homo sapiens
atacaagtgagaaaactgaaga

SEQ ID NO: 8482761 - DNA, 22 bp, Homo sapiens
atacaagtgatataattgtttc

SEQ ID NO: 8482762 - DNA, 22 bp, Homo sapiens
atacaagtgatataattgtttc

SEQ ID NO: 8482763 - DNA, 22 bp, Homo sapiens
ctgctttaatgtaagatatacc

SEQ ID NO: 8482764 - DNA, 22 bp, Homo sapiens
ctgcttctgggatgatggagta

SEQ ID NO: 8482765 - DNA, 18 bp, Homo sapiens
ctgcttctgtctgccagt

SEQ ID NO: 8482766 - DNA, 18 bp, Homo sapiens
ctgcttctgtctgccagt

SEQ ID NO: 8482767 - DNA, 22 bp, Homo sapiens
ctgctgtgtgcttacttgggtt

SEQ ID NO: 8482768 - DNA, 22 bp, Homo sapiens
ctgcttctagcaccaagtccct

SEQ ID NO: 8482769 - DNA, 22 bp, Homo sapiens
ctgcttctagcaccaagtccct

SEQ ID NO: 8482770 - DNA, 22 bp, Homo sapiens
ctgcttctccaaagtaggactt

SEQ ID NO: 8482771 - DNA, 22 bp, Homo sapiens
ctgcttctccaaagtaggactt

SEQ ID NO: 8482772 - DNA, 22 bp, Homo sapiens
ctgcttctccaaagtaggactt

SEQ ID NO: 8482773 - DNA, 22 bp, Homo sapiens
ctgcttgacctgttgttctcac

SEQ ID NO: 8482774 - DNA, 22 bp, Homo sapiens
ctgcttggaggcctgggtgcta

SEQ ID NO: 8482775 - DNA, 22 bp, Homo sapiens
ctgcttggcattggtaaagaat

SEQ ID NO: 8482776 - DNA, 22 bp, Homo sapiens
ctgcttggagtcctccagcacc

SEQ ID NO: 8482777 - DNA, 17 bp, Homo sapiens
ctgcttggcctctgggg

SEQ ID NO: 8482778 - DNA, 22 bp, Homo sapiens
ctgcttggcttataacctcagg

SEQ ID NO: 8482779 - DNA, 18 bp, Homo sapiens
ctgcttgggagacgtcag

SEQ ID NO: 8482780 - DNA, 20 bp, Homo sapiens
ctgcttgggacactgccaga

SEQ ID NO: 8482781 - DNA, 18 bp, Homo sapiens
ctgcttgggagacgtcag

SEQ ID NO: 8482782 - DNA, 22 bp, Homo sapiens
ctgcttgggtcctggcatgggt

SEQ ID NO: 8482783 - DNA, 22 bp, Homo sapiens
ctgcttggggttagggtgtcct

SEQ ID NO: 8482784 - DNA, 20 bp, Homo sapiens
ctgcttgggcccctctggcc

SEQ ID NO: 8482785 - DNA, 22 bp, Homo sapiens
ataatataatcctacttcccat

SEQ ID NO: 8482786 - DNA, 22 bp, Homo sapiens
ataatatcgctcctttttttga

SEQ ID NO: 8482787 - DNA, 22 bp, Homo sapiens
ataatatttgcattactgtgat

SEQ ID NO: 8482788 - DNA, 22 bp, Homo sapiens
ataatcaaagtcctatgacatc

SEQ ID NO: 8482789 - DNA, 22 bp, Homo sapiens
ataatatttggataggacagta

SEQ ID NO: 8482790 - DNA, 22 bp, Homo sapiens
ataatatttggataggacagta

SEQ ID NO: 8482791 - DNA, 22 bp, Homo sapiens
ataatatttggataggacagta

SEQ ID NO: 8482792 - DNA, 22 bp, Homo sapiens
ataatcagaattcatgaaagat

SEQ ID NO: 8482793 - DNA, 22 bp, Homo sapiens
ataatcaaagtcctatgacatc

SEQ ID NO: 8482794 - DNA, 22 bp, Homo sapiens
ctgctgtgtgaccatggacagg

SEQ ID NO: 8482795 - DNA, 22 bp, Homo sapiens
ctgctgtgtgaccatggacagg

SEQ ID NO: 8482796 - DNA, 22 bp, Homo sapiens
ataatcagaattcatgaaagat

SEQ ID NO: 8482797 - DNA, 22 bp, Homo sapiens
atacagagaaggggtagaggat

SEQ ID NO: 8482798 - DNA, 22 bp, Homo sapiens
atacagagaagggaggcaaaat

SEQ ID NO: 8482799 - DNA, 18 bp, Homo sapiens
atacagagacctcaagga

SEQ ID NO: 8482800 - DNA, 22 bp, Homo sapiens
atacagaatttgcccttttcat

SEQ ID NO: 8482801 - DNA, 22 bp, Homo sapiens
atacagaattcactacagtttc

SEQ ID NO: 8482802 - DNA, 22 bp, Homo sapiens
atacagaattcactacagtttc

SEQ ID NO: 8482803 - DNA, 22 bp, Homo sapiens
atacagaattcactacagtttc

SEQ ID NO: 8482804 - DNA, 22 bp, Homo sapiens
atacagatgcttgctcgtgact

SEQ ID NO: 8482805 - DNA, 22 bp, Homo sapiens
atacagatcccacagcatgtga

SEQ ID NO: 8482806 - DNA, 22 bp, Homo sapiens
atacagatcccacagcatgtga

SEQ ID NO: 8482807 - DNA, 22 bp, Homo sapiens
ctggaggaaaacaactgcagac

SEQ ID NO: 8482808 - DNA, 22 bp, Homo sapiens
ctggaggaaaacaactgcagac

SEQ ID NO: 8482809 - DNA, 22 bp, Homo sapiens
atacagatgggtcagatttcat

SEQ ID NO: 8482810 - DNA, 22 bp, Homo sapiens
ctggagggaggaggctgctatt

SEQ ID NO: 8482811 - DNA, 22 bp, Homo sapiens
ctggagggatgtagggtgtatt

SEQ ID NO: 8482812 - DNA, 22 bp, Homo sapiens
ctggagggatgtagggtgtatt

SEQ ID NO: 8482813 - DNA, 22 bp, Homo sapiens
ctggagccccagacagggagag

SEQ ID NO: 8482814 - DNA, 22 bp, Homo sapiens
ctggagccccagacagggagag

SEQ ID NO: 8482815 - DNA, 22 bp, Homo sapiens
ctggagcccaggcctggtgtct

SEQ ID NO: 8482816 - DNA, 22 bp, Homo sapiens
ctggagcccaggcctggtgtct

SEQ ID NO: 8482817 - DNA, 22 bp, Homo sapiens
ctggagcccaggcctggtgtct

SEQ ID NO: 8482818 - DNA, 22 bp, Homo sapiens
ctggagccatgtcttgactgct

SEQ ID NO: 8482819 - DNA, 22 bp, Homo sapiens
ctggagccatgtcttgactgct

SEQ ID NO: 8482820 - DNA, 22 bp, Homo sapiens
ctggagccatgtcttgactgct

SEQ ID NO: 8482821 - DNA, 22 bp, Homo sapiens
ctggagccatgtatagcctatg

SEQ ID NO: 8482822 - DNA, 22 bp, Homo sapiens
ctggagccatgtatagcctatg

SEQ ID NO: 8482823 - DNA, 22 bp, Homo sapiens
ctggagccagccagggccctct

SEQ ID NO: 8482824 - DNA, 22 bp, Homo sapiens
atacagaatactaattcctgag

SEQ ID NO: 8482825 - DNA, 22 bp, Homo sapiens
ctggagccccagacagggagag

SEQ ID NO: 8482826 - DNA, 22 bp, Homo sapiens
ctggagccccagacagggagag

SEQ ID NO: 8482827 - DNA, 22 bp, Homo sapiens
atacaagtggccacttgaattc

SEQ ID NO: 8482828 - DNA, 22 bp, Homo sapiens
atacaagttaatgagaatgaca

SEQ ID NO: 8482829 - DNA, 22 bp, Homo sapiens
atacaagttaatgagaatgaca

SEQ ID NO: 8482830 - DNA, 22 bp, Homo sapiens
ctggagagaccgaaagaggctg

SEQ ID NO: 8482831 - DNA, 22 bp, Homo sapiens
ctggagagaccgaaagaggctg

SEQ ID NO: 8482832 - DNA, 22 bp, Homo sapiens
ctggagagaccgaaagaggctg

SEQ ID NO: 8482833 - DNA, 22 bp, Homo sapiens
ctggagcatccatgcccagggt

SEQ ID NO: 8482834 - DNA, 22 bp, Homo sapiens
ctggagcattttctgcttctgc

SEQ ID NO: 8482835 - DNA, 22 bp, Homo sapiens
ctggagcattttctgcttctgc

SEQ ID NO: 8482836 - DNA, 22 bp, Homo sapiens
ctggagcattttctgcttctgc

SEQ ID NO: 8482837 - DNA, 17 bp, Homo sapiens
ctggagccaagagggcc

SEQ ID NO: 8482838 - DNA, 17 bp, Homo sapiens
ctggagccaagagggcc

SEQ ID NO: 8482839 - DNA, 22 bp, Homo sapiens
ctggagccactgggtcttgtat

SEQ ID NO: 8482840 - DNA, 17 bp, Homo sapiens
ctggagccaagagggcc

SEQ ID NO: 8482841 - DNA, 22 bp, Homo sapiens
ctggagccactgggtcttgtat

SEQ ID NO: 8482842 - DNA, 22 bp, Homo sapiens
ctggagccactgggtcttgtat

SEQ ID NO: 8482843 - DNA, 22 bp, Homo sapiens
ctggagccactttttatccttt

SEQ ID NO: 8482844 - DNA, 22 bp, Homo sapiens
ctggagccactttttatccttt

SEQ ID NO: 8482845 - DNA, 22 bp, Homo sapiens
ctggagccagccagggccctct

SEQ ID NO: 8482846 - DNA, 22 bp, Homo sapiens
ctggagccagccagggccctct

SEQ ID NO: 8482847 - DNA, 22 bp, Homo sapiens
ctggagccagccagggccctct

SEQ ID NO: 8482848 - DNA, 21 bp, Homo sapiens
ctggagtctgggggtggcagt

SEQ ID NO: 8482849 - DNA, 22 bp, Homo sapiens
ctggagtcttcagcttgctgcc

SEQ ID NO: 8482850 - DNA, 22 bp, Homo sapiens
ctggagtcttcagcttgctgcc

SEQ ID NO: 8482851 - DNA, 22 bp, Homo sapiens
ctggagggctgcagcgaggctg

SEQ ID NO: 8482852 - DNA, 22 bp, Homo sapiens
ctggagggctgcagcgaggctg

SEQ ID NO: 8482853 - DNA, 22 bp, Homo sapiens
ctggagggctgcagcgaggctg

SEQ ID NO: 8482854 - DNA, 22 bp, Homo sapiens
ctggagggctggactaaggaaa

SEQ ID NO: 8482855 - DNA, 22 bp, Homo sapiens
ctggagtctcttctgtagctac

SEQ ID NO: 8482856 - DNA, 22 bp, Homo sapiens
atactcagctgctagacagaag

SEQ ID NO: 8482857 - DNA, 22 bp, Homo sapiens
atacttacttttcttcagacta

SEQ ID NO: 8482858 - DNA, 22 bp, Homo sapiens
atacttatactaagaatgtact

SEQ ID NO: 8482859 - DNA, 22 bp, Homo sapiens
atacttatgataaataattgct

SEQ ID NO: 8482860 - DNA, 22 bp, Homo sapiens
atacttcatgcttcatgtctgt

SEQ ID NO: 8482861 - DNA, 22 bp, Homo sapiens
ctggagtgatactcagaatgtg

SEQ ID NO: 8482862 - DNA, 22 bp, Homo sapiens
ctggagtgatactcagaatgtg

SEQ ID NO: 8482863 - DNA, 22 bp, Homo sapiens
atactttagagctagattgcct

SEQ ID NO: 8482864 - DNA, 22 bp, Homo sapiens
atactttagagctagattgcct

SEQ ID NO: 8482865 - DNA, 22 bp, Homo sapiens
atactttaacgtggcgaacctt

SEQ ID NO: 8482866 - DNA, 22 bp, Homo sapiens
atactttaacgtggcgaacctt

SEQ ID NO: 8482867 - DNA, 22 bp, Homo sapiens
atacttgaggtagcaacttaag

SEQ ID NO: 8482868 - DNA, 22 bp, Homo sapiens
atacttctttgatgttcacagg

SEQ ID NO: 8482869 - DNA, 22 bp, Homo sapiens
atacttctcatgggctctgagc

SEQ ID NO: 8482870 - DNA, 22 bp, Homo sapiens
atacttctagaaatactatgca

SEQ ID NO: 8482871 - DNA, 22 bp, Homo sapiens
atacttcctgcttccctgatct

SEQ ID NO: 8482872 - DNA, 19 bp, Homo sapiens
ctggcagcctgtctgtgtc

SEQ ID NO: 8482873 - DNA, 22 bp, Homo sapiens
atactttagagctagattgcct

SEQ ID NO: 8482874 - DNA, 22 bp, Homo sapiens
atactttagagctagattgcct

SEQ ID NO: 8482875 - DNA, 19 bp, Homo sapiens
ctggcagcctgtctgtgtc

SEQ ID NO: 8482876 - DNA, 22 bp, Homo sapiens
atactttctgaccaattaattg

SEQ ID NO: 8482877 - DNA, 22 bp, Homo sapiens
ctggcagcggtttgcagcctgg

SEQ ID NO: 8482878 - DNA, 22 bp, Homo sapiens
ctggcagcgcagcatgaagtcg

SEQ ID NO: 8482879 - DNA, 22 bp, Homo sapiens
ctggcagcgtgagcagcatcca

SEQ ID NO: 8482880 - DNA, 22 bp, Homo sapiens
ctggcagcgtgtttatgaacat

SEQ ID NO: 8482881 - DNA, 22 bp, Homo sapiens
ctggcagctctactcagagcct

SEQ ID NO: 8482882 - DNA, 22 bp, Homo sapiens
ctggcagctctactcagagcct

SEQ ID NO: 8482883 - DNA, 22 bp, Homo sapiens
ctggcagctctgagtcccttct

SEQ ID NO: 8482884 - DNA, 22 bp, Homo sapiens
ctgaggcctctgttcaccagaa

SEQ ID NO: 8482885 - DNA, 22 bp, Homo sapiens
ctgaggcctctctccttggctt

SEQ ID NO: 8482886 - DNA, 22 bp, Homo sapiens
ctgaggcctctgttcaccagaa

SEQ ID NO: 8482887 - DNA, 23 bp, Homo sapiens
ctgaggcctgctgcgttcaggtt

SEQ ID NO: 8482888 - DNA, 22 bp, Homo sapiens
ctgaggcctctttccttggctt

SEQ ID NO: 8482889 - DNA, 22 bp, Homo sapiens
ctgaggcctctccttggcttgt

SEQ ID NO: 8482890 - DNA, 22 bp, Homo sapiens
ctgaggcctctcccactccagc

SEQ ID NO: 8482891 - DNA, 22 bp, Homo sapiens
ctgaggcctcgttggctggaac

SEQ ID NO: 8482892 - DNA, 22 bp, Homo sapiens
ctgaggcctcgttggctggaac

SEQ ID NO: 8482893 - DNA, 22 bp, Homo sapiens
ctgaggcctctctcctgggctt

SEQ ID NO: 8482894 - DNA, 22 bp, Homo sapiens
ctgaggcctctctcctgggctt

SEQ ID NO: 8482895 - DNA, 22 bp, Homo sapiens
ctgaggcctctctcctgggctt

SEQ ID NO: 8482896 - DNA, 22 bp, Homo sapiens
ctgaggcttggaggggtctggt

SEQ ID NO: 8482897 - DNA, 22 bp, Homo sapiens
ctgaggcttctctagttcagct

SEQ ID NO: 8482898 - DNA, 22 bp, Homo sapiens
ctgaggcttctctagttcagct

SEQ ID NO: 8482899 - DNA, 22 bp, Homo sapiens
ctgaggcttgtcctctcagctt

SEQ ID NO: 8482900 - DNA, 22 bp, Homo sapiens
ctgaggcttgtcctctcagctt

SEQ ID NO: 8482901 - DNA, 22 bp, Homo sapiens
ctgaggctggggaagggaagtg

SEQ ID NO: 8482902 - DNA, 18 bp, Homo sapiens
ctgaggcttagagaggtt

SEQ ID NO: 8482903 - DNA, 18 bp, Homo sapiens
ctgaggcttagagaggtt

SEQ ID NO: 8482904 - DNA, 22 bp, Homo sapiens
ctgaggctggggaagggaagtg

SEQ ID NO: 8482905 - DNA, 22 bp, Homo sapiens
ctgaggctgggcttgccttctt

SEQ ID NO: 8482906 - DNA, 22 bp, Homo sapiens
ctgaggctgggctgagggtata

SEQ ID NO: 8482907 - DNA, 22 bp, Homo sapiens
ctgaggggatgtttttgacgga

SEQ ID NO: 8482908 - DNA, 22 bp, Homo sapiens
ctgaggggtatccaaggggtaa

SEQ ID NO: 8482909 - DNA, 22 bp, Homo sapiens
ctgaggggtatccaaggggtaa

SEQ ID NO: 8482910 - DNA, 22 bp, Homo sapiens
ctgaggggataaaggtttgggt

SEQ ID NO: 8482911 - DNA, 22 bp, Homo sapiens
ctgaggggataaaggtttgggt

SEQ ID NO: 8482912 - DNA, 22 bp, Homo sapiens
ctgaggctttgtgtgcatgcct

SEQ ID NO: 8482913 - DNA, 22 bp, Homo sapiens
ctgaggctttgtgtgcatgcct

SEQ ID NO: 8482914 - DNA, 20 bp, Homo sapiens
ctgaggggtctgacttggac

SEQ ID NO: 8482915 - DNA, 20 bp, Homo sapiens
ctgaggggtctgacttggac

SEQ ID NO: 8482916 - DNA, 22 bp, Homo sapiens
ctgaggggtcgtgggagcccag

SEQ ID NO: 8482917 - DNA, 22 bp, Homo sapiens
ctgaggggtcgtgggagcccag

SEQ ID NO: 8482918 - DNA, 22 bp, Homo sapiens
ctgaggggtatccaaggggtaa

SEQ ID NO: 8482919 - DNA, 22 bp, Homo sapiens
ctgagggtcaacttgattgtat

SEQ ID NO: 8482920 - DNA, 22 bp, Homo sapiens
ctgagggtcaacttgattgtat

SEQ ID NO: 8482921 - DNA, 22 bp, Homo sapiens
ctgagggtcaacttgattgtat

SEQ ID NO: 8482922 - DNA, 22 bp, Homo sapiens
ctgagggtcaacttgattgtat

SEQ ID NO: 8482923 - DNA, 22 bp, Homo sapiens
ctgagggtcaacttgattgtat

SEQ ID NO: 8482924 - DNA, 22 bp, Homo sapiens
ctgaggtcagagtttagtctgg

SEQ ID NO: 8482925 - DNA, 22 bp, Homo sapiens
ctgaggtcagagtttagtctgg

SEQ ID NO: 8482926 - DNA, 22 bp, Homo sapiens
ctgaggtcaccccactggctgt

SEQ ID NO: 8482927 - DNA, 22 bp, Homo sapiens
ctgaggtcaccccactggctgt

SEQ ID NO: 8482928 - DNA, 22 bp, Homo sapiens
ctgaggtattgaagtatcttct

SEQ ID NO: 8482929 - DNA, 22 bp, Homo sapiens
ctgaggtcaattaatcaacaac

SEQ ID NO: 8482930 - DNA, 22 bp, Homo sapiens
ctgaggtcaattaatcaacaac

SEQ ID NO: 8482931 - DNA, 22 bp, Homo sapiens
agttgtattagagaacacaaac

SEQ ID NO: 8482932 - DNA, 22 bp, Homo sapiens
ctgaggtacctggagcaggtcc

SEQ ID NO: 8482933 - DNA, 22 bp, Homo sapiens
ctgaggtacaagaaaggcacct

SEQ ID NO: 8482934 - DNA, 23 bp, Homo sapiens
ctgaggtaaaatattctgaagga

SEQ ID NO: 8482935 - DNA, 22 bp, Homo sapiens
ctgaggtaaaatttctattttg

SEQ ID NO: 8482936 - DNA, 22 bp, Homo sapiens
ctgaggtagctgtgaatgttct

SEQ ID NO: 8482937 - DNA, 22 bp, Homo sapiens
ctgaggtatgtgggactagcct

SEQ ID NO: 8482938 - DNA, 22 bp, Homo sapiens
ctgaggtatgtgggactagcct

SEQ ID NO: 8482939 - DNA, 22 bp, Homo sapiens
agttgctctaggtgaggtcttt

SEQ ID NO: 8482940 - DNA, 22 bp, Homo sapiens
agttgctgattctgtctgtgat

SEQ ID NO: 8482941 - DNA, 22 bp, Homo sapiens
agttgctgattctgtctgtgat

SEQ ID NO: 8482942 - DNA, 21 bp, Homo sapiens
agttgctgctgctgcaggtga

SEQ ID NO: 8482943 - DNA, 21 bp, Homo sapiens
agttgctgctgctgcaggtga

SEQ ID NO: 8482944 - DNA, 22 bp, Homo sapiens
agttgctgcttctctctagaga

SEQ ID NO: 8482945 - DNA, 22 bp, Homo sapiens
agttgctggcacctgtgagtat

SEQ ID NO: 8482946 - DNA, 22 bp, Homo sapiens
agttgctgcttctctctagaga

SEQ ID NO: 8482947 - DNA, 22 bp, Homo sapiens
ctctttggtcgcatcatccatt

SEQ ID NO: 8482948 - DNA, 22 bp, Homo sapiens
agttggcattcctgcatcctat

SEQ ID NO: 8482949 - DNA, 22 bp, Homo sapiens
agttggcgggacatgtggaaag

SEQ ID NO: 8482950 - DNA, 19 bp, Homo sapiens
agttggggcagggaagaga

SEQ ID NO: 8482951 - DNA, 22 bp, Homo sapiens
agttgggtttgtgtcagttgca

SEQ ID NO: 8482952 - DNA, 19 bp, Homo sapiens
agttggggcagggaagaga

SEQ ID NO: 8482953 - DNA, 22 bp, Homo sapiens
agttgctgggaaagatttcagt

SEQ ID NO: 8482954 - DNA, 22 bp, Homo sapiens
agttgctggtaaatgttatcaa

SEQ ID NO: 8482955 - DNA, 22 bp, Homo sapiens
ctgaggcatgaatgtgggcttt

SEQ ID NO: 8482956 - DNA, 22 bp, Homo sapiens
ctgaggcctaagacatgaatga

SEQ ID NO: 8482957 - DNA, 22 bp, Homo sapiens
ctgaggccgttggtgggcctta

SEQ ID NO: 8482958 - DNA, 22 bp, Homo sapiens
ctgaggcctcactgtagtccct

SEQ ID NO: 8482959 - DNA, 22 bp, Homo sapiens
ctgaggcctaagacatgaatga

SEQ ID NO: 8482960 - DNA, 22 bp, Homo sapiens
ctgaggcctaagacatgaatga

SEQ ID NO: 8482961 - DNA, 22 bp, Homo sapiens
ctgaggcatgaatgtgggcttt

SEQ ID NO: 8482962 - DNA, 22 bp, Homo sapiens
ctgaggcatgaatgtgggcttt

SEQ ID NO: 8482963 - DNA, 22 bp, Homo sapiens
ctgaggcatcatggagaacagt

SEQ ID NO: 8482964 - DNA, 22 bp, Homo sapiens
ctgaggcaggggcagctggaga

SEQ ID NO: 8482965 - DNA, 21 bp, Homo sapiens
ctgaggcagcacagctagtca

SEQ ID NO: 8482966 - DNA, 22 bp, Homo sapiens
ctgcagctcctctctgtgcccc

SEQ ID NO: 8482967 - DNA, 22 bp, Homo sapiens
ctgcagctatattttcccacag

SEQ ID NO: 8482968 - DNA, 22 bp, Homo sapiens
ctgcagctaaggaatgtggttg

SEQ ID NO: 8482969 - DNA, 22 bp, Homo sapiens
ctgcagctcccctgagatcaag

SEQ ID NO: 8482970 - DNA, 22 bp, Homo sapiens
ctgcagagcaagttctctgttg

SEQ ID NO: 8482971 - DNA, 22 bp, Homo sapiens
ctgcagagcagccagtccccca

SEQ ID NO: 8482972 - DNA, 22 bp, Homo sapiens
ctgcagagcagccagtccccca

SEQ ID NO: 8482973 - DNA, 22 bp, Homo sapiens
ctgcagcctcctggggtacatg

SEQ ID NO: 8482974 - DNA, 22 bp, Homo sapiens
ctgcagcctcctggggtacatg

SEQ ID NO: 8482975 - DNA, 22 bp, Homo sapiens
agtttaaatcatgttttgtaac

SEQ ID NO: 8482976 - DNA, 22 bp, Homo sapiens
agtttaactttggaaaactata

SEQ ID NO: 8482977 - DNA, 22 bp, Homo sapiens
agttgtgagaaacagaatgagc

SEQ ID NO: 8482978 - DNA, 22 bp, Homo sapiens
agttgtgaatagatctgattgg

SEQ ID NO: 8482979 - DNA, 22 bp, Homo sapiens
agttgtcccggtctagccactt

SEQ ID NO: 8482980 - DNA, 22 bp, Homo sapiens
agttgtcacctctattcaaatc

SEQ ID NO: 8482981 - DNA, 22 bp, Homo sapiens
ctgcagagcaagttctctgttg

SEQ ID NO: 8482982 - DNA, 22 bp, Homo sapiens
agtttaattggaggcgtggctc

SEQ ID NO: 8482983 - DNA, 22 bp, Homo sapiens
agtttaatcctccagcccaact

SEQ ID NO: 8482984 - DNA, 22 bp, Homo sapiens
agtttaatatccttcaactttc

SEQ ID NO: 8482985 - DNA, 22 bp, Homo sapiens
ctgcagctggctcatgggatat

SEQ ID NO: 8482986 - DNA, 22 bp, Homo sapiens
ctgcagctgcagttctgagaga

SEQ ID NO: 8482987 - DNA, 22 bp, Homo sapiens
ctgcagctgcagttctgagaga

SEQ ID NO: 8482988 - DNA, 22 bp, Homo sapiens
ctgcagctgccagtgatttcag

SEQ ID NO: 8482989 - DNA, 22 bp, Homo sapiens
ctgcagctggagcatcttctca

SEQ ID NO: 8482990 - DNA, 22 bp, Homo sapiens
ctgcagctgctcatgttacttg

SEQ ID NO: 8482991 - DNA, 23 bp, Homo sapiens
agtttgtaaagaaatatttgcac

SEQ ID NO: 8482992 - DNA, 22 bp, Homo sapiens
agtttgatttgtctatcttcat

SEQ ID NO: 8482993 - DNA, 22 bp, Homo sapiens
agtttgattgtatgggttttaa

SEQ ID NO: 8482994 - DNA, 20 bp, Homo sapiens
ataaaataactgccacaaga

SEQ ID NO: 8482995 - DNA, 20 bp, Homo sapiens
ataaaataactgccacaaga

SEQ ID NO: 8482996 - DNA, 20 bp, Homo sapiens
ataaaataactgccacaaga

SEQ ID NO: 8482997 - DNA, 20 bp, Homo sapiens
ataaaataactgccacaaga

SEQ ID NO: 8482998 - DNA, 20 bp, Homo sapiens
ataaaataactgccacaaga

SEQ ID NO: 8482999 - DNA, 20 bp, Homo sapiens
ataaaataactgccacaaga

SEQ ID NO: 8483000 - DNA, 22 bp, Homo sapiens
ataaaagtttccaatcatgcct

SEQ ID NO: 8483001 - DNA, 22 bp, Homo sapiens
ataaaagtttccaatcatgcct

SEQ ID NO: 8483002 - DNA, 22 bp, Homo sapiens
ataaaagttcaagagagtacag

SEQ ID NO: 8483003 - DNA, 22 bp, Homo sapiens
ataaaagtttccaatcatgcct

SEQ ID NO: 8483004 - DNA, 22 bp, Homo sapiens
ataaaagtttccaatcatgcct

SEQ ID NO: 8483005 - DNA, 20 bp, Homo sapiens
ataaaataactgccacaaga

SEQ ID NO: 8483006 - DNA, 22 bp, Homo sapiens
ataaatagtgtgtcataaagtc

SEQ ID NO: 8483007 - DNA, 22 bp, Homo sapiens
ataaatagtgtgtcataaagtc

SEQ ID NO: 8483008 - DNA, 22 bp, Homo sapiens
ataaatagtgtgtcataaagtc

SEQ ID NO: 8483009 - DNA, 22 bp, Homo sapiens
ataaatatcactgttgtccctc

SEQ ID NO: 8483010 - DNA, 22 bp, Homo sapiens
ataaatatcactgttgtccctc

SEQ ID NO: 8483011 - DNA, 22 bp, Homo sapiens
ataaatatcactgttgtccctc

SEQ ID NO: 8483012 - DNA, 22 bp, Homo sapiens
ataaatatcactgttgtccctc

SEQ ID NO: 8483013 - DNA, 22 bp, Homo sapiens
ataaatatcactgttgtccctc

SEQ ID NO: 8483014 - DNA, 19 bp, Homo sapiens
ataaataaaaagtgggaga

SEQ ID NO: 8483015 - DNA, 22 bp, Homo sapiens
ataaaggataatccattagact

SEQ ID NO: 8483016 - DNA, 22 bp, Homo sapiens
ataaaggataatccattagact

SEQ ID NO: 8483017 - DNA, 22 bp, Homo sapiens
ataaatagtgctgccatgagta

SEQ ID NO: 8483018 - DNA, 22 bp, Homo sapiens
ataaatagtgctgccatgagta

SEQ ID NO: 8483019 - DNA, 22 bp, Homo sapiens
ataaatagtgaagggagccggt

SEQ ID NO: 8483020 - DNA, 22 bp, Homo sapiens
ataaatagtgctgccatgagta

SEQ ID NO: 8483021 - DNA, 22 bp, Homo sapiens
agtttgtatcaatttgctttat

SEQ ID NO: 8483022 - DNA, 22 bp, Homo sapiens
ctgcatttcacatttaaacttt

SEQ ID NO: 8483023 - DNA, 22 bp, Homo sapiens
ctgccaggactgacgtcttcag

SEQ ID NO: 8483024 - DNA, 22 bp, Homo sapiens
ctgccaggactgacgtcttcag

SEQ ID NO: 8483025 - DNA, 22 bp, Homo sapiens
ctgccaggcactgggctctgca

SEQ ID NO: 8483026 - DNA, 22 bp, Homo sapiens
ctgccaggcactgggctctgca

SEQ ID NO: 8483027 - DNA, 22 bp, Homo sapiens
ctgccaggattctgtgaacccc

SEQ ID NO: 8483028 - DNA, 22 bp, Homo sapiens
ctgccaggattctgtgaacccc

SEQ ID NO: 8483029 - DNA, 22 bp, Homo sapiens
ctgccaggcagggagatggctg

SEQ ID NO: 8483030 - DNA, 22 bp, Homo sapiens
ctgccaggcctcatcccagcca

SEQ ID NO: 8483031 - DNA, 22 bp, Homo sapiens
ctgccaggcctcatcccagcca

SEQ ID NO: 8483032 - DNA, 22 bp, Homo sapiens
ctgccaggcagcagagggagaa

SEQ ID NO: 8483033 - DNA, 22 bp, Homo sapiens
ctgccaggcagggagatggctg

SEQ ID NO: 8483034 - DNA, 22 bp, Homo sapiens
ataaaagtaggaccaacttaca

SEQ ID NO: 8483035 - DNA, 22 bp, Homo sapiens
ataaaagtaggaccaacttaca

SEQ ID NO: 8483036 - DNA, 22 bp, Homo sapiens
ataaaaggaaagcctgttgtga

SEQ ID NO: 8483037 - DNA, 22 bp, Homo sapiens
ataaaagtaggaccaacttaca

SEQ ID NO: 8483038 - DNA, 22 bp, Homo sapiens
ataaaagtctgcttatttgggc

SEQ ID NO: 8483039 - DNA, 22 bp, Homo sapiens
ataaaagtaggaccaacttaca

SEQ ID NO: 8483040 - DNA, 22 bp, Homo sapiens
ataaaagtctgcttatttgggc

SEQ ID NO: 8483041 - DNA, 22 bp, Homo sapiens
ataaaagtctgcttatttgggc

SEQ ID NO: 8483042 - DNA, 22 bp, Homo sapiens
ataaaagtaggaccaacttaca

SEQ ID NO: 8483043 - DNA, 22 bp, Homo sapiens
ctgggcaggagggctctatgga

SEQ ID NO: 8483044 - DNA, 22 bp, Homo sapiens
ctgggcaggagggctctatgga

SEQ ID NO: 8483045 - DNA, 22 bp, Homo sapiens
atatgcaagcacatagaatact

SEQ ID NO: 8483046 - DNA, 22 bp, Homo sapiens
ctgggcaggagggctctatgga

SEQ ID NO: 8483047 - DNA, 22 bp, Homo sapiens
ctgggcaggagggctctatgga

SEQ ID NO: 8483048 - DNA, 22 bp, Homo sapiens
ctgggcaggatacttcatggga

SEQ ID NO: 8483049 - DNA, 20 bp, Homo sapiens
ctgggcaggtgtttgatctc

SEQ ID NO: 8483050 - DNA, 22 bp, Homo sapiens
ctgggcagtatgaatattcaaa

SEQ ID NO: 8483051 - DNA, 22 bp, Homo sapiens
ctgggcagtgcagctatagaac

SEQ ID NO: 8483052 - DNA, 22 bp, Homo sapiens
ctgggcagtgcagctatagaac

SEQ ID NO: 8483053 - DNA, 22 bp, Homo sapiens
atatggcattttaatgtatgag

SEQ ID NO: 8483054 - DNA, 22 bp, Homo sapiens
atatgctggagtacaggaaata

SEQ ID NO: 8483055 - DNA, 22 bp, Homo sapiens
ctgggcagtggtggcccttccc

SEQ ID NO: 8483056 - DNA, 22 bp, Homo sapiens
ctgggcagtggtggcccttccc

SEQ ID NO: 8483057 - DNA, 22 bp, Homo sapiens
ctgggcagtggtggcccttccc

SEQ ID NO: 8483058 - DNA, 22 bp, Homo sapiens
ctgggcagtggtggcccttccc

SEQ ID NO: 8483059 - DNA, 22 bp, Homo sapiens
ctgggcagtggtggcatctttg

SEQ ID NO: 8483060 - DNA, 22 bp, Homo sapiens
ctgggcagtggtggcatctttg

SEQ ID NO: 8483061 - DNA, 22 bp, Homo sapiens
ctgggcagtggtggcatctttg

SEQ ID NO: 8483062 - DNA, 22 bp, Homo sapiens
atatgacataaaatcatttttg

SEQ ID NO: 8483063 - DNA, 22 bp, Homo sapiens
atatgagagaggaaagatttta

SEQ ID NO: 8483064 - DNA, 22 bp, Homo sapiens
atatgagagaggaaagatttta

SEQ ID NO: 8483065 - DNA, 22 bp, Homo sapiens
atatgagagtaaatgccgatct

SEQ ID NO: 8483066 - DNA, 22 bp, Homo sapiens
atatgagagtaaatgccgatct

SEQ ID NO: 8483067 - DNA, 21 bp, Homo sapiens
atatgagtttcagatgttgct

SEQ ID NO: 8483068 - DNA, 22 bp, Homo sapiens
atatgagtttcccacttctgga

SEQ ID NO: 8483069 - DNA, 22 bp, Homo sapiens
atatgacagcggattcacatat

SEQ ID NO: 8483070 - DNA, 22 bp, Homo sapiens
atatgacagcggattcacatat

SEQ ID NO: 8483071 - DNA, 22 bp, Homo sapiens
atatgaatttggctggaaaggt

SEQ ID NO: 8483072 - DNA, 22 bp, Homo sapiens
atatgaagaattccaatttgga

SEQ ID NO: 8483073 - DNA, 22 bp, Homo sapiens
atatgaagtcagacaaactggg

SEQ ID NO: 8483074 - DNA, 22 bp, Homo sapiens
atatatcatgagtaaaacttga

SEQ ID NO: 8483075 - DNA, 22 bp, Homo sapiens
atatatcatgagtaaaacttga

SEQ ID NO: 8483076 - DNA, 22 bp, Homo sapiens
atatatctgcagtactgaagaa

SEQ ID NO: 8483077 - DNA, 22 bp, Homo sapiens
atatatctgcagtactgaagaa

SEQ ID NO: 8483078 - DNA, 22 bp, Homo sapiens
atatatcatgagtaaaacttga

SEQ ID NO: 8483079 - DNA, 22 bp, Homo sapiens
atatatcatgagtaaaacttga

SEQ ID NO: 8483080 - DNA, 22 bp, Homo sapiens
atatatcatgagtaaaacttga

SEQ ID NO: 8483081 - DNA, 22 bp, Homo sapiens
atatcattctgatgtatatctt

SEQ ID NO: 8483082 - DNA, 22 bp, Homo sapiens
atatatgcgcaggcacccagct

SEQ ID NO: 8483083 - DNA, 19 bp, Homo sapiens
atatatgtatacaatgtgg

SEQ ID NO: 8483084 - DNA, 18 bp, Homo sapiens
atatccaataatgaacac

SEQ ID NO: 8483085 - DNA, 21 bp, Homo sapiens
atatgaactgtggactttgga

SEQ ID NO: 8483086 - DNA, 22 bp, Homo sapiens
atatgtgtgccatttcagcagt

SEQ ID NO: 8483087 - DNA, 22 bp, Homo sapiens
atatgtgtgatgcatggactaa

SEQ ID NO: 8483088 - DNA, 22 bp, Homo sapiens
atatgtgtgcacatatgtattt

SEQ ID NO: 8483089 - DNA, 22 bp, Homo sapiens
atatgtgtgtatttcttactag

SEQ ID NO: 8483090 - DNA, 22 bp, Homo sapiens
atatgtgtgtgtgagaaaagct

SEQ ID NO: 8483091 - DNA, 22 bp, Homo sapiens
atatgtgtgatgcatggactaa

SEQ ID NO: 8483092 - DNA, 22 bp, Homo sapiens
atatgtgtatttggttagccta

SEQ ID NO: 8483093 - DNA, 22 bp, Homo sapiens
atatgtgtatggatttctatct

SEQ ID NO: 8483094 - DNA, 22 bp, Homo sapiens
atatgtgtacgtgcagtatata

SEQ ID NO: 8483095 - DNA, 20 bp, Homo sapiens
atatgtgtacgtgtatacat

SEQ ID NO: 8483096 - DNA, 22 bp, Homo sapiens
atatgtgtaaatgcatttgttt

SEQ ID NO: 8483097 - DNA, 23 bp, Homo sapiens
atatgtcatgcaccagcacttta

SEQ ID NO: 8483098 - DNA, 22 bp, Homo sapiens
atatgtatgtacgcacatattc

SEQ ID NO: 8483099 - DNA, 22 bp, Homo sapiens
atatgtattttaacgtgtaagg

SEQ ID NO: 8483100 - DNA, 22 bp, Homo sapiens
atatggctgttggtagccaaca

SEQ ID NO: 8483101 - DNA, 20 bp, Homo sapiens
atatgggtgatgatgtctgt

SEQ ID NO: 8483102 - DNA, 22 bp, Homo sapiens
atatgggtcatgtgatgttcaa

SEQ ID NO: 8483103 - DNA, 22 bp, Homo sapiens
atatgggggggcgtgcagagga

SEQ ID NO: 8483104 - DNA, 22 bp, Homo sapiens
atatgggggggcgtgcagagga

SEQ ID NO: 8483105 - DNA, 22 bp, Homo sapiens
atatgggggggcgtgcagagga

SEQ ID NO: 8483106 - DNA, 22 bp, Homo sapiens
atatttctgggggtgtgtttct

SEQ ID NO: 8483107 - DNA, 22 bp, Homo sapiens
atatttctgggggtgtgtttct

SEQ ID NO: 8483108 - DNA, 22 bp, Homo sapiens
atatttctctcagacatggaag

SEQ ID NO: 8483109 - DNA, 20 bp, Homo sapiens
atatttcttaagaactttca

SEQ ID NO: 8483110 - DNA, 20 bp, Homo sapiens
atatttcttaagaactttca

SEQ ID NO: 8483111 - DNA, 20 bp, Homo sapiens
atatttcttaagaactttca

SEQ ID NO: 8483112 - DNA, 22 bp, Homo sapiens
atatttggaaagaaaatcattg

SEQ ID NO: 8483113 - DNA, 22 bp, Homo sapiens
atatttcttgagcacctggtat

SEQ ID NO: 8483114 - DNA, 22 bp, Homo sapiens
atatttgagggcaatagggtgg

SEQ ID NO: 8483115 - DNA, 22 bp, Homo sapiens
atatttgtaaaattctgtgtct

SEQ ID NO: 8483116 - DNA, 22 bp, Homo sapiens
atatttgtaaaattctgtgtct

SEQ ID NO: 8483117 - DNA, 22 bp, Homo sapiens
atatttgtagtgggtaagaagt

SEQ ID NO: 8483118 - DNA, 22 bp, Homo sapiens
atatttgtagtgggtaagaagt

SEQ ID NO: 8483119 - DNA, 22 bp, Homo sapiens
atatttctctcagacatggaag

SEQ ID NO: 8483120 - DNA, 22 bp, Homo sapiens
atatttctctcagacatggaag

SEQ ID NO: 8483121 - DNA, 22 bp, Homo sapiens
atatttagctcatttccagtgc

SEQ ID NO: 8483122 - DNA, 18 bp, Homo sapiens
atatgttaattaggtagg

SEQ ID NO: 8483123 - DNA, 22 bp, Homo sapiens
atatgttactctttcaagcaga

SEQ ID NO: 8483124 - DNA, 22 bp, Homo sapiens
atatgttttgtgcttcattggt

SEQ ID NO: 8483125 - DNA, 22 bp, Homo sapiens
atatgtttcagtattcaagtca

SEQ ID NO: 8483126 - DNA, 22 bp, Homo sapiens
ctgggagacaagagagggctga

SEQ ID NO: 8483127 - DNA, 22 bp, Homo sapiens
ctgggagacaagagagggctga

SEQ ID NO: 8483128 - DNA, 22 bp, Homo sapiens
ctgggagagaagcgaagctggg

SEQ ID NO: 8483129 - DNA, 22 bp, Homo sapiens
ctgggagagaagcgaagctggg

SEQ ID NO: 8483130 - DNA, 22 bp, Homo sapiens
ctgggagagaagcgaagctggg

SEQ ID NO: 8483131 - DNA, 22 bp, Homo sapiens
ctgggagagaagcgaagctggg

SEQ ID NO: 8483132 - DNA, 22 bp, Homo sapiens
ctgggagagaagcgaagctggg

SEQ ID NO: 8483133 - DNA, 22 bp, Homo sapiens
atatatactttgacacattctg

SEQ ID NO: 8483134 - DNA, 22 bp, Homo sapiens
atatatagagctagatgttaaa

SEQ ID NO: 8483135 - DNA, 22 bp, Homo sapiens
atatatactttgacacattctg

SEQ ID NO: 8483136 - DNA, 22 bp, Homo sapiens
atatatacaactagattaaaag

SEQ ID NO: 8483137 - DNA, 22 bp, Homo sapiens
atatatacaactagattaaaag

SEQ ID NO: 8483138 - DNA, 22 bp, Homo sapiens
atatatactttgacacattctg

SEQ ID NO: 8483139 - DNA, 22 bp, Homo sapiens
ctgggactttgtaggccagttg

SEQ ID NO: 8483140 - DNA, 22 bp, Homo sapiens
ctgggactttgtaggccagttg

SEQ ID NO: 8483141 - DNA, 22 bp, Homo sapiens
ctgggactttgtaggccagttg

SEQ ID NO: 8483142 - DNA, 22 bp, Homo sapiens
ctgggactttgtaggccagttg

SEQ ID NO: 8483143 - DNA, 22 bp, Homo sapiens
ctgggactttgtaggccagttg

SEQ ID NO: 8483144 - DNA, 22 bp, Homo sapiens
ctgggactttaccctgtggccc

SEQ ID NO: 8483145 - DNA, 22 bp, Homo sapiens
ctgggactttaccctgtggccc

SEQ ID NO: 8483146 - DNA, 22 bp, Homo sapiens
atatatagagctagatgttaaa

SEQ ID NO: 8483147 - DNA, 22 bp, Homo sapiens
atatatagagctagatgttaaa

SEQ ID NO: 8483148 - DNA, 22 bp, Homo sapiens
ctgggactttaccctgtggccc

SEQ ID NO: 8483149 - DNA, 22 bp, Homo sapiens
atatatatcgagttcatgtctc

SEQ ID NO: 8483150 - DNA, 19 bp, Homo sapiens
ctgggaggtgttcagagaa

SEQ ID NO: 8483151 - DNA, 19 bp, Homo sapiens
ctgggaggtgttcagagaa

SEQ ID NO: 8483152 - DNA, 22 bp, Homo sapiens
ctgggcacaagtggccctggat

SEQ ID NO: 8483153 - DNA, 22 bp, Homo sapiens
ctgggcacacagtgactctgca

SEQ ID NO: 8483154 - DNA, 22 bp, Homo sapiens
ctgggcacactctgctccagct

SEQ ID NO: 8483155 - DNA, 22 bp, Homo sapiens
ctgggcacaggggagcagagtc

SEQ ID NO: 8483156 - DNA, 22 bp, Homo sapiens
ctgggcacaggggagcagagtc

SEQ ID NO: 8483157 - DNA, 22 bp, Homo sapiens
ctgggcacaggggagcagagtc

SEQ ID NO: 8483158 - DNA, 22 bp, Homo sapiens
ctgggcacagcgttgggctctt

SEQ ID NO: 8483159 - DNA, 22 bp, Homo sapiens
ctgggcacagcgttgggctctt

SEQ ID NO: 8483160 - DNA, 22 bp, Homo sapiens
atatatatcgagttcatgtctc

SEQ ID NO: 8483161 - DNA, 20 bp, Homo sapiens
ctgggcacctgtctgcagtt

SEQ ID NO: 8483162 - DNA, 22 bp, Homo sapiens
ctgggcacctttgcagcaggct

SEQ ID NO: 8483163 - DNA, 22 bp, Homo sapiens
atatatatgctgatggctgcca

SEQ ID NO: 8483164 - DNA, 22 bp, Homo sapiens
ctgggcaccaggcatgacaggg

SEQ ID NO: 8483165 - DNA, 22 bp, Homo sapiens
ctgggcacagtggctcacgcct

SEQ ID NO: 8483166 - DNA, 22 bp, Homo sapiens
ctgggcacattttgactagtgt

SEQ ID NO: 8483167 - DNA, 22 bp, Homo sapiens
ctgggcacaggggagcagagtc

SEQ ID NO: 8483168 - DNA, 22 bp, Homo sapiens
ctgggcacagtggctcacgcct

SEQ ID NO: 8483169 - DNA, 22 bp, Homo sapiens
ctgggaaggggaaggtcctctc

SEQ ID NO: 8483170 - DNA, 22 bp, Homo sapiens
ctgggaagtagaatcagatgag

SEQ ID NO: 8483171 - DNA, 22 bp, Homo sapiens
ctgggaagtggtgagggcctga

SEQ ID NO: 8483172 - DNA, 22 bp, Homo sapiens
ctgggaagggagtcaagatact

SEQ ID NO: 8483173 - DNA, 22 bp, Homo sapiens
ctgggaagcttcgagcaggaaa

SEQ ID NO: 8483174 - DNA, 22 bp, Homo sapiens
ctgggaagggacgccagtgcct

SEQ ID NO: 8483175 - DNA, 22 bp, Homo sapiens
ctgggaagccacagggtgtggg

SEQ ID NO: 8483176 - DNA, 22 bp, Homo sapiens
ctggcttgaagttatgcaccag

SEQ ID NO: 8483177 - DNA, 23 bp, Homo sapiens
ctggcttctggggcctctgtttc

SEQ ID NO: 8483178 - DNA, 22 bp, Homo sapiens
ctgggaagatggtgacagaatt

SEQ ID NO: 8483179 - DNA, 22 bp, Homo sapiens
ctggcttgaagttatgcaccag

SEQ ID NO: 8483180 - DNA, 22 bp, Homo sapiens
ctgggaagatggtgacagaatt

SEQ ID NO: 8483181 - DNA, 22 bp, Homo sapiens
ctggcagctgcccgagatgccc

SEQ ID NO: 8483182 - DNA, 22 bp, Homo sapiens
ctggcagctggaggctagaggc

SEQ ID NO: 8483183 - DNA, 22 bp, Homo sapiens
ctggcagctggaggctagaggc

SEQ ID NO: 8483184 - DNA, 22 bp, Homo sapiens
ctggcagctgtgtgaagaactg

SEQ ID NO: 8483185 - DNA, 22 bp, Homo sapiens
ctggcttctgggccagggcaga

SEQ ID NO: 8483186 - DNA, 22 bp, Homo sapiens
atataatacaacctgctaagtg

SEQ ID NO: 8483187 - DNA, 20 bp, Homo sapiens
atataataaattttggttac

SEQ ID NO: 8483188 - DNA, 22 bp, Homo sapiens
atatacttttcactaatggcta

SEQ ID NO: 8483189 - DNA, 22 bp, Homo sapiens
atatataacctggataaggctt

SEQ ID NO: 8483190 - DNA, 22 bp, Homo sapiens
atataatacaacctgctaagtg

SEQ ID NO: 8483191 - DNA, 22 bp, Homo sapiens
atatacttggagactatcattg

SEQ ID NO: 8483192 - DNA, 22 bp, Homo sapiens
atatataagctgatgagccaca

SEQ ID NO: 8483193 - DNA, 22 bp, Homo sapiens
atatatacaactagattaaaag

SEQ ID NO: 8483194 - DNA, 22 bp, Homo sapiens
atatataatacttgctgtgggc

SEQ ID NO: 8483195 - DNA, 22 bp, Homo sapiens
atatatacaactagattaaaag

SEQ ID NO: 8483196 - DNA, 22 bp, Homo sapiens
atatataacctggataaggctt

SEQ ID NO: 8483197 - DNA, 22 bp, Homo sapiens
atataactcttgttcttatagt

SEQ ID NO: 8483198 - DNA, 22 bp, Homo sapiens
atataactcttgttcttatagt

SEQ ID NO: 8483199 - DNA, 22 bp, Homo sapiens
atataacatacatacagaaaag

SEQ ID NO: 8483200 - DNA, 22 bp, Homo sapiens
atataactcttgttcttatagt

SEQ ID NO: 8483201 - DNA, 22 bp, Homo sapiens
atataactcttgttcttatagt

SEQ ID NO: 8483202 - DNA, 20 bp, Homo sapiens
atataataaattttggttac

SEQ ID NO: 8483203 - DNA, 22 bp, Homo sapiens
atataagtgtgtggctgttagt

SEQ ID NO: 8483204 - DNA, 22 bp, Homo sapiens
atataacatacatacagaaaag

SEQ ID NO: 8483205 - DNA, 22 bp, Homo sapiens
ctgggacacccaaggaaagagc

SEQ ID NO: 8483206 - DNA, 22 bp, Homo sapiens
atataacatacatacagaaaag

SEQ ID NO: 8483207 - DNA, 22 bp, Homo sapiens
ctgtcttttcatactttccctc

SEQ ID NO: 8483208 - DNA, 22 bp, Homo sapiens
ctgtcttttcatactttccctc

SEQ ID NO: 8483209 - DNA, 22 bp, Homo sapiens
ctgtcttttcatactttccctc

SEQ ID NO: 8483210 - DNA, 22 bp, Homo sapiens
ctgtcttttcatactttccctc

SEQ ID NO: 8483211 - DNA, 22 bp, Homo sapiens
ctgtcttttcttctcattgatg

SEQ ID NO: 8483212 - DNA, 22 bp, Homo sapiens
ctgtcttttcttctcattgatg

SEQ ID NO: 8483213 - DNA, 22 bp, Homo sapiens
ctgtctttggtcctgtctgtta

SEQ ID NO: 8483214 - DNA, 22 bp, Homo sapiens
ctgtcttttactatcatttact

SEQ ID NO: 8483215 - DNA, 22 bp, Homo sapiens
ctgtcttttactatcatttact

SEQ ID NO: 8483216 - DNA, 18 bp, Homo sapiens
ctgtcttttttctctcca

SEQ ID NO: 8483217 - DNA, 18 bp, Homo sapiens
ctgtcttttttctctcca

SEQ ID NO: 8483218 - DNA, 22 bp, Homo sapiens
ctgtctttttagagagtaggat

SEQ ID NO: 8483219 - DNA, 22 bp, Homo sapiens
ctgtctttttagagagtaggat

SEQ ID NO: 8483220 - DNA, 18 bp, Homo sapiens
ctgtcttttttctctcca

SEQ ID NO: 8483221 - DNA, 22 bp, Homo sapiens
ctgtgagttcattgtgccacct

SEQ ID NO: 8483222 - DNA, 22 bp, Homo sapiens
ctgtgatcattcttgatttaag

SEQ ID NO: 8483223 - DNA, 22 bp, Homo sapiens
ctgtctgttttgtatacaggcc

SEQ ID NO: 8483224 - DNA, 22 bp, Homo sapiens
ctgtcttcccgaggccctggag

SEQ ID NO: 8483225 - DNA, 22 bp, Homo sapiens
ctgtctgttttgtatacaggcc

SEQ ID NO: 8483226 - DNA, 22 bp, Homo sapiens
ctgtcttctaccttcaacctcc

SEQ ID NO: 8483227 - DNA, 22 bp, Homo sapiens
ctgtcttctcctttgtttcagg

SEQ ID NO: 8483228 - DNA, 22 bp, Homo sapiens
ctgtcttctaccttcaacctcc

SEQ ID NO: 8483229 - DNA, 22 bp, Homo sapiens
ctgtctttagtacaaaaaatgt

SEQ ID NO: 8483230 - DNA, 19 bp, Homo sapiens
atcacatgtcaagagcagg

SEQ ID NO: 8483231 - DNA, 22 bp, Homo sapiens
atcacatggaatgattttagac

SEQ ID NO: 8483232 - DNA, 22 bp, Homo sapiens
ctgtctctgtcttaactcccag

SEQ ID NO: 8483233 - DNA, 22 bp, Homo sapiens
atcacattatgtagtgaaaagg

SEQ ID NO: 8483234 - DNA, 22 bp, Homo sapiens
ctgtctgtttctgattcaacct

SEQ ID NO: 8483235 - DNA, 22 bp, Homo sapiens
ctgtctgttttaccttctccag

SEQ ID NO: 8483236 - DNA, 22 bp, Homo sapiens
ctgtctctgttgcctgtaggtg

SEQ ID NO: 8483237 - DNA, 22 bp, Homo sapiens
ctgtctgtttctgattcaacct

SEQ ID NO: 8483238 - DNA, 22 bp, Homo sapiens
ctgtctctgtcttaactcccag

SEQ ID NO: 8483239 - DNA, 22 bp, Homo sapiens
ctgtgcactaaccacacccacg

SEQ ID NO: 8483240 - DNA, 22 bp, Homo sapiens
ctgtgcacacgtgcccaacagt

SEQ ID NO: 8483241 - DNA, 22 bp, Homo sapiens
ctgtgcacttctctttatttgt

SEQ ID NO: 8483242 - DNA, 22 bp, Homo sapiens
ctgtgatgttagctctgtgtta

SEQ ID NO: 8483243 - DNA, 22 bp, Homo sapiens
ctgtgatgttagctctgtgtta

SEQ ID NO: 8483244 - DNA, 22 bp, Homo sapiens
ctgtgattgttagttcctatac

SEQ ID NO: 8483245 - DNA, 22 bp, Homo sapiens
ctgtgcaagacttactttaata

SEQ ID NO: 8483246 - DNA, 22 bp, Homo sapiens
ctgtgcaagcccaagataaaac

SEQ ID NO: 8483247 - DNA, 22 bp, Homo sapiens
atcatcattcttggataaagca

SEQ ID NO: 8483248 - DNA, 22 bp, Homo sapiens
atcatcatgcactctcaggttt

SEQ ID NO: 8483249 - DNA, 22 bp, Homo sapiens
atcatgacagagtctgccatcc

SEQ ID NO: 8483250 - DNA, 22 bp, Homo sapiens
atcatgacatctgagtttaagt

SEQ ID NO: 8483251 - DNA, 22 bp, Homo sapiens
atcatgacatacttttgagaag

SEQ ID NO: 8483252 - DNA, 22 bp, Homo sapiens
atcatggaagcctatcttgaga

SEQ ID NO: 8483253 - DNA, 22 bp, Homo sapiens
atcatggaaaggttcagcaagc

SEQ ID NO: 8483254 - DNA, 22 bp, Homo sapiens
atcatgttcatcgtatttaggc

SEQ ID NO: 8483255 - DNA, 22 bp, Homo sapiens
atcatgttcatcgtatttaggc

SEQ ID NO: 8483256 - DNA, 22 bp, Homo sapiens
atcatgttaaatatttcaatct

SEQ ID NO: 8483257 - DNA, 22 bp, Homo sapiens
atcacatggaatgattttagac

SEQ ID NO: 8483258 - DNA, 22 bp, Homo sapiens
atcacatcgaggagcaatcaga

SEQ ID NO: 8483259 - DNA, 22 bp, Homo sapiens
atcacatctcaccactgcaacc

SEQ ID NO: 8483260 - DNA, 22 bp, Homo sapiens
atcacatatttaagaaacatgt

SEQ ID NO: 8483261 - DNA, 22 bp, Homo sapiens
atcacagggtgaggattagacc

SEQ ID NO: 8483262 - DNA, 22 bp, Homo sapiens
atcacaggtggtaggaaaagaa

SEQ ID NO: 8483263 - DNA, 22 bp, Homo sapiens
atcacagtggcagggatttggg

SEQ ID NO: 8483264 - DNA, 22 bp, Homo sapiens
atcacagtgtagaccttttaaa

SEQ ID NO: 8483265 - DNA, 22 bp, Homo sapiens
ctgtcctctgtcctcagcagga

SEQ ID NO: 8483266 - DNA, 22 bp, Homo sapiens
ctgtcctccggccacctacagt

SEQ ID NO: 8483267 - DNA, 22 bp, Homo sapiens
ctgtcctctgtcctcagcagga

SEQ ID NO: 8483268 - DNA, 22 bp, Homo sapiens
ctgtcctctgtcctcagcagga

SEQ ID NO: 8483269 - DNA, 22 bp, Homo sapiens
ctgtcctccagacgacagtccc

SEQ ID NO: 8483270 - DNA, 22 bp, Homo sapiens
ctgtcctccagacgacagtccc

SEQ ID NO: 8483271 - DNA, 22 bp, Homo sapiens
ctgtcctccggccacctacagt

SEQ ID NO: 8483272 - DNA, 22 bp, Homo sapiens
ctgtcctccggccacctacagt

SEQ ID NO: 8483273 - DNA, 22 bp, Homo sapiens
ctgtcctccagacgacagtccc

SEQ ID NO: 8483274 - DNA, 22 bp, Homo sapiens
ctgtcctcaccttggcaggggg

SEQ ID NO: 8483275 - DNA, 21 bp, Homo sapiens
ctgtcctcagatgtggacgag

SEQ ID NO: 8483276 - DNA, 22 bp, Homo sapiens
ctgtcctcatctgccccaaggg

SEQ ID NO: 8483277 - DNA, 20 bp, Homo sapiens
ctgggtcacttggctgctct

SEQ ID NO: 8483278 - DNA, 22 bp, Homo sapiens
ctgggtcacccaaaagggccag

SEQ ID NO: 8483279 - DNA, 22 bp, Homo sapiens
ctgggtcccacagcctgctggg

SEQ ID NO: 8483280 - DNA, 22 bp, Homo sapiens
ctgggtcagtctgtccctaggg

SEQ ID NO: 8483281 - DNA, 22 bp, Homo sapiens
ctgggtcagtctgtccctaggg

SEQ ID NO: 8483282 - DNA, 22 bp, Homo sapiens
ctgggtcagtggcaagctgggt

SEQ ID NO: 8483283 - DNA, 22 bp, Homo sapiens
atatttgtcaattcactgttca

SEQ ID NO: 8483284 - DNA, 22 bp, Homo sapiens
atatttgtatttcgtgtgtgta

SEQ ID NO: 8483285 - DNA, 22 bp, Homo sapiens
atatttgtatttcgtgtgtgta

SEQ ID NO: 8483286 - DNA, 22 bp, Homo sapiens
atatttgtatttcgtgtgtgta

SEQ ID NO: 8483287 - DNA, 22 bp, Homo sapiens
atatttgtcatctgccttagtt

SEQ ID NO: 8483288 - DNA, 22 bp, Homo sapiens
atatttgtggtaaaggtaagaa

SEQ ID NO: 8483289 - DNA, 22 bp, Homo sapiens
atatttgtggtttttggctcct

SEQ ID NO: 8483290 - DNA, 22 bp, Homo sapiens
atatttgtggtttttggctcct

SEQ ID NO: 8483291 - DNA, 18 bp, Homo sapiens
ctgggtctccaggctgcc

SEQ ID NO: 8483292 - DNA, 22 bp, Homo sapiens
ctgggtcctggtgctgagttct

SEQ ID NO: 8483293 - DNA, 22 bp, Homo sapiens
ctgggtcctgctctccctaaga

SEQ ID NO: 8483294 - DNA, 22 bp, Homo sapiens
ctgtcccttcccaagcccagcc

SEQ ID NO: 8483295 - DNA, 22 bp, Homo sapiens
ctgtcccttcccaagcccagcc

SEQ ID NO: 8483296 - DNA, 22 bp, Homo sapiens
ctgtcctatgagtactcactag

SEQ ID NO: 8483297 - DNA, 22 bp, Homo sapiens
ctgtggaggtaggagcaggaca

SEQ ID NO: 8483298 - DNA, 22 bp, Homo sapiens
ctgtggagcttgtggcagtggg

SEQ ID NO: 8483299 - DNA, 22 bp, Homo sapiens
ctgtggagcttgtggcagtggg

SEQ ID NO: 8483300 - DNA, 22 bp, Homo sapiens
ctgtggagcttgtggcagtggg

SEQ ID NO: 8483301 - DNA, 22 bp, Homo sapiens
ctgtggagcttgtggcagtggg

SEQ ID NO: 8483302 - DNA, 22 bp, Homo sapiens
ctgtggaggtaggagcaggaca

SEQ ID NO: 8483303 - DNA, 22 bp, Homo sapiens
ctgtggaggtaggagcaggaca

SEQ ID NO: 8483304 - DNA, 22 bp, Homo sapiens
ctgtggagtcctggggaatgga

SEQ ID NO: 8483305 - DNA, 22 bp, Homo sapiens
ctgtggagtcctggggaatgga

SEQ ID NO: 8483306 - DNA, 22 bp, Homo sapiens
ctgtggagtgcttggctcagtg

SEQ ID NO: 8483307 - DNA, 22 bp, Homo sapiens
ctgtggagtgcttggctcagtg

SEQ ID NO: 8483308 - DNA, 22 bp, Homo sapiens
ctgtggagtggggagtactggt

SEQ ID NO: 8483309 - DNA, 22 bp, Homo sapiens
atcattctagctgttgtgttga

SEQ ID NO: 8483310 - DNA, 22 bp, Homo sapiens
ctgtggagtggggagtactggt

SEQ ID NO: 8483311 - DNA, 22 bp, Homo sapiens
ctgtggagtgcttggctcagtg

SEQ ID NO: 8483312 - DNA, 22 bp, Homo sapiens
ctgtggagtgcttggctcagtg

SEQ ID NO: 8483313 - DNA, 23 bp, Homo sapiens
ctgtggagccctttgttgggaga

SEQ ID NO: 8483314 - DNA, 22 bp, Homo sapiens
ctgtggagcagggcagggtcac

SEQ ID NO: 8483315 - DNA, 22 bp, Homo sapiens
ctgtggagcagggcagggtcac

SEQ ID NO: 8483316 - DNA, 22 bp, Homo sapiens
ctgtggagcagggcagggtcac

SEQ ID NO: 8483317 - DNA, 22 bp, Homo sapiens
ctgtggagatgcagaccaggcc

SEQ ID NO: 8483318 - DNA, 22 bp, Homo sapiens
ctgtggagatgcagaccaggcc

SEQ ID NO: 8483319 - DNA, 22 bp, Homo sapiens
atcatgttgtatgtaatctttt

SEQ ID NO: 8483320 - DNA, 22 bp, Homo sapiens
atcatgttttaattagcaaact

SEQ ID NO: 8483321 - DNA, 22 bp, Homo sapiens
atcatgttccagaaacagtgat

SEQ ID NO: 8483322 - DNA, 22 bp, Homo sapiens
atcatgttccagaaacagtgat

SEQ ID NO: 8483323 - DNA, 22 bp, Homo sapiens
atcatgttggctctgacaaaaa

SEQ ID NO: 8483324 - DNA, 22 bp, Homo sapiens
atcatgttgctcaaaattaaac

SEQ ID NO: 8483325 - DNA, 22 bp, Homo sapiens
atccaaaggtgacacagaatac

SEQ ID NO: 8483326 - DNA, 22 bp, Homo sapiens
atccaaatcatgtcagaagaac

SEQ ID NO: 8483327 - DNA, 22 bp, Homo sapiens
atccaaatatattttattcact

SEQ ID NO: 8483328 - DNA, 22 bp, Homo sapiens
atccaaagatggaaagaacttt

SEQ ID NO: 8483329 - DNA, 22 bp, Homo sapiens
atccaaagatggaaagaacttt

SEQ ID NO: 8483330 - DNA, 22 bp, Homo sapiens
atccaaagccctaagttaactg

SEQ ID NO: 8483331 - DNA, 22 bp, Homo sapiens
atccaacacgtatttgctggcc

SEQ ID NO: 8483332 - DNA, 22 bp, Homo sapiens
atcatttttaagagactcttct

SEQ ID NO: 8483333 - DNA, 22 bp, Homo sapiens
atcattttgtgacaatgcctgt

SEQ ID NO: 8483334 - DNA, 22 bp, Homo sapiens
atcattttgtgacaatgcctgt

SEQ ID NO: 8483335 - DNA, 22 bp, Homo sapiens
atcattttatggctgagaggac

SEQ ID NO: 8483336 - DNA, 22 bp, Homo sapiens
atcattttgtgacaatgcctgt

SEQ ID NO: 8483337 - DNA, 22 bp, Homo sapiens
atcattttatggctgagaggac

SEQ ID NO: 8483338 - DNA, 22 bp, Homo sapiens
atcatttttaagagactcttct

SEQ ID NO: 8483339 - DNA, 22 bp, Homo sapiens
atccaaaatttactgtagcatt

SEQ ID NO: 8483340 - DNA, 22 bp, Homo sapiens
atccaaacctggacatgagtgg

SEQ ID NO: 8483341 - DNA, 22 bp, Homo sapiens
atccaaactatgactagtgttc

SEQ ID NO: 8483342 - DNA, 22 bp, Homo sapiens
atccaaacatgtaccacactaa

SEQ ID NO: 8483343 - DNA, 22 bp, Homo sapiens
atccaaacctggacatgagtgg

SEQ ID NO: 8483344 - DNA, 22 bp, Homo sapiens
atccccttgtgggctggcagca

SEQ ID NO: 8483345 - DNA, 22 bp, Homo sapiens
atccctcagcagacagcaaaat

SEQ ID NO: 8483346 - DNA, 22 bp, Homo sapiens
atcccgaacctctacttctttc

SEQ ID NO: 8483347 - DNA, 22 bp, Homo sapiens
atccctcagccacctttgagga

SEQ ID NO: 8483348 - DNA, 22 bp, Homo sapiens
atccctctctgcatgactgtgt

SEQ ID NO: 8483349 - DNA, 22 bp, Homo sapiens
atccctgccctcatggagctta

SEQ ID NO: 8483350 - DNA, 22 bp, Homo sapiens
atccccctcttggatggcggca

SEQ ID NO: 8483351 - DNA, 22 bp, Homo sapiens
atccccctgtatctggaagaat

SEQ ID NO: 8483352 - DNA, 23 bp, Homo sapiens
atcccctgccttgggtgagtccc

SEQ ID NO: 8483353 - DNA, 22 bp, Homo sapiens
atccccaggggcattcaagctt

SEQ ID NO: 8483354 - DNA, 22 bp, Homo sapiens
atccccaggggcattcaagctt

SEQ ID NO: 8483355 - DNA, 22 bp, Homo sapiens
atccccagggagtgagctgtct

SEQ ID NO: 8483356 - DNA, 17 bp, Homo sapiens
atccccagcatctagaa

SEQ ID NO: 8483357 - DNA, 17 bp, Homo sapiens
atccccagcatctagaa

SEQ ID NO: 8483358 - DNA, 17 bp, Homo sapiens
atccccagcatctagaa

SEQ ID NO: 8483359 - DNA, 22 bp, Homo sapiens
atccatttgtaaatgttagagt

SEQ ID NO: 8483360 - DNA, 22 bp, Homo sapiens
atccccagactttagatttctc

SEQ ID NO: 8483361 - DNA, 22 bp, Homo sapiens
atccacagtgcagcaagggccc

SEQ ID NO: 8483362 - DNA, 22 bp, Homo sapiens
atccacagaaggaacttgaaag

SEQ ID NO: 8483363 - DNA, 22 bp, Homo sapiens
atccacagagaggaagaatagt

SEQ ID NO: 8483364 - DNA, 22 bp, Homo sapiens
atccacaggtcatgtaatgtgg

SEQ ID NO: 8483365 - DNA, 22 bp, Homo sapiens
atccacaggtcatgtaatgtgg

SEQ ID NO: 8483366 - DNA, 22 bp, Homo sapiens
atcctcagtgtttctgacatct

SEQ ID NO: 8483367 - DNA, 22 bp, Homo sapiens
atcctcagtgtttctgacatct

SEQ ID NO: 8483368 - DNA, 18 bp, Homo sapiens
atcctctagcttctcaga

SEQ ID NO: 8483369 - DNA, 22 bp, Homo sapiens
atcctctctgtgacagggaacg

SEQ ID NO: 8483370 - DNA, 22 bp, Homo sapiens
atcctctctcccataccagtct

SEQ ID NO: 8483371 - DNA, 22 bp, Homo sapiens
atcctctctgtgacagggaacg

SEQ ID NO: 8483372 - DNA, 23 bp, Homo sapiens
atcctctctccatcccactgtgc

SEQ ID NO: 8483373 - DNA, 22 bp, Homo sapiens
atcctctctcccataccagtct

SEQ ID NO: 8483374 - DNA, 23 bp, Homo sapiens
atcctctctccatcccactgtgc

SEQ ID NO: 8483375 - DNA, 22 bp, Homo sapiens
atctacaacgggtggagtaggg

SEQ ID NO: 8483376 - DNA, 22 bp, Homo sapiens
atctaattttcactcatttgct

SEQ ID NO: 8483377 - DNA, 22 bp, Homo sapiens
atcctttagtcctacaactcga

SEQ ID NO: 8483378 - DNA, 22 bp, Homo sapiens
atcctttaagttaataaaattc

SEQ ID NO: 8483379 - DNA, 22 bp, Homo sapiens
atcctctgtggattacacctag

SEQ ID NO: 8483380 - DNA, 22 bp, Homo sapiens
atcctctgaccgctgcagggag

SEQ ID NO: 8483381 - DNA, 22 bp, Homo sapiens
atccctggacggcgcctcccca

SEQ ID NO: 8483382 - DNA, 22 bp, Homo sapiens
atccctgccctcatggagctta

SEQ ID NO: 8483383 - DNA, 23 bp, Homo sapiens
atcccttctccagtgtggtgagg

SEQ ID NO: 8483384 - DNA, 19 bp, Homo sapiens
atcctaaatccagtttcta

SEQ ID NO: 8483385 - DNA, 22 bp, Homo sapiens
atcctaaagcagacagcaggtt

SEQ ID NO: 8483386 - DNA, 22 bp, Homo sapiens
atccgtttttatgaaatgtcca

SEQ ID NO: 8483387 - DNA, 22 bp, Homo sapiens
atccgcttatctcagctggcag

SEQ ID NO: 8483388 - DNA, 21 bp, Homo sapiens
atccgtttaataatactgaat

SEQ ID NO: 8483389 - DNA, 22 bp, Homo sapiens
atcctcagacctcagcaaagcc

SEQ ID NO: 8483390 - DNA, 22 bp, Homo sapiens
atcctcagcatctagcatgaag

SEQ ID NO: 8483391 - DNA, 22 bp, Homo sapiens
atcctcagacctcagcaaagcc

SEQ ID NO: 8483392 - DNA, 20 bp, Homo sapiens
atcctcaccctcagtcctag

SEQ ID NO: 8483393 - DNA, 22 bp, Homo sapiens
atcctagaatcagcccttgctg

SEQ ID NO: 8483394 - DNA, 21 bp, Homo sapiens
atcctatttctgaaaacctgc

SEQ ID NO: 8483395 - DNA, 23 bp, Homo sapiens
atcctatataaccttggaggctg

SEQ ID NO: 8483396 - DNA, 22 bp, Homo sapiens
atcctcacaataaaatcagcct

SEQ ID NO: 8483397 - DNA, 22 bp, Homo sapiens
cagagctgtcatttgccagtga

SEQ ID NO: 8483398 - DNA, 22 bp, Homo sapiens
cagagctgtatttatctttcca

SEQ ID NO: 8483399 - DNA, 22 bp, Homo sapiens
cagagctggtgttacaagtcca

SEQ ID NO: 8483400 - DNA, 22 bp, Homo sapiens
cagagctggtgtgtcctggcat

SEQ ID NO: 8483401 - DNA, 22 bp, Homo sapiens
cagagctggtgttacaagtcca

SEQ ID NO: 8483402 - DNA, 22 bp, Homo sapiens
cagagctggtgttacaagtcca

SEQ ID NO: 8483403 - DNA, 20 bp, Homo sapiens
cagaggcattttcagactct

SEQ ID NO: 8483404 - DNA, 20 bp, Homo sapiens
cagaggcattttcagactct

SEQ ID NO: 8483405 - DNA, 22 bp, Homo sapiens
cagaggccacctgtggccactg

SEQ ID NO: 8483406 - DNA, 22 bp, Homo sapiens
cagaggccacctgtggccactg

SEQ ID NO: 8483407 - DNA, 22 bp, Homo sapiens
cagaggccacctgtggccactg

SEQ ID NO: 8483408 - DNA, 22 bp, Homo sapiens
cagaggccacctgtggccactg

SEQ ID NO: 8483409 - DNA, 22 bp, Homo sapiens
cagagctggtaagtggtagagg

SEQ ID NO: 8483410 - DNA, 22 bp, Homo sapiens
cagagctggtaagtggtagagg

SEQ ID NO: 8483411 - DNA, 22 bp, Homo sapiens
cagagctggtaagtggtagagg

SEQ ID NO: 8483412 - DNA, 22 bp, Homo sapiens
cagagctggtgtgtcctggcat

SEQ ID NO: 8483413 - DNA, 22 bp, Homo sapiens
cagagctggtgtgtcctggcat

SEQ ID NO: 8483414 - DNA, 22 bp, Homo sapiens
cagagctggtgtgtcctggcat

SEQ ID NO: 8483415 - DNA, 22 bp, Homo sapiens
cagagctggtgtgtcctggcat

SEQ ID NO: 8483416 - DNA, 22 bp, Homo sapiens
cagagctggtgtgtcctggcat

SEQ ID NO: 8483417 - DNA, 22 bp, Homo sapiens
cagagctggtgtgtcctggcat

SEQ ID NO: 8483418 - DNA, 22 bp, Homo sapiens
ggggaagaatgctctctagaga

SEQ ID NO: 8483419 - DNA, 22 bp, Homo sapiens
ggggaagaatgctctctagaga

SEQ ID NO: 8483420 - DNA, 22 bp, Homo sapiens
ggggaagaaatctgggttcttc

SEQ ID NO: 8483421 - DNA, 22 bp, Homo sapiens
ggggaagaaccgggattcccat

SEQ ID NO: 8483422 - DNA, 20 bp, Homo sapiens
ggggaagaaaaggatgtgat

SEQ ID NO: 8483423 - DNA, 22 bp, Homo sapiens
ggggaagaaatctgggttcttc

SEQ ID NO: 8483424 - DNA, 21 bp, Homo sapiens
cagaggcctcatgctctgtgc

SEQ ID NO: 8483425 - DNA, 21 bp, Homo sapiens
cagaggcctcatgctctgtgc

SEQ ID NO: 8483426 - DNA, 22 bp, Homo sapiens
cagaggcctatccagtgtccat

SEQ ID NO: 8483427 - DNA, 22 bp, Homo sapiens
cagaggcctatccagtgtccat

SEQ ID NO: 8483428 - DNA, 22 bp, Homo sapiens
cagaggcctcacttccagccag

SEQ ID NO: 8483429 - DNA, 22 bp, Homo sapiens
cagaggcctcacttccagccag

SEQ ID NO: 8483430 - DNA, 22 bp, Homo sapiens
cagaggcctcacttccagccag

SEQ ID NO: 8483431 - DNA, 21 bp, Homo sapiens
cagaggcctatcacagactcc

SEQ ID NO: 8483432 - DNA, 22 bp, Homo sapiens
cagaggcctatccagtgtccat

SEQ ID NO: 8483433 - DNA, 21 bp, Homo sapiens
cagaggcctatcacagactcc

SEQ ID NO: 8483434 - DNA, 21 bp, Homo sapiens
cagaggcctatcacagactcc

SEQ ID NO: 8483435 - DNA, 21 bp, Homo sapiens
cagaggcctatcacagactcc

SEQ ID NO: 8483436 - DNA, 22 bp, Homo sapiens
cagaggccccagaactagctct

SEQ ID NO: 8483437 - DNA, 22 bp, Homo sapiens
cagaggccccagaactagctct

SEQ ID NO: 8483438 - DNA, 22 bp, Homo sapiens
cagaggccccagaactagctct

SEQ ID NO: 8483439 - DNA, 22 bp, Homo sapiens
cagaggcccagtgagagggctg

SEQ ID NO: 8483440 - DNA, 22 bp, Homo sapiens
cagaggcccagtgagagggctg

SEQ ID NO: 8483441 - DNA, 22 bp, Homo sapiens
cagaggcccagtgagagggctg

SEQ ID NO: 8483442 - DNA, 22 bp, Homo sapiens
cagaggcccagtgagagggctg

SEQ ID NO: 8483443 - DNA, 22 bp, Homo sapiens
cagaggcccagtgagagggctg

SEQ ID NO: 8483444 - DNA, 22 bp, Homo sapiens
cagaggccatatttcttcactc

SEQ ID NO: 8483445 - DNA, 22 bp, Homo sapiens
cagaggccatatttcttcactc

SEQ ID NO: 8483446 - DNA, 22 bp, Homo sapiens
cagaggccagtggacaagggcc

SEQ ID NO: 8483447 - DNA, 22 bp, Homo sapiens
cagaggccagtggacaagggcc

SEQ ID NO: 8483448 - DNA, 22 bp, Homo sapiens
cagaggccatatttcttcactc

SEQ ID NO: 8483449 - DNA, 22 bp, Homo sapiens
cagaggccatatttcttcactc

SEQ ID NO: 8483450 - DNA, 22 bp, Homo sapiens
cagaggccagtggacaagggcc

SEQ ID NO: 8483451 - DNA, 22 bp, Homo sapiens
cagaggccagtggacaagggcc

SEQ ID NO: 8483452 - DNA, 22 bp, Homo sapiens
cagaggccagggggctcacaaa

SEQ ID NO: 8483453 - DNA, 22 bp, Homo sapiens
cagaggccagggggctcacaaa

SEQ ID NO: 8483454 - DNA, 22 bp, Homo sapiens
cagaggccaggctgcctgactg

SEQ ID NO: 8483455 - DNA, 22 bp, Homo sapiens
cagaggccagggggctcacaaa

SEQ ID NO: 8483456 - DNA, 22 bp, Homo sapiens
cagaggccagggggctcacaaa

SEQ ID NO: 8483457 - DNA, 22 bp, Homo sapiens
cagaggccagggggctcacaaa

SEQ ID NO: 8483458 - DNA, 19 bp, Homo sapiens
cagaggccagaagcacagg

SEQ ID NO: 8483459 - DNA, 19 bp, Homo sapiens
cagaggccagaagcacagg

SEQ ID NO: 8483460 - DNA, 19 bp, Homo sapiens
cagaggccagaagcacagg

SEQ ID NO: 8483461 - DNA, 22 bp, Homo sapiens
cagaggctgtgtaggcagactg

SEQ ID NO: 8483462 - DNA, 22 bp, Homo sapiens
cagaggctgtgtaggcagactg

SEQ ID NO: 8483463 - DNA, 22 bp, Homo sapiens
cagaggctgggacctcaggcat

SEQ ID NO: 8483464 - DNA, 22 bp, Homo sapiens
cagaggctgggacctcaggcat

SEQ ID NO: 8483465 - DNA, 22 bp, Homo sapiens
cagaggctgggacctcaggcat

SEQ ID NO: 8483466 - DNA, 22 bp, Homo sapiens
cagaggctgggacctcaggcat

SEQ ID NO: 8483467 - DNA, 22 bp, Homo sapiens
cagaggctgggacctcaggcat

SEQ ID NO: 8483468 - DNA, 22 bp, Homo sapiens
cagaggctggcggccgccccga

SEQ ID NO: 8483469 - DNA, 22 bp, Homo sapiens
cagaggctggatggacttgcct

SEQ ID NO: 8483470 - DNA, 22 bp, Homo sapiens
cagaggcttcaagtcattctcc

SEQ ID NO: 8483471 - DNA, 22 bp, Homo sapiens
cagaggcttcaagtcattctcc

SEQ ID NO: 8483472 - DNA, 22 bp, Homo sapiens
cagaggcttcaagtcattctcc

SEQ ID NO: 8483473 - DNA, 22 bp, Homo sapiens
cagaggcttggcattatcatgc

SEQ ID NO: 8483474 - DNA, 22 bp, Homo sapiens
cagaggctttgccctggaaacc

SEQ ID NO: 8483475 - DNA, 22 bp, Homo sapiens
cagaggtagccgagtgcaatcg

SEQ ID NO: 8483476 - DNA, 22 bp, Homo sapiens
cagaggctgtgtaggcagactg

SEQ ID NO: 8483477 - DNA, 22 bp, Homo sapiens
cagaggctgtgtaggcagactg

SEQ ID NO: 8483478 - DNA, 22 bp, Homo sapiens
cagaggcttcaagtcattctcc

SEQ ID NO: 8483479 - DNA, 22 bp, Homo sapiens
cagaggcttatacctgattagg

SEQ ID NO: 8483480 - DNA, 22 bp, Homo sapiens
cagaggttgagcaaaaatgata

SEQ ID NO: 8483481 - DNA, 22 bp, Homo sapiens
cagagtaaacctgtcatcaaga

SEQ ID NO: 8483482 - DNA, 22 bp, Homo sapiens
cagaggtttgatcgagtaggtc

SEQ ID NO: 8483483 - DNA, 22 bp, Homo sapiens
cagagtaaacctgtcatcaaga

SEQ ID NO: 8483484 - DNA, 22 bp, Homo sapiens
cagagtaaacctgtcatcaaga

SEQ ID NO: 8483485 - DNA, 22 bp, Homo sapiens
cagaggtgttggtgaatggaga

SEQ ID NO: 8483486 - DNA, 22 bp, Homo sapiens
cagaggtagccgagtgcaatcg

SEQ ID NO: 8483487 - DNA, 21 bp, Homo sapiens
cagaggtggcctgacctctga

SEQ ID NO: 8483488 - DNA, 22 bp, Homo sapiens
cagaggtagggagctatgttat

SEQ ID NO: 8483489 - DNA, 22 bp, Homo sapiens
cagaggtgtacagagggaggcc

SEQ ID NO: 8483490 - DNA, 23 bp, Homo sapiens
cagaggtgtcagtgcccagtgtc

SEQ ID NO: 8483491 - DNA, 22 bp, Homo sapiens
cagaggtgtacagagggaggcc

SEQ ID NO: 8483492 - DNA, 22 bp, Homo sapiens
cagaggtgtacagagggaggcc

SEQ ID NO: 8483493 - DNA, 22 bp, Homo sapiens
gggtgccacagagcttccactt

SEQ ID NO: 8483494 - DNA, 22 bp, Homo sapiens
gggtgccacagagcttccactt

SEQ ID NO: 8483495 - DNA, 22 bp, Homo sapiens
gggtgcctgagttagggcagaa

SEQ ID NO: 8483496 - DNA, 22 bp, Homo sapiens
cagaggctgctctgggtggcat

SEQ ID NO: 8483497 - DNA, 22 bp, Homo sapiens
cagaggctggatggacttgcct

SEQ ID NO: 8483498 - DNA, 22 bp, Homo sapiens
gggtgctgaggaagacagcagg

SEQ ID NO: 8483499 - DNA, 22 bp, Homo sapiens
gggtgctgactggggcctgaaa

SEQ ID NO: 8483500 - DNA, 22 bp, Homo sapiens
gggtgcaggcagcccaggcagg

SEQ ID NO: 8483501 - DNA, 22 bp, Homo sapiens
gggtgcaggggaccctagggac

SEQ ID NO: 8483502 - DNA, 22 bp, Homo sapiens
gggtgcagtggttcacgcctgt

SEQ ID NO: 8483503 - DNA, 22 bp, Homo sapiens
cagaggcctggcttggacacct

SEQ ID NO: 8483504 - DNA, 22 bp, Homo sapiens
cagaggccttcaatactcattt

SEQ ID NO: 8483505 - DNA, 22 bp, Homo sapiens
cagaggcctggcttggacacct

SEQ ID NO: 8483506 - DNA, 22 bp, Homo sapiens
cagaggcctggcttggacacct

SEQ ID NO: 8483507 - DNA, 22 bp, Homo sapiens
cagaggcctggcttggacacct

SEQ ID NO: 8483508 - DNA, 22 bp, Homo sapiens
cagaggcctggcttggacacct

SEQ ID NO: 8483509 - DNA, 22 bp, Homo sapiens
cagaggcctggcttggacacct

SEQ ID NO: 8483510 - DNA, 22 bp, Homo sapiens
cagaggccttgtcttctttgct

SEQ ID NO: 8483511 - DNA, 22 bp, Homo sapiens
gggtcgggcaggcgccctcgtc

SEQ ID NO: 8483512 - DNA, 22 bp, Homo sapiens
gggtcgggcaggcgccctcgtc

SEQ ID NO: 8483513 - DNA, 22 bp, Homo sapiens
cagagcccatcctatactctcc

SEQ ID NO: 8483514 - DNA, 22 bp, Homo sapiens
cagagcccagggcctacgtccc

SEQ ID NO: 8483515 - DNA, 22 bp, Homo sapiens
cagagccagctgtccttggcat

SEQ ID NO: 8483516 - DNA, 22 bp, Homo sapiens
cagagccagctgtccttggcat

SEQ ID NO: 8483517 - DNA, 22 bp, Homo sapiens
cagagccagctgtccttggcat

SEQ ID NO: 8483518 - DNA, 22 bp, Homo sapiens
gggcagagaaatggacagttgg

SEQ ID NO: 8483519 - DNA, 22 bp, Homo sapiens
gggcagagaaatggacagttgg

SEQ ID NO: 8483520 - DNA, 22 bp, Homo sapiens
gggcagagaaatggacagttgg

SEQ ID NO: 8483521 - DNA, 19 bp, Homo sapiens
gggcagaatggcatctcag

SEQ ID NO: 8483522 - DNA, 22 bp, Homo sapiens
gggcacagaagtctaagacatc

SEQ ID NO: 8483523 - DNA, 22 bp, Homo sapiens
gggcacagaagtctaagacatc

SEQ ID NO: 8483524 - DNA, 22 bp, Homo sapiens
gggcacagagggtcttgaagaa

SEQ ID NO: 8483525 - DNA, 22 bp, Homo sapiens
gggcactgtgctaggtgctgag

SEQ ID NO: 8483526 - DNA, 22 bp, Homo sapiens
gggcactgtgttcagagtgcag

SEQ ID NO: 8483527 - DNA, 22 bp, Homo sapiens
gggcactgtggggcccatgctg

SEQ ID NO: 8483528 - DNA, 22 bp, Homo sapiens
gggcactgtgctgggtgcttta

SEQ ID NO: 8483529 - DNA, 22 bp, Homo sapiens
cagagccccccttctgatcaca

SEQ ID NO: 8483530 - DNA, 22 bp, Homo sapiens
cagagcccctcagctctctccc

SEQ ID NO: 8483531 - DNA, 22 bp, Homo sapiens
cagagcccctcagctctctccc

SEQ ID NO: 8483532 - DNA, 22 bp, Homo sapiens
cagagccctagtcctgatggcc

SEQ ID NO: 8483533 - DNA, 22 bp, Homo sapiens
cagagccctgtgtgccatgtga

SEQ ID NO: 8483534 - DNA, 21 bp, Homo sapiens
gggcgaggcctgatgtggctc

SEQ ID NO: 8483535 - DNA, 22 bp, Homo sapiens
gggcgagggcgaaagcgagagc

SEQ ID NO: 8483536 - DNA, 22 bp, Homo sapiens
gggcgagggcgaaagcgagagc

SEQ ID NO: 8483537 - DNA, 22 bp, Homo sapiens
gggcgagggcgaaagcgagagc

SEQ ID NO: 8483538 - DNA, 22 bp, Homo sapiens
gggcgaggactgactctgggca

SEQ ID NO: 8483539 - DNA, 22 bp, Homo sapiens
gggccttggcgaagtgtggtgg

SEQ ID NO: 8483540 - DNA, 22 bp, Homo sapiens
gggcgcagccaatcctggccct

SEQ ID NO: 8483541 - DNA, 22 bp, Homo sapiens
cagagcctgctgccttctgaag

SEQ ID NO: 8483542 - DNA, 22 bp, Homo sapiens
gggcgccgtgggaaacagccgg

SEQ ID NO: 8483543 - DNA, 22 bp, Homo sapiens
cagagcctgctcacgtctctgt

SEQ ID NO: 8483544 - DNA, 22 bp, Homo sapiens
cagagctgacccaaggattgaa

SEQ ID NO: 8483545 - DNA, 21 bp, Homo sapiens
cagagctgaagggtgtagtgt

SEQ ID NO: 8483546 - DNA, 21 bp, Homo sapiens
cagagctgaagggtgtagtgt

SEQ ID NO: 8483547 - DNA, 22 bp, Homo sapiens
cagagctgacccaaggattgaa

SEQ ID NO: 8483548 - DNA, 22 bp, Homo sapiens
cagagctgacccaaggattgaa

SEQ ID NO: 8483549 - DNA, 22 bp, Homo sapiens
cagagctgacccaaggattgaa

SEQ ID NO: 8483550 - DNA, 22 bp, Homo sapiens
cagagctgagaatgttgatgct

SEQ ID NO: 8483551 - DNA, 22 bp, Homo sapiens
cagagctgcacattctatgatg

SEQ ID NO: 8483552 - DNA, 22 bp, Homo sapiens
cagagctgcacattctatgatg

SEQ ID NO: 8483553 - DNA, 22 bp, Homo sapiens
cagagctgcacattctatgatg

SEQ ID NO: 8483554 - DNA, 22 bp, Homo sapiens
cagagctgcaaatgcccctccg

SEQ ID NO: 8483555 - DNA, 22 bp, Homo sapiens
cagagctgcaaatgcccctccg

SEQ ID NO: 8483556 - DNA, 22 bp, Homo sapiens
cagagctgcaaatgcccctccg

SEQ ID NO: 8483557 - DNA, 22 bp, Homo sapiens
cagagctgcaaatgcccctccg

SEQ ID NO: 8483558 - DNA, 22 bp, Homo sapiens
cagagctgattggatccagaga

SEQ ID NO: 8483559 - DNA, 22 bp, Homo sapiens
cagagctgagtcttcaaggttg

SEQ ID NO: 8483560 - DNA, 22 bp, Homo sapiens
cagagctgagtcttcaaggttg

SEQ ID NO: 8483561 - DNA, 22 bp, Homo sapiens
cagagctgagaatgttgatgct

SEQ ID NO: 8483562 - DNA, 22 bp, Homo sapiens
cagagctgagaatgttgatgct

SEQ ID NO: 8483563 - DNA, 22 bp, Homo sapiens
cagagctgagaatgttgatgct

SEQ ID NO: 8483564 - DNA, 23 bp, Homo sapiens
cagagctgattaaacttaatctc

SEQ ID NO: 8483565 - DNA, 22 bp, Homo sapiens
cagagctgattggatccagaga

SEQ ID NO: 8483566 - DNA, 22 bp, Homo sapiens
cagagctgcgctttttcctggt

SEQ ID NO: 8483567 - DNA, 22 bp, Homo sapiens
cagagctgcgctttttcctggt

SEQ ID NO: 8483568 - DNA, 22 bp, Homo sapiens
cagagctgcgctttttcctggt

SEQ ID NO: 8483569 - DNA, 22 bp, Homo sapiens
cagagctgcgctttttcctggt

SEQ ID NO: 8483570 - DNA, 22 bp, Homo sapiens
cagagctgcagattgaaggcat

SEQ ID NO: 8483571 - DNA, 22 bp, Homo sapiens
cagagctgcagattgaaggcat

SEQ ID NO: 8483572 - DNA, 22 bp, Homo sapiens
cagagctgcagattgaaggcat

SEQ ID NO: 8483573 - DNA, 22 bp, Homo sapiens
cagagctgcagattgaaggcat

SEQ ID NO: 8483574 - DNA, 22 bp, Homo sapiens
cagagctgcagattgaaggcat

SEQ ID NO: 8483575 - DNA, 22 bp, Homo sapiens
cagagctgctcatggtggccag

SEQ ID NO: 8483576 - DNA, 22 bp, Homo sapiens
cagagctgctcatggtggccag

SEQ ID NO: 8483577 - DNA, 19 bp, Homo sapiens
cagagctgctggcctcgtc

SEQ ID NO: 8483578 - DNA, 19 bp, Homo sapiens
cagagctgctggcctcgtc

SEQ ID NO: 8483579 - DNA, 19 bp, Homo sapiens
cagagctgctggcctcgtc

SEQ ID NO: 8483580 - DNA, 19 bp, Homo sapiens
cagagctgctggcctcgtc

SEQ ID NO: 8483581 - DNA, 22 bp, Homo sapiens
gggctgtgtatcagttatctat

SEQ ID NO: 8483582 - DNA, 21 bp, Homo sapiens
gggctttttatttagcactgt

SEQ ID NO: 8483583 - DNA, 22 bp, Homo sapiens
gggctgtgtactatgaggaggg

SEQ ID NO: 8483584 - DNA, 23 bp, Homo sapiens
ggggaaagaccatgcttgaggac

SEQ ID NO: 8483585 - DNA, 22 bp, Homo sapiens
ggggaacaccgggcagaggcgc

SEQ ID NO: 8483586 - DNA, 22 bp, Homo sapiens
ggggaaattgtggctgacagtg

SEQ ID NO: 8483587 - DNA, 22 bp, Homo sapiens
ggggaaattgtggctgacagtg

SEQ ID NO: 8483588 - DNA, 20 bp, Homo sapiens
ggggaagaaaaggatgtgat

SEQ ID NO: 8483589 - DNA, 20 bp, Homo sapiens
ggggaagaaaaggatgtgat

SEQ ID NO: 8483590 - DNA, 23 bp, Homo sapiens
gggaagctccatggaggtgctgg

SEQ ID NO: 8483591 - DNA, 22 bp, Homo sapiens
gggaagctgaagctagagaaaa

SEQ ID NO: 8483592 - DNA, 22 bp, Homo sapiens
gggaaggaaagttattagcaga

SEQ ID NO: 8483593 - DNA, 22 bp, Homo sapiens
gggaagctgcgtggtctagggc

SEQ ID NO: 8483594 - DNA, 22 bp, Homo sapiens
gggaaggacacagccatgactg

SEQ ID NO: 8483595 - DNA, 22 bp, Homo sapiens
gggaaggagcctgcttgctaga

SEQ ID NO: 8483596 - DNA, 22 bp, Homo sapiens
gggaaggaggtggcttgaagtg

SEQ ID NO: 8483597 - DNA, 22 bp, Homo sapiens
gggacaatggaggcctctctcc

SEQ ID NO: 8483598 - DNA, 22 bp, Homo sapiens
gggacaatggaggcctctctcc

SEQ ID NO: 8483599 - DNA, 22 bp, Homo sapiens
gggacaatggaggcctctctcc

SEQ ID NO: 8483600 - DNA, 22 bp, Homo sapiens
gggacaatggaggcctctctcc

SEQ ID NO: 8483601 - DNA, 22 bp, Homo sapiens
gggacagacccatgggccaggt

SEQ ID NO: 8483602 - DNA, 22 bp, Homo sapiens
gggacagaaggaagtgagcaca

SEQ ID NO: 8483603 - DNA, 22 bp, Homo sapiens
gggacacagccatctgtgtttt

SEQ ID NO: 8483604 - DNA, 22 bp, Homo sapiens
gggacacaggtatctcaaatga

SEQ ID NO: 8483605 - DNA, 21 bp, Homo sapiens
gggacaccaactccagggctt

SEQ ID NO: 8483606 - DNA, 22 bp, Homo sapiens
gggacactcaatgagacctgca

SEQ ID NO: 8483607 - DNA, 22 bp, Homo sapiens
gggactggaactactggtgcag

SEQ ID NO: 8483608 - DNA, 22 bp, Homo sapiens
gggactggagtagaggccggtg

SEQ ID NO: 8483609 - DNA, 22 bp, Homo sapiens
gggactggaactactggtgcag

SEQ ID NO: 8483610 - DNA, 22 bp, Homo sapiens
gggactggcacagggctgggag

SEQ ID NO: 8483611 - DNA, 22 bp, Homo sapiens
gggactggagtagaggccggtg

SEQ ID NO: 8483612 - DNA, 22 bp, Homo sapiens
cagaagtaagattactgtgagt

SEQ ID NO: 8483613 - DNA, 21 bp, Homo sapiens
cagaagtaagggtaacttctc

SEQ ID NO: 8483614 - DNA, 22 bp, Homo sapiens
cagaagtaagattactgtgagt

SEQ ID NO: 8483615 - DNA, 22 bp, Homo sapiens
cagaagtaagattactgtgaga

SEQ ID NO: 8483616 - DNA, 22 bp, Homo sapiens
cagaagtaagattactgtgaga

SEQ ID NO: 8483617 - DNA, 22 bp, Homo sapiens
cagaagtaagattactgtgagt

SEQ ID NO: 8483618 - DNA, 22 bp, Homo sapiens
cagaagtaagattactgtgaga

SEQ ID NO: 8483619 - DNA, 22 bp, Homo sapiens
cagaaggtttacactggactgt

SEQ ID NO: 8483620 - DNA, 20 bp, Homo sapiens
cagaaggtctaagctttaga

SEQ ID NO: 8483621 - DNA, 20 bp, Homo sapiens
cagaaggtctaagctttaga

SEQ ID NO: 8483622 - DNA, 22 bp, Homo sapiens
gggaaaaataatgcacagatat

SEQ ID NO: 8483623 - DNA, 22 bp, Homo sapiens
ggcttttgtttcagctctgcta

SEQ ID NO: 8483624 - DNA, 18 bp, Homo sapiens
cagaagtccttcaaggcc

SEQ ID NO: 8483625 - DNA, 22 bp, Homo sapiens
ggcttttgctgtgttttccaga

SEQ ID NO: 8483626 - DNA, 22 bp, Homo sapiens
ggcttttgaattccaaggcatt

SEQ ID NO: 8483627 - DNA, 22 bp, Homo sapiens
cactggcctaagcgcctcagcc

SEQ ID NO: 8483628 - DNA, 22 bp, Homo sapiens
cactgggaatctgggaaagaga

SEQ ID NO: 8483629 - DNA, 22 bp, Homo sapiens
cactggctgggccagcactcct

SEQ ID NO: 8483630 - DNA, 22 bp, Homo sapiens
cactggctgagcttctctaggg

SEQ ID NO: 8483631 - DNA, 22 bp, Homo sapiens
cactggctgagcttctctaggg

SEQ ID NO: 8483632 - DNA, 22 bp, Homo sapiens
cagaagcagtgagagatgtgca

SEQ ID NO: 8483633 - DNA, 22 bp, Homo sapiens
cagaaggcaaggcctgccacgc

SEQ ID NO: 8483634 - DNA, 22 bp, Homo sapiens
cagaagggcagcactgggaagg

SEQ ID NO: 8483635 - DNA, 22 bp, Homo sapiens
cagaagggcagcactgggaagg

SEQ ID NO: 8483636 - DNA, 22 bp, Homo sapiens
cagaaggctttgtggagtagac

SEQ ID NO: 8483637 - DNA, 22 bp, Homo sapiens
cagaagggacagggtttgtaga

SEQ ID NO: 8483638 - DNA, 22 bp, Homo sapiens
cagaaggcatagatgaaggcct

SEQ ID NO: 8483639 - DNA, 22 bp, Homo sapiens
cagacagggtcctgtccgtcac

SEQ ID NO: 8483640 - DNA, 22 bp, Homo sapiens
gggatgagagtagggtgtgaaa

SEQ ID NO: 8483641 - DNA, 22 bp, Homo sapiens
cagacaggggtaaccttcctca

SEQ ID NO: 8483642 - DNA, 22 bp, Homo sapiens
gggatgagagtagggtgtgaaa

SEQ ID NO: 8483643 - DNA, 20 bp, Homo sapiens
gggatgagagtcctagctct

SEQ ID NO: 8483644 - DNA, 22 bp, Homo sapiens
cagacagggccctgtgatggta

SEQ ID NO: 8483645 - DNA, 22 bp, Homo sapiens
cagacagggacctcgctccaga

SEQ ID NO: 8483646 - DNA, 22 bp, Homo sapiens
cagacagggccctgtgatggta

SEQ ID NO: 8483647 - DNA, 22 bp, Homo sapiens
cagacagggacctcgctccaga

SEQ ID NO: 8483648 - DNA, 22 bp, Homo sapiens
cagacagggacctcgctccaga

SEQ ID NO: 8483649 - DNA, 17 bp, Homo sapiens
cagacaggctgtcaccc

SEQ ID NO: 8483650 - DNA, 22 bp, Homo sapiens
cagacaggctagccagactcac

SEQ ID NO: 8483651 - DNA, 22 bp, Homo sapiens
cagacaggctagccagactcac

SEQ ID NO: 8483652 - DNA, 20 bp, Homo sapiens
gggcaaggaaacagccccca

SEQ ID NO: 8483653 - DNA, 22 bp, Homo sapiens
gggcaaggcagaagagttggag

SEQ ID NO: 8483654 - DNA, 22 bp, Homo sapiens
gggcaaggcagaagagttggag

SEQ ID NO: 8483655 - DNA, 18 bp, Homo sapiens
gggcaagcggctgtcacc

SEQ ID NO: 8483656 - DNA, 22 bp, Homo sapiens
gggcaagctcttcagaagctct

SEQ ID NO: 8483657 - DNA, 22 bp, Homo sapiens
gggaggggttgcatgtttgagt

SEQ ID NO: 8483658 - DNA, 22 bp, Homo sapiens
gggaggggttgcatgtttgagt

SEQ ID NO: 8483659 - DNA, 22 bp, Homo sapiens
gggaggggttgcatgtttgagt

SEQ ID NO: 8483660 - DNA, 22 bp, Homo sapiens
gggaggggttgcatgtttgagt

SEQ ID NO: 8483661 - DNA, 22 bp, Homo sapiens
gggagggcttggacccagatgt

SEQ ID NO: 8483662 - DNA, 22 bp, Homo sapiens
gggagggccagtgctctctaga

SEQ ID NO: 8483663 - DNA, 22 bp, Homo sapiens
gggagggccagtgctctctaga

SEQ ID NO: 8483664 - DNA, 22 bp, Homo sapiens
gggagggcttggacccagatgt

SEQ ID NO: 8483665 - DNA, 22 bp, Homo sapiens
gggagggcttggacccagatgt

SEQ ID NO: 8483666 - DNA, 22 bp, Homo sapiens
gggaggggttgcatgtttgagt

SEQ ID NO: 8483667 - DNA, 22 bp, Homo sapiens
gggagggccagtgctctctaga

SEQ ID NO: 8483668 - DNA, 22 bp, Homo sapiens
gggagggccaggctcacccagg

SEQ ID NO: 8483669 - DNA, 22 bp, Homo sapiens
gggagcagttaaaatgattcct

SEQ ID NO: 8483670 - DNA, 22 bp, Homo sapiens
gggagcagttaaaatgattcct

SEQ ID NO: 8483671 - DNA, 22 bp, Homo sapiens
gggagcaggagcctgcctgcca

SEQ ID NO: 8483672 - DNA, 22 bp, Homo sapiens
gggagcagttaaaatgattcct

SEQ ID NO: 8483673 - DNA, 22 bp, Homo sapiens
gggaggtgaaaggtcatgtgtg

SEQ ID NO: 8483674 - DNA, 22 bp, Homo sapiens
cagacaggctagccagactcac

SEQ ID NO: 8483675 - DNA, 22 bp, Homo sapiens
cagacaggctagccagactcac

SEQ ID NO: 8483676 - DNA, 22 bp, Homo sapiens
gggaggtcctaaaggggaccag

SEQ ID NO: 8483677 - DNA, 22 bp, Homo sapiens
gggaggtcagggtgcctgctgg

SEQ ID NO: 8483678 - DNA, 22 bp, Homo sapiens
gggagggtgttctcccaagaac

SEQ ID NO: 8483679 - DNA, 22 bp, Homo sapiens
gggagggtctgagagctgcacc

SEQ ID NO: 8483680 - DNA, 22 bp, Homo sapiens
gggagggtctgccatgctccct

SEQ ID NO: 8483681 - DNA, 22 bp, Homo sapiens
gggagggtctgagagctgcacc

SEQ ID NO: 8483682 - DNA, 22 bp, Homo sapiens
gggagggtctgagagctgcacc

SEQ ID NO: 8483683 - DNA, 22 bp, Homo sapiens
gggagcaggacataatagcaat

SEQ ID NO: 8483684 - DNA, 22 bp, Homo sapiens
gggagcaggacataatagcaat

SEQ ID NO: 8483685 - DNA, 22 bp, Homo sapiens
gggagcaggagcctgcctgcca

SEQ ID NO: 8483686 - DNA, 22 bp, Homo sapiens
gggagcaggagcctgcctgcca

SEQ ID NO: 8483687 - DNA, 22 bp, Homo sapiens
gggagcaggagcctgcctgcca

SEQ ID NO: 8483688 - DNA, 22 bp, Homo sapiens
gggagcaggagcctgcctgcca

SEQ ID NO: 8483689 - DNA, 19 bp, Homo sapiens
gggagcaggaaagctgtgg

SEQ ID NO: 8483690 - DNA, 19 bp, Homo sapiens
gggagcaggaaagctgtgg

SEQ ID NO: 8483691 - DNA, 22 bp, Homo sapiens
gggagcagcctgcctcccacct

SEQ ID NO: 8483692 - DNA, 22 bp, Homo sapiens
gggagcagcctgcctcccacct

SEQ ID NO: 8483693 - DNA, 22 bp, Homo sapiens
gggagcagcctgcctcccacct

SEQ ID NO: 8483694 - DNA, 22 bp, Homo sapiens
gggagcagcctgcctcccacct

SEQ ID NO: 8483695 - DNA, 22 bp, Homo sapiens
gggagcactgagaggcaggtag

SEQ ID NO: 8483696 - DNA, 22 bp, Homo sapiens
gggagcactgagaggcaggtag

SEQ ID NO: 8483697 - DNA, 22 bp, Homo sapiens
cagacaggctagccagactcac

SEQ ID NO: 8483698 - DNA, 22 bp, Homo sapiens
cagacaggcaggtgagagctcc

SEQ ID NO: 8483699 - DNA, 22 bp, Homo sapiens
cagacaggagactggatcatgg

SEQ ID NO: 8483700 - DNA, 22 bp, Homo sapiens
cagacaggaattctggcgtggt

SEQ ID NO: 8483701 - DNA, 22 bp, Homo sapiens
cagacaggcaggtgagagctcc

SEQ ID NO: 8483702 - DNA, 22 bp, Homo sapiens
cagacaggagactggatcatgg

SEQ ID NO: 8483703 - DNA, 22 bp, Homo sapiens
cagacaggaattctggcgtggt

SEQ ID NO: 8483704 - DNA, 22 bp, Homo sapiens
cagacagaaggctccttgaggt

SEQ ID NO: 8483705 - DNA, 22 bp, Homo sapiens
cagacagaaggctccttgaggt

SEQ ID NO: 8483706 - DNA, 22 bp, Homo sapiens
cagaataaaaactcctatgtct

SEQ ID NO: 8483707 - DNA, 22 bp, Homo sapiens
cagaagtgaatgtgataaacca

SEQ ID NO: 8483708 - DNA, 22 bp, Homo sapiens
gggactgtaaattcatatggcc

SEQ ID NO: 8483709 - DNA, 22 bp, Homo sapiens
gggactgggagatcctcctggc

SEQ ID NO: 8483710 - DNA, 22 bp, Homo sapiens
cagaagtggcctcagagggagt

SEQ ID NO: 8483711 - DNA, 22 bp, Homo sapiens
cagaagtggcctcagagggagt

SEQ ID NO: 8483712 - DNA, 22 bp, Homo sapiens
cagaagtgcaatttaaattagg

SEQ ID NO: 8483713 - DNA, 22 bp, Homo sapiens
cagaagtgatgttgagctagtc

SEQ ID NO: 8483714 - DNA, 22 bp, Homo sapiens
cagaagtggcatcattcaagag

SEQ ID NO: 8483715 - DNA, 22 bp, Homo sapiens
ggtgtgcctggggcttagctgc

SEQ ID NO: 8483716 - DNA, 22 bp, Homo sapiens
cagcaatggcaggcggagagtg

SEQ ID NO: 8483717 - DNA, 22 bp, Homo sapiens
cagcaaggtctgtcaatagtgg

SEQ ID NO: 8483718 - DNA, 22 bp, Homo sapiens
cagcaaggtctgtcaatagtgg

SEQ ID NO: 8483719 - DNA, 22 bp, Homo sapiens
cagcaataactcaaagccattt

SEQ ID NO: 8483720 - DNA, 22 bp, Homo sapiens
ggttccccaggcggcccttgga

SEQ ID NO: 8483721 - DNA, 22 bp, Homo sapiens
ggttccccaggcggcccttgga

SEQ ID NO: 8483722 - DNA, 22 bp, Homo sapiens
ggttccccaggcggcccttgga

SEQ ID NO: 8483723 - DNA, 22 bp, Homo sapiens
ggttcccggatctccgagtccc

SEQ ID NO: 8483724 - DNA, 22 bp, Homo sapiens
ggttccagagtatttcatttca

SEQ ID NO: 8483725 - DNA, 23 bp, Homo sapiens
ggttccaggaacacagcctgatg

SEQ ID NO: 8483726 - DNA, 23 bp, Homo sapiens
ggttcctgagcagggatctggaa

SEQ ID NO: 8483727 - DNA, 22 bp, Homo sapiens
ggttccccaggcggcccttgga

SEQ ID NO: 8483728 - DNA, 22 bp, Homo sapiens
ggttcccggatctccgagtccc

SEQ ID NO: 8483729 - DNA, 22 bp, Homo sapiens
ggttctgaagtggtcccattcc

SEQ ID NO: 8483730 - DNA, 22 bp, Homo sapiens
ggttgacagaagaaggatgaca

SEQ ID NO: 8483731 - DNA, 22 bp, Homo sapiens
ggttggacactaggtaggagcg

SEQ ID NO: 8483732 - DNA, 22 bp, Homo sapiens
ggttggacactaggtaggagcg

SEQ ID NO: 8483733 - DNA, 22 bp, Homo sapiens
ggttgccggggcaggactggaa

SEQ ID NO: 8483734 - DNA, 22 bp, Homo sapiens
ggttgcaaactcctgggatcaa

SEQ ID NO: 8483735 - DNA, 20 bp, Homo sapiens
gtaaaatatggtctttgggt

SEQ ID NO: 8483736 - DNA, 19 bp, Homo sapiens
ggttggagaagagcggccc

SEQ ID NO: 8483737 - DNA, 19 bp, Homo sapiens
ggttggagaagagcggccc

SEQ ID NO: 8483738 - DNA, 20 bp, Homo sapiens
gtaaaatatggtctttgggt

SEQ ID NO: 8483739 - DNA, 22 bp, Homo sapiens
gtaaaattgcaattacttttgc

SEQ ID NO: 8483740 - DNA, 22 bp, Homo sapiens
gtaaaattgcaattacttttgc

SEQ ID NO: 8483741 - DNA, 22 bp, Homo sapiens
gtaaaattctagcatctgaaag

SEQ ID NO: 8483742 - DNA, 22 bp, Homo sapiens
gtaaaattctagcatctgaaag

SEQ ID NO: 8483743 - DNA, 22 bp, Homo sapiens
gtaaacacctgttaaattcaga

SEQ ID NO: 8483744 - DNA, 22 bp, Homo sapiens
gtaaacacctgttaaattcaga

SEQ ID NO: 8483745 - DNA, 22 bp, Homo sapiens
gtaaacacctgttaaattcaga

SEQ ID NO: 8483746 - DNA, 22 bp, Homo sapiens
ggtgggggagacttggtcaaga

SEQ ID NO: 8483747 - DNA, 21 bp, Homo sapiens
ggtggggtacctaaggtagct

SEQ ID NO: 8483748 - DNA, 22 bp, Homo sapiens
ggtgggggagacttggtcaaga

SEQ ID NO: 8483749 - DNA, 22 bp, Homo sapiens
ggtggggctgcaagcagttcgg

SEQ ID NO: 8483750 - DNA, 22 bp, Homo sapiens
ggtggggttttaggctgctgca

SEQ ID NO: 8483751 - DNA, 22 bp, Homo sapiens
ggtgggtatagttagggcctct

SEQ ID NO: 8483752 - DNA, 22 bp, Homo sapiens
ggtgggtatagttagggcctct

SEQ ID NO: 8483753 - DNA, 22 bp, Homo sapiens
ggtggggtcacgacagagggaa

SEQ ID NO: 8483754 - DNA, 22 bp, Homo sapiens
ggtggggtcacgacagagggaa

SEQ ID NO: 8483755 - DNA, 22 bp, Homo sapiens
ggtggggtcacgacagagggaa

SEQ ID NO: 8483756 - DNA, 22 bp, Homo sapiens
cagcaaggccattggatgcagt

SEQ ID NO: 8483757 - DNA, 22 bp, Homo sapiens
cagcaaggccattggatgcagt

SEQ ID NO: 8483758 - DNA, 22 bp, Homo sapiens
cagcaaggccattggatgcagt

SEQ ID NO: 8483759 - DNA, 22 bp, Homo sapiens
cagcaagggataaacaaggacg

SEQ ID NO: 8483760 - DNA, 22 bp, Homo sapiens
cagcaagggttatatcaaagat

SEQ ID NO: 8483761 - DNA, 22 bp, Homo sapiens
cagcaagggataaagagttact

SEQ ID NO: 8483762 - DNA, 22 bp, Homo sapiens
ggtgggtattgaatacaggtgt

SEQ ID NO: 8483763 - DNA, 22 bp, Homo sapiens
ggtgggtattgaatacaggtgt

SEQ ID NO: 8483764 - DNA, 22 bp, Homo sapiens
ggtgggtgaaatctaggtgtgt

SEQ ID NO: 8483765 - DNA, 22 bp, Homo sapiens
cagcaaggcattctgtggatta

SEQ ID NO: 8483766 - DNA, 22 bp, Homo sapiens
ggtggggctaggacctcaggat

SEQ ID NO: 8483767 - DNA, 22 bp, Homo sapiens
ggtggggctaggacctcaggat

SEQ ID NO: 8483768 - DNA, 22 bp, Homo sapiens
ggtggggctaggacctcaggat

SEQ ID NO: 8483769 - DNA, 22 bp, Homo sapiens
gggtgggagtctggccctcaaa

SEQ ID NO: 8483770 - DNA, 22 bp, Homo sapiens
gggtgggagtctggccctcaaa

SEQ ID NO: 8483771 - DNA, 22 bp, Homo sapiens
gggtgggagtctggccctcaaa

SEQ ID NO: 8483772 - DNA, 20 bp, Homo sapiens
gggtgggagagtctgagggt

SEQ ID NO: 8483773 - DNA, 20 bp, Homo sapiens
gggtgggagagtctgagggt

SEQ ID NO: 8483774 - DNA, 20 bp, Homo sapiens
gggtgggagagtctgagggt

SEQ ID NO: 8483775 - DNA, 21 bp, Homo sapiens
gggtgggaggacacagcaggc

SEQ ID NO: 8483776 - DNA, 21 bp, Homo sapiens
gggtgggaggacacagcaggc

SEQ ID NO: 8483777 - DNA, 21 bp, Homo sapiens
gggtgggaggacacagcaggc

SEQ ID NO: 8483778 - DNA, 21 bp, Homo sapiens
gggtgggaggacacagcaggc

SEQ ID NO: 8483779 - DNA, 21 bp, Homo sapiens
gggtgggaggacacagcaggc

SEQ ID NO: 8483780 - DNA, 19 bp, Homo sapiens
cagagtacaccagatagga

SEQ ID NO: 8483781 - DNA, 22 bp, Homo sapiens
cagagtactgggagaacagaag

SEQ ID NO: 8483782 - DNA, 22 bp, Homo sapiens
gggtgggaaggctaagggattg

SEQ ID NO: 8483783 - DNA, 22 bp, Homo sapiens
cagagtcagagctccatggagt

SEQ ID NO: 8483784 - DNA, 22 bp, Homo sapiens
cagagtcagagctccatggagt

SEQ ID NO: 8483785 - DNA, 22 bp, Homo sapiens
cagagtcagagcacctgggatt

SEQ ID NO: 8483786 - DNA, 22 bp, Homo sapiens
cagagtcagagcacctgggatt

SEQ ID NO: 8483787 - DNA, 22 bp, Homo sapiens
cagagtatccctttagaattaa

SEQ ID NO: 8483788 - DNA, 22 bp, Homo sapiens
gggtgggactgaagtctgaggg

SEQ ID NO: 8483789 - DNA, 22 bp, Homo sapiens
gggtgggagaaatgagtatcta

SEQ ID NO: 8483790 - DNA, 22 bp, Homo sapiens
gggtgggaaggctaagggattg

SEQ ID NO: 8483791 - DNA, 22 bp, Homo sapiens
gggtgggaaggctaagggattg

SEQ ID NO: 8483792 - DNA, 22 bp, Homo sapiens
gggtgggactctttggcctgag

SEQ ID NO: 8483793 - DNA, 22 bp, Homo sapiens
gggtgggactctttggcctgag

SEQ ID NO: 8483794 - DNA, 22 bp, Homo sapiens
gggtgggactctttggcctgag

SEQ ID NO: 8483795 - DNA, 22 bp, Homo sapiens
cagcagcaaatctagaagagga

SEQ ID NO: 8483796 - DNA, 22 bp, Homo sapiens
cagcagcaaatctagaagagga

SEQ ID NO: 8483797 - DNA, 22 bp, Homo sapiens
cagcagcaaatctagaagagga

SEQ ID NO: 8483798 - DNA, 22 bp, Homo sapiens
cagcagcaaatctagaagagga

SEQ ID NO: 8483799 - DNA, 22 bp, Homo sapiens
cagcagatcaatgtagaatatt

SEQ ID NO: 8483800 - DNA, 22 bp, Homo sapiens
cagcagatcaatgtagaatatt

SEQ ID NO: 8483801 - DNA, 22 bp, Homo sapiens
cagcagcaaatctagaagagga

SEQ ID NO: 8483802 - DNA, 22 bp, Homo sapiens
cagcagatttgggaaacactgt

SEQ ID NO: 8483803 - DNA, 22 bp, Homo sapiens
cagcagcaacaacggaagcctt

SEQ ID NO: 8483804 - DNA, 22 bp, Homo sapiens
cagcagcaacaacggaagcctt

SEQ ID NO: 8483805 - DNA, 22 bp, Homo sapiens
cagcagcaacaacggaagcctt

SEQ ID NO: 8483806 - DNA, 22 bp, Homo sapiens
cagcagcaacaacggaagcctt

SEQ ID NO: 8483807 - DNA, 22 bp, Homo sapiens
cagcagcaacaacggaagcctt

SEQ ID NO: 8483808 - DNA, 22 bp, Homo sapiens
cagcagcaaggtgagggtggag

SEQ ID NO: 8483809 - DNA, 22 bp, Homo sapiens
cagcagcaacaatagcggtcac

SEQ ID NO: 8483810 - DNA, 22 bp, Homo sapiens
cagcagagtaggtgctacttct

SEQ ID NO: 8483811 - DNA, 22 bp, Homo sapiens
cagcagagtttggcttctaatg

SEQ ID NO: 8483812 - DNA, 22 bp, Homo sapiens
cagcagagctgtgtgggaaggg

SEQ ID NO: 8483813 - DNA, 22 bp, Homo sapiens
cagcagagtaattctcacctct

SEQ ID NO: 8483814 - DNA, 22 bp, Homo sapiens
gtatctgtggattttggtatcc

SEQ ID NO: 8483815 - DNA, 22 bp, Homo sapiens
gtatctttatccctcgttggag

SEQ ID NO: 8483816 - DNA, 22 bp, Homo sapiens
gtatcacttttgagagtgagaa

SEQ ID NO: 8483817 - DNA, 22 bp, Homo sapiens
gtatcctttgcggaaatttcta

SEQ ID NO: 8483818 - DNA, 19 bp, Homo sapiens
gtatatttatatggctgta

SEQ ID NO: 8483819 - DNA, 22 bp, Homo sapiens
gtatattttgatcaccctctat

SEQ ID NO: 8483820 - DNA, 22 bp, Homo sapiens
gtagggcaacatgggcactagg

SEQ ID NO: 8483821 - DNA, 22 bp, Homo sapiens
cagcagcagagatactggtttc

SEQ ID NO: 8483822 - DNA, 22 bp, Homo sapiens
cagcagcagagatactggtttc

SEQ ID NO: 8483823 - DNA, 22 bp, Homo sapiens
cagcagcagattcagcgtctgg

SEQ ID NO: 8483824 - DNA, 22 bp, Homo sapiens
cagcagcaaggtgagggtggag

SEQ ID NO: 8483825 - DNA, 22 bp, Homo sapiens
cagcagcactctgcgggtcccc

SEQ ID NO: 8483826 - DNA, 22 bp, Homo sapiens
cagcaggcccaggtgctggtga

SEQ ID NO: 8483827 - DNA, 22 bp, Homo sapiens
gtatttctagaaaatgcagatt

SEQ ID NO: 8483828 - DNA, 22 bp, Homo sapiens
gtatttctagaatggtagcact

SEQ ID NO: 8483829 - DNA, 22 bp, Homo sapiens
gtatttctggttaaatgtgcta

SEQ ID NO: 8483830 - DNA, 22 bp, Homo sapiens
gtatttctggtaactgctgcta

SEQ ID NO: 8483831 - DNA, 22 bp, Homo sapiens
gtatttctttatctggtcagaa

SEQ ID NO: 8483832 - DNA, 22 bp, Homo sapiens
cagcaggcagccatttcactgt

SEQ ID NO: 8483833 - DNA, 22 bp, Homo sapiens
cagcaggccatgctgcttttca

SEQ ID NO: 8483834 - DNA, 22 bp, Homo sapiens
cagcaggcccagagtttcatgg

SEQ ID NO: 8483835 - DNA, 22 bp, Homo sapiens
cagcaggcaggtgggccaagtc

SEQ ID NO: 8483836 - DNA, 22 bp, Homo sapiens
cagcaggcaggtgggccaagtc

SEQ ID NO: 8483837 - DNA, 22 bp, Homo sapiens
cagcagcctggcccctcctcgg

SEQ ID NO: 8483838 - DNA, 22 bp, Homo sapiens
cagcagcctggagggggccacg

SEQ ID NO: 8483839 - DNA, 22 bp, Homo sapiens
cagcagcctggagggggccacg

SEQ ID NO: 8483840 - DNA, 22 bp, Homo sapiens
cagcagctacttggagcagcag

SEQ ID NO: 8483841 - DNA, 22 bp, Homo sapiens
gtatgcatgcatgtgtatgtac

SEQ ID NO: 8483842 - DNA, 22 bp, Homo sapiens
gtatgcttattccttgttgtga

SEQ ID NO: 8483843 - DNA, 22 bp, Homo sapiens
gtatgctgcctacgaacatgca

SEQ ID NO: 8483844 - DNA, 22 bp, Homo sapiens
cagcagcctcaagtttattttc

SEQ ID NO: 8483845 - DNA, 22 bp, Homo sapiens
gtatcttttggtggaaaaataa

SEQ ID NO: 8483846 - DNA, 22 bp, Homo sapiens
gtatcttttacaccaggaaatt

SEQ ID NO: 8483847 - DNA, 22 bp, Homo sapiens
gtatctttccacatcttcagta

SEQ ID NO: 8483848 - DNA, 22 bp, Homo sapiens
gtatctttcccaccaatcacaa

SEQ ID NO: 8483849 - DNA, 22 bp, Homo sapiens
gtatctttgtcttcatgttgga

SEQ ID NO: 8483850 - DNA, 22 bp, Homo sapiens
gtatgaaaattgtaaagttctt

SEQ ID NO: 8483851 - DNA, 22 bp, Homo sapiens
gtatgaaagcatcattcctgct

SEQ ID NO: 8483852 - DNA, 22 bp, Homo sapiens
cagcccagcagtcttagcctgc

SEQ ID NO: 8483853 - DNA, 22 bp, Homo sapiens
cagcccagcagtcttagcctgc

SEQ ID NO: 8483854 - DNA, 21 bp, Homo sapiens
cagcccagcccattgacagtg

SEQ ID NO: 8483855 - DNA, 22 bp, Homo sapiens
cagcccagcagggtctggccct

SEQ ID NO: 8483856 - DNA, 22 bp, Homo sapiens
cagcccagcagggtctggccct

SEQ ID NO: 8483857 - DNA, 22 bp, Homo sapiens
cagcccagcagggtctggccct

SEQ ID NO: 8483858 - DNA, 22 bp, Homo sapiens
cagcccagcactaagtagattt

SEQ ID NO: 8483859 - DNA, 22 bp, Homo sapiens
cagcccagcactaagtagattt

SEQ ID NO: 8483860 - DNA, 22 bp, Homo sapiens
cagcccagcactaagtagattt

SEQ ID NO: 8483861 - DNA, 22 bp, Homo sapiens
cagcccagcactaagtagattt

SEQ ID NO: 8483862 - DNA, 22 bp, Homo sapiens
cagcccagagccagttcccgct

SEQ ID NO: 8483863 - DNA, 22 bp, Homo sapiens
cagcccagagccagttcccgct

SEQ ID NO: 8483864 - DNA, 21 bp, Homo sapiens
cagcccagcccattgacagtg

SEQ ID NO: 8483865 - DNA, 21 bp, Homo sapiens
cagcccagcccattgacagtg

SEQ ID NO: 8483866 - DNA, 22 bp, Homo sapiens
cagcatttggtgatcatcttaa

SEQ ID NO: 8483867 - DNA, 22 bp, Homo sapiens
cagcatttggtgatcatcttaa

SEQ ID NO: 8483868 - DNA, 22 bp, Homo sapiens
cagcatttagaatttgaagtgt

SEQ ID NO: 8483869 - DNA, 22 bp, Homo sapiens
cagcattctactttgtgaactg

SEQ ID NO: 8483870 - DNA, 22 bp, Homo sapiens
cagcattgatcccaggctgtgg

SEQ ID NO: 8483871 - DNA, 22 bp, Homo sapiens
cagcattgatcccaggctgtgg

SEQ ID NO: 8483872 - DNA, 22 bp, Homo sapiens
cagcattgtaagaatgaagacc

SEQ ID NO: 8483873 - DNA, 22 bp, Homo sapiens
cagcattgtaagaatgaagacc

SEQ ID NO: 8483874 - DNA, 22 bp, Homo sapiens
cagcatttagaatttgaagtgt

SEQ ID NO: 8483875 - DNA, 22 bp, Homo sapiens
gtattttactgctcaaagctct

SEQ ID NO: 8483876 - DNA, 22 bp, Homo sapiens
gtattttaagtgactactaggt

SEQ ID NO: 8483877 - DNA, 22 bp, Homo sapiens
gtattttactgctcaaagctct

SEQ ID NO: 8483878 - DNA, 22 bp, Homo sapiens
gtattttactgctcaaagctct

SEQ ID NO: 8483879 - DNA, 22 bp, Homo sapiens
gtattttactgctcaaagctct

SEQ ID NO: 8483880 - DNA, 22 bp, Homo sapiens
gtattttaagtgactactaggt

SEQ ID NO: 8483881 - DNA, 22 bp, Homo sapiens
gtattttaagtgactactaggt

SEQ ID NO: 8483882 - DNA, 22 bp, Homo sapiens
gtatttgtcttgttggtctcca

SEQ ID NO: 8483883 - DNA, 22 bp, Homo sapiens
gtatttgtagtagcatagaatt

SEQ ID NO: 8483884 - DNA, 22 bp, Homo sapiens
gtatttgtagtagcatagaatt

SEQ ID NO: 8483885 - DNA, 22 bp, Homo sapiens
gtatttggtgatgcctccaaac

SEQ ID NO: 8483886 - DNA, 22 bp, Homo sapiens
gtatttgtagtagcatagaatt

SEQ ID NO: 8483887 - DNA, 22 bp, Homo sapiens
gtatttggtctatttggcatcc

SEQ ID NO: 8483888 - DNA, 22 bp, Homo sapiens
gtatttgatagatttcaaagga

SEQ ID NO: 8483889 - DNA, 22 bp, Homo sapiens
gtatttgatacatgaaatggtg

SEQ ID NO: 8483890 - DNA, 22 bp, Homo sapiens
gtatttgcaaatctaaaagaga

SEQ ID NO: 8483891 - DNA, 22 bp, Homo sapiens
gtatttggaaaccaccagtgcc

SEQ ID NO: 8483892 - DNA, 22 bp, Homo sapiens
cagccactacaattggttccat

SEQ ID NO: 8483893 - DNA, 22 bp, Homo sapiens
cagccacagctgggtgcctgac

SEQ ID NO: 8483894 - DNA, 22 bp, Homo sapiens
cagccacagctgggtgcctgac

SEQ ID NO: 8483895 - DNA, 22 bp, Homo sapiens
cagccaccatacagcagaagct

SEQ ID NO: 8483896 - DNA, 22 bp, Homo sapiens
cagccaccatacagcagaagct

SEQ ID NO: 8483897 - DNA, 22 bp, Homo sapiens
cagccactgaactcctggctat

SEQ ID NO: 8483898 - DNA, 22 bp, Homo sapiens
cagccactctcagacagtccca

SEQ ID NO: 8483899 - DNA, 22 bp, Homo sapiens
cagccaagaaccacagacccag

SEQ ID NO: 8483900 - DNA, 21 bp, Homo sapiens
cagcccagagcagtggggcca

SEQ ID NO: 8483901 - DNA, 22 bp, Homo sapiens
cagccaggttcaagtccttata

SEQ ID NO: 8483902 - DNA, 22 bp, Homo sapiens
cagccacttgtgatgctgggga

SEQ ID NO: 8483903 - DNA, 22 bp, Homo sapiens
cagccactgtggtctagctgca

SEQ ID NO: 8483904 - DNA, 22 bp, Homo sapiens
cagccactgtggtctagctgca

SEQ ID NO: 8483905 - DNA, 22 bp, Homo sapiens
cagccacttcgagcttcctgat

SEQ ID NO: 8483906 - DNA, 22 bp, Homo sapiens
cagccactggtgccaggctgtt

SEQ ID NO: 8483907 - DNA, 22 bp, Homo sapiens
gcttgggatatgctgatgtaaa

SEQ ID NO: 8483908 - DNA, 17 bp, Homo sapiens
gcttgggctgcctgttg

SEQ ID NO: 8483909 - DNA, 22 bp, Homo sapiens
caatttctcgaactctaatcca

SEQ ID NO: 8483910 - DNA, 22 bp, Homo sapiens
cacaaaagtaggaggcaggcgg

SEQ ID NO: 8483911 - DNA, 22 bp, Homo sapiens
caatttctctttatatctcaca

SEQ ID NO: 8483912 - DNA, 22 bp, Homo sapiens
gcttggctgtgagctttgctgt

SEQ ID NO: 8483913 - DNA, 22 bp, Homo sapiens
gcttggctgtgagctttgctgt

SEQ ID NO: 8483914 - DNA, 22 bp, Homo sapiens
gcttggctttgtcttgttcact

SEQ ID NO: 8483915 - DNA, 22 bp, Homo sapiens
gcttgggagaggcttcctcttt

SEQ ID NO: 8483916 - DNA, 22 bp, Homo sapiens
gcttgggagaggcttcctcttt

SEQ ID NO: 8483917 - DNA, 22 bp, Homo sapiens
gcttggccagcagccgggatgc

SEQ ID NO: 8483918 - DNA, 22 bp, Homo sapiens
gcttggccagcagccgggatgc

SEQ ID NO: 8483919 - DNA, 20 bp, Homo sapiens
gcttggcataggccacttga

SEQ ID NO: 8483920 - DNA, 22 bp, Homo sapiens
gcttggcattgaccattatcat

SEQ ID NO: 8483921 - DNA, 22 bp, Homo sapiens
gcttctcttgtccaagggcagg

SEQ ID NO: 8483922 - DNA, 22 bp, Homo sapiens
gcttctctttctcccctggcgg

SEQ ID NO: 8483923 - DNA, 22 bp, Homo sapiens
gcttctcttgtccaagggcagg

SEQ ID NO: 8483924 - DNA, 22 bp, Homo sapiens
gcttctcttcgcctaggtcctt

SEQ ID NO: 8483925 - DNA, 22 bp, Homo sapiens
gcttctcttaatgcctggcttt

SEQ ID NO: 8483926 - DNA, 22 bp, Homo sapiens
gcttctctttctcccctggcgg

SEQ ID NO: 8483927 - DNA, 22 bp, Homo sapiens
gcttctcctcccgctcccaggc

SEQ ID NO: 8483928 - DNA, 22 bp, Homo sapiens
gcttctctcaggagcatcagcc

SEQ ID NO: 8483929 - DNA, 22 bp, Homo sapiens
gcttctcgggcctgatgtcgtc

SEQ ID NO: 8483930 - DNA, 22 bp, Homo sapiens
gcttctcctcccgctcccaggc

SEQ ID NO: 8483931 - DNA, 22 bp, Homo sapiens
gcttctccctacagatgtcagt

SEQ ID NO: 8483932 - DNA, 22 bp, Homo sapiens
gcttctccctacagatgtcagt

SEQ ID NO: 8483933 - DNA, 15 bp, Homo sapiens
gcttctccagatgac

SEQ ID NO: 8483934 - DNA, 22 bp, Homo sapiens
gcttctccagaccttcatcccc

SEQ ID NO: 8483935 - DNA, 22 bp, Homo sapiens
gcttctccagaccttcatcccc

SEQ ID NO: 8483936 - DNA, 22 bp, Homo sapiens
gcttctctggctggtctgccac

SEQ ID NO: 8483937 - DNA, 22 bp, Homo sapiens
gcttctctggctggtctgccac

SEQ ID NO: 8483938 - DNA, 22 bp, Homo sapiens
gcttctctctcagactgcaagc

SEQ ID NO: 8483939 - DNA, 22 bp, Homo sapiens
gcttctctcaggagcatcagcc

SEQ ID NO: 8483940 - DNA, 22 bp, Homo sapiens
gcttctctggctggtctgccac

SEQ ID NO: 8483941 - DNA, 22 bp, Homo sapiens
gcttctctggctggtctgccac

SEQ ID NO: 8483942 - DNA, 22 bp, Homo sapiens
gcttctcttaatgcctggcttt

SEQ ID NO: 8483943 - DNA, 22 bp, Homo sapiens
gcttctcatgtttatttttaca

SEQ ID NO: 8483944 - DNA, 18 bp, Homo sapiens
gcttctcatttctaagca

SEQ ID NO: 8483945 - DNA, 22 bp, Homo sapiens
gcttccaggtcattctcaccct

SEQ ID NO: 8483946 - DNA, 20 bp, Homo sapiens
gcttctcagggcttctctga

SEQ ID NO: 8483947 - DNA, 22 bp, Homo sapiens
gctgtggcctagtttgttatat

SEQ ID NO: 8483948 - DNA, 22 bp, Homo sapiens
gctgtggcctccagcactcccc

SEQ ID NO: 8483949 - DNA, 22 bp, Homo sapiens
gctgtggccgtcagggaaatgg

SEQ ID NO: 8483950 - DNA, 22 bp, Homo sapiens
gctgtggccgggcccaggccgc

SEQ ID NO: 8483951 - DNA, 22 bp, Homo sapiens
gctgtacaaggcctctgccatc

SEQ ID NO: 8483952 - DNA, 22 bp, Homo sapiens
gctgtacaaattccacaagaga

SEQ ID NO: 8483953 - DNA, 21 bp, Homo sapiens
gctgtctcctccttgcaccag

SEQ ID NO: 8483954 - DNA, 22 bp, Homo sapiens
gctgtctccatagctgtgtgtc

SEQ ID NO: 8483955 - DNA, 22 bp, Homo sapiens
gctgtctccatagctgtgtgtc

SEQ ID NO: 8483956 - DNA, 22 bp, Homo sapiens
caaggcagcgttcctttctgga

SEQ ID NO: 8483957 - DNA, 22 bp, Homo sapiens
caaggcagctgtagggatttgg

SEQ ID NO: 8483958 - DNA, 20 bp, Homo sapiens
caaggcagaccagagtgagt

SEQ ID NO: 8483959 - DNA, 22 bp, Homo sapiens
caaggcagaattcagactcagg

SEQ ID NO: 8483960 - DNA, 22 bp, Homo sapiens
caaggattctcactagactaga

SEQ ID NO: 8483961 - DNA, 22 bp, Homo sapiens
gctgtgcttgggaagaatctct

SEQ ID NO: 8483962 - DNA, 22 bp, Homo sapiens
gctgtgcttgcatgagtgtctg

SEQ ID NO: 8483963 - DNA, 22 bp, Homo sapiens
gctgtggaaatgcctaacatga

SEQ ID NO: 8483964 - DNA, 22 bp, Homo sapiens
gctgtgctggaaggggacctgc

SEQ ID NO: 8483965 - DNA, 22 bp, Homo sapiens
gctgtctgccgcaggctgccac

SEQ ID NO: 8483966 - DNA, 22 bp, Homo sapiens
gctgtgctgattcattccctgc

SEQ ID NO: 8483967 - DNA, 22 bp, Homo sapiens
gctgtggagtacagagctggtt

SEQ ID NO: 8483968 - DNA, 22 bp, Homo sapiens
gctgtggatgctatggatcatc

SEQ ID NO: 8483969 - DNA, 20 bp, Homo sapiens
gctgtggcaaagctttgtgt

SEQ ID NO: 8483970 - DNA, 20 bp, Homo sapiens
gctgtggcaagtgctcactg

SEQ ID NO: 8483971 - DNA, 22 bp, Homo sapiens
gctgtggcaatgtttataatta

SEQ ID NO: 8483972 - DNA, 20 bp, Homo sapiens
gctgtggcaaagctttgtgt

SEQ ID NO: 8483973 - DNA, 22 bp, Homo sapiens
gctgtctgccgcaggctgccac

SEQ ID NO: 8483974 - DNA, 22 bp, Homo sapiens
gctgtctgcatctctagagctt

SEQ ID NO: 8483975 - DNA, 22 bp, Homo sapiens
gctgtctgcatctctagagctt

SEQ ID NO: 8483976 - DNA, 22 bp, Homo sapiens
gctgtctgcaagccaggaaatg

SEQ ID NO: 8483977 - DNA, 22 bp, Homo sapiens
gctgtctgcaagccaggaaatg

SEQ ID NO: 8483978 - DNA, 19 bp, Homo sapiens
gctgtctgatgctgaggtc

SEQ ID NO: 8483979 - DNA, 19 bp, Homo sapiens
gctgtctgatgctgaggtc

SEQ ID NO: 8483980 - DNA, 19 bp, Homo sapiens
gctgtctgatgctgaggtc

SEQ ID NO: 8483981 - DNA, 19 bp, Homo sapiens
gctgtctgatgctgaggtc

SEQ ID NO: 8483982 - DNA, 18 bp, Homo sapiens
gctgtctgaggtctgagg

SEQ ID NO: 8483983 - DNA, 22 bp, Homo sapiens
gctgtctcgcctgacactggct

SEQ ID NO: 8483984 - DNA, 22 bp, Homo sapiens
gctgtctcggggctttctcctg

SEQ ID NO: 8483985 - DNA, 21 bp, Homo sapiens
gctgtctctggctcctgggaa

SEQ ID NO: 8483986 - DNA, 21 bp, Homo sapiens
gctgtctctggctcctgggaa

SEQ ID NO: 8483987 - DNA, 22 bp, Homo sapiens
gctgtctgactccaagttggag

SEQ ID NO: 8483988 - DNA, 22 bp, Homo sapiens
gctgtctgagaacatggtggaa

SEQ ID NO: 8483989 - DNA, 18 bp, Homo sapiens
gctgtctgaggtctgagg

SEQ ID NO: 8483990 - DNA, 22 bp, Homo sapiens
gctgtctgagaacatggtggaa

SEQ ID NO: 8483991 - DNA, 22 bp, Homo sapiens
gctgtctgagaacatggtggaa

SEQ ID NO: 8483992 - DNA, 22 bp, Homo sapiens
gctgtctgactccaagttggag

SEQ ID NO: 8483993 - DNA, 22 bp, Homo sapiens
cacaaaatctttctcgattatt

SEQ ID NO: 8483994 - DNA, 22 bp, Homo sapiens
cacaaaatctttctcgattatt

SEQ ID NO: 8483995 - DNA, 22 bp, Homo sapiens
cacaaaatatcaagcactttta

SEQ ID NO: 8483996 - DNA, 23 bp, Homo sapiens
cacaaaggttccattctctcacc

SEQ ID NO: 8483997 - DNA, 22 bp, Homo sapiens
cacaaaggagaatgtcagcata

SEQ ID NO: 8483998 - DNA, 22 bp, Homo sapiens
ggaaaagaaagggactgattgg

SEQ ID NO: 8483999 - DNA, 17 bp, Homo sapiens
ggaaaagaagagtagga

SEQ ID NO: 8484000 - DNA, 17 bp, Homo sapiens
ggaaaagaagagtagga

SEQ ID NO: 8484001 - DNA, 22 bp, Homo sapiens
ggaaaagaattgcagtgaagta

SEQ ID NO: 8484002 - DNA, 22 bp, Homo sapiens
cacaaagttggacaacgcaccc

SEQ ID NO: 8484003 - DNA, 22 bp, Homo sapiens
ggaaaactgtatttgaataact

SEQ ID NO: 8484004 - DNA, 22 bp, Homo sapiens
cacaaagtataacttgatggaa

SEQ ID NO: 8484005 - DNA, 22 bp, Homo sapiens
cacaaagtctgcagctgctgta

SEQ ID NO: 8484006 - DNA, 22 bp, Homo sapiens
cacaaagtgggtggaaaactaa

SEQ ID NO: 8484007 - DNA, 22 bp, Homo sapiens
cacaatgatttggttcaaaaat

SEQ ID NO: 8484008 - DNA, 22 bp, Homo sapiens
cacaatgatttggttcaaaaat

SEQ ID NO: 8484009 - DNA, 22 bp, Homo sapiens
cacaatgcagcatgtaaatgca

SEQ ID NO: 8484010 - DNA, 22 bp, Homo sapiens
cacaatgatttggttcaaaaat

SEQ ID NO: 8484011 - DNA, 22 bp, Homo sapiens
cacaataaatgtttgctgatga

SEQ ID NO: 8484012 - DNA, 18 bp, Homo sapiens
cacaatagacaccgataa

SEQ ID NO: 8484013 - DNA, 22 bp, Homo sapiens
cacaataaatgtttgctgatga

SEQ ID NO: 8484014 - DNA, 22 bp, Homo sapiens
cacaagtctgtggtctccaaca

SEQ ID NO: 8484015 - DNA, 22 bp, Homo sapiens
cacaattacttttgcaccaaca

SEQ ID NO: 8484016 - DNA, 22 bp, Homo sapiens
cacaatgtatatgtatatcaaa

SEQ ID NO: 8484017 - DNA, 22 bp, Homo sapiens
cacaatgtctggtaggccactt

SEQ ID NO: 8484018 - DNA, 22 bp, Homo sapiens
cacaatgcgtacatatatcaaa

SEQ ID NO: 8484019 - DNA, 22 bp, Homo sapiens
cacaatgcgtacatatatcaaa

SEQ ID NO: 8484020 - DNA, 22 bp, Homo sapiens
cacaatgcagcatgtaaatgca

SEQ ID NO: 8484021 - DNA, 22 bp, Homo sapiens
ggaaaatactgattcatgccat

SEQ ID NO: 8484022 - DNA, 22 bp, Homo sapiens
ggaaaatactgattcatgccat

SEQ ID NO: 8484023 - DNA, 19 bp, Homo sapiens
cacaacttcgcttgattcc

SEQ ID NO: 8484024 - DNA, 22 bp, Homo sapiens
cacaactttaggaaccacattc

SEQ ID NO: 8484025 - DNA, 22 bp, Homo sapiens
cacacatttcagatgctacaat

SEQ ID NO: 8484026 - DNA, 22 bp, Homo sapiens
cacacatttcagatgctacaat

SEQ ID NO: 8484027 - DNA, 21 bp, Homo sapiens
cacaccaaacaggaacaggga

SEQ ID NO: 8484028 - DNA, 22 bp, Homo sapiens
cacacattgaattcattcttgt

SEQ ID NO: 8484029 - DNA, 22 bp, Homo sapiens
cacacattccaaaatcaagggt

SEQ ID NO: 8484030 - DNA, 21 bp, Homo sapiens
cacaccaggcatgtcttgagc

SEQ ID NO: 8484031 - DNA, 21 bp, Homo sapiens
cacaccaggcatgtcttgagc

SEQ ID NO: 8484032 - DNA, 23 bp, Homo sapiens
cacaccaggagccgtctgggcca

SEQ ID NO: 8484033 - DNA, 23 bp, Homo sapiens
cacaccaggagccgtctgggcca

SEQ ID NO: 8484034 - DNA, 22 bp, Homo sapiens
cacaccagcatggtctcagtgt

SEQ ID NO: 8484035 - DNA, 22 bp, Homo sapiens
cacaccagatggcagcgtggga

SEQ ID NO: 8484036 - DNA, 22 bp, Homo sapiens
cacaccagatggcagcgtggga

SEQ ID NO: 8484037 - DNA, 22 bp, Homo sapiens
cacaccagaggttacctgcaaa

SEQ ID NO: 8484038 - DNA, 22 bp, Homo sapiens
cacaccagaggttacctgcaaa

SEQ ID NO: 8484039 - DNA, 22 bp, Homo sapiens
cacaccagaggttacctgcaaa

SEQ ID NO: 8484040 - DNA, 22 bp, Homo sapiens
cacacctgtaataccagctact

SEQ ID NO: 8484041 - DNA, 22 bp, Homo sapiens
cacactaatttttcaagagttt

SEQ ID NO: 8484042 - DNA, 23 bp, Homo sapiens
cacacctgttaagaagagtgcct

SEQ ID NO: 8484043 - DNA, 22 bp, Homo sapiens
cacacctgtaatcctagcactt

SEQ ID NO: 8484044 - DNA, 22 bp, Homo sapiens
cacacctgtgagtctcggcttg

SEQ ID NO: 8484045 - DNA, 23 bp, Homo sapiens
cacacccatcactaagagctcct

SEQ ID NO: 8484046 - DNA, 23 bp, Homo sapiens
cacacccatcactaagagctcct

SEQ ID NO: 8484047 - DNA, 19 bp, Homo sapiens
cacacccatgcttgccaag

SEQ ID NO: 8484048 - DNA, 22 bp, Homo sapiens
cacaatttccttgcttcacttt

SEQ ID NO: 8484049 - DNA, 22 bp, Homo sapiens
cacaatttggacttcactggtt

SEQ ID NO: 8484050 - DNA, 22 bp, Homo sapiens
cacacattaatatcaaaggctc

SEQ ID NO: 8484051 - DNA, 22 bp, Homo sapiens
cacacatcaacctagacattgt

SEQ ID NO: 8484052 - DNA, 22 bp, Homo sapiens
cacacatcaacctagacattgt

SEQ ID NO: 8484053 - DNA, 22 bp, Homo sapiens
cacacattagagccaatgtcag

SEQ ID NO: 8484054 - DNA, 22 bp, Homo sapiens
cacacagtgggaaaacctgaag

SEQ ID NO: 8484055 - DNA, 22 bp, Homo sapiens
cacacatattgtccctagtgtg

SEQ ID NO: 8484056 - DNA, 22 bp, Homo sapiens
cacacatattgtccctagtgtg

SEQ ID NO: 8484057 - DNA, 18 bp, Homo sapiens
cacaatttacagatgaca

SEQ ID NO: 8484058 - DNA, 18 bp, Homo sapiens
cacaatttacagatgaca

SEQ ID NO: 8484059 - DNA, 22 bp, Homo sapiens
cacaattgtatcagaaaatagt

SEQ ID NO: 8484060 - DNA, 22 bp, Homo sapiens
cacaatttccaagtcatgttat

SEQ ID NO: 8484061 - DNA, 22 bp, Homo sapiens
cacaatttccaagtcatgttat

SEQ ID NO: 8484062 - DNA, 22 bp, Homo sapiens
cacaattatagaagaaagcata

SEQ ID NO: 8484063 - DNA, 22 bp, Homo sapiens
cacaattagcagctctttattt

SEQ ID NO: 8484064 - DNA, 22 bp, Homo sapiens
gctgcagccctgcggatcactt

SEQ ID NO: 8484065 - DNA, 22 bp, Homo sapiens
gctgcaggtttgtctagtctgg

SEQ ID NO: 8484066 - DNA, 22 bp, Homo sapiens
gctgcaggtttgtctagtctgg

SEQ ID NO: 8484067 - DNA, 17 bp, Homo sapiens
gctgcagcggtaggcag

SEQ ID NO: 8484068 - DNA, 17 bp, Homo sapiens
gctgcagcggtaggcag

SEQ ID NO: 8484069 - DNA, 17 bp, Homo sapiens
gctgcagcggtaggcag

SEQ ID NO: 8484070 - DNA, 22 bp, Homo sapiens
gctgcagtgagccaagatcgtg

SEQ ID NO: 8484071 - DNA, 22 bp, Homo sapiens
gctgcagtgagccaagatcgtg

SEQ ID NO: 8484072 - DNA, 22 bp, Homo sapiens
gctgcagtgagccaagatcgtg

SEQ ID NO: 8484073 - DNA, 22 bp, Homo sapiens
gctgcatgacagacaggcctgg

SEQ ID NO: 8484074 - DNA, 22 bp, Homo sapiens
gctgcatgacagacaggcctgg

SEQ ID NO: 8484075 - DNA, 21 bp, Homo sapiens
gctgcatcaatctacccaggg

SEQ ID NO: 8484076 - DNA, 22 bp, Homo sapiens
caacactgattatggctgagct

SEQ ID NO: 8484077 - DNA, 22 bp, Homo sapiens
caacactgacaatggactgatt

SEQ ID NO: 8484078 - DNA, 22 bp, Homo sapiens
gctgccaccgtggagatgagtg

SEQ ID NO: 8484079 - DNA, 19 bp, Homo sapiens
caacagtactggtttgtcc

SEQ ID NO: 8484080 - DNA, 21 bp, Homo sapiens
gctgccaccgcgtgctccagg

SEQ ID NO: 8484081 - DNA, 22 bp, Homo sapiens
gctgccacattttcaggactaa

SEQ ID NO: 8484082 - DNA, 21 bp, Homo sapiens
gctgccaccgcgtgctccagg

SEQ ID NO: 8484083 - DNA, 21 bp, Homo sapiens
gctgccaccgcgtgctccagg

SEQ ID NO: 8484084 - DNA, 22 bp, Homo sapiens
gctgccaatccagctgtgggag

SEQ ID NO: 8484085 - DNA, 22 bp, Homo sapiens
gctgcagtgagccaagatcgtg

SEQ ID NO: 8484086 - DNA, 22 bp, Homo sapiens
caacatttcaaggtctttagga

SEQ ID NO: 8484087 - DNA, 22 bp, Homo sapiens
caacatttcaaggtctttagga

SEQ ID NO: 8484088 - DNA, 22 bp, Homo sapiens
caaccagtagctgagttcaaaa

SEQ ID NO: 8484089 - DNA, 22 bp, Homo sapiens
caacatttgtgatgagcaaact

SEQ ID NO: 8484090 - DNA, 22 bp, Homo sapiens
caacatttgagtaaagaaatgg

SEQ ID NO: 8484091 - DNA, 22 bp, Homo sapiens
caacatgccagacattagtttg

SEQ ID NO: 8484092 - DNA, 20 bp, Homo sapiens
caacatgagcaagtgaactg

SEQ ID NO: 8484093 - DNA, 22 bp, Homo sapiens
caacattcaaccaacatttatg

SEQ ID NO: 8484094 - DNA, 22 bp, Homo sapiens
caacattatatagccacatgcc

SEQ ID NO: 8484095 - DNA, 22 bp, Homo sapiens
caacatatgattttgtatataa

SEQ ID NO: 8484096 - DNA, 22 bp, Homo sapiens
caacatatataaggatttacta

SEQ ID NO: 8484097 - DNA, 22 bp, Homo sapiens
caacatatgattttgtatataa

SEQ ID NO: 8484098 - DNA, 22 bp, Homo sapiens
caacatcagtcctcatgagaca

SEQ ID NO: 8484099 - DNA, 22 bp, Homo sapiens
caacatattttccaagagtgaa

SEQ ID NO: 8484100 - DNA, 22 bp, Homo sapiens
caacatataatatttgagttct

SEQ ID NO: 8484101 - DNA, 22 bp, Homo sapiens
caacagtttatagtgttatctt

SEQ ID NO: 8484102 - DNA, 22 bp, Homo sapiens
caacatataatatttgagttct

SEQ ID NO: 8484103 - DNA, 22 bp, Homo sapiens
caacatataatatttgagttct

SEQ ID NO: 8484104 - DNA, 18 bp, Homo sapiens
gctcctggaccaggtcac

SEQ ID NO: 8484105 - DNA, 22 bp, Homo sapiens
gctcctgccctcttgcaattcc

SEQ ID NO: 8484106 - DNA, 22 bp, Homo sapiens
gctcctcttctcccactgaatg

SEQ ID NO: 8484107 - DNA, 22 bp, Homo sapiens
gctcctcttctcccactgaatg

SEQ ID NO: 8484108 - DNA, 22 bp, Homo sapiens
gctcctgaaggctctgcagggt

SEQ ID NO: 8484109 - DNA, 22 bp, Homo sapiens
caaagtatatttcatagtctca

SEQ ID NO: 8484110 - DNA, 22 bp, Homo sapiens
caaagtatattggattgaatgg

SEQ ID NO: 8484111 - DNA, 22 bp, Homo sapiens
caaaggtttcacagtagcccat

SEQ ID NO: 8484112 - DNA, 22 bp, Homo sapiens
caaaggttatgaaccacttgta

SEQ ID NO: 8484113 - DNA, 22 bp, Homo sapiens
caaaggttggaaatgtttacca

SEQ ID NO: 8484114 - DNA, 22 bp, Homo sapiens
caaaggttgttgagagtgcagg

SEQ ID NO: 8484115 - DNA, 22 bp, Homo sapiens
gctgcagcccggcgcgcctgag

SEQ ID NO: 8484116 - DNA, 22 bp, Homo sapiens
gctgcagcagctgcagggttgt

SEQ ID NO: 8484117 - DNA, 22 bp, Homo sapiens
gctgcagccaaattcattgtca

SEQ ID NO: 8484118 - DNA, 22 bp, Homo sapiens
gctgcagcaagccctccagggg

SEQ ID NO: 8484119 - DNA, 22 bp, Homo sapiens
gctgcagcaagccctccagggg

SEQ ID NO: 8484120 - DNA, 19 bp, Homo sapiens
gctgcagcagagaaactgg

SEQ ID NO: 8484121 - DNA, 22 bp, Homo sapiens
gctgcagcagaagttctcagag

SEQ ID NO: 8484122 - DNA, 22 bp, Homo sapiens
gctgcagagggaggggctcgca

SEQ ID NO: 8484123 - DNA, 22 bp, Homo sapiens
gctgcagagtgatgaagtgggg

SEQ ID NO: 8484124 - DNA, 19 bp, Homo sapiens
gctgcagagtattcttggg

SEQ ID NO: 8484125 - DNA, 22 bp, Homo sapiens
gctgcagatcccacccattccc

SEQ ID NO: 8484126 - DNA, 19 bp, Homo sapiens
gctcctggatgacctgtgg

SEQ ID NO: 8484127 - DNA, 19 bp, Homo sapiens
gctcctggatgacctgtgg

SEQ ID NO: 8484128 - DNA, 19 bp, Homo sapiens
gctcctggatgacctgtgg

SEQ ID NO: 8484129 - DNA, 20 bp, Homo sapiens
gctgaggtggaggaaggaga

SEQ ID NO: 8484130 - DNA, 22 bp, Homo sapiens
gctgaggtggaggaaggagacc

SEQ ID NO: 8484131 - DNA, 22 bp, Homo sapiens
gctgcagagacagctgccgatg

SEQ ID NO: 8484132 - DNA, 22 bp, Homo sapiens
gctgcagacttctcatctcatt

SEQ ID NO: 8484133 - DNA, 18 bp, Homo sapiens
gctcctggagtctgactc

SEQ ID NO: 8484134 - DNA, 18 bp, Homo sapiens
gctcctggaccaggtcac

SEQ ID NO: 8484135 - DNA, 22 bp, Homo sapiens
gctcctggagagattgagaaag

SEQ ID NO: 8484136 - DNA, 22 bp, Homo sapiens
gctcctggagagattgagaaag

SEQ ID NO: 8484137 - DNA, 22 bp, Homo sapiens
gctgccttcccggaatgtcatc

SEQ ID NO: 8484138 - DNA, 22 bp, Homo sapiens
gctgccttcccaggcctttgct

SEQ ID NO: 8484139 - DNA, 22 bp, Homo sapiens
gctgccttcccggaatgtcatc

SEQ ID NO: 8484140 - DNA, 22 bp, Homo sapiens
gctgccttctggaggaagtgaa

SEQ ID NO: 8484141 - DNA, 22 bp, Homo sapiens
gctgccttgccctcttcccata

SEQ ID NO: 8484142 - DNA, 20 bp, Homo sapiens
gctgccttgtcctgcttggt

SEQ ID NO: 8484143 - DNA, 20 bp, Homo sapiens
gctgccttgtcctgcttggt

SEQ ID NO: 8484144 - DNA, 22 bp, Homo sapiens
gctgcctttagggggtgctcag

SEQ ID NO: 8484145 - DNA, 22 bp, Homo sapiens
caacctgacaaggttaatgaat

SEQ ID NO: 8484146 - DNA, 22 bp, Homo sapiens
caacctgacaagactatgagta

SEQ ID NO: 8484147 - DNA, 22 bp, Homo sapiens
caacctgaattctgctttggca

SEQ ID NO: 8484148 - DNA, 22 bp, Homo sapiens
caacctctgtaatgttctagga

SEQ ID NO: 8484149 - DNA, 22 bp, Homo sapiens
caacctctttgggccttggttt

SEQ ID NO: 8484150 - DNA, 21 bp, Homo sapiens
caacctgagctgaacccgtgc

SEQ ID NO: 8484151 - DNA, 22 bp, Homo sapiens
caacctgagactccaggcacct

SEQ ID NO: 8484152 - DNA, 22 bp, Homo sapiens
caacctgatgaattgaatttaa

SEQ ID NO: 8484153 - DNA, 22 bp, Homo sapiens
caacctgatgaattgaatttaa

SEQ ID NO: 8484154 - DNA, 22 bp, Homo sapiens
caacctctatcggtcaggaagc

SEQ ID NO: 8484155 - DNA, 22 bp, Homo sapiens
caacctctggaaagtatggaca

SEQ ID NO: 8484156 - DNA, 22 bp, Homo sapiens
caacctcatagaaagaaaatgt

SEQ ID NO: 8484157 - DNA, 22 bp, Homo sapiens
gctgcctgccttgcctggagga

SEQ ID NO: 8484158 - DNA, 22 bp, Homo sapiens
gctgccttcccaggcctttgct

SEQ ID NO: 8484159 - DNA, 22 bp, Homo sapiens
gctgcctgccttgcctggagga

SEQ ID NO: 8484160 - DNA, 22 bp, Homo sapiens
gctgcctgccttgcctggagga

SEQ ID NO: 8484161 - DNA, 22 bp, Homo sapiens
gctgcctgccttgcctggagga

SEQ ID NO: 8484162 - DNA, 22 bp, Homo sapiens
caacctgatgtgcatgccacgg

SEQ ID NO: 8484163 - DNA, 22 bp, Homo sapiens
caacctggccctagccctggga

SEQ ID NO: 8484164 - DNA, 22 bp, Homo sapiens
caactacatccacactttgtta

SEQ ID NO: 8484165 - DNA, 22 bp, Homo sapiens
caactacaggaaaagtcattca

SEQ ID NO: 8484166 - DNA, 22 bp, Homo sapiens
caactacaggaaaagtcattca

SEQ ID NO: 8484167 - DNA, 22 bp, Homo sapiens
caagacaagatctaagcatgct

SEQ ID NO: 8484168 - DNA, 22 bp, Homo sapiens
caagacaagatctaagcatgct

SEQ ID NO: 8484169 - DNA, 22 bp, Homo sapiens
caagagctcaccggagagcatt

SEQ ID NO: 8484170 - DNA, 22 bp, Homo sapiens
caagagctcaccggagagcatt

SEQ ID NO: 8484171 - DNA, 22 bp, Homo sapiens
caagagctcccagacctgggca

SEQ ID NO: 8484172 - DNA, 22 bp, Homo sapiens
caagagctgaggctggagaggt

SEQ ID NO: 8484173 - DNA, 22 bp, Homo sapiens
caagagctgaggctggagaggt

SEQ ID NO: 8484174 - DNA, 22 bp, Homo sapiens
caagagctgcaaatagcgtgac

SEQ ID NO: 8484175 - DNA, 22 bp, Homo sapiens
gctgctggcactggagtgagcc

SEQ ID NO: 8484176 - DNA, 22 bp, Homo sapiens
gctgctggcactggagtgagcc

SEQ ID NO: 8484177 - DNA, 22 bp, Homo sapiens
gctgctggcactggagtgagcc

SEQ ID NO: 8484178 - DNA, 22 bp, Homo sapiens
gctgctggatgcgcttgatggt

SEQ ID NO: 8484179 - DNA, 22 bp, Homo sapiens
gctgcctttgtgagccaagggg

SEQ ID NO: 8484180 - DNA, 22 bp, Homo sapiens
gctgccttttgctcctcccacc

SEQ ID NO: 8484181 - DNA, 22 bp, Homo sapiens
caagatggacataaggagagaa

SEQ ID NO: 8484182 - DNA, 22 bp, Homo sapiens
caagatgcccctggtagggatc

SEQ ID NO: 8484183 - DNA, 22 bp, Homo sapiens
caagatgggcaccccagcacct

SEQ ID NO: 8484184 - DNA, 22 bp, Homo sapiens
caagatggagaagcagcaaggg

SEQ ID NO: 8484185 - DNA, 22 bp, Homo sapiens
caagatggagaagcagcaaggg

SEQ ID NO: 8484186 - DNA, 22 bp, Homo sapiens
caaggaagttttaggagaggaa

SEQ ID NO: 8484187 - DNA, 22 bp, Homo sapiens
caaggaatatttaagaacgtca

SEQ ID NO: 8484188 - DNA, 22 bp, Homo sapiens
caaggacactgagctttgtaaa

SEQ ID NO: 8484189 - DNA, 22 bp, Homo sapiens
caaggacactccctgctgggca

SEQ ID NO: 8484190 - DNA, 22 bp, Homo sapiens
caagctgccaccagaagagcat

SEQ ID NO: 8484191 - DNA, 22 bp, Homo sapiens
caaggacactccctgctgggca

SEQ ID NO: 8484192 - DNA, 22 bp, Homo sapiens
caaggacactgatgttcatcct

SEQ ID NO: 8484193 - DNA, 22 bp, Homo sapiens
caaggacactgatgttcatcct

SEQ ID NO: 8484194 - DNA, 22 bp, Homo sapiens
caaggacagcgtcaggtgcaac

SEQ ID NO: 8484195 - DNA, 22 bp, Homo sapiens
caaggagaaaacggcttctgaa

SEQ ID NO: 8484196 - DNA, 21 bp, Homo sapiens
caaggacaggttgcagggcaa

SEQ ID NO: 8484197 - DNA, 22 bp, Homo sapiens
caaggagataaaatgttgagct

SEQ ID NO: 8484198 - DNA, 22 bp, Homo sapiens
caagaggcaaattgtctagaag

SEQ ID NO: 8484199 - DNA, 22 bp, Homo sapiens
caagagctttagaaatgctcat

SEQ ID NO: 8484200 - DNA, 22 bp, Homo sapiens
caagagctggagaggcagtcta

SEQ ID NO: 8484201 - DNA, 18 bp, Homo sapiens
caagagctgctcctggcc

SEQ ID NO: 8484202 - DNA, 22 bp, Homo sapiens
caagaggctaaactgggctatt

SEQ ID NO: 8484203 - DNA, 22 bp, Homo sapiens
caagagtttaaatcaatggcca

SEQ ID NO: 8484204 - DNA, 22 bp, Homo sapiens
caagatcaaggtgtcagcaggt

SEQ ID NO: 8484205 - DNA, 22 bp, Homo sapiens
caagatcaaggtatcagcagat

SEQ ID NO: 8484206 - DNA, 22 bp, Homo sapiens
caagatcaatcaatactcctta

SEQ ID NO: 8484207 - DNA, 22 bp, Homo sapiens
caagatgaaactacagggagga

SEQ ID NO: 8484208 - DNA, 22 bp, Homo sapiens
caagatgatccctgaaggcagc

SEQ ID NO: 8484209 - DNA, 22 bp, Homo sapiens
caagatgacaaggctggaggct

SEQ ID NO: 8484210 - DNA, 22 bp, Homo sapiens
caccctggaaagaaggtctggg

SEQ ID NO: 8484211 - DNA, 22 bp, Homo sapiens
caccctggaaagaaggtctggg

SEQ ID NO: 8484212 - DNA, 22 bp, Homo sapiens
caccctgctctgctgtgcggcc

SEQ ID NO: 8484213 - DNA, 22 bp, Homo sapiens
caccctgctacaaagcctcctg

SEQ ID NO: 8484214 - DNA, 22 bp, Homo sapiens
caccctgcccactagcaatctg

SEQ ID NO: 8484215 - DNA, 22 bp, Homo sapiens
caccctggctggaggtgcagtg

SEQ ID NO: 8484216 - DNA, 22 bp, Homo sapiens
cactctgagaaacactaaacca

SEQ ID NO: 8484217 - DNA, 22 bp, Homo sapiens
cactctgagaagtacaagctcc

SEQ ID NO: 8484218 - DNA, 22 bp, Homo sapiens
cactctgagaagtacaagctcc

SEQ ID NO: 8484219 - DNA, 22 bp, Homo sapiens
caccctggcctcgctctctgca

SEQ ID NO: 8484220 - DNA, 22 bp, Homo sapiens
caccctggctggaggtgcagtg

SEQ ID NO: 8484221 - DNA, 22 bp, Homo sapiens
caccctggctggaggtgcagtg

SEQ ID NO: 8484222 - DNA, 20 bp, Homo sapiens
caccctacggcctcacctcc

SEQ ID NO: 8484223 - DNA, 20 bp, Homo sapiens
caccctcccagcacctatgc

SEQ ID NO: 8484224 - DNA, 22 bp, Homo sapiens
cacccccaggagctccagggac

SEQ ID NO: 8484225 - DNA, 22 bp, Homo sapiens
cacccccaggagctccagggac

SEQ ID NO: 8484226 - DNA, 22 bp, Homo sapiens
cacccccacctgtgggctcctg

SEQ ID NO: 8484227 - DNA, 22 bp, Homo sapiens
cacccccacctgtgggctcctg

SEQ ID NO: 8484228 - DNA, 22 bp, Homo sapiens
cacccccaggagctccagggac

SEQ ID NO: 8484229 - DNA, 22 bp, Homo sapiens
cacccccagcagggaaaggagg

SEQ ID NO: 8484230 - DNA, 22 bp, Homo sapiens
cacccctgtggagcatggtggc

SEQ ID NO: 8484231 - DNA, 22 bp, Homo sapiens
cacccctgggctgggcacacag

SEQ ID NO: 8484232 - DNA, 22 bp, Homo sapiens
ggcatacaagagaaatataaga

SEQ ID NO: 8484233 - DNA, 22 bp, Homo sapiens
ggcatagatttctttaggttta

SEQ ID NO: 8484234 - DNA, 22 bp, Homo sapiens
ggcatcagcccggtcctgggct

SEQ ID NO: 8484235 - DNA, 22 bp, Homo sapiens
cacccaggctggaatgcaatgg

SEQ ID NO: 8484236 - DNA, 22 bp, Homo sapiens
cacccaggctggaatgcagtgg

SEQ ID NO: 8484237 - DNA, 22 bp, Homo sapiens
cacccaggctggaatgcagtgg

SEQ ID NO: 8484238 - DNA, 19 bp, Homo sapiens
caccccagtcctctttccc

SEQ ID NO: 8484239 - DNA, 22 bp, Homo sapiens
caccccagcttctcaggataga

SEQ ID NO: 8484240 - DNA, 22 bp, Homo sapiens
caccccagtctaaaaccagcct

SEQ ID NO: 8484241 - DNA, 22 bp, Homo sapiens
caccccagcttctcaggataga

SEQ ID NO: 8484242 - DNA, 22 bp, Homo sapiens
caccccagcttctcaggataga

SEQ ID NO: 8484243 - DNA, 22 bp, Homo sapiens
cacccatgtttccctctgtctt

SEQ ID NO: 8484244 - DNA, 22 bp, Homo sapiens
cacccaggttggagtgcagtgg

SEQ ID NO: 8484245 - DNA, 22 bp, Homo sapiens
cacccaggttggagtgcagtgg

SEQ ID NO: 8484246 - DNA, 22 bp, Homo sapiens
cacccaggttggagtgcagtgg

SEQ ID NO: 8484247 - DNA, 22 bp, Homo sapiens
cacccagtaagcatgaggccct

SEQ ID NO: 8484248 - DNA, 22 bp, Homo sapiens
cacccagtgaaggagcaagagg

SEQ ID NO: 8484249 - DNA, 22 bp, Homo sapiens
cacccagtgaaggagcaagagg

SEQ ID NO: 8484250 - DNA, 22 bp, Homo sapiens
cacccagttgactacaaagggg

SEQ ID NO: 8484251 - DNA, 22 bp, Homo sapiens
cacccagttgactacaaagggg

SEQ ID NO: 8484252 - DNA, 22 bp, Homo sapiens
cacccattaaccaaagagtgaa

SEQ ID NO: 8484253 - DNA, 19 bp, Homo sapiens
ggcagctcttgtcttctgc

SEQ ID NO: 8484254 - DNA, 22 bp, Homo sapiens
ggcagccagagggcagctggat

SEQ ID NO: 8484255 - DNA, 22 bp, Homo sapiens
ggcagccagagggcagctggat

SEQ ID NO: 8484256 - DNA, 22 bp, Homo sapiens
ggcagccagagggcagctggat

SEQ ID NO: 8484257 - DNA, 21 bp, Homo sapiens
ggcagctgaccgcgcggtgca

SEQ ID NO: 8484258 - DNA, 22 bp, Homo sapiens
ggcagctgacctagcaccatcc

SEQ ID NO: 8484259 - DNA, 22 bp, Homo sapiens
ggcagctgacctagcaccatcc

SEQ ID NO: 8484260 - DNA, 22 bp, Homo sapiens
ggcagctgacctagcaccatcc

SEQ ID NO: 8484261 - DNA, 22 bp, Homo sapiens
ggcagctgagatcatgctgttg

SEQ ID NO: 8484262 - DNA, 22 bp, Homo sapiens
ggcagctgagatcatgctgttg

SEQ ID NO: 8484263 - DNA, 22 bp, Homo sapiens
caccaggttccgggcagagctg

SEQ ID NO: 8484264 - DNA, 22 bp, Homo sapiens
caccaggctggagtgcagtggc

SEQ ID NO: 8484265 - DNA, 22 bp, Homo sapiens
caccaggctggagtgcagaggt

SEQ ID NO: 8484266 - DNA, 20 bp, Homo sapiens
caccagtcatgagtcaatac

SEQ ID NO: 8484267 - DNA, 22 bp, Homo sapiens
ggcagctgagcatggctacctt

SEQ ID NO: 8484268 - DNA, 22 bp, Homo sapiens
ggcagctgagcatggctacctt

SEQ ID NO: 8484269 - DNA, 22 bp, Homo sapiens
ggcagctgagcatggctacctt

SEQ ID NO: 8484270 - DNA, 22 bp, Homo sapiens
ggcagctgagcatggctacctt

SEQ ID NO: 8484271 - DNA, 22 bp, Homo sapiens
ggcagctgattagcatcaagga

SEQ ID NO: 8484272 - DNA, 22 bp, Homo sapiens
ggcagtgttctggttgtcagga

SEQ ID NO: 8484273 - DNA, 22 bp, Homo sapiens
ggcagtgtggcataacatgtag

SEQ ID NO: 8484274 - DNA, 22 bp, Homo sapiens
ggcagtgtgcatctgtgtggcc

SEQ ID NO: 8484275 - DNA, 22 bp, Homo sapiens
ggcagtgtgcatctgtgtggcc

SEQ ID NO: 8484276 - DNA, 22 bp, Homo sapiens
cacccagagcctgagagggata

SEQ ID NO: 8484277 - DNA, 22 bp, Homo sapiens
cacccagagggcttgctgaaca

SEQ ID NO: 8484278 - DNA, 22 bp, Homo sapiens
ggcagtgtccttgcagctctac

SEQ ID NO: 8484279 - DNA, 22 bp, Homo sapiens
ggcagtgtccttgcagctctac

SEQ ID NO: 8484280 - DNA, 22 bp, Homo sapiens
cacccacattccatcactctgc

SEQ ID NO: 8484281 - DNA, 22 bp, Homo sapiens
cacccactgagctcatgtccca

SEQ ID NO: 8484282 - DNA, 22 bp, Homo sapiens
cacccacattccatcactctgc

SEQ ID NO: 8484283 - DNA, 22 bp, Homo sapiens
cacccacattccatcactctgc

SEQ ID NO: 8484284 - DNA, 22 bp, Homo sapiens
cacccacatggaaattcacagt

SEQ ID NO: 8484285 - DNA, 22 bp, Homo sapiens
cacccacatggaaattcacagt

SEQ ID NO: 8484286 - DNA, 22 bp, Homo sapiens
caccatctatagaggtatttgg

SEQ ID NO: 8484287 - DNA, 22 bp, Homo sapiens
caccatctagcatttatttgga

SEQ ID NO: 8484288 - DNA, 22 bp, Homo sapiens
caccatgactggttgagagagg

SEQ ID NO: 8484289 - DNA, 22 bp, Homo sapiens
caccatgcttgatttgtaatgt

SEQ ID NO: 8484290 - DNA, 22 bp, Homo sapiens
ggctatgtgtgtccagtgtatt

SEQ ID NO: 8484291 - DNA, 22 bp, Homo sapiens
ggctcaagcagtctgcctgcct

SEQ ID NO: 8484292 - DNA, 22 bp, Homo sapiens
ggctatccatggatctgaactc

SEQ ID NO: 8484293 - DNA, 22 bp, Homo sapiens
ggctagggatctagaccaggac

SEQ ID NO: 8484294 - DNA, 22 bp, Homo sapiens
ggctagggatctagaccaggac

SEQ ID NO: 8484295 - DNA, 22 bp, Homo sapiens
ggctagggatctagaccaggac

SEQ ID NO: 8484296 - DNA, 22 bp, Homo sapiens
cactgcccaccaagtggctggt

SEQ ID NO: 8484297 - DNA, 22 bp, Homo sapiens
ggctagggagacagagggcatg

SEQ ID NO: 8484298 - DNA, 22 bp, Homo sapiens
ggctagggagacagagggcatg

SEQ ID NO: 8484299 - DNA, 22 bp, Homo sapiens
cactgcagttccccagtgcgca

SEQ ID NO: 8484300 - DNA, 22 bp, Homo sapiens
cactgcagttccccagtgcgca

SEQ ID NO: 8484301 - DNA, 22 bp, Homo sapiens
cactgcagtaactctaggactg

SEQ ID NO: 8484302 - DNA, 22 bp, Homo sapiens
cactgcagtaactctaggactg

SEQ ID NO: 8484303 - DNA, 22 bp, Homo sapiens
cactgcatggatgatggctgta

SEQ ID NO: 8484304 - DNA, 22 bp, Homo sapiens
cactggcatgtgaggcggtggc

SEQ ID NO: 8484305 - DNA, 22 bp, Homo sapiens
cactggaatgttgaggagacaa

SEQ ID NO: 8484306 - DNA, 22 bp, Homo sapiens
cactggaatgttgaggagacaa

SEQ ID NO: 8484307 - DNA, 21 bp, Homo sapiens
cactggaattttctgtgacat

SEQ ID NO: 8484308 - DNA, 22 bp, Homo sapiens
cactggaccaaggaaactcttc

SEQ ID NO: 8484309 - DNA, 22 bp, Homo sapiens
cactgcctggaaggagagacat

SEQ ID NO: 8484310 - DNA, 22 bp, Homo sapiens
cactgctttaaggctgagtaac

SEQ ID NO: 8484311 - DNA, 22 bp, Homo sapiens
cactgcctggaaggagagacat

SEQ ID NO: 8484312 - DNA, 22 bp, Homo sapiens
cactgcttttcagacagttatt

SEQ ID NO: 8484313 - DNA, 22 bp, Homo sapiens
cactgctttttctcctcactgg

SEQ ID NO: 8484314 - DNA, 22 bp, Homo sapiens
cactggaagagcatctgagcca

SEQ ID NO: 8484315 - DNA, 22 bp, Homo sapiens
cactggaaccatccacatagtg

SEQ ID NO: 8484316 - DNA, 22 bp, Homo sapiens
cactggaaccaagacccagggc

SEQ ID NO: 8484317 - DNA, 22 bp, Homo sapiens
cactgcttttttggctatgtac

SEQ ID NO: 8484318 - DNA, 22 bp, Homo sapiens
cactggaagttcattctcagaa

SEQ ID NO: 8484319 - DNA, 22 bp, Homo sapiens
cactggaatggatagagcagag

SEQ ID NO: 8484320 - DNA, 22 bp, Homo sapiens
cactgagaccagagtccctgac

SEQ ID NO: 8484321 - DNA, 22 bp, Homo sapiens
cactgagaaagtgacctgccaa

SEQ ID NO: 8484322 - DNA, 22 bp, Homo sapiens
cactgactaagtttgtgaaggt

SEQ ID NO: 8484323 - DNA, 22 bp, Homo sapiens
cactgactccaaaaataaagaa

SEQ ID NO: 8484324 - DNA, 22 bp, Homo sapiens
cactgagagatgtgtcacagca

SEQ ID NO: 8484325 - DNA, 22 bp, Homo sapiens
cactgagagatgtgtcacagca

SEQ ID NO: 8484326 - DNA, 22 bp, Homo sapiens
cactgagaggtctcatttccaa

SEQ ID NO: 8484327 - DNA, 22 bp, Homo sapiens
cactgaaggacagtaggaaggg

SEQ ID NO: 8484328 - DNA, 22 bp, Homo sapiens
cactgacagtatcagagctgtt

SEQ ID NO: 8484329 - DNA, 22 bp, Homo sapiens
cactgacagtatcagagctgtt

SEQ ID NO: 8484330 - DNA, 22 bp, Homo sapiens
cactgacagtatcagagctgtt

SEQ ID NO: 8484331 - DNA, 22 bp, Homo sapiens
cactgagagtagggcacaagtg

SEQ ID NO: 8484332 - DNA, 22 bp, Homo sapiens
cactgagcaagtcagtacagca

SEQ ID NO: 8484333 - DNA, 22 bp, Homo sapiens
cactgagcatgagtgggctgtg

SEQ ID NO: 8484334 - DNA, 22 bp, Homo sapiens
cactgagccaggagcaatatca

SEQ ID NO: 8484335 - DNA, 22 bp, Homo sapiens
cactgagccttgccagcttggt

SEQ ID NO: 8484336 - DNA, 22 bp, Homo sapiens
ggcctcgcggcttctggtggct

SEQ ID NO: 8484337 - DNA, 22 bp, Homo sapiens
cactgcagcaccatgcagggct

SEQ ID NO: 8484338 - DNA, 22 bp, Homo sapiens
cactgcagcaccatgcagggct

SEQ ID NO: 8484339 - DNA, 22 bp, Homo sapiens
cactgcagcaccatgcagggct

SEQ ID NO: 8484340 - DNA, 22 bp, Homo sapiens
cactgcagcaccatgcagggct

SEQ ID NO: 8484341 - DNA, 22 bp, Homo sapiens
cactgcactccatcctgggaaa

SEQ ID NO: 8484342 - DNA, 23 bp, Homo sapiens
cactgcagcgtggtctggcagga

SEQ ID NO: 8484343 - DNA, 23 bp, Homo sapiens
cactgcagcgtggtctggcagga

SEQ ID NO: 8484344 - DNA, 23 bp, Homo sapiens
cactgcagcgtggtctggcagga

SEQ ID NO: 8484345 - DNA, 21 bp, Homo sapiens
cactgcagccttgacctgggc

SEQ ID NO: 8484346 - DNA, 21 bp, Homo sapiens
cactgcagccttgacctgggc

SEQ ID NO: 8484347 - DNA, 23 bp, Homo sapiens
cactgcagcgtggtctggcagga

SEQ ID NO: 8484348 - DNA, 22 bp, Homo sapiens
cactgcaggtctgagatggggg

SEQ ID NO: 8484349 - DNA, 22 bp, Homo sapiens
cactgcaggtctgagatggggg

SEQ ID NO: 8484350 - DNA, 22 bp, Homo sapiens
ggcctcgcggcttctggtggct

SEQ ID NO: 8484351 - DNA, 22 bp, Homo sapiens
ggcctcgcggcttctggtggct

SEQ ID NO: 8484352 - DNA, 22 bp, Homo sapiens
ggcctcgcggcttctggtggct

SEQ ID NO: 8484353 - DNA, 22 bp, Homo sapiens
ggcctcgcggcttctggtggct

SEQ ID NO: 8484354 - DNA, 22 bp, Homo sapiens
ggcctcgcggcttctggtggct

SEQ ID NO: 8484355 - DNA, 22 bp, Homo sapiens
ggcctcgcggcttctggtggct

SEQ ID NO: 8484356 - DNA, 20 bp, Homo sapiens
ggcctcggacttcatcgtag

SEQ ID NO: 8484357 - DNA, 22 bp, Homo sapiens
ggcctctcatgcccagagccaa

SEQ ID NO: 8484358 - DNA, 22 bp, Homo sapiens
ggcctctcatgcccagagccaa

SEQ ID NO: 8484359 - DNA, 22 bp, Homo sapiens
ggcctctcatgtcctgggcttc

SEQ ID NO: 8484360 - DNA, 22 bp, Homo sapiens
ggcctctcatgcccagagccaa

SEQ ID NO: 8484361 - DNA, 22 bp, Homo sapiens
ggcctcggcccactgctgcggt

SEQ ID NO: 8484362 - DNA, 22 bp, Homo sapiens
ggcctctcagggcagagaccct

SEQ ID NO: 8484363 - DNA, 22 bp, Homo sapiens
ggcctctctagcatccagcctg

SEQ ID NO: 8484364 - DNA, 22 bp, Homo sapiens
cactgcactccagcttgggtga

SEQ ID NO: 8484365 - DNA, 22 bp, Homo sapiens
ggcctctcatgtcctgggcttc

SEQ ID NO: 8484366 - DNA, 22 bp, Homo sapiens
ggcctctcatgtcctgggcttc

SEQ ID NO: 8484367 - DNA, 22 bp, Homo sapiens
ggcctctcgaagcttcagtcca

SEQ ID NO: 8484368 - DNA, 22 bp, Homo sapiens
ggcagagctagtggcttctctt

SEQ ID NO: 8484369 - DNA, 22 bp, Homo sapiens
ggcagagctctggactgagaac

SEQ ID NO: 8484370 - DNA, 19 bp, Homo sapiens
ggcagagctcctgctttct

SEQ ID NO: 8484371 - DNA, 22 bp, Homo sapiens
ggcagagctagtggcttctctt

SEQ ID NO: 8484372 - DNA, 20 bp, Homo sapiens
ggcagagctatgtctgttgc

SEQ ID NO: 8484373 - DNA, 20 bp, Homo sapiens
ggcagagctatgtctgttgc

SEQ ID NO: 8484374 - DNA, 21 bp, Homo sapiens
ggcagagctggggcctccagc

SEQ ID NO: 8484375 - DNA, 22 bp, Homo sapiens
ggcagagctgcatgagcactca

SEQ ID NO: 8484376 - DNA, 22 bp, Homo sapiens
ggcagagctgcatgagcactca

SEQ ID NO: 8484377 - DNA, 22 bp, Homo sapiens
ggcagagctgcatgagcactca

SEQ ID NO: 8484378 - DNA, 17 bp, Homo sapiens
ggcagagctgacagggc

SEQ ID NO: 8484379 - DNA, 22 bp, Homo sapiens
ggcagagcttgcagtgagccga

SEQ ID NO: 8484380 - DNA, 22 bp, Homo sapiens
cacagtggcaggtgtgggttgt

SEQ ID NO: 8484381 - DNA, 22 bp, Homo sapiens
cacagtggcaaaggggcttggg

SEQ ID NO: 8484382 - DNA, 22 bp, Homo sapiens
cacagtgtagactaataataga

SEQ ID NO: 8484383 - DNA, 22 bp, Homo sapiens
cacagtggattgggtgatgccc

SEQ ID NO: 8484384 - DNA, 22 bp, Homo sapiens
cacagtgctttatgagagatct

SEQ ID NO: 8484385 - DNA, 22 bp, Homo sapiens
cacagtgtgggcatggtgcctg

SEQ ID NO: 8484386 - DNA, 22 bp, Homo sapiens
ggcagatggaagaggctgggtc

SEQ ID NO: 8484387 - DNA, 22 bp, Homo sapiens
ggcagatggaagaggctgggtc

SEQ ID NO: 8484388 - DNA, 22 bp, Homo sapiens
cacagtgtagactaataataga

SEQ ID NO: 8484389 - DNA, 22 bp, Homo sapiens
cacagtgtagttaatgtgacat

SEQ ID NO: 8484390 - DNA, 22 bp, Homo sapiens
cacagtgtctgtgcttcagtgt

SEQ ID NO: 8484391 - DNA, 22 bp, Homo sapiens
cacagtgtgactgaccttcagc

SEQ ID NO: 8484392 - DNA, 22 bp, Homo sapiens
ggcagcagtggctgctattgtc

SEQ ID NO: 8484393 - DNA, 22 bp, Homo sapiens
ggcagcagttacaaatgtgcag

SEQ ID NO: 8484394 - DNA, 22 bp, Homo sapiens
ggcagcagtggctgctattgtc

SEQ ID NO: 8484395 - DNA, 22 bp, Homo sapiens
ggcagcagtggctgctattgtc

SEQ ID NO: 8484396 - DNA, 22 bp, Homo sapiens
ggcagcagttacaaatgtgcag

SEQ ID NO: 8484397 - DNA, 22 bp, Homo sapiens
ggcagcatgagcctggtgaatt

SEQ ID NO: 8484398 - DNA, 22 bp, Homo sapiens
ggcagcattgccaatccagaca

SEQ ID NO: 8484399 - DNA, 20 bp, Homo sapiens
ggcagccaatcagcgtgccg

SEQ ID NO: 8484400 - DNA, 22 bp, Homo sapiens
ggcacagggagccgcagttgca

SEQ ID NO: 8484401 - DNA, 22 bp, Homo sapiens
ggcacagggaggccctggtgtg

SEQ ID NO: 8484402 - DNA, 22 bp, Homo sapiens
ggcacagggaggccctggtgtg

SEQ ID NO: 8484403 - DNA, 22 bp, Homo sapiens
ggcacagggggctgaggactag

SEQ ID NO: 8484404 - DNA, 22 bp, Homo sapiens
ggcacagggggctgaggactag

SEQ ID NO: 8484405 - DNA, 22 bp, Homo sapiens
ggcacagggtgatgttgcagtt

SEQ ID NO: 8484406 - DNA, 22 bp, Homo sapiens
ggcacagtccctggcacagagt

SEQ ID NO: 8484407 - DNA, 22 bp, Homo sapiens
ggcacagtgattaagagccagt

SEQ ID NO: 8484408 - DNA, 22 bp, Homo sapiens
ggcacagggtgatgttgcagtt

SEQ ID NO: 8484409 - DNA, 22 bp, Homo sapiens
ggcacagggtgatgttgcagtt

SEQ ID NO: 8484410 - DNA, 22 bp, Homo sapiens
ggcacagggggctgaggactag

SEQ ID NO: 8484411 - DNA, 22 bp, Homo sapiens
cacagggcagagacctgggtgc

SEQ ID NO: 8484412 - DNA, 22 bp, Homo sapiens
cacagggcagagacctgggtgc

SEQ ID NO: 8484413 - DNA, 22 bp, Homo sapiens
cacagggcagagacctgggtgc

SEQ ID NO: 8484414 - DNA, 22 bp, Homo sapiens
cacagggcagagggtccgtggc

SEQ ID NO: 8484415 - DNA, 22 bp, Homo sapiens
cacagggcagagggtccgtggc

SEQ ID NO: 8484416 - DNA, 22 bp, Homo sapiens
cacagggcagagggtccgtggc

SEQ ID NO: 8484417 - DNA, 22 bp, Homo sapiens
cacagggcagagacctgggtgc

SEQ ID NO: 8484418 - DNA, 22 bp, Homo sapiens
ggcacaaggtttaaataacatc

SEQ ID NO: 8484419 - DNA, 22 bp, Homo sapiens
ggcacaaggtttaaataacatc

SEQ ID NO: 8484420 - DNA, 22 bp, Homo sapiens
ggcacaagtttgatgtgagtta

SEQ ID NO: 8484421 - DNA, 22 bp, Homo sapiens
cacagggcaggccccaggcctc

SEQ ID NO: 8484422 - DNA, 22 bp, Homo sapiens
cacagggcaggccccaggcctc

SEQ ID NO: 8484423 - DNA, 22 bp, Homo sapiens
ggcacagggagccgcagttgca

SEQ ID NO: 8484424 - DNA, 22 bp, Homo sapiens
ggcacagggagccgcagttgca

SEQ ID NO: 8484425 - DNA, 22 bp, Homo sapiens
ggcacagggagccgcagttgca

SEQ ID NO: 8484426 - DNA, 22 bp, Homo sapiens
ggcacaattgcagcaataaaca

SEQ ID NO: 8484427 - DNA, 22 bp, Homo sapiens
ggcacatgtatgtgggagtgtg

SEQ ID NO: 8484428 - DNA, 22 bp, Homo sapiens
ggcacatggagacttggcatca

SEQ ID NO: 8484429 - DNA, 22 bp, Homo sapiens
ggcacatggagacttggcatca

SEQ ID NO: 8484430 - DNA, 22 bp, Homo sapiens
ggcacatgtatgtgggagtgtg

SEQ ID NO: 8484431 - DNA, 20 bp, Homo sapiens
ggcactggaagcacacagga

SEQ ID NO: 8484432 - DNA, 20 bp, Homo sapiens
ggcactggaagcacacagga

SEQ ID NO: 8484433 - DNA, 22 bp, Homo sapiens
ggcactggaaggatcatgtgag

SEQ ID NO: 8484434 - DNA, 22 bp, Homo sapiens
ggcactggcctggggccaagag

SEQ ID NO: 8484435 - DNA, 22 bp, Homo sapiens
ggcagagccttctggagctcgc

SEQ ID NO: 8484436 - DNA, 22 bp, Homo sapiens
ggcagagagttctccacctctc

SEQ ID NO: 8484437 - DNA, 22 bp, Homo sapiens
ggcagagatgtgggtcagaatc

SEQ ID NO: 8484438 - DNA, 22 bp, Homo sapiens
ggcagagatgtgggtcagaatc

SEQ ID NO: 8484439 - DNA, 22 bp, Homo sapiens
ggcagagcagccccagggtttg

SEQ ID NO: 8484440 - DNA, 22 bp, Homo sapiens
ggcactgggagaggtgagacgg

SEQ ID NO: 8484441 - DNA, 22 bp, Homo sapiens
ggcactgggagaggtgagacgg

SEQ ID NO: 8484442 - DNA, 22 bp, Homo sapiens
ggcactgggcaccggctgaggg

SEQ ID NO: 8484443 - DNA, 22 bp, Homo sapiens
ggcactgggcaccggctgaggg

SEQ ID NO: 8484444 - DNA, 22 bp, Homo sapiens
ggagggaggttagattcaagct

SEQ ID NO: 8484445 - DNA, 22 bp, Homo sapiens
ggagggagcatccccttgctga

SEQ ID NO: 8484446 - DNA, 22 bp, Homo sapiens
ggagggagcatccccttgctga

SEQ ID NO: 8484447 - DNA, 22 bp, Homo sapiens
ggagggagcatccccttgctga

SEQ ID NO: 8484448 - DNA, 22 bp, Homo sapiens
ggaggcggaggttgcagtgagc

SEQ ID NO: 8484449 - DNA, 22 bp, Homo sapiens
ggaggcggaggctgcagtgagc

SEQ ID NO: 8484450 - DNA, 22 bp, Homo sapiens
ggaggcggaggctgcagtgagc

SEQ ID NO: 8484451 - DNA, 22 bp, Homo sapiens
ggagggagcagagaacccaacc

SEQ ID NO: 8484452 - DNA, 22 bp, Homo sapiens
ggagggagcagagaacccaacc

SEQ ID NO: 8484453 - DNA, 22 bp, Homo sapiens
ggagggagtcagctgattagaa

SEQ ID NO: 8484454 - DNA, 22 bp, Homo sapiens
ggagggagtcagctgattagaa

SEQ ID NO: 8484455 - DNA, 22 bp, Homo sapiens
ggatccttctttgacctcacag

SEQ ID NO: 8484456 - DNA, 22 bp, Homo sapiens
ggagggagtcagctgattagaa

SEQ ID NO: 8484457 - DNA, 22 bp, Homo sapiens
ggagggagtttcattcctgccc

SEQ ID NO: 8484458 - DNA, 22 bp, Homo sapiens
ggatgggagcagaggacgacca

SEQ ID NO: 8484459 - DNA, 23 bp, Homo sapiens
ggatgggcaagcctagtgcctac

SEQ ID NO: 8484460 - DNA, 22 bp, Homo sapiens
ggatgggaacttggtagggcat

SEQ ID NO: 8484461 - DNA, 22 bp, Homo sapiens
cacagggaggcggtcactggct

SEQ ID NO: 8484462 - DNA, 22 bp, Homo sapiens
cacagggcaccagttggccatc

SEQ ID NO: 8484463 - DNA, 22 bp, Homo sapiens
cacagggcaccagttggccatc

SEQ ID NO: 8484464 - DNA, 22 bp, Homo sapiens
cacagggagttacagaagcact

SEQ ID NO: 8484465 - DNA, 19 bp, Homo sapiens
cacagggagaccacatgtc

SEQ ID NO: 8484466 - DNA, 22 bp, Homo sapiens
cacagggaggacatcaacagtg

SEQ ID NO: 8484467 - DNA, 22 bp, Homo sapiens
cacagggaggacatcaacagtg

SEQ ID NO: 8484468 - DNA, 22 bp, Homo sapiens
ggatgtagtgcaaggagtgaat

SEQ ID NO: 8484469 - DNA, 22 bp, Homo sapiens
ggatgtcgaggatggggtagca

SEQ ID NO: 8484470 - DNA, 22 bp, Homo sapiens
ggatgggttccgtgggcaaatg

SEQ ID NO: 8484471 - DNA, 22 bp, Homo sapiens
ggatgggctgaaaggtagcccc

SEQ ID NO: 8484472 - DNA, 22 bp, Homo sapiens
ggatgggcagacaggacggcac

SEQ ID NO: 8484473 - DNA, 22 bp, Homo sapiens
ggatgggcagacaggacggcac

SEQ ID NO: 8484474 - DNA, 22 bp, Homo sapiens
ggatgggcccgggacggcgctg

SEQ ID NO: 8484475 - DNA, 22 bp, Homo sapiens
ggatgggcccgggacggcgctg

SEQ ID NO: 8484476 - DNA, 22 bp, Homo sapiens
ggatgtgaatctgggctgagac

SEQ ID NO: 8484477 - DNA, 22 bp, Homo sapiens
ggatgttctggggttctcttgt

SEQ ID NO: 8484478 - DNA, 22 bp, Homo sapiens
ggatgttctggggttctcttgt

SEQ ID NO: 8484479 - DNA, 22 bp, Homo sapiens
ggatgttctggggttctcttgt

SEQ ID NO: 8484480 - DNA, 22 bp, Homo sapiens
ggatgtgaatctgggctgagac

SEQ ID NO: 8484481 - DNA, 22 bp, Homo sapiens
ggatgttctggggttctcttgt

SEQ ID NO: 8484482 - DNA, 22 bp, Homo sapiens
ggaggccttgaggccaggagct

SEQ ID NO: 8484483 - DNA, 22 bp, Homo sapiens
ggaggccaaggcaggtggatcg

SEQ ID NO: 8484484 - DNA, 22 bp, Homo sapiens
ggaggccaaggcaggtggatcg

SEQ ID NO: 8484485 - DNA, 22 bp, Homo sapiens
ggaggccaaggcaggtggatcg

SEQ ID NO: 8484486 - DNA, 22 bp, Homo sapiens
cacagcttgtttagtgactcac

SEQ ID NO: 8484487 - DNA, 22 bp, Homo sapiens
ggaggccaaggcaggtggatca

SEQ ID NO: 8484488 - DNA, 22 bp, Homo sapiens
cacagcttgtttagtgactcac

SEQ ID NO: 8484489 - DNA, 22 bp, Homo sapiens
ggaggccaaggcaggtggatca

SEQ ID NO: 8484490 - DNA, 22 bp, Homo sapiens
cacagcttgggctctgacaata

SEQ ID NO: 8484491 - DNA, 22 bp, Homo sapiens
cacagcttgggctctgacaata

SEQ ID NO: 8484492 - DNA, 22 bp, Homo sapiens
cacagcttctgagtgaggattt

SEQ ID NO: 8484493 - DNA, 22 bp, Homo sapiens
cacagcttctgagtgaggattt

SEQ ID NO: 8484494 - DNA, 22 bp, Homo sapiens
cacagcttctccccgctgcggc

SEQ ID NO: 8484495 - DNA, 22 bp, Homo sapiens
cacagcttctccttgatatcgc

SEQ ID NO: 8484496 - DNA, 20 bp, Homo sapiens
cacagcttgccttttatgac

SEQ ID NO: 8484497 - DNA, 20 bp, Homo sapiens
cacagcttgccttttatgac

SEQ ID NO: 8484498 - DNA, 22 bp, Homo sapiens
cacagcttgggctctgacaata

SEQ ID NO: 8484499 - DNA, 22 bp, Homo sapiens
cacagcttcttccattccactc

SEQ ID NO: 8484500 - DNA, 22 bp, Homo sapiens
cacagcttctgtctgacccatg

SEQ ID NO: 8484501 - DNA, 22 bp, Homo sapiens
ggaggcggaagttgcagtgagc

SEQ ID NO: 8484502 - DNA, 22 bp, Homo sapiens
ggaggcggagcttgcagtgagc

SEQ ID NO: 8484503 - DNA, 22 bp, Homo sapiens
ggaggcggagcttgcagtgagc

SEQ ID NO: 8484504 - DNA, 22 bp, Homo sapiens
ggaggcggaggctgcagtgagc

SEQ ID NO: 8484505 - DNA, 22 bp, Homo sapiens
ggaggcggagcttgcagtgagc

SEQ ID NO: 8484506 - DNA, 22 bp, Homo sapiens
ggaggcggaagttgcagtgagc

SEQ ID NO: 8484507 - DNA, 22 bp, Homo sapiens
ggaggcggacacaggtagtgtt

SEQ ID NO: 8484508 - DNA, 22 bp, Homo sapiens
ggaggcggaagttgcagtgagc

SEQ ID NO: 8484509 - DNA, 22 bp, Homo sapiens
ggaggccttgcctgcaggcaca

SEQ ID NO: 8484510 - DNA, 22 bp, Homo sapiens
ggaggcgcggctcggctgtgcc

SEQ ID NO: 8484511 - DNA, 22 bp, Homo sapiens
cacactgtcaggtaaataacac

SEQ ID NO: 8484512 - DNA, 22 bp, Homo sapiens
cacagctgaagtagccatgtgg

SEQ ID NO: 8484513 - DNA, 22 bp, Homo sapiens
cacagctgaagtagccatgtgg

SEQ ID NO: 8484514 - DNA, 22 bp, Homo sapiens
cacactgtcaggtaaataacac

SEQ ID NO: 8484515 - DNA, 22 bp, Homo sapiens
cacactgtcaggtaaataacac

SEQ ID NO: 8484516 - DNA, 22 bp, Homo sapiens
cacagctggtgcactagctctg

SEQ ID NO: 8484517 - DNA, 22 bp, Homo sapiens
cacagctggtgcactagctctg

SEQ ID NO: 8484518 - DNA, 22 bp, Homo sapiens
cacagctggtgacagagcccag

SEQ ID NO: 8484519 - DNA, 22 bp, Homo sapiens
cacagctggtgacagagcccag

SEQ ID NO: 8484520 - DNA, 22 bp, Homo sapiens
cacactcattagtcatttctct

SEQ ID NO: 8484521 - DNA, 22 bp, Homo sapiens
cacactgacctgaacttagcat

SEQ ID NO: 8484522 - DNA, 22 bp, Homo sapiens
cacactgtcaggtaaataacac

SEQ ID NO: 8484523 - DNA, 22 bp, Homo sapiens
cacactgatagcactaagtcag

SEQ ID NO: 8484524 - DNA, 22 bp, Homo sapiens
cacagctgtgagaagggagcct

SEQ ID NO: 8484525 - DNA, 22 bp, Homo sapiens
cacagctgtgagaagggagcct

SEQ ID NO: 8484526 - DNA, 22 bp, Homo sapiens
cacagctggtgcactagctctg

SEQ ID NO: 8484527 - DNA, 22 bp, Homo sapiens
cacagctgtcagctgacctagg

SEQ ID NO: 8484528 - DNA, 22 bp, Homo sapiens
cacagctgtcagctgacctagg

SEQ ID NO: 8484529 - DNA, 22 bp, Homo sapiens
cacagcttatgccactgattgg

SEQ ID NO: 8484530 - DNA, 22 bp, Homo sapiens
cacagcttagaaaagaagccat

SEQ ID NO: 8484531 - DNA, 22 bp, Homo sapiens
cacagcttatgccactgattgg

SEQ ID NO: 8484532 - DNA, 22 bp, Homo sapiens
cacagcttcagtttctgacttg

SEQ ID NO: 8484533 - DNA, 22 bp, Homo sapiens
cacagcttccattagaatgaga

SEQ ID NO: 8484534 - DNA, 22 bp, Homo sapiens
cacagcttccattagaatgaga

SEQ ID NO: 8484535 - DNA, 22 bp, Homo sapiens
cacagcttccattagaatgaga

SEQ ID NO: 8484536 - DNA, 22 bp, Homo sapiens
cacagcttcccgtgcatggaga

SEQ ID NO: 8484537 - DNA, 22 bp, Homo sapiens
cacagcttcccaaagtggacct

SEQ ID NO: 8484538 - DNA, 22 bp, Homo sapiens
atgtctttcaaattctgcctag

SEQ ID NO: 8484539 - DNA, 22 bp, Homo sapiens
atgtctttattaatatcatgcc

SEQ ID NO: 8484540 - DNA, 22 bp, Homo sapiens
atgtctttcgcatcagtagcta

SEQ ID NO: 8484541 - DNA, 22 bp, Homo sapiens
atgtctttataaatgtataatg

SEQ ID NO: 8484542 - DNA, 22 bp, Homo sapiens
atgtctttataaatgtataatg

SEQ ID NO: 8484543 - DNA, 22 bp, Homo sapiens
atgtctggaggtcatctggtta

SEQ ID NO: 8484544 - DNA, 22 bp, Homo sapiens
atgtctggaggtcatctggtta

SEQ ID NO: 8484545 - DNA, 19 bp, Homo sapiens
atgtctgggtaacagctgc

SEQ ID NO: 8484546 - DNA, 22 bp, Homo sapiens
atgtctggtggtcgatgctaca

SEQ ID NO: 8484547 - DNA, 22 bp, Homo sapiens
gaggcctggctgggaggaggtg

SEQ ID NO: 8484548 - DNA, 22 bp, Homo sapiens
gaggcctggctctgccctcctg

SEQ ID NO: 8484549 - DNA, 22 bp, Homo sapiens
gaggccagggtaccatcaacat

SEQ ID NO: 8484550 - DNA, 22 bp, Homo sapiens
atgtctttcttatggtctgttg

SEQ ID NO: 8484551 - DNA, 22 bp, Homo sapiens
atgtctttcttgtgtcccaaga

SEQ ID NO: 8484552 - DNA, 22 bp, Homo sapiens
atgtctttctcacagccagttc

SEQ ID NO: 8484553 - DNA, 22 bp, Homo sapiens
atgtctttgccatagttcatat

SEQ ID NO: 8484554 - DNA, 22 bp, Homo sapiens
atgtctttgccatagttcatat

SEQ ID NO: 8484555 - DNA, 22 bp, Homo sapiens
atgtgaaaaatttcttattaca

SEQ ID NO: 8484556 - DNA, 22 bp, Homo sapiens
atgtgaaaatccaatggcagca

SEQ ID NO: 8484557 - DNA, 22 bp, Homo sapiens
atgtgaaaatccaatggcagca

SEQ ID NO: 8484558 - DNA, 22 bp, Homo sapiens
atgtgaaaaatttcttattaca

SEQ ID NO: 8484559 - DNA, 22 bp, Homo sapiens
atgtgaaaaatttcttattaca

SEQ ID NO: 8484560 - DNA, 22 bp, Homo sapiens
atgtcttttatgattacgggat

SEQ ID NO: 8484561 - DNA, 22 bp, Homo sapiens
atgtctttggctttgacatggc

SEQ ID NO: 8484562 - DNA, 22 bp, Homo sapiens
gaggctgcggggaggagcctgc

SEQ ID NO: 8484563 - DNA, 22 bp, Homo sapiens
gaggctgcggggaggagcctgc

SEQ ID NO: 8484564 - DNA, 22 bp, Homo sapiens
gaggctgctgagagccctgttt

SEQ ID NO: 8484565 - DNA, 22 bp, Homo sapiens
gaggctgctgagagccctgttt

SEQ ID NO: 8484566 - DNA, 22 bp, Homo sapiens
gaggctgctgccatcattaggt

SEQ ID NO: 8484567 - DNA, 22 bp, Homo sapiens
atgtgaaacgcaatgggatcat

SEQ ID NO: 8484568 - DNA, 22 bp, Homo sapiens
atgtgaaacctgtgagtagagt

SEQ ID NO: 8484569 - DNA, 22 bp, Homo sapiens
atgtgaaacctgtgagtagagt

SEQ ID NO: 8484570 - DNA, 22 bp, Homo sapiens
atgtgaaaatccaatggcagca

SEQ ID NO: 8484571 - DNA, 22 bp, Homo sapiens
atgtgaaacctgtgagtagagt

SEQ ID NO: 8484572 - DNA, 21 bp, Homo sapiens
atgtgaaaccttccacgctga

SEQ ID NO: 8484573 - DNA, 20 bp, Homo sapiens
gaggctgcggactgctggac

SEQ ID NO: 8484574 - DNA, 22 bp, Homo sapiens
gaggctgccccttcctcagctg

SEQ ID NO: 8484575 - DNA, 22 bp, Homo sapiens
gaggggaagacttctggacagt

SEQ ID NO: 8484576 - DNA, 22 bp, Homo sapiens
atgtgtccacaggtgtgagaga

SEQ ID NO: 8484577 - DNA, 22 bp, Homo sapiens
atgtgtattagttagtttaatg

SEQ ID NO: 8484578 - DNA, 22 bp, Homo sapiens
atgtgtattgagcacctactgc

SEQ ID NO: 8484579 - DNA, 22 bp, Homo sapiens
atgtgtatttatttggggctta

SEQ ID NO: 8484580 - DNA, 22 bp, Homo sapiens
atgtgtatttccatcgatcagc

SEQ ID NO: 8484581 - DNA, 22 bp, Homo sapiens
atgtgtattttgtactattggg

SEQ ID NO: 8484582 - DNA, 22 bp, Homo sapiens
atgtgtcattatccagaataac

SEQ ID NO: 8484583 - DNA, 22 bp, Homo sapiens
atgtgtcaattttcaaatgctt

SEQ ID NO: 8484584 - DNA, 22 bp, Homo sapiens
gaggctgctgttagccctgggc

SEQ ID NO: 8484585 - DNA, 22 bp, Homo sapiens
gaggctgctgttagccctgggc

SEQ ID NO: 8484586 - DNA, 22 bp, Homo sapiens
gaggctgctttgatgacaggag

SEQ ID NO: 8484587 - DNA, 22 bp, Homo sapiens
gaggctgctttcctcctatcct

SEQ ID NO: 8484588 - DNA, 22 bp, Homo sapiens
gaggctgctttgatgacaggag

SEQ ID NO: 8484589 - DNA, 22 bp, Homo sapiens
atgtggctgtcacagcataatg

SEQ ID NO: 8484590 - DNA, 22 bp, Homo sapiens
atgtggctgtggacacctttca

SEQ ID NO: 8484591 - DNA, 22 bp, Homo sapiens
atgtggcttagttaggtgcccc

SEQ ID NO: 8484592 - DNA, 22 bp, Homo sapiens
atgtgtattaccctttcattcc

SEQ ID NO: 8484593 - DNA, 22 bp, Homo sapiens
atgtgtattacctcgattgtga

SEQ ID NO: 8484594 - DNA, 22 bp, Homo sapiens
atgtgtatgtgtatacacacag

SEQ ID NO: 8484595 - DNA, 22 bp, Homo sapiens
atgtgtatgtcttattcaaaga

SEQ ID NO: 8484596 - DNA, 22 bp, Homo sapiens
atgtgtattaccctttcattcc

SEQ ID NO: 8484597 - DNA, 22 bp, Homo sapiens
atgtgtattaccctttcattcc

SEQ ID NO: 8484598 - DNA, 22 bp, Homo sapiens
atgtgtatgcatgcactaagat

SEQ ID NO: 8484599 - DNA, 22 bp, Homo sapiens
atgtgtatgatacctttgctga

SEQ ID NO: 8484600 - DNA, 22 bp, Homo sapiens
atgtgtatgagtgtgcttcttt

SEQ ID NO: 8484601 - DNA, 22 bp, Homo sapiens
atgtggctttctgcgttttctc

SEQ ID NO: 8484602 - DNA, 22 bp, Homo sapiens
atgtggcttttcctgggttcct

SEQ ID NO: 8484603 - DNA, 22 bp, Homo sapiens
atgtggcttttcctgggttcct

SEQ ID NO: 8484604 - DNA, 22 bp, Homo sapiens
atgtggcttggcagggaatatg

SEQ ID NO: 8484605 - DNA, 22 bp, Homo sapiens
atgtggcttgtcgatattagca

SEQ ID NO: 8484606 - DNA, 22 bp, Homo sapiens
atgtggctttcatgattaagca

SEQ ID NO: 8484607 - DNA, 22 bp, Homo sapiens
gaggggagaggcttatggatca

SEQ ID NO: 8484608 - DNA, 16 bp, Homo sapiens
gaggggagcagtaggc

SEQ ID NO: 8484609 - DNA, 22 bp, Homo sapiens
gaggggagcatgatctagattg

SEQ ID NO: 8484610 - DNA, 16 bp, Homo sapiens
gaggggagcagtaggc

SEQ ID NO: 8484611 - DNA, 22 bp, Homo sapiens
gaggggagcatgatctagattg

SEQ ID NO: 8484612 - DNA, 22 bp, Homo sapiens
gaggggagcatgatctagattg

SEQ ID NO: 8484613 - DNA, 22 bp, Homo sapiens
gaggggagcatgatctagattg

SEQ ID NO: 8484614 - DNA, 22 bp, Homo sapiens
atgtgtcttctgtgggtttgaa

SEQ ID NO: 8484615 - DNA, 22 bp, Homo sapiens
atgtgtcttgagggggatggag

SEQ ID NO: 8484616 - DNA, 22 bp, Homo sapiens
atgtgtcttctgtgggtttgaa

SEQ ID NO: 8484617 - DNA, 22 bp, Homo sapiens
gaggggagcccccatcctccag

SEQ ID NO: 8484618 - DNA, 22 bp, Homo sapiens
gaggggagaggcttatggatca

SEQ ID NO: 8484619 - DNA, 16 bp, Homo sapiens
gaggggagcagtaggc

SEQ ID NO: 8484620 - DNA, 22 bp, Homo sapiens
gaggggagaggcttatggatca

SEQ ID NO: 8484621 - DNA, 22 bp, Homo sapiens
gaggggagaaggcactaaccag

SEQ ID NO: 8484622 - DNA, 22 bp, Homo sapiens
gaggggagacagggaaatcagt

SEQ ID NO: 8484623 - DNA, 22 bp, Homo sapiens
gaggggagacagggaaatcagt

SEQ ID NO: 8484624 - DNA, 22 bp, Homo sapiens
atgtgtgtatgtgcctatatct

SEQ ID NO: 8484625 - DNA, 22 bp, Homo sapiens
atgtgtgtatgtgcctatatct

SEQ ID NO: 8484626 - DNA, 22 bp, Homo sapiens
atgtgtgtgatgggcgccgcca

SEQ ID NO: 8484627 - DNA, 22 bp, Homo sapiens
atgtgtgtgcatttctctccct

SEQ ID NO: 8484628 - DNA, 22 bp, Homo sapiens
atgtgtgtgcatttctctccct

SEQ ID NO: 8484629 - DNA, 22 bp, Homo sapiens
atgtgtgtgcatttctctccct

SEQ ID NO: 8484630 - DNA, 22 bp, Homo sapiens
atgtgtgtgcatttctctccct

SEQ ID NO: 8484631 - DNA, 22 bp, Homo sapiens
atgtgtgtgatgggcgccgcca

SEQ ID NO: 8484632 - DNA, 22 bp, Homo sapiens
atgtgtgtgatgggcgccgcca

SEQ ID NO: 8484633 - DNA, 22 bp, Homo sapiens
atgtgtgtgatgggcgccgcca

SEQ ID NO: 8484634 - DNA, 22 bp, Homo sapiens
atgtgtcttgcggcagttggta

SEQ ID NO: 8484635 - DNA, 22 bp, Homo sapiens
atgtgtcttggagttttaatgt

SEQ ID NO: 8484636 - DNA, 22 bp, Homo sapiens
atgtgtgtacacacgtgactct

SEQ ID NO: 8484637 - DNA, 22 bp, Homo sapiens
atgtgtgtatatatagtcattt

SEQ ID NO: 8484638 - DNA, 22 bp, Homo sapiens
atgtgtgtatatatagtcattt

SEQ ID NO: 8484639 - DNA, 22 bp, Homo sapiens
atgtgtgtatatatagtcattt

SEQ ID NO: 8484640 - DNA, 22 bp, Homo sapiens
atgtgtgtatgtgcctatatct

SEQ ID NO: 8484641 - DNA, 22 bp, Homo sapiens
atgtgtgtatatatagtcattt

SEQ ID NO: 8484642 - DNA, 22 bp, Homo sapiens
atgtgtgtatatatagtcattt

SEQ ID NO: 8484643 - DNA, 22 bp, Homo sapiens
atgtgtgtatatatagtcattt

SEQ ID NO: 8484644 - DNA, 22 bp, Homo sapiens
gaggccaggagtgctgtaagtt

SEQ ID NO: 8484645 - DNA, 22 bp, Homo sapiens
gaggccaggagtgctgtaagtt

SEQ ID NO: 8484646 - DNA, 22 bp, Homo sapiens
gaggccacggaagggagctgtg

SEQ ID NO: 8484647 - DNA, 22 bp, Homo sapiens
gaggccaccctatgggtcccag

SEQ ID NO: 8484648 - DNA, 23 bp, Homo sapiens
gaggccacattcccctgcttgag

SEQ ID NO: 8484649 - DNA, 22 bp, Homo sapiens
gaggagctggcagcgtctccgc

SEQ ID NO: 8484650 - DNA, 22 bp, Homo sapiens
gaggagctgggaccctgtcatc

SEQ ID NO: 8484651 - DNA, 22 bp, Homo sapiens
gaggccagggatgcaatgagag

SEQ ID NO: 8484652 - DNA, 22 bp, Homo sapiens
gaggccagggatgcaatgagag

SEQ ID NO: 8484653 - DNA, 22 bp, Homo sapiens
gaggccagggtaccatcaacat

SEQ ID NO: 8484654 - DNA, 22 bp, Homo sapiens
gaggccaggggcctggagatga

SEQ ID NO: 8484655 - DNA, 22 bp, Homo sapiens
gaggagctgaggctgaggcctc

SEQ ID NO: 8484656 - DNA, 22 bp, Homo sapiens
gaggagctctgctccatccttc

SEQ ID NO: 8484657 - DNA, 22 bp, Homo sapiens
atgtacatttgtagtaatatca

SEQ ID NO: 8484658 - DNA, 22 bp, Homo sapiens
atgtacatttagatcatttctg

SEQ ID NO: 8484659 - DNA, 18 bp, Homo sapiens
atgtacatttgctaaagc

SEQ ID NO: 8484660 - DNA, 18 bp, Homo sapiens
atgtacatttgctaaagc

SEQ ID NO: 8484661 - DNA, 22 bp, Homo sapiens
atgtacattttcctaatgtttt

SEQ ID NO: 8484662 - DNA, 22 bp, Homo sapiens
atgtacatttgtagtaatatca

SEQ ID NO: 8484663 - DNA, 22 bp, Homo sapiens
atgtacattttcctaatgtttt

SEQ ID NO: 8484664 - DNA, 22 bp, Homo sapiens
gagctggggcagcttaggagtg

SEQ ID NO: 8484665 - DNA, 22 bp, Homo sapiens
gagctggggcagcttaggagtg

SEQ ID NO: 8484666 - DNA, 22 bp, Homo sapiens
gagctgggctggcttcctccct

SEQ ID NO: 8484667 - DNA, 22 bp, Homo sapiens
gagctgggctggcttcctccct

SEQ ID NO: 8484668 - DNA, 21 bp, Homo sapiens
gagctgggcgaggctccgggg

SEQ ID NO: 8484669 - DNA, 22 bp, Homo sapiens
gagctgggcgagccggggaagt

SEQ ID NO: 8484670 - DNA, 22 bp, Homo sapiens
gagctgggcctgcgagtgctgc

SEQ ID NO: 8484671 - DNA, 22 bp, Homo sapiens
gagctgggcctgcgagtgctgc

SEQ ID NO: 8484672 - DNA, 22 bp, Homo sapiens
atggtcaggcaaggagggctgg

SEQ ID NO: 8484673 - DNA, 23 bp, Homo sapiens
atggtcagaattttccagctgag

SEQ ID NO: 8484674 - DNA, 23 bp, Homo sapiens
atggtcagaattttccagctgag

SEQ ID NO: 8484675 - DNA, 22 bp, Homo sapiens
atgggttcaagtgattctcctg

SEQ ID NO: 8484676 - DNA, 22 bp, Homo sapiens
atgggttcaagtgattctcctg

SEQ ID NO: 8484677 - DNA, 22 bp, Homo sapiens
atggggctgggattctcctcgg

SEQ ID NO: 8484678 - DNA, 22 bp, Homo sapiens
atggggctctgcggctgctccc

SEQ ID NO: 8484679 - DNA, 22 bp, Homo sapiens
atggctggaggccgggcttcct

SEQ ID NO: 8484680 - DNA, 22 bp, Homo sapiens
atggctggcactggcctgggtt

SEQ ID NO: 8484681 - DNA, 22 bp, Homo sapiens
atggctggatttgatccatggg

SEQ ID NO: 8484682 - DNA, 21 bp, Homo sapiens
atggtaggtggagcaggtgat

SEQ ID NO: 8484683 - DNA, 22 bp, Homo sapiens
atggtaggtacaacagcaggca

SEQ ID NO: 8484684 - DNA, 22 bp, Homo sapiens
atggtacaattttcatttgtgg

SEQ ID NO: 8484685 - DNA, 22 bp, Homo sapiens
atggtacagataatacatgctg

SEQ ID NO: 8484686 - DNA, 22 bp, Homo sapiens
atggtacaaaatgtataaagtc

SEQ ID NO: 8484687 - DNA, 22 bp, Homo sapiens
atggcagggcagcctctcagag

SEQ ID NO: 8484688 - DNA, 22 bp, Homo sapiens
atggcagggcacagctctagtt

SEQ ID NO: 8484689 - DNA, 22 bp, Homo sapiens
atggcaggcccaggtgttcatt

SEQ ID NO: 8484690 - DNA, 22 bp, Homo sapiens
atggcagtacgttgaaaatttt

SEQ ID NO: 8484691 - DNA, 22 bp, Homo sapiens
atggcagtggaatgggatgagt

SEQ ID NO: 8484692 - DNA, 22 bp, Homo sapiens
atggcaggatacccagtccggc

SEQ ID NO: 8484693 - DNA, 22 bp, Homo sapiens
atggcaggcccaggtgttcatt

SEQ ID NO: 8484694 - DNA, 22 bp, Homo sapiens
atggcaggatgagacaacaatt

SEQ ID NO: 8484695 - DNA, 22 bp, Homo sapiens
atggcagagggattgaacagct

SEQ ID NO: 8484696 - DNA, 22 bp, Homo sapiens
gagaacactaatggtttcttaa

SEQ ID NO: 8484697 - DNA, 22 bp, Homo sapiens
gagaacacttatggattattct

SEQ ID NO: 8484698 - DNA, 22 bp, Homo sapiens
atggcagagggattgaacagct

SEQ ID NO: 8484699 - DNA, 22 bp, Homo sapiens
atggccagatgaaataatagag

SEQ ID NO: 8484700 - DNA, 22 bp, Homo sapiens
atggccagcaaggtagggcaat

SEQ ID NO: 8484701 - DNA, 22 bp, Homo sapiens
atggccagcaaggtagggcaat

SEQ ID NO: 8484702 - DNA, 22 bp, Homo sapiens
atggccagtctgttggacagca

SEQ ID NO: 8484703 - DNA, 22 bp, Homo sapiens
atggccagtctgttggacagca

SEQ ID NO: 8484704 - DNA, 22 bp, Homo sapiens
atggccagtctgttggacagca

SEQ ID NO: 8484705 - DNA, 22 bp, Homo sapiens
gagaggaaagatatatacttct

SEQ ID NO: 8484706 - DNA, 22 bp, Homo sapiens
gagaggaagccagggggtgttg

SEQ ID NO: 8484707 - DNA, 22 bp, Homo sapiens
atggcagttttagaacttttca

SEQ ID NO: 8484708 - DNA, 22 bp, Homo sapiens
atggcagtgtttcagtttttgg

SEQ ID NO: 8484709 - DNA, 22 bp, Homo sapiens
atggcagtgtttcagtttttgg

SEQ ID NO: 8484710 - DNA, 22 bp, Homo sapiens
gagagctgtccggctgagcagc

SEQ ID NO: 8484711 - DNA, 22 bp, Homo sapiens
gagagctgtggtttgaccaggc

SEQ ID NO: 8484712 - DNA, 22 bp, Homo sapiens
gagagctgtccggctgagcagc

SEQ ID NO: 8484713 - DNA, 22 bp, Homo sapiens
gagagctgtccggctgagcagc

SEQ ID NO: 8484714 - DNA, 22 bp, Homo sapiens
gagagctgtccggctgagcagc

SEQ ID NO: 8484715 - DNA, 22 bp, Homo sapiens
gagaggaaagaaccaatgaccc

SEQ ID NO: 8484716 - DNA, 22 bp, Homo sapiens
gagagctgtttatcttcttcaa

SEQ ID NO: 8484717 - DNA, 22 bp, Homo sapiens
gagagctgtttatcttcttcaa

SEQ ID NO: 8484718 - DNA, 22 bp, Homo sapiens
gagagctgtgttcattctacca

SEQ ID NO: 8484719 - DNA, 22 bp, Homo sapiens
gagagctgtgttcattctacca

SEQ ID NO: 8484720 - DNA, 22 bp, Homo sapiens
gagagctgtggtttgaccaggc

SEQ ID NO: 8484721 - DNA, 22 bp, Homo sapiens
gagagctgtggtttgaccaggc

SEQ ID NO: 8484722 - DNA, 22 bp, Homo sapiens
gagagctgtggtttgaccaggc

SEQ ID NO: 8484723 - DNA, 22 bp, Homo sapiens
gagagctgtggtttgaccaggc

SEQ ID NO: 8484724 - DNA, 22 bp, Homo sapiens
atggctgccttaattcttcagc

SEQ ID NO: 8484725 - DNA, 22 bp, Homo sapiens
atggctgcctgggcgctggccg

SEQ ID NO: 8484726 - DNA, 22 bp, Homo sapiens
atggctgcctagaggtgagatg

SEQ ID NO: 8484727 - DNA, 22 bp, Homo sapiens
gagccaggcccgtacttgctgt

SEQ ID NO: 8484728 - DNA, 22 bp, Homo sapiens
gagccaggcaccttctgtgttg

SEQ ID NO: 8484729 - DNA, 22 bp, Homo sapiens
gagccaggcaccttctgtgttg

SEQ ID NO: 8484730 - DNA, 22 bp, Homo sapiens
atggctgcccacgttggtgctt

SEQ ID NO: 8484731 - DNA, 22 bp, Homo sapiens
gagccagggctgtgagctgagc

SEQ ID NO: 8484732 - DNA, 22 bp, Homo sapiens
gagccaggaggcagagactgca

SEQ ID NO: 8484733 - DNA, 22 bp, Homo sapiens
gagccagctgagctgcactgtc

SEQ ID NO: 8484734 - DNA, 22 bp, Homo sapiens
gagccagctgagctgcactgtc

SEQ ID NO: 8484735 - DNA, 22 bp, Homo sapiens
gagccagcgccttgcctctggg

SEQ ID NO: 8484736 - DNA, 22 bp, Homo sapiens
gagccagctacatggtctgcaa

SEQ ID NO: 8484737 - DNA, 22 bp, Homo sapiens
gagccagctacatggtctgcaa

SEQ ID NO: 8484738 - DNA, 22 bp, Homo sapiens
atggccctggaaagagcttgag

SEQ ID NO: 8484739 - DNA, 22 bp, Homo sapiens
atggccctggcccagaccccac

SEQ ID NO: 8484740 - DNA, 22 bp, Homo sapiens
atggccctgccaggaggaacaa

SEQ ID NO: 8484741 - DNA, 22 bp, Homo sapiens
atggccctgctggtttgatcgt

SEQ ID NO: 8484742 - DNA, 22 bp, Homo sapiens
atggccctgctaccacttttct

SEQ ID NO: 8484743 - DNA, 22 bp, Homo sapiens
atggcccaggcctcctgtggct

SEQ ID NO: 8484744 - DNA, 22 bp, Homo sapiens
atggccctaatgagttggtgtt

SEQ ID NO: 8484745 - DNA, 22 bp, Homo sapiens
atggccctatcacctttgcttc

SEQ ID NO: 8484746 - DNA, 22 bp, Homo sapiens
atggccctgaccttgatgacct

SEQ ID NO: 8484747 - DNA, 22 bp, Homo sapiens
atggccctctccttaggtcagc

SEQ ID NO: 8484748 - DNA, 22 bp, Homo sapiens
atggccctcagtccttccttgg

SEQ ID NO: 8484749 - DNA, 22 bp, Homo sapiens
gagccagccttcttctgaggtc

SEQ ID NO: 8484750 - DNA, 22 bp, Homo sapiens
gagccagcgccttgcctctggg

SEQ ID NO: 8484751 - DNA, 22 bp, Homo sapiens
gagccagcctccgcctctctcc

SEQ ID NO: 8484752 - DNA, 22 bp, Homo sapiens
gagcagtgactggagcatgaga

SEQ ID NO: 8484753 - DNA, 22 bp, Homo sapiens
gagcagtgactggagcatgaga

SEQ ID NO: 8484754 - DNA, 22 bp, Homo sapiens
atggccagttagaaatcaaaaa

SEQ ID NO: 8484755 - DNA, 19 bp, Homo sapiens
atggccagtttagaggttt

SEQ ID NO: 8484756 - DNA, 22 bp, Homo sapiens
atggccagtgttgagatcaggc

SEQ ID NO: 8484757 - DNA, 22 bp, Homo sapiens
atggccagtgtttccctcagtt

SEQ ID NO: 8484758 - DNA, 22 bp, Homo sapiens
atggccagtgttgagatcaggc

SEQ ID NO: 8484759 - DNA, 22 bp, Homo sapiens
atggccagtctgttggacagca

SEQ ID NO: 8484760 - DNA, 22 bp, Homo sapiens
atggcccaaaacctcctccctc

SEQ ID NO: 8484761 - DNA, 19 bp, Homo sapiens
atggccagtttagaggttt

SEQ ID NO: 8484762 - DNA, 22 bp, Homo sapiens
atggaaatggagtgtgcttgct

SEQ ID NO: 8484763 - DNA, 22 bp, Homo sapiens
atggaaatgttaagtcagtccg

SEQ ID NO: 8484764 - DNA, 22 bp, Homo sapiens
atggaaatgttccatatattga

SEQ ID NO: 8484765 - DNA, 22 bp, Homo sapiens
atggaaatgttccatatattga

SEQ ID NO: 8484766 - DNA, 22 bp, Homo sapiens
atggaacatcaggttaagaaat

SEQ ID NO: 8484767 - DNA, 22 bp, Homo sapiens
atggaacatgaattaatatggt

SEQ ID NO: 8484768 - DNA, 22 bp, Homo sapiens
atggaactgagcttgccaaact

SEQ ID NO: 8484769 - DNA, 22 bp, Homo sapiens
atggaacagattaaagtgaggg

SEQ ID NO: 8484770 - DNA, 22 bp, Homo sapiens
atggaacaagaactcagattta

SEQ ID NO: 8484771 - DNA, 21 bp, Homo sapiens
atggaaattggcaaatgctac

SEQ ID NO: 8484772 - DNA, 22 bp, Homo sapiens
atgccactgcgctctagcctgg

SEQ ID NO: 8484773 - DNA, 22 bp, Homo sapiens
atgccactgcgctctagcctgg

SEQ ID NO: 8484774 - DNA, 22 bp, Homo sapiens
atgccacttcattccagcctcg

SEQ ID NO: 8484775 - DNA, 22 bp, Homo sapiens
atgccactgtactcaacaatag

SEQ ID NO: 8484776 - DNA, 22 bp, Homo sapiens
atgccactgcgctccagcctgg

SEQ ID NO: 8484777 - DNA, 22 bp, Homo sapiens
atgccactgcgctccagcctgg

SEQ ID NO: 8484778 - DNA, 22 bp, Homo sapiens
atggaaaaggctgatttcatta

SEQ ID NO: 8484779 - DNA, 22 bp, Homo sapiens
atggaaaaggctgatttcatta

SEQ ID NO: 8484780 - DNA, 22 bp, Homo sapiens
atggaaatggagggtgctagaa

SEQ ID NO: 8484781 - DNA, 22 bp, Homo sapiens
atggaaatgatggaacattaaa

SEQ ID NO: 8484782 - DNA, 22 bp, Homo sapiens
atggaaaaggctgatttcatta

SEQ ID NO: 8484783 - DNA, 22 bp, Homo sapiens
atgccacttcattccagcctcg

SEQ ID NO: 8484784 - DNA, 22 bp, Homo sapiens
gacagcaaagcagagccaaggc

SEQ ID NO: 8484785 - DNA, 22 bp, Homo sapiens
gacagcaacctcatgagaaact

SEQ ID NO: 8484786 - DNA, 22 bp, Homo sapiens
gacagcaacctcatgagaaact

SEQ ID NO: 8484787 - DNA, 22 bp, Homo sapiens
atgccactgcacttcagcttgg

SEQ ID NO: 8484788 - DNA, 22 bp, Homo sapiens
gacagcaacactcaattctgca

SEQ ID NO: 8484789 - DNA, 22 bp, Homo sapiens
gacagcaacacatgcttagtgc

SEQ ID NO: 8484790 - DNA, 22 bp, Homo sapiens
atgccactgcgctccagcctgg

SEQ ID NO: 8484791 - DNA, 22 bp, Homo sapiens
atgccactgcgctccagcctgg

SEQ ID NO: 8484792 - DNA, 22 bp, Homo sapiens
atgccactgcgctccagcctgg

SEQ ID NO: 8484793 - DNA, 22 bp, Homo sapiens
atgccactgcgctccagcctgg

SEQ ID NO: 8484794 - DNA, 22 bp, Homo sapiens
atgccactgcgctccagcctgg

SEQ ID NO: 8484795 - DNA, 22 bp, Homo sapiens
atgccactgcacttcagcttgg

SEQ ID NO: 8484796 - DNA, 22 bp, Homo sapiens
gacagagttgttgatgtatgct

SEQ ID NO: 8484797 - DNA, 22 bp, Homo sapiens
gacagagtgcagggctagaaga

SEQ ID NO: 8484798 - DNA, 22 bp, Homo sapiens
gacagagtgcagggctagaaga

SEQ ID NO: 8484799 - DNA, 22 bp, Homo sapiens
gacagagttgttgatgtatgct

SEQ ID NO: 8484800 - DNA, 23 bp, Homo sapiens
gacagagtgagaccttgtcttac

SEQ ID NO: 8484801 - DNA, 23 bp, Homo sapiens
gacagagtgagaccttgtcttac

SEQ ID NO: 8484802 - DNA, 23 bp, Homo sapiens
gacagagtgagaccttgtcttac

SEQ ID NO: 8484803 - DNA, 23 bp, Homo sapiens
gacagagtgagaccttgtcttac

SEQ ID NO: 8484804 - DNA, 23 bp, Homo sapiens
gacagagtgagaccttgtcttac

SEQ ID NO: 8484805 - DNA, 23 bp, Homo sapiens
gacagagtgagaccttgtcttac

SEQ ID NO: 8484806 - DNA, 22 bp, Homo sapiens
gacagaggcaagaccagaagcc

SEQ ID NO: 8484807 - DNA, 22 bp, Homo sapiens
gacagaggcaagaccagaagcc

SEQ ID NO: 8484808 - DNA, 22 bp, Homo sapiens
gacactgaggcatgcagagccg

SEQ ID NO: 8484809 - DNA, 23 bp, Homo sapiens
gacagagtgagaccttgtcttac

SEQ ID NO: 8484810 - DNA, 22 bp, Homo sapiens
gacagaggctggagcacctcct

SEQ ID NO: 8484811 - DNA, 22 bp, Homo sapiens
gacagaggtgtccttgagtcca

SEQ ID NO: 8484812 - DNA, 22 bp, Homo sapiens
gacagagggttccaaaattgat

SEQ ID NO: 8484813 - DNA, 22 bp, Homo sapiens
atggagagtgaaagtctctcta

SEQ ID NO: 8484814 - DNA, 22 bp, Homo sapiens
atggagagtgaaagtctctcta

SEQ ID NO: 8484815 - DNA, 22 bp, Homo sapiens
atggagagtgaaagtctctcta

SEQ ID NO: 8484816 - DNA, 22 bp, Homo sapiens
atggagagtgaaagtctctcta

SEQ ID NO: 8484817 - DNA, 22 bp, Homo sapiens
atggagagagaaggcttgctgt

SEQ ID NO: 8484818 - DNA, 22 bp, Homo sapiens
atggagagagaaggcttgctgt

SEQ ID NO: 8484819 - DNA, 22 bp, Homo sapiens
atggagagttcacttctaagtt

SEQ ID NO: 8484820 - DNA, 22 bp, Homo sapiens
atggagagttcacttctaagtt

SEQ ID NO: 8484821 - DNA, 22 bp, Homo sapiens
atggagagtgaaagtctctcta

SEQ ID NO: 8484822 - DNA, 22 bp, Homo sapiens
atggagagttcacttctaagtt

SEQ ID NO: 8484823 - DNA, 22 bp, Homo sapiens
atggagagttcacttctaagtt

SEQ ID NO: 8484824 - DNA, 22 bp, Homo sapiens
atggagcaaatggggctgcagg

SEQ ID NO: 8484825 - DNA, 22 bp, Homo sapiens
atggagccattcctgaagactt

SEQ ID NO: 8484826 - DNA, 22 bp, Homo sapiens
atggagccattcctgaagactt

SEQ ID NO: 8484827 - DNA, 22 bp, Homo sapiens
atggagcagcagaaggggcttg

SEQ ID NO: 8484828 - DNA, 23 bp, Homo sapiens
atggagctggtactagctacctc

SEQ ID NO: 8484829 - DNA, 21 bp, Homo sapiens
atggagcctaagagtggaggt

SEQ ID NO: 8484830 - DNA, 21 bp, Homo sapiens
atggagcctaagagtggaggt

SEQ ID NO: 8484831 - DNA, 22 bp, Homo sapiens
atggagctgtgtgaatattcat

SEQ ID NO: 8484832 - DNA, 20 bp, Homo sapiens
atggaggaagggcaagagaa

SEQ ID NO: 8484833 - DNA, 22 bp, Homo sapiens
gagaaatgcatgcatgtcatca

SEQ ID NO: 8484834 - DNA, 22 bp, Homo sapiens
gagaaatgagtgattcactttt

SEQ ID NO: 8484835 - DNA, 22 bp, Homo sapiens
gagaaatgcatgcatgtcatca

SEQ ID NO: 8484836 - DNA, 22 bp, Homo sapiens
gagaacacgaggaggcccagcg

SEQ ID NO: 8484837 - DNA, 22 bp, Homo sapiens
gagaacacatgcagactgggta

SEQ ID NO: 8484838 - DNA, 22 bp, Homo sapiens
gagaaatatggctcagttccac

SEQ ID NO: 8484839 - DNA, 22 bp, Homo sapiens
atggaggatgtgcagcatgggc

SEQ ID NO: 8484840 - DNA, 22 bp, Homo sapiens
gagaaagggataatttgaagag

SEQ ID NO: 8484841 - DNA, 18 bp, Homo sapiens
gagaaagtttgggcagaa

SEQ ID NO: 8484842 - DNA, 22 bp, Homo sapiens
atggaagacagataaggcagaa

SEQ ID NO: 8484843 - DNA, 22 bp, Homo sapiens
atggaagaacgctcagggttac

SEQ ID NO: 8484844 - DNA, 22 bp, Homo sapiens
atggaagaacgctcagggttac

SEQ ID NO: 8484845 - DNA, 22 bp, Homo sapiens
atggaagagtccccatggatga

SEQ ID NO: 8484846 - DNA, 22 bp, Homo sapiens
atggaagactaacagaaacatg

SEQ ID NO: 8484847 - DNA, 22 bp, Homo sapiens
atggaagactaacagaaacatg

SEQ ID NO: 8484848 - DNA, 22 bp, Homo sapiens
atggaaggtcctacagagcgca

SEQ ID NO: 8484849 - DNA, 22 bp, Homo sapiens
atggaagggacagaagggcaag

SEQ ID NO: 8484850 - DNA, 22 bp, Homo sapiens
atggaagggacagaagggcaag

SEQ ID NO: 8484851 - DNA, 22 bp, Homo sapiens
atggaagctgaaaaagacacgg

SEQ ID NO: 8484852 - DNA, 19 bp, Homo sapiens
atggaagctgggatcaatg

SEQ ID NO: 8484853 - DNA, 22 bp, Homo sapiens
atggaaggctttatgactcaaa

SEQ ID NO: 8484854 - DNA, 22 bp, Homo sapiens
atggactcactaattcctccac

SEQ ID NO: 8484855 - DNA, 22 bp, Homo sapiens
atggacagtgtgaagcagatag

SEQ ID NO: 8484856 - DNA, 22 bp, Homo sapiens
atggaatgtgaacatgatggca

SEQ ID NO: 8484857 - DNA, 22 bp, Homo sapiens
atggaatatagtcttatatctc

SEQ ID NO: 8484858 - DNA, 22 bp, Homo sapiens
atggaatatagtcttatatctc

SEQ ID NO: 8484859 - DNA, 22 bp, Homo sapiens
atggaataggctgctctttaaa

SEQ ID NO: 8484860 - DNA, 22 bp, Homo sapiens
atggaataggctgctctttaaa

SEQ ID NO: 8484861 - DNA, 22 bp, Homo sapiens
atggaagttggaaccattcata

SEQ ID NO: 8484862 - DNA, 22 bp, Homo sapiens
atggaataattgtttcacagaa

SEQ ID NO: 8484863 - DNA, 22 bp, Homo sapiens
cttggtcatttcttgtcctgtt

SEQ ID NO: 8484864 - DNA, 22 bp, Homo sapiens
cttggtcatttggggctgctat

SEQ ID NO: 8484865 - DNA, 22 bp, Homo sapiens
cttggtaaaactgtcttaaatt

SEQ ID NO: 8484866 - DNA, 22 bp, Homo sapiens
cttggctctgtgttgatgggac

SEQ ID NO: 8484867 - DNA, 22 bp, Homo sapiens
cttggcctgcccagccagaagg

SEQ ID NO: 8484868 - DNA, 22 bp, Homo sapiens
cttggcctgcaggcagcagcgc

SEQ ID NO: 8484869 - DNA, 22 bp, Homo sapiens
cttggcctcttctcagggtggg

SEQ ID NO: 8484870 - DNA, 22 bp, Homo sapiens
cttggcagctacacaggtaaga

SEQ ID NO: 8484871 - DNA, 22 bp, Homo sapiens
cttggcagcttttggaggagcc

SEQ ID NO: 8484872 - DNA, 22 bp, Homo sapiens
cttggcagagggctgggctcag

SEQ ID NO: 8484873 - DNA, 22 bp, Homo sapiens
cttggcagatccaaaaatgaca

SEQ ID NO: 8484874 - DNA, 22 bp, Homo sapiens
cttggccagacagggagctcca

SEQ ID NO: 8484875 - DNA, 22 bp, Homo sapiens
cttggcccagttgccaaggaaa

SEQ ID NO: 8484876 - DNA, 20 bp, Homo sapiens
cttggcctacttagctttgt

SEQ ID NO: 8484877 - DNA, 22 bp, Homo sapiens
cttggtgcattactcaatctgt

SEQ ID NO: 8484878 - DNA, 22 bp, Homo sapiens
cttggtctagtgagtgagcata

SEQ ID NO: 8484879 - DNA, 22 bp, Homo sapiens
cttggtctactagagaaaaaga

SEQ ID NO: 8484880 - DNA, 19 bp, Homo sapiens
cttggttatggtatgatgc

SEQ ID NO: 8484881 - DNA, 20 bp, Homo sapiens
atcttcttggccagcttgct

SEQ ID NO: 8484882 - DNA, 22 bp, Homo sapiens
atcttgaatgaatgactcttta

SEQ ID NO: 8484883 - DNA, 22 bp, Homo sapiens
atcttgaaatactttctagaat

SEQ ID NO: 8484884 - DNA, 22 bp, Homo sapiens
atcttctcaagcagcatcctgt

SEQ ID NO: 8484885 - DNA, 22 bp, Homo sapiens
atcttctcaagcagcatcctgt

SEQ ID NO: 8484886 - DNA, 22 bp, Homo sapiens
atcttctcatgtgtaatgaggt

SEQ ID NO: 8484887 - DNA, 22 bp, Homo sapiens
atcttctgatttatggagcaat

SEQ ID NO: 8484888 - DNA, 22 bp, Homo sapiens
cttgtaattataatgtactgtt

SEQ ID NO: 8484889 - DNA, 22 bp, Homo sapiens
cttgtacactcagtacttctag

SEQ ID NO: 8484890 - DNA, 22 bp, Homo sapiens
atcttcctttgccatgggatag

SEQ ID NO: 8484891 - DNA, 22 bp, Homo sapiens
atctagaggagggctgctggat

SEQ ID NO: 8484892 - DNA, 22 bp, Homo sapiens
atctagaagtggcatgaattac

SEQ ID NO: 8484893 - DNA, 22 bp, Homo sapiens
atctagcagtgttataattgga

SEQ ID NO: 8484894 - DNA, 22 bp, Homo sapiens
atctaggatttgaatgcacagt

SEQ ID NO: 8484895 - DNA, 22 bp, Homo sapiens
atctagaagtggcatgaattac

SEQ ID NO: 8484896 - DNA, 22 bp, Homo sapiens
atctagaaagtgttgaagatca

SEQ ID NO: 8484897 - DNA, 22 bp, Homo sapiens
atctacagtgcacaggacagcc

SEQ ID NO: 8484898 - DNA, 22 bp, Homo sapiens
atctacaggctgaggtgggagg

SEQ ID NO: 8484899 - DNA, 22 bp, Homo sapiens
atctacatgttgatttaaagaa

SEQ ID NO: 8484900 - DNA, 22 bp, Homo sapiens
atctacactataacagaatgct

SEQ ID NO: 8484901 - DNA, 22 bp, Homo sapiens
atctacactataacagaatgct

SEQ ID NO: 8484902 - DNA, 22 bp, Homo sapiens
atctacagctgtctgcacagta

SEQ ID NO: 8484903 - DNA, 22 bp, Homo sapiens
atctacagccagtctggtttgt

SEQ ID NO: 8484904 - DNA, 22 bp, Homo sapiens
atctacaggatagtttaatatt

SEQ ID NO: 8484905 - DNA, 22 bp, Homo sapiens
atctacaggattttacagagtt

SEQ ID NO: 8484906 - DNA, 22 bp, Homo sapiens
atctacaggattttacagagtt

SEQ ID NO: 8484907 - DNA, 22 bp, Homo sapiens
atctacaggattttacagagtt

SEQ ID NO: 8484908 - DNA, 18 bp, Homo sapiens
cttgctgagggcctcatt

SEQ ID NO: 8484909 - DNA, 22 bp, Homo sapiens
cttgctcacagtacctggcttg

SEQ ID NO: 8484910 - DNA, 22 bp, Homo sapiens
cttgctcacagtacctggcttg

SEQ ID NO: 8484911 - DNA, 22 bp, Homo sapiens
cttgctcattaagtagctcaca

SEQ ID NO: 8484912 - DNA, 22 bp, Homo sapiens
cttgccttcagtgtccctttgc

SEQ ID NO: 8484913 - DNA, 22 bp, Homo sapiens
cttgcctttgtcttcaaaggct

SEQ ID NO: 8484914 - DNA, 22 bp, Homo sapiens
cttgcctttgtcttcaaaggct

SEQ ID NO: 8484915 - DNA, 22 bp, Homo sapiens
cttgcctttgtcttcaaaggct

SEQ ID NO: 8484916 - DNA, 22 bp, Homo sapiens
cttgcctgtggctagttggctc

SEQ ID NO: 8484917 - DNA, 19 bp, Homo sapiens
cttgcctgttcctacagct

SEQ ID NO: 8484918 - DNA, 22 bp, Homo sapiens
cttgcctgggactgaggcattt

SEQ ID NO: 8484919 - DNA, 23 bp, Homo sapiens
cttgcctggcctctctgcccaga

SEQ ID NO: 8484920 - DNA, 22 bp, Homo sapiens
cttgatctacatagtgaaaccc

SEQ ID NO: 8484921 - DNA, 22 bp, Homo sapiens
cttgagtcatataaagacagag

SEQ ID NO: 8484922 - DNA, 22 bp, Homo sapiens
atctattatgctgagaaactgt

SEQ ID NO: 8484923 - DNA, 22 bp, Homo sapiens
atctatatcatggggtaaggta

SEQ ID NO: 8484924 - DNA, 22 bp, Homo sapiens
atctaggatttgaatgcacagt

SEQ ID NO: 8484925 - DNA, 22 bp, Homo sapiens
atctatacccatcatgatttaa

SEQ ID NO: 8484926 - DNA, 22 bp, Homo sapiens
atgaaaagggagtgatatttgt

SEQ ID NO: 8484927 - DNA, 22 bp, Homo sapiens
cttgtggagtgcctgctgcagt

SEQ ID NO: 8484928 - DNA, 22 bp, Homo sapiens
atgaaaagggagtgatatttgt

SEQ ID NO: 8484929 - DNA, 22 bp, Homo sapiens
cttgtggccaatgtttgttata

SEQ ID NO: 8484930 - DNA, 22 bp, Homo sapiens
cttgtggcccatggcttcctgc

SEQ ID NO: 8484931 - DNA, 22 bp, Homo sapiens
cttgtgtggtctggtcttgcta

SEQ ID NO: 8484932 - DNA, 22 bp, Homo sapiens
cttgttaaaatgccgattctga

SEQ ID NO: 8484933 - DNA, 22 bp, Homo sapiens
cttgttaaaatgcagattccaa

SEQ ID NO: 8484934 - DNA, 22 bp, Homo sapiens
cttgtgttgtacattctatggg

SEQ ID NO: 8484935 - DNA, 23 bp, Homo sapiens
cttgttataagaagactgtctgg

SEQ ID NO: 8484936 - DNA, 22 bp, Homo sapiens
cttgttaaattatataagcaga

SEQ ID NO: 8484937 - DNA, 20 bp, Homo sapiens
cttgttaaatatgcaggtag

SEQ ID NO: 8484938 - DNA, 22 bp, Homo sapiens
cttgttattggaaatgtcatgc

SEQ ID NO: 8484939 - DNA, 22 bp, Homo sapiens
cttgttatctccgtgtccttgt

SEQ ID NO: 8484940 - DNA, 22 bp, Homo sapiens
cttgttatctccgtgtccttgt

SEQ ID NO: 8484941 - DNA, 23 bp, Homo sapiens
atgaaacatcacaatggtaccat

SEQ ID NO: 8484942 - DNA, 23 bp, Homo sapiens
atgaaacatcacaatggtaccat

SEQ ID NO: 8484943 - DNA, 22 bp, Homo sapiens
atgaaatatcttgaagaaattc

SEQ ID NO: 8484944 - DNA, 22 bp, Homo sapiens
atgaaatatcttgaagaaattc

SEQ ID NO: 8484945 - DNA, 22 bp, Homo sapiens
cttgtttaagccgctgttaagc

SEQ ID NO: 8484946 - DNA, 22 bp, Homo sapiens
cttgttgggtcgtgaattctgt

SEQ ID NO: 8484947 - DNA, 22 bp, Homo sapiens
cttgtttaaataagatagcagt

SEQ ID NO: 8484948 - DNA, 22 bp, Homo sapiens
cttgttgggtcgtgaattctgt

SEQ ID NO: 8484949 - DNA, 22 bp, Homo sapiens
atgaaaacggaccagagctatt

SEQ ID NO: 8484950 - DNA, 22 bp, Homo sapiens
atgaaaacggaccagagctatt

SEQ ID NO: 8484951 - DNA, 22 bp, Homo sapiens
atgaaaactttagcctcattag

SEQ ID NO: 8484952 - DNA, 22 bp, Homo sapiens
atgaaaacggaccagagctatt

SEQ ID NO: 8484953 - DNA, 22 bp, Homo sapiens
atgaaaacggaccagagctatt

SEQ ID NO: 8484954 - DNA, 22 bp, Homo sapiens
atcttttttgtcttggtcactg

SEQ ID NO: 8484955 - DNA, 22 bp, Homo sapiens
atctttttgacatggtgatggt

SEQ ID NO: 8484956 - DNA, 22 bp, Homo sapiens
atctttttgacatggtgatggt

SEQ ID NO: 8484957 - DNA, 22 bp, Homo sapiens
atctttttatctgtttggaaca

SEQ ID NO: 8484958 - DNA, 22 bp, Homo sapiens
atctttttactaacactgctta

SEQ ID NO: 8484959 - DNA, 22 bp, Homo sapiens
atctttttactaacactgctta

SEQ ID NO: 8484960 - DNA, 22 bp, Homo sapiens
atcttgcatttgctaaaatgca

SEQ ID NO: 8484961 - DNA, 22 bp, Homo sapiens
atcttgcatttgctaaaatgca

SEQ ID NO: 8484962 - DNA, 22 bp, Homo sapiens
atcttgatcaaggctatcatga

SEQ ID NO: 8484963 - DNA, 22 bp, Homo sapiens
atcttgaatgaatgactcttta

SEQ ID NO: 8484964 - DNA, 22 bp, Homo sapiens
atcttgatcaaggctatcatga

SEQ ID NO: 8484965 - DNA, 22 bp, Homo sapiens
atcttgctgctacaaagtgccc

SEQ ID NO: 8484966 - DNA, 22 bp, Homo sapiens
atcttggattggagaaagaagt

SEQ ID NO: 8484967 - DNA, 22 bp, Homo sapiens
atcttggattgactggctctgc

SEQ ID NO: 8484968 - DNA, 22 bp, Homo sapiens
atctttgttgctctcatttctg

SEQ ID NO: 8484969 - DNA, 22 bp, Homo sapiens
atctttgttttgatgcagatct

SEQ ID NO: 8484970 - DNA, 22 bp, Homo sapiens
atcttttactacaaatcaggtg

SEQ ID NO: 8484971 - DNA, 22 bp, Homo sapiens
atcttttctgtttgctatgtct

SEQ ID NO: 8484972 - DNA, 22 bp, Homo sapiens
atcttttctgtttgctatgtct

SEQ ID NO: 8484973 - DNA, 22 bp, Homo sapiens
atcttttctgtttgctatgtct

SEQ ID NO: 8484974 - DNA, 22 bp, Homo sapiens
atgaaatgtgaatgcttttcat

SEQ ID NO: 8484975 - DNA, 22 bp, Homo sapiens
atgaaatgtctggatctttttc

SEQ ID NO: 8484976 - DNA, 22 bp, Homo sapiens
atgaaatgtctggatctttttc

SEQ ID NO: 8484977 - DNA, 22 bp, Homo sapiens
atgaaatgtatgagtctgggtt

SEQ ID NO: 8484978 - DNA, 22 bp, Homo sapiens
atgaaatgattgaaatctttac

SEQ ID NO: 8484979 - DNA, 23 bp, Homo sapiens
atgaaatgctggctcagggaggt

SEQ ID NO: 8484980 - DNA, 22 bp, Homo sapiens
atgaaatggtggttttccattt

SEQ ID NO: 8484981 - DNA, 22 bp, Homo sapiens
atgaaatggtggttttccattt

SEQ ID NO: 8484982 - DNA, 22 bp, Homo sapiens
atgaaatatcttgaagaaattc

SEQ ID NO: 8484983 - DNA, 22 bp, Homo sapiens
atgaaatatcttgaagaaattc

SEQ ID NO: 8484984 - DNA, 22 bp, Homo sapiens
atgaaatatcttgaagaaattc

SEQ ID NO: 8484985 - DNA, 22 bp, Homo sapiens
atgaaatatcttgaagaaattc

SEQ ID NO: 8484986 - DNA, 22 bp, Homo sapiens
atgaaatatcttgaagaaattc

SEQ ID NO: 8484987 - DNA, 22 bp, Homo sapiens
atgaaatatcttgaagaaattc

SEQ ID NO: 8484988 - DNA, 22 bp, Homo sapiens
atgaaatatcttgaagaaattc

SEQ ID NO: 8484989 - DNA, 22 bp, Homo sapiens
atgaaatatcttgaagaaattc

SEQ ID NO: 8484990 - DNA, 22 bp, Homo sapiens
atgaaatatcttgaagaaattc

SEQ ID NO: 8484991 - DNA, 22 bp, Homo sapiens
atgaaatgattgaaatctttac

SEQ ID NO: 8484992 - DNA, 22 bp, Homo sapiens
atgaaatgaagttggcctggct

SEQ ID NO: 8484993 - DNA, 22 bp, Homo sapiens
atgaaatattctttggtaagaa

SEQ ID NO: 8484994 - DNA, 22 bp, Homo sapiens
atgaaatattctttggtaagaa

SEQ ID NO: 8484995 - DNA, 22 bp, Homo sapiens
cttttattttgaattaagggct

SEQ ID NO: 8484996 - DNA, 22 bp, Homo sapiens
cttttattttgaattaagggct

SEQ ID NO: 8484997 - DNA, 22 bp, Homo sapiens
cttttattttgaattaagggct

SEQ ID NO: 8484998 - DNA, 22 bp, Homo sapiens
cttttattttgaattaagggct

SEQ ID NO: 8484999 - DNA, 22 bp, Homo sapiens
cttttattttgaattaagggct

SEQ ID NO: 8485000 - DNA, 22 bp, Homo sapiens
cttttattttgaattaagggct

SEQ ID NO: 8485001 - DNA, 22 bp, Homo sapiens
cttttagctgtttccatggcaa

SEQ ID NO: 8485002 - DNA, 22 bp, Homo sapiens
cttttacatttgttgaagagta

SEQ ID NO: 8485003 - DNA, 22 bp, Homo sapiens
cttttactgtgaaaagaaactg

SEQ ID NO: 8485004 - DNA, 22 bp, Homo sapiens
cttttattttgaattaagggct

SEQ ID NO: 8485005 - DNA, 22 bp, Homo sapiens
atgaaattaatcaacacataca

SEQ ID NO: 8485006 - DNA, 22 bp, Homo sapiens
atgaaattaatcaacacataca

SEQ ID NO: 8485007 - DNA, 20 bp, Homo sapiens
ctttggtgggggtagcccag

SEQ ID NO: 8485008 - DNA, 20 bp, Homo sapiens
ctttggtgggggtagcccag

SEQ ID NO: 8485009 - DNA, 22 bp, Homo sapiens
cttttacatttgttgaagagta

SEQ ID NO: 8485010 - DNA, 22 bp, Homo sapiens
cttttacatttgttgaagagta

SEQ ID NO: 8485011 - DNA, 22 bp, Homo sapiens
atgaagactaatgtgaatggga

SEQ ID NO: 8485012 - DNA, 22 bp, Homo sapiens
cttttcattgtttgtacatgca

SEQ ID NO: 8485013 - DNA, 23 bp, Homo sapiens
cttttcattgccttagcgcagag

SEQ ID NO: 8485014 - DNA, 22 bp, Homo sapiens
cttttcatgagtctgttatggg

SEQ ID NO: 8485015 - DNA, 22 bp, Homo sapiens
cttttcatgccagcccatcaca

SEQ ID NO: 8485016 - DNA, 22 bp, Homo sapiens
cttttcagagctgagatcaccg

SEQ ID NO: 8485017 - DNA, 22 bp, Homo sapiens
cttttcagagctgagatcaccg

SEQ ID NO: 8485018 - DNA, 19 bp, Homo sapiens
cttttcatcaacagccaat

SEQ ID NO: 8485019 - DNA, 19 bp, Homo sapiens
cttttcaagccatcagttt

SEQ ID NO: 8485020 - DNA, 22 bp, Homo sapiens
atgcagaaggagccatgcttgc

SEQ ID NO: 8485021 - DNA, 22 bp, Homo sapiens
atgcagaaggagccatgcttgc

SEQ ID NO: 8485022 - DNA, 22 bp, Homo sapiens
atgcagaattgctaagtatctg

SEQ ID NO: 8485023 - DNA, 22 bp, Homo sapiens
atgcagaagcagaacttacaca

SEQ ID NO: 8485024 - DNA, 22 bp, Homo sapiens
atgcacagtatgtagggtctat

SEQ ID NO: 8485025 - DNA, 22 bp, Homo sapiens
atgcacagtatgtagggtctat

SEQ ID NO: 8485026 - DNA, 22 bp, Homo sapiens
atgcacagtatgtagggtctat

SEQ ID NO: 8485027 - DNA, 22 bp, Homo sapiens
atgcacttcaagcatctctctg

SEQ ID NO: 8485028 - DNA, 23 bp, Homo sapiens
atgcagagaataacaaatgccat

SEQ ID NO: 8485029 - DNA, 22 bp, Homo sapiens
atgcagagcttccagtggcctg

SEQ ID NO: 8485030 - DNA, 22 bp, Homo sapiens
atgcagagacagatgtggcatg

SEQ ID NO: 8485031 - DNA, 19 bp, Homo sapiens
atgcagagaatggcagtag

SEQ ID NO: 8485032 - DNA, 19 bp, Homo sapiens
atgcagagaatggcagtag

SEQ ID NO: 8485033 - DNA, 22 bp, Homo sapiens
atgcagatgtttggttcattgt

SEQ ID NO: 8485034 - DNA, 22 bp, Homo sapiens
atgcaaaattaccattctgttc

SEQ ID NO: 8485035 - DNA, 22 bp, Homo sapiens
atgcaaaattaccattctgttc

SEQ ID NO: 8485036 - DNA, 20 bp, Homo sapiens
atgcaaactcacaaaatacc

SEQ ID NO: 8485037 - DNA, 22 bp, Homo sapiens
atgcaaaagtaattgcaatttt

SEQ ID NO: 8485038 - DNA, 22 bp, Homo sapiens
atgcaaaagtaattgcaatttt

SEQ ID NO: 8485039 - DNA, 22 bp, Homo sapiens
atgcaaaagtagttgcagtttt

SEQ ID NO: 8485040 - DNA, 22 bp, Homo sapiens
atgcaaaagtagttgcagtttt

SEQ ID NO: 8485041 - DNA, 22 bp, Homo sapiens
atgcaaaataaggcagaaacat

SEQ ID NO: 8485042 - DNA, 22 bp, Homo sapiens
atgcaaaataaggcagaaacat

SEQ ID NO: 8485043 - DNA, 22 bp, Homo sapiens
atgcaaaataaggcagaaacat

SEQ ID NO: 8485044 - DNA, 22 bp, Homo sapiens
atgcaaaataaggcagaaacat

SEQ ID NO: 8485045 - DNA, 22 bp, Homo sapiens
atgcaaagcacacacagaatcc

SEQ ID NO: 8485046 - DNA, 22 bp, Homo sapiens
atgcaaagcacacacagaatcc

SEQ ID NO: 8485047 - DNA, 22 bp, Homo sapiens
atgcaaagcaccacactaagat

SEQ ID NO: 8485048 - DNA, 22 bp, Homo sapiens
atgcaaagcaccacactaagat

SEQ ID NO: 8485049 - DNA, 23 bp, Homo sapiens
atgcaaagtgctgtcatgtagac

SEQ ID NO: 8485050 - DNA, 22 bp, Homo sapiens
atgcaaataaacagtctagttg

SEQ ID NO: 8485051 - DNA, 22 bp, Homo sapiens
atgcacagtacaaactggaaac

SEQ ID NO: 8485052 - DNA, 22 bp, Homo sapiens
atgcacagtaatgagctggttg

SEQ ID NO: 8485053 - DNA, 22 bp, Homo sapiens
gacactgaccccaagctgtcct

SEQ ID NO: 8485054 - DNA, 22 bp, Homo sapiens
gacactgaccccaagctgtcct

SEQ ID NO: 8485055 - DNA, 22 bp, Homo sapiens
gacactctcctccagtggatag

SEQ ID NO: 8485056 - DNA, 22 bp, Homo sapiens
atgcatttatgtgtgtacattg

SEQ ID NO: 8485057 - DNA, 22 bp, Homo sapiens
atgcattgtctggtttcatttt

SEQ ID NO: 8485058 - DNA, 22 bp, Homo sapiens
atgcattgtcaggcaatttcat

SEQ ID NO: 8485059 - DNA, 20 bp, Homo sapiens
atgcattgtgattctgtttt

SEQ ID NO: 8485060 - DNA, 20 bp, Homo sapiens
atgcattgtgattctgtttt

SEQ ID NO: 8485061 - DNA, 19 bp, Homo sapiens
atgcattgtttgaagttga

SEQ ID NO: 8485062 - DNA, 20 bp, Homo sapiens
atgcattgtgattctgtttt

SEQ ID NO: 8485063 - DNA, 19 bp, Homo sapiens
atgcattgtttgaagttga

SEQ ID NO: 8485064 - DNA, 22 bp, Homo sapiens
atgcatttatgtgtgtacattg

SEQ ID NO: 8485065 - DNA, 22 bp, Homo sapiens
atgcattctggaaagtagcaat

SEQ ID NO: 8485066 - DNA, 22 bp, Homo sapiens
atgcattgaggatgacatgagt

SEQ ID NO: 8485067 - DNA, 22 bp, Homo sapiens
atgcattgctgctttcaaaaca

SEQ ID NO: 8485068 - DNA, 22 bp, Homo sapiens
atgcattgctcaacagaataca

SEQ ID NO: 8485069 - DNA, 22 bp, Homo sapiens
atgcattgaggatgacatgagt

SEQ ID NO: 8485070 - DNA, 22 bp, Homo sapiens
atgcattgaggatgacatgagt

SEQ ID NO: 8485071 - DNA, 22 bp, Homo sapiens
atgcattgcttgagggtaggaa

SEQ ID NO: 8485072 - DNA, 22 bp, Homo sapiens
atgcattgcttgagggtaggaa

SEQ ID NO: 8485073 - DNA, 22 bp, Homo sapiens
atgcattgctgctttcaaaaca

SEQ ID NO: 8485074 - DNA, 22 bp, Homo sapiens
atgcattgctcaacagaataca

SEQ ID NO: 8485075 - DNA, 22 bp, Homo sapiens
atgcattggtcagggtcttagg

SEQ ID NO: 8485076 - DNA, 22 bp, Homo sapiens
atgcattggataagaaccccat

SEQ ID NO: 8485077 - DNA, 22 bp, Homo sapiens
atgcattgtaacgatgtgcaca

SEQ ID NO: 8485078 - DNA, 22 bp, Homo sapiens
atgcattgtaacgatgtgcaca

SEQ ID NO: 8485079 - DNA, 22 bp, Homo sapiens
atgcattgtatgaaaggaaata

SEQ ID NO: 8485080 - DNA, 22 bp, Homo sapiens
atgcattgtctggtttcatttt

SEQ ID NO: 8485081 - DNA, 22 bp, Homo sapiens
atgcattggataagaaccccat

SEQ ID NO: 8485082 - DNA, 22 bp, Homo sapiens
atgcattggtcagggtcttagg

SEQ ID NO: 8485083 - DNA, 22 bp, Homo sapiens
atgcattgtcaggcaatttcat

SEQ ID NO: 8485084 - DNA, 22 bp, Homo sapiens
atgcattgtatgaaaggaaata

SEQ ID NO: 8485085 - DNA, 22 bp, Homo sapiens
atgcatgtattcatgtgtgaca

SEQ ID NO: 8485086 - DNA, 22 bp, Homo sapiens
atgcatgtcagctgtgcccatg

SEQ ID NO: 8485087 - DNA, 22 bp, Homo sapiens
atgcatgtattatctagatgag

SEQ ID NO: 8485088 - DNA, 22 bp, Homo sapiens
atgcatgtaacagtgttatgaa

SEQ ID NO: 8485089 - DNA, 22 bp, Homo sapiens
atgcatgtttatagggtgcttc

SEQ ID NO: 8485090 - DNA, 22 bp, Homo sapiens
atgcattcagcggaatgcttag

SEQ ID NO: 8485091 - DNA, 22 bp, Homo sapiens
atgcattcagcggaatgcttag

SEQ ID NO: 8485092 - DNA, 21 bp, Homo sapiens
atgcatgttacagtatatgcc

SEQ ID NO: 8485093 - DNA, 22 bp, Homo sapiens
atgcatgttaagctcttaaaat

SEQ ID NO: 8485094 - DNA, 22 bp, Homo sapiens
atgcatgtgtgagagcaagagg

SEQ ID NO: 8485095 - DNA, 22 bp, Homo sapiens
atgcatgtgtgaattatttgac

SEQ ID NO: 8485096 - DNA, 22 bp, Homo sapiens
atgcatgtgtgagagcaagagg

SEQ ID NO: 8485097 - DNA, 22 bp, Homo sapiens
atgcatgtgtgtttacatgctt

SEQ ID NO: 8485098 - DNA, 22 bp, Homo sapiens
atgcatctatgacttagacatt

SEQ ID NO: 8485099 - DNA, 19 bp, Homo sapiens
atgcatctgcattgacagg

SEQ ID NO: 8485100 - DNA, 22 bp, Homo sapiens
atgcatcttatcaaaaattata

SEQ ID NO: 8485101 - DNA, 20 bp, Homo sapiens
atgcatctggtatctttcct

SEQ ID NO: 8485102 - DNA, 20 bp, Homo sapiens
atgcatctggtatctttcct

SEQ ID NO: 8485103 - DNA, 21 bp, Homo sapiens
atgcatctatcttctactcca

SEQ ID NO: 8485104 - DNA, 22 bp, Homo sapiens
atgcatcatggaaaactcagtt

SEQ ID NO: 8485105 - DNA, 22 bp, Homo sapiens
atgcatatgccgtagaataagt

SEQ ID NO: 8485106 - DNA, 22 bp, Homo sapiens
atgcatatgccgtagaataagt

SEQ ID NO: 8485107 - DNA, 22 bp, Homo sapiens
atgcatatgcatggacactcag

SEQ ID NO: 8485108 - DNA, 22 bp, Homo sapiens
atgcatgagaatatcccatgct

SEQ ID NO: 8485109 - DNA, 22 bp, Homo sapiens
atgcatgaaagaatccaagcct

SEQ ID NO: 8485110 - DNA, 22 bp, Homo sapiens
atgcatgaaagaatccaagcct

SEQ ID NO: 8485111 - DNA, 22 bp, Homo sapiens
atgcatgatgaacttgctttca

SEQ ID NO: 8485112 - DNA, 22 bp, Homo sapiens
atgcatgatcctgagcaaccca

SEQ ID NO: 8485113 - DNA, 22 bp, Homo sapiens
atgcatgagtcactcagtgcag

SEQ ID NO: 8485114 - DNA, 22 bp, Homo sapiens
atgcatgagctttgtgatcctg

SEQ ID NO: 8485115 - DNA, 22 bp, Homo sapiens
atgcatgatcctgagcaaccca

SEQ ID NO: 8485116 - DNA, 22 bp, Homo sapiens
atgcatgcacacactgcattgc

SEQ ID NO: 8485117 - DNA, 22 bp, Homo sapiens
atgcatgcagggaagacagtag

SEQ ID NO: 8485118 - DNA, 22 bp, Homo sapiens
atgcatgcttcttatagtactt

SEQ ID NO: 8485119 - DNA, 22 bp, Homo sapiens
atgcatgcttcttatagtactt

SEQ ID NO: 8485120 - DNA, 22 bp, Homo sapiens
atgcaggagaccaattggatgg

SEQ ID NO: 8485121 - DNA, 22 bp, Homo sapiens
atgcagcagtttacaaagcaat

SEQ ID NO: 8485122 - DNA, 22 bp, Homo sapiens
atgcagcagtttacaaagcaat

SEQ ID NO: 8485123 - DNA, 22 bp, Homo sapiens
atgaagcagcgttgtagagtga

SEQ ID NO: 8485124 - DNA, 22 bp, Homo sapiens
atgagcttcccagacaggatgg

SEQ ID NO: 8485125 - DNA, 22 bp, Homo sapiens
atgagcttccagacaaaggcat

SEQ ID NO: 8485126 - DNA, 22 bp, Homo sapiens
atgaggaacagacttgctggat

SEQ ID NO: 8485127 - DNA, 22 bp, Homo sapiens
atgagcttggtccagcaggctt

SEQ ID NO: 8485128 - DNA, 22 bp, Homo sapiens
atgaggcagatgttgcatgagg

SEQ ID NO: 8485129 - DNA, 22 bp, Homo sapiens
atgaagataagaccaggctgga

SEQ ID NO: 8485130 - DNA, 22 bp, Homo sapiens
atgaagataatagcattggttg

SEQ ID NO: 8485131 - DNA, 22 bp, Homo sapiens
atgaagataatagcattggttg

SEQ ID NO: 8485132 - DNA, 22 bp, Homo sapiens
atgaagataagaccaggctgga

SEQ ID NO: 8485133 - DNA, 22 bp, Homo sapiens
atgaagatattcttgttttctg

SEQ ID NO: 8485134 - DNA, 22 bp, Homo sapiens
atgaagatgtgaaggctggatt

SEQ ID NO: 8485135 - DNA, 22 bp, Homo sapiens
atgaagatggttcaactggcct

SEQ ID NO: 8485136 - DNA, 22 bp, Homo sapiens
atgaagcagaatttcccactct

SEQ ID NO: 8485137 - DNA, 22 bp, Homo sapiens
atgaagatttcccagagacatg

SEQ ID NO: 8485138 - DNA, 22 bp, Homo sapiens
atgaagattctatttatcactt

SEQ ID NO: 8485139 - DNA, 18 bp, Homo sapiens
gaaagatgaacttttttc

SEQ ID NO: 8485140 - DNA, 19 bp, Homo sapiens
gaaagatttcagttgagga

SEQ ID NO: 8485141 - DNA, 22 bp, Homo sapiens
gaaagcaagttgactgcagaat

SEQ ID NO: 8485142 - DNA, 22 bp, Homo sapiens
gaaagcaagttgactgcagaat

SEQ ID NO: 8485143 - DNA, 22 bp, Homo sapiens
gaaagcaatttgtgtaatctgt

SEQ ID NO: 8485144 - DNA, 22 bp, Homo sapiens
atgaggcaggtggaggctgcca

SEQ ID NO: 8485145 - DNA, 22 bp, Homo sapiens
atgaggcagtacacacaaagcc

SEQ ID NO: 8485146 - DNA, 22 bp, Homo sapiens
gaaagatatttattggcaacag

SEQ ID NO: 8485147 - DNA, 22 bp, Homo sapiens
atgaggcagctgctggagaacg

SEQ ID NO: 8485148 - DNA, 22 bp, Homo sapiens
atgaggtcttattgcagtagtt

SEQ ID NO: 8485149 - DNA, 22 bp, Homo sapiens
atgaggtctggcaatcagaaac

SEQ ID NO: 8485150 - DNA, 22 bp, Homo sapiens
atgaggtccagggaagttaaat

SEQ ID NO: 8485151 - DNA, 22 bp, Homo sapiens
atgaggtcattcttggattaca

SEQ ID NO: 8485152 - DNA, 17 bp, Homo sapiens
atgaggtcattaagata

SEQ ID NO: 8485153 - DNA, 22 bp, Homo sapiens
atgaggtcatcttgaagtaggg

SEQ ID NO: 8485154 - DNA, 22 bp, Homo sapiens
atgaggtcatcctggagtaagg

SEQ ID NO: 8485155 - DNA, 23 bp, Homo sapiens
atgaggtcagccataagacggaa

SEQ ID NO: 8485156 - DNA, 22 bp, Homo sapiens
atgaggtcacagtgtttggcat

SEQ ID NO: 8485157 - DNA, 22 bp, Homo sapiens
atgaggtattcgtaatatttcc

SEQ ID NO: 8485158 - DNA, 22 bp, Homo sapiens
atgagtcactcagcagaaaagg

SEQ ID NO: 8485159 - DNA, 22 bp, Homo sapiens
atgagtaagaccataatttttg

SEQ ID NO: 8485160 - DNA, 22 bp, Homo sapiens
atgagtaaaaccactatttaca

SEQ ID NO: 8485161 - DNA, 22 bp, Homo sapiens
atgaggttttgattggcacagg

SEQ ID NO: 8485162 - DNA, 22 bp, Homo sapiens
atgaggttatatttaattcact

SEQ ID NO: 8485163 - DNA, 22 bp, Homo sapiens
atgaggttttactgccattttc

SEQ ID NO: 8485164 - DNA, 22 bp, Homo sapiens
atgaggtttgagcctcttgacc

SEQ ID NO: 8485165 - DNA, 22 bp, Homo sapiens
atgaggttttactgccattttc

SEQ ID NO: 8485166 - DNA, 22 bp, Homo sapiens
atgaggtttaggttcctcctct

SEQ ID NO: 8485167 - DNA, 22 bp, Homo sapiens
gaaagcagctaagtcttatgat

SEQ ID NO: 8485168 - DNA, 22 bp, Homo sapiens
atgaggccacagttatagattt

SEQ ID NO: 8485169 - DNA, 22 bp, Homo sapiens
atgaggccaccttctacatttc

SEQ ID NO: 8485170 - DNA, 23 bp, Homo sapiens
atgaggtaaagatcagctttaaa

SEQ ID NO: 8485171 - DNA, 19 bp, Homo sapiens
atgaggtagcagctggtgc

SEQ ID NO: 8485172 - DNA, 22 bp, Homo sapiens
atgaggtatctcatttcctgaa

SEQ ID NO: 8485173 - DNA, 22 bp, Homo sapiens
atgaggtagtattagaaggaga

SEQ ID NO: 8485174 - DNA, 22 bp, Homo sapiens
atgaggtaatactttcagtcct

SEQ ID NO: 8485175 - DNA, 22 bp, Homo sapiens
atgaggtactagtatatacgta

SEQ ID NO: 8485176 - DNA, 22 bp, Homo sapiens
atgcaaaagtaactgtgatttt

SEQ ID NO: 8485177 - DNA, 22 bp, Homo sapiens
atgcaaaagactatttgttgct

SEQ ID NO: 8485178 - DNA, 22 bp, Homo sapiens
atgcaaaaactgcacttacgct

SEQ ID NO: 8485179 - DNA, 22 bp, Homo sapiens
atgcaaaaactgcacttacgct

SEQ ID NO: 8485180 - DNA, 20 bp, Homo sapiens
atgattttgcactaacttca

SEQ ID NO: 8485181 - DNA, 22 bp, Homo sapiens
atgattcagcccaatttttcta

SEQ ID NO: 8485182 - DNA, 22 bp, Homo sapiens
atgattcagcccaatttttcta

SEQ ID NO: 8485183 - DNA, 22 bp, Homo sapiens
atgattcaagaaaataggatgg

SEQ ID NO: 8485184 - DNA, 22 bp, Homo sapiens
atgattcagcaattttatatct

SEQ ID NO: 8485185 - DNA, 22 bp, Homo sapiens
atgattttttctaacacagtcg

SEQ ID NO: 8485186 - DNA, 20 bp, Homo sapiens
atgattttgcactaacttca

SEQ ID NO: 8485187 - DNA, 22 bp, Homo sapiens
atgagttgaagctacaagaggc

SEQ ID NO: 8485188 - DNA, 22 bp, Homo sapiens
atgataacaacagcagtgctgg

SEQ ID NO: 8485189 - DNA, 19 bp, Homo sapiens
atgatacaggtgaaaattg

SEQ ID NO: 8485190 - DNA, 22 bp, Homo sapiens
atgatacaagcaaaactaatca

SEQ ID NO: 8485191 - DNA, 23 bp, Homo sapiens
atgataatgccattaactttgat

SEQ ID NO: 8485192 - DNA, 22 bp, Homo sapiens
atgatacaagcaaaactaatca

SEQ ID NO: 8485193 - DNA, 22 bp, Homo sapiens
atgatacaagcaaaactaatca

SEQ ID NO: 8485194 - DNA, 22 bp, Homo sapiens
atgatacaagcaaaactaatca

SEQ ID NO: 8485195 - DNA, 22 bp, Homo sapiens
atgagtgtgaagttagctcagt

SEQ ID NO: 8485196 - DNA, 22 bp, Homo sapiens
atgagtgtttagaaaacactgg

SEQ ID NO: 8485197 - DNA, 22 bp, Homo sapiens
atgagtgatgggtacattggct

SEQ ID NO: 8485198 - DNA, 22 bp, Homo sapiens
atgagtgatgggtacattggct

SEQ ID NO: 8485199 - DNA, 22 bp, Homo sapiens
atgagttcaattgtttcagtca

SEQ ID NO: 8485200 - DNA, 22 bp, Homo sapiens
atgagttagtttcttgtctaga

SEQ ID NO: 8485201 - DNA, 22 bp, Homo sapiens
atgagttaggggcctgagtgga

SEQ ID NO: 8485202 - DNA, 22 bp, Homo sapiens
atgagttcattgcatttgacag

SEQ ID NO: 8485203 - DNA, 22 bp, Homo sapiens
atgagttcatactttcagtacc

SEQ ID NO: 8485204 - DNA, 22 bp, Homo sapiens
atgttttcctgggagagcactc

SEQ ID NO: 8485205 - DNA, 22 bp, Homo sapiens
atgttttccattgccatggaaa

SEQ ID NO: 8485206 - DNA, 22 bp, Homo sapiens
atgttttcaaagtaaacttgta

SEQ ID NO: 8485207 - DNA, 22 bp, Homo sapiens
atgttttattaccaacttgtac

SEQ ID NO: 8485208 - DNA, 22 bp, Homo sapiens
atgttttattaccaacttgtac

SEQ ID NO: 8485209 - DNA, 22 bp, Homo sapiens
atgttttattaccaacttgtac

SEQ ID NO: 8485210 - DNA, 22 bp, Homo sapiens
atgttttctagagtttaaaatc

SEQ ID NO: 8485211 - DNA, 22 bp, Homo sapiens
atgttttctagagtttaaaatc

SEQ ID NO: 8485212 - DNA, 20 bp, Homo sapiens
atgttttataaaagaacggg

SEQ ID NO: 8485213 - DNA, 22 bp, Homo sapiens
atgtttctgaagtttacagata

SEQ ID NO: 8485214 - DNA, 22 bp, Homo sapiens
atgttttaccctttgcacaaac

SEQ ID NO: 8485215 - DNA, 22 bp, Homo sapiens
atgttttaccctttgcacaaac

SEQ ID NO: 8485216 - DNA, 22 bp, Homo sapiens
atgttttaccctttgcacaaac

SEQ ID NO: 8485217 - DNA, 19 bp, Homo sapiens
atgttttatgctgatggga

SEQ ID NO: 8485218 - DNA, 22 bp, Homo sapiens
atgttttatattttgcagcagt

SEQ ID NO: 8485219 - DNA, 22 bp, Homo sapiens
atgttttatgcttcagatgagg

SEQ ID NO: 8485220 - DNA, 23 bp, Homo sapiens
atgttttatgtctctagctgcca

SEQ ID NO: 8485221 - DNA, 22 bp, Homo sapiens
atgttttatgttccactcaagg

SEQ ID NO: 8485222 - DNA, 22 bp, Homo sapiens
atgtgttagtttgtgattatac

SEQ ID NO: 8485223 - DNA, 22 bp, Homo sapiens
atgtgttaatgtcaaccagaaa

SEQ ID NO: 8485224 - DNA, 22 bp, Homo sapiens
atgtgttaatgagcaatgacct

SEQ ID NO: 8485225 - DNA, 22 bp, Homo sapiens
atgtgtgtgtttaatcctcaaa

SEQ ID NO: 8485226 - DNA, 22 bp, Homo sapiens
atgtgtgtgtttaatcctcaaa

SEQ ID NO: 8485227 - DNA, 22 bp, Homo sapiens
atgtgttaatgtcaaccagaaa

SEQ ID NO: 8485228 - DNA, 22 bp, Homo sapiens
atgtgtgtgtttaatcctcaaa

SEQ ID NO: 8485229 - DNA, 22 bp, Homo sapiens
atgtgtgtgtttaatcctcaaa

SEQ ID NO: 8485230 - DNA, 22 bp, Homo sapiens
atgtgtgtgtatatacacacat

SEQ ID NO: 8485231 - DNA, 22 bp, Homo sapiens
atgtgtgtgtatatacacacat

SEQ ID NO: 8485232 - DNA, 22 bp, Homo sapiens
atgtgtgtgtgcgcgcgcagga

SEQ ID NO: 8485233 - DNA, 22 bp, Homo sapiens
atgtgtgtgtatatacacacat

SEQ ID NO: 8485234 - DNA, 22 bp, Homo sapiens
atgtgtgtgtgcgcgcgcagga

SEQ ID NO: 8485235 - DNA, 22 bp, Homo sapiens
atgtgtgtgtgcgcgcgcagga

SEQ ID NO: 8485236 - DNA, 22 bp, Homo sapiens
atgtgtgtgtttaatcctcaaa

SEQ ID NO: 8485237 - DNA, 22 bp, Homo sapiens
atgtgtgtgtgcgcgcgcagga

SEQ ID NO: 8485238 - DNA, 22 bp, Homo sapiens
atgttaaaaaccagtacagttg

SEQ ID NO: 8485239 - DNA, 22 bp, Homo sapiens
atgttaaaaaccagtacagttg

SEQ ID NO: 8485240 - DNA, 20 bp, Homo sapiens
atgtttctctgtcgtgattt

SEQ ID NO: 8485241 - DNA, 18 bp, Homo sapiens
atgtttctcttggctctg

SEQ ID NO: 8485242 - DNA, 20 bp, Homo sapiens
atgtttctctgtcgtgattt

SEQ ID NO: 8485243 - DNA, 22 bp, Homo sapiens
atgtgtttttattctggcatgt

SEQ ID NO: 8485244 - DNA, 22 bp, Homo sapiens
atgtgtttttattctggcatgt

SEQ ID NO: 8485245 - DNA, 22 bp, Homo sapiens
atgtgttttggtggatcattca

SEQ ID NO: 8485246 - DNA, 22 bp, Homo sapiens
atgtgttttggtggatcattca

SEQ ID NO: 8485247 - DNA, 22 bp, Homo sapiens
atgtgttttggtaatttctgct

SEQ ID NO: 8485248 - DNA, 22 bp, Homo sapiens
atgtgttttggtaatttctgct

SEQ ID NO: 8485249 - DNA, 22 bp, Homo sapiens
atgtgttggatattagtgggga

SEQ ID NO: 8485250 - DNA, 22 bp, Homo sapiens
atgtgtttataattactcaatc

SEQ ID NO: 8485251 - DNA, 22 bp, Homo sapiens
atgtgtttggttatatggtatt

SEQ ID NO: 8485252 - DNA, 22 bp, Homo sapiens
atgtgtttgtacctttaaatat

SEQ ID NO: 8485253 - DNA, 22 bp, Homo sapiens
atgtgtttgtacctttaaatat

SEQ ID NO: 8485254 - DNA, 22 bp, Homo sapiens
attaaatactgcaggctaagca

SEQ ID NO: 8485255 - DNA, 22 bp, Homo sapiens
attaaatactgcaggctaagca

SEQ ID NO: 8485256 - DNA, 22 bp, Homo sapiens
attaaatactgcaggctaagca

SEQ ID NO: 8485257 - DNA, 22 bp, Homo sapiens
attaaatgatggcatgtcttat

SEQ ID NO: 8485258 - DNA, 22 bp, Homo sapiens
attaaatggtggtcattcattt

SEQ ID NO: 8485259 - DNA, 22 bp, Homo sapiens
attaaatggtggtcattcattt

SEQ ID NO: 8485260 - DNA, 22 bp, Homo sapiens
attaaatggtggtcattcattt

SEQ ID NO: 8485261 - DNA, 22 bp, Homo sapiens
attaaatggtggtcattcattt

SEQ ID NO: 8485262 - DNA, 22 bp, Homo sapiens
attaaatgttccttaaattata

SEQ ID NO: 8485263 - DNA, 22 bp, Homo sapiens
atgtttttgagatacaaacaga

SEQ ID NO: 8485264 - DNA, 22 bp, Homo sapiens
atgtttttgagatacaaacaga

SEQ ID NO: 8485265 - DNA, 22 bp, Homo sapiens
atgtttttgagatacaaacaga

SEQ ID NO: 8485266 - DNA, 22 bp, Homo sapiens
atgtttttcataccagtgttgg

SEQ ID NO: 8485267 - DNA, 22 bp, Homo sapiens
atgtttttaaatagacttacag

SEQ ID NO: 8485268 - DNA, 22 bp, Homo sapiens
attaaaactaaaatgcctgatt

SEQ ID NO: 8485269 - DNA, 22 bp, Homo sapiens
attaaaagcttcccaagagtta

SEQ ID NO: 8485270 - DNA, 22 bp, Homo sapiens
atgtttttggcttcaagtttct

SEQ ID NO: 8485271 - DNA, 22 bp, Homo sapiens
atgtttttggaaatgggaacat

SEQ ID NO: 8485272 - DNA, 22 bp, Homo sapiens
atgtttttgagatacaaacaga

SEQ ID NO: 8485273 - DNA, 22 bp, Homo sapiens
atgtttttggaaatgggaacat

SEQ ID NO: 8485274 - DNA, 22 bp, Homo sapiens
gatgaggtcatgttttacatat

SEQ ID NO: 8485275 - DNA, 22 bp, Homo sapiens
gatgaggtctacattgttaaaa

SEQ ID NO: 8485276 - DNA, 22 bp, Homo sapiens
gatgaggggtcattggctggga

SEQ ID NO: 8485277 - DNA, 22 bp, Homo sapiens
gatgagggcctggtggctgtgc

SEQ ID NO: 8485278 - DNA, 18 bp, Homo sapiens
gatgaggctgtctgagaa

SEQ ID NO: 8485279 - DNA, 22 bp, Homo sapiens
attaaattaagtggctaattta

SEQ ID NO: 8485280 - DNA, 22 bp, Homo sapiens
attaaattaagtggctaattta

SEQ ID NO: 8485281 - DNA, 22 bp, Homo sapiens
attaaattagcaaactgtgaaa

SEQ ID NO: 8485282 - DNA, 22 bp, Homo sapiens
attaaatgttggcatattttgt

SEQ ID NO: 8485283 - DNA, 22 bp, Homo sapiens
attaaatgttggacgtatacat

SEQ ID NO: 8485284 - DNA, 22 bp, Homo sapiens
attaaatgttggcatattttgt

SEQ ID NO: 8485285 - DNA, 22 bp, Homo sapiens
attaaatgttggacgtatacat

SEQ ID NO: 8485286 - DNA, 21 bp, Homo sapiens
gcaaggcttttgtgtttccca

SEQ ID NO: 8485287 - DNA, 22 bp, Homo sapiens
gcaaggctttgtgaattttaaa

SEQ ID NO: 8485288 - DNA, 17 bp, Homo sapiens
gcaagggatgggagatt

SEQ ID NO: 8485289 - DNA, 17 bp, Homo sapiens
gcaagggatgggagatt

SEQ ID NO: 8485290 - DNA, 17 bp, Homo sapiens
gcaagggatgggagatt

SEQ ID NO: 8485291 - DNA, 22 bp, Homo sapiens
gcaagggtgtgaaccaatgaga

SEQ ID NO: 8485292 - DNA, 22 bp, Homo sapiens
gcaagtcctttgcatgcaggga

SEQ ID NO: 8485293 - DNA, 21 bp, Homo sapiens
attagaaggtatttagggcct

SEQ ID NO: 8485294 - DNA, 22 bp, Homo sapiens
attagaagcgtgaatcctttca

SEQ ID NO: 8485295 - DNA, 22 bp, Homo sapiens
attagaatgaagtataggattt

SEQ ID NO: 8485296 - DNA, 22 bp, Homo sapiens
attagaagatagtgatttctgc

SEQ ID NO: 8485297 - DNA, 22 bp, Homo sapiens
attagaagaggctgacgaatgt

SEQ ID NO: 8485298 - DNA, 22 bp, Homo sapiens
gcaataaaatgtaatgattggg

SEQ ID NO: 8485299 - DNA, 21 bp, Homo sapiens
gcaagtgtttctgacagtggc

SEQ ID NO: 8485300 - DNA, 22 bp, Homo sapiens
gcaagttatttccatttaaagc

SEQ ID NO: 8485301 - DNA, 22 bp, Homo sapiens
attagaattatgcttgctaatg

SEQ ID NO: 8485302 - DNA, 22 bp, Homo sapiens
attagacatcatatgattcagc

SEQ ID NO: 8485303 - DNA, 22 bp, Homo sapiens
attagaatgcagggttcattgt

SEQ ID NO: 8485304 - DNA, 22 bp, Homo sapiens
attagaattatgcttgctaatg

SEQ ID NO: 8485305 - DNA, 22 bp, Homo sapiens
attagaatgcagggttcattgt

SEQ ID NO: 8485306 - DNA, 22 bp, Homo sapiens
attagaatgacagaaatgaggc

SEQ ID NO: 8485307 - DNA, 22 bp, Homo sapiens
attattcagtcttgtaaggagt

SEQ ID NO: 8485308 - DNA, 22 bp, Homo sapiens
attattcagtcttgtaaggagt

SEQ ID NO: 8485309 - DNA, 22 bp, Homo sapiens
attattcagtcttgtaaggagt

SEQ ID NO: 8485310 - DNA, 20 bp, Homo sapiens
attattcatacatgtgtgac

SEQ ID NO: 8485311 - DNA, 20 bp, Homo sapiens
attattcatacatgtgtgac

SEQ ID NO: 8485312 - DNA, 20 bp, Homo sapiens
attattcatacatgtgtgac

SEQ ID NO: 8485313 - DNA, 20 bp, Homo sapiens
attattcatacatgtgtgac

SEQ ID NO: 8485314 - DNA, 22 bp, Homo sapiens
attattcattggtaggcaagct

SEQ ID NO: 8485315 - DNA, 22 bp, Homo sapiens
attattcattggtaggcaagct

SEQ ID NO: 8485316 - DNA, 22 bp, Homo sapiens
attattcatggtcttccacaat

SEQ ID NO: 8485317 - DNA, 22 bp, Homo sapiens
attattcatggtcttccacaat

SEQ ID NO: 8485318 - DNA, 22 bp, Homo sapiens
attattcttgaggtgtttattg

SEQ ID NO: 8485319 - DNA, 22 bp, Homo sapiens
attattcaatcatattaaaagt

SEQ ID NO: 8485320 - DNA, 22 bp, Homo sapiens
attattcaatgttatttcagtg

SEQ ID NO: 8485321 - DNA, 22 bp, Homo sapiens
attattcaatgttatttcagtg

SEQ ID NO: 8485322 - DNA, 22 bp, Homo sapiens
attattcaatcatattaaaagt

SEQ ID NO: 8485323 - DNA, 22 bp, Homo sapiens
attattcaatcatattaaaagt

SEQ ID NO: 8485324 - DNA, 22 bp, Homo sapiens
attattcaatcatattaaaagt

SEQ ID NO: 8485325 - DNA, 22 bp, Homo sapiens
attagagagagcatattactgg

SEQ ID NO: 8485326 - DNA, 22 bp, Homo sapiens
attattaaaatgtgtttctctt

SEQ ID NO: 8485327 - DNA, 22 bp, Homo sapiens
attattaaagctacatcaagga

SEQ ID NO: 8485328 - DNA, 22 bp, Homo sapiens
attacaataaggtttatttgta

SEQ ID NO: 8485329 - DNA, 22 bp, Homo sapiens
attacaaaagaagggagaaggt

SEQ ID NO: 8485330 - DNA, 22 bp, Homo sapiens
attacaaaagaagggagaaggt

SEQ ID NO: 8485331 - DNA, 22 bp, Homo sapiens
attacaaaagaagggagaaggt

SEQ ID NO: 8485332 - DNA, 22 bp, Homo sapiens
attaattttacctttgtaaaca

SEQ ID NO: 8485333 - DNA, 22 bp, Homo sapiens
attacaataatacatgctcatt

SEQ ID NO: 8485334 - DNA, 22 bp, Homo sapiens
attacaataatacatgctcatt

SEQ ID NO: 8485335 - DNA, 22 bp, Homo sapiens
attacaataaggtttatttgta

SEQ ID NO: 8485336 - DNA, 22 bp, Homo sapiens
gcaacttaggagttagagcatg

SEQ ID NO: 8485337 - DNA, 22 bp, Homo sapiens
attacaataatacatgctcatt

SEQ ID NO: 8485338 - DNA, 22 bp, Homo sapiens
gcaaggctgcccacttcaaaag

SEQ ID NO: 8485339 - DNA, 22 bp, Homo sapiens
gcaaggctgctgccacccatct

SEQ ID NO: 8485340 - DNA, 22 bp, Homo sapiens
gcaaggctgtgcactttgcatt

SEQ ID NO: 8485341 - DNA, 22 bp, Homo sapiens
gcaaggctgtgcactttgcatt

SEQ ID NO: 8485342 - DNA, 22 bp, Homo sapiens
gcaaggctgggagatgaggcct

SEQ ID NO: 8485343 - DNA, 22 bp, Homo sapiens
gcaaggctgagcacatttgcat

SEQ ID NO: 8485344 - DNA, 22 bp, Homo sapiens
gcaaggctgacctctctagact

SEQ ID NO: 8485345 - DNA, 22 bp, Homo sapiens
attaatgtctaccagttgtgtg

SEQ ID NO: 8485346 - DNA, 22 bp, Homo sapiens
attaatgtgtagccaacttaat

SEQ ID NO: 8485347 - DNA, 22 bp, Homo sapiens
attaatgtgtagccaacttaat

SEQ ID NO: 8485348 - DNA, 22 bp, Homo sapiens
attaattgggaacttgttgaaa

SEQ ID NO: 8485349 - DNA, 22 bp, Homo sapiens
attaattgggaacttgttgaaa

SEQ ID NO: 8485350 - DNA, 22 bp, Homo sapiens
attaatattggttcattagctg

SEQ ID NO: 8485351 - DNA, 18 bp, Homo sapiens
attaatcataaaatgctg

SEQ ID NO: 8485352 - DNA, 22 bp, Homo sapiens
attaagatgtgggaaaatttaa

SEQ ID NO: 8485353 - DNA, 22 bp, Homo sapiens
attaagatgtgggaaaatttaa

SEQ ID NO: 8485354 - DNA, 22 bp, Homo sapiens
attaatatcctgctggctaaat

SEQ ID NO: 8485355 - DNA, 22 bp, Homo sapiens
gatgatctgaggtacatgaaac

SEQ ID NO: 8485356 - DNA, 22 bp, Homo sapiens
gatgatcatctgtaaagttaga

SEQ ID NO: 8485357 - DNA, 22 bp, Homo sapiens
gatgatcatctgtaaagttaga

SEQ ID NO: 8485358 - DNA, 22 bp, Homo sapiens
gatgatgaggccatgaggcagg

SEQ ID NO: 8485359 - DNA, 22 bp, Homo sapiens
gatgatgagataaggataactt

SEQ ID NO: 8485360 - DNA, 22 bp, Homo sapiens
gatgatgagataaggataactt

SEQ ID NO: 8485361 - DNA, 22 bp, Homo sapiens
attaagatgtgggaaaatttaa

SEQ ID NO: 8485362 - DNA, 22 bp, Homo sapiens
attgacacaatgggatgtaagg

SEQ ID NO: 8485363 - DNA, 22 bp, Homo sapiens
attgacaattctatgcagagca

SEQ ID NO: 8485364 - DNA, 22 bp, Homo sapiens
attgacaattctatgcagagca

SEQ ID NO: 8485365 - DNA, 22 bp, Homo sapiens
attgacaattagcccttaggtg

SEQ ID NO: 8485366 - DNA, 22 bp, Homo sapiens
attgacaatgtatttgtatctg

SEQ ID NO: 8485367 - DNA, 22 bp, Homo sapiens
attgacaatgtatttgtatctg

SEQ ID NO: 8485368 - DNA, 22 bp, Homo sapiens
attgacaagacaatggctctta

SEQ ID NO: 8485369 - DNA, 22 bp, Homo sapiens
attgacaaatggatgttgacat

SEQ ID NO: 8485370 - DNA, 22 bp, Homo sapiens
attgacaaatggatgttgacat

SEQ ID NO: 8485371 - DNA, 22 bp, Homo sapiens
attgacaatctactatgttctg

SEQ ID NO: 8485372 - DNA, 22 bp, Homo sapiens
attgacaagtgagctgggctgc

SEQ ID NO: 8485373 - DNA, 22 bp, Homo sapiens
attgacaagcagtatgtcttag

SEQ ID NO: 8485374 - DNA, 22 bp, Homo sapiens
attgcacttcagcctgggtgac

SEQ ID NO: 8485375 - DNA, 22 bp, Homo sapiens
attgcacttcagcctgggtgac

SEQ ID NO: 8485376 - DNA, 22 bp, Homo sapiens
attgctggcagctggatctgca

SEQ ID NO: 8485377 - DNA, 22 bp, Homo sapiens
attgctgtaaattatcttatta

SEQ ID NO: 8485378 - DNA, 22 bp, Homo sapiens
attgctggtagtcagtgtccct

SEQ ID NO: 8485379 - DNA, 22 bp, Homo sapiens
attgctgtacacttctagatct

SEQ ID NO: 8485380 - DNA, 22 bp, Homo sapiens
attgctgtggaaatataagatg

SEQ ID NO: 8485381 - DNA, 22 bp, Homo sapiens
attgcttactaatcatcttcag

SEQ ID NO: 8485382 - DNA, 22 bp, Homo sapiens
attgaagatcagggaaagattc

SEQ ID NO: 8485383 - DNA, 22 bp, Homo sapiens
attgaagattaaatgcttcctt

SEQ ID NO: 8485384 - DNA, 22 bp, Homo sapiens
attgaagattctgacatcagaa

SEQ ID NO: 8485385 - DNA, 22 bp, Homo sapiens
attgaacttaacagtaagtggc

SEQ ID NO: 8485386 - DNA, 22 bp, Homo sapiens
attgaactgttggagaggtttt

SEQ ID NO: 8485387 - DNA, 22 bp, Homo sapiens
attgaactgtctttgaagaaat

SEQ ID NO: 8485388 - DNA, 22 bp, Homo sapiens
attgaactgatatttggtgtag

SEQ ID NO: 8485389 - DNA, 22 bp, Homo sapiens
attgaactgtagtcttctgtct

SEQ ID NO: 8485390 - DNA, 22 bp, Homo sapiens
attgacaaatctgaacatacgg

SEQ ID NO: 8485391 - DNA, 22 bp, Homo sapiens
attgacaaaaacaggtggttga

SEQ ID NO: 8485392 - DNA, 22 bp, Homo sapiens
attgaatgcttgctaacacttt

SEQ ID NO: 8485393 - DNA, 22 bp, Homo sapiens
attgaatagatgcattatacta

SEQ ID NO: 8485394 - DNA, 22 bp, Homo sapiens
attgaatagatgcattatacta

SEQ ID NO: 8485395 - DNA, 22 bp, Homo sapiens
attgaagtcctaatctccagta

SEQ ID NO: 8485396 - DNA, 22 bp, Homo sapiens
attgaaaaatgactattgctta

SEQ ID NO: 8485397 - DNA, 22 bp, Homo sapiens
attcttcagcaggggacactat

SEQ ID NO: 8485398 - DNA, 22 bp, Homo sapiens
attcttcagaatatctggcact

SEQ ID NO: 8485399 - DNA, 22 bp, Homo sapiens
attcttcagaatatctggcact

SEQ ID NO: 8485400 - DNA, 20 bp, Homo sapiens
attgaaatttttctgagatt

SEQ ID NO: 8485401 - DNA, 20 bp, Homo sapiens
attgaaatttttctgagatt

SEQ ID NO: 8485402 - DNA, 20 bp, Homo sapiens
attgaaatttttctgagatt

SEQ ID NO: 8485403 - DNA, 22 bp, Homo sapiens
attgaacagaaaccatcagagt

SEQ ID NO: 8485404 - DNA, 23 bp, Homo sapiens
attgaacagagagaaaaacatcc

SEQ ID NO: 8485405 - DNA, 23 bp, Homo sapiens
attgaacagagagaaaaacatcc

SEQ ID NO: 8485406 - DNA, 22 bp, Homo sapiens
attgaacatacatatccacacc

SEQ ID NO: 8485407 - DNA, 22 bp, Homo sapiens
attgaactaaataagcagtcat

SEQ ID NO: 8485408 - DNA, 22 bp, Homo sapiens
attgaacattgttctaggaggc

SEQ ID NO: 8485409 - DNA, 22 bp, Homo sapiens
attgaactataattatgatttg

SEQ ID NO: 8485410 - DNA, 22 bp, Homo sapiens
attgaactgaatcctggattgc

SEQ ID NO: 8485411 - DNA, 22 bp, Homo sapiens
attgaactctgcaggagctgcc

SEQ ID NO: 8485412 - DNA, 22 bp, Homo sapiens
attcttaattgccatgctgtat

SEQ ID NO: 8485413 - DNA, 22 bp, Homo sapiens
attcttacaaagcagagtctgt

SEQ ID NO: 8485414 - DNA, 22 bp, Homo sapiens
attcttattatagtaaaacagt

SEQ ID NO: 8485415 - DNA, 22 bp, Homo sapiens
attcttattatagtaaaacagt

SEQ ID NO: 8485416 - DNA, 22 bp, Homo sapiens
attcttattaaatagccagaag

SEQ ID NO: 8485417 - DNA, 22 bp, Homo sapiens
attcttaaatttaggtctgtga

SEQ ID NO: 8485418 - DNA, 22 bp, Homo sapiens
attctgtgttaggatagatggt

SEQ ID NO: 8485419 - DNA, 22 bp, Homo sapiens
attcttaaatttaggtctgtga

SEQ ID NO: 8485420 - DNA, 22 bp, Homo sapiens
attcttaattccaaagactgag

SEQ ID NO: 8485421 - DNA, 22 bp, Homo sapiens
attcttaattccaaagactgag

SEQ ID NO: 8485422 - DNA, 22 bp, Homo sapiens
attcttaattgccatgctgtat

SEQ ID NO: 8485423 - DNA, 22 bp, Homo sapiens
attcttcacaaatatatagaag

SEQ ID NO: 8485424 - DNA, 22 bp, Homo sapiens
attcttcacaaatatatagaag

SEQ ID NO: 8485425 - DNA, 22 bp, Homo sapiens
attcttcaaagagtgtcaaagt

SEQ ID NO: 8485426 - DNA, 22 bp, Homo sapiens
attcttcaaagagtgtcaaagt

SEQ ID NO: 8485427 - DNA, 22 bp, Homo sapiens
attcttcaaagagtgtcaaagt

SEQ ID NO: 8485428 - DNA, 22 bp, Homo sapiens
attcttatttaaatagagtctg

SEQ ID NO: 8485429 - DNA, 22 bp, Homo sapiens
attcttcactgtttcagaatga

SEQ ID NO: 8485430 - DNA, 22 bp, Homo sapiens
attcttcactgtttcagaatga

SEQ ID NO: 8485431 - DNA, 22 bp, Homo sapiens
attcttcactgtttcagaatga

SEQ ID NO: 8485432 - DNA, 22 bp, Homo sapiens
attctggaagcaagcttttaaa

SEQ ID NO: 8485433 - DNA, 22 bp, Homo sapiens
attctggaattctaagattctg

SEQ ID NO: 8485434 - DNA, 22 bp, Homo sapiens
attctggaattctaagattctg

SEQ ID NO: 8485435 - DNA, 22 bp, Homo sapiens
attctgtctttttaaaataata

SEQ ID NO: 8485436 - DNA, 22 bp, Homo sapiens
attctgtctaagctggctacgt

SEQ ID NO: 8485437 - DNA, 22 bp, Homo sapiens
attctgtgatagttgatcctta

SEQ ID NO: 8485438 - DNA, 22 bp, Homo sapiens
attctcaaagccagagtcaacg

SEQ ID NO: 8485439 - DNA, 22 bp, Homo sapiens
attctcaatggctactttcata

SEQ ID NO: 8485440 - DNA, 22 bp, Homo sapiens
attctcaatggctactttcata

SEQ ID NO: 8485441 - DNA, 22 bp, Homo sapiens
attctcagatcttagaggaata

SEQ ID NO: 8485442 - DNA, 22 bp, Homo sapiens
attctcagctttcaaatagaca

SEQ ID NO: 8485443 - DNA, 22 bp, Homo sapiens
attctcagctttcaaatagaca

SEQ ID NO: 8485444 - DNA, 22 bp, Homo sapiens
attctattttttaagaagtagt

SEQ ID NO: 8485445 - DNA, 22 bp, Homo sapiens
attctcaaacaagtggtttgat

SEQ ID NO: 8485446 - DNA, 22 bp, Homo sapiens
attctcaaaacataacttcact

SEQ ID NO: 8485447 - DNA, 22 bp, Homo sapiens
attctatagacagaaggtcaat

SEQ ID NO: 8485448 - DNA, 22 bp, Homo sapiens
attctagtgtttccattacaag

SEQ ID NO: 8485449 - DNA, 22 bp, Homo sapiens
attctattaatatttctaggaa

SEQ ID NO: 8485450 - DNA, 22 bp, Homo sapiens
attctagatgctgtaagtagca

SEQ ID NO: 8485451 - DNA, 22 bp, Homo sapiens
attctagcagttacaggctgat

SEQ ID NO: 8485452 - DNA, 22 bp, Homo sapiens
attctagctgagtatcagcccc

SEQ ID NO: 8485453 - DNA, 22 bp, Homo sapiens
gcagagctggtacttgagcctg

SEQ ID NO: 8485454 - DNA, 22 bp, Homo sapiens
gcagagctgtctaagtcacttc

SEQ ID NO: 8485455 - DNA, 22 bp, Homo sapiens
gcagagctgtctaagtcacttc

SEQ ID NO: 8485456 - DNA, 20 bp, Homo sapiens
gcagagctgttctgtgggga

SEQ ID NO: 8485457 - DNA, 22 bp, Homo sapiens
gcagagctgttaatggagctga

SEQ ID NO: 8485458 - DNA, 22 bp, Homo sapiens
gcagagctgggtctgtatccaa

SEQ ID NO: 8485459 - DNA, 22 bp, Homo sapiens
gcagagctgggtctgtatccaa

SEQ ID NO: 8485460 - DNA, 21 bp, Homo sapiens
gcagagctggaaccaggaccc

SEQ ID NO: 8485461 - DNA, 23 bp, Homo sapiens
gcagagctgccctattgccttgg

SEQ ID NO: 8485462 - DNA, 23 bp, Homo sapiens
gcagagctgccctattgccttgg

SEQ ID NO: 8485463 - DNA, 22 bp, Homo sapiens
attcagtgggtgctcagcacaa

SEQ ID NO: 8485464 - DNA, 22 bp, Homo sapiens
attcagtgtttgcagcaacttt

SEQ ID NO: 8485465 - DNA, 22 bp, Homo sapiens
attcagttaaaaactgtacttc

SEQ ID NO: 8485466 - DNA, 22 bp, Homo sapiens
attcagttaaaaactgtacttc

SEQ ID NO: 8485467 - DNA, 22 bp, Homo sapiens
attcagttagccacagctattc

SEQ ID NO: 8485468 - DNA, 22 bp, Homo sapiens
attcagttagccacagctattc

SEQ ID NO: 8485469 - DNA, 22 bp, Homo sapiens
attcagttagccacagctattc

SEQ ID NO: 8485470 - DNA, 22 bp, Homo sapiens
attcagttagatcatcctaatt

SEQ ID NO: 8485471 - DNA, 22 bp, Homo sapiens
attcagttaagggtcttgagat

SEQ ID NO: 8485472 - DNA, 22 bp, Homo sapiens
attcagttaaaaactgtacttc

SEQ ID NO: 8485473 - DNA, 22 bp, Homo sapiens
attcagttaagggtcttgagat

SEQ ID NO: 8485474 - DNA, 22 bp, Homo sapiens
attcagttactctagacacttc

SEQ ID NO: 8485475 - DNA, 22 bp, Homo sapiens
attcagttaagggtcttgagat

SEQ ID NO: 8485476 - DNA, 22 bp, Homo sapiens
attcagttactctagacacttc

SEQ ID NO: 8485477 - DNA, 22 bp, Homo sapiens
attcagttattcagagaaggga

SEQ ID NO: 8485478 - DNA, 22 bp, Homo sapiens
attcagttatttactttgctat

SEQ ID NO: 8485479 - DNA, 22 bp, Homo sapiens
attcagttagtagatttggtca

SEQ ID NO: 8485480 - DNA, 22 bp, Homo sapiens
attcagttccttgtgattgtag

SEQ ID NO: 8485481 - DNA, 22 bp, Homo sapiens
attcagttccttgagggtatag

SEQ ID NO: 8485482 - DNA, 22 bp, Homo sapiens
attcagtcaaaccactggtcat

SEQ ID NO: 8485483 - DNA, 21 bp, Homo sapiens
attcagagtaattcatcttta

SEQ ID NO: 8485484 - DNA, 22 bp, Homo sapiens
attcagtgccaaggagaacttg

SEQ ID NO: 8485485 - DNA, 22 bp, Homo sapiens
attatttatcctcttggtctat

SEQ ID NO: 8485486 - DNA, 22 bp, Homo sapiens
attcagactgtctaaatggttt

SEQ ID NO: 8485487 - DNA, 22 bp, Homo sapiens
attatttcagtcagacactggc

SEQ ID NO: 8485488 - DNA, 22 bp, Homo sapiens
attcagagattgttattcagac

SEQ ID NO: 8485489 - DNA, 21 bp, Homo sapiens
attcagagtaattcatcttta

SEQ ID NO: 8485490 - DNA, 21 bp, Homo sapiens
attcagagtaattcatcttta

SEQ ID NO: 8485491 - DNA, 22 bp, Homo sapiens
attattgtactttcaataaggt

SEQ ID NO: 8485492 - DNA, 22 bp, Homo sapiens
attattgtactttcaataaggt

SEQ ID NO: 8485493 - DNA, 22 bp, Homo sapiens
attattgtcatcttaatcttaa

SEQ ID NO: 8485494 - DNA, 22 bp, Homo sapiens
attatttagaaatcgattgaaa

SEQ ID NO: 8485495 - DNA, 22 bp, Homo sapiens
attatttagaaatcgattgaaa

SEQ ID NO: 8485496 - DNA, 22 bp, Homo sapiens
attattgttttaatagtagaga

SEQ ID NO: 8485497 - DNA, 22 bp, Homo sapiens
attattgttgcggctgttaccg

SEQ ID NO: 8485498 - DNA, 22 bp, Homo sapiens
attcctcatttgttgagaacca

SEQ ID NO: 8485499 - DNA, 22 bp, Homo sapiens
attcctgagacttatctgtttc

SEQ ID NO: 8485500 - DNA, 22 bp, Homo sapiens
attccttctaaaacgctgccct

SEQ ID NO: 8485501 - DNA, 22 bp, Homo sapiens
attcctaaagtaatacactaga

SEQ ID NO: 8485502 - DNA, 22 bp, Homo sapiens
gcagagcttctgtccttcagga

SEQ ID NO: 8485503 - DNA, 22 bp, Homo sapiens
gcagagcttctgtccttcagga

SEQ ID NO: 8485504 - DNA, 22 bp, Homo sapiens
gcagagcttctgtccttcagga

SEQ ID NO: 8485505 - DNA, 22 bp, Homo sapiens
gcagagcttctgtccttcagga

SEQ ID NO: 8485506 - DNA, 22 bp, Homo sapiens
attcctcattatttactgagga

SEQ ID NO: 8485507 - DNA, 22 bp, Homo sapiens
attcctcattatttactgagga

SEQ ID NO: 8485508 - DNA, 22 bp, Homo sapiens
attcctcatttgttgagaacca

SEQ ID NO: 8485509 - DNA, 22 bp, Homo sapiens
attcctcatttgttgagaacca

SEQ ID NO: 8485510 - DNA, 20 bp, Homo sapiens
attcctcagccccagcctca

SEQ ID NO: 8485511 - DNA, 22 bp, Homo sapiens
attcctcagcaggccttttgtt

SEQ ID NO: 8485512 - DNA, 22 bp, Homo sapiens
attcctcaaaggtagcccatta

SEQ ID NO: 8485513 - DNA, 19 bp, Homo sapiens
attcctcaaggacagaaat

SEQ ID NO: 8485514 - DNA, 22 bp, Homo sapiens
attcctaaggaaggctggcaag

SEQ ID NO: 8485515 - DNA, 22 bp, Homo sapiens
gcagcaggcttttcataccttg

SEQ ID NO: 8485516 - DNA, 22 bp, Homo sapiens
attctacacaaagcaagaagac

SEQ ID NO: 8485517 - DNA, 22 bp, Homo sapiens
attcctttggactcctccttgc

SEQ ID NO: 8485518 - DNA, 22 bp, Homo sapiens
attctacacctctctcatttag

SEQ ID NO: 8485519 - DNA, 22 bp, Homo sapiens
attctacacaacatgatgatgg

SEQ ID NO: 8485520 - DNA, 22 bp, Homo sapiens
attctacagatgaaagcggctg

SEQ ID NO: 8485521 - DNA, 22 bp, Homo sapiens
attctacacctctctcatttag

SEQ ID NO: 8485522 - DNA, 22 bp, Homo sapiens
attctacaggactggcaatccc

SEQ ID NO: 8485523 - DNA, 22 bp, Homo sapiens
attctacatttggagtgatgtc

SEQ ID NO: 8485524 - DNA, 22 bp, Homo sapiens
attggaaatacagtagaaaaat

SEQ ID NO: 8485525 - DNA, 22 bp, Homo sapiens
attggaaatactgagagataaa

SEQ ID NO: 8485526 - DNA, 22 bp, Homo sapiens
attggaaatacagtagaaaaat

SEQ ID NO: 8485527 - DNA, 22 bp, Homo sapiens
attggagacagatgggctccag

SEQ ID NO: 8485528 - DNA, 22 bp, Homo sapiens
attgcttcaactgttcaatggg

SEQ ID NO: 8485529 - DNA, 22 bp, Homo sapiens
attgcttttgagctagaatttt

SEQ ID NO: 8485530 - DNA, 22 bp, Homo sapiens
atttaattttctcaacagtgct

SEQ ID NO: 8485531 - DNA, 22 bp, Homo sapiens
atttaattttctcaacagtgct

SEQ ID NO: 8485532 - DNA, 22 bp, Homo sapiens
atttaattttctcaacagtgct

SEQ ID NO: 8485533 - DNA, 21 bp, Homo sapiens
atttacaaaacagtcccttcc

SEQ ID NO: 8485534 - DNA, 22 bp, Homo sapiens
atttaatttgtgtctttagctg

SEQ ID NO: 8485535 - DNA, 22 bp, Homo sapiens
atttaatttgtgtctttagctg

SEQ ID NO: 8485536 - DNA, 22 bp, Homo sapiens
atttaatttatagatgtggata

SEQ ID NO: 8485537 - DNA, 22 bp, Homo sapiens
atttaatttatagatgtggata

SEQ ID NO: 8485538 - DNA, 22 bp, Homo sapiens
atttaatttggagagagaaacc

SEQ ID NO: 8485539 - DNA, 22 bp, Homo sapiens
atttaatttacatttgacagag

SEQ ID NO: 8485540 - DNA, 22 bp, Homo sapiens
atttaatttacatttgacagag

SEQ ID NO: 8485541 - DNA, 22 bp, Homo sapiens
atttaatttacatttgacagag

SEQ ID NO: 8485542 - DNA, 22 bp, Homo sapiens
atttaattaatcatggtgaatt

SEQ ID NO: 8485543 - DNA, 22 bp, Homo sapiens
atttaattgttcttctggctat

SEQ ID NO: 8485544 - DNA, 22 bp, Homo sapiens
attggcactgcacatgattgct

SEQ ID NO: 8485545 - DNA, 21 bp, Homo sapiens
attggcacaccttttattgga

SEQ ID NO: 8485546 - DNA, 22 bp, Homo sapiens
atttaaattttctgatggagag

SEQ ID NO: 8485547 - DNA, 22 bp, Homo sapiens
atttaaattttctgatggagag

SEQ ID NO: 8485548 - DNA, 22 bp, Homo sapiens
atttaatgtcgagctattgtag

SEQ ID NO: 8485549 - DNA, 22 bp, Homo sapiens
atttagaaattccaaaagtatt

SEQ ID NO: 8485550 - DNA, 22 bp, Homo sapiens
atttagaaattccaaaagtatt

SEQ ID NO: 8485551 - DNA, 22 bp, Homo sapiens
atttagaaattccaaaagtatt

SEQ ID NO: 8485552 - DNA, 22 bp, Homo sapiens
atttagaaccccttccaacctg

SEQ ID NO: 8485553 - DNA, 22 bp, Homo sapiens
atttagaactttgtttgccaat

SEQ ID NO: 8485554 - DNA, 22 bp, Homo sapiens
atttagaactttgtttgccaat

SEQ ID NO: 8485555 - DNA, 22 bp, Homo sapiens
atttagaagctaatttttcaga

SEQ ID NO: 8485556 - DNA, 22 bp, Homo sapiens
atttagaagctaatttttcaga

SEQ ID NO: 8485557 - DNA, 22 bp, Homo sapiens
atttagaaattccaaaagtatt

SEQ ID NO: 8485558 - DNA, 19 bp, Homo sapiens
atttactgcctaaaatctc

SEQ ID NO: 8485559 - DNA, 22 bp, Homo sapiens
gccaggaggggagagtgtgtca

SEQ ID NO: 8485560 - DNA, 20 bp, Homo sapiens
gccaggagggtgtgatgagc

SEQ ID NO: 8485561 - DNA, 22 bp, Homo sapiens
gccaggaggggagagtgtgtca

SEQ ID NO: 8485562 - DNA, 22 bp, Homo sapiens
gccaggaggtcagcccctcaac

SEQ ID NO: 8485563 - DNA, 23 bp, Homo sapiens
gccaggagtgggtagactaatgc

SEQ ID NO: 8485564 - DNA, 22 bp, Homo sapiens
gccaggagtgtgtggctatgtt

SEQ ID NO: 8485565 - DNA, 22 bp, Homo sapiens
atttactcgtgcttcattgaat

SEQ ID NO: 8485566 - DNA, 22 bp, Homo sapiens
atttactcgtgtctccagtgct

SEQ ID NO: 8485567 - DNA, 22 bp, Homo sapiens
gccaggagggaaaggacaattt

SEQ ID NO: 8485568 - DNA, 22 bp, Homo sapiens
gccaggagggaaaggacaattt

SEQ ID NO: 8485569 - DNA, 19 bp, Homo sapiens
gccaggagggctctggctg

SEQ ID NO: 8485570 - DNA, 19 bp, Homo sapiens
gccaggagggctctggctg

SEQ ID NO: 8485571 - DNA, 19 bp, Homo sapiens
gccaggagggctctggctg

SEQ ID NO: 8485572 - DNA, 19 bp, Homo sapiens
gccaggagggctctggctg

SEQ ID NO: 8485573 - DNA, 22 bp, Homo sapiens
gccagctggctgcaggtcccag

SEQ ID NO: 8485574 - DNA, 22 bp, Homo sapiens
gccaggaggcttaactggacag

SEQ ID NO: 8485575 - DNA, 22 bp, Homo sapiens
atttacagaagcatgtaatagc

SEQ ID NO: 8485576 - DNA, 22 bp, Homo sapiens
gccagctggagtgagagtgggc

SEQ ID NO: 8485577 - DNA, 22 bp, Homo sapiens
atttacactaaaggaaggagga

SEQ ID NO: 8485578 - DNA, 22 bp, Homo sapiens
atttacaccttcttcgattctc

SEQ ID NO: 8485579 - DNA, 22 bp, Homo sapiens
atttacactggttctcagagct

SEQ ID NO: 8485580 - DNA, 22 bp, Homo sapiens
atttacacattcataagatttc

SEQ ID NO: 8485581 - DNA, 22 bp, Homo sapiens
atttacacattcataagatttc

SEQ ID NO: 8485582 - DNA, 22 bp, Homo sapiens
atttacacattcataagatttc

SEQ ID NO: 8485583 - DNA, 22 bp, Homo sapiens
atttacagaagcatgtaatagc

SEQ ID NO: 8485584 - DNA, 22 bp, Homo sapiens
atttacagaaacttaatcatag

SEQ ID NO: 8485585 - DNA, 22 bp, Homo sapiens
atttacagaaacttaatcatag

SEQ ID NO: 8485586 - DNA, 22 bp, Homo sapiens
atttacagaaacttaatcatag

SEQ ID NO: 8485587 - DNA, 22 bp, Homo sapiens
atttacacttggtttactagag

SEQ ID NO: 8485588 - DNA, 22 bp, Homo sapiens
atttacacttggtttactagag

SEQ ID NO: 8485589 - DNA, 22 bp, Homo sapiens
atttacacttggtttactagag

SEQ ID NO: 8485590 - DNA, 22 bp, Homo sapiens
atttctacagtacacatgcatt

SEQ ID NO: 8485591 - DNA, 22 bp, Homo sapiens
atttcctttgcaaagactgtgc

SEQ ID NO: 8485592 - DNA, 18 bp, Homo sapiens
atttctactactataaag

SEQ ID NO: 8485593 - DNA, 22 bp, Homo sapiens
atttctacagtacacatgcatt

SEQ ID NO: 8485594 - DNA, 22 bp, Homo sapiens
atttctactgtgagaaacatga

SEQ ID NO: 8485595 - DNA, 22 bp, Homo sapiens
atttctagacttagaactctta

SEQ ID NO: 8485596 - DNA, 22 bp, Homo sapiens
atttctataggaggacagtatt

SEQ ID NO: 8485597 - DNA, 22 bp, Homo sapiens
atttcctttgcaaagactgtgc

SEQ ID NO: 8485598 - DNA, 22 bp, Homo sapiens
atttccttcggacagtttgggt

SEQ ID NO: 8485599 - DNA, 22 bp, Homo sapiens
atttccttcccagatttggttc

SEQ ID NO: 8485600 - DNA, 22 bp, Homo sapiens
atttcctagggtagatgtcaca

SEQ ID NO: 8485601 - DNA, 21 bp, Homo sapiens
atttcatggtgcttttaagaa

SEQ ID NO: 8485602 - DNA, 22 bp, Homo sapiens
atttcatgtgaagaagagataa

SEQ ID NO: 8485603 - DNA, 22 bp, Homo sapiens
atttcctagcctctcttgcagt

SEQ ID NO: 8485604 - DNA, 22 bp, Homo sapiens
atttcatgtgaagaagagataa

SEQ ID NO: 8485605 - DNA, 22 bp, Homo sapiens
atttcatgtgaagaagagataa

SEQ ID NO: 8485606 - DNA, 22 bp, Homo sapiens
atttcatagattgtaaatccct

SEQ ID NO: 8485607 - DNA, 22 bp, Homo sapiens
atttcatagattgtaaatccct

SEQ ID NO: 8485608 - DNA, 22 bp, Homo sapiens
atttcatatgtatcacctagcc

SEQ ID NO: 8485609 - DNA, 22 bp, Homo sapiens
atttcatgagttattatagtgg

SEQ ID NO: 8485610 - DNA, 22 bp, Homo sapiens
atttcatggcagactttaaccc

SEQ ID NO: 8485611 - DNA, 21 bp, Homo sapiens
atttcatggtgcttttaagaa

SEQ ID NO: 8485612 - DNA, 21 bp, Homo sapiens
atttcatggtgcttttaagaa

SEQ ID NO: 8485613 - DNA, 22 bp, Homo sapiens
atttcatgagttattatagtgg

SEQ ID NO: 8485614 - DNA, 22 bp, Homo sapiens
atttcaggatagcctagttttg

SEQ ID NO: 8485615 - DNA, 22 bp, Homo sapiens
atttcaggagcagtttcagtgg

SEQ ID NO: 8485616 - DNA, 22 bp, Homo sapiens
atttcagcccagtatgagcccc

SEQ ID NO: 8485617 - DNA, 22 bp, Homo sapiens
atttcagcccagtatgagcccc

SEQ ID NO: 8485618 - DNA, 22 bp, Homo sapiens
atttcagctaaaattcttaatt

SEQ ID NO: 8485619 - DNA, 22 bp, Homo sapiens
atttcagcaaagttttgattgg

SEQ ID NO: 8485620 - DNA, 22 bp, Homo sapiens
atttcagattcgagaggaagtg

SEQ ID NO: 8485621 - DNA, 22 bp, Homo sapiens
atttcagcagcccatgtttgga

SEQ ID NO: 8485622 - DNA, 22 bp, Homo sapiens
atttcagcagcccatgtttgga

SEQ ID NO: 8485623 - DNA, 22 bp, Homo sapiens
atttcaggtacctgtgggatcc

SEQ ID NO: 8485624 - DNA, 22 bp, Homo sapiens
atttcagtgttggttagcaagc

SEQ ID NO: 8485625 - DNA, 22 bp, Homo sapiens
atttcagtgtcttcttctccct

SEQ ID NO: 8485626 - DNA, 22 bp, Homo sapiens
atttcagtgttggttagcaagc

SEQ ID NO: 8485627 - DNA, 22 bp, Homo sapiens
atttcagagtgagagtgctcaa

SEQ ID NO: 8485628 - DNA, 22 bp, Homo sapiens
atttcagatgaccaaatggaaa

SEQ ID NO: 8485629 - DNA, 22 bp, Homo sapiens
atttcagagtagatcgttattt

SEQ ID NO: 8485630 - DNA, 21 bp, Homo sapiens
atttcagagcacacaagtaaa

SEQ ID NO: 8485631 - DNA, 22 bp, Homo sapiens
atttcagagctttgcagctaat

SEQ ID NO: 8485632 - DNA, 22 bp, Homo sapiens
atttcagatgaccaaatggaaa

SEQ ID NO: 8485633 - DNA, 22 bp, Homo sapiens
atttcagattcagaaatgtagg

SEQ ID NO: 8485634 - DNA, 22 bp, Homo sapiens
atttcagattcagaaatgtagg

SEQ ID NO: 8485635 - DNA, 22 bp, Homo sapiens
atttcagattcgagaggaagtg

SEQ ID NO: 8485636 - DNA, 21 bp, Homo sapiens
atttcagagcacacaagtaaa

SEQ ID NO: 8485637 - DNA, 21 bp, Homo sapiens
atttcagagcacacaagtaaa

SEQ ID NO: 8485638 - DNA, 22 bp, Homo sapiens
atttcagagaatgaacctaatc

SEQ ID NO: 8485639 - DNA, 22 bp, Homo sapiens
atttcagactgtgttggaaaat

SEQ ID NO: 8485640 - DNA, 22 bp, Homo sapiens
atttcagactgtgttggaaaat

SEQ ID NO: 8485641 - DNA, 22 bp, Homo sapiens
atttcagaatgtcctaatttag

SEQ ID NO: 8485642 - DNA, 22 bp, Homo sapiens
atttcagaatgtcctaatttag

SEQ ID NO: 8485643 - DNA, 22 bp, Homo sapiens
atttcagaatgtcctaatttag

SEQ ID NO: 8485644 - DNA, 22 bp, Homo sapiens
gccaggccactcccgggtcctg

SEQ ID NO: 8485645 - DNA, 22 bp, Homo sapiens
gccaggccactcccgggtcctg

SEQ ID NO: 8485646 - DNA, 22 bp, Homo sapiens
gccaggccctgggcacttcgtg

SEQ ID NO: 8485647 - DNA, 22 bp, Homo sapiens
gccaggcctgcaagtgctggtg

SEQ ID NO: 8485648 - DNA, 22 bp, Homo sapiens
gccaggcctgcaagtgctggtg

SEQ ID NO: 8485649 - DNA, 22 bp, Homo sapiens
gccaggcctgcaagtgctggtg

SEQ ID NO: 8485650 - DNA, 22 bp, Homo sapiens
gccaggcctgcaagtgctggtg

SEQ ID NO: 8485651 - DNA, 22 bp, Homo sapiens
atttcacaaaccatcctgattt

SEQ ID NO: 8485652 - DNA, 22 bp, Homo sapiens
atttcacaaaccatcctgattt

SEQ ID NO: 8485653 - DNA, 22 bp, Homo sapiens
atttattatgggatttggcaca

SEQ ID NO: 8485654 - DNA, 22 bp, Homo sapiens
atttattgagacttaacaaccc

SEQ ID NO: 8485655 - DNA, 22 bp, Homo sapiens
atttattgagacttaacaaccc

SEQ ID NO: 8485656 - DNA, 22 bp, Homo sapiens
atttattgagagggaggggaat

SEQ ID NO: 8485657 - DNA, 22 bp, Homo sapiens
atttattgagagggaggggaat

SEQ ID NO: 8485658 - DNA, 22 bp, Homo sapiens
atttattgagcctttcctatgt

SEQ ID NO: 8485659 - DNA, 22 bp, Homo sapiens
gccaggcattattccgatccct

SEQ ID NO: 8485660 - DNA, 22 bp, Homo sapiens
gccaggcattctagaagtagtg

SEQ ID NO: 8485661 - DNA, 22 bp, Homo sapiens
gccaggcatttgttaggtgctg

SEQ ID NO: 8485662 - DNA, 22 bp, Homo sapiens
gccaggcatttgttaggtgctg

SEQ ID NO: 8485663 - DNA, 22 bp, Homo sapiens
atttattggatgcttacttggg

SEQ ID NO: 8485664 - DNA, 22 bp, Homo sapiens
caaaactgtctagagagagaag

SEQ ID NO: 8485665 - DNA, 22 bp, Homo sapiens
caaaactgtctagagagagaag

SEQ ID NO: 8485666 - DNA, 22 bp, Homo sapiens
gcgagcctctggagtcctctgg

SEQ ID NO: 8485667 - DNA, 22 bp, Homo sapiens
gcgagcctctggagtcctctgg

SEQ ID NO: 8485668 - DNA, 22 bp, Homo sapiens
caaaacctaaacagactgtcca

SEQ ID NO: 8485669 - DNA, 22 bp, Homo sapiens
caaaactatcaggctcaaagct

SEQ ID NO: 8485670 - DNA, 22 bp, Homo sapiens
caaaactatcaggctcaaagct

SEQ ID NO: 8485671 - DNA, 22 bp, Homo sapiens
caaaacattctctgcagcaggg

SEQ ID NO: 8485672 - DNA, 22 bp, Homo sapiens
caaaacattctctgcagcaggg

SEQ ID NO: 8485673 - DNA, 22 bp, Homo sapiens
caaaaactgcaattacttttac

SEQ ID NO: 8485674 - DNA, 22 bp, Homo sapiens
caaaaactgcaattacttttac

SEQ ID NO: 8485675 - DNA, 22 bp, Homo sapiens
caaaaagcttaggtaacaagcc

SEQ ID NO: 8485676 - DNA, 22 bp, Homo sapiens
caaaacattcagagagctcact

SEQ ID NO: 8485677 - DNA, 22 bp, Homo sapiens
caaaacattcagagagctcact

SEQ ID NO: 8485678 - DNA, 22 bp, Homo sapiens
caaaacattcagagagctcact

SEQ ID NO: 8485679 - DNA, 22 bp, Homo sapiens
attttttagaacctggcctgat

SEQ ID NO: 8485680 - DNA, 22 bp, Homo sapiens
gcctgtcctatacaggcggctg

SEQ ID NO: 8485681 - DNA, 22 bp, Homo sapiens
gcctgtccactaaacagccaag

SEQ ID NO: 8485682 - DNA, 22 bp, Homo sapiens
gcctgggagtgcacagtgaggt

SEQ ID NO: 8485683 - DNA, 23 bp, Homo sapiens
gcctgggagttgcgatctgcccg

SEQ ID NO: 8485684 - DNA, 23 bp, Homo sapiens
gcctgggagttgcgatctgcccg

SEQ ID NO: 8485685 - DNA, 22 bp, Homo sapiens
gcctgggagggcagcagtgtgg

SEQ ID NO: 8485686 - DNA, 22 bp, Homo sapiens
gcctgggagggcagcagtgtgg

SEQ ID NO: 8485687 - DNA, 22 bp, Homo sapiens
gcctgggagggcagcagtgtgg

SEQ ID NO: 8485688 - DNA, 18 bp, Homo sapiens
gcctgggaggaggaaatg

SEQ ID NO: 8485689 - DNA, 18 bp, Homo sapiens
gcctgggaggaggaaatg

SEQ ID NO: 8485690 - DNA, 22 bp, Homo sapiens
gcctgggagggcagcagtgtgg

SEQ ID NO: 8485691 - DNA, 22 bp, Homo sapiens
gcctgggagtgcacagtgaggt

SEQ ID NO: 8485692 - DNA, 22 bp, Homo sapiens
gcctgggagtgcacagtgaggt

SEQ ID NO: 8485693 - DNA, 22 bp, Homo sapiens
gcctgtctgcagggctgtcatt

SEQ ID NO: 8485694 - DNA, 22 bp, Homo sapiens
gcctgtctcttggaacttggta

SEQ ID NO: 8485695 - DNA, 20 bp, Homo sapiens
gcctgtcctgagtgtcatgg

SEQ ID NO: 8485696 - DNA, 22 bp, Homo sapiens
gcctgtcctggatgctctgcaa

SEQ ID NO: 8485697 - DNA, 22 bp, Homo sapiens
gcctgtgcctcagcctgcagcc

SEQ ID NO: 8485698 - DNA, 22 bp, Homo sapiens
gcctgtgcatagcagcggactc

SEQ ID NO: 8485699 - DNA, 22 bp, Homo sapiens
gcctgtctgcgtcacgcttatt

SEQ ID NO: 8485700 - DNA, 22 bp, Homo sapiens
gcctgtgatgcccccataagta

SEQ ID NO: 8485701 - DNA, 22 bp, Homo sapiens
gcctgtgacccctccatctgct

SEQ ID NO: 8485702 - DNA, 22 bp, Homo sapiens
caaactgttctctgtgggattc

SEQ ID NO: 8485703 - DNA, 22 bp, Homo sapiens
caaactttcagttataacatga

SEQ ID NO: 8485704 - DNA, 22 bp, Homo sapiens
caaactttcagttataacatga

SEQ ID NO: 8485705 - DNA, 22 bp, Homo sapiens
caaacttttcctggaaaagatt

SEQ ID NO: 8485706 - DNA, 22 bp, Homo sapiens
caaactttgcaaaacttacagt

SEQ ID NO: 8485707 - DNA, 22 bp, Homo sapiens
gctcaggaaggctcaaccagga

SEQ ID NO: 8485708 - DNA, 22 bp, Homo sapiens
gctcaggaaggctcaaccagga

SEQ ID NO: 8485709 - DNA, 22 bp, Homo sapiens
gctcaggaaacagcagggcttg

SEQ ID NO: 8485710 - DNA, 22 bp, Homo sapiens
gctcaggaaacagcagggcttg

SEQ ID NO: 8485711 - DNA, 22 bp, Homo sapiens
caaaggcaacatatacttgttt

SEQ ID NO: 8485712 - DNA, 22 bp, Homo sapiens
caaaggtattctcattttggaa

SEQ ID NO: 8485713 - DNA, 22 bp, Homo sapiens
caaaggtattctcattttggaa

SEQ ID NO: 8485714 - DNA, 22 bp, Homo sapiens
gctcaggcaggagtgcagtggc

SEQ ID NO: 8485715 - DNA, 22 bp, Homo sapiens
gctcaggcaaatttctggtgaa

SEQ ID NO: 8485716 - DNA, 22 bp, Homo sapiens
gctcaggcaccatatgatgtgt

SEQ ID NO: 8485717 - DNA, 22 bp, Homo sapiens
gctcaggatcagccacctcttt

SEQ ID NO: 8485718 - DNA, 22 bp, Homo sapiens
gctcaggatcagccacctcttt

SEQ ID NO: 8485719 - DNA, 22 bp, Homo sapiens
gctcaggagctcttggtggcgc

SEQ ID NO: 8485720 - DNA, 22 bp, Homo sapiens
gctcaggagctgacagcctcaa

SEQ ID NO: 8485721 - DNA, 22 bp, Homo sapiens
gcgagtgccgagagggcagggc

SEQ ID NO: 8485722 - DNA, 22 bp, Homo sapiens
gcgagggcacgcggttgaaggc

SEQ ID NO: 8485723 - DNA, 22 bp, Homo sapiens
gcgaggctgggccctgcaggcg

SEQ ID NO: 8485724 - DNA, 22 bp, Homo sapiens
gcgcagagtagcagagtgctga

SEQ ID NO: 8485725 - DNA, 22 bp, Homo sapiens
gcgcacatgttcagatgtgtga

SEQ ID NO: 8485726 - DNA, 22 bp, Homo sapiens
caaacattccgcttctcccagg

SEQ ID NO: 8485727 - DNA, 22 bp, Homo sapiens
caaacctgttagaggtcatcgt

SEQ ID NO: 8485728 - DNA, 23 bp, Homo sapiens
caaacctgttctccccacatgca

SEQ ID NO: 8485729 - DNA, 23 bp, Homo sapiens
caaacctgtttctctcacctgtc

SEQ ID NO: 8485730 - DNA, 22 bp, Homo sapiens
caaaccttgcagaactgggcag

SEQ ID NO: 8485731 - DNA, 22 bp, Homo sapiens
caaaccttgtaaatgccaaact

SEQ ID NO: 8485732 - DNA, 22 bp, Homo sapiens
caaacctgactggggatgggcg

SEQ ID NO: 8485733 - DNA, 22 bp, Homo sapiens
caaacctgagaacatgtgctgt

SEQ ID NO: 8485734 - DNA, 22 bp, Homo sapiens
caaacctgctgctattttatcc

SEQ ID NO: 8485735 - DNA, 22 bp, Homo sapiens
caaacctgtccttttgtctcct

SEQ ID NO: 8485736 - DNA, 22 bp, Homo sapiens
caaactattgttcacaagacaa

SEQ ID NO: 8485737 - DNA, 22 bp, Homo sapiens
caaactatttacaatggaatca

SEQ ID NO: 8485738 - DNA, 22 bp, Homo sapiens
caaactgaacacgaaagtcttt

SEQ ID NO: 8485739 - DNA, 22 bp, Homo sapiens
caaactgagcatcagaaagttt

SEQ ID NO: 8485740 - DNA, 22 bp, Homo sapiens
caaactgagcatcagaaagttt

SEQ ID NO: 8485741 - DNA, 22 bp, Homo sapiens
gcctgggagcacatcggggtcc

SEQ ID NO: 8485742 - DNA, 22 bp, Homo sapiens
gcctgggagcacatcggggtcc

SEQ ID NO: 8485743 - DNA, 22 bp, Homo sapiens
gcctgggagcacatcggggtcc

SEQ ID NO: 8485744 - DNA, 22 bp, Homo sapiens
gcctgggagattaattaggaag

SEQ ID NO: 8485745 - DNA, 22 bp, Homo sapiens
gcctgggagattaattaggaag

SEQ ID NO: 8485746 - DNA, 22 bp, Homo sapiens
gcctgggagagggatagtgcag

SEQ ID NO: 8485747 - DNA, 22 bp, Homo sapiens
gcctgggagagggatagtgcag

SEQ ID NO: 8485748 - DNA, 22 bp, Homo sapiens
gcctgggagagggatagtgcag

SEQ ID NO: 8485749 - DNA, 22 bp, Homo sapiens
gcctggctgaggcctctgctaa

SEQ ID NO: 8485750 - DNA, 22 bp, Homo sapiens
gcctggctgaggtggggaggca

SEQ ID NO: 8485751 - DNA, 22 bp, Homo sapiens
gcctgggagaatgacctccaac

SEQ ID NO: 8485752 - DNA, 22 bp, Homo sapiens
gcctgggagagggatagtgcag

SEQ ID NO: 8485753 - DNA, 22 bp, Homo sapiens
gcctgggagagggatagtgcag

SEQ ID NO: 8485754 - DNA, 22 bp, Homo sapiens
gcctggagctctccacttgggg

SEQ ID NO: 8485755 - DNA, 22 bp, Homo sapiens
gcctggagctctccacttgggg

SEQ ID NO: 8485756 - DNA, 22 bp, Homo sapiens
gcctggagctctccacttgggg

SEQ ID NO: 8485757 - DNA, 22 bp, Homo sapiens
gcctggaggaatgtagctgagg

SEQ ID NO: 8485758 - DNA, 22 bp, Homo sapiens
gcctggagctcatgtgggcatt

SEQ ID NO: 8485759 - DNA, 22 bp, Homo sapiens
gcctggagctcatgtgggcatt

SEQ ID NO: 8485760 - DNA, 22 bp, Homo sapiens
gcctggagctcatgtgggcatt

SEQ ID NO: 8485761 - DNA, 22 bp, Homo sapiens
gcctggagctcggctgagggcg

SEQ ID NO: 8485762 - DNA, 22 bp, Homo sapiens
gcctggagctcggctgagggcg

SEQ ID NO: 8485763 - DNA, 22 bp, Homo sapiens
gcctggagctcggctgagggcg

SEQ ID NO: 8485764 - DNA, 22 bp, Homo sapiens
gcctggagctcggctgagggcg

SEQ ID NO: 8485765 - DNA, 22 bp, Homo sapiens
gcctggagctcggctgagggcg

SEQ ID NO: 8485766 - DNA, 22 bp, Homo sapiens
gcctggagctcggctgagggcg

SEQ ID NO: 8485767 - DNA, 22 bp, Homo sapiens
gcctggagctctccacttgggg

SEQ ID NO: 8485768 - DNA, 22 bp, Homo sapiens
gcctggagctcatgtgggcatt

SEQ ID NO: 8485769 - DNA, 22 bp, Homo sapiens
gcctggagctcatgtgggcatt

SEQ ID NO: 8485770 - DNA, 22 bp, Homo sapiens
gcctggagctcatgtgggcatt

SEQ ID NO: 8485771 - DNA, 22 bp, Homo sapiens
gcctggagctcatgtgggcatt

SEQ ID NO: 8485772 - DNA, 22 bp, Homo sapiens
gcctggagctcatgtgggcatt

SEQ ID NO: 8485773 - DNA, 22 bp, Homo sapiens
gcctggagctactggacactga

SEQ ID NO: 8485774 - DNA, 22 bp, Homo sapiens
gcctggagctactggacactga

SEQ ID NO: 8485775 - DNA, 22 bp, Homo sapiens
gcctggagctactggacactga

SEQ ID NO: 8485776 - DNA, 22 bp, Homo sapiens
gcctggagctactggacactga

SEQ ID NO: 8485777 - DNA, 22 bp, Homo sapiens
gcctggagctactggacactga

SEQ ID NO: 8485778 - DNA, 22 bp, Homo sapiens
gcctggagctactggacactga

SEQ ID NO: 8485779 - DNA, 22 bp, Homo sapiens
gcctgctggaggagcctcaggg

SEQ ID NO: 8485780 - DNA, 22 bp, Homo sapiens
gcctgctggatgtggccaggcc

SEQ ID NO: 8485781 - DNA, 22 bp, Homo sapiens
gcctgctgaacctcatgcagtc

SEQ ID NO: 8485782 - DNA, 22 bp, Homo sapiens
gcctgctgaacctcatgcagtc

SEQ ID NO: 8485783 - DNA, 18 bp, Homo sapiens
gcctgctctgctctcccc

SEQ ID NO: 8485784 - DNA, 22 bp, Homo sapiens
gcctgctctggaatccatgtaa

SEQ ID NO: 8485785 - DNA, 18 bp, Homo sapiens
gcctgctctgctctcccc

SEQ ID NO: 8485786 - DNA, 18 bp, Homo sapiens
gcctgcctagagcttgcc

SEQ ID NO: 8485787 - DNA, 18 bp, Homo sapiens
gcctgctctgctctcccc

SEQ ID NO: 8485788 - DNA, 18 bp, Homo sapiens
gcctgcctagagcttgcc

SEQ ID NO: 8485789 - DNA, 18 bp, Homo sapiens
gcctgcctagagcttgcc

SEQ ID NO: 8485790 - DNA, 18 bp, Homo sapiens
gcctgcctagagcttgcc

SEQ ID NO: 8485791 - DNA, 22 bp, Homo sapiens
gcctctctctacccagtatgat

SEQ ID NO: 8485792 - DNA, 22 bp, Homo sapiens
gcctctctctacccagtatgat

SEQ ID NO: 8485793 - DNA, 22 bp, Homo sapiens
gcctctctgggctgccgaggct

SEQ ID NO: 8485794 - DNA, 22 bp, Homo sapiens
gcctctctgggctgccgaggct

SEQ ID NO: 8485795 - DNA, 19 bp, Homo sapiens
gcctctgagggcaggacac

SEQ ID NO: 8485796 - DNA, 22 bp, Homo sapiens
gcctccagcccacgcaggcctg

SEQ ID NO: 8485797 - DNA, 22 bp, Homo sapiens
gcctccagggtagaggaggaag

SEQ ID NO: 8485798 - DNA, 22 bp, Homo sapiens
gcctccagggtagaggaggaag

SEQ ID NO: 8485799 - DNA, 22 bp, Homo sapiens
gcctccagtttttttctgaact

SEQ ID NO: 8485800 - DNA, 22 bp, Homo sapiens
gcctccccaaagtgctgacagc

SEQ ID NO: 8485801 - DNA, 22 bp, Homo sapiens
gcctccccaagcagcagggatt

SEQ ID NO: 8485802 - DNA, 22 bp, Homo sapiens
gcctcctgttatgccatgtgcc

SEQ ID NO: 8485803 - DNA, 21 bp, Homo sapiens
gcctctccaaatcctgccttc

SEQ ID NO: 8485804 - DNA, 22 bp, Homo sapiens
gcctcgaggctgagaaggcaca

SEQ ID NO: 8485805 - DNA, 22 bp, Homo sapiens
gcctctccgagccactgcctct

SEQ ID NO: 8485806 - DNA, 21 bp, Homo sapiens
gcctctccaaatcctgccttc

SEQ ID NO: 8485807 - DNA, 22 bp, Homo sapiens
gcctctctccttggcttgcagt

SEQ ID NO: 8485808 - DNA, 22 bp, Homo sapiens
gcctctcctggagaaggcaggg

SEQ ID NO: 8485809 - DNA, 22 bp, Homo sapiens
gcctctcctggagaaggcaggg

SEQ ID NO: 8485810 - DNA, 22 bp, Homo sapiens
gcctctccgagccactgcctct

SEQ ID NO: 8485811 - DNA, 22 bp, Homo sapiens
atttctcagcacttcctatctc

SEQ ID NO: 8485812 - DNA, 22 bp, Homo sapiens
atttctcactgagcagataaaa

SEQ ID NO: 8485813 - DNA, 22 bp, Homo sapiens
atttctcagcacttcctatctc

SEQ ID NO: 8485814 - DNA, 22 bp, Homo sapiens
atttctcagtaatctcagcaat

SEQ ID NO: 8485815 - DNA, 22 bp, Homo sapiens
atttctcagtaatctcagcaat

SEQ ID NO: 8485816 - DNA, 22 bp, Homo sapiens
atttctcactcacagtccatgt

SEQ ID NO: 8485817 - DNA, 22 bp, Homo sapiens
atttctcacaaagttgcttatc

SEQ ID NO: 8485818 - DNA, 22 bp, Homo sapiens
atttctcaccctacctcactcc

SEQ ID NO: 8485819 - DNA, 22 bp, Homo sapiens
atttctcaaccaggtcaaaaag

SEQ ID NO: 8485820 - DNA, 22 bp, Homo sapiens
atttctcagtaggtgcacagtg

SEQ ID NO: 8485821 - DNA, 22 bp, Homo sapiens
atttctcagtgaaatgacaggc

SEQ ID NO: 8485822 - DNA, 22 bp, Homo sapiens
atttctcagtgaaatgacaggc

SEQ ID NO: 8485823 - DNA, 22 bp, Homo sapiens
atttctcagtgaaatgacaggc

SEQ ID NO: 8485824 - DNA, 22 bp, Homo sapiens
atttctcagtgaaatgacaggc

SEQ ID NO: 8485825 - DNA, 22 bp, Homo sapiens
atttctcagtgaaatgacaggc

SEQ ID NO: 8485826 - DNA, 22 bp, Homo sapiens
atttctcagtgtacattatgtt

SEQ ID NO: 8485827 - DNA, 22 bp, Homo sapiens
atttctcagtgtacattatgtt

SEQ ID NO: 8485828 - DNA, 22 bp, Homo sapiens
gcctccagcccacgcaggcctg

SEQ ID NO: 8485829 - DNA, 22 bp, Homo sapiens
gcctccagcccacgcaggcctg

SEQ ID NO: 8485830 - DNA, 22 bp, Homo sapiens
gcctccagcccacgcaggcctg

SEQ ID NO: 8485831 - DNA, 21 bp, Homo sapiens
gcctccagccagatggcctcc

SEQ ID NO: 8485832 - DNA, 21 bp, Homo sapiens
gcctccagccagatggcctcc

SEQ ID NO: 8485833 - DNA, 21 bp, Homo sapiens
gcctccagccagatggcctcc

SEQ ID NO: 8485834 - DNA, 22 bp, Homo sapiens
gcctcactgcagccccaggaag

SEQ ID NO: 8485835 - DNA, 22 bp, Homo sapiens
tatctgcatctgcatgtgtatt

SEQ ID NO: 8485836 - DNA, 22 bp, Homo sapiens
tatctgatacaacagaataaca

SEQ ID NO: 8485837 - DNA, 22 bp, Homo sapiens
tatctcttgtctgttttgcaaa

SEQ ID NO: 8485838 - DNA, 22 bp, Homo sapiens
tatctctttcattttagagtca

SEQ ID NO: 8485839 - DNA, 22 bp, Homo sapiens
tatctctttattgacaataaaa

SEQ ID NO: 8485840 - DNA, 17 bp, Homo sapiens
tatctcttcaagtttca

SEQ ID NO: 8485841 - DNA, 22 bp, Homo sapiens
tatctctagcgcacagaagaaa

SEQ ID NO: 8485842 - DNA, 22 bp, Homo sapiens
tatggcaagatgacatgttctc

SEQ ID NO: 8485843 - DNA, 22 bp, Homo sapiens
tatggcaagagaatcaactgaa

SEQ ID NO: 8485844 - DNA, 22 bp, Homo sapiens
tatggcaatatgtatcaagatc

SEQ ID NO: 8485845 - DNA, 22 bp, Homo sapiens
tatggcagaggagaggcactag

SEQ ID NO: 8485846 - DNA, 22 bp, Homo sapiens
tatgcacacctgggtccttgtc

SEQ ID NO: 8485847 - DNA, 22 bp, Homo sapiens
tatgcacagaagtttgctgaat

SEQ ID NO: 8485848 - DNA, 22 bp, Homo sapiens
tatgcacacattagcacagggt

SEQ ID NO: 8485849 - DNA, 22 bp, Homo sapiens
tatgcacacatgtatgcatgtg

SEQ ID NO: 8485850 - DNA, 22 bp, Homo sapiens
tatggatgagttcctgaggagt

SEQ ID NO: 8485851 - DNA, 22 bp, Homo sapiens
tatggatggaaagggccaagct

SEQ ID NO: 8485852 - DNA, 22 bp, Homo sapiens
tatggatgtttatctacaggct

SEQ ID NO: 8485853 - DNA, 22 bp, Homo sapiens
tatgcacagttacaagaatatc

SEQ ID NO: 8485854 - DNA, 22 bp, Homo sapiens
tatgcacagttacaagaatatc

SEQ ID NO: 8485855 - DNA, 22 bp, Homo sapiens
tatggagattcaaaagcatctt

SEQ ID NO: 8485856 - DNA, 22 bp, Homo sapiens
caggtctgtgtgccatttccaa

SEQ ID NO: 8485857 - DNA, 22 bp, Homo sapiens
caggtctgtttccatcagtgct

SEQ ID NO: 8485858 - DNA, 22 bp, Homo sapiens
caggtctgtttccatcagtgct

SEQ ID NO: 8485859 - DNA, 22 bp, Homo sapiens
caggtctgttttcaaggtcagt

SEQ ID NO: 8485860 - DNA, 22 bp, Homo sapiens
caggtctggtgagagaacagtt

SEQ ID NO: 8485861 - DNA, 22 bp, Homo sapiens
caggtctgtattaacagagggt

SEQ ID NO: 8485862 - DNA, 22 bp, Homo sapiens
caggtctgttttcaaggtcagt

SEQ ID NO: 8485863 - DNA, 22 bp, Homo sapiens
caggtctgttttcaaggtcagt

SEQ ID NO: 8485864 - DNA, 22 bp, Homo sapiens
caggtgaaaaagcaaccatatt

SEQ ID NO: 8485865 - DNA, 22 bp, Homo sapiens
caggtctttgttgcagcatgga

SEQ ID NO: 8485866 - DNA, 22 bp, Homo sapiens
tatgtacatgttaaagggcaaa

SEQ ID NO: 8485867 - DNA, 22 bp, Homo sapiens
tatgtacatgttaaagggcaaa

SEQ ID NO: 8485868 - DNA, 17 bp, Homo sapiens
tatggctgtgtttgtgc

SEQ ID NO: 8485869 - DNA, 22 bp, Homo sapiens
tatggcttaaaatttcagcatg

SEQ ID NO: 8485870 - DNA, 22 bp, Homo sapiens
tatggctggaatactgaaaggc

SEQ ID NO: 8485871 - DNA, 22 bp, Homo sapiens
tatggctaattctttactgacc

SEQ ID NO: 8485872 - DNA, 22 bp, Homo sapiens
tatggcttctgctttcttgact

SEQ ID NO: 8485873 - DNA, 22 bp, Homo sapiens
caggtctgggttgatggcctgg

SEQ ID NO: 8485874 - DNA, 22 bp, Homo sapiens
tatggcttatgctgaacacctg

SEQ ID NO: 8485875 - DNA, 23 bp, Homo sapiens
tatggcttacagtgctttaggta

SEQ ID NO: 8485876 - DNA, 22 bp, Homo sapiens
tatggcttaggagagtttaact

SEQ ID NO: 8485877 - DNA, 22 bp, Homo sapiens
tatggcttctataaggaagctt

SEQ ID NO: 8485878 - DNA, 22 bp, Homo sapiens
tatggcttccaggctggccagg

SEQ ID NO: 8485879 - DNA, 22 bp, Homo sapiens
tatggcttcattgtgctccgca

SEQ ID NO: 8485880 - DNA, 22 bp, Homo sapiens
tatggcttctcagtcatgaaaa

SEQ ID NO: 8485881 - DNA, 22 bp, Homo sapiens
tattgccaaatgtctgctggaa

SEQ ID NO: 8485882 - DNA, 22 bp, Homo sapiens
tattgcctgagtgtttcataat

SEQ ID NO: 8485883 - DNA, 22 bp, Homo sapiens
tattgctttctcagacgtttag

SEQ ID NO: 8485884 - DNA, 22 bp, Homo sapiens
tattgctttgtgtcataagcaa

SEQ ID NO: 8485885 - DNA, 22 bp, Homo sapiens
tattaaagagagaatcatcatc

SEQ ID NO: 8485886 - DNA, 22 bp, Homo sapiens
tattaaagagagaatcatcatc

SEQ ID NO: 8485887 - DNA, 22 bp, Homo sapiens
tattaaagagagaatcatcatc

SEQ ID NO: 8485888 - DNA, 22 bp, Homo sapiens
tattaaagagagaatcatcatc

SEQ ID NO: 8485889 - DNA, 22 bp, Homo sapiens
tattaaagggaagttatgcatg

SEQ ID NO: 8485890 - DNA, 22 bp, Homo sapiens
tatgtttttcaagtgcacacta

SEQ ID NO: 8485891 - DNA, 22 bp, Homo sapiens
tattaaatatatctgttagttg

SEQ ID NO: 8485892 - DNA, 22 bp, Homo sapiens
tattaaatatatctgttagttg

SEQ ID NO: 8485893 - DNA, 22 bp, Homo sapiens
tattaaatatatctgttagttg

SEQ ID NO: 8485894 - DNA, 22 bp, Homo sapiens
tatgtttttaagagaatgcatt

SEQ ID NO: 8485895 - DNA, 22 bp, Homo sapiens
tatgtgtattgagcattgttac

SEQ ID NO: 8485896 - DNA, 22 bp, Homo sapiens
tatgtgtatgttcattcatgca

SEQ ID NO: 8485897 - DNA, 19 bp, Homo sapiens
tatgtgtatatgtatctgt

SEQ ID NO: 8485898 - DNA, 22 bp, Homo sapiens
tatgtgtattgagcattgttac

SEQ ID NO: 8485899 - DNA, 22 bp, Homo sapiens
tatgtactaactttcattctag

SEQ ID NO: 8485900 - DNA, 22 bp, Homo sapiens
tatgtggaaaatgcacttaaaa

SEQ ID NO: 8485901 - DNA, 22 bp, Homo sapiens
tatgtggccttttatgtctgac

SEQ ID NO: 8485902 - DNA, 22 bp, Homo sapiens
tatgtggccattctgtttgtgt

SEQ ID NO: 8485903 - DNA, 22 bp, Homo sapiens
tatgtgtaatcaaacacatgct

SEQ ID NO: 8485904 - DNA, 22 bp, Homo sapiens
tatgtgtaatcatatctgatac

SEQ ID NO: 8485905 - DNA, 22 bp, Homo sapiens
tatgtgtaaccttgtgatttat

SEQ ID NO: 8485906 - DNA, 23 bp, Homo sapiens
tatgtgtaaggagaaggagtgag

SEQ ID NO: 8485907 - DNA, 22 bp, Homo sapiens
tatgtgtatacctatacatgtg

SEQ ID NO: 8485908 - DNA, 22 bp, Homo sapiens
tatgtgtatatctgtatgtgca

SEQ ID NO: 8485909 - DNA, 22 bp, Homo sapiens
tatgtgtaggaggaggacaggg

SEQ ID NO: 8485910 - DNA, 22 bp, Homo sapiens
tatgtgtacatctggttgagca

SEQ ID NO: 8485911 - DNA, 22 bp, Homo sapiens
tataatcctgcttcacattgaa

SEQ ID NO: 8485912 - DNA, 22 bp, Homo sapiens
tataatcctgcttcacattgaa

SEQ ID NO: 8485913 - DNA, 22 bp, Homo sapiens
tataatccattcattgatttct

SEQ ID NO: 8485914 - DNA, 22 bp, Homo sapiens
tataatccattcattgatttct

SEQ ID NO: 8485915 - DNA, 22 bp, Homo sapiens
tataatccattcattgatttct

SEQ ID NO: 8485916 - DNA, 22 bp, Homo sapiens
tataattagtaaatggcagatt

SEQ ID NO: 8485917 - DNA, 22 bp, Homo sapiens
tataatctggttttattaagag

SEQ ID NO: 8485918 - DNA, 22 bp, Homo sapiens
caggggcaagaatgctgtcagc

SEQ ID NO: 8485919 - DNA, 22 bp, Homo sapiens
tataagcacatccttgactgat

SEQ ID NO: 8485920 - DNA, 22 bp, Homo sapiens
tataagtagttgttgaagactt

SEQ ID NO: 8485921 - DNA, 22 bp, Homo sapiens
tataagtagttgttgaagactt

SEQ ID NO: 8485922 - DNA, 22 bp, Homo sapiens
tataagtgacagattatccaaa

SEQ ID NO: 8485923 - DNA, 22 bp, Homo sapiens
tataagtctggcatatgtatgc

SEQ ID NO: 8485924 - DNA, 22 bp, Homo sapiens
tataatatgaggcaggagtgat

SEQ ID NO: 8485925 - DNA, 22 bp, Homo sapiens
tataagtgtagtttcaaatgtt

SEQ ID NO: 8485926 - DNA, 22 bp, Homo sapiens
tagttttagtcccattttacag

SEQ ID NO: 8485927 - DNA, 22 bp, Homo sapiens
tacatgtgttctgtttcaagtt

SEQ ID NO: 8485928 - DNA, 17 bp, Homo sapiens
tacatgtgtatctgatt

SEQ ID NO: 8485929 - DNA, 17 bp, Homo sapiens
tacatgtgtatctgatt

SEQ ID NO: 8485930 - DNA, 22 bp, Homo sapiens
tacatgtggtagggagggcagt

SEQ ID NO: 8485931 - DNA, 22 bp, Homo sapiens
tagttttagtcccattttacag

SEQ ID NO: 8485932 - DNA, 22 bp, Homo sapiens
tataagaaacaaggcaaatttt

SEQ ID NO: 8485933 - DNA, 22 bp, Homo sapiens
tataagaaattgccaacctgtt

SEQ ID NO: 8485934 - DNA, 22 bp, Homo sapiens
caggggcaggtgtgagatcatc

SEQ ID NO: 8485935 - DNA, 22 bp, Homo sapiens
caggggcaggtgtgagatcatc

SEQ ID NO: 8485936 - DNA, 22 bp, Homo sapiens
caggggcagtctgtgtgcgtgg

SEQ ID NO: 8485937 - DNA, 22 bp, Homo sapiens
caggggcagtctgtgtgcgtgg

SEQ ID NO: 8485938 - DNA, 22 bp, Homo sapiens
caggggcagtctgtgtgcgtgg

SEQ ID NO: 8485939 - DNA, 22 bp, Homo sapiens
caggggccaagggtccagacct

SEQ ID NO: 8485940 - DNA, 22 bp, Homo sapiens
caggggccaggctgtctgctgt

SEQ ID NO: 8485941 - DNA, 22 bp, Homo sapiens
caggggccaggctgtctgctgt

SEQ ID NO: 8485942 - DNA, 22 bp, Homo sapiens
caggggccggctgtccgtgccc

SEQ ID NO: 8485943 - DNA, 22 bp, Homo sapiens
caggggccggctgtccgtgccc

SEQ ID NO: 8485944 - DNA, 22 bp, Homo sapiens
caggggccggctgtccgtgccc

SEQ ID NO: 8485945 - DNA, 22 bp, Homo sapiens
caggggccggctgtccgtgccc

SEQ ID NO: 8485946 - DNA, 22 bp, Homo sapiens
caggggccggctgtccgtgccc

SEQ ID NO: 8485947 - DNA, 22 bp, Homo sapiens
caggggccaggctgtctgctgt

SEQ ID NO: 8485948 - DNA, 22 bp, Homo sapiens
caggggccaagggtccagacct

SEQ ID NO: 8485949 - DNA, 22 bp, Homo sapiens
caggggccaagggtccagacct

SEQ ID NO: 8485950 - DNA, 22 bp, Homo sapiens
cagggtcttataaggccaattt

SEQ ID NO: 8485951 - DNA, 22 bp, Homo sapiens
caggggcctgtcctggcttctg

SEQ ID NO: 8485952 - DNA, 22 bp, Homo sapiens
cagggtgcttccgtggagctgt

SEQ ID NO: 8485953 - DNA, 22 bp, Homo sapiens
cagggtcttataaggccaattt

SEQ ID NO: 8485954 - DNA, 22 bp, Homo sapiens
caggggcctggctgtctaggaa

SEQ ID NO: 8485955 - DNA, 22 bp, Homo sapiens
caggggcctggctgtctaggaa

SEQ ID NO: 8485956 - DNA, 22 bp, Homo sapiens
caggggcctggctgtctaggaa

SEQ ID NO: 8485957 - DNA, 22 bp, Homo sapiens
cagggtggaagctgtagagtgg

SEQ ID NO: 8485958 - DNA, 22 bp, Homo sapiens
cagggtggaacaggcaatactt

SEQ ID NO: 8485959 - DNA, 22 bp, Homo sapiens
cagggtggaagctgtagagtgg

SEQ ID NO: 8485960 - DNA, 22 bp, Homo sapiens
cagggtggaagctgtagagtgg

SEQ ID NO: 8485961 - DNA, 22 bp, Homo sapiens
cagggtggaacaggcaatactt

SEQ ID NO: 8485962 - DNA, 22 bp, Homo sapiens
cagggtgcttccgtggagctgt

SEQ ID NO: 8485963 - DNA, 22 bp, Homo sapiens
cagggtggaaaagctagttgga

SEQ ID NO: 8485964 - DNA, 22 bp, Homo sapiens
cagggtggaaaagctagttgga

SEQ ID NO: 8485965 - DNA, 17 bp, Homo sapiens
caggtctgaggccaggc

SEQ ID NO: 8485966 - DNA, 22 bp, Homo sapiens
caggtctgcagacagggccatg

SEQ ID NO: 8485967 - DNA, 22 bp, Homo sapiens
caggtctgcagacagggccatg

SEQ ID NO: 8485968 - DNA, 22 bp, Homo sapiens
caggtctgcagacagggccatg

SEQ ID NO: 8485969 - DNA, 22 bp, Homo sapiens
tatctataatgttttacttcct

SEQ ID NO: 8485970 - DNA, 22 bp, Homo sapiens
tatctattccaaatatcagcgt

SEQ ID NO: 8485971 - DNA, 22 bp, Homo sapiens
tatctattatgttctatgtgtc

SEQ ID NO: 8485972 - DNA, 22 bp, Homo sapiens
tatctatgtgctctgacctctc

SEQ ID NO: 8485973 - DNA, 22 bp, Homo sapiens
caggtctcgggttcagcagtga

SEQ ID NO: 8485974 - DNA, 22 bp, Homo sapiens
caggtctcgggttcagcagtga

SEQ ID NO: 8485975 - DNA, 22 bp, Homo sapiens
caggtctcttttgtcacaccac

SEQ ID NO: 8485976 - DNA, 22 bp, Homo sapiens
caggtctctgcagcccctctgt

SEQ ID NO: 8485977 - DNA, 17 bp, Homo sapiens
caggtctgaggccaggc

SEQ ID NO: 8485978 - DNA, 22 bp, Homo sapiens
caggtctgaagagtcacatgcc

SEQ ID NO: 8485979 - DNA, 22 bp, Homo sapiens
caggtctccagctcagggtcca

SEQ ID NO: 8485980 - DNA, 22 bp, Homo sapiens
caggtctccagctcagggtcca

SEQ ID NO: 8485981 - DNA, 22 bp, Homo sapiens
caggtctcccatcccctctgtt

SEQ ID NO: 8485982 - DNA, 22 bp, Homo sapiens
caggtctcccatcccctctgtt

SEQ ID NO: 8485983 - DNA, 22 bp, Homo sapiens
caggtccacggcgcccaggggt

SEQ ID NO: 8485984 - DNA, 22 bp, Homo sapiens
tatacagatggaaagatacaca

SEQ ID NO: 8485985 - DNA, 22 bp, Homo sapiens
tatacagatggaaagatacaca

SEQ ID NO: 8485986 - DNA, 22 bp, Homo sapiens
cagggtggcactcagcgcatct

SEQ ID NO: 8485987 - DNA, 22 bp, Homo sapiens
cagggtggcacatcacagcatt

SEQ ID NO: 8485988 - DNA, 22 bp, Homo sapiens
cagggtggaagctgtagagtgg

SEQ ID NO: 8485989 - DNA, 22 bp, Homo sapiens
cagggtggaatggaatgctggc

SEQ ID NO: 8485990 - DNA, 22 bp, Homo sapiens
cagggtggaatggaatgctggc

SEQ ID NO: 8485991 - DNA, 22 bp, Homo sapiens
cagggtggaatggaatgctggc

SEQ ID NO: 8485992 - DNA, 22 bp, Homo sapiens
cagggtggcacatcacagcatt

SEQ ID NO: 8485993 - DNA, 22 bp, Homo sapiens
tatacagattaacagatttaaa

SEQ ID NO: 8485994 - DNA, 22 bp, Homo sapiens
tatacagtatcttttgaaggca

SEQ ID NO: 8485995 - DNA, 22 bp, Homo sapiens
tatacagtcttttgctatattc

SEQ ID NO: 8485996 - DNA, 22 bp, Homo sapiens
tatacagtgcctcttccattag

SEQ ID NO: 8485997 - DNA, 22 bp, Homo sapiens
tatacagttaagtttcttcagt

SEQ ID NO: 8485998 - DNA, 22 bp, Homo sapiens
tatacagttaagtttcttcagt

SEQ ID NO: 8485999 - DNA, 22 bp, Homo sapiens
tatacagtcttttgctatattc

SEQ ID NO: 8486000 - DNA, 22 bp, Homo sapiens
cagtcctggggaccaggctgag

SEQ ID NO: 8486001 - DNA, 22 bp, Homo sapiens
cagtcctggggaccaggctgag

SEQ ID NO: 8486002 - DNA, 22 bp, Homo sapiens
cagtcctggggaccaggctgag

SEQ ID NO: 8486003 - DNA, 22 bp, Homo sapiens
cagtcctgggtgcagcaggaaa

SEQ ID NO: 8486004 - DNA, 22 bp, Homo sapiens
cagtcctgggcaggtcaggcca

SEQ ID NO: 8486005 - DNA, 22 bp, Homo sapiens
cagtcctctcactcaggccttt

SEQ ID NO: 8486006 - DNA, 22 bp, Homo sapiens
cagtcctctcactcaggccttt

SEQ ID NO: 8486007 - DNA, 22 bp, Homo sapiens
cagtcctgggcacagccctggg

SEQ ID NO: 8486008 - DNA, 22 bp, Homo sapiens
cagtcctctctgtgtctgcacc

SEQ ID NO: 8486009 - DNA, 22 bp, Homo sapiens
cagtcctctctgtgtctgcacc

SEQ ID NO: 8486010 - DNA, 22 bp, Homo sapiens
cagtcctgtgttaaacaagagc

SEQ ID NO: 8486011 - DNA, 22 bp, Homo sapiens
cagtcctgtgtcccttggtggg

SEQ ID NO: 8486012 - DNA, 22 bp, Homo sapiens
cagtccttaaggaaacatttgt

SEQ ID NO: 8486013 - DNA, 22 bp, Homo sapiens
cagtccttaaggaaacatttgt

SEQ ID NO: 8486014 - DNA, 22 bp, Homo sapiens
cagtccttagattttactgcca

SEQ ID NO: 8486015 - DNA, 22 bp, Homo sapiens
cagtcctgttcctggagtagtt

SEQ ID NO: 8486016 - DNA, 22 bp, Homo sapiens
cagtccttgctctgggatgatg

SEQ ID NO: 8486017 - DNA, 22 bp, Homo sapiens
cagtccttggcaagttctcagt

SEQ ID NO: 8486018 - DNA, 22 bp, Homo sapiens
cagtccttggcaagttctcagt

SEQ ID NO: 8486019 - DNA, 22 bp, Homo sapiens
cagtccttgctatgaccctgag

SEQ ID NO: 8486020 - DNA, 22 bp, Homo sapiens
cagtccttgctcaaagtctaca

SEQ ID NO: 8486021 - DNA, 22 bp, Homo sapiens
cagtccttgctatgaccctgag

SEQ ID NO: 8486022 - DNA, 22 bp, Homo sapiens
cagtccttgatccaatagtggg

SEQ ID NO: 8486023 - DNA, 22 bp, Homo sapiens
cagtccttattcctatattcct

SEQ ID NO: 8486024 - DNA, 22 bp, Homo sapiens
cagtccttagtctggatggctt

SEQ ID NO: 8486025 - DNA, 22 bp, Homo sapiens
cagtccttagattttactgcca

SEQ ID NO: 8486026 - DNA, 22 bp, Homo sapiens
cagtccttctccattaaggctc

SEQ ID NO: 8486027 - DNA, 22 bp, Homo sapiens
cagtccttccttgccccttggg

SEQ ID NO: 8486028 - DNA, 22 bp, Homo sapiens
cagtccttcattcctcctttga

SEQ ID NO: 8486029 - DNA, 22 bp, Homo sapiens
tatttagtgatagaagcaagga

SEQ ID NO: 8486030 - DNA, 22 bp, Homo sapiens
tatttagctggagtcagtgctt

SEQ ID NO: 8486031 - DNA, 20 bp, Homo sapiens
tatttagattcaagtatgga

SEQ ID NO: 8486032 - DNA, 21 bp, Homo sapiens
tatttagttttacaaatgtgg

SEQ ID NO: 8486033 - DNA, 22 bp, Homo sapiens
tatttagctggagtcagtgctt

SEQ ID NO: 8486034 - DNA, 20 bp, Homo sapiens
tatttagattcaagtatgga

SEQ ID NO: 8486035 - DNA, 22 bp, Homo sapiens
tatttagatgcatttggattgc

SEQ ID NO: 8486036 - DNA, 22 bp, Homo sapiens
tatttagaacagacaatagaaa

SEQ ID NO: 8486037 - DNA, 22 bp, Homo sapiens
tatttagaacagacaatagaaa

SEQ ID NO: 8486038 - DNA, 22 bp, Homo sapiens
tatttacttttaaattgagaac

SEQ ID NO: 8486039 - DNA, 22 bp, Homo sapiens
tatttactgtatttgaagttga

SEQ ID NO: 8486040 - DNA, 22 bp, Homo sapiens
tatttactgtatttgaagttga

SEQ ID NO: 8486041 - DNA, 20 bp, Homo sapiens
tatttacaacttagagcctc

SEQ ID NO: 8486042 - DNA, 22 bp, Homo sapiens
tattggaccacagactttaagg

SEQ ID NO: 8486043 - DNA, 22 bp, Homo sapiens
tattggattgagacattttaga

SEQ ID NO: 8486044 - DNA, 22 bp, Homo sapiens
tattggagtatggggctggagt

SEQ ID NO: 8486045 - DNA, 22 bp, Homo sapiens
tattggcagcatgagctcctgg

SEQ ID NO: 8486046 - DNA, 20 bp, Homo sapiens
tatttacaacttagagcctc

SEQ ID NO: 8486047 - DNA, 20 bp, Homo sapiens
tatttacaacttagagcctc

SEQ ID NO: 8486048 - DNA, 22 bp, Homo sapiens
cagtgcaaactccctgaggtgg

SEQ ID NO: 8486049 - DNA, 22 bp, Homo sapiens
cagtgattttaaactatggatg

SEQ ID NO: 8486050 - DNA, 22 bp, Homo sapiens
cagtgattaaaacatgacagcc

SEQ ID NO: 8486051 - DNA, 22 bp, Homo sapiens
cagtgatggatatggagaagtc

SEQ ID NO: 8486052 - DNA, 22 bp, Homo sapiens
cagtgcaatgttaaataggaaa

SEQ ID NO: 8486053 - DNA, 22 bp, Homo sapiens
cagtgcaattacaagctaattc

SEQ ID NO: 8486054 - DNA, 22 bp, Homo sapiens
cagtgcaattagaacttattta

SEQ ID NO: 8486055 - DNA, 22 bp, Homo sapiens
cagtgcagacgtggagggggca

SEQ ID NO: 8486056 - DNA, 22 bp, Homo sapiens
cagtgcagaacacatggaaaat

SEQ ID NO: 8486057 - DNA, 22 bp, Homo sapiens
cagtgcagaacacatggaaaat

SEQ ID NO: 8486058 - DNA, 22 bp, Homo sapiens
cagtgcacacaatcctctgccg

SEQ ID NO: 8486059 - DNA, 22 bp, Homo sapiens
cagtgcagaggccagggaggat

SEQ ID NO: 8486060 - DNA, 17 bp, Homo sapiens
cagtgcagagccctttc

SEQ ID NO: 8486061 - DNA, 22 bp, Homo sapiens
cagtgaggtggatggatggcct

SEQ ID NO: 8486062 - DNA, 22 bp, Homo sapiens
cagtgagttgtgctgaggacca

SEQ ID NO: 8486063 - DNA, 22 bp, Homo sapiens
cagtgagttgtgctgaggacca

SEQ ID NO: 8486064 - DNA, 21 bp, Homo sapiens
cagtgaggtccccagcctagg

SEQ ID NO: 8486065 - DNA, 22 bp, Homo sapiens
cagtgaggtagacagctttttc

SEQ ID NO: 8486066 - DNA, 22 bp, Homo sapiens
cagtgagggcccccttccaggt

SEQ ID NO: 8486067 - DNA, 22 bp, Homo sapiens
cagtgagggcccccttccaggt

SEQ ID NO: 8486068 - DNA, 20 bp, Homo sapiens
cagtgaggaggtgctggggg

SEQ ID NO: 8486069 - DNA, 22 bp, Homo sapiens
cagtgaggtgcccagcctgccc

SEQ ID NO: 8486070 - DNA, 21 bp, Homo sapiens
cagtgaggtccccagcctagg

SEQ ID NO: 8486071 - DNA, 22 bp, Homo sapiens
cagtgaggtgcccagcctgccc

SEQ ID NO: 8486072 - DNA, 22 bp, Homo sapiens
cagtgaggtgcccagcctgccc

SEQ ID NO: 8486073 - DNA, 22 bp, Homo sapiens
cagtctccaaatcagtctgaat

SEQ ID NO: 8486074 - DNA, 22 bp, Homo sapiens
cagtctccaaatcaatctgaat

SEQ ID NO: 8486075 - DNA, 22 bp, Homo sapiens
cagtctcctgggggctgttgtt

SEQ ID NO: 8486076 - DNA, 22 bp, Homo sapiens
cagtctctaaatcaatctgaat

SEQ ID NO: 8486077 - DNA, 22 bp, Homo sapiens
cagtctacctttcagacattga

SEQ ID NO: 8486078 - DNA, 22 bp, Homo sapiens
cagtctcagaggtgggagtggg

SEQ ID NO: 8486079 - DNA, 22 bp, Homo sapiens
cagtcctttcaatggtgacctt

SEQ ID NO: 8486080 - DNA, 22 bp, Homo sapiens
cagtccttggcttcatccgagt

SEQ ID NO: 8486081 - DNA, 19 bp, Homo sapiens
cagtcctttccgctttctc

SEQ ID NO: 8486082 - DNA, 17 bp, Homo sapiens
cagtcgaggaggacctg

SEQ ID NO: 8486083 - DNA, 22 bp, Homo sapiens
cagtcctttctgaaatcctata

SEQ ID NO: 8486084 - DNA, 22 bp, Homo sapiens
tcagaaatagtctttaaaatga

SEQ ID NO: 8486085 - DNA, 22 bp, Homo sapiens
tcagaaatagtctttaaaatga

SEQ ID NO: 8486086 - DNA, 22 bp, Homo sapiens
tcagaaatgatcgttattcatt

SEQ ID NO: 8486087 - DNA, 22 bp, Homo sapiens
tcagaaatgatcgttattcatt

SEQ ID NO: 8486088 - DNA, 22 bp, Homo sapiens
tcagaaatgatcgttattcatt

SEQ ID NO: 8486089 - DNA, 22 bp, Homo sapiens
tcagaaatgtaagctgatgact

SEQ ID NO: 8486090 - DNA, 22 bp, Homo sapiens
tcagaaataatgaatgatgggg

SEQ ID NO: 8486091 - DNA, 22 bp, Homo sapiens
tcagaaatactatcagcttttg

SEQ ID NO: 8486092 - DNA, 19 bp, Homo sapiens
tcagaaggcaggagaggcc

SEQ ID NO: 8486093 - DNA, 22 bp, Homo sapiens
tcagaagctggtgtcctttgaa

SEQ ID NO: 8486094 - DNA, 22 bp, Homo sapiens
tcagaaggaaacgatgccagct

SEQ ID NO: 8486095 - DNA, 22 bp, Homo sapiens
tcagaagctaaatttgatattt

SEQ ID NO: 8486096 - DNA, 22 bp, Homo sapiens
tcagaagctaaatttgatattt

SEQ ID NO: 8486097 - DNA, 21 bp, Homo sapiens
tcagaacaattccatgcctcc

SEQ ID NO: 8486098 - DNA, 21 bp, Homo sapiens
tcagaacaattccatgcctcc

SEQ ID NO: 8486099 - DNA, 22 bp, Homo sapiens
tcagaaattttctcagtagttc

SEQ ID NO: 8486100 - DNA, 23 bp, Homo sapiens
tcagaacaatgccttaggggcat

SEQ ID NO: 8486101 - DNA, 22 bp, Homo sapiens
tcagaaattttctcagtagttc

SEQ ID NO: 8486102 - DNA, 22 bp, Homo sapiens
tcagaaatttaggctggacttg

SEQ ID NO: 8486103 - DNA, 22 bp, Homo sapiens
tcacccagaaaagacagcagat

SEQ ID NO: 8486104 - DNA, 22 bp, Homo sapiens
tcacccagactgtctgactctt

SEQ ID NO: 8486105 - DNA, 22 bp, Homo sapiens
tcacccagacagcttgcactga

SEQ ID NO: 8486106 - DNA, 22 bp, Homo sapiens
tcacccagacagcttgcactga

SEQ ID NO: 8486107 - DNA, 22 bp, Homo sapiens
tcacccagattacatcctgtca

SEQ ID NO: 8486108 - DNA, 22 bp, Homo sapiens
tcacccagacttgtgaatgtgt

SEQ ID NO: 8486109 - DNA, 22 bp, Homo sapiens
tcacccagatagtgagcatagt

SEQ ID NO: 8486110 - DNA, 22 bp, Homo sapiens
tcactcaatatcccagtggggc

SEQ ID NO: 8486111 - DNA, 22 bp, Homo sapiens
tcactatgttcggagaactctg

SEQ ID NO: 8486112 - DNA, 22 bp, Homo sapiens
tcacttcccagacggggtggca

SEQ ID NO: 8486113 - DNA, 22 bp, Homo sapiens
tcactccatctttgctactggt

SEQ ID NO: 8486114 - DNA, 22 bp, Homo sapiens
tcactccatctttgctactggt

SEQ ID NO: 8486115 - DNA, 22 bp, Homo sapiens
tcactcctcaggctagcatcat

SEQ ID NO: 8486116 - DNA, 22 bp, Homo sapiens
tcagaaagtgaactgttgacat

SEQ ID NO: 8486117 - DNA, 22 bp, Homo sapiens
tcagaaaggttgagtcatgtgc

SEQ ID NO: 8486118 - DNA, 22 bp, Homo sapiens
tcacttccctcttcagctccca

SEQ ID NO: 8486119 - DNA, 22 bp, Homo sapiens
tcacttcccagacggggtggca

SEQ ID NO: 8486120 - DNA, 22 bp, Homo sapiens
tcacttcccagacggggtggca

SEQ ID NO: 8486121 - DNA, 22 bp, Homo sapiens
tcactccatagcttaactcttt

SEQ ID NO: 8486122 - DNA, 22 bp, Homo sapiens
tcactccatagcttaactcttt

SEQ ID NO: 8486123 - DNA, 18 bp, Homo sapiens
tcactcatagacatctat

SEQ ID NO: 8486124 - DNA, 22 bp, Homo sapiens
tcactcaggctggagtgcagtg

SEQ ID NO: 8486125 - DNA, 22 bp, Homo sapiens
cagtgcagaggccagggaggat

SEQ ID NO: 8486126 - DNA, 22 bp, Homo sapiens
cagtgcagaggccagggaggat

SEQ ID NO: 8486127 - DNA, 21 bp, Homo sapiens
cagtgccccagctacaaaagg

SEQ ID NO: 8486128 - DNA, 22 bp, Homo sapiens
cagtgctcctgatgtacccttg

SEQ ID NO: 8486129 - DNA, 22 bp, Homo sapiens
cagtgctcctgatgtacccttg

SEQ ID NO: 8486130 - DNA, 22 bp, Homo sapiens
cagtgctgagagcctggccagg

SEQ ID NO: 8486131 - DNA, 22 bp, Homo sapiens
cagtgctgcaggcgcctgcggt

SEQ ID NO: 8486132 - DNA, 22 bp, Homo sapiens
cagtgctgcatctccatgccag

SEQ ID NO: 8486133 - DNA, 22 bp, Homo sapiens
cagtgctgggcagaggagagcg

SEQ ID NO: 8486134 - DNA, 22 bp, Homo sapiens
cagtgctgggcagaggagagcg

SEQ ID NO: 8486135 - DNA, 22 bp, Homo sapiens
cagtgctggctgttaggacagt

SEQ ID NO: 8486136 - DNA, 22 bp, Homo sapiens
cagtgctggctgttaggacagt

SEQ ID NO: 8486137 - DNA, 22 bp, Homo sapiens
cagtgctggctgttaggacagt

SEQ ID NO: 8486138 - DNA, 22 bp, Homo sapiens
cagtgctgtgctggaagctgtt

SEQ ID NO: 8486139 - DNA, 22 bp, Homo sapiens
cagtgctgtgctggaagctgtt

SEQ ID NO: 8486140 - DNA, 23 bp, Homo sapiens
cagtgctggttctgcctgtgggg

SEQ ID NO: 8486141 - DNA, 22 bp, Homo sapiens
cagtgctgtgctggaagctgtt

SEQ ID NO: 8486142 - DNA, 22 bp, Homo sapiens
cagtgctgttgggcccagagag

SEQ ID NO: 8486143 - DNA, 22 bp, Homo sapiens
tcacccaagaccatcggaagtg

SEQ ID NO: 8486144 - DNA, 22 bp, Homo sapiens
tcaccagggctccagccagcct

SEQ ID NO: 8486145 - DNA, 22 bp, Homo sapiens
tcaccagtctttcttaccattg

SEQ ID NO: 8486146 - DNA, 22 bp, Homo sapiens
tcaccagttaaaataacagtaa

SEQ ID NO: 8486147 - DNA, 22 bp, Homo sapiens
tcaccaggctagagtgcagtgg

SEQ ID NO: 8486148 - DNA, 22 bp, Homo sapiens
tcaccaggctggagtgcagtgg

SEQ ID NO: 8486149 - DNA, 22 bp, Homo sapiens
tcaccaggctggaatgcagtgg

SEQ ID NO: 8486150 - DNA, 22 bp, Homo sapiens
tcacattgaagaaattttaagt

SEQ ID NO: 8486151 - DNA, 22 bp, Homo sapiens
tcacattgaatggaagaataga

SEQ ID NO: 8486152 - DNA, 22 bp, Homo sapiens
cagtttctctcatacatatttg

SEQ ID NO: 8486153 - DNA, 22 bp, Homo sapiens
cagtttctctcatacatatttg

SEQ ID NO: 8486154 - DNA, 22 bp, Homo sapiens
cagtttatatgtcagagctgta

SEQ ID NO: 8486155 - DNA, 22 bp, Homo sapiens
cagtttctgtggtctcttttca

SEQ ID NO: 8486156 - DNA, 22 bp, Homo sapiens
cagtttctgggcgttcacaggt

SEQ ID NO: 8486157 - DNA, 22 bp, Homo sapiens
tcagaaggtggaggttgcagtg

SEQ ID NO: 8486158 - DNA, 22 bp, Homo sapiens
tcagaaggtactgaagacatgg

SEQ ID NO: 8486159 - DNA, 22 bp, Homo sapiens
tcagaaggtacagaagggaggt

SEQ ID NO: 8486160 - DNA, 22 bp, Homo sapiens
tcagaagtcatgctcagtctgt

SEQ ID NO: 8486161 - DNA, 22 bp, Homo sapiens
tcagaagtctggactgcttctc

SEQ ID NO: 8486162 - DNA, 22 bp, Homo sapiens
cagtttcttcaattcagacact

SEQ ID NO: 8486163 - DNA, 22 bp, Homo sapiens
cagtttcttctattttgaacta

SEQ ID NO: 8486164 - DNA, 22 bp, Homo sapiens
cagtttcttcatcagttaagca

SEQ ID NO: 8486165 - DNA, 22 bp, Homo sapiens
cagtttcttagtgacacaaatc

SEQ ID NO: 8486166 - DNA, 22 bp, Homo sapiens
cagtttcttatcttcaaaattg

SEQ ID NO: 8486167 - DNA, 22 bp, Homo sapiens
cagtttctgttttaaatagcag

SEQ ID NO: 8486168 - DNA, 22 bp, Homo sapiens
cagtttctgttttaaatagcag

SEQ ID NO: 8486169 - DNA, 22 bp, Homo sapiens
tcagcagtgggtcctgagggtg

SEQ ID NO: 8486170 - DNA, 22 bp, Homo sapiens
tcagcagtgcagggtgaggcag

SEQ ID NO: 8486171 - DNA, 22 bp, Homo sapiens
tcagcccaggaggttgagacta

SEQ ID NO: 8486172 - DNA, 22 bp, Homo sapiens
tcagcccagggacagaggcccc

SEQ ID NO: 8486173 - DNA, 22 bp, Homo sapiens
tcagcccaggaatgagccttct

SEQ ID NO: 8486174 - DNA, 19 bp, Homo sapiens
tcagcccaggctgggaagc

SEQ ID NO: 8486175 - DNA, 20 bp, Homo sapiens
tcagcccagggtgagcatct

SEQ ID NO: 8486176 - DNA, 22 bp, Homo sapiens
cagtttcttggatgccaatttc

SEQ ID NO: 8486177 - DNA, 19 bp, Homo sapiens
cagtttgtccagaggggac

SEQ ID NO: 8486178 - DNA, 19 bp, Homo sapiens
tcagcccatcagactcaca

SEQ ID NO: 8486179 - DNA, 22 bp, Homo sapiens
tcagcccatcactcacgtatta

SEQ ID NO: 8486180 - DNA, 21 bp, Homo sapiens
tcagcccaggtgtctttgccc

SEQ ID NO: 8486181 - DNA, 22 bp, Homo sapiens
tcagcccagttaagaacctgtt

SEQ ID NO: 8486182 - DNA, 22 bp, Homo sapiens
tcagcccagttttatcatctgt

SEQ ID NO: 8486183 - DNA, 22 bp, Homo sapiens
tcagcccaggtcacgtaatcaa

SEQ ID NO: 8486184 - DNA, 22 bp, Homo sapiens
tcagctgaagtggagaagcaga

SEQ ID NO: 8486185 - DNA, 22 bp, Homo sapiens
tcagctgagctccagctcatag

SEQ ID NO: 8486186 - DNA, 22 bp, Homo sapiens
tcagctgagttctagagcactc

SEQ ID NO: 8486187 - DNA, 20 bp, Homo sapiens
tcagctcttagaggtcgctt

SEQ ID NO: 8486188 - DNA, 22 bp, Homo sapiens
tcagctcttccccccagccagg

SEQ ID NO: 8486189 - DNA, 22 bp, Homo sapiens
tcagctcttaaccctctggcct

SEQ ID NO: 8486190 - DNA, 22 bp, Homo sapiens
tcagctcttaaccctctggcct

SEQ ID NO: 8486191 - DNA, 22 bp, Homo sapiens
tcagctcttaaccctctggcct

SEQ ID NO: 8486192 - DNA, 22 bp, Homo sapiens
tcagctctgttttgagtggaac

SEQ ID NO: 8486193 - DNA, 22 bp, Homo sapiens
tcagctctgttttgagtggaac

SEQ ID NO: 8486194 - DNA, 20 bp, Homo sapiens
tcagctctgtgcctgggatg

SEQ ID NO: 8486195 - DNA, 20 bp, Homo sapiens
tcagctctgtgcctgggatg

SEQ ID NO: 8486196 - DNA, 22 bp, Homo sapiens
tcagctctgtgtacagttagca

SEQ ID NO: 8486197 - DNA, 22 bp, Homo sapiens
tcagccctgggcttcctcatgg

SEQ ID NO: 8486198 - DNA, 19 bp, Homo sapiens
tcagctctggggtcagtgg

SEQ ID NO: 8486199 - DNA, 22 bp, Homo sapiens
catactttttagatctgccttc

SEQ ID NO: 8486200 - DNA, 22 bp, Homo sapiens
catactttttagatctgccttc

SEQ ID NO: 8486201 - DNA, 22 bp, Homo sapiens
catacttttgccctgacattct

SEQ ID NO: 8486202 - DNA, 22 bp, Homo sapiens
catacttttgccctgacattct

SEQ ID NO: 8486203 - DNA, 22 bp, Homo sapiens
catactttgggataagagtgga

SEQ ID NO: 8486204 - DNA, 22 bp, Homo sapiens
catactttgggataagagtgga

SEQ ID NO: 8486205 - DNA, 22 bp, Homo sapiens
catactattactaggagcagga

SEQ ID NO: 8486206 - DNA, 22 bp, Homo sapiens
catactttgggataagagtgga

SEQ ID NO: 8486207 - DNA, 22 bp, Homo sapiens
catactttctttttcacgcata

SEQ ID NO: 8486208 - DNA, 22 bp, Homo sapiens
catactgtgaagcttactattt

SEQ ID NO: 8486209 - DNA, 22 bp, Homo sapiens
catacctttctcaagcacatgt

SEQ ID NO: 8486210 - DNA, 22 bp, Homo sapiens
catacattttgcatatttacca

SEQ ID NO: 8486211 - DNA, 22 bp, Homo sapiens
catacattttgcatatttacca

SEQ ID NO: 8486212 - DNA, 22 bp, Homo sapiens
catacatttatacacatctatg

SEQ ID NO: 8486213 - DNA, 22 bp, Homo sapiens
catacatttatacacatctatg

SEQ ID NO: 8486214 - DNA, 22 bp, Homo sapiens
catacatttatacacatctatg

SEQ ID NO: 8486215 - DNA, 22 bp, Homo sapiens
catacatttatacacatctatg

SEQ ID NO: 8486216 - DNA, 22 bp, Homo sapiens
catacattgctcattcagtatc

SEQ ID NO: 8486217 - DNA, 22 bp, Homo sapiens
catacattgctcattcagtatc

SEQ ID NO: 8486218 - DNA, 22 bp, Homo sapiens
catacattgctcattcagtatc

SEQ ID NO: 8486219 - DNA, 22 bp, Homo sapiens
tcagctgcagcaggcaccattt

SEQ ID NO: 8486220 - DNA, 22 bp, Homo sapiens
catacattacctaacttaatgc

SEQ ID NO: 8486221 - DNA, 22 bp, Homo sapiens
cataatttttttaagtcagaac

SEQ ID NO: 8486222 - DNA, 19 bp, Homo sapiens
tcagggccatgagcgccac

SEQ ID NO: 8486223 - DNA, 22 bp, Homo sapiens
tcagggcccagagctcaggcaa

SEQ ID NO: 8486224 - DNA, 22 bp, Homo sapiens
catcacagaaataaacatacct

SEQ ID NO: 8486225 - DNA, 22 bp, Homo sapiens
catcacaccacaggcattttct

SEQ ID NO: 8486226 - DNA, 22 bp, Homo sapiens
catcacagaaataaacatacct

SEQ ID NO: 8486227 - DNA, 22 bp, Homo sapiens
catcacagatgttgtgtggagt

SEQ ID NO: 8486228 - DNA, 22 bp, Homo sapiens
catatgtatttctcataattag

SEQ ID NO: 8486229 - DNA, 20 bp, Homo sapiens
catatggaaagatattgttc

SEQ ID NO: 8486230 - DNA, 22 bp, Homo sapiens
catatggacaagaacatttatg

SEQ ID NO: 8486231 - DNA, 22 bp, Homo sapiens
tcagggcatggctgcacttggc

SEQ ID NO: 8486232 - DNA, 22 bp, Homo sapiens
tcagggcatggctgcacttggc

SEQ ID NO: 8486233 - DNA, 22 bp, Homo sapiens
tcagggcatggctgcacttggc

SEQ ID NO: 8486234 - DNA, 22 bp, Homo sapiens
tcagggcatggctgcacttggc

SEQ ID NO: 8486235 - DNA, 22 bp, Homo sapiens
tcagggcatgtatgtttcttta

SEQ ID NO: 8486236 - DNA, 22 bp, Homo sapiens
tcagggcattcaagaggcctgg

SEQ ID NO: 8486237 - DNA, 22 bp, Homo sapiens
tcagggcattcaagaggcctgg

SEQ ID NO: 8486238 - DNA, 22 bp, Homo sapiens
tcagggcattcaagaggcctgg

SEQ ID NO: 8486239 - DNA, 20 bp, Homo sapiens
tcagggcatgggacagcccc

SEQ ID NO: 8486240 - DNA, 20 bp, Homo sapiens
tcagggcatgggacagcccc

SEQ ID NO: 8486241 - DNA, 20 bp, Homo sapiens
tcagggcatgggacagcccc

SEQ ID NO: 8486242 - DNA, 22 bp, Homo sapiens
tcagggcatgtatgtttcttta

SEQ ID NO: 8486243 - DNA, 22 bp, Homo sapiens
catccagctcctgggggccacc

SEQ ID NO: 8486244 - DNA, 22 bp, Homo sapiens
catccagaccgtgccatgctgc

SEQ ID NO: 8486245 - DNA, 22 bp, Homo sapiens
catcatctggcttttagaaaaa

SEQ ID NO: 8486246 - DNA, 22 bp, Homo sapiens
catcatctgtgctggagagcct

SEQ ID NO: 8486247 - DNA, 22 bp, Homo sapiens
catcatctgtgctggagagcct

SEQ ID NO: 8486248 - DNA, 22 bp, Homo sapiens
catcatcttgaatgactgtgat

SEQ ID NO: 8486249 - DNA, 22 bp, Homo sapiens
catccagtggtcagggaagttg

SEQ ID NO: 8486250 - DNA, 22 bp, Homo sapiens
catccatagattgagagatggt

SEQ ID NO: 8486251 - DNA, 22 bp, Homo sapiens
catccagggcagccatggcctg

SEQ ID NO: 8486252 - DNA, 23 bp, Homo sapiens
catccaggagctgagtctgactg

SEQ ID NO: 8486253 - DNA, 22 bp, Homo sapiens
catccaggctgaagtgcagtgg

SEQ ID NO: 8486254 - DNA, 22 bp, Homo sapiens
catcatctctcccccaggcctg

SEQ ID NO: 8486255 - DNA, 22 bp, Homo sapiens
catcatctggcttttagaaaaa

SEQ ID NO: 8486256 - DNA, 22 bp, Homo sapiens
catcatctctggcccttgaagt

SEQ ID NO: 8486257 - DNA, 22 bp, Homo sapiens
catcacatgtaggcagcatcac

SEQ ID NO: 8486258 - DNA, 22 bp, Homo sapiens
catcacatgtaggcagcatcac

SEQ ID NO: 8486259 - DNA, 19 bp, Homo sapiens
catcacatggtctgatgaa

SEQ ID NO: 8486260 - DNA, 22 bp, Homo sapiens
catcacatcagtgtgaacagtt

SEQ ID NO: 8486261 - DNA, 22 bp, Homo sapiens
catcacatctactataagtgat

SEQ ID NO: 8486262 - DNA, 22 bp, Homo sapiens
catcacatcagtgtgaacagtt

SEQ ID NO: 8486263 - DNA, 22 bp, Homo sapiens
catcacatgcctatcatgagct

SEQ ID NO: 8486264 - DNA, 22 bp, Homo sapiens
catcacagtttgtcagaaatca

SEQ ID NO: 8486265 - DNA, 22 bp, Homo sapiens
catcacagtttgtcagaaatca

SEQ ID NO: 8486266 - DNA, 22 bp, Homo sapiens
catcacaggtcctgatgacatt

SEQ ID NO: 8486267 - DNA, 22 bp, Homo sapiens
catcacagggggctagaagtct

SEQ ID NO: 8486268 - DNA, 22 bp, Homo sapiens
catcacaggcattttgagtgtc

SEQ ID NO: 8486269 - DNA, 22 bp, Homo sapiens
catcacaggtcctgatgacatt

SEQ ID NO: 8486270 - DNA, 22 bp, Homo sapiens
catcacaggtcctgatgacatt

SEQ ID NO: 8486271 - DNA, 22 bp, Homo sapiens
catcacaggtcctgatgacatt

SEQ ID NO: 8486272 - DNA, 22 bp, Homo sapiens
tcaggaagtgctgaggctgctt

SEQ ID NO: 8486273 - DNA, 22 bp, Homo sapiens
tcaggaagtggtaaaggatgtt

SEQ ID NO: 8486274 - DNA, 22 bp, Homo sapiens
tcaggaagttgaggcgtagaga

SEQ ID NO: 8486275 - DNA, 22 bp, Homo sapiens
tcaggaagtggtaaaggatgtt

SEQ ID NO: 8486276 - DNA, 22 bp, Homo sapiens
tcaggaagtctcaattagctac

SEQ ID NO: 8486277 - DNA, 22 bp, Homo sapiens
tcaggaagtgcctaggctggcc

SEQ ID NO: 8486278 - DNA, 19 bp, Homo sapiens
tcaggaagttgatgaggtg

SEQ ID NO: 8486279 - DNA, 22 bp, Homo sapiens
catagaatgtaataaagagtag

SEQ ID NO: 8486280 - DNA, 22 bp, Homo sapiens
catataaatacaacatgtgtta

SEQ ID NO: 8486281 - DNA, 22 bp, Homo sapiens
catataaatacaacatgtgtta

SEQ ID NO: 8486282 - DNA, 22 bp, Homo sapiens
catatacacttccacctctgtg

SEQ ID NO: 8486283 - DNA, 22 bp, Homo sapiens
catatacacttccacctctgtg

SEQ ID NO: 8486284 - DNA, 22 bp, Homo sapiens
catataaatacaacatgtgtta

SEQ ID NO: 8486285 - DNA, 22 bp, Homo sapiens
catataaatacaacatgtgtta

SEQ ID NO: 8486286 - DNA, 22 bp, Homo sapiens
catatcataggtcttggataat

SEQ ID NO: 8486287 - DNA, 22 bp, Homo sapiens
catatcatttgcttataaatct

SEQ ID NO: 8486288 - DNA, 22 bp, Homo sapiens
catatcatttgcttataaatct

SEQ ID NO: 8486289 - DNA, 22 bp, Homo sapiens
catatcatttgcttataaatct

SEQ ID NO: 8486290 - DNA, 22 bp, Homo sapiens
catatcttatggttttctaagt

SEQ ID NO: 8486291 - DNA, 22 bp, Homo sapiens
catatcttctgacatgatcagg

SEQ ID NO: 8486292 - DNA, 23 bp, Homo sapiens
catatgaaagtagacactttcca

SEQ ID NO: 8486293 - DNA, 23 bp, Homo sapiens
catatgaaagtagacactttcca

SEQ ID NO: 8486294 - DNA, 22 bp, Homo sapiens
catatgaaatatgagttgaaca

SEQ ID NO: 8486295 - DNA, 20 bp, Homo sapiens
catatggaaagatattgttc

SEQ ID NO: 8486296 - DNA, 23 bp, Homo sapiens
catatgaattttagaggcagttt

SEQ ID NO: 8486297 - DNA, 22 bp, Homo sapiens
catatgaagatgtctttttgta

SEQ ID NO: 8486298 - DNA, 22 bp, Homo sapiens
catatgaagttcaacagagatg

SEQ ID NO: 8486299 - DNA, 20 bp, Homo sapiens
catatatacctagaagtgga

SEQ ID NO: 8486300 - DNA, 22 bp, Homo sapiens
catatacttttctatagctttc

SEQ ID NO: 8486301 - DNA, 20 bp, Homo sapiens
catatatacctagaagtgga

SEQ ID NO: 8486302 - DNA, 20 bp, Homo sapiens
catatatacctagaagtgga

SEQ ID NO: 8486303 - DNA, 22 bp, Homo sapiens
catgcaaaatgtattttattag

SEQ ID NO: 8486304 - DNA, 23 bp, Homo sapiens
catgcaaacactattgcatttgg

SEQ ID NO: 8486305 - DNA, 23 bp, Homo sapiens
catgcaaacactattgcatttgg

SEQ ID NO: 8486306 - DNA, 22 bp, Homo sapiens
catgattttgtcttgtgttaat

SEQ ID NO: 8486307 - DNA, 22 bp, Homo sapiens
catgattttgtcttgtgttaat

SEQ ID NO: 8486308 - DNA, 22 bp, Homo sapiens
catgcaaatgtgctaatctgaa

SEQ ID NO: 8486309 - DNA, 20 bp, Homo sapiens
catgcaacagattatttccc

SEQ ID NO: 8486310 - DNA, 20 bp, Homo sapiens
catgcaacagattatttccc

SEQ ID NO: 8486311 - DNA, 22 bp, Homo sapiens
catgcaaaggtcaagatcagga

SEQ ID NO: 8486312 - DNA, 22 bp, Homo sapiens
catgcaaaggtcaagatcagga

SEQ ID NO: 8486313 - DNA, 22 bp, Homo sapiens
tcattttgcctgccatttgagt

SEQ ID NO: 8486314 - DNA, 22 bp, Homo sapiens
tcattttggggtttgtcatctt

SEQ ID NO: 8486315 - DNA, 18 bp, Homo sapiens
tcattttgtctgcctttg

SEQ ID NO: 8486316 - DNA, 22 bp, Homo sapiens
tcattttcacacataaatagca

SEQ ID NO: 8486317 - DNA, 22 bp, Homo sapiens
tcattttcacacataaatagca

SEQ ID NO: 8486318 - DNA, 22 bp, Homo sapiens
tcattttcaagtttgaacagga

SEQ ID NO: 8486319 - DNA, 22 bp, Homo sapiens
tcattttcaagtttgaacagga

SEQ ID NO: 8486320 - DNA, 22 bp, Homo sapiens
tcattttcaagtttgaacagga

SEQ ID NO: 8486321 - DNA, 22 bp, Homo sapiens
tcattttcccactgaagctgtc

SEQ ID NO: 8486322 - DNA, 22 bp, Homo sapiens
tcattttcccactgaagctgtc

SEQ ID NO: 8486323 - DNA, 22 bp, Homo sapiens
catggctggcacacagcaacca

SEQ ID NO: 8486324 - DNA, 22 bp, Homo sapiens
catggctgcgagaagagtgggt

SEQ ID NO: 8486325 - DNA, 22 bp, Homo sapiens
catggctggcacacagcaacca

SEQ ID NO: 8486326 - DNA, 19 bp, Homo sapiens
catggctgctgcttgggag

SEQ ID NO: 8486327 - DNA, 22 bp, Homo sapiens
catggcttaccccaggagcagc

SEQ ID NO: 8486328 - DNA, 22 bp, Homo sapiens
catggcttctaagtgataacgt

SEQ ID NO: 8486329 - DNA, 22 bp, Homo sapiens
catggcttcgtcacagagggca

SEQ ID NO: 8486330 - DNA, 22 bp, Homo sapiens
catggcttcgcgcgtccccgct

SEQ ID NO: 8486331 - DNA, 22 bp, Homo sapiens
catggcttcatgagggttttgc

SEQ ID NO: 8486332 - DNA, 22 bp, Homo sapiens
catggcttcgcgcgtccccgct

SEQ ID NO: 8486333 - DNA, 22 bp, Homo sapiens
catggcttactttcagggagta

SEQ ID NO: 8486334 - DNA, 22 bp, Homo sapiens
catggcttcaaagcctttggca

SEQ ID NO: 8486335 - DNA, 22 bp, Homo sapiens
catggcttagaagttccagccc

SEQ ID NO: 8486336 - DNA, 22 bp, Homo sapiens
catggcttgtcttgtcttctga

SEQ ID NO: 8486337 - DNA, 22 bp, Homo sapiens
catggctttccagtcctccact

SEQ ID NO: 8486338 - DNA, 22 bp, Homo sapiens
catggctttccctcaagagcaa

SEQ ID NO: 8486339 - DNA, 22 bp, Homo sapiens
catggcttgtaataaatttata

SEQ ID NO: 8486340 - DNA, 22 bp, Homo sapiens
catggcttggagcaggatgaga

SEQ ID NO: 8486341 - DNA, 22 bp, Homo sapiens
catggcttgctagtggcccaag

SEQ ID NO: 8486342 - DNA, 22 bp, Homo sapiens
catggcttgcaagcataggaga

SEQ ID NO: 8486343 - DNA, 22 bp, Homo sapiens
catggcttctgatcaaggaact

SEQ ID NO: 8486344 - DNA, 23 bp, Homo sapiens
catggctgatttcaagctaccac

SEQ ID NO: 8486345 - DNA, 22 bp, Homo sapiens
catggctgcgagaagagtgggt

SEQ ID NO: 8486346 - DNA, 22 bp, Homo sapiens
catggctgaacactcagtgact

SEQ ID NO: 8486347 - DNA, 22 bp, Homo sapiens
catgcacaaaggtaagatgcgt

SEQ ID NO: 8486348 - DNA, 22 bp, Homo sapiens
catgcacaaaggtaagatgcgt

SEQ ID NO: 8486349 - DNA, 22 bp, Homo sapiens
catgcacaaaggtaagatgcgt

SEQ ID NO: 8486350 - DNA, 22 bp, Homo sapiens
catgcacaacatactcaagagg

SEQ ID NO: 8486351 - DNA, 22 bp, Homo sapiens
catgcacaacatactcaagagg

SEQ ID NO: 8486352 - DNA, 22 bp, Homo sapiens
catgcacaagggatgatgaaat

SEQ ID NO: 8486353 - DNA, 18 bp, Homo sapiens
catgtctgcgccacaagg

SEQ ID NO: 8486354 - DNA, 18 bp, Homo sapiens
catgtctgcgccacaagg

SEQ ID NO: 8486355 - DNA, 22 bp, Homo sapiens
catgtacatgcctactatcaat

SEQ ID NO: 8486356 - DNA, 22 bp, Homo sapiens
catgtctgtgtacacatgcaca

SEQ ID NO: 8486357 - DNA, 22 bp, Homo sapiens
catgtctgggtatatgcatatg

SEQ ID NO: 8486358 - DNA, 22 bp, Homo sapiens
catgtctgtgtacacatgcaca

SEQ ID NO: 8486359 - DNA, 22 bp, Homo sapiens
tccagccatgactcggacagtg

SEQ ID NO: 8486360 - DNA, 22 bp, Homo sapiens
tccagccatgcatgacaatcac

SEQ ID NO: 8486361 - DNA, 22 bp, Homo sapiens
tccagccatatcttgtagccct

SEQ ID NO: 8486362 - DNA, 21 bp, Homo sapiens
tccagccagtaaatgctcagc

SEQ ID NO: 8486363 - DNA, 22 bp, Homo sapiens
tccagccacttgcacagttaaa

SEQ ID NO: 8486364 - DNA, 22 bp, Homo sapiens
tccagccaggatggcccaggga

SEQ ID NO: 8486365 - DNA, 22 bp, Homo sapiens
tccagccaggatggcccaggga

SEQ ID NO: 8486366 - DNA, 22 bp, Homo sapiens
catggctttgttcatataattt

SEQ ID NO: 8486367 - DNA, 22 bp, Homo sapiens
catggctttgttctgttagatg

SEQ ID NO: 8486368 - DNA, 22 bp, Homo sapiens
catggcttttttattctgaatg

SEQ ID NO: 8486369 - DNA, 22 bp, Homo sapiens
catggctttttagcatattcaa

SEQ ID NO: 8486370 - DNA, 22 bp, Homo sapiens
catggcttttgcttttgcccat

SEQ ID NO: 8486371 - DNA, 22 bp, Homo sapiens
catggcttttagccctacatga

SEQ ID NO: 8486372 - DNA, 22 bp, Homo sapiens
catgggaggcctgctgctggtg

SEQ ID NO: 8486373 - DNA, 22 bp, Homo sapiens
catgggagctatctccatcact

SEQ ID NO: 8486374 - DNA, 22 bp, Homo sapiens
catgtgaattccaaagctaggt

SEQ ID NO: 8486375 - DNA, 22 bp, Homo sapiens
catgtgaattccaaagctaggt

SEQ ID NO: 8486376 - DNA, 22 bp, Homo sapiens
catgtctttctcatcacatcta

SEQ ID NO: 8486377 - DNA, 22 bp, Homo sapiens
catgtctttgttatgctcacca

SEQ ID NO: 8486378 - DNA, 22 bp, Homo sapiens
catgtcttccttgcacacacac

SEQ ID NO: 8486379 - DNA, 21 bp, Homo sapiens
catgtcttccacactgtagta

SEQ ID NO: 8486380 - DNA, 22 bp, Homo sapiens
tccaggcaaagtgctgggctgc

SEQ ID NO: 8486381 - DNA, 22 bp, Homo sapiens
tccaggcaaagtgctgggctgc

SEQ ID NO: 8486382 - DNA, 22 bp, Homo sapiens
tccaggcaaaaaccaactacag

SEQ ID NO: 8486383 - DNA, 22 bp, Homo sapiens
tccaggcaaaaggaactgcttg

SEQ ID NO: 8486384 - DNA, 22 bp, Homo sapiens
tcatgtacatgtaagtcagaaa

SEQ ID NO: 8486385 - DNA, 22 bp, Homo sapiens
tcatggtatatttcactcttta

SEQ ID NO: 8486386 - DNA, 22 bp, Homo sapiens
tcatgtaaatgtggatgcttcc

SEQ ID NO: 8486387 - DNA, 22 bp, Homo sapiens
tcatggggtttggctggatgtc

SEQ ID NO: 8486388 - DNA, 22 bp, Homo sapiens
tcatggttcatgagtgtccttt

SEQ ID NO: 8486389 - DNA, 22 bp, Homo sapiens
tcatggggccacagctgccagc

SEQ ID NO: 8486390 - DNA, 22 bp, Homo sapiens
catgatttactaaaatttgttt

SEQ ID NO: 8486391 - DNA, 22 bp, Homo sapiens
catgatttactaaaatttgttt

SEQ ID NO: 8486392 - DNA, 22 bp, Homo sapiens
tcatgtcagctgttgatgtgca

SEQ ID NO: 8486393 - DNA, 22 bp, Homo sapiens
tcatgtcagtttcttctataaa

SEQ ID NO: 8486394 - DNA, 22 bp, Homo sapiens
tcatgtcagtttcttctataaa

SEQ ID NO: 8486395 - DNA, 22 bp, Homo sapiens
tcatttcaagttctgacagcta

SEQ ID NO: 8486396 - DNA, 22 bp, Homo sapiens
tcatttcaagttctgacagcta

SEQ ID NO: 8486397 - DNA, 19 bp, Homo sapiens
tcatgtctctcatctgtga

SEQ ID NO: 8486398 - DNA, 22 bp, Homo sapiens
tcatgtctctatgtgcctatta

SEQ ID NO: 8486399 - DNA, 19 bp, Homo sapiens
tcatgtctctcatctgtga

SEQ ID NO: 8486400 - DNA, 19 bp, Homo sapiens
tcatgtctctcatctgtga

SEQ ID NO: 8486401 - DNA, 22 bp, Homo sapiens
tcatttcaagttctgacagcta

SEQ ID NO: 8486402 - DNA, 22 bp, Homo sapiens
tcatttgttctcattctctact

SEQ ID NO: 8486403 - DNA, 17 bp, Homo sapiens
tcatttgttgtgactag

SEQ ID NO: 8486404 - DNA, 22 bp, Homo sapiens
catgatacttgacatttgcgat

SEQ ID NO: 8486405 - DNA, 22 bp, Homo sapiens
catgatacttgaatttggaagg

SEQ ID NO: 8486406 - DNA, 22 bp, Homo sapiens
catgataacttcattacacaat

SEQ ID NO: 8486407 - DNA, 22 bp, Homo sapiens
catgataacttcattacacaat

SEQ ID NO: 8486408 - DNA, 22 bp, Homo sapiens
catgatcaccacttgacagccc

SEQ ID NO: 8486409 - DNA, 20 bp, Homo sapiens
catgatacttggaagggctt

SEQ ID NO: 8486410 - DNA, 22 bp, Homo sapiens
catgataggtatttaattaaat

SEQ ID NO: 8486411 - DNA, 22 bp, Homo sapiens
catgatgtcacagagaagcaca

SEQ ID NO: 8486412 - DNA, 22 bp, Homo sapiens
catgatcagaaagagaagctag

SEQ ID NO: 8486413 - DNA, 22 bp, Homo sapiens
catgatctggtcctactgtggg

SEQ ID NO: 8486414 - DNA, 22 bp, Homo sapiens
catgatctggtcctactgtggg

SEQ ID NO: 8486415 - DNA, 22 bp, Homo sapiens
catgatctggtcctactgtggg

SEQ ID NO: 8486416 - DNA, 22 bp, Homo sapiens
catgatggatgtgcacttcgct

SEQ ID NO: 8486417 - DNA, 19 bp, Homo sapiens
catgatgagcatcctgcag

SEQ ID NO: 8486418 - DNA, 22 bp, Homo sapiens
tcagtttagagttatttaatct

SEQ ID NO: 8486419 - DNA, 22 bp, Homo sapiens
tcagtttaagatgactaacaat

SEQ ID NO: 8486420 - DNA, 22 bp, Homo sapiens
tcagtttaatacccagatgcct

SEQ ID NO: 8486421 - DNA, 22 bp, Homo sapiens
tcagtttatggtctagttcatg

SEQ ID NO: 8486422 - DNA, 22 bp, Homo sapiens
tcagtttataaattgtatttag

SEQ ID NO: 8486423 - DNA, 22 bp, Homo sapiens
catgagttttttagttcatgca

SEQ ID NO: 8486424 - DNA, 22 bp, Homo sapiens
catgagttcatctgcttctctt

SEQ ID NO: 8486425 - DNA, 22 bp, Homo sapiens
catgagttcaaaatgcctgcct

SEQ ID NO: 8486426 - DNA, 22 bp, Homo sapiens
catgagtgtcatctcagcagct

SEQ ID NO: 8486427 - DNA, 22 bp, Homo sapiens
catgagaaggttttggcatata

SEQ ID NO: 8486428 - DNA, 22 bp, Homo sapiens
tcagtttcacagtctgtgcaga

SEQ ID NO: 8486429 - DNA, 22 bp, Homo sapiens
tcagtttcacagtctgtgcaga

SEQ ID NO: 8486430 - DNA, 22 bp, Homo sapiens
catgagaaggttttggcatata

SEQ ID NO: 8486431 - DNA, 22 bp, Homo sapiens
catgagaagtggccttcaaaaa

SEQ ID NO: 8486432 - DNA, 22 bp, Homo sapiens
catgagaatgaagaagacttaa

SEQ ID NO: 8486433 - DNA, 22 bp, Homo sapiens
catgagaagtggccttcaaaaa

SEQ ID NO: 8486434 - DNA, 20 bp, Homo sapiens
tcagtttaaatcctggcttt

SEQ ID NO: 8486435 - DNA, 22 bp, Homo sapiens
tcagtttaagatgactaacaat

SEQ ID NO: 8486436 - DNA, 22 bp, Homo sapiens
tcagttgcctccatagtcatcc

SEQ ID NO: 8486437 - DNA, 22 bp, Homo sapiens
tcagttgccagtattttatata

SEQ ID NO: 8486438 - DNA, 22 bp, Homo sapiens
tcagttgctagaagggggaacc

SEQ ID NO: 8486439 - DNA, 22 bp, Homo sapiens
tcagttgctaaatggtgtagtg

SEQ ID NO: 8486440 - DNA, 22 bp, Homo sapiens
tcagttgctgtgtaatgttttc

SEQ ID NO: 8486441 - DNA, 22 bp, Homo sapiens
tcagttgctatgagaaataaat

SEQ ID NO: 8486442 - DNA, 22 bp, Homo sapiens
tcagttgcacctgcatggtact

SEQ ID NO: 8486443 - DNA, 22 bp, Homo sapiens
tcagttctttatttcacagtga

SEQ ID NO: 8486444 - DNA, 21 bp, Homo sapiens
tcagttgccaaagtgatgtca

SEQ ID NO: 8486445 - DNA, 22 bp, Homo sapiens
tcagttgcatgggaagttcaga

SEQ ID NO: 8486446 - DNA, 22 bp, Homo sapiens
tcagttgcatattttgtgttct

SEQ ID NO: 8486447 - DNA, 22 bp, Homo sapiens
tcagttcttattttcatgaata

SEQ ID NO: 8486448 - DNA, 22 bp, Homo sapiens
tcagttcttgggctgctaggac

SEQ ID NO: 8486449 - DNA, 22 bp, Homo sapiens
tcagttctaacagtttagaaca

SEQ ID NO: 8486450 - DNA, 22 bp, Homo sapiens
tcagttctaacagtttagaaca

SEQ ID NO: 8486451 - DNA, 21 bp, Homo sapiens
tcagttctctgcctgtgcttg

SEQ ID NO: 8486452 - DNA, 22 bp, Homo sapiens
tcagttctaagtgctttacatg

SEQ ID NO: 8486453 - DNA, 22 bp, Homo sapiens
tcagttcttagtaatgcagtct

SEQ ID NO: 8486454 - DNA, 22 bp, Homo sapiens
tcagttctgaagttctgcctcc

SEQ ID NO: 8486455 - DNA, 22 bp, Homo sapiens
tcagttctctcatgcctgccct

SEQ ID NO: 8486456 - DNA, 22 bp, Homo sapiens
catctttaatttgtgacaacta

SEQ ID NO: 8486457 - DNA, 22 bp, Homo sapiens
catctttaatttgtgacaacta

SEQ ID NO: 8486458 - DNA, 22 bp, Homo sapiens
catctttaacagaatggatttg

SEQ ID NO: 8486459 - DNA, 22 bp, Homo sapiens
catctttagggaccattattct

SEQ ID NO: 8486460 - DNA, 22 bp, Homo sapiens
catctttagggaccattattct

SEQ ID NO: 8486461 - DNA, 22 bp, Homo sapiens
catctttagttattgaatatag

SEQ ID NO: 8486462 - DNA, 22 bp, Homo sapiens
catctttagttattgaatatag

SEQ ID NO: 8486463 - DNA, 22 bp, Homo sapiens
catctttagttattgaatatag

SEQ ID NO: 8486464 - DNA, 22 bp, Homo sapiens
catctttatttatatagacagg

SEQ ID NO: 8486465 - DNA, 22 bp, Homo sapiens
catctttatttatatagacagg

SEQ ID NO: 8486466 - DNA, 22 bp, Homo sapiens
catctttatttatatagacagg

SEQ ID NO: 8486467 - DNA, 22 bp, Homo sapiens
catccctgattcctagtacagt

SEQ ID NO: 8486468 - DNA, 22 bp, Homo sapiens
catccctggttcctgtgtttaa

SEQ ID NO: 8486469 - DNA, 22 bp, Homo sapiens
catccctgtcgtcaagtctctg

SEQ ID NO: 8486470 - DNA, 22 bp, Homo sapiens
tcaggtggcttcggggagtggc

SEQ ID NO: 8486471 - DNA, 22 bp, Homo sapiens
catccatatgaggcacattggt

SEQ ID NO: 8486472 - DNA, 22 bp, Homo sapiens
catccatagcctcaataaatag

SEQ ID NO: 8486473 - DNA, 22 bp, Homo sapiens
catccatagcttgatctgttcc

SEQ ID NO: 8486474 - DNA, 22 bp, Homo sapiens
catccccaattagcgcccagct

SEQ ID NO: 8486475 - DNA, 22 bp, Homo sapiens
catctttaacaatttacaatgt

SEQ ID NO: 8486476 - DNA, 22 bp, Homo sapiens
catctttaaaggggagacaccc

SEQ ID NO: 8486477 - DNA, 22 bp, Homo sapiens
catctttaacaatttacaatgt

SEQ ID NO: 8486478 - DNA, 22 bp, Homo sapiens
catcttaacaggtctctgaggg

SEQ ID NO: 8486479 - DNA, 22 bp, Homo sapiens
catcttaataaatctcctccct

SEQ ID NO: 8486480 - DNA, 21 bp, Homo sapiens
catcttaattgaaagcagaga

SEQ ID NO: 8486481 - DNA, 22 bp, Homo sapiens
catctttaaaatgggaacaaca

SEQ ID NO: 8486482 - DNA, 22 bp, Homo sapiens
tcaggtgggacctgctaggaca

SEQ ID NO: 8486483 - DNA, 22 bp, Homo sapiens
tcaggtggtcctaagtgccatc

SEQ ID NO: 8486484 - DNA, 22 bp, Homo sapiens
catttacttaaatctttacaag

SEQ ID NO: 8486485 - DNA, 22 bp, Homo sapiens
catttagaaactgtttttaaca

SEQ ID NO: 8486486 - DNA, 17 bp, Homo sapiens
tccaggcagcaactgag

SEQ ID NO: 8486487 - DNA, 22 bp, Homo sapiens
tccaggcactatatatactttt

SEQ ID NO: 8486488 - DNA, 22 bp, Homo sapiens
catttagagaagattacaagga

SEQ ID NO: 8486489 - DNA, 22 bp, Homo sapiens
catttagaagtcttagaactat

SEQ ID NO: 8486490 - DNA, 22 bp, Homo sapiens
catttagacatttgatttgggg

SEQ ID NO: 8486491 - DNA, 19 bp, Homo sapiens
catttagaagtacatatta

SEQ ID NO: 8486492 - DNA, 22 bp, Homo sapiens
catttagttttgcagtagcagg

SEQ ID NO: 8486493 - DNA, 22 bp, Homo sapiens
catttagttatactaaaacatt

SEQ ID NO: 8486494 - DNA, 22 bp, Homo sapiens
catttagttatactaaaacatt

SEQ ID NO: 8486495 - DNA, 22 bp, Homo sapiens
catttagtcaaggacacgtggc

SEQ ID NO: 8486496 - DNA, 22 bp, Homo sapiens
catttagagtcttgcaatttta

SEQ ID NO: 8486497 - DNA, 22 bp, Homo sapiens
catttagagtcttgcaatttta

SEQ ID NO: 8486498 - DNA, 22 bp, Homo sapiens
catttagagagtaaaaattagc

SEQ ID NO: 8486499 - DNA, 22 bp, Homo sapiens
catttagagagtaaaaattagc

SEQ ID NO: 8486500 - DNA, 22 bp, Homo sapiens
tcccagggcttttctcatgctt

SEQ ID NO: 8486501 - DNA, 22 bp, Homo sapiens
tcccagggcttttctcatgctt

SEQ ID NO: 8486502 - DNA, 22 bp, Homo sapiens
tcccagggcttttctcatgctt

SEQ ID NO: 8486503 - DNA, 22 bp, Homo sapiens
tcccagggctctagagtgctgg

SEQ ID NO: 8486504 - DNA, 22 bp, Homo sapiens
tcccagggctctagagtgctgg

SEQ ID NO: 8486505 - DNA, 22 bp, Homo sapiens
tcccagggccgcaaacgagttt

SEQ ID NO: 8486506 - DNA, 22 bp, Homo sapiens
tcccagggtcagtggtgaggcc

SEQ ID NO: 8486507 - DNA, 22 bp, Homo sapiens
tcccagggtcagtggtgaggcc

SEQ ID NO: 8486508 - DNA, 22 bp, Homo sapiens
catttctcactccagcaacttt

SEQ ID NO: 8486509 - DNA, 22 bp, Homo sapiens
tcccagggggatgaacactgcc

SEQ ID NO: 8486510 - DNA, 22 bp, Homo sapiens
tcccagggggatgaacactgcc

SEQ ID NO: 8486511 - DNA, 22 bp, Homo sapiens
tcccagggggatgaacactgcc

SEQ ID NO: 8486512 - DNA, 22 bp, Homo sapiens
tcccagggtcagtggtgaggcc

SEQ ID NO: 8486513 - DNA, 22 bp, Homo sapiens
tcccagggtatcctgtagtaaa

SEQ ID NO: 8486514 - DNA, 22 bp, Homo sapiens
catttattagttagttcgatgt

SEQ ID NO: 8486515 - DNA, 22 bp, Homo sapiens
catttattagttagttcgatgt

SEQ ID NO: 8486516 - DNA, 22 bp, Homo sapiens
tcccagggattaggacatggat

SEQ ID NO: 8486517 - DNA, 22 bp, Homo sapiens
catttatgatagtaatatgaaa

SEQ ID NO: 8486518 - DNA, 22 bp, Homo sapiens
catttatataaaatgtccagaa

SEQ ID NO: 8486519 - DNA, 22 bp, Homo sapiens
catttatataaaatgtccagaa

SEQ ID NO: 8486520 - DNA, 21 bp, Homo sapiens
tcccagggccaggtgccatca

SEQ ID NO: 8486521 - DNA, 21 bp, Homo sapiens
tcccagggccaggtgccatca

SEQ ID NO: 8486522 - DNA, 22 bp, Homo sapiens
tcccagggccgcaaacgagttt

SEQ ID NO: 8486523 - DNA, 21 bp, Homo sapiens
tcccagggccaggtgccatca

SEQ ID NO: 8486524 - DNA, 22 bp, Homo sapiens
tcccagggcagctgtccagaag

SEQ ID NO: 8486525 - DNA, 22 bp, Homo sapiens
tcccagggcagctgtccagaag

SEQ ID NO: 8486526 - DNA, 22 bp, Homo sapiens
tcccagggcagctgtccagaag

SEQ ID NO: 8486527 - DNA, 22 bp, Homo sapiens
tcccagggcactcaccctccct

SEQ ID NO: 8486528 - DNA, 22 bp, Homo sapiens
tccctgctgcactcacacctac

SEQ ID NO: 8486529 - DNA, 22 bp, Homo sapiens
tccctgctgagagtgctctccc

SEQ ID NO: 8486530 - DNA, 22 bp, Homo sapiens
tccctgctgagagtgctctccc

SEQ ID NO: 8486531 - DNA, 22 bp, Homo sapiens
tccctgctcagctcacctggca

SEQ ID NO: 8486532 - DNA, 21 bp, Homo sapiens
tccctgctttctggcccagtc

SEQ ID NO: 8486533 - DNA, 21 bp, Homo sapiens
tccctgctttctggcccagtc

SEQ ID NO: 8486534 - DNA, 22 bp, Homo sapiens
ccaaaagcagctgtctgtgaat

SEQ ID NO: 8486535 - DNA, 22 bp, Homo sapiens
ccaaaaattagatacacatata

SEQ ID NO: 8486536 - DNA, 22 bp, Homo sapiens
ccaaaaattagatacacatata

SEQ ID NO: 8486537 - DNA, 22 bp, Homo sapiens
ccaaagtccatagtttacataa

SEQ ID NO: 8486538 - DNA, 22 bp, Homo sapiens
ccaaagtccatagtttacatta

SEQ ID NO: 8486539 - DNA, 22 bp, Homo sapiens
ccaaagtcagtgctcagtcgtc

SEQ ID NO: 8486540 - DNA, 22 bp, Homo sapiens
ccaaagtccacagtttacatta

SEQ ID NO: 8486541 - DNA, 22 bp, Homo sapiens
ccaaagtcagtgctcagtcgtc

SEQ ID NO: 8486542 - DNA, 22 bp, Homo sapiens
ccaaagtgctaggattacaggc

SEQ ID NO: 8486543 - DNA, 23 bp, Homo sapiens
ccaaagtcgaagtctagtccaga

SEQ ID NO: 8486544 - DNA, 22 bp, Homo sapiens
ccaaagtctggagcagcagagc

SEQ ID NO: 8486545 - DNA, 22 bp, Homo sapiens
ccaaagtctgcattttaacatg

SEQ ID NO: 8486546 - DNA, 22 bp, Homo sapiens
ccaaagtccatagtttacttta

SEQ ID NO: 8486547 - DNA, 22 bp, Homo sapiens
ccaaagtcctttctccacctgc

SEQ ID NO: 8486548 - DNA, 23 bp, Homo sapiens
ccaaagtcgaagtctagtccaga

SEQ ID NO: 8486549 - DNA, 22 bp, Homo sapiens
ccaaagtgctgggattacaggt

SEQ ID NO: 8486550 - DNA, 22 bp, Homo sapiens
ccaaagtgctgggattacaggc

SEQ ID NO: 8486551 - DNA, 22 bp, Homo sapiens
ccaaagtgctgagattacaggt

SEQ ID NO: 8486552 - DNA, 22 bp, Homo sapiens
ccaaagtgctaggattacaggt

SEQ ID NO: 8486553 - DNA, 22 bp, Homo sapiens
catttgattactaaagataatt

SEQ ID NO: 8486554 - DNA, 22 bp, Homo sapiens
catttgattactaaagataatt

SEQ ID NO: 8486555 - DNA, 22 bp, Homo sapiens
catttgatgactcaactcataa

SEQ ID NO: 8486556 - DNA, 22 bp, Homo sapiens
catttgatgactcaactcataa

SEQ ID NO: 8486557 - DNA, 23 bp, Homo sapiens
catttgatcctcacaataaatgg

SEQ ID NO: 8486558 - DNA, 22 bp, Homo sapiens
catttgatctcctgaataaaca

SEQ ID NO: 8486559 - DNA, 22 bp, Homo sapiens
catttgatctcctgaataaaca

SEQ ID NO: 8486560 - DNA, 22 bp, Homo sapiens
catttgaatggcatttcacttt

SEQ ID NO: 8486561 - DNA, 21 bp, Homo sapiens
catttgatccctcatcaggat

SEQ ID NO: 8486562 - DNA, 22 bp, Homo sapiens
catttgatcctcacaacaatct

SEQ ID NO: 8486563 - DNA, 22 bp, Homo sapiens
catttgatcctcacaacaatct

SEQ ID NO: 8486564 - DNA, 22 bp, Homo sapiens
catttgaacctggatgttctta

SEQ ID NO: 8486565 - DNA, 22 bp, Homo sapiens
catttgaacctggatgttctta

SEQ ID NO: 8486566 - DNA, 22 bp, Homo sapiens
catttgaactaataactgtgct

SEQ ID NO: 8486567 - DNA, 20 bp, Homo sapiens
catttgaatctccattctgc

SEQ ID NO: 8486568 - DNA, 22 bp, Homo sapiens
catttgaatgagattgctgtaa

SEQ ID NO: 8486569 - DNA, 22 bp, Homo sapiens
catttgaagacttagaagagga

SEQ ID NO: 8486570 - DNA, 22 bp, Homo sapiens
catttgaactaataactgtgct

SEQ ID NO: 8486571 - DNA, 22 bp, Homo sapiens
tccctgcctctcagacttcctt

SEQ ID NO: 8486572 - DNA, 22 bp, Homo sapiens
catttggaaagagactagagaa

SEQ ID NO: 8486573 - DNA, 20 bp, Homo sapiens
tccctgccttttactgctgg

SEQ ID NO: 8486574 - DNA, 22 bp, Homo sapiens
tccctgcctgacagcacccacc

SEQ ID NO: 8486575 - DNA, 22 bp, Homo sapiens
catttgctctgtgtcagtggca

SEQ ID NO: 8486576 - DNA, 17 bp, Homo sapiens
ccacagcctggcacttg

SEQ ID NO: 8486577 - DNA, 22 bp, Homo sapiens
ccacagctagggcaatctgatt

SEQ ID NO: 8486578 - DNA, 22 bp, Homo sapiens
ccacagctagggcaatctgatt

SEQ ID NO: 8486579 - DNA, 22 bp, Homo sapiens
ccacagctagggcaatctgatt

SEQ ID NO: 8486580 - DNA, 22 bp, Homo sapiens
ccacagccattccagggaggct

SEQ ID NO: 8486581 - DNA, 22 bp, Homo sapiens
ccacagcatgcaggcctgacac

SEQ ID NO: 8486582 - DNA, 22 bp, Homo sapiens
ccacagccattccagggaggct

SEQ ID NO: 8486583 - DNA, 22 bp, Homo sapiens
ccacagcacctgcagccagttg

SEQ ID NO: 8486584 - DNA, 22 bp, Homo sapiens
ccacagcacctgcagccagttg

SEQ ID NO: 8486585 - DNA, 22 bp, Homo sapiens
ccacagcaccgctgccagtccc

SEQ ID NO: 8486586 - DNA, 22 bp, Homo sapiens
ccacagcaccgctgccagtccc

SEQ ID NO: 8486587 - DNA, 22 bp, Homo sapiens
ccacagcaccgctgccagtccc

SEQ ID NO: 8486588 - DNA, 22 bp, Homo sapiens
ccacagattatttctaaacagg

SEQ ID NO: 8486589 - DNA, 22 bp, Homo sapiens
ccacagagttgatgcaataaga

SEQ ID NO: 8486590 - DNA, 22 bp, Homo sapiens
ccacagagttacaaaacagtca

SEQ ID NO: 8486591 - DNA, 22 bp, Homo sapiens
ccacagagttacaaaacagtca

SEQ ID NO: 8486592 - DNA, 22 bp, Homo sapiens
ccacagcatgcaggcctgacac

SEQ ID NO: 8486593 - DNA, 22 bp, Homo sapiens
ccacagcatgcaggcctgacac

SEQ ID NO: 8486594 - DNA, 22 bp, Homo sapiens
ccacagcatgcaggcctgacac

SEQ ID NO: 8486595 - DNA, 18 bp, Homo sapiens
ccacagcagagttcttac

SEQ ID NO: 8486596 - DNA, 18 bp, Homo sapiens
ccacagcagagttcttac

SEQ ID NO: 8486597 - DNA, 22 bp, Homo sapiens
ccacagcaggactggagccgcc

SEQ ID NO: 8486598 - DNA, 22 bp, Homo sapiens
ccacagcaggactggagccgcc

SEQ ID NO: 8486599 - DNA, 22 bp, Homo sapiens
ccacagaggacaactgcctggc

SEQ ID NO: 8486600 - DNA, 23 bp, Homo sapiens
ccacagagctgccaattcctgtg

SEQ ID NO: 8486601 - DNA, 23 bp, Homo sapiens
ccacagagctgccaattcctgtg

SEQ ID NO: 8486602 - DNA, 22 bp, Homo sapiens
ccacagaggacaactgcctggc

SEQ ID NO: 8486603 - DNA, 22 bp, Homo sapiens
ccacagagtccgcatttgaggc

SEQ ID NO: 8486604 - DNA, 22 bp, Homo sapiens
ccacagagtcttccttctcttc

SEQ ID NO: 8486605 - DNA, 22 bp, Homo sapiens
ccacagagtccgcatttgaggc

SEQ ID NO: 8486606 - DNA, 20 bp, Homo sapiens
ccacagaggacagggctgtg

SEQ ID NO: 8486607 - DNA, 22 bp, Homo sapiens
ccacagaggacaactgcctggc

SEQ ID NO: 8486608 - DNA, 23 bp, Homo sapiens
tcctgccagatgactcctttctt

SEQ ID NO: 8486609 - DNA, 22 bp, Homo sapiens
tcctgccactgcacatatactt

SEQ ID NO: 8486610 - DNA, 22 bp, Homo sapiens
tcctgccaggagtgctggccct

SEQ ID NO: 8486611 - DNA, 22 bp, Homo sapiens
tcctgccatttgctttttctcc

SEQ ID NO: 8486612 - DNA, 22 bp, Homo sapiens
tcctgccatctgctgttgatct

SEQ ID NO: 8486613 - DNA, 20 bp, Homo sapiens
tcctgccacacctcagttgc

SEQ ID NO: 8486614 - DNA, 20 bp, Homo sapiens
tcctgccacacctcagttgc

SEQ ID NO: 8486615 - DNA, 22 bp, Homo sapiens
tcctgccacctgcacagctccc

SEQ ID NO: 8486616 - DNA, 20 bp, Homo sapiens
tcctgcagttcctaggaggg

SEQ ID NO: 8486617 - DNA, 20 bp, Homo sapiens
tcctgcagttcctaggaggg

SEQ ID NO: 8486618 - DNA, 20 bp, Homo sapiens
tcctgcagttcctaggaggg

SEQ ID NO: 8486619 - DNA, 22 bp, Homo sapiens
ccacaaattaggttttgcttgt

SEQ ID NO: 8486620 - DNA, 22 bp, Homo sapiens
ccacaaattaggttttgcttgt

SEQ ID NO: 8486621 - DNA, 22 bp, Homo sapiens
ccacaagactctgtcagcataa

SEQ ID NO: 8486622 - DNA, 22 bp, Homo sapiens
ccaatgttttatacagaagtac

SEQ ID NO: 8486623 - DNA, 22 bp, Homo sapiens
ccaagggctatttacagaacag

SEQ ID NO: 8486624 - DNA, 22 bp, Homo sapiens
ccacacagggggatgagttatt

SEQ ID NO: 8486625 - DNA, 22 bp, Homo sapiens
tcctgcagtgtgtctcctgcac

SEQ ID NO: 8486626 - DNA, 22 bp, Homo sapiens
tcctgcagtgtgtctcctgcac

SEQ ID NO: 8486627 - DNA, 22 bp, Homo sapiens
ccacacagataagtgttttcta

SEQ ID NO: 8486628 - DNA, 22 bp, Homo sapiens
ccacaagtttcagcacccagag

SEQ ID NO: 8486629 - DNA, 22 bp, Homo sapiens
ccacaaggcctgtggggctgct

SEQ ID NO: 8486630 - DNA, 22 bp, Homo sapiens
ccaagggaaggatgtatatgat

SEQ ID NO: 8486631 - DNA, 22 bp, Homo sapiens
tcctccccaaagcccagcctgg

SEQ ID NO: 8486632 - DNA, 22 bp, Homo sapiens
tcctcccaacttttccatctca

SEQ ID NO: 8486633 - DNA, 22 bp, Homo sapiens
tcctcccaacttttccatctca

SEQ ID NO: 8486634 - DNA, 22 bp, Homo sapiens
tcctcccaacttttccatctca

SEQ ID NO: 8486635 - DNA, 22 bp, Homo sapiens
tcctcccacataggacaatggg

SEQ ID NO: 8486636 - DNA, 22 bp, Homo sapiens
tcctcccacataggacaatggg

SEQ ID NO: 8486637 - DNA, 22 bp, Homo sapiens
tcctcccacataggacaatggg

SEQ ID NO: 8486638 - DNA, 22 bp, Homo sapiens
tcctcccacataggacaatggg

SEQ ID NO: 8486639 - DNA, 22 bp, Homo sapiens
ccaaagtttttatagttagcat

SEQ ID NO: 8486640 - DNA, 22 bp, Homo sapiens
ccaaagtgtgggagaagaggta

SEQ ID NO: 8486641 - DNA, 22 bp, Homo sapiens
ccaaagtgctggggttacaggc

SEQ ID NO: 8486642 - DNA, 22 bp, Homo sapiens
ccaaatattaacaaagtaattt

SEQ ID NO: 8486643 - DNA, 23 bp, Homo sapiens
tcctcccaaatttcagcctcatt

SEQ ID NO: 8486644 - DNA, 23 bp, Homo sapiens
tcctcccaaatttcagcctcatt

SEQ ID NO: 8486645 - DNA, 23 bp, Homo sapiens
tcctcccaaatttcagcctcatt

SEQ ID NO: 8486646 - DNA, 23 bp, Homo sapiens
tcctcccaaatttcagcctcatt

SEQ ID NO: 8486647 - DNA, 23 bp, Homo sapiens
tcctcccaaatttcagcctcatt

SEQ ID NO: 8486648 - DNA, 22 bp, Homo sapiens
ccaaatgctccactgactttgg

SEQ ID NO: 8486649 - DNA, 22 bp, Homo sapiens
ccactgagcagtagctgcgtcg

SEQ ID NO: 8486650 - DNA, 22 bp, Homo sapiens
ccactgaggcctgggcccaggg

SEQ ID NO: 8486651 - DNA, 22 bp, Homo sapiens
ccactgaggttttgtggttatg

SEQ ID NO: 8486652 - DNA, 22 bp, Homo sapiens
ccactgaggggtcatggtggga

SEQ ID NO: 8486653 - DNA, 22 bp, Homo sapiens
ccactgagtacccgatggctgc

SEQ ID NO: 8486654 - DNA, 22 bp, Homo sapiens
ccactgagtgagcagagcaggg

SEQ ID NO: 8486655 - DNA, 22 bp, Homo sapiens
ccactgatcctgactttggagc

SEQ ID NO: 8486656 - DNA, 22 bp, Homo sapiens
ccactgattctgccaggtctct

SEQ ID NO: 8486657 - DNA, 22 bp, Homo sapiens
ccactgatcctgactttggagc

SEQ ID NO: 8486658 - DNA, 22 bp, Homo sapiens
ccagaaaaggagctgcaggatg

SEQ ID NO: 8486659 - DNA, 22 bp, Homo sapiens
ccagaaaagcatctggttcttt

SEQ ID NO: 8486660 - DNA, 22 bp, Homo sapiens
ccactgcctatttgcagggccc

SEQ ID NO: 8486661 - DNA, 22 bp, Homo sapiens
ccactgccgtgggccttgggga

SEQ ID NO: 8486662 - DNA, 21 bp, Homo sapiens
ccagaagctgcttgcaggcta

SEQ ID NO: 8486663 - DNA, 22 bp, Homo sapiens
ccagaagcttcaaggagattct

SEQ ID NO: 8486664 - DNA, 22 bp, Homo sapiens
ccagaagcttctacacaggaga

SEQ ID NO: 8486665 - DNA, 22 bp, Homo sapiens
ccagaagcaaaacagacagttt

SEQ ID NO: 8486666 - DNA, 22 bp, Homo sapiens
ccagaagagatcacagttcttg

SEQ ID NO: 8486667 - DNA, 22 bp, Homo sapiens
ccagaatcatcatctgaagcct

SEQ ID NO: 8486668 - DNA, 22 bp, Homo sapiens
ccagaagtggctttctcaggga

SEQ ID NO: 8486669 - DNA, 22 bp, Homo sapiens
ccagaagtgtctatcaagatgt

SEQ ID NO: 8486670 - DNA, 22 bp, Homo sapiens
ccagaagtcaagtaagatgaag

SEQ ID NO: 8486671 - DNA, 22 bp, Homo sapiens
ccagaagtcaggaatgagtctt

SEQ ID NO: 8486672 - DNA, 20 bp, Homo sapiens
ccagaaggtaggatggaaca

SEQ ID NO: 8486673 - DNA, 22 bp, Homo sapiens
ccagaagtcaagtaagatgaag

SEQ ID NO: 8486674 - DNA, 20 bp, Homo sapiens
ccagaaggtttgccactttc

SEQ ID NO: 8486675 - DNA, 19 bp, Homo sapiens
ccagaagggcagctatgga

SEQ ID NO: 8486676 - DNA, 22 bp, Homo sapiens
ccagaagggctattgcagtgac

SEQ ID NO: 8486677 - DNA, 22 bp, Homo sapiens
ccagaagggctattgcagtgac

SEQ ID NO: 8486678 - DNA, 22 bp, Homo sapiens
ccagaagggctattgcagtgac

SEQ ID NO: 8486679 - DNA, 22 bp, Homo sapiens
ccactgagaaggggttggggtc

SEQ ID NO: 8486680 - DNA, 22 bp, Homo sapiens
ccactcttgaatcaagagctca

SEQ ID NO: 8486681 - DNA, 22 bp, Homo sapiens
ccactctgctgtgctccatgat

SEQ ID NO: 8486682 - DNA, 23 bp, Homo sapiens
ccactgaagaatccagggagttt

SEQ ID NO: 8486683 - DNA, 22 bp, Homo sapiens
ccactctgattttggctccact

SEQ ID NO: 8486684 - DNA, 22 bp, Homo sapiens
ccactctgattttggctccact

SEQ ID NO: 8486685 - DNA, 22 bp, Homo sapiens
ccactctgctgtgctccatgat

SEQ ID NO: 8486686 - DNA, 22 bp, Homo sapiens
ccactctgctgtgctccatgat

SEQ ID NO: 8486687 - DNA, 22 bp, Homo sapiens
ccactctgattggtcacctctg

SEQ ID NO: 8486688 - DNA, 22 bp, Homo sapiens
ccactctgatttcaagggagat

SEQ ID NO: 8486689 - DNA, 23 bp, Homo sapiens
ccacctggactctgggcaggtgc

SEQ ID NO: 8486690 - DNA, 20 bp, Homo sapiens
ccactccgcccccagagggc

SEQ ID NO: 8486691 - DNA, 16 bp, Homo sapiens
ccacctgcagctctca

SEQ ID NO: 8486692 - DNA, 16 bp, Homo sapiens
ccacctgcagctctca

SEQ ID NO: 8486693 - DNA, 16 bp, Homo sapiens
ccacctgcagctctca

SEQ ID NO: 8486694 - DNA, 22 bp, Homo sapiens
ccacagtgacacgggctggccc

SEQ ID NO: 8486695 - DNA, 22 bp, Homo sapiens
ccacagtgagttagattgacca

SEQ ID NO: 8486696 - DNA, 22 bp, Homo sapiens
ccacagtgagttagattgacca

SEQ ID NO: 8486697 - DNA, 22 bp, Homo sapiens
ccacagtagcatccaaacagta

SEQ ID NO: 8486698 - DNA, 22 bp, Homo sapiens
ccacagtccgggctggcaggac

SEQ ID NO: 8486699 - DNA, 22 bp, Homo sapiens
ccacagtacaggaaatcttgtt

SEQ ID NO: 8486700 - DNA, 22 bp, Homo sapiens
ccacagtccgggctggcaggac

SEQ ID NO: 8486701 - DNA, 22 bp, Homo sapiens
ccacagtcctggcttctgtctg

SEQ ID NO: 8486702 - DNA, 22 bp, Homo sapiens
ccacagtctagctagaaggcat

SEQ ID NO: 8486703 - DNA, 22 bp, Homo sapiens
ccacagtctatgcaacaaggtc

SEQ ID NO: 8486704 - DNA, 22 bp, Homo sapiens
ccacagtgaaatcttgatggag

SEQ ID NO: 8486705 - DNA, 20 bp, Homo sapiens
tcctggtcatgtggctgggc

SEQ ID NO: 8486706 - DNA, 22 bp, Homo sapiens
tcctggtctacactgcattggg

SEQ ID NO: 8486707 - DNA, 22 bp, Homo sapiens
tcctggtctacactgcattggg

SEQ ID NO: 8486708 - DNA, 22 bp, Homo sapiens
tcctggtcttcaggttgcaaaa

SEQ ID NO: 8486709 - DNA, 23 bp, Homo sapiens
tcctggtgacatgcctgagcatc

SEQ ID NO: 8486710 - DNA, 23 bp, Homo sapiens
tcctggtgacatgcctgagcatc

SEQ ID NO: 8486711 - DNA, 19 bp, Homo sapiens
tcctggtgcttgacactga

SEQ ID NO: 8486712 - DNA, 22 bp, Homo sapiens
tcctggtgaggctagaagtgtc

SEQ ID NO: 8486713 - DNA, 22 bp, Homo sapiens
ccacagggtcagccactctgca

SEQ ID NO: 8486714 - DNA, 22 bp, Homo sapiens
ccacagggtcagccactctgca

SEQ ID NO: 8486715 - DNA, 22 bp, Homo sapiens
ccacagggtcagccactctgca

SEQ ID NO: 8486716 - DNA, 18 bp, Homo sapiens
tcctggtggagaagtggt

SEQ ID NO: 8486717 - DNA, 20 bp, Homo sapiens
tcctggtggatactgcttaa

SEQ ID NO: 8486718 - DNA, 22 bp, Homo sapiens
tcctggtgcttgtatttgaagt

SEQ ID NO: 8486719 - DNA, 22 bp, Homo sapiens
ccacagtaaatggattcagacc

SEQ ID NO: 8486720 - DNA, 22 bp, Homo sapiens
ccacagtaaagaaacaacttcg

SEQ ID NO: 8486721 - DNA, 22 bp, Homo sapiens
ccacagtaaagaaacaacttcg

SEQ ID NO: 8486722 - DNA, 22 bp, Homo sapiens
ccacagtaagagatagtttatg

SEQ ID NO: 8486723 - DNA, 22 bp, Homo sapiens
ccacagggtcagccactctgca

SEQ ID NO: 8486724 - DNA, 22 bp, Homo sapiens
ccacagggtgtcatcagcttga

SEQ ID NO: 8486725 - DNA, 22 bp, Homo sapiens
ccagaggaaaaatatctcccta

SEQ ID NO: 8486726 - DNA, 22 bp, Homo sapiens
tctccataggcagttcataaca

SEQ ID NO: 8486727 - DNA, 21 bp, Homo sapiens
tctcccaaggaggtcctgagg

SEQ ID NO: 8486728 - DNA, 22 bp, Homo sapiens
tctcccaaggcacagaaagagt

SEQ ID NO: 8486729 - DNA, 22 bp, Homo sapiens
tctcccaacatgtggaggtcag

SEQ ID NO: 8486730 - DNA, 22 bp, Homo sapiens
tctcccaagcctggcaggggca

SEQ ID NO: 8486731 - DNA, 22 bp, Homo sapiens
tctcccaacatgtggaggtcag

SEQ ID NO: 8486732 - DNA, 22 bp, Homo sapiens
tctcccaacctctggtgggtgc

SEQ ID NO: 8486733 - DNA, 22 bp, Homo sapiens
tctcccacagtctcccatggct

SEQ ID NO: 8486734 - DNA, 22 bp, Homo sapiens
tctcccacagccgtgcttcaag

SEQ ID NO: 8486735 - DNA, 22 bp, Homo sapiens
tctcccaagtgaccaggaaaga

SEQ ID NO: 8486736 - DNA, 22 bp, Homo sapiens
tctcccaagtgaccaggaaaga

SEQ ID NO: 8486737 - DNA, 22 bp, Homo sapiens
ccagacagcagttaaaggacat

SEQ ID NO: 8486738 - DNA, 20 bp, Homo sapiens
ccagacagcacctgcctggt

SEQ ID NO: 8486739 - DNA, 22 bp, Homo sapiens
ccagagctgatgggcccagggt

SEQ ID NO: 8486740 - DNA, 20 bp, Homo sapiens
ccagagctgatggctgcccg

SEQ ID NO: 8486741 - DNA, 22 bp, Homo sapiens
ccagagcctgctgagccccatt

SEQ ID NO: 8486742 - DNA, 22 bp, Homo sapiens
ccagagcctgctgagccccatt

SEQ ID NO: 8486743 - DNA, 22 bp, Homo sapiens
ccagacaggaacacacatctcc

SEQ ID NO: 8486744 - DNA, 22 bp, Homo sapiens
ccagacaggaacacacatctcc

SEQ ID NO: 8486745 - DNA, 22 bp, Homo sapiens
ccagagctgcaggtaaaatgct

SEQ ID NO: 8486746 - DNA, 22 bp, Homo sapiens
ccagagctgcatccagcaggtt

SEQ ID NO: 8486747 - DNA, 22 bp, Homo sapiens
ccagagctgcatccagcaggtt

SEQ ID NO: 8486748 - DNA, 22 bp, Homo sapiens
ccagagctgcatccagcaggtt

SEQ ID NO: 8486749 - DNA, 22 bp, Homo sapiens
ccagagctgcatccagcaggtt

SEQ ID NO: 8486750 - DNA, 22 bp, Homo sapiens
ccagagctgcatccagcaggtt

SEQ ID NO: 8486751 - DNA, 22 bp, Homo sapiens
ccagagctgcatccagcaggtt

SEQ ID NO: 8486752 - DNA, 22 bp, Homo sapiens
ccagagctgattcctgggactt

SEQ ID NO: 8486753 - DNA, 22 bp, Homo sapiens
ccagagctgattcctgggactt

SEQ ID NO: 8486754 - DNA, 22 bp, Homo sapiens
ccagagctgatgggcccagggt

SEQ ID NO: 8486755 - DNA, 18 bp, Homo sapiens
ccagagctggctcctcgc

SEQ ID NO: 8486756 - DNA, 18 bp, Homo sapiens
ccagagctggctcctcgc

SEQ ID NO: 8486757 - DNA, 18 bp, Homo sapiens
ccagagctggctcctcgc

SEQ ID NO: 8486758 - DNA, 22 bp, Homo sapiens
ccagagcttcggggcggctgta

SEQ ID NO: 8486759 - DNA, 22 bp, Homo sapiens
ccagagcttcggggcggctgta

SEQ ID NO: 8486760 - DNA, 22 bp, Homo sapiens
ccagagcttgacgtgcaacgga

SEQ ID NO: 8486761 - DNA, 22 bp, Homo sapiens
ccagagcttcggggcggctgta

SEQ ID NO: 8486762 - DNA, 22 bp, Homo sapiens
ccagagcttgacgtgcaacgga

SEQ ID NO: 8486763 - DNA, 22 bp, Homo sapiens
ccagaggagttgaggctttggg

SEQ ID NO: 8486764 - DNA, 22 bp, Homo sapiens
ccagaggagttgaggctttggg

SEQ ID NO: 8486765 - DNA, 22 bp, Homo sapiens
ccagaggagggctctgatgagg

SEQ ID NO: 8486766 - DNA, 22 bp, Homo sapiens
ccagaggagggctctgatgagg

SEQ ID NO: 8486767 - DNA, 22 bp, Homo sapiens
ccagaggagggctctgatgagg

SEQ ID NO: 8486768 - DNA, 22 bp, Homo sapiens
ccagaggagggctctgatgagg

SEQ ID NO: 8486769 - DNA, 22 bp, Homo sapiens
ccagaggagcaggctggctcca

SEQ ID NO: 8486770 - DNA, 22 bp, Homo sapiens
ccagaggagcaggctggctcca

SEQ ID NO: 8486771 - DNA, 22 bp, Homo sapiens
ccagaggagatgcctcctctgt

SEQ ID NO: 8486772 - DNA, 22 bp, Homo sapiens
ccagaggagcaggctggctcca

SEQ ID NO: 8486773 - DNA, 22 bp, Homo sapiens
ccagaggagatgcctcctctgt

SEQ ID NO: 8486774 - DNA, 22 bp, Homo sapiens
ccagaggagatgcctcctctgt

SEQ ID NO: 8486775 - DNA, 22 bp, Homo sapiens
ccagaggacttgggggctgaat

SEQ ID NO: 8486776 - DNA, 22 bp, Homo sapiens
ccagaggacttgggggctgaat

SEQ ID NO: 8486777 - DNA, 22 bp, Homo sapiens
ccagaggacttgggggctgaat

SEQ ID NO: 8486778 - DNA, 22 bp, Homo sapiens
tctctacagatcctatatagaa

SEQ ID NO: 8486779 - DNA, 22 bp, Homo sapiens
tctctacagatcctatatagaa

SEQ ID NO: 8486780 - DNA, 22 bp, Homo sapiens
tctctacagacactgttgactt

SEQ ID NO: 8486781 - DNA, 21 bp, Homo sapiens
tctctacactttcactaggct

SEQ ID NO: 8486782 - DNA, 22 bp, Homo sapiens
tctctacagaatcttattattg

SEQ ID NO: 8486783 - DNA, 21 bp, Homo sapiens
tctctacactttcactaggct

SEQ ID NO: 8486784 - DNA, 22 bp, Homo sapiens
tctctacacaggattcacatga

SEQ ID NO: 8486785 - DNA, 19 bp, Homo sapiens
tctctacactacatttcta

SEQ ID NO: 8486786 - DNA, 22 bp, Homo sapiens
tctctacaaaaattagcatgca

SEQ ID NO: 8486787 - DNA, 22 bp, Homo sapiens
tctctaattcaaccagacactt

SEQ ID NO: 8486788 - DNA, 19 bp, Homo sapiens
ccagaggactgttaatgaa

SEQ ID NO: 8486789 - DNA, 22 bp, Homo sapiens
tctctagtataatatagcaaaa

SEQ ID NO: 8486790 - DNA, 22 bp, Homo sapiens
tctctagagcatgtgctgggca

SEQ ID NO: 8486791 - DNA, 22 bp, Homo sapiens
tctctagacatggggaatgtca

SEQ ID NO: 8486792 - DNA, 22 bp, Homo sapiens
tctctacataacctcaatactc

SEQ ID NO: 8486793 - DNA, 18 bp, Homo sapiens
tctctaccagaagtgacg

SEQ ID NO: 8486794 - DNA, 22 bp, Homo sapiens
ccagatgaggtcatgctgggtt

SEQ ID NO: 8486795 - DNA, 19 bp, Homo sapiens
ccagatgagcagctgagat

SEQ ID NO: 8486796 - DNA, 21 bp, Homo sapiens
ccagatgcaaatgcagacatt

SEQ ID NO: 8486797 - DNA, 18 bp, Homo sapiens
ccagatggccagtctgct

SEQ ID NO: 8486798 - DNA, 22 bp, Homo sapiens
ccagatggtatagtagggagag

SEQ ID NO: 8486799 - DNA, 20 bp, Homo sapiens
ccagatggtccctgtgaaaa

SEQ ID NO: 8486800 - DNA, 19 bp, Homo sapiens
tctctctgtacattagata

SEQ ID NO: 8486801 - DNA, 22 bp, Homo sapiens
ccagatgtatgtatgagtgcat

SEQ ID NO: 8486802 - DNA, 22 bp, Homo sapiens
ccagatggtttgcatgggaggg

SEQ ID NO: 8486803 - DNA, 22 bp, Homo sapiens
ccagatcttcttttcagtgtct

SEQ ID NO: 8486804 - DNA, 21 bp, Homo sapiens
ccagatcctgcttcctcaccc

SEQ ID NO: 8486805 - DNA, 22 bp, Homo sapiens
ccagatgagaccacactgctgg

SEQ ID NO: 8486806 - DNA, 19 bp, Homo sapiens
ccagatgagcagctgagat

SEQ ID NO: 8486807 - DNA, 22 bp, Homo sapiens
ccagatgagaccacactgctgg

SEQ ID NO: 8486808 - DNA, 22 bp, Homo sapiens
ccagatccctgtttgcctctgg

SEQ ID NO: 8486809 - DNA, 17 bp, Homo sapiens
ccagatcccagtcctta

SEQ ID NO: 8486810 - DNA, 22 bp, Homo sapiens
ccagatatcactgccgtgttgt

SEQ ID NO: 8486811 - DNA, 22 bp, Homo sapiens
ccagatattcacttttacatgc

SEQ ID NO: 8486812 - DNA, 22 bp, Homo sapiens
ccagatatcactgccgtgttgt

SEQ ID NO: 8486813 - DNA, 22 bp, Homo sapiens
ccagaggtgccacagaaagagc

SEQ ID NO: 8486814 - DNA, 22 bp, Homo sapiens
ccagaggtgctgggagaggtct

SEQ ID NO: 8486815 - DNA, 22 bp, Homo sapiens
ccagatagcaggtcagaagtgc

SEQ ID NO: 8486816 - DNA, 22 bp, Homo sapiens
ccagatatcactgccgtgttgt

SEQ ID NO: 8486817 - DNA, 22 bp, Homo sapiens
ccagatagggatgagagtgcta

SEQ ID NO: 8486818 - DNA, 22 bp, Homo sapiens
ccagatatcactgccgtgttgt

SEQ ID NO: 8486819 - DNA, 22 bp, Homo sapiens
ccagatagaaaagaaggcagga

SEQ ID NO: 8486820 - DNA, 17 bp, Homo sapiens
tctgtcttgactgtcac

SEQ ID NO: 8486821 - DNA, 17 bp, Homo sapiens
tctgtcttgactgtcac

SEQ ID NO: 8486822 - DNA, 17 bp, Homo sapiens
tctgtcttgactgtcac

SEQ ID NO: 8486823 - DNA, 22 bp, Homo sapiens
tctgtcttggccagccatctgg

SEQ ID NO: 8486824 - DNA, 22 bp, Homo sapiens
tctgtcttggccagccatctgg

SEQ ID NO: 8486825 - DNA, 23 bp, Homo sapiens
tctgtcttgtttaggccactgtt

SEQ ID NO: 8486826 - DNA, 23 bp, Homo sapiens
tctgtcttgtttaggccactgtt

SEQ ID NO: 8486827 - DNA, 21 bp, Homo sapiens
tctgtcttcctcagcctaagg

SEQ ID NO: 8486828 - DNA, 21 bp, Homo sapiens
tctgtcttcctcagcctaagg

SEQ ID NO: 8486829 - DNA, 22 bp, Homo sapiens
tctgtcttctgtagctaataat

SEQ ID NO: 8486830 - DNA, 22 bp, Homo sapiens
tctgtcttctgtagctaataat

SEQ ID NO: 8486831 - DNA, 22 bp, Homo sapiens
tctgtcttctgtagctaataat

SEQ ID NO: 8486832 - DNA, 22 bp, Homo sapiens
tctgtcttctgtagctaataat

SEQ ID NO: 8486833 - DNA, 22 bp, Homo sapiens
tctgtggattttagtgttcatg

SEQ ID NO: 8486834 - DNA, 19 bp, Homo sapiens
tctgtggcacctgggaggg

SEQ ID NO: 8486835 - DNA, 22 bp, Homo sapiens
tctgtggcacgattgcactgca

SEQ ID NO: 8486836 - DNA, 18 bp, Homo sapiens
tctgtggcagcagtgcac

SEQ ID NO: 8486837 - DNA, 21 bp, Homo sapiens
tctgtggcagcatgatgaggt

SEQ ID NO: 8486838 - DNA, 22 bp, Homo sapiens
tctgtcttagcatctttgctca

SEQ ID NO: 8486839 - DNA, 22 bp, Homo sapiens
tctgtcttagccatctcaggct

SEQ ID NO: 8486840 - DNA, 22 bp, Homo sapiens
tctgtcttagcatctttgctca

SEQ ID NO: 8486841 - DNA, 22 bp, Homo sapiens
tctgtcttcatcagcatgtgat

SEQ ID NO: 8486842 - DNA, 22 bp, Homo sapiens
tctgtcttagccatctcaggct

SEQ ID NO: 8486843 - DNA, 23 bp, Homo sapiens
tctgtctgtgtatgtgcagaaag

SEQ ID NO: 8486844 - DNA, 18 bp, Homo sapiens
tctgtctgtgttgtcttt

SEQ ID NO: 8486845 - DNA, 18 bp, Homo sapiens
tctgtctgtgttgtcttt

SEQ ID NO: 8486846 - DNA, 21 bp, Homo sapiens
tctgtctggttttagagtggc

SEQ ID NO: 8486847 - DNA, 18 bp, Homo sapiens
tctgtctgtacaagtatc

SEQ ID NO: 8486848 - DNA, 21 bp, Homo sapiens
tctgtctggttttagagtggc

SEQ ID NO: 8486849 - DNA, 17 bp, Homo sapiens
tctgtctgtggtccact

SEQ ID NO: 8486850 - DNA, 22 bp, Homo sapiens
tctgtctgggtgcctcgagtac

SEQ ID NO: 8486851 - DNA, 22 bp, Homo sapiens
tctgtcataagtgctgaagtat

SEQ ID NO: 8486852 - DNA, 22 bp, Homo sapiens
tctgtcatcaaatatgctttct

SEQ ID NO: 8486853 - DNA, 22 bp, Homo sapiens
tctgtcatccaggctggaatat

SEQ ID NO: 8486854 - DNA, 22 bp, Homo sapiens
tctgtctgggtgcctcgagtac

SEQ ID NO: 8486855 - DNA, 21 bp, Homo sapiens
tctgtctggttttagagtggc

SEQ ID NO: 8486856 - DNA, 19 bp, Homo sapiens
tctgtcagtgcatcacctc

SEQ ID NO: 8486857 - DNA, 22 bp, Homo sapiens
tctgtcagcccctcagctgtca

SEQ ID NO: 8486858 - DNA, 21 bp, Homo sapiens
tctgtcagaaaagctgaggct

SEQ ID NO: 8486859 - DNA, 22 bp, Homo sapiens
tctgtcacttttatttactgaa

SEQ ID NO: 8486860 - DNA, 19 bp, Homo sapiens
tctgtcactgggggtattc

SEQ ID NO: 8486861 - DNA, 23 bp, Homo sapiens
tctgtcactttctgctgtggagt

SEQ ID NO: 8486862 - DNA, 22 bp, Homo sapiens
tctgtcacttattaagatggat

SEQ ID NO: 8486863 - DNA, 22 bp, Homo sapiens
tctgtcacccgagcaggcgaga

SEQ ID NO: 8486864 - DNA, 22 bp, Homo sapiens
tctgtcacccctgtttctggct

SEQ ID NO: 8486865 - DNA, 22 bp, Homo sapiens
ccaggaggcggaggttgcagcg

SEQ ID NO: 8486866 - DNA, 22 bp, Homo sapiens
tctgtcaccgagggcatccaaa

SEQ ID NO: 8486867 - DNA, 23 bp, Homo sapiens
tctgtcacctatggctgctcttc

SEQ ID NO: 8486868 - DNA, 22 bp, Homo sapiens
tctgtcactattggccagaaca

SEQ ID NO: 8486869 - DNA, 22 bp, Homo sapiens
tctgtcactccctgatgatgaa

SEQ ID NO: 8486870 - DNA, 22 bp, Homo sapiens
tctgtcactctagagatggcag

SEQ ID NO: 8486871 - DNA, 22 bp, Homo sapiens
tctgtcactgagctcaggattc

SEQ ID NO: 8486872 - DNA, 22 bp, Homo sapiens
ccaggaggcggaaggtacagtg

SEQ ID NO: 8486873 - DNA, 22 bp, Homo sapiens
ccaggaggcggaggttgcagcg

SEQ ID NO: 8486874 - DNA, 22 bp, Homo sapiens
ccaggaggcggaggttgcagcg

SEQ ID NO: 8486875 - DNA, 22 bp, Homo sapiens
ccaggaggcggaaggtacagtg

SEQ ID NO: 8486876 - DNA, 22 bp, Homo sapiens
ccaggaggcggaaggtacagtg

SEQ ID NO: 8486877 - DNA, 22 bp, Homo sapiens
ccaggaggcggaaggtacagtg

SEQ ID NO: 8486878 - DNA, 22 bp, Homo sapiens
ccaggaggcggaaggtacagtg

SEQ ID NO: 8486879 - DNA, 22 bp, Homo sapiens
ccaggaggcggaaggtacagtg

SEQ ID NO: 8486880 - DNA, 22 bp, Homo sapiens
ccaggaggcagaagttgcagtg

SEQ ID NO: 8486881 - DNA, 22 bp, Homo sapiens
ccaggaggcagaagttgcagtg

SEQ ID NO: 8486882 - DNA, 22 bp, Homo sapiens
ccaggaggcagaagttgcagtg

SEQ ID NO: 8486883 - DNA, 22 bp, Homo sapiens
ccaggaggcagaggttacagtg

SEQ ID NO: 8486884 - DNA, 22 bp, Homo sapiens
ccaggaggcagaggttgtagtg

SEQ ID NO: 8486885 - DNA, 22 bp, Homo sapiens
ccaggaggcagaggttgtagtg

SEQ ID NO: 8486886 - DNA, 22 bp, Homo sapiens
ccaggaggcagaggttgtagtg

SEQ ID NO: 8486887 - DNA, 22 bp, Homo sapiens
ccaggaagcctgtgtctctgga

SEQ ID NO: 8486888 - DNA, 22 bp, Homo sapiens
ccaggaagcctcagatgctgag

SEQ ID NO: 8486889 - DNA, 22 bp, Homo sapiens
ccaggaagcctcagatgctgag

SEQ ID NO: 8486890 - DNA, 22 bp, Homo sapiens
ccaggaagcctcagatgctgag

SEQ ID NO: 8486891 - DNA, 22 bp, Homo sapiens
ccaggaagcataatgtagtggg

SEQ ID NO: 8486892 - DNA, 23 bp, Homo sapiens
ccaggaagaggccatccacagtc

SEQ ID NO: 8486893 - DNA, 23 bp, Homo sapiens
ccaggaagaggccatccacagtc

SEQ ID NO: 8486894 - DNA, 23 bp, Homo sapiens
ccaggaagaggccatccacagtc

SEQ ID NO: 8486895 - DNA, 22 bp, Homo sapiens
ccaggaagatttattttggctt

SEQ ID NO: 8486896 - DNA, 22 bp, Homo sapiens
ccaggaagcataatgtagtggg

SEQ ID NO: 8486897 - DNA, 22 bp, Homo sapiens
ccaggaacaaagccccatccac

SEQ ID NO: 8486898 - DNA, 16 bp, Homo sapiens
ccaggaacacacagct

SEQ ID NO: 8486899 - DNA, 22 bp, Homo sapiens
ccaggaagacacatgctcatcc

SEQ ID NO: 8486900 - DNA, 22 bp, Homo sapiens
ccaggaactcagctctgcactt

SEQ ID NO: 8486901 - DNA, 22 bp, Homo sapiens
ccaggaagaaacagtctttata

SEQ ID NO: 8486902 - DNA, 22 bp, Homo sapiens
ccagcttcatgggcatgcacca

SEQ ID NO: 8486903 - DNA, 22 bp, Homo sapiens
ccaggaaaataccaagctttaa

SEQ ID NO: 8486904 - DNA, 22 bp, Homo sapiens
ccaggaaacctgcgccatccag

SEQ ID NO: 8486905 - DNA, 22 bp, Homo sapiens
ccaggaagcggtgagggctgcc

SEQ ID NO: 8486906 - DNA, 22 bp, Homo sapiens
ccaggaagcggtgagggctgcc

SEQ ID NO: 8486907 - DNA, 22 bp, Homo sapiens
ccaggaagcggtgagggctgcc

SEQ ID NO: 8486908 - DNA, 22 bp, Homo sapiens
ccaggaagcctttttctttgac

SEQ ID NO: 8486909 - DNA, 22 bp, Homo sapiens
ccaggaagctgtgagattccaa

SEQ ID NO: 8486910 - DNA, 22 bp, Homo sapiens
ccaggaaggaagcaggggtttc

SEQ ID NO: 8486911 - DNA, 22 bp, Homo sapiens
ccaggaagctgtctgatatgaa

SEQ ID NO: 8486912 - DNA, 22 bp, Homo sapiens
ccaggaagctctgctccacggg

SEQ ID NO: 8486913 - DNA, 22 bp, Homo sapiens
ccaggaggcagaagttgcagtg

SEQ ID NO: 8486914 - DNA, 22 bp, Homo sapiens
ccaggaggcagaagttgcagtg

SEQ ID NO: 8486915 - DNA, 22 bp, Homo sapiens
ccaggaggcagaagttgcagtg

SEQ ID NO: 8486916 - DNA, 22 bp, Homo sapiens
ccaggaggatggttgttaggtg

SEQ ID NO: 8486917 - DNA, 22 bp, Homo sapiens
ccaggaggcaatatcaagtcca

SEQ ID NO: 8486918 - DNA, 21 bp, Homo sapiens
ccaggaaggactgagctccct

SEQ ID NO: 8486919 - DNA, 21 bp, Homo sapiens
ccaggaaggactgagctccct

SEQ ID NO: 8486920 - DNA, 22 bp, Homo sapiens
ccaggagcgcgtgaacaggctg

SEQ ID NO: 8486921 - DNA, 22 bp, Homo sapiens
ccagctggtgttccttaggacc

SEQ ID NO: 8486922 - DNA, 22 bp, Homo sapiens
ccagctggtgttccttaggacc

SEQ ID NO: 8486923 - DNA, 22 bp, Homo sapiens
ccagctggtgttccttaggacc

SEQ ID NO: 8486924 - DNA, 22 bp, Homo sapiens
ccagctggtgttccttaggacc

SEQ ID NO: 8486925 - DNA, 22 bp, Homo sapiens
ccagctggtgttccttaggacc

SEQ ID NO: 8486926 - DNA, 22 bp, Homo sapiens
ccagctggttaaaatagagaaa

SEQ ID NO: 8486927 - DNA, 22 bp, Homo sapiens
ccagctggttaaaatagagaaa

SEQ ID NO: 8486928 - DNA, 22 bp, Homo sapiens
ccagctggttaaaatagagaaa

SEQ ID NO: 8486929 - DNA, 22 bp, Homo sapiens
tctggagcgaggtccctgtctg

SEQ ID NO: 8486930 - DNA, 19 bp, Homo sapiens
tctggagctgatgcaggtg

SEQ ID NO: 8486931 - DNA, 21 bp, Homo sapiens
tctggagccctaagctgagaa

SEQ ID NO: 8486932 - DNA, 22 bp, Homo sapiens
tctggagccttggatgggaaag

SEQ ID NO: 8486933 - DNA, 22 bp, Homo sapiens
ccagctggtctgtgctcatgtt

SEQ ID NO: 8486934 - DNA, 22 bp, Homo sapiens
ccagctggtctgtgctcatgtt

SEQ ID NO: 8486935 - DNA, 22 bp, Homo sapiens
ccagctggtctgtgctcatgtt

SEQ ID NO: 8486936 - DNA, 22 bp, Homo sapiens
ccagctggtctgtgctcatgtt

SEQ ID NO: 8486937 - DNA, 22 bp, Homo sapiens
ccagctggtgacatccccaacc

SEQ ID NO: 8486938 - DNA, 22 bp, Homo sapiens
ccagctggtgacatccccaacc

SEQ ID NO: 8486939 - DNA, 22 bp, Homo sapiens
ccagctggtgggtctttctctg

SEQ ID NO: 8486940 - DNA, 22 bp, Homo sapiens
ccagctggtgggtctttctctg

SEQ ID NO: 8486941 - DNA, 22 bp, Homo sapiens
ccagctgggtccctgctggggc

SEQ ID NO: 8486942 - DNA, 22 bp, Homo sapiens
ccagctgggtccctgctggggc

SEQ ID NO: 8486943 - DNA, 22 bp, Homo sapiens
ccagctggggaagtggggcata

SEQ ID NO: 8486944 - DNA, 22 bp, Homo sapiens
ccagctggtaagtgatggagcc

SEQ ID NO: 8486945 - DNA, 22 bp, Homo sapiens
ccagctggtaagtgatggagcc

SEQ ID NO: 8486946 - DNA, 22 bp, Homo sapiens
ccagctggtaagtgatggagcc

SEQ ID NO: 8486947 - DNA, 22 bp, Homo sapiens
ccagctggtaagtgatggagcc

SEQ ID NO: 8486948 - DNA, 22 bp, Homo sapiens
ccagctgggattaagggaaaat

SEQ ID NO: 8486949 - DNA, 22 bp, Homo sapiens
ccagctgggattaagggaaaat

SEQ ID NO: 8486950 - DNA, 22 bp, Homo sapiens
ccagctggggaagtggggcata

SEQ ID NO: 8486951 - DNA, 22 bp, Homo sapiens
ccagctgcttgggaaaatgtct

SEQ ID NO: 8486952 - DNA, 22 bp, Homo sapiens
ccagctgctttttgtcacatgg

SEQ ID NO: 8486953 - DNA, 22 bp, Homo sapiens
tctgcctctttcaggcctggca

SEQ ID NO: 8486954 - DNA, 22 bp, Homo sapiens
tctgcctgaaattcacatgtaa

SEQ ID NO: 8486955 - DNA, 22 bp, Homo sapiens
tctgcctgaaattcacatgtaa

SEQ ID NO: 8486956 - DNA, 22 bp, Homo sapiens
tctgcctgaaattcacatgtaa

SEQ ID NO: 8486957 - DNA, 19 bp, Homo sapiens
tctgcctctggtcaggctc

SEQ ID NO: 8486958 - DNA, 19 bp, Homo sapiens
tctgcctctggtcaggctc

SEQ ID NO: 8486959 - DNA, 19 bp, Homo sapiens
tctgcctctggtcaggctc

SEQ ID NO: 8486960 - DNA, 22 bp, Homo sapiens
tctgcctctttcaggcctggca

SEQ ID NO: 8486961 - DNA, 22 bp, Homo sapiens
tctgcctctttcaggcctggca

SEQ ID NO: 8486962 - DNA, 22 bp, Homo sapiens
tctgccttggcaaccacagctt

SEQ ID NO: 8486963 - DNA, 22 bp, Homo sapiens
tctgcctgaaccactcttggag

SEQ ID NO: 8486964 - DNA, 22 bp, Homo sapiens
tctgcctgaaccactcttggag

SEQ ID NO: 8486965 - DNA, 22 bp, Homo sapiens
tctgcctttcacacagacggcc

SEQ ID NO: 8486966 - DNA, 22 bp, Homo sapiens
tctgcctttcccaggctactgt

SEQ ID NO: 8486967 - DNA, 22 bp, Homo sapiens
tctgccttttcactgccactaa

SEQ ID NO: 8486968 - DNA, 22 bp, Homo sapiens
tctgcgccgcatgtgttctttc

SEQ ID NO: 8486969 - DNA, 22 bp, Homo sapiens
tctgcgctgccttgatccttgg

SEQ ID NO: 8486970 - DNA, 22 bp, Homo sapiens
tctgcgtgaatttgcattgtgg

SEQ ID NO: 8486971 - DNA, 22 bp, Homo sapiens
tctgcgtggcgtggttctgtgc

SEQ ID NO: 8486972 - DNA, 22 bp, Homo sapiens
tctgcgtggctgctgtgagcgt

SEQ ID NO: 8486973 - DNA, 22 bp, Homo sapiens
tctgcgtggctgctgtgagcgt

SEQ ID NO: 8486974 - DNA, 22 bp, Homo sapiens
tctgcgttattgaaaagcagcc

SEQ ID NO: 8486975 - DNA, 22 bp, Homo sapiens
tctgcgtgaatttgcattgtgg

SEQ ID NO: 8486976 - DNA, 22 bp, Homo sapiens
tctgcgtgatgagggtgcagca

SEQ ID NO: 8486977 - DNA, 22 bp, Homo sapiens
tctgcgtggcgtggttctgtgc

SEQ ID NO: 8486978 - DNA, 22 bp, Homo sapiens
tctggctttattccttcactga

SEQ ID NO: 8486979 - DNA, 22 bp, Homo sapiens
tctggcttggcgctgccctctg

SEQ ID NO: 8486980 - DNA, 22 bp, Homo sapiens
tctggcttgggtaggtagttca

SEQ ID NO: 8486981 - DNA, 22 bp, Homo sapiens
tctggcttggctggcatctctg

SEQ ID NO: 8486982 - DNA, 22 bp, Homo sapiens
tctggcttggctggcatctctg

SEQ ID NO: 8486983 - DNA, 22 bp, Homo sapiens
tctggcttgctggcttggtccc

SEQ ID NO: 8486984 - DNA, 22 bp, Homo sapiens
tctggcttgagcttcgaccagt

SEQ ID NO: 8486985 - DNA, 22 bp, Homo sapiens
tctggcttgagcttcgaccagt

SEQ ID NO: 8486986 - DNA, 22 bp, Homo sapiens
ccagctgtttctgatgctaggc

SEQ ID NO: 8486987 - DNA, 22 bp, Homo sapiens
ccagctgtttctgatgctaggc

SEQ ID NO: 8486988 - DNA, 22 bp, Homo sapiens
ccagctgttggagtttcactgc

SEQ ID NO: 8486989 - DNA, 22 bp, Homo sapiens
ccagcttcatgggcatgcacca

SEQ ID NO: 8486990 - DNA, 22 bp, Homo sapiens
ccagctgtgctgttggcttgtc

SEQ ID NO: 8486991 - DNA, 22 bp, Homo sapiens
ccagctgtgcctaggagcaggg

SEQ ID NO: 8486992 - DNA, 22 bp, Homo sapiens
ccagctgtgccgtgtggatagc

SEQ ID NO: 8486993 - DNA, 18 bp, Homo sapiens
ccagctgtgcagcatctg

SEQ ID NO: 8486994 - DNA, 22 bp, Homo sapiens
ccagctgtctggttccagagcc

SEQ ID NO: 8486995 - DNA, 18 bp, Homo sapiens
ccagctgtgcagcatctg

SEQ ID NO: 8486996 - DNA, 22 bp, Homo sapiens
tctggcttcaagtcccagctct

SEQ ID NO: 8486997 - DNA, 22 bp, Homo sapiens
tctggcttcaagtcccagctct

SEQ ID NO: 8486998 - DNA, 22 bp, Homo sapiens
tctggcttcaagtcccagctct

SEQ ID NO: 8486999 - DNA, 22 bp, Homo sapiens
tctggctcatctctccaggtaa

SEQ ID NO: 8487000 - DNA, 22 bp, Homo sapiens
tctggctcatctctccaggtaa

SEQ ID NO: 8487001 - DNA, 23 bp, Homo sapiens
tctggcttccagtgggttcaacc

SEQ ID NO: 8487002 - DNA, 22 bp, Homo sapiens
tctggcttcagtagggttcact

SEQ ID NO: 8487003 - DNA, 22 bp, Homo sapiens
tctggcttccctctgttctggg

SEQ ID NO: 8487004 - DNA, 22 bp, Homo sapiens
tctggcttcgcagctcccagcc

SEQ ID NO: 8487005 - DNA, 22 bp, Homo sapiens
tctggagctggagggcaaggca

SEQ ID NO: 8487006 - DNA, 19 bp, Homo sapiens
tctggagctgatgcaggtg

SEQ ID NO: 8487007 - DNA, 21 bp, Homo sapiens
tctggagctgcaggctgggca

SEQ ID NO: 8487008 - DNA, 22 bp, Homo sapiens
tctggagcttcctcatttacag

SEQ ID NO: 8487009 - DNA, 22 bp, Homo sapiens
tctggagcttcctcatttacag

SEQ ID NO: 8487010 - DNA, 22 bp, Homo sapiens
tctggagctgggggcttagtat

SEQ ID NO: 8487011 - DNA, 22 bp, Homo sapiens
tctggagctggcagggccctgg

SEQ ID NO: 8487012 - DNA, 22 bp, Homo sapiens
tctggagctggcagggccctgg

SEQ ID NO: 8487013 - DNA, 22 bp, Homo sapiens
tctggagctggagggcaaggca

SEQ ID NO: 8487014 - DNA, 22 bp, Homo sapiens
tctggagctggagggcaaggca

SEQ ID NO: 8487015 - DNA, 22 bp, Homo sapiens
tctggagcttgaagctttggtt

SEQ ID NO: 8487016 - DNA, 22 bp, Homo sapiens
tctggagcttgtttcagatggt

SEQ ID NO: 8487017 - DNA, 22 bp, Homo sapiens
tctggagcttgtttcagatggt

SEQ ID NO: 8487018 - DNA, 22 bp, Homo sapiens
tctggctcatacaagcctgcaa

SEQ ID NO: 8487019 - DNA, 22 bp, Homo sapiens
tctgcctcgctaacagcagcca

SEQ ID NO: 8487020 - DNA, 22 bp, Homo sapiens
tctgcctcgctaacagcagcca

SEQ ID NO: 8487021 - DNA, 22 bp, Homo sapiens
tctgcctcctgcttgtcccgac

SEQ ID NO: 8487022 - DNA, 22 bp, Homo sapiens
tctgcctcgctaacagcagcca

SEQ ID NO: 8487023 - DNA, 21 bp, Homo sapiens
tctgccagctgaagaggtgga

SEQ ID NO: 8487024 - DNA, 21 bp, Homo sapiens
tctgccagctgaagaggtgga

SEQ ID NO: 8487025 - DNA, 22 bp, Homo sapiens
tctgccaggagccatgagcaag

SEQ ID NO: 8487026 - DNA, 22 bp, Homo sapiens
tctgcctagtgggacagcagcc

SEQ ID NO: 8487027 - DNA, 22 bp, Homo sapiens
tctgccaggcattgtgctgctc

SEQ ID NO: 8487028 - DNA, 22 bp, Homo sapiens
tctgccagcaccatgatccttc

SEQ ID NO: 8487029 - DNA, 22 bp, Homo sapiens
tctgccagaagttctgagagta

SEQ ID NO: 8487030 - DNA, 22 bp, Homo sapiens
tctgccagaagttctgagagta

SEQ ID NO: 8487031 - DNA, 22 bp, Homo sapiens
tctgccagaagttctgagagta

SEQ ID NO: 8487032 - DNA, 22 bp, Homo sapiens
tctgccactgtgatgcatgata

SEQ ID NO: 8487033 - DNA, 20 bp, Homo sapiens
tctgccactgcactctgccc

SEQ ID NO: 8487034 - DNA, 22 bp, Homo sapiens
tctgccagaagccagggtctgg

SEQ ID NO: 8487035 - DNA, 22 bp, Homo sapiens
ccagctcctcttcccagtgtca

SEQ ID NO: 8487036 - DNA, 22 bp, Homo sapiens
ccagctccaggactgggagctg

SEQ ID NO: 8487037 - DNA, 21 bp, Homo sapiens
ccagctccaggaccttggatc

SEQ ID NO: 8487038 - DNA, 21 bp, Homo sapiens
ccagctccaggaccttggatc

SEQ ID NO: 8487039 - DNA, 22 bp, Homo sapiens
ccagctcctcttgtctctagca

SEQ ID NO: 8487040 - DNA, 22 bp, Homo sapiens
ccagctcctcttcccagtgtca

SEQ ID NO: 8487041 - DNA, 22 bp, Homo sapiens
ccagctcctcttcccagtgtca

SEQ ID NO: 8487042 - DNA, 22 bp, Homo sapiens
ccagctcctcttgtctctagca

SEQ ID NO: 8487043 - DNA, 22 bp, Homo sapiens
ccagctctcaaggctccctggg

SEQ ID NO: 8487044 - DNA, 22 bp, Homo sapiens
ccagctctagccccatgtggct

SEQ ID NO: 8487045 - DNA, 22 bp, Homo sapiens
ccagctctagccccatgtggct

SEQ ID NO: 8487046 - DNA, 22 bp, Homo sapiens
ccagctctagccccatgtggct

SEQ ID NO: 8487047 - DNA, 22 bp, Homo sapiens
ccagctctagccccatgtggct

SEQ ID NO: 8487048 - DNA, 22 bp, Homo sapiens
ccagctctaaacggctctgtgg

SEQ ID NO: 8487049 - DNA, 22 bp, Homo sapiens
ccagctctaaacggctctgtgg

SEQ ID NO: 8487050 - DNA, 22 bp, Homo sapiens
ccagctctaaacggctctgtgg

SEQ ID NO: 8487051 - DNA, 22 bp, Homo sapiens
ccagctctaaacggctctgtgg

SEQ ID NO: 8487052 - DNA, 22 bp, Homo sapiens
ccagctccttctgtctgtggag

SEQ ID NO: 8487053 - DNA, 22 bp, Homo sapiens
ccagctccttctgtctgtggag

SEQ ID NO: 8487054 - DNA, 22 bp, Homo sapiens
ccagctcctgggtcttagtcag

SEQ ID NO: 8487055 - DNA, 22 bp, Homo sapiens
ccagctcctgggtcttagtcag

SEQ ID NO: 8487056 - DNA, 22 bp, Homo sapiens
tctgagtgagtgtaggcctgac

SEQ ID NO: 8487057 - DNA, 22 bp, Homo sapiens
tctgagtgagggtgtgagatat

SEQ ID NO: 8487058 - DNA, 23 bp, Homo sapiens
tctgagtgattagcctctggggt

SEQ ID NO: 8487059 - DNA, 22 bp, Homo sapiens
tctgagtgtcttaataggctct

SEQ ID NO: 8487060 - DNA, 23 bp, Homo sapiens
tctgagttatgtccttacatttg

SEQ ID NO: 8487061 - DNA, 22 bp, Homo sapiens
tctgagttacacaagcaagggt

SEQ ID NO: 8487062 - DNA, 22 bp, Homo sapiens
tctgagttgaggaaatgcattt

SEQ ID NO: 8487063 - DNA, 22 bp, Homo sapiens
tctgagtttaggaccaggctga

SEQ ID NO: 8487064 - DNA, 22 bp, Homo sapiens
tctgagttcataccaggctacc

SEQ ID NO: 8487065 - DNA, 22 bp, Homo sapiens
tctgataaatgccatctttttg

SEQ ID NO: 8487066 - DNA, 22 bp, Homo sapiens
tctgataaatgccatctttttg

SEQ ID NO: 8487067 - DNA, 22 bp, Homo sapiens
tctgataaatgccatctttttg

SEQ ID NO: 8487068 - DNA, 22 bp, Homo sapiens
tctgagttttctgagaagctta

SEQ ID NO: 8487069 - DNA, 20 bp, Homo sapiens
tctgataaaaactactccat

SEQ ID NO: 8487070 - DNA, 22 bp, Homo sapiens
tctgagtttaggaccaggctga

SEQ ID NO: 8487071 - DNA, 22 bp, Homo sapiens
tctgataagacagctgatttga

SEQ ID NO: 8487072 - DNA, 22 bp, Homo sapiens
tctgataagacagctgatttga

SEQ ID NO: 8487073 - DNA, 22 bp, Homo sapiens
tctgataagtggtgtatactgt

SEQ ID NO: 8487074 - DNA, 22 bp, Homo sapiens
tctgataacaaccatgtctggc

SEQ ID NO: 8487075 - DNA, 20 bp, Homo sapiens
tctgataactggttgtgatt

SEQ ID NO: 8487076 - DNA, 22 bp, Homo sapiens
ccagcctggactgggtcttgtg

SEQ ID NO: 8487077 - DNA, 21 bp, Homo sapiens
ccagcctcagatcagggagct

SEQ ID NO: 8487078 - DNA, 22 bp, Homo sapiens
tctgataatggacttctcatct

SEQ ID NO: 8487079 - DNA, 22 bp, Homo sapiens
tctgataatgtgcttcgtgacc

SEQ ID NO: 8487080 - DNA, 22 bp, Homo sapiens
tctgataagtggtgtatactgt

SEQ ID NO: 8487081 - DNA, 22 bp, Homo sapiens
tctgataatggacttctcatct

SEQ ID NO: 8487082 - DNA, 22 bp, Homo sapiens
tctgataggtggtagaaggagg

SEQ ID NO: 8487083 - DNA, 22 bp, Homo sapiens
ccagcctggagggcagtggtgg

SEQ ID NO: 8487084 - DNA, 22 bp, Homo sapiens
ccagcctggggaggcagcttct

SEQ ID NO: 8487085 - DNA, 22 bp, Homo sapiens
ccagcctggggaggcagcttct

SEQ ID NO: 8487086 - DNA, 22 bp, Homo sapiens
ccagcctggagggcagtggtgg

SEQ ID NO: 8487087 - DNA, 22 bp, Homo sapiens
ccagcctggagggcagtggtgg

SEQ ID NO: 8487088 - DNA, 22 bp, Homo sapiens
ccagcctggagggcagtggtgg

SEQ ID NO: 8487089 - DNA, 22 bp, Homo sapiens
ccagcctggagggcagtggtgg

SEQ ID NO: 8487090 - DNA, 22 bp, Homo sapiens
ccagctccagcatagccaccat

SEQ ID NO: 8487091 - DNA, 22 bp, Homo sapiens
ccagctccagcatagccaccat

SEQ ID NO: 8487092 - DNA, 22 bp, Homo sapiens
ccagctccagcatagccaccat

SEQ ID NO: 8487093 - DNA, 22 bp, Homo sapiens
ccagctccactgtcagatgaga

SEQ ID NO: 8487094 - DNA, 22 bp, Homo sapiens
ccagctccactgtcagatgaga

SEQ ID NO: 8487095 - DNA, 22 bp, Homo sapiens
ccagctccaagtttgggcatca

SEQ ID NO: 8487096 - DNA, 22 bp, Homo sapiens
ccagctcatctcagtgaaatgc

SEQ ID NO: 8487097 - DNA, 22 bp, Homo sapiens
ccagctccaagtttgggcatca

SEQ ID NO: 8487098 - DNA, 22 bp, Homo sapiens
ccagctcagggtcacatggcac

SEQ ID NO: 8487099 - DNA, 22 bp, Homo sapiens
ccagctagtaagcacctgcatc

SEQ ID NO: 8487100 - DNA, 22 bp, Homo sapiens
ccagctagtaagcacctgcatc

SEQ ID NO: 8487101 - DNA, 22 bp, Homo sapiens
ccagcgcttcccatcagggagg

SEQ ID NO: 8487102 - DNA, 22 bp, Homo sapiens
ccagctaggcttgcactcttgt

SEQ ID NO: 8487103 - DNA, 22 bp, Homo sapiens
ccagctaggcttgcactcttgt

SEQ ID NO: 8487104 - DNA, 22 bp, Homo sapiens
ccagccttgcaccgagccagcc

SEQ ID NO: 8487105 - DNA, 22 bp, Homo sapiens
ccagccttgactgccccagcac

SEQ ID NO: 8487106 - DNA, 22 bp, Homo sapiens
ccagccttctgggactctcatc

SEQ ID NO: 8487107 - DNA, 22 bp, Homo sapiens
ccagcctttgcatcccccatct

SEQ ID NO: 8487108 - DNA, 23 bp, Homo sapiens
ccagcgctcactcagagcatgtt

SEQ ID NO: 8487109 - DNA, 22 bp, Homo sapiens
ccagccttctgagctgcctgga

SEQ ID NO: 8487110 - DNA, 22 bp, Homo sapiens
ccagcctggttcagaattggct

SEQ ID NO: 8487111 - DNA, 22 bp, Homo sapiens
ccagcctggggaggcagcttct

SEQ ID NO: 8487112 - DNA, 22 bp, Homo sapiens
ccagcctggggaggcagcttct

SEQ ID NO: 8487113 - DNA, 22 bp, Homo sapiens
ccagcctgggtgttagaagaca

SEQ ID NO: 8487114 - DNA, 22 bp, Homo sapiens
ccagcctgggtgttagaagaca

SEQ ID NO: 8487115 - DNA, 22 bp, Homo sapiens
ccagcctggttcagaattggct

SEQ ID NO: 8487116 - DNA, 22 bp, Homo sapiens
tctgaaatattggtaatacttt

SEQ ID NO: 8487117 - DNA, 22 bp, Homo sapiens
tctgaaatcctttatcttggct

SEQ ID NO: 8487118 - DNA, 22 bp, Homo sapiens
tctgaaatattggtaatacttt

SEQ ID NO: 8487119 - DNA, 22 bp, Homo sapiens
tctgaaatattggtaatacttt

SEQ ID NO: 8487120 - DNA, 22 bp, Homo sapiens
tctgaaataggagccatgtaga

SEQ ID NO: 8487121 - DNA, 22 bp, Homo sapiens
tctgaaataggagccatgtaga

SEQ ID NO: 8487122 - DNA, 22 bp, Homo sapiens
tctgaaataggagccatgtaga

SEQ ID NO: 8487123 - DNA, 22 bp, Homo sapiens
tctgaaataggcttcttttggt

SEQ ID NO: 8487124 - DNA, 22 bp, Homo sapiens
tctgaaatatattttgagtgtt

SEQ ID NO: 8487125 - DNA, 22 bp, Homo sapiens
tctgaaatatattttgagtgtt

SEQ ID NO: 8487126 - DNA, 22 bp, Homo sapiens
tctgaaataggcttcttttggt

SEQ ID NO: 8487127 - DNA, 22 bp, Homo sapiens
tctgaaataggaaagcaaatgg

SEQ ID NO: 8487128 - DNA, 22 bp, Homo sapiens
tctcttgtggttttgtagttga

SEQ ID NO: 8487129 - DNA, 22 bp, Homo sapiens
tctcttggtgatagtctttctt

SEQ ID NO: 8487130 - DNA, 22 bp, Homo sapiens
ccagccactgggccactgccag

SEQ ID NO: 8487131 - DNA, 22 bp, Homo sapiens
ccagccagtccagcattggtgt

SEQ ID NO: 8487132 - DNA, 22 bp, Homo sapiens
ccagccagtcccgcatgaccgc

SEQ ID NO: 8487133 - DNA, 22 bp, Homo sapiens
ccagccagtcccgcatgaccgc

SEQ ID NO: 8487134 - DNA, 22 bp, Homo sapiens
ccagccataaacccagatgact

SEQ ID NO: 8487135 - DNA, 22 bp, Homo sapiens
tctgaaatgaactcttgaactt

SEQ ID NO: 8487136 - DNA, 22 bp, Homo sapiens
ccagccactgggccactgccag

SEQ ID NO: 8487137 - DNA, 22 bp, Homo sapiens
tctgaaatctaatgctctgtgg

SEQ ID NO: 8487138 - DNA, 22 bp, Homo sapiens
tctgaaatctaatgctctgtgg

SEQ ID NO: 8487139 - DNA, 22 bp, Homo sapiens
tctgaaatcctttatcttggct

SEQ ID NO: 8487140 - DNA, 22 bp, Homo sapiens
tctgaaatcctttatcttggct

SEQ ID NO: 8487141 - DNA, 22 bp, Homo sapiens
tctgaaatctgtaagcactagc

SEQ ID NO: 8487142 - DNA, 22 bp, Homo sapiens
tctgaaatctgtaagcactagc

SEQ ID NO: 8487143 - DNA, 22 bp, Homo sapiens
tctcttggaacacttgctctta

SEQ ID NO: 8487144 - DNA, 18 bp, Homo sapiens
tctcttgcatcttctgta

SEQ ID NO: 8487145 - DNA, 22 bp, Homo sapiens
tctcttaataagtaaatactga

SEQ ID NO: 8487146 - DNA, 22 bp, Homo sapiens
tctcttctttggggtgggctca

SEQ ID NO: 8487147 - DNA, 22 bp, Homo sapiens
tctctcttcaacccttaactag

SEQ ID NO: 8487148 - DNA, 23 bp, Homo sapiens
tctctcttagctatgcttatggc

SEQ ID NO: 8487149 - DNA, 23 bp, Homo sapiens
tctctcttagctatgcttatggc

SEQ ID NO: 8487150 - DNA, 22 bp, Homo sapiens
tctctcttcagagataccttgc

SEQ ID NO: 8487151 - DNA, 22 bp, Homo sapiens
tctctcttcagagataccttgc

SEQ ID NO: 8487152 - DNA, 22 bp, Homo sapiens
tctctcttcaacccttaactag

SEQ ID NO: 8487153 - DNA, 22 bp, Homo sapiens
tctctcttcaacccttaactag

SEQ ID NO: 8487154 - DNA, 23 bp, Homo sapiens
tctctcttagctatgcttatggc

SEQ ID NO: 8487155 - DNA, 23 bp, Homo sapiens
tctctcttagctatgcttatggc

SEQ ID NO: 8487156 - DNA, 22 bp, Homo sapiens
tctctctgtgacagctttgctg

SEQ ID NO: 8487157 - DNA, 22 bp, Homo sapiens
tctctctgtgacagctttgctg

SEQ ID NO: 8487158 - DNA, 19 bp, Homo sapiens
tctctctgtacattagata

SEQ ID NO: 8487159 - DNA, 22 bp, Homo sapiens
tctctctgtgacagctttgctg

SEQ ID NO: 8487160 - DNA, 22 bp, Homo sapiens
tctctcttgaagtattagctag

SEQ ID NO: 8487161 - DNA, 22 bp, Homo sapiens
tctctcttgaagtattagctag

SEQ ID NO: 8487162 - DNA, 22 bp, Homo sapiens
tctctcttgaagtattagctag

SEQ ID NO: 8487163 - DNA, 22 bp, Homo sapiens
tctcttaactggttcagcaatt

SEQ ID NO: 8487164 - DNA, 22 bp, Homo sapiens
tctctcttgaagtattagctag

SEQ ID NO: 8487165 - DNA, 22 bp, Homo sapiens
tctctcttcatgcttttagaat

SEQ ID NO: 8487166 - DNA, 22 bp, Homo sapiens
tctctcttcatgcttttagaat

SEQ ID NO: 8487167 - DNA, 22 bp, Homo sapiens
tctctcttctttgttaagaatg

SEQ ID NO: 8487168 - DNA, 22 bp, Homo sapiens
tctctcttctttgttaagaatg

SEQ ID NO: 8487169 - DNA, 22 bp, Homo sapiens
ccagccccgggaacctggccgt

SEQ ID NO: 8487170 - DNA, 22 bp, Homo sapiens
ccagccccgggaacctggccgt

SEQ ID NO: 8487171 - DNA, 22 bp, Homo sapiens
ccagcccatgcccttatagcat

SEQ ID NO: 8487172 - DNA, 22 bp, Homo sapiens
ccagcccatgcccttatagcat

SEQ ID NO: 8487173 - DNA, 19 bp, Homo sapiens
ccagcccatagtccatcac

SEQ ID NO: 8487174 - DNA, 19 bp, Homo sapiens
ccagcccatagtccatcac

SEQ ID NO: 8487175 - DNA, 19 bp, Homo sapiens
ccagcccatagtccatcac

SEQ ID NO: 8487176 - DNA, 19 bp, Homo sapiens
ccagcccatagtccatcac

SEQ ID NO: 8487177 - DNA, 22 bp, Homo sapiens
ccagcccctatcctcgctccac

SEQ ID NO: 8487178 - DNA, 21 bp, Homo sapiens
ccagcccagctgtgtcccagc

SEQ ID NO: 8487179 - DNA, 21 bp, Homo sapiens
ccagcccagctgtgtcccagc

SEQ ID NO: 8487180 - DNA, 21 bp, Homo sapiens
ccagcccagctgtgtcccagc

SEQ ID NO: 8487181 - DNA, 21 bp, Homo sapiens
ccagcccagcctccttctctt

SEQ ID NO: 8487182 - DNA, 21 bp, Homo sapiens
ccagcccagcctccttctctt

SEQ ID NO: 8487183 - DNA, 19 bp, Homo sapiens
ccagcccacagtgactttc

SEQ ID NO: 8487184 - DNA, 19 bp, Homo sapiens
ccagcccacagtgactttc

SEQ ID NO: 8487185 - DNA, 19 bp, Homo sapiens
ccagcccacagtgactttc

SEQ ID NO: 8487186 - DNA, 22 bp, Homo sapiens
ccagcccaaacaagccgccttc

SEQ ID NO: 8487187 - DNA, 22 bp, Homo sapiens
ccagcccaaacaagccgccttc

SEQ ID NO: 8487188 - DNA, 22 bp, Homo sapiens
ccagcccaaagtcaccccggga

SEQ ID NO: 8487189 - DNA, 22 bp, Homo sapiens
ccagcccaaagtcaccccggga

SEQ ID NO: 8487190 - DNA, 22 bp, Homo sapiens
ccagccatgcacaaaccatgag

SEQ ID NO: 8487191 - DNA, 22 bp, Homo sapiens
ccagccatgcacaaaccatgag

SEQ ID NO: 8487192 - DNA, 22 bp, Homo sapiens
ccagccataaacccagatgact

SEQ ID NO: 8487193 - DNA, 22 bp, Homo sapiens
tctgaggcccctgggcaggatg

SEQ ID NO: 8487194 - DNA, 22 bp, Homo sapiens
tctgaggccccagccctgcaca

SEQ ID NO: 8487195 - DNA, 22 bp, Homo sapiens
tctgaggttctgttttcaactg

SEQ ID NO: 8487196 - DNA, 22 bp, Homo sapiens
tctgaggttccctcaactacct

SEQ ID NO: 8487197 - DNA, 22 bp, Homo sapiens
tctgaggttttcatgttttctg

SEQ ID NO: 8487198 - DNA, 22 bp, Homo sapiens
tctgaggttgaactttgcaaag

SEQ ID NO: 8487199 - DNA, 22 bp, Homo sapiens
tctgaggcataacctgttctgc

SEQ ID NO: 8487200 - DNA, 22 bp, Homo sapiens
tctgaggcataacctgttctgc

SEQ ID NO: 8487201 - DNA, 22 bp, Homo sapiens
tctgaggcatacccaggccccc

SEQ ID NO: 8487202 - DNA, 22 bp, Homo sapiens
tctgaggcatacccaggccccc

SEQ ID NO: 8487203 - DNA, 22 bp, Homo sapiens
tctgaggcccagttcaactctt

SEQ ID NO: 8487204 - DNA, 22 bp, Homo sapiens
ccagccctcactgaggcctctc

SEQ ID NO: 8487205 - DNA, 22 bp, Homo sapiens
ccagccctcactgaggcctctc

SEQ ID NO: 8487206 - DNA, 22 bp, Homo sapiens
ccagccctacagtatcacctgt

SEQ ID NO: 8487207 - DNA, 22 bp, Homo sapiens
tctgagattaagcagagatgga

SEQ ID NO: 8487208 - DNA, 22 bp, Homo sapiens
tctgaggacagtgctgtgcctg

SEQ ID NO: 8487209 - DNA, 22 bp, Homo sapiens
tctgaggacctactgaagagtt

SEQ ID NO: 8487210 - DNA, 22 bp, Homo sapiens
tctgaggcaaacagaggagtgt

SEQ ID NO: 8487211 - DNA, 22 bp, Homo sapiens
cagctgagttactctgaggtct

SEQ ID NO: 8487212 - DNA, 22 bp, Homo sapiens
cagctgagtttccaagtctgcc

SEQ ID NO: 8487213 - DNA, 22 bp, Homo sapiens
cagctgagttactctgaggtct

SEQ ID NO: 8487214 - DNA, 22 bp, Homo sapiens
cagctgagtgttggcatgttca

SEQ ID NO: 8487215 - DNA, 22 bp, Homo sapiens
cagctgagtggaccctagaggc

SEQ ID NO: 8487216 - DNA, 22 bp, Homo sapiens
cagctgagtttccaagtctgcc

SEQ ID NO: 8487217 - DNA, 22 bp, Homo sapiens
gtggcctggggtttgttctgag

SEQ ID NO: 8487218 - DNA, 22 bp, Homo sapiens
cagctgagtttccaagtctgcc

SEQ ID NO: 8487219 - DNA, 22 bp, Homo sapiens
gtggcctgtcagaagccgtggg

SEQ ID NO: 8487220 - DNA, 22 bp, Homo sapiens
gtggcctgtcagaagccgtggg

SEQ ID NO: 8487221 - DNA, 20 bp, Homo sapiens
gtggcctgtcctgttgtggg

SEQ ID NO: 8487222 - DNA, 22 bp, Homo sapiens
gtggccttaagaaacaaacaac

SEQ ID NO: 8487223 - DNA, 22 bp, Homo sapiens
gtggccttattatgtacaaaat

SEQ ID NO: 8487224 - DNA, 20 bp, Homo sapiens
gtggcctgtcctgttgtggg

SEQ ID NO: 8487225 - DNA, 20 bp, Homo sapiens
gtggcctgtcctgttgtggg

SEQ ID NO: 8487226 - DNA, 20 bp, Homo sapiens
gtggcctgtcctgttgtggg

SEQ ID NO: 8487227 - DNA, 22 bp, Homo sapiens
cagctgagcatcactagtctgg

SEQ ID NO: 8487228 - DNA, 22 bp, Homo sapiens
cagctgagctcccaggccatca

SEQ ID NO: 8487229 - DNA, 22 bp, Homo sapiens
cagctgagctcccaggccatca

SEQ ID NO: 8487230 - DNA, 22 bp, Homo sapiens
cagctgaagaaagagtggttag

SEQ ID NO: 8487231 - DNA, 23 bp, Homo sapiens
cagctgaagcagcctgggctgga

SEQ ID NO: 8487232 - DNA, 18 bp, Homo sapiens
cagctgaggaccaaactg

SEQ ID NO: 8487233 - DNA, 22 bp, Homo sapiens
cagctgaggtcaaagaagcagg

SEQ ID NO: 8487234 - DNA, 22 bp, Homo sapiens
cagctgaggtcaaagaagcagg

SEQ ID NO: 8487235 - DNA, 22 bp, Homo sapiens
cagctgagtatgcattcaagca

SEQ ID NO: 8487236 - DNA, 22 bp, Homo sapiens
cagctgagtctgaggttctttg

SEQ ID NO: 8487237 - DNA, 22 bp, Homo sapiens
cagctgaggaatactagatgta

SEQ ID NO: 8487238 - DNA, 22 bp, Homo sapiens
cagctgagctgccagactactg

SEQ ID NO: 8487239 - DNA, 22 bp, Homo sapiens
cagctgaaagaaggaagtgtca

SEQ ID NO: 8487240 - DNA, 22 bp, Homo sapiens
cagctgaaagaaggaagtgtca

SEQ ID NO: 8487241 - DNA, 22 bp, Homo sapiens
cagctgaacatgtagagcatct

SEQ ID NO: 8487242 - DNA, 22 bp, Homo sapiens
cagctgaacatgtagagcatct

SEQ ID NO: 8487243 - DNA, 22 bp, Homo sapiens
cagctgaacatgtagagcatct

SEQ ID NO: 8487244 - DNA, 22 bp, Homo sapiens
cagctctttgagtattccattt

SEQ ID NO: 8487245 - DNA, 22 bp, Homo sapiens
cagctctttttcacacaacatg

SEQ ID NO: 8487246 - DNA, 18 bp, Homo sapiens
cagctcttctccagtaac

SEQ ID NO: 8487247 - DNA, 22 bp, Homo sapiens
cagctctttattgccaatattc

SEQ ID NO: 8487248 - DNA, 22 bp, Homo sapiens
cagctcttcctcccaccggaca

SEQ ID NO: 8487249 - DNA, 17 bp, Homo sapiens
cagctcttcctccctct

SEQ ID NO: 8487250 - DNA, 22 bp, Homo sapiens
cagctcttcctagccatgccac

SEQ ID NO: 8487251 - DNA, 22 bp, Homo sapiens
cagctcttattttctctcctaa

SEQ ID NO: 8487252 - DNA, 22 bp, Homo sapiens
cagctcttaacacagcttgtat

SEQ ID NO: 8487253 - DNA, 22 bp, Homo sapiens
cagctcttcagtgcctgagata

SEQ ID NO: 8487254 - DNA, 22 bp, Homo sapiens
cagctcttcagtgcctgagata

SEQ ID NO: 8487255 - DNA, 22 bp, Homo sapiens
cagctcttccatttccttcagc

SEQ ID NO: 8487256 - DNA, 22 bp, Homo sapiens
cagctcttcctaccctagttgg

SEQ ID NO: 8487257 - DNA, 22 bp, Homo sapiens
cagctctgttcatagatggtgc

SEQ ID NO: 8487258 - DNA, 22 bp, Homo sapiens
cagctctgttgccaaagtgggc

SEQ ID NO: 8487259 - DNA, 22 bp, Homo sapiens
cagctctgttgccaaagtgggc

SEQ ID NO: 8487260 - DNA, 22 bp, Homo sapiens
gtgggacagcggggtgggacag

SEQ ID NO: 8487261 - DNA, 22 bp, Homo sapiens
gtgggactcttctttggcagtg

SEQ ID NO: 8487262 - DNA, 22 bp, Homo sapiens
gtgggcaggaggccctgccctg

SEQ ID NO: 8487263 - DNA, 22 bp, Homo sapiens
gtgggcaggagtgagcaacagg

SEQ ID NO: 8487264 - DNA, 22 bp, Homo sapiens
gtgggcaggagtgagcaacagg

SEQ ID NO: 8487265 - DNA, 22 bp, Homo sapiens
gtgggactcttctttggcagtg

SEQ ID NO: 8487266 - DNA, 22 bp, Homo sapiens
gtgggacagtcagaagtgagca

SEQ ID NO: 8487267 - DNA, 22 bp, Homo sapiens
gtgggacagtcagaagtgagca

SEQ ID NO: 8487268 - DNA, 22 bp, Homo sapiens
gtgggcaggccccaaagcaggg

SEQ ID NO: 8487269 - DNA, 22 bp, Homo sapiens
gtgggcaggccccaaagcaggg

SEQ ID NO: 8487270 - DNA, 22 bp, Homo sapiens
gtgggcaggccctaggcgattt

SEQ ID NO: 8487271 - DNA, 22 bp, Homo sapiens
gtgggcaggccctaggcgattt

SEQ ID NO: 8487272 - DNA, 22 bp, Homo sapiens
gtgggcaggccctaggcgattt

SEQ ID NO: 8487273 - DNA, 22 bp, Homo sapiens
gtggggagggagatgctgaagt

SEQ ID NO: 8487274 - DNA, 22 bp, Homo sapiens
gtggggaggcctaagcaagttg

SEQ ID NO: 8487275 - DNA, 22 bp, Homo sapiens
gtggggaggcctaagcaagttg

SEQ ID NO: 8487276 - DNA, 22 bp, Homo sapiens
gtgggcagtggggtcttctgcc

SEQ ID NO: 8487277 - DNA, 22 bp, Homo sapiens
gtgggcaggtaggcaccagcta

SEQ ID NO: 8487278 - DNA, 22 bp, Homo sapiens
gtgggcaggtaggcaccagcta

SEQ ID NO: 8487279 - DNA, 22 bp, Homo sapiens
gtgggcaggtaggcaccagcta

SEQ ID NO: 8487280 - DNA, 22 bp, Homo sapiens
gtgggcagtgcctgacggatga

SEQ ID NO: 8487281 - DNA, 22 bp, Homo sapiens
gtgggcagtgcctgacggatga

SEQ ID NO: 8487282 - DNA, 22 bp, Homo sapiens
gtgggcaggtaggcaccagcta

SEQ ID NO: 8487283 - DNA, 22 bp, Homo sapiens
gtggcttctgcggtgtgcgcag

SEQ ID NO: 8487284 - DNA, 22 bp, Homo sapiens
gtggcttctgcggtgtgcgcag

SEQ ID NO: 8487285 - DNA, 22 bp, Homo sapiens
gtggctcacgtctgtcatctca

SEQ ID NO: 8487286 - DNA, 22 bp, Homo sapiens
gtggctcacacctgtaatccca

SEQ ID NO: 8487287 - DNA, 22 bp, Homo sapiens
gtggctagttggcagagaacag

SEQ ID NO: 8487288 - DNA, 22 bp, Homo sapiens
gtggctagaaaaatatgggtgc

SEQ ID NO: 8487289 - DNA, 22 bp, Homo sapiens
gtggctcacagcaatgtttcct

SEQ ID NO: 8487290 - DNA, 22 bp, Homo sapiens
gtggctcacgcctgtaatccca

SEQ ID NO: 8487291 - DNA, 22 bp, Homo sapiens
gtggccttttagaataaactct

SEQ ID NO: 8487292 - DNA, 22 bp, Homo sapiens
gtggccttttcaagtagggtat

SEQ ID NO: 8487293 - DNA, 22 bp, Homo sapiens
gtggcctttcctgaagaaatga

SEQ ID NO: 8487294 - DNA, 22 bp, Homo sapiens
gtggcctttcttgggctacaga

SEQ ID NO: 8487295 - DNA, 22 bp, Homo sapiens
gtggccttgggcactgaccttg

SEQ ID NO: 8487296 - DNA, 22 bp, Homo sapiens
gtggccttggcttctaccctga

SEQ ID NO: 8487297 - DNA, 22 bp, Homo sapiens
gtggccttgctcacatgtccag

SEQ ID NO: 8487298 - DNA, 22 bp, Homo sapiens
gtgggaagagccaattggggta

SEQ ID NO: 8487299 - DNA, 22 bp, Homo sapiens
gtgggaagaacttcaagtggct

SEQ ID NO: 8487300 - DNA, 19 bp, Homo sapiens
gtgggacagacattacata

SEQ ID NO: 8487301 - DNA, 22 bp, Homo sapiens
gtggctttcatttcaggatgtg

SEQ ID NO: 8487302 - DNA, 22 bp, Homo sapiens
gtggctttgtttccaaatgaaa

SEQ ID NO: 8487303 - DNA, 22 bp, Homo sapiens
gtggcttggaccagtcacagtg

SEQ ID NO: 8487304 - DNA, 22 bp, Homo sapiens
gtggcttgaccatccctgctac

SEQ ID NO: 8487305 - DNA, 22 bp, Homo sapiens
gtggcttgaccatccctgctac

SEQ ID NO: 8487306 - DNA, 22 bp, Homo sapiens
gtggcaggttccgtagacagca

SEQ ID NO: 8487307 - DNA, 22 bp, Homo sapiens
gtggcagtagacagtgcatcta

SEQ ID NO: 8487308 - DNA, 22 bp, Homo sapiens
gtggcagtcatcaaggacagat

SEQ ID NO: 8487309 - DNA, 22 bp, Homo sapiens
gtggcagtcggaagtcaggaga

SEQ ID NO: 8487310 - DNA, 22 bp, Homo sapiens
gtggcagtcgctgacagataca

SEQ ID NO: 8487311 - DNA, 22 bp, Homo sapiens
gtggcagtctcatctgtggctc

SEQ ID NO: 8487312 - DNA, 19 bp, Homo sapiens
gtggccagggcaggggctg

SEQ ID NO: 8487313 - DNA, 19 bp, Homo sapiens
gtggccagggcaggggctg

SEQ ID NO: 8487314 - DNA, 22 bp, Homo sapiens
gtggcagtctttggcaatgaca

SEQ ID NO: 8487315 - DNA, 22 bp, Homo sapiens
gtggcagtgaggcaggagcagt

SEQ ID NO: 8487316 - DNA, 22 bp, Homo sapiens
gtggcagtgaaggtcatagcat

SEQ ID NO: 8487317 - DNA, 22 bp, Homo sapiens
gtggccaggccgactgccaggc

SEQ ID NO: 8487318 - DNA, 22 bp, Homo sapiens
gtggccaggcgtccgcgcggct

SEQ ID NO: 8487319 - DNA, 22 bp, Homo sapiens
gtggcagtgccagctccgacaa

SEQ ID NO: 8487320 - DNA, 22 bp, Homo sapiens
gtggccaggtcagggacttgtg

SEQ ID NO: 8487321 - DNA, 22 bp, Homo sapiens
gtggccagtcccgatgcttgtt

SEQ ID NO: 8487322 - DNA, 22 bp, Homo sapiens
gtggccagtcccgatgcttgtt

SEQ ID NO: 8487323 - DNA, 22 bp, Homo sapiens
gtggccagggcccacaggatga

SEQ ID NO: 8487324 - DNA, 22 bp, Homo sapiens
gtggccaggtcagggacttgtg

SEQ ID NO: 8487325 - DNA, 22 bp, Homo sapiens
gtggccagggcccacaggatga

SEQ ID NO: 8487326 - DNA, 19 bp, Homo sapiens
gtggccagggcaggggctg

SEQ ID NO: 8487327 - DNA, 22 bp, Homo sapiens
gtggccagtgggaatgggctca

SEQ ID NO: 8487328 - DNA, 21 bp, Homo sapiens
gtggccagtgactacttattg

SEQ ID NO: 8487329 - DNA, 22 bp, Homo sapiens
gtggccagtggtgggcgccctg

SEQ ID NO: 8487330 - DNA, 22 bp, Homo sapiens
gtggccagtgggaatgggctca

SEQ ID NO: 8487331 - DNA, 22 bp, Homo sapiens
gtggccatgtgcttgcagggta

SEQ ID NO: 8487332 - DNA, 20 bp, Homo sapiens
cagctctgggaaagaggcca

SEQ ID NO: 8487333 - DNA, 20 bp, Homo sapiens
cagctctgggaaagaggcca

SEQ ID NO: 8487334 - DNA, 20 bp, Homo sapiens
cagctctgggaaagaggcca

SEQ ID NO: 8487335 - DNA, 22 bp, Homo sapiens
cagctctggctttggggagctt

SEQ ID NO: 8487336 - DNA, 22 bp, Homo sapiens
cagctctgtgcaggcctgggga

SEQ ID NO: 8487337 - DNA, 22 bp, Homo sapiens
cagctctgtgcaggcctgggga

SEQ ID NO: 8487338 - DNA, 22 bp, Homo sapiens
cagctctgtgtattttccccac

SEQ ID NO: 8487339 - DNA, 22 bp, Homo sapiens
cagctctgtgcaggcctgggga

SEQ ID NO: 8487340 - DNA, 22 bp, Homo sapiens
cagctctgtgcaggcctgggga

SEQ ID NO: 8487341 - DNA, 22 bp, Homo sapiens
cagctctgggagtcccacccct

SEQ ID NO: 8487342 - DNA, 22 bp, Homo sapiens
cagctctggcagagcccaaccc

SEQ ID NO: 8487343 - DNA, 22 bp, Homo sapiens
cagctctggccagatctatcct

SEQ ID NO: 8487344 - DNA, 22 bp, Homo sapiens
cagctctgcttccttgtacagg

SEQ ID NO: 8487345 - DNA, 22 bp, Homo sapiens
cagctctggcgtcagggagcga

SEQ ID NO: 8487346 - DNA, 22 bp, Homo sapiens
cagctctggcgtcagggagcga

SEQ ID NO: 8487347 - DNA, 22 bp, Homo sapiens
cagctctgctgggaggatgcag

SEQ ID NO: 8487348 - DNA, 22 bp, Homo sapiens
cagctctgctggtggtgccagg

SEQ ID NO: 8487349 - DNA, 22 bp, Homo sapiens
cagctctgctggtggtgccagg

SEQ ID NO: 8487350 - DNA, 22 bp, Homo sapiens
cagctctgctggtggtgccagg

SEQ ID NO: 8487351 - DNA, 22 bp, Homo sapiens
cagctctgcttccttgtacagg

SEQ ID NO: 8487352 - DNA, 22 bp, Homo sapiens
cagcccagccgagggcctggct

SEQ ID NO: 8487353 - DNA, 22 bp, Homo sapiens
cagcccagccgagggcctggct

SEQ ID NO: 8487354 - DNA, 22 bp, Homo sapiens
cagcccagccgagggcctggct

SEQ ID NO: 8487355 - DNA, 22 bp, Homo sapiens
cagcccagccttgtctctttat

SEQ ID NO: 8487356 - DNA, 21 bp, Homo sapiens
cagcccagcttcttccccagt

SEQ ID NO: 8487357 - DNA, 21 bp, Homo sapiens
cagcccagcttcttccccagt

SEQ ID NO: 8487358 - DNA, 22 bp, Homo sapiens
cagcccagcgcaaacaactggc

SEQ ID NO: 8487359 - DNA, 22 bp, Homo sapiens
cagcccaggactgcaggtgttt

SEQ ID NO: 8487360 - DNA, 22 bp, Homo sapiens
cagcccaggactgcaggtgttt

SEQ ID NO: 8487361 - DNA, 22 bp, Homo sapiens
cagcccaggactgcaggtgttt

SEQ ID NO: 8487362 - DNA, 22 bp, Homo sapiens
cagcccaggccgacagttcctc

SEQ ID NO: 8487363 - DNA, 22 bp, Homo sapiens
cagcccaggccgacagttcctc

SEQ ID NO: 8487364 - DNA, 22 bp, Homo sapiens
cagcccaggccgacagttcctc

SEQ ID NO: 8487365 - DNA, 22 bp, Homo sapiens
gtggagccctgccttgctcatg

SEQ ID NO: 8487366 - DNA, 22 bp, Homo sapiens
gtggagccctgccttgctcatg

SEQ ID NO: 8487367 - DNA, 22 bp, Homo sapiens
cagcccaggccgacagttcctc

SEQ ID NO: 8487368 - DNA, 22 bp, Homo sapiens
gtggagccaggggctgtaggta

SEQ ID NO: 8487369 - DNA, 22 bp, Homo sapiens
gtggagccctgccttgctcatg

SEQ ID NO: 8487370 - DNA, 22 bp, Homo sapiens
gtggcaggtcccattggagcag

SEQ ID NO: 8487371 - DNA, 22 bp, Homo sapiens
gtggcaggtcccattggagcag

SEQ ID NO: 8487372 - DNA, 22 bp, Homo sapiens
gtggcaggttataagcatctca

SEQ ID NO: 8487373 - DNA, 22 bp, Homo sapiens
gtggcaggttccgtagacagca

SEQ ID NO: 8487374 - DNA, 22 bp, Homo sapiens
gtggcaggttccgtagacagca

SEQ ID NO: 8487375 - DNA, 22 bp, Homo sapiens
gtggcaggtcccattggagcag

SEQ ID NO: 8487376 - DNA, 22 bp, Homo sapiens
gtggcagaaactggcagaggag

SEQ ID NO: 8487377 - DNA, 22 bp, Homo sapiens
gtggcagaaatattcttgctct

SEQ ID NO: 8487378 - DNA, 22 bp, Homo sapiens
gtggcagaaatgggactttgag

SEQ ID NO: 8487379 - DNA, 22 bp, Homo sapiens
gtggcagaaatgggactttgag

SEQ ID NO: 8487380 - DNA, 22 bp, Homo sapiens
gtggcagaagagtaggatgggc

SEQ ID NO: 8487381 - DNA, 22 bp, Homo sapiens
gtggcagaactatgtgattgct

SEQ ID NO: 8487382 - DNA, 22 bp, Homo sapiens
gtggcagagaacaaggagaggt

SEQ ID NO: 8487383 - DNA, 22 bp, Homo sapiens
gtggcagaccttcccttctcct

SEQ ID NO: 8487384 - DNA, 22 bp, Homo sapiens
gtggcagagagcaagtgtctga

SEQ ID NO: 8487385 - DNA, 22 bp, Homo sapiens
gtggcagagagcaagtgtctga

SEQ ID NO: 8487386 - DNA, 22 bp, Homo sapiens
gtggcagagcaggagacaggac

SEQ ID NO: 8487387 - DNA, 22 bp, Homo sapiens
gtggcagagcaggagacaggac

SEQ ID NO: 8487388 - DNA, 22 bp, Homo sapiens
cagctgcttactagctgtgtga

SEQ ID NO: 8487389 - DNA, 22 bp, Homo sapiens
cagctgcttactagctgtgtga

SEQ ID NO: 8487390 - DNA, 22 bp, Homo sapiens
cagctgctgttcagttttgttt

SEQ ID NO: 8487391 - DNA, 22 bp, Homo sapiens
cagctgctgttcagttttgttt

SEQ ID NO: 8487392 - DNA, 22 bp, Homo sapiens
cagctgcttactagctgtgtga

SEQ ID NO: 8487393 - DNA, 22 bp, Homo sapiens
cagctgctgttcagttttgttt

SEQ ID NO: 8487394 - DNA, 22 bp, Homo sapiens
cagctgctgttactgcttatta

SEQ ID NO: 8487395 - DNA, 22 bp, Homo sapiens
cagctgctgttcagttttgttt

SEQ ID NO: 8487396 - DNA, 22 bp, Homo sapiens
cagctgctgttactgcttatta

SEQ ID NO: 8487397 - DNA, 22 bp, Homo sapiens
cagctgctgtaacagaatactt

SEQ ID NO: 8487398 - DNA, 22 bp, Homo sapiens
cagctgctgcctcatccacttt

SEQ ID NO: 8487399 - DNA, 22 bp, Homo sapiens
cagctgctgcctcatccacttt

SEQ ID NO: 8487400 - DNA, 22 bp, Homo sapiens
cagctgctgcccttggctgcag

SEQ ID NO: 8487401 - DNA, 22 bp, Homo sapiens
cagctgctgcctcatccacttt

SEQ ID NO: 8487402 - DNA, 22 bp, Homo sapiens
cagctgccttctgcgggaagtc

SEQ ID NO: 8487403 - DNA, 22 bp, Homo sapiens
cagctgccttctgcgggaagtc

SEQ ID NO: 8487404 - DNA, 19 bp, Homo sapiens
cagctgccttttctttgca

SEQ ID NO: 8487405 - DNA, 22 bp, Homo sapiens
cagctgcctgtctggaggcaat

SEQ ID NO: 8487406 - DNA, 22 bp, Homo sapiens
cagctgcctgtctggaggcaat

SEQ ID NO: 8487407 - DNA, 22 bp, Homo sapiens
cagctgcctgtctggaggcaat

SEQ ID NO: 8487408 - DNA, 22 bp, Homo sapiens
cagctgcctgtattgtcctcat

SEQ ID NO: 8487409 - DNA, 22 bp, Homo sapiens
cagctgctgatggcctgacaga

SEQ ID NO: 8487410 - DNA, 22 bp, Homo sapiens
cagctgctgatggcctgacaga

SEQ ID NO: 8487411 - DNA, 22 bp, Homo sapiens
cagctgccttctgcgggaagtc

SEQ ID NO: 8487412 - DNA, 22 bp, Homo sapiens
cagctgctctggtggtctctcc

SEQ ID NO: 8487413 - DNA, 22 bp, Homo sapiens
cagctggccctttggtagcctt

SEQ ID NO: 8487414 - DNA, 22 bp, Homo sapiens
cagctggccccacagtagaggc

SEQ ID NO: 8487415 - DNA, 22 bp, Homo sapiens
cagctggccccacagtagaggc

SEQ ID NO: 8487416 - DNA, 22 bp, Homo sapiens
cagctggcctgatccctgtggc

SEQ ID NO: 8487417 - DNA, 22 bp, Homo sapiens
cagctggcgtggagtgattgca

SEQ ID NO: 8487418 - DNA, 22 bp, Homo sapiens
cagctggcgggcagagccgcca

SEQ ID NO: 8487419 - DNA, 22 bp, Homo sapiens
cagctggcgtggagtgattgca

SEQ ID NO: 8487420 - DNA, 22 bp, Homo sapiens
cagctggcgtggagtgattgca

SEQ ID NO: 8487421 - DNA, 22 bp, Homo sapiens
cagctggcgcctggggaccaga

SEQ ID NO: 8487422 - DNA, 22 bp, Homo sapiens
cagctggctgcatgatgccaaa

SEQ ID NO: 8487423 - DNA, 22 bp, Homo sapiens
cagctggctgcatgatgccaaa

SEQ ID NO: 8487424 - DNA, 22 bp, Homo sapiens
cagctggctccacctctgggct

SEQ ID NO: 8487425 - DNA, 22 bp, Homo sapiens
gtgggtggaggcgtcgagggca

SEQ ID NO: 8487426 - DNA, 22 bp, Homo sapiens
gtgggtggaggcgtcgagggca

SEQ ID NO: 8487427 - DNA, 22 bp, Homo sapiens
gtgggtggatcacctgaggtca

SEQ ID NO: 8487428 - DNA, 22 bp, Homo sapiens
gtgggtggatcacctgaggtca

SEQ ID NO: 8487429 - DNA, 22 bp, Homo sapiens
gtgggtggatcacctgaggtca

SEQ ID NO: 8487430 - DNA, 22 bp, Homo sapiens
gtgggtggatcacctgaggtca

SEQ ID NO: 8487431 - DNA, 22 bp, Homo sapiens
gtgggtggatcacctgaggtca

SEQ ID NO: 8487432 - DNA, 22 bp, Homo sapiens
gtgggtggatcacctgaggtca

SEQ ID NO: 8487433 - DNA, 22 bp, Homo sapiens
gtgggtggatcatgaggtcagg

SEQ ID NO: 8487434 - DNA, 22 bp, Homo sapiens
gtgggtggatcatgaggtcagg

SEQ ID NO: 8487435 - DNA, 22 bp, Homo sapiens
gtgggtggatcatgaggtcagg

SEQ ID NO: 8487436 - DNA, 22 bp, Homo sapiens
gtgggtggatcatgaggtcagg

SEQ ID NO: 8487437 - DNA, 22 bp, Homo sapiens
cagctgcagaaagcaagcaggt

SEQ ID NO: 8487438 - DNA, 22 bp, Homo sapiens
cagctgcactgaagcaggtttg

SEQ ID NO: 8487439 - DNA, 22 bp, Homo sapiens
cagctgcagaaagcaagcaggt

SEQ ID NO: 8487440 - DNA, 22 bp, Homo sapiens
cagctgcaggagctgagcactt

SEQ ID NO: 8487441 - DNA, 22 bp, Homo sapiens
cagctgcaggaacaaaaatgtg

SEQ ID NO: 8487442 - DNA, 22 bp, Homo sapiens
cagctgcaggagaaacagaggc

SEQ ID NO: 8487443 - DNA, 19 bp, Homo sapiens
cagctgcaccgtgaccatc

SEQ ID NO: 8487444 - DNA, 19 bp, Homo sapiens
cagctgcaccgtgaccatc

SEQ ID NO: 8487445 - DNA, 22 bp, Homo sapiens
gtggggctgcttaggctgcgca

SEQ ID NO: 8487446 - DNA, 22 bp, Homo sapiens
gtggggctgagtggagccagaa

SEQ ID NO: 8487447 - DNA, 22 bp, Homo sapiens
gtggggctcccatctcctggct

SEQ ID NO: 8487448 - DNA, 22 bp, Homo sapiens
gtggggctgagtggagccagaa

SEQ ID NO: 8487449 - DNA, 22 bp, Homo sapiens
gtggggagtgttctgtgattgg

SEQ ID NO: 8487450 - DNA, 22 bp, Homo sapiens
gtggggagggagatgctgaagt

SEQ ID NO: 8487451 - DNA, 22 bp, Homo sapiens
gtggggagggagatgctgaagt

SEQ ID NO: 8487452 - DNA, 22 bp, Homo sapiens
gtggggcagtggcctgggagca

SEQ ID NO: 8487453 - DNA, 22 bp, Homo sapiens
gtggggcatgcacgctgctcct

SEQ ID NO: 8487454 - DNA, 22 bp, Homo sapiens
gtggggcatgcacgctgctcct

SEQ ID NO: 8487455 - DNA, 22 bp, Homo sapiens
gtggggctcccatctcctggct

SEQ ID NO: 8487456 - DNA, 22 bp, Homo sapiens
gtggggctaaaaactgtgcagt

SEQ ID NO: 8487457 - DNA, 22 bp, Homo sapiens
cagctgcctgtattgtcctcat

SEQ ID NO: 8487458 - DNA, 22 bp, Homo sapiens
cagctgcctgtattgtcctcat

SEQ ID NO: 8487459 - DNA, 20 bp, Homo sapiens
cagctgcctggctctgggat

SEQ ID NO: 8487460 - DNA, 20 bp, Homo sapiens
cagctgcctggctctgggat

SEQ ID NO: 8487461 - DNA, 20 bp, Homo sapiens
cagctgcctggctctgggat

SEQ ID NO: 8487462 - DNA, 22 bp, Homo sapiens
cagctgcctgcaacacaagctt

SEQ ID NO: 8487463 - DNA, 22 bp, Homo sapiens
cagctgcctgcaacacaagctt

SEQ ID NO: 8487464 - DNA, 22 bp, Homo sapiens
cagctgcctatgacctagcctc

SEQ ID NO: 8487465 - DNA, 22 bp, Homo sapiens
cagctgcctatgacctagcctc

SEQ ID NO: 8487466 - DNA, 22 bp, Homo sapiens
cagctgcctatgacctagcctc

SEQ ID NO: 8487467 - DNA, 22 bp, Homo sapiens
cagctgcctatgacctagcctc

SEQ ID NO: 8487468 - DNA, 22 bp, Homo sapiens
cagctgcccctccagggctggg

SEQ ID NO: 8487469 - DNA, 22 bp, Homo sapiens
cagctgccacttgctctcggct

SEQ ID NO: 8487470 - DNA, 22 bp, Homo sapiens
cagctgcccctccagggctggg

SEQ ID NO: 8487471 - DNA, 22 bp, Homo sapiens
cagctgccctgccttgccctta

SEQ ID NO: 8487472 - DNA, 22 bp, Homo sapiens
cagctgccctgccttgccctta

SEQ ID NO: 8487473 - DNA, 22 bp, Homo sapiens
cagctgccctgccttgccctta

SEQ ID NO: 8487474 - DNA, 22 bp, Homo sapiens
cagctgccaagaatcttttcta

SEQ ID NO: 8487475 - DNA, 22 bp, Homo sapiens
cagctgccaagaatcttttcta

SEQ ID NO: 8487476 - DNA, 22 bp, Homo sapiens
cagctgccacaggactttctga

SEQ ID NO: 8487477 - DNA, 22 bp, Homo sapiens
cagctgccacacctctttctct

SEQ ID NO: 8487478 - DNA, 22 bp, Homo sapiens
cagctgccacacctctttctct

SEQ ID NO: 8487479 - DNA, 22 bp, Homo sapiens
cagctgccacttgctctcggct

SEQ ID NO: 8487480 - DNA, 22 bp, Homo sapiens
cagctgccacaggactttctga

SEQ ID NO: 8487481 - DNA, 22 bp, Homo sapiens
cagctgcaggctgtgcaggaag

SEQ ID NO: 8487482 - DNA, 18 bp, Homo sapiens
cagctgcaggctcaggac

SEQ ID NO: 8487483 - DNA, 22 bp, Homo sapiens
cagctgcagttcaatgcttgct

SEQ ID NO: 8487484 - DNA, 19 bp, Homo sapiens
gtgtctgcctttgtgccac

SEQ ID NO: 8487485 - DNA, 22 bp, Homo sapiens
gtgtattgcacatcctgtagcc

SEQ ID NO: 8487486 - DNA, 22 bp, Homo sapiens
gtgtatgttctacttaatatta

SEQ ID NO: 8487487 - DNA, 22 bp, Homo sapiens
gtgtatgttctacttaatatta

SEQ ID NO: 8487488 - DNA, 22 bp, Homo sapiens
gtgtatgttctacttaatatta

SEQ ID NO: 8487489 - DNA, 19 bp, Homo sapiens
gtgtatgtaagttgtgagg

SEQ ID NO: 8487490 - DNA, 22 bp, Homo sapiens
gtgtcttagaaagactgaatgc

SEQ ID NO: 8487491 - DNA, 22 bp, Homo sapiens
gtgtctgttatacagaggagac

SEQ ID NO: 8487492 - DNA, 22 bp, Homo sapiens
gtgtctgtgtcattactaatag

SEQ ID NO: 8487493 - DNA, 18 bp, Homo sapiens
gtgtcttattacagtggg

SEQ ID NO: 8487494 - DNA, 22 bp, Homo sapiens
gtgtcttagggttgcacagagt

SEQ ID NO: 8487495 - DNA, 22 bp, Homo sapiens
gtgtgaaagtaattgcggtttt

SEQ ID NO: 8487496 - DNA, 22 bp, Homo sapiens
gtgtgaaaatgtgcacaatatg

SEQ ID NO: 8487497 - DNA, 22 bp, Homo sapiens
gtgtgaaagtaattgcggtttt

SEQ ID NO: 8487498 - DNA, 22 bp, Homo sapiens
gtgtgaaatggttctctttgtt

SEQ ID NO: 8487499 - DNA, 20 bp, Homo sapiens
gtgtgaagccctcaggagga

SEQ ID NO: 8487500 - DNA, 22 bp, Homo sapiens
gtgtgaaagttcctaagactat

SEQ ID NO: 8487501 - DNA, 22 bp, Homo sapiens
gtgtgagcagaaaccatgagta

SEQ ID NO: 8487502 - DNA, 22 bp, Homo sapiens
gtgtgagcatcaaagcctgtca

SEQ ID NO: 8487503 - DNA, 22 bp, Homo sapiens
gtgtgacccaaggacactctct

SEQ ID NO: 8487504 - DNA, 22 bp, Homo sapiens
gtgtgagaagggaatgtaaagc

SEQ ID NO: 8487505 - DNA, 22 bp, Homo sapiens
gtgtgagagaagctgccatgga

SEQ ID NO: 8487506 - DNA, 22 bp, Homo sapiens
gtgtgagagactgaagaaagcc

SEQ ID NO: 8487507 - DNA, 22 bp, Homo sapiens
gtgtatgcaattgagtcataga

SEQ ID NO: 8487508 - DNA, 22 bp, Homo sapiens
gtgtatcagtaactgtggacag

SEQ ID NO: 8487509 - DNA, 19 bp, Homo sapiens
gtgtatgtaagttgtgagg

SEQ ID NO: 8487510 - DNA, 22 bp, Homo sapiens
gtgtatggacacatgtcatgtt

SEQ ID NO: 8487511 - DNA, 22 bp, Homo sapiens
gtgtatgcagaaacatgcaaag

SEQ ID NO: 8487512 - DNA, 22 bp, Homo sapiens
gtgtatgcttagccagagattt

SEQ ID NO: 8487513 - DNA, 22 bp, Homo sapiens
gtgtatcaaagcacagacttca

SEQ ID NO: 8487514 - DNA, 22 bp, Homo sapiens
gtgtataactatctatctagta

SEQ ID NO: 8487515 - DNA, 22 bp, Homo sapiens
gtgtacatattgagtctgctga

SEQ ID NO: 8487516 - DNA, 22 bp, Homo sapiens
gtgtacatagaattgtgctttg

SEQ ID NO: 8487517 - DNA, 22 bp, Homo sapiens
gtgtacatagaattgtgctttg

SEQ ID NO: 8487518 - DNA, 22 bp, Homo sapiens
gtgtacatattgagtctgctga

SEQ ID NO: 8487519 - DNA, 22 bp, Homo sapiens
gtgtacatgagaaatcaacttt

SEQ ID NO: 8487520 - DNA, 22 bp, Homo sapiens
gtgtactgcaaatgctgctgcc

SEQ ID NO: 8487521 - DNA, 22 bp, Homo sapiens
gtgtagctttggagtgggaggc

SEQ ID NO: 8487522 - DNA, 22 bp, Homo sapiens
gtgtagcatatagcaagagcat

SEQ ID NO: 8487523 - DNA, 22 bp, Homo sapiens
gtgtagagtgacaaggtgggaa

SEQ ID NO: 8487524 - DNA, 22 bp, Homo sapiens
gtgggtgtcagtatctttaacg

SEQ ID NO: 8487525 - DNA, 22 bp, Homo sapiens
gtgggtgtcagtatctttaacg

SEQ ID NO: 8487526 - DNA, 22 bp, Homo sapiens
gtgggtgtgagtgacggcgtcc

SEQ ID NO: 8487527 - DNA, 22 bp, Homo sapiens
gtgggtgtctcaagaatggggg

SEQ ID NO: 8487528 - DNA, 22 bp, Homo sapiens
gtgggtggattccagcaacgct

SEQ ID NO: 8487529 - DNA, 22 bp, Homo sapiens
gtgggtggattccagcaacgct

SEQ ID NO: 8487530 - DNA, 22 bp, Homo sapiens
gtgggtgtggttcgtttaagac

SEQ ID NO: 8487531 - DNA, 22 bp, Homo sapiens
gtgggtgtggaactgtgagacc

SEQ ID NO: 8487532 - DNA, 22 bp, Homo sapiens
gtgggtgtggaactgtgagacc

SEQ ID NO: 8487533 - DNA, 22 bp, Homo sapiens
gtgggtgtggaactgtgagacc

SEQ ID NO: 8487534 - DNA, 22 bp, Homo sapiens
gtggtaatttaatcctacactg

SEQ ID NO: 8487535 - DNA, 22 bp, Homo sapiens
gtggtaatcggattcttaccgg

SEQ ID NO: 8487536 - DNA, 22 bp, Homo sapiens
gtggtaatagagctccaaacta

SEQ ID NO: 8487537 - DNA, 22 bp, Homo sapiens
gtgtacaggatgactgtactta

SEQ ID NO: 8487538 - DNA, 22 bp, Homo sapiens
gtggtaggcacagagaacaaga

SEQ ID NO: 8487539 - DNA, 22 bp, Homo sapiens
gtgtacagtaagtgaatctagg

SEQ ID NO: 8487540 - DNA, 22 bp, Homo sapiens
gtgtgctgagtgactgtcatca

SEQ ID NO: 8487541 - DNA, 18 bp, Homo sapiens
gtgtgctcagagagtgag

SEQ ID NO: 8487542 - DNA, 22 bp, Homo sapiens
gtgtgctgagtgactgtcatca

SEQ ID NO: 8487543 - DNA, 22 bp, Homo sapiens
gtgtgcgcgctcataggtgtgt

SEQ ID NO: 8487544 - DNA, 22 bp, Homo sapiens
gtgtgcgttcctagtaaacgtg

SEQ ID NO: 8487545 - DNA, 22 bp, Homo sapiens
gtgtgcgcgctcataggtgtgt

SEQ ID NO: 8487546 - DNA, 22 bp, Homo sapiens
gtgtgctgttgttcaggtagaa

SEQ ID NO: 8487547 - DNA, 22 bp, Homo sapiens
gtgtggaaagagtggcctctca

SEQ ID NO: 8487548 - DNA, 21 bp, Homo sapiens
gtgtgctgatacattggagaa

SEQ ID NO: 8487549 - DNA, 22 bp, Homo sapiens
cagctggctggtcagtgcacaa

SEQ ID NO: 8487550 - DNA, 22 bp, Homo sapiens
cagctggctggtcagtgcacaa

SEQ ID NO: 8487551 - DNA, 22 bp, Homo sapiens
cagctggcttgtttgttcttga

SEQ ID NO: 8487552 - DNA, 22 bp, Homo sapiens
cagctggcttgtttgttcttga

SEQ ID NO: 8487553 - DNA, 22 bp, Homo sapiens
cagctgggagctccattagata

SEQ ID NO: 8487554 - DNA, 22 bp, Homo sapiens
gtgtggccgtgtatccatggct

SEQ ID NO: 8487555 - DNA, 19 bp, Homo sapiens
gtgtggcagagagtgacca

SEQ ID NO: 8487556 - DNA, 22 bp, Homo sapiens
cagctgggagctccattagata

SEQ ID NO: 8487557 - DNA, 22 bp, Homo sapiens
cagctgggcctcctgagccctg

SEQ ID NO: 8487558 - DNA, 22 bp, Homo sapiens
cagctgggcctcctgagccctg

SEQ ID NO: 8487559 - DNA, 22 bp, Homo sapiens
cagctggggcagccacgtgcgg

SEQ ID NO: 8487560 - DNA, 22 bp, Homo sapiens
cagctggggcagccacgtgcgg

SEQ ID NO: 8487561 - DNA, 22 bp, Homo sapiens
cagctggggcagccacgtgcgg

SEQ ID NO: 8487562 - DNA, 22 bp, Homo sapiens
cagctgtctaagttgagcagga

SEQ ID NO: 8487563 - DNA, 22 bp, Homo sapiens
cagctgtctgaagcaggagtcc

SEQ ID NO: 8487564 - DNA, 22 bp, Homo sapiens
cagctgtctgaagcaggagtcc

SEQ ID NO: 8487565 - DNA, 22 bp, Homo sapiens
cagctgtctgctgaaggaagct

SEQ ID NO: 8487566 - DNA, 22 bp, Homo sapiens
caggaaagaaatgagaacacca

SEQ ID NO: 8487567 - DNA, 22 bp, Homo sapiens
caggaaagaaatgagaacacca

SEQ ID NO: 8487568 - DNA, 21 bp, Homo sapiens
caggaaactgaggccatgggg

SEQ ID NO: 8487569 - DNA, 21 bp, Homo sapiens
caggaaactgaggccatgggg

SEQ ID NO: 8487570 - DNA, 22 bp, Homo sapiens
caggaaacaaagccttgctcat

SEQ ID NO: 8487571 - DNA, 22 bp, Homo sapiens
caggaaaatgtcaatggaaagc

SEQ ID NO: 8487572 - DNA, 22 bp, Homo sapiens
caggaaacatatgtgcttgagg

SEQ ID NO: 8487573 - DNA, 19 bp, Homo sapiens
caggaaacacctactgcta

SEQ ID NO: 8487574 - DNA, 22 bp, Homo sapiens
caggaaagagctgccaggcagg

SEQ ID NO: 8487575 - DNA, 22 bp, Homo sapiens
gttcacaagagttacagacaga

SEQ ID NO: 8487576 - DNA, 22 bp, Homo sapiens
gttcacaaatatgcacttacga

SEQ ID NO: 8487577 - DNA, 22 bp, Homo sapiens
gttcacagaaattgtgtacctc

SEQ ID NO: 8487578 - DNA, 22 bp, Homo sapiens
gttcacacttttgatatgtgaa

SEQ ID NO: 8487579 - DNA, 22 bp, Homo sapiens
gttcacagaaggccagatggta

SEQ ID NO: 8487580 - DNA, 22 bp, Homo sapiens
gttcacagaaattgtgtacctc

SEQ ID NO: 8487581 - DNA, 22 bp, Homo sapiens
gttcacagcaaacctatgaact

SEQ ID NO: 8487582 - DNA, 22 bp, Homo sapiens
gttcacagatccttgaagccag

SEQ ID NO: 8487583 - DNA, 22 bp, Homo sapiens
gttcacagctgggacaagactg

SEQ ID NO: 8487584 - DNA, 22 bp, Homo sapiens
gttcacagctgggacaagactg

SEQ ID NO: 8487585 - DNA, 22 bp, Homo sapiens
caggaaaatctgcccacacaag

SEQ ID NO: 8487586 - DNA, 22 bp, Homo sapiens
caggaaaatggaatcacctgta

SEQ ID NO: 8487587 - DNA, 22 bp, Homo sapiens
caggaaaatggaatcacctgta

SEQ ID NO: 8487588 - DNA, 22 bp, Homo sapiens
cagctttctgtctcatgactga

SEQ ID NO: 8487589 - DNA, 22 bp, Homo sapiens
cagctttgaaacatggctctag

SEQ ID NO: 8487590 - DNA, 22 bp, Homo sapiens
cagctttctttccataaggttt

SEQ ID NO: 8487591 - DNA, 22 bp, Homo sapiens
cagctttcttccttctgtctgt

SEQ ID NO: 8487592 - DNA, 22 bp, Homo sapiens
cagctttccccgtgcctcagcc

SEQ ID NO: 8487593 - DNA, 22 bp, Homo sapiens
cagctttccccgtgcctcagcc

SEQ ID NO: 8487594 - DNA, 22 bp, Homo sapiens
cagctttcatcagtgacactca

SEQ ID NO: 8487595 - DNA, 22 bp, Homo sapiens
cagctttcatcagtgacactca

SEQ ID NO: 8487596 - DNA, 22 bp, Homo sapiens
cagctttatttcacgtgtttgt

SEQ ID NO: 8487597 - DNA, 16 bp, Homo sapiens
cagctttatgtcagtg

SEQ ID NO: 8487598 - DNA, 17 bp, Homo sapiens
cagctttatgctactgt

SEQ ID NO: 8487599 - DNA, 22 bp, Homo sapiens
cagctttaggactcataataaa

SEQ ID NO: 8487600 - DNA, 22 bp, Homo sapiens
cagctttaggactcataataaa

SEQ ID NO: 8487601 - DNA, 20 bp, Homo sapiens
cagctttagatctttgatta

SEQ ID NO: 8487602 - DNA, 22 bp, Homo sapiens
cagctttagagaaaacatattt

SEQ ID NO: 8487603 - DNA, 20 bp, Homo sapiens
cagcttggatgagaggctga

SEQ ID NO: 8487604 - DNA, 22 bp, Homo sapiens
cagcttggattttggcacgtgt

SEQ ID NO: 8487605 - DNA, 20 bp, Homo sapiens
cagcttggatgagaggctga

SEQ ID NO: 8487606 - DNA, 20 bp, Homo sapiens
cagcttggatgagaggctga

SEQ ID NO: 8487607 - DNA, 22 bp, Homo sapiens
cagcttggaggaggatctaaga

SEQ ID NO: 8487608 - DNA, 22 bp, Homo sapiens
cagcttgggagtttggttttat

SEQ ID NO: 8487609 - DNA, 22 bp, Homo sapiens
cagcttggcttccgctttactg

SEQ ID NO: 8487610 - DNA, 22 bp, Homo sapiens
cagcttgggtcaggtgcctgct

SEQ ID NO: 8487611 - DNA, 22 bp, Homo sapiens
cagcttgggtcaggtgcctgct

SEQ ID NO: 8487612 - DNA, 22 bp, Homo sapiens
cagcttgggtcaggtgcctgct

SEQ ID NO: 8487613 - DNA, 22 bp, Homo sapiens
cagcttgggggcgctggcctca

SEQ ID NO: 8487614 - DNA, 22 bp, Homo sapiens
cagcttctcgggagcgcatgtg

SEQ ID NO: 8487615 - DNA, 21 bp, Homo sapiens
cagcttctgaaggtgtaggaa

SEQ ID NO: 8487616 - DNA, 22 bp, Homo sapiens
cagcttctgagcaagccagggg

SEQ ID NO: 8487617 - DNA, 22 bp, Homo sapiens
cagcttctatttatctttgtgt

SEQ ID NO: 8487618 - DNA, 22 bp, Homo sapiens
cagcttctatttatctttgtgt

SEQ ID NO: 8487619 - DNA, 22 bp, Homo sapiens
cagcttctcagaaagctgaggt

SEQ ID NO: 8487620 - DNA, 22 bp, Homo sapiens
gttacatggagcaatgatgcat

SEQ ID NO: 8487621 - DNA, 22 bp, Homo sapiens
gttacagtgggtttggggccca

SEQ ID NO: 8487622 - DNA, 22 bp, Homo sapiens
gttacagtttgggcttgattca

SEQ ID NO: 8487623 - DNA, 23 bp, Homo sapiens
gttaccttacttctgtgatcttc

SEQ ID NO: 8487624 - DNA, 22 bp, Homo sapiens
gttatgtatgggggccttatga

SEQ ID NO: 8487625 - DNA, 22 bp, Homo sapiens
gttattcaatggcttataagga

SEQ ID NO: 8487626 - DNA, 22 bp, Homo sapiens
gttattcaatggcttataagga

SEQ ID NO: 8487627 - DNA, 22 bp, Homo sapiens
gttattcaacttgtgtctctta

SEQ ID NO: 8487628 - DNA, 22 bp, Homo sapiens
gttattcaacttgtgtctctta

SEQ ID NO: 8487629 - DNA, 22 bp, Homo sapiens
gttattaaagtatttgatgtta

SEQ ID NO: 8487630 - DNA, 22 bp, Homo sapiens
gttatgtattgggaaatccaag

SEQ ID NO: 8487631 - DNA, 22 bp, Homo sapiens
gttatgtattgggaaatccaag

SEQ ID NO: 8487632 - DNA, 22 bp, Homo sapiens
gttattgactctcttgtggctt

SEQ ID NO: 8487633 - DNA, 22 bp, Homo sapiens
gttattgagacatagagttatg

SEQ ID NO: 8487634 - DNA, 22 bp, Homo sapiens
cagcttctaccatcaggaaatt

SEQ ID NO: 8487635 - DNA, 22 bp, Homo sapiens
gttattgaggtggagtctcact

SEQ ID NO: 8487636 - DNA, 22 bp, Homo sapiens
gttattgaggtggagtctcact

SEQ ID NO: 8487637 - DNA, 22 bp, Homo sapiens
gttattgacatgtattaagcac

SEQ ID NO: 8487638 - DNA, 21 bp, Homo sapiens
gttattgacctccaggctggc

SEQ ID NO: 8487639 - DNA, 22 bp, Homo sapiens
gttattctaccactatgtacag

SEQ ID NO: 8487640 - DNA, 22 bp, Homo sapiens
gttattctacagtcattgaagt

SEQ ID NO: 8487641 - DNA, 22 bp, Homo sapiens
cagcttccgaccgggggctgca

SEQ ID NO: 8487642 - DNA, 22 bp, Homo sapiens
cagcttccgaccgggggctgca

SEQ ID NO: 8487643 - DNA, 22 bp, Homo sapiens
gtgtgtctcccaagaaggccca

SEQ ID NO: 8487644 - DNA, 22 bp, Homo sapiens
cagcttctaccatcaggaaatt

SEQ ID NO: 8487645 - DNA, 22 bp, Homo sapiens
gtgtgtctgaagttgagtagac

SEQ ID NO: 8487646 - DNA, 21 bp, Homo sapiens
gtgtgtctaatgtagtggaaa

SEQ ID NO: 8487647 - DNA, 22 bp, Homo sapiens
gtgtgtctttataagaagaggg

SEQ ID NO: 8487648 - DNA, 22 bp, Homo sapiens
gtgtgtcttgaccaggatcgga

SEQ ID NO: 8487649 - DNA, 22 bp, Homo sapiens
gtgtgtctgaagttgagtagac

SEQ ID NO: 8487650 - DNA, 22 bp, Homo sapiens
gtgtgtctgaagttgagtagac

SEQ ID NO: 8487651 - DNA, 22 bp, Homo sapiens
cagcttcatgtccaggtactgt

SEQ ID NO: 8487652 - DNA, 22 bp, Homo sapiens
cagcttcatgtccaggtactgt

SEQ ID NO: 8487653 - DNA, 22 bp, Homo sapiens
cagcttcattgcctgatgtctt

SEQ ID NO: 8487654 - DNA, 22 bp, Homo sapiens
cagcttccataagagatggaga

SEQ ID NO: 8487655 - DNA, 22 bp, Homo sapiens
cagcttccacagacttggctcg

SEQ ID NO: 8487656 - DNA, 22 bp, Homo sapiens
cagcttccataagagatggaga

SEQ ID NO: 8487657 - DNA, 22 bp, Homo sapiens
cagcttccataagagatggaga

SEQ ID NO: 8487658 - DNA, 22 bp, Homo sapiens
cagcttccatctccactgccct

SEQ ID NO: 8487659 - DNA, 22 bp, Homo sapiens
cagcttccatctccactgccct

SEQ ID NO: 8487660 - DNA, 22 bp, Homo sapiens
cagcttcccagctcactcataa

SEQ ID NO: 8487661 - DNA, 22 bp, Homo sapiens
cagcttccatctccactgccct

SEQ ID NO: 8487662 - DNA, 22 bp, Homo sapiens
cagcttcccttggctgagcaga

SEQ ID NO: 8487663 - DNA, 22 bp, Homo sapiens
cagcttcccttggctgagcaga

SEQ ID NO: 8487664 - DNA, 22 bp, Homo sapiens
cagcttccccccgggcttgaga

SEQ ID NO: 8487665 - DNA, 22 bp, Homo sapiens
cagctgttgtgtatcaggcaga

SEQ ID NO: 8487666 - DNA, 22 bp, Homo sapiens
cagctgtttcagtagcgttact

SEQ ID NO: 8487667 - DNA, 20 bp, Homo sapiens
cagcttcaatgtcagcttga

SEQ ID NO: 8487668 - DNA, 22 bp, Homo sapiens
cagcttcaactgcacagtcaac

SEQ ID NO: 8487669 - DNA, 22 bp, Homo sapiens
cagcttcaactgcacagtcaac

SEQ ID NO: 8487670 - DNA, 22 bp, Homo sapiens
cagcttcaataatggctgatgg

SEQ ID NO: 8487671 - DNA, 20 bp, Homo sapiens
cagcttcaatgtcagcttga

SEQ ID NO: 8487672 - DNA, 22 bp, Homo sapiens
cagcttcatgacaaacagtttt

SEQ ID NO: 8487673 - DNA, 22 bp, Homo sapiens
cagcttcagggacagcttcttt

SEQ ID NO: 8487674 - DNA, 22 bp, Homo sapiens
cagcttcagcgtgacaccagtg

SEQ ID NO: 8487675 - DNA, 22 bp, Homo sapiens
cagctgtggagatggggtgcat

SEQ ID NO: 8487676 - DNA, 22 bp, Homo sapiens
cagctgtgctgtattaagctct

SEQ ID NO: 8487677 - DNA, 22 bp, Homo sapiens
cagctgtgctgattgctcagta

SEQ ID NO: 8487678 - DNA, 22 bp, Homo sapiens
cagctgtgctgattgctcagta

SEQ ID NO: 8487679 - DNA, 22 bp, Homo sapiens
cagctgtgctgattgctcagta

SEQ ID NO: 8487680 - DNA, 22 bp, Homo sapiens
cagctgtgatatgcctgcctga

SEQ ID NO: 8487681 - DNA, 18 bp, Homo sapiens
cagctgtgccctgtttgg

SEQ ID NO: 8487682 - DNA, 22 bp, Homo sapiens
cagctgtgtagatgcagggtca

SEQ ID NO: 8487683 - DNA, 22 bp, Homo sapiens
cagctgtgtatgagagcatgct

SEQ ID NO: 8487684 - DNA, 22 bp, Homo sapiens
cagctgtgggcctgacgtggca

SEQ ID NO: 8487685 - DNA, 22 bp, Homo sapiens
cagctgtggagggaggaaatgc

SEQ ID NO: 8487686 - DNA, 22 bp, Homo sapiens
cagctgtggctgccactgctcc

SEQ ID NO: 8487687 - DNA, 22 bp, Homo sapiens
gtgtgtggaaagttttccatgg

SEQ ID NO: 8487688 - DNA, 22 bp, Homo sapiens
gtgtgtggcaaactgggcctgc

SEQ ID NO: 8487689 - DNA, 22 bp, Homo sapiens
gtgtgtggaatgctcatttatt

SEQ ID NO: 8487690 - DNA, 22 bp, Homo sapiens
gtgtgtggacgtctgagcccag

SEQ ID NO: 8487691 - DNA, 23 bp, Homo sapiens
gtgtgtggaaagtgcatgggcct

SEQ ID NO: 8487692 - DNA, 22 bp, Homo sapiens
gtgtgtgtactctgtatataaa

SEQ ID NO: 8487693 - DNA, 22 bp, Homo sapiens
gtgtgtgtactctgtatataaa

SEQ ID NO: 8487694 - DNA, 22 bp, Homo sapiens
gtgtgtggcatgtcctattttg

SEQ ID NO: 8487695 - DNA, 22 bp, Homo sapiens
gtgtgtgtactctgtatataaa

SEQ ID NO: 8487696 - DNA, 22 bp, Homo sapiens
gtgtgtggggccttcgggtcct

SEQ ID NO: 8487697 - DNA, 22 bp, Homo sapiens
gtgtgtggggccttcgggtcct

SEQ ID NO: 8487698 - DNA, 22 bp, Homo sapiens
gtgtgtgcaagaggtttattga

SEQ ID NO: 8487699 - DNA, 22 bp, Homo sapiens
gtgtgtgccaactttatgtgca

SEQ ID NO: 8487700 - DNA, 22 bp, Homo sapiens
gtgtgtctttcatttcatgagg

SEQ ID NO: 8487701 - DNA, 22 bp, Homo sapiens
gtgtgtctttcatttcatgagg

SEQ ID NO: 8487702 - DNA, 22 bp, Homo sapiens
gtgtgtgcaagaggtttattga

SEQ ID NO: 8487703 - DNA, 22 bp, Homo sapiens
gtgtgtgctccccaggagagct

SEQ ID NO: 8487704 - DNA, 20 bp, Homo sapiens
gtgtgtgctccatgcatgct

SEQ ID NO: 8487705 - DNA, 22 bp, Homo sapiens
gtgtgtgccaactttatgtgca

SEQ ID NO: 8487706 - DNA, 22 bp, Homo sapiens
gtgtgtgccatcaagagctttc

SEQ ID NO: 8487707 - DNA, 20 bp, Homo sapiens
gtgtgtgctccatgcatgct

SEQ ID NO: 8487708 - DNA, 22 bp, Homo sapiens
gtgttttatggagtcataacgt

SEQ ID NO: 8487709 - DNA, 22 bp, Homo sapiens
gtgttttaagaaagaagctcag

SEQ ID NO: 8487710 - DNA, 22 bp, Homo sapiens
gtgtttggtcagacgtccgggg

SEQ ID NO: 8487711 - DNA, 22 bp, Homo sapiens
gtgtttggtcagacgtccgggg

SEQ ID NO: 8487712 - DNA, 22 bp, Homo sapiens
gtgtgtgtactctgtatataaa

SEQ ID NO: 8487713 - DNA, 22 bp, Homo sapiens
gtgtgtgtatatatacacacac

SEQ ID NO: 8487714 - DNA, 22 bp, Homo sapiens
gtgtgtgtatatatacacacac

SEQ ID NO: 8487715 - DNA, 22 bp, Homo sapiens
gtgtgtgtatatatacacacac

SEQ ID NO: 8487716 - DNA, 20 bp, Homo sapiens
gttaaaagagtaatttgagg

SEQ ID NO: 8487717 - DNA, 22 bp, Homo sapiens
gttaaacaagctggacactgaa

SEQ ID NO: 8487718 - DNA, 22 bp, Homo sapiens
gttaaacaataactggcacaca

SEQ ID NO: 8487719 - DNA, 22 bp, Homo sapiens
gttaaacaataactggcacaca

SEQ ID NO: 8487720 - DNA, 22 bp, Homo sapiens
gttaaactgaaaggctcgttca

SEQ ID NO: 8487721 - DNA, 22 bp, Homo sapiens
gttaaagagtttggctttcttc

SEQ ID NO: 8487722 - DNA, 22 bp, Homo sapiens
gttaaagtgatcttgtcaggtt

SEQ ID NO: 8487723 - DNA, 22 bp, Homo sapiens
gttaaagtgatcttgtcaggtt

SEQ ID NO: 8487724 - DNA, 22 bp, Homo sapiens
gttaaagtgagctactttaggt

SEQ ID NO: 8487725 - DNA, 22 bp, Homo sapiens
gttaaagtgagctactttaggt

SEQ ID NO: 8487726 - DNA, 22 bp, Homo sapiens
gttacaaatgccaaagctgaga

SEQ ID NO: 8487727 - DNA, 22 bp, Homo sapiens
gttacaaatgccaaagctgaga

SEQ ID NO: 8487728 - DNA, 22 bp, Homo sapiens
gttacaaatgtaaattctgggg

SEQ ID NO: 8487729 - DNA, 22 bp, Homo sapiens
gttacaaatgtaaattctgggg

SEQ ID NO: 8487730 - DNA, 22 bp, Homo sapiens
gttacaactccctgaacctcgg

SEQ ID NO: 8487731 - DNA, 22 bp, Homo sapiens
gttacaatgttcttcagttctg

SEQ ID NO: 8487732 - DNA, 22 bp, Homo sapiens
gttacacacaatatatcctaaa

SEQ ID NO: 8487733 - DNA, 22 bp, Homo sapiens
gttacaatgtccttacatgaaa

SEQ ID NO: 8487734 - DNA, 22 bp, Homo sapiens
gttacaatgttcttcagttctg

SEQ ID NO: 8487735 - DNA, 22 bp, Homo sapiens
gttacaatgtccttacatgaaa

SEQ ID NO: 8487736 - DNA, 22 bp, Homo sapiens
gttacagtgcatgtggcttctg

SEQ ID NO: 8487737 - DNA, 22 bp, Homo sapiens
gttacagtgagaagatagccta

SEQ ID NO: 8487738 - DNA, 22 bp, Homo sapiens
gttacagtgcttggcaataagt

SEQ ID NO: 8487739 - DNA, 22 bp, Homo sapiens
gttacagtcaggagatattttg

SEQ ID NO: 8487740 - DNA, 22 bp, Homo sapiens
gttacacaggaaaacattagca

SEQ ID NO: 8487741 - DNA, 22 bp, Homo sapiens
gttacacaggaaaacattagca

SEQ ID NO: 8487742 - DNA, 22 bp, Homo sapiens
gttacacagctaagcttctcct

SEQ ID NO: 8487743 - DNA, 22 bp, Homo sapiens
gtttacatgcatgcaagaatga

SEQ ID NO: 8487744 - DNA, 22 bp, Homo sapiens
gtttacatgcagaaaatcaatg

SEQ ID NO: 8487745 - DNA, 22 bp, Homo sapiens
gtttacatgcagaaaatcaatg

SEQ ID NO: 8487746 - DNA, 22 bp, Homo sapiens
gtttacatgcagaaaatcaatg

SEQ ID NO: 8487747 - DNA, 22 bp, Homo sapiens
gtttacagtggcttcattggat

SEQ ID NO: 8487748 - DNA, 22 bp, Homo sapiens
gtttacagtactcacttgcatt

SEQ ID NO: 8487749 - DNA, 18 bp, Homo sapiens
gtttacacattctagaaa

SEQ ID NO: 8487750 - DNA, 22 bp, Homo sapiens
gtttacagtactcacttgcatt

SEQ ID NO: 8487751 - DNA, 22 bp, Homo sapiens
gtttacagagacagaaagtagt

SEQ ID NO: 8487752 - DNA, 22 bp, Homo sapiens
gtttacactccaggctggggtg

SEQ ID NO: 8487753 - DNA, 22 bp, Homo sapiens
gtttacacataactcctatcaa

SEQ ID NO: 8487754 - DNA, 22 bp, Homo sapiens
caggaagattagaccaagagct

SEQ ID NO: 8487755 - DNA, 22 bp, Homo sapiens
caggaagattagaccaagagct

SEQ ID NO: 8487756 - DNA, 22 bp, Homo sapiens
caggaagattgtggaggtggtt

SEQ ID NO: 8487757 - DNA, 22 bp, Homo sapiens
caggaagcacagtgaggagacc

SEQ ID NO: 8487758 - DNA, 22 bp, Homo sapiens
caggaagcaagtgattttcttg

SEQ ID NO: 8487759 - DNA, 22 bp, Homo sapiens
caggaagaggtatcaccgagca

SEQ ID NO: 8487760 - DNA, 22 bp, Homo sapiens
caggaagaggtatcaccgagca

SEQ ID NO: 8487761 - DNA, 22 bp, Homo sapiens
caggaagaggtatcaccgagca

SEQ ID NO: 8487762 - DNA, 22 bp, Homo sapiens
caggaacatgttggaaagaaat

SEQ ID NO: 8487763 - DNA, 22 bp, Homo sapiens
caggaacatgttggaaagaaat

SEQ ID NO: 8487764 - DNA, 22 bp, Homo sapiens
caggaacatgtctccaattaga

SEQ ID NO: 8487765 - DNA, 22 bp, Homo sapiens
caggaacatttaaccacagggt

SEQ ID NO: 8487766 - DNA, 22 bp, Homo sapiens
caggaagagaacatggaggctg

SEQ ID NO: 8487767 - DNA, 22 bp, Homo sapiens
caggaacattgtagaattgaaa

SEQ ID NO: 8487768 - DNA, 21 bp, Homo sapiens
caggaacattctttacattta

SEQ ID NO: 8487769 - DNA, 22 bp, Homo sapiens
caggaacagcaccaggagctag

SEQ ID NO: 8487770 - DNA, 22 bp, Homo sapiens
caggaacagctgacctgacaat

SEQ ID NO: 8487771 - DNA, 22 bp, Homo sapiens
caggaacagcaccaggagctag

SEQ ID NO: 8487772 - DNA, 22 bp, Homo sapiens
caggaacagcaccaggagctag

SEQ ID NO: 8487773 - DNA, 22 bp, Homo sapiens
caggaacaggggagtgaacctg

SEQ ID NO: 8487774 - DNA, 22 bp, Homo sapiens
caggaacaggctgatgggcagg

SEQ ID NO: 8487775 - DNA, 19 bp, Homo sapiens
caggaacatggagggaggg

SEQ ID NO: 8487776 - DNA, 22 bp, Homo sapiens
caggaacagggtgtcctggcag

SEQ ID NO: 8487777 - DNA, 22 bp, Homo sapiens
caggaacacaagttcagggatg

SEQ ID NO: 8487778 - DNA, 22 bp, Homo sapiens
caggaacacaatgagtctcaaa

SEQ ID NO: 8487779 - DNA, 22 bp, Homo sapiens
caggaacacctgcagctagtgg

SEQ ID NO: 8487780 - DNA, 22 bp, Homo sapiens
caggaacacctgcagctagtgg

SEQ ID NO: 8487781 - DNA, 22 bp, Homo sapiens
caggaacagagtggcattgtct

SEQ ID NO: 8487782 - DNA, 22 bp, Homo sapiens
caggaacaatgtaagtctcatt

SEQ ID NO: 8487783 - DNA, 22 bp, Homo sapiens
caggaacacaatgagtctcaaa

SEQ ID NO: 8487784 - DNA, 22 bp, Homo sapiens
caggaacacaagttcagggatg

SEQ ID NO: 8487785 - DNA, 22 bp, Homo sapiens
caggaacacaagttcagggatg

SEQ ID NO: 8487786 - DNA, 18 bp, Homo sapiens
gtttcctgtcttacgggg

SEQ ID NO: 8487787 - DNA, 22 bp, Homo sapiens
gtttcctggaaactgctccact

SEQ ID NO: 8487788 - DNA, 22 bp, Homo sapiens
gtttcctgtttctcagcagccc

SEQ ID NO: 8487789 - DNA, 22 bp, Homo sapiens
gtttcctgtggccacagaataa

SEQ ID NO: 8487790 - DNA, 22 bp, Homo sapiens
gtttcctgtgggaactcggctg

SEQ ID NO: 8487791 - DNA, 22 bp, Homo sapiens
gtttgcctgccgacgctctcat

SEQ ID NO: 8487792 - DNA, 22 bp, Homo sapiens
gtttgcatttattagtcttctg

SEQ ID NO: 8487793 - DNA, 22 bp, Homo sapiens
gtttgcatttattagtcttctg

SEQ ID NO: 8487794 - DNA, 22 bp, Homo sapiens
gtttcctgaccctggcccagca

SEQ ID NO: 8487795 - DNA, 22 bp, Homo sapiens
gtttcctctgctggttttcatt

SEQ ID NO: 8487796 - DNA, 20 bp, Homo sapiens
gtttcctatttacctcctca

SEQ ID NO: 8487797 - DNA, 22 bp, Homo sapiens
gtttcctatgtccattgaggga

SEQ ID NO: 8487798 - DNA, 22 bp, Homo sapiens
gtttcctataactcaggcacca

SEQ ID NO: 8487799 - DNA, 22 bp, Homo sapiens
gtttcctatggctgctgcagga

SEQ ID NO: 8487800 - DNA, 18 bp, Homo sapiens
gtttcctgaggtgaaggg

SEQ ID NO: 8487801 - DNA, 22 bp, Homo sapiens
gtttcctgatgtgggagatctt

SEQ ID NO: 8487802 - DNA, 22 bp, Homo sapiens
gtttcctgcgtgtgccactcat

SEQ ID NO: 8487803 - DNA, 22 bp, Homo sapiens
gtttcctggaaacattaggaga

SEQ ID NO: 8487804 - DNA, 22 bp, Homo sapiens
gtttattcttcagcaacatctg

SEQ ID NO: 8487805 - DNA, 22 bp, Homo sapiens
gtttattcttcagcaacatctg

SEQ ID NO: 8487806 - DNA, 22 bp, Homo sapiens
gtttattgataaaagctggaca

SEQ ID NO: 8487807 - DNA, 22 bp, Homo sapiens
gtttattgataaaagctggaca

SEQ ID NO: 8487808 - DNA, 22 bp, Homo sapiens
gtttcaaaagtcaggctattct

SEQ ID NO: 8487809 - DNA, 22 bp, Homo sapiens
gtttcaaaatgatgctgtaact

SEQ ID NO: 8487810 - DNA, 22 bp, Homo sapiens
gtttattgggtattgtggagcc

SEQ ID NO: 8487811 - DNA, 22 bp, Homo sapiens
gtttattgggtattgtggagcc

SEQ ID NO: 8487812 - DNA, 22 bp, Homo sapiens
gtttacattaagtattagcatc

SEQ ID NO: 8487813 - DNA, 22 bp, Homo sapiens
gtttacattaagtattagcatc

SEQ ID NO: 8487814 - DNA, 18 bp, Homo sapiens
gtttacattactgaatag

SEQ ID NO: 8487815 - DNA, 18 bp, Homo sapiens
gtttacattactgaatag

SEQ ID NO: 8487816 - DNA, 22 bp, Homo sapiens
gtttattatacaacaaaagcta

SEQ ID NO: 8487817 - DNA, 22 bp, Homo sapiens
gtttattattcaacttcatgtt

SEQ ID NO: 8487818 - DNA, 22 bp, Homo sapiens
gtttattccagcaatctgctta

SEQ ID NO: 8487819 - DNA, 22 bp, Homo sapiens
gttccccttgtgttgttgccca

SEQ ID NO: 8487820 - DNA, 22 bp, Homo sapiens
gttcacagttcagcctgtaaca

SEQ ID NO: 8487821 - DNA, 22 bp, Homo sapiens
gttcacagttcagcctgtaaca

SEQ ID NO: 8487822 - DNA, 22 bp, Homo sapiens
gttcacagtttctaatcccagc

SEQ ID NO: 8487823 - DNA, 22 bp, Homo sapiens
gttcacagttttatacctgaga

SEQ ID NO: 8487824 - DNA, 22 bp, Homo sapiens
gttcacagttaggacaactgct

SEQ ID NO: 8487825 - DNA, 22 bp, Homo sapiens
gttcacagtgttttctttgcat

SEQ ID NO: 8487826 - DNA, 22 bp, Homo sapiens
gttcacagtgttttctttgcat

SEQ ID NO: 8487827 - DNA, 22 bp, Homo sapiens
gttcacaggttctctttctaag

SEQ ID NO: 8487828 - DNA, 22 bp, Homo sapiens
gttcacagtctacatagtaaag

SEQ ID NO: 8487829 - DNA, 22 bp, Homo sapiens
gttcacaggttctctttctaag

SEQ ID NO: 8487830 - DNA, 22 bp, Homo sapiens
gttcacaggttctctttctaag

SEQ ID NO: 8487831 - DNA, 22 bp, Homo sapiens
gttcacagcttgtgttttctct

SEQ ID NO: 8487832 - DNA, 22 bp, Homo sapiens
gttcacagcttcttaggtcata

SEQ ID NO: 8487833 - DNA, 20 bp, Homo sapiens
gttcacaggcttcctttcag

SEQ ID NO: 8487834 - DNA, 20 bp, Homo sapiens
gttcacaggcttcctttcag

SEQ ID NO: 8487835 - DNA, 20 bp, Homo sapiens
gttcacaggcttcctttcag

SEQ ID NO: 8487836 - DNA, 22 bp, Homo sapiens
gttcacagggttaggaatcact

SEQ ID NO: 8487837 - DNA, 22 bp, Homo sapiens
gttcacagggatccttgttgaa

SEQ ID NO: 8487838 - DNA, 22 bp, Homo sapiens
gttcacagcttcttaggtcata

SEQ ID NO: 8487839 - DNA, 22 bp, Homo sapiens
gttcctaaatctggaggacctc

SEQ ID NO: 8487840 - DNA, 22 bp, Homo sapiens
gttcctaaatttgaaggacttt

SEQ ID NO: 8487841 - DNA, 22 bp, Homo sapiens
gttcctaaccagcagagaaaca

SEQ ID NO: 8487842 - DNA, 22 bp, Homo sapiens
gttccgcttcatatttggagtc

SEQ ID NO: 8487843 - DNA, 22 bp, Homo sapiens
gttcctaagcactgtgcattct

SEQ ID NO: 8487844 - DNA, 22 bp, Homo sapiens
gttcctaagctgtggccctgga

SEQ ID NO: 8487845 - DNA, 22 bp, Homo sapiens
gttcctcacgtggacagatgat

SEQ ID NO: 8487846 - DNA, 22 bp, Homo sapiens
gttcctcaaaaaggagagcccc

SEQ ID NO: 8487847 - DNA, 22 bp, Homo sapiens
gttcctcatgagtaccccttaa

SEQ ID NO: 8487848 - DNA, 22 bp, Homo sapiens
gttcctcatccagtcatgacta

SEQ ID NO: 8487849 - DNA, 22 bp, Homo sapiens
gttcctcagttgtaaaaaatgt

SEQ ID NO: 8487850 - DNA, 22 bp, Homo sapiens
gttcctcagcccttacttagcc

SEQ ID NO: 8487851 - DNA, 22 bp, Homo sapiens
gttcctgagaaataaagagaga

SEQ ID NO: 8487852 - DNA, 22 bp, Homo sapiens
gttctgggaaggtggacctgtt

SEQ ID NO: 8487853 - DNA, 22 bp, Homo sapiens
gttgctgcaaaggagtgtaggt

SEQ ID NO: 8487854 - DNA, 22 bp, Homo sapiens
gttgcttttctccatcacatgg

SEQ ID NO: 8487855 - DNA, 22 bp, Homo sapiens
gttgcttgttagtggtgaggtt

SEQ ID NO: 8487856 - DNA, 22 bp, Homo sapiens
gttcttcagaggggaaagaacc

SEQ ID NO: 8487857 - DNA, 22 bp, Homo sapiens
gttctgtcacacactggtactt

SEQ ID NO: 8487858 - DNA, 22 bp, Homo sapiens
gttctgtctgagcaccacagga

SEQ ID NO: 8487859 - DNA, 22 bp, Homo sapiens
gttctgtcctcactgcaggcct

SEQ ID NO: 8487860 - DNA, 22 bp, Homo sapiens
gttctgggtctggacacacaga

SEQ ID NO: 8487861 - DNA, 22 bp, Homo sapiens
gttctgtctgagcaccacagga

SEQ ID NO: 8487862 - DNA, 22 bp, Homo sapiens
gttctgtcctcctaccaggcat

SEQ ID NO: 8487863 - DNA, 22 bp, Homo sapiens
gttcttaagaccacaataaaaa

SEQ ID NO: 8487864 - DNA, 22 bp, Homo sapiens
caggaaagccgagtgccatagg

SEQ ID NO: 8487865 - DNA, 22 bp, Homo sapiens
caggaaagggatgggctgccac

SEQ ID NO: 8487866 - DNA, 22 bp, Homo sapiens
caggaaaggtgtgtcatgatgg

SEQ ID NO: 8487867 - DNA, 22 bp, Homo sapiens
caggaaaggtgtgtcatgatgg

SEQ ID NO: 8487868 - DNA, 22 bp, Homo sapiens
caggaaaggtagtcacaatgta

SEQ ID NO: 8487869 - DNA, 22 bp, Homo sapiens
gttgggaaggcaagaagtagaa

SEQ ID NO: 8487870 - DNA, 22 bp, Homo sapiens
gttgggaagcagatggatgagc

SEQ ID NO: 8487871 - DNA, 22 bp, Homo sapiens
gttggctcattttatagacagc

SEQ ID NO: 8487872 - DNA, 18 bp, Homo sapiens
gttggctgctgtggctgg

SEQ ID NO: 8487873 - DNA, 22 bp, Homo sapiens
gttggctatgagagctttagtg

SEQ ID NO: 8487874 - DNA, 22 bp, Homo sapiens
gttggctatgagagctttagtg

SEQ ID NO: 8487875 - DNA, 22 bp, Homo sapiens
gttggcacttcataatatgaaa

SEQ ID NO: 8487876 - DNA, 22 bp, Homo sapiens
gttggaatttgctcatccattt

SEQ ID NO: 8487877 - DNA, 22 bp, Homo sapiens
caggaaattggctatttgggat

SEQ ID NO: 8487878 - DNA, 22 bp, Homo sapiens
caggaaattgcaacagtctgag

SEQ ID NO: 8487879 - DNA, 22 bp, Homo sapiens
caggaaattctttttaacagaa

SEQ ID NO: 8487880 - DNA, 22 bp, Homo sapiens
caggaaattcttttgtttgtgc

SEQ ID NO: 8487881 - DNA, 22 bp, Homo sapiens
caggaaatttaagagtgtacaa

SEQ ID NO: 8487882 - DNA, 22 bp, Homo sapiens
caggaaatttatgttctactta

SEQ ID NO: 8487883 - DNA, 22 bp, Homo sapiens
caggaaattttgtgatctgttc

SEQ ID NO: 8487884 - DNA, 22 bp, Homo sapiens
caggaacaactcccagcatctc

SEQ ID NO: 8487885 - DNA, 22 bp, Homo sapiens
caggaacaactcccagcatctc

SEQ ID NO: 8487886 - DNA, 22 bp, Homo sapiens
caggaacaaggcctatgggact

SEQ ID NO: 8487887 - DNA, 22 bp, Homo sapiens
caggaacaactcccagcatctc

SEQ ID NO: 8487888 - DNA, 22 bp, Homo sapiens
caggaacaatatctgtcctggt

SEQ ID NO: 8487889 - DNA, 22 bp, Homo sapiens
caggaacaatcttactactatt

SEQ ID NO: 8487890 - DNA, 22 bp, Homo sapiens
caggaacaatgtaagtctcatt

SEQ ID NO: 8487891 - DNA, 22 bp, Homo sapiens
caggaaataggcgtttgtcctc

SEQ ID NO: 8487892 - DNA, 22 bp, Homo sapiens
caggaaataaatggtaatgcat

SEQ ID NO: 8487893 - DNA, 22 bp, Homo sapiens
caggaaataaaaagtatcttct

SEQ ID NO: 8487894 - DNA, 22 bp, Homo sapiens
caggaaattcccagaaggactg

SEQ ID NO: 8487895 - DNA, 23 bp, Homo sapiens
caggaaatgttcttgaagcctga

SEQ ID NO: 8487896 - DNA, 22 bp, Homo sapiens
caggaaattcaagagaggctgc

SEQ ID NO: 8487897 - DNA, 22 bp, Homo sapiens
caggaaatgggtcgttttataa

SEQ ID NO: 8487898 - DNA, 22 bp, Homo sapiens
caggaaatgggtcgttttataa

SEQ ID NO: 8487899 - DNA, 22 bp, Homo sapiens
taatttaattccatggattcta

SEQ ID NO: 8487900 - DNA, 22 bp, Homo sapiens
taatttaattccatggattcta

SEQ ID NO: 8487901 - DNA, 22 bp, Homo sapiens
taatttaatccaagtgttacat

SEQ ID NO: 8487902 - DNA, 22 bp, Homo sapiens
taatttaatccaagtgttacat

SEQ ID NO: 8487903 - DNA, 22 bp, Homo sapiens
taattgtcttaggtgtgatgat

SEQ ID NO: 8487904 - DNA, 22 bp, Homo sapiens
taattgtcttagtctgtgcagg

SEQ ID NO: 8487905 - DNA, 22 bp, Homo sapiens
taattgtccctgcagttaggat

SEQ ID NO: 8487906 - DNA, 22 bp, Homo sapiens
taattgtcatcgtagtaaacat

SEQ ID NO: 8487907 - DNA, 22 bp, Homo sapiens
taattgtcaggttttagtatca

SEQ ID NO: 8487908 - DNA, 22 bp, Homo sapiens
taatttaatttcatgccagcct

SEQ ID NO: 8487909 - DNA, 22 bp, Homo sapiens
taatttaatttcatgccagcct

SEQ ID NO: 8487910 - DNA, 22 bp, Homo sapiens
taatttacagagatacagtcag

SEQ ID NO: 8487911 - DNA, 22 bp, Homo sapiens
caggcagagcaactggtccaga

SEQ ID NO: 8487912 - DNA, 22 bp, Homo sapiens
caggcagagcaactggtccaga

SEQ ID NO: 8487913 - DNA, 22 bp, Homo sapiens
caggcagagcaactggtccaga

SEQ ID NO: 8487914 - DNA, 22 bp, Homo sapiens
taattggatgttctctggaagc

SEQ ID NO: 8487915 - DNA, 22 bp, Homo sapiens
taattgtaaagtagtagtacag

SEQ ID NO: 8487916 - DNA, 22 bp, Homo sapiens
taattgtatggagaaggctgca

SEQ ID NO: 8487917 - DNA, 22 bp, Homo sapiens
taattgtactccctgtgggaaa

SEQ ID NO: 8487918 - DNA, 22 bp, Homo sapiens
caggcagaaggaagtaccaggc

SEQ ID NO: 8487919 - DNA, 22 bp, Homo sapiens
caggcagaaggaagtaccaggc

SEQ ID NO: 8487920 - DNA, 22 bp, Homo sapiens
caggcagaaattttgtttcatt

SEQ ID NO: 8487921 - DNA, 22 bp, Homo sapiens
caggcagaagaagtggaaggac

SEQ ID NO: 8487922 - DNA, 22 bp, Homo sapiens
caggcagaagaagtggaaggac

SEQ ID NO: 8487923 - DNA, 22 bp, Homo sapiens
caggcagaagaagtggaaggac

SEQ ID NO: 8487924 - DNA, 22 bp, Homo sapiens
caggcagaaggaagtaccaggc

SEQ ID NO: 8487925 - DNA, 22 bp, Homo sapiens
caggcagaagaagtggaaggac

SEQ ID NO: 8487926 - DNA, 22 bp, Homo sapiens
caggcagactttgagaatgatg

SEQ ID NO: 8487927 - DNA, 17 bp, Homo sapiens
caggcagacatgtaagc

SEQ ID NO: 8487928 - DNA, 22 bp, Homo sapiens
caggcagagaccctctcctaaa

SEQ ID NO: 8487929 - DNA, 22 bp, Homo sapiens
caggcagagaggagcatttaat

SEQ ID NO: 8487930 - DNA, 22 bp, Homo sapiens
caggcagcaggagccctgctcg

SEQ ID NO: 8487931 - DNA, 22 bp, Homo sapiens
caggcagcaggagccctgctcg

SEQ ID NO: 8487932 - DNA, 22 bp, Homo sapiens
caggcagcaggagccctgctcg

SEQ ID NO: 8487933 - DNA, 22 bp, Homo sapiens
caggcagcagccactctggtat

SEQ ID NO: 8487934 - DNA, 22 bp, Homo sapiens
caggcagcagccactctggtat

SEQ ID NO: 8487935 - DNA, 22 bp, Homo sapiens
caggcagcagccactctggtat

SEQ ID NO: 8487936 - DNA, 22 bp, Homo sapiens
caggcagcatcagtctgctgta

SEQ ID NO: 8487937 - DNA, 22 bp, Homo sapiens
caggcagcatcagtctgctgta

SEQ ID NO: 8487938 - DNA, 22 bp, Homo sapiens
caggcagcatttactctgatga

SEQ ID NO: 8487939 - DNA, 22 bp, Homo sapiens
caggcagcatttactctgatga

SEQ ID NO: 8487940 - DNA, 22 bp, Homo sapiens
caggcagctgactgtcagatat

SEQ ID NO: 8487941 - DNA, 22 bp, Homo sapiens
caggcagctgactgtcagatat

SEQ ID NO: 8487942 - DNA, 22 bp, Homo sapiens
caggcagctgactgtcagatat

SEQ ID NO: 8487943 - DNA, 22 bp, Homo sapiens
caggcagccctgcaccaagtgt

SEQ ID NO: 8487944 - DNA, 22 bp, Homo sapiens
caggcagccaggggacctgtcc

SEQ ID NO: 8487945 - DNA, 22 bp, Homo sapiens
caggcagccaggggacctgtcc

SEQ ID NO: 8487946 - DNA, 22 bp, Homo sapiens
caggcagcctgagggatctggg

SEQ ID NO: 8487947 - DNA, 22 bp, Homo sapiens
caggcagcctgagggatctggg

SEQ ID NO: 8487948 - DNA, 22 bp, Homo sapiens
caggcagctcgatgccttgttg

SEQ ID NO: 8487949 - DNA, 22 bp, Homo sapiens
caggcaggagccagggattcca

SEQ ID NO: 8487950 - DNA, 22 bp, Homo sapiens
caggcaggagccagggattcca

SEQ ID NO: 8487951 - DNA, 22 bp, Homo sapiens
caggcaggagaggaggatttct

SEQ ID NO: 8487952 - DNA, 23 bp, Homo sapiens
caggcaggatgaggactacactc

SEQ ID NO: 8487953 - DNA, 23 bp, Homo sapiens
caggcaggatgaggactacactc

SEQ ID NO: 8487954 - DNA, 22 bp, Homo sapiens
caggcagggagccactgtataa

SEQ ID NO: 8487955 - DNA, 22 bp, Homo sapiens
caggcagctgggtcaccgtccc

SEQ ID NO: 8487956 - DNA, 22 bp, Homo sapiens
caggcagctgctgggttcagcc

SEQ ID NO: 8487957 - DNA, 22 bp, Homo sapiens
caggcagctgctgggttcagcc

SEQ ID NO: 8487958 - DNA, 22 bp, Homo sapiens
caggcagctgctgggttcagcc

SEQ ID NO: 8487959 - DNA, 22 bp, Homo sapiens
caggcagctgctgggttcagcc

SEQ ID NO: 8487960 - DNA, 22 bp, Homo sapiens
caggcagctgcgacaagagagc

SEQ ID NO: 8487961 - DNA, 22 bp, Homo sapiens
caggcagctgcgacaagagagc

SEQ ID NO: 8487962 - DNA, 22 bp, Homo sapiens
caggcagctgaggactttgcta

SEQ ID NO: 8487963 - DNA, 22 bp, Homo sapiens
caggcagctgaggactttgcta

SEQ ID NO: 8487964 - DNA, 22 bp, Homo sapiens
tacagggtattcaagggtagtt

SEQ ID NO: 8487965 - DNA, 22 bp, Homo sapiens
tacagggtataggtacagatga

SEQ ID NO: 8487966 - DNA, 22 bp, Homo sapiens
tacaggggtaacagtggggaat

SEQ ID NO: 8487967 - DNA, 22 bp, Homo sapiens
tacaggtagagtctctagttta

SEQ ID NO: 8487968 - DNA, 22 bp, Homo sapiens
tacaggtagagtctctagttta

SEQ ID NO: 8487969 - DNA, 22 bp, Homo sapiens
tacaggtagcaaaacctttcct

SEQ ID NO: 8487970 - DNA, 22 bp, Homo sapiens
tacaggtagggtctatgttaga

SEQ ID NO: 8487971 - DNA, 22 bp, Homo sapiens
tacaggtaaaattatcagaaac

SEQ ID NO: 8487972 - DNA, 22 bp, Homo sapiens
tacagctgttggtgtttcctct

SEQ ID NO: 8487973 - DNA, 22 bp, Homo sapiens
tacaatagggcttttgtttatg

SEQ ID NO: 8487974 - DNA, 22 bp, Homo sapiens
tacagcttaaaaaagccaactt

SEQ ID NO: 8487975 - DNA, 22 bp, Homo sapiens
tacagcttaaaaaagccaactt

SEQ ID NO: 8487976 - DNA, 20 bp, Homo sapiens
tacaatacacatgcatatga

SEQ ID NO: 8487977 - DNA, 20 bp, Homo sapiens
tacaagtacattatagttat

SEQ ID NO: 8487978 - DNA, 22 bp, Homo sapiens
tacaagtaaattgtagatacca

SEQ ID NO: 8487979 - DNA, 22 bp, Homo sapiens
tacaagtagctcaggttttctg

SEQ ID NO: 8487980 - DNA, 19 bp, Homo sapiens
tacaagtaggcgttttctc

SEQ ID NO: 8487981 - DNA, 22 bp, Homo sapiens
tacaagtactgtggctttgaat

SEQ ID NO: 8487982 - DNA, 22 bp, Homo sapiens
tacaagtatgttttaaaatgtt

SEQ ID NO: 8487983 - DNA, 22 bp, Homo sapiens
tacaagtatgttttaaaatgtt

SEQ ID NO: 8487984 - DNA, 22 bp, Homo sapiens
tacaagtatggaatgattctca

SEQ ID NO: 8487985 - DNA, 22 bp, Homo sapiens
tacaagtatattctagtgatat

SEQ ID NO: 8487986 - DNA, 22 bp, Homo sapiens
tacaagtcattggatgaggaat

SEQ ID NO: 8487987 - DNA, 22 bp, Homo sapiens
tacaagtcacttcctttctaaa

SEQ ID NO: 8487988 - DNA, 22 bp, Homo sapiens
tacaaatgggttaaaatatagt

SEQ ID NO: 8487989 - DNA, 22 bp, Homo sapiens
tacaaatgggttaaaatatagt

SEQ ID NO: 8487990 - DNA, 22 bp, Homo sapiens
tacaaatgggttaaaatatagt

SEQ ID NO: 8487991 - DNA, 22 bp, Homo sapiens
tacaaatgcctgacacacagat

SEQ ID NO: 8487992 - DNA, 22 bp, Homo sapiens
tacaaatgtattttattttggt

SEQ ID NO: 8487993 - DNA, 22 bp, Homo sapiens
tacaaatgtattttattttggt

SEQ ID NO: 8487994 - DNA, 22 bp, Homo sapiens
tacaaatgaaccaactttgatg

SEQ ID NO: 8487995 - DNA, 22 bp, Homo sapiens
tacaaatgaaccaactttgatg

SEQ ID NO: 8487996 - DNA, 22 bp, Homo sapiens
tacaaatgaaccaactttgatg

SEQ ID NO: 8487997 - DNA, 22 bp, Homo sapiens
tacaaatgagttgtatgaacca

SEQ ID NO: 8487998 - DNA, 22 bp, Homo sapiens
tacaaatgaaccaactttgatg

SEQ ID NO: 8487999 - DNA, 22 bp, Homo sapiens
tacaaatgaccatagccactta

SEQ ID NO: 8488000 - DNA, 22 bp, Homo sapiens
tacaaatgaccatagccactta

SEQ ID NO: 8488001 - DNA, 22 bp, Homo sapiens
tacaaatgaccatagccactta

SEQ ID NO: 8488002 - DNA, 22 bp, Homo sapiens
tacaaatgagttgtatgaacca

SEQ ID NO: 8488003 - DNA, 22 bp, Homo sapiens
tacaaatgagttgtatgaacca

SEQ ID NO: 8488004 - DNA, 22 bp, Homo sapiens
tacaaatgcctgacacacagat

SEQ ID NO: 8488005 - DNA, 22 bp, Homo sapiens
tacaaatgcctgacacacagat

SEQ ID NO: 8488006 - DNA, 22 bp, Homo sapiens
tacaaatgcctgacacacagat

SEQ ID NO: 8488007 - DNA, 22 bp, Homo sapiens
tacatcaaatcaatgttccagt

SEQ ID NO: 8488008 - DNA, 22 bp, Homo sapiens
tacatcaaggaacacctggtat

SEQ ID NO: 8488009 - DNA, 22 bp, Homo sapiens
tacatcatgaaagcatacatca

SEQ ID NO: 8488010 - DNA, 22 bp, Homo sapiens
tacatcataataatacttagaa

SEQ ID NO: 8488011 - DNA, 21 bp, Homo sapiens
tacatcagttttcttggctca

SEQ ID NO: 8488012 - DNA, 22 bp, Homo sapiens
tacatcatgaaagcatacatca

SEQ ID NO: 8488013 - DNA, 22 bp, Homo sapiens
tacatgtggagataactgaagc

SEQ ID NO: 8488014 - DNA, 22 bp, Homo sapiens
tacatcatgaaagcatacatca

SEQ ID NO: 8488015 - DNA, 22 bp, Homo sapiens
tacatcatggcttcatgctgca

SEQ ID NO: 8488016 - DNA, 22 bp, Homo sapiens
tacatattgtccatagttgctt

SEQ ID NO: 8488017 - DNA, 22 bp, Homo sapiens
tacatattcaacgttcagtatt

SEQ ID NO: 8488018 - DNA, 20 bp, Homo sapiens
tacatattatatcagctgca

SEQ ID NO: 8488019 - DNA, 22 bp, Homo sapiens
tacatatttgtctttgtactgt

SEQ ID NO: 8488020 - DNA, 22 bp, Homo sapiens
tacatatttgtctttgtactgt

SEQ ID NO: 8488021 - DNA, 22 bp, Homo sapiens
tacatatgtaaacatgtataaa

SEQ ID NO: 8488022 - DNA, 22 bp, Homo sapiens
tacatatccaggctgagaagat

SEQ ID NO: 8488023 - DNA, 22 bp, Homo sapiens
tacatatccaggctgagaagat

SEQ ID NO: 8488024 - DNA, 22 bp, Homo sapiens
caggccggccggccccagctct

SEQ ID NO: 8488025 - DNA, 22 bp, Homo sapiens
caggccctgggcaggcacagag

SEQ ID NO: 8488026 - DNA, 18 bp, Homo sapiens
caggccctgtctggcctc

SEQ ID NO: 8488027 - DNA, 22 bp, Homo sapiens
caggccctggcagggctgagtc

SEQ ID NO: 8488028 - DNA, 22 bp, Homo sapiens
caggccctggcagggctgagtc

SEQ ID NO: 8488029 - DNA, 22 bp, Homo sapiens
caggccctgggcaggatcagcc

SEQ ID NO: 8488030 - DNA, 22 bp, Homo sapiens
caggccctgggcaggatcagcc

SEQ ID NO: 8488031 - DNA, 22 bp, Homo sapiens
tacagtaaatgtggtagaaact

SEQ ID NO: 8488032 - DNA, 22 bp, Homo sapiens
tacagtaaatgtggtagaaact

SEQ ID NO: 8488033 - DNA, 22 bp, Homo sapiens
tacagtaaagctgctatgaatt

SEQ ID NO: 8488034 - DNA, 22 bp, Homo sapiens
tacagtaaagctgctatgaatt

SEQ ID NO: 8488035 - DNA, 22 bp, Homo sapiens
tacagtaaagctgctatgaatt

SEQ ID NO: 8488036 - DNA, 22 bp, Homo sapiens
tacaggttacacttttaaaagt

SEQ ID NO: 8488037 - DNA, 22 bp, Homo sapiens
tacagtaacatgttgtacaagc

SEQ ID NO: 8488038 - DNA, 22 bp, Homo sapiens
tacagtaacatgttgtacaagc

SEQ ID NO: 8488039 - DNA, 22 bp, Homo sapiens
tacagtaacatgttgtacaagc

SEQ ID NO: 8488040 - DNA, 22 bp, Homo sapiens
tacagtaacatgttgtacaagc

SEQ ID NO: 8488041 - DNA, 19 bp, Homo sapiens
caggccctggacccatctg

SEQ ID NO: 8488042 - DNA, 22 bp, Homo sapiens
tacagtaaccagtctacttaga

SEQ ID NO: 8488043 - DNA, 22 bp, Homo sapiens
tacagtaaccttatttgtcatt

SEQ ID NO: 8488044 - DNA, 22 bp, Homo sapiens
caggatgcagtgggacccaggg

SEQ ID NO: 8488045 - DNA, 22 bp, Homo sapiens
caggatgcactaggaaccaggg

SEQ ID NO: 8488046 - DNA, 20 bp, Homo sapiens
caggatgattggacacgatg

SEQ ID NO: 8488047 - DNA, 22 bp, Homo sapiens
caggatggagagtgaggggtca

SEQ ID NO: 8488048 - DNA, 22 bp, Homo sapiens
caggatgcttctggggccaggc

SEQ ID NO: 8488049 - DNA, 22 bp, Homo sapiens
caggatggagagtgaggggtca

SEQ ID NO: 8488050 - DNA, 22 bp, Homo sapiens
caggatggagagtgaggggtca

SEQ ID NO: 8488051 - DNA, 22 bp, Homo sapiens
caggatggtggcatgatcagaa

SEQ ID NO: 8488052 - DNA, 22 bp, Homo sapiens
caggatggtcttcatttggctc

SEQ ID NO: 8488053 - DNA, 22 bp, Homo sapiens
caggatggtcttcatttggctc

SEQ ID NO: 8488054 - DNA, 22 bp, Homo sapiens
caggatgaggtagaggcagata

SEQ ID NO: 8488055 - DNA, 18 bp, Homo sapiens
caggatgagtgatgggga

SEQ ID NO: 8488056 - DNA, 18 bp, Homo sapiens
caggatgagtgatgggga

SEQ ID NO: 8488057 - DNA, 19 bp, Homo sapiens
caggatgatcccatgacac

SEQ ID NO: 8488058 - DNA, 22 bp, Homo sapiens
caggatgagaggcccagggaag

SEQ ID NO: 8488059 - DNA, 22 bp, Homo sapiens
caggatctgccaatattcaacc

SEQ ID NO: 8488060 - DNA, 22 bp, Homo sapiens
taagaaacatttttatgacagt

SEQ ID NO: 8488061 - DNA, 22 bp, Homo sapiens
caggatattagttttcttgtta

SEQ ID NO: 8488062 - DNA, 22 bp, Homo sapiens
caggatatttacgttctgctac

SEQ ID NO: 8488063 - DNA, 22 bp, Homo sapiens
caggatattacctaatatttga

SEQ ID NO: 8488064 - DNA, 22 bp, Homo sapiens
caggatatatctctagtgttgg

SEQ ID NO: 8488065 - DNA, 22 bp, Homo sapiens
taactttagtgtatgaggtaag

SEQ ID NO: 8488066 - DNA, 22 bp, Homo sapiens
taactttcacatcacactgact

SEQ ID NO: 8488067 - DNA, 22 bp, Homo sapiens
taactttatgacatgtcttgct

SEQ ID NO: 8488068 - DNA, 20 bp, Homo sapiens
taactttctatgctttcagc

SEQ ID NO: 8488069 - DNA, 22 bp, Homo sapiens
taactttgagaactttctggtg

SEQ ID NO: 8488070 - DNA, 22 bp, Homo sapiens
taactttgaagggaattttact

SEQ ID NO: 8488071 - DNA, 22 bp, Homo sapiens
taactttggggacacttctctt

SEQ ID NO: 8488072 - DNA, 22 bp, Homo sapiens
taacttttacatttggctcact

SEQ ID NO: 8488073 - DNA, 22 bp, Homo sapiens
taacttttgtgatctgtcgatt

SEQ ID NO: 8488074 - DNA, 21 bp, Homo sapiens
taacttttgtgcctatcttgt

SEQ ID NO: 8488075 - DNA, 22 bp, Homo sapiens
taacttttacttaccatctgag

SEQ ID NO: 8488076 - DNA, 22 bp, Homo sapiens
taacttttctaggtgtgataat

SEQ ID NO: 8488077 - DNA, 22 bp, Homo sapiens
taagaaacatgattaatggcag

SEQ ID NO: 8488078 - DNA, 15 bp, Homo sapiens
taacttttttgggct

SEQ ID NO: 8488079 - DNA, 22 bp, Homo sapiens
taagaaacatgatacttttcct

SEQ ID NO: 8488080 - DNA, 22 bp, Homo sapiens
taacttctttggtttaaagaga

SEQ ID NO: 8488081 - DNA, 22 bp, Homo sapiens
taacttgaacatggagagtaag

SEQ ID NO: 8488082 - DNA, 22 bp, Homo sapiens
taacttgacctgtataaaacac

SEQ ID NO: 8488083 - DNA, 19 bp, Homo sapiens
taacttgtagatatgaagt

SEQ ID NO: 8488084 - DNA, 19 bp, Homo sapiens
taacttgtagatatgaagt

SEQ ID NO: 8488085 - DNA, 22 bp, Homo sapiens
taacttgtgttacattactctt

SEQ ID NO: 8488086 - DNA, 19 bp, Homo sapiens
taacttgtagatatgaagt

SEQ ID NO: 8488087 - DNA, 22 bp, Homo sapiens
taacttgtgttacattactctt

SEQ ID NO: 8488088 - DNA, 22 bp, Homo sapiens
taacatttaaatttttcacata

SEQ ID NO: 8488089 - DNA, 22 bp, Homo sapiens
taacatttgctgtctcctatgt

SEQ ID NO: 8488090 - DNA, 22 bp, Homo sapiens
taacaacttgcttttatcttag

SEQ ID NO: 8488091 - DNA, 22 bp, Homo sapiens
taacaactcagtttgttccttg

SEQ ID NO: 8488092 - DNA, 22 bp, Homo sapiens
taacaacatgcaatttaacctt

SEQ ID NO: 8488093 - DNA, 19 bp, Homo sapiens
taacaagcactctgcattc

SEQ ID NO: 8488094 - DNA, 22 bp, Homo sapiens
taacaagtcattttaaattatg

SEQ ID NO: 8488095 - DNA, 22 bp, Homo sapiens
taacaatacccattctaattac

SEQ ID NO: 8488096 - DNA, 22 bp, Homo sapiens
taacaatacccattctaattac

SEQ ID NO: 8488097 - DNA, 22 bp, Homo sapiens
taacaatacccattctaattac

SEQ ID NO: 8488098 - DNA, 22 bp, Homo sapiens
taacaatacccattctaattac

SEQ ID NO: 8488099 - DNA, 22 bp, Homo sapiens
taacactgtgtctgccatatcc

SEQ ID NO: 8488100 - DNA, 22 bp, Homo sapiens
taacacttgaagccatttttgc

SEQ ID NO: 8488101 - DNA, 22 bp, Homo sapiens
taacacttcagatgattttgtt

SEQ ID NO: 8488102 - DNA, 20 bp, Homo sapiens
taacacttgctttttgactt

SEQ ID NO: 8488103 - DNA, 22 bp, Homo sapiens
taacagaaaggctcaggtgctc

SEQ ID NO: 8488104 - DNA, 22 bp, Homo sapiens
taacagaaacagataagtgtaa

SEQ ID NO: 8488105 - DNA, 22 bp, Homo sapiens
taacagaaacagataagtgtaa

SEQ ID NO: 8488106 - DNA, 22 bp, Homo sapiens
taacagaaaagaactgagtttg

SEQ ID NO: 8488107 - DNA, 22 bp, Homo sapiens
taacagaaaagaactgagtttg

SEQ ID NO: 8488108 - DNA, 22 bp, Homo sapiens
taacacttgggggcatccttag

SEQ ID NO: 8488109 - DNA, 22 bp, Homo sapiens
taacactttggattaaaattct

SEQ ID NO: 8488110 - DNA, 22 bp, Homo sapiens
taacactttggattaaaattct

SEQ ID NO: 8488111 - DNA, 22 bp, Homo sapiens
taacagaaaggggacagaaata

SEQ ID NO: 8488112 - DNA, 22 bp, Homo sapiens
taacagaaaggggacagaaata

SEQ ID NO: 8488113 - DNA, 22 bp, Homo sapiens
taacagaaaggggacagaaata

SEQ ID NO: 8488114 - DNA, 22 bp, Homo sapiens
taacagaaaggggacagaaata

SEQ ID NO: 8488115 - DNA, 22 bp, Homo sapiens
taacagaaatagtaggtgaggg

SEQ ID NO: 8488116 - DNA, 22 bp, Homo sapiens
taacagaaatagaaatgagagt

SEQ ID NO: 8488117 - DNA, 22 bp, Homo sapiens
taacagaaatagaaatgagagt

SEQ ID NO: 8488118 - DNA, 22 bp, Homo sapiens
taacagaaatagaaatgagagt

SEQ ID NO: 8488119 - DNA, 22 bp, Homo sapiens
taacagaaatatttccaggtga

SEQ ID NO: 8488120 - DNA, 22 bp, Homo sapiens
taacagaaatagtaggtgaggg

SEQ ID NO: 8488121 - DNA, 22 bp, Homo sapiens
taacagaaatagtaggtgaggg

SEQ ID NO: 8488122 - DNA, 22 bp, Homo sapiens
taacagaagaaaacatattgga

SEQ ID NO: 8488123 - DNA, 22 bp, Homo sapiens
taacagaaattttagttagggg

SEQ ID NO: 8488124 - DNA, 22 bp, Homo sapiens
taacagaaattttagttagggg

SEQ ID NO: 8488125 - DNA, 22 bp, Homo sapiens
taacagaagaaaacatattgga

SEQ ID NO: 8488126 - DNA, 22 bp, Homo sapiens
taacagaagagcaggcagccct

SEQ ID NO: 8488127 - DNA, 22 bp, Homo sapiens
taacagaagatgaaacttcttt

SEQ ID NO: 8488128 - DNA, 22 bp, Homo sapiens
taacagaagatgaaacttcttt

SEQ ID NO: 8488129 - DNA, 20 bp, Homo sapiens
taacagaagtagaagtgggt

SEQ ID NO: 8488130 - DNA, 22 bp, Homo sapiens
taacattacggacatctgtcag

SEQ ID NO: 8488131 - DNA, 22 bp, Homo sapiens
taacagaagttgttcattgtgg

SEQ ID NO: 8488132 - DNA, 22 bp, Homo sapiens
taacattaggtagacataagcc

SEQ ID NO: 8488133 - DNA, 22 bp, Homo sapiens
taacattaggtagacataagcc

SEQ ID NO: 8488134 - DNA, 22 bp, Homo sapiens
taacattccatggatctgcaga

SEQ ID NO: 8488135 - DNA, 22 bp, Homo sapiens
taacattgagtccactaaacag

SEQ ID NO: 8488136 - DNA, 22 bp, Homo sapiens
taacattgtcagttcaactgct

SEQ ID NO: 8488137 - DNA, 22 bp, Homo sapiens
taacattgtcagttcaactgct

SEQ ID NO: 8488138 - DNA, 22 bp, Homo sapiens
taacattgttatgaatcaggtc

SEQ ID NO: 8488139 - DNA, 22 bp, Homo sapiens
taacattgttatgaatcaggtc

SEQ ID NO: 8488140 - DNA, 22 bp, Homo sapiens
caggatggtgtgagtgtgagga

SEQ ID NO: 8488141 - DNA, 22 bp, Homo sapiens
caggatggtggcatgatcagaa

SEQ ID NO: 8488142 - DNA, 22 bp, Homo sapiens
caggatggtgtgagtgtgagga

SEQ ID NO: 8488143 - DNA, 22 bp, Homo sapiens
caggatggtgtgagtgtgagga

SEQ ID NO: 8488144 - DNA, 22 bp, Homo sapiens
caggattgaatgcttctccctg

SEQ ID NO: 8488145 - DNA, 22 bp, Homo sapiens
caggattaaggtgaggggagta

SEQ ID NO: 8488146 - DNA, 22 bp, Homo sapiens
caggatgtgaggaggccatttg

SEQ ID NO: 8488147 - DNA, 22 bp, Homo sapiens
caggatgttcaagggacctatg

SEQ ID NO: 8488148 - DNA, 19 bp, Homo sapiens
caggattgtttaaagcttt

SEQ ID NO: 8488149 - DNA, 22 bp, Homo sapiens
caggcaagatccagaggctgct

SEQ ID NO: 8488150 - DNA, 22 bp, Homo sapiens
caggcaagatccagaggctgct

SEQ ID NO: 8488151 - DNA, 22 bp, Homo sapiens
caggcaagcacggtgaacctgg

SEQ ID NO: 8488152 - DNA, 22 bp, Homo sapiens
caggcaaggactctggtaattt

SEQ ID NO: 8488153 - DNA, 22 bp, Homo sapiens
caggcaagattagagatgagca

SEQ ID NO: 8488154 - DNA, 22 bp, Homo sapiens
caggcaagattagagatgagca

SEQ ID NO: 8488155 - DNA, 22 bp, Homo sapiens
caggcaagattagagatgagca

SEQ ID NO: 8488156 - DNA, 22 bp, Homo sapiens
caggcacaaaaggaccccagca

SEQ ID NO: 8488157 - DNA, 22 bp, Homo sapiens
caggcaagttcatttccaggca

SEQ ID NO: 8488158 - DNA, 22 bp, Homo sapiens
caggcacaaatttctagataag

SEQ ID NO: 8488159 - DNA, 22 bp, Homo sapiens
caggcacaaatttctagataag

SEQ ID NO: 8488160 - DNA, 22 bp, Homo sapiens
caggcacaaatttctagataag

SEQ ID NO: 8488161 - DNA, 22 bp, Homo sapiens
caggcaaggaggcactgaggga

SEQ ID NO: 8488162 - DNA, 22 bp, Homo sapiens
caggcacaagaagcaaatgtta

SEQ ID NO: 8488163 - DNA, 22 bp, Homo sapiens
caggcacaagatcggctagata

SEQ ID NO: 8488164 - DNA, 22 bp, Homo sapiens
caggcacaagatcggctagata

SEQ ID NO: 8488165 - DNA, 22 bp, Homo sapiens
caggcacaagaagcaaatgtta

SEQ ID NO: 8488166 - DNA, 22 bp, Homo sapiens
caggcacactgtctacactgag

SEQ ID NO: 8488167 - DNA, 22 bp, Homo sapiens
caggcacaggggaatgtctttt

SEQ ID NO: 8488168 - DNA, 22 bp, Homo sapiens
caggcacagtggggtcctctct

SEQ ID NO: 8488169 - DNA, 22 bp, Homo sapiens
caggcacagacgcaaacttctt

SEQ ID NO: 8488170 - DNA, 17 bp, Homo sapiens
caggcacatgaagccag

SEQ ID NO: 8488171 - DNA, 22 bp, Homo sapiens
caggcacatgggagctcatcat

SEQ ID NO: 8488172 - DNA, 22 bp, Homo sapiens
caggcacagttccaagcatttt

SEQ ID NO: 8488173 - DNA, 22 bp, Homo sapiens
taagacacagtccgcactctct

SEQ ID NO: 8488174 - DNA, 22 bp, Homo sapiens
taagacacaaatatcttttaca

SEQ ID NO: 8488175 - DNA, 22 bp, Homo sapiens
caggcaccaacttcctggggag

SEQ ID NO: 8488176 - DNA, 22 bp, Homo sapiens
taagcaaataatgcatcaaggg

SEQ ID NO: 8488177 - DNA, 22 bp, Homo sapiens
taaggcacacagttgctgcatg

SEQ ID NO: 8488178 - DNA, 22 bp, Homo sapiens
taaggcacacagttgctgcatg

SEQ ID NO: 8488179 - DNA, 22 bp, Homo sapiens
taaggcaccataatatatttaa

SEQ ID NO: 8488180 - DNA, 22 bp, Homo sapiens
taaggcacccatgttcatacag

SEQ ID NO: 8488181 - DNA, 22 bp, Homo sapiens
taaggcacccttctgagtagag

SEQ ID NO: 8488182 - DNA, 22 bp, Homo sapiens
taaggcacccgtgagctgccag

SEQ ID NO: 8488183 - DNA, 22 bp, Homo sapiens
taaggcacccgtgagctgccag

SEQ ID NO: 8488184 - DNA, 22 bp, Homo sapiens
taaggcacgcataagagggggc

SEQ ID NO: 8488185 - DNA, 22 bp, Homo sapiens
taaggcacctgtccaggctggg

SEQ ID NO: 8488186 - DNA, 22 bp, Homo sapiens
taaggcagaaatatgagcaggg

SEQ ID NO: 8488187 - DNA, 22 bp, Homo sapiens
taaggcacgcataagagggggc

SEQ ID NO: 8488188 - DNA, 22 bp, Homo sapiens
taaggcacttcaatgtttagaa

SEQ ID NO: 8488189 - DNA, 22 bp, Homo sapiens
taaggcacgcggtgaatgccaa

SEQ ID NO: 8488190 - DNA, 22 bp, Homo sapiens
taagacacattcatatctgtct

SEQ ID NO: 8488191 - DNA, 22 bp, Homo sapiens
taagacacatgcgtacaagata

SEQ ID NO: 8488192 - DNA, 22 bp, Homo sapiens
taagacacatgcgtacaagata

SEQ ID NO: 8488193 - DNA, 22 bp, Homo sapiens
taagacacatgcgtacaagata

SEQ ID NO: 8488194 - DNA, 22 bp, Homo sapiens
taagacacattgagaaacacaa

SEQ ID NO: 8488195 - DNA, 22 bp, Homo sapiens
taagacacattggagtagatga

SEQ ID NO: 8488196 - DNA, 22 bp, Homo sapiens
taagacacattggagtagatga

SEQ ID NO: 8488197 - DNA, 22 bp, Homo sapiens
taagacacattggagtagatga

SEQ ID NO: 8488198 - DNA, 23 bp, Homo sapiens
taagacacccgactccagagatg

SEQ ID NO: 8488199 - DNA, 23 bp, Homo sapiens
taagacacccgactccagagatg

SEQ ID NO: 8488200 - DNA, 22 bp, Homo sapiens
taagacacctctctgcccttca

SEQ ID NO: 8488201 - DNA, 22 bp, Homo sapiens
taagacacgggctgatctaaag

SEQ ID NO: 8488202 - DNA, 22 bp, Homo sapiens
taagatgtacaaccacttctct

SEQ ID NO: 8488203 - DNA, 22 bp, Homo sapiens
taagatgtacaaccacttctct

SEQ ID NO: 8488204 - DNA, 22 bp, Homo sapiens
taagcaaaagtcgagtgtgagc

SEQ ID NO: 8488205 - DNA, 22 bp, Homo sapiens
taagcaaaagtcgagtgtgagc

SEQ ID NO: 8488206 - DNA, 22 bp, Homo sapiens
taagatttttaaaatgtcctca

SEQ ID NO: 8488207 - DNA, 22 bp, Homo sapiens
taagcaaaggattttgatcttt

SEQ ID NO: 8488208 - DNA, 22 bp, Homo sapiens
taagattacagtgagaaataaa

SEQ ID NO: 8488209 - DNA, 22 bp, Homo sapiens
taagatttttaaaatgtcctca

SEQ ID NO: 8488210 - DNA, 22 bp, Homo sapiens
taagattatacttaaagagaaa

SEQ ID NO: 8488211 - DNA, 22 bp, Homo sapiens
taagatgttttggtttgataag

SEQ ID NO: 8488212 - DNA, 22 bp, Homo sapiens
taagatgtcatccacatagagt

SEQ ID NO: 8488213 - DNA, 22 bp, Homo sapiens
gttttcttcctgcaattggcat

SEQ ID NO: 8488214 - DNA, 19 bp, Homo sapiens
taaaaactgaaggaagcag

SEQ ID NO: 8488215 - DNA, 19 bp, Homo sapiens
taaaaactgaaggaagcag

SEQ ID NO: 8488216 - DNA, 19 bp, Homo sapiens
taaaaactgaaggaagcag

SEQ ID NO: 8488217 - DNA, 19 bp, Homo sapiens
taaaaactgaaggaagcag

SEQ ID NO: 8488218 - DNA, 22 bp, Homo sapiens
taaaaagcagctgagattttct

SEQ ID NO: 8488219 - DNA, 22 bp, Homo sapiens
taaaaagtagtgagaatggcgc

SEQ ID NO: 8488220 - DNA, 22 bp, Homo sapiens
taaaaagtagtgagaatggcgc

SEQ ID NO: 8488221 - DNA, 22 bp, Homo sapiens
taaaaagtagtgagaatggcgc

SEQ ID NO: 8488222 - DNA, 22 bp, Homo sapiens
gttttctgcctgaaggtgacca

SEQ ID NO: 8488223 - DNA, 22 bp, Homo sapiens
gttttctgccggtggtgggctc

SEQ ID NO: 8488224 - DNA, 19 bp, Homo sapiens
gttttctgatcttgccccc

SEQ ID NO: 8488225 - DNA, 22 bp, Homo sapiens
gttttctctgtgtttggatgat

SEQ ID NO: 8488226 - DNA, 22 bp, Homo sapiens
gttttctctgagatgcctttct

SEQ ID NO: 8488227 - DNA, 22 bp, Homo sapiens
gttttctcatctcctcaatggt

SEQ ID NO: 8488228 - DNA, 22 bp, Homo sapiens
gttttctcaggatggtgtgtac

SEQ ID NO: 8488229 - DNA, 22 bp, Homo sapiens
gttttctaccagggaagagagt

SEQ ID NO: 8488230 - DNA, 22 bp, Homo sapiens
gttttctaccagggaagagagt

SEQ ID NO: 8488231 - DNA, 22 bp, Homo sapiens
gttttcctgttgagtagtattc

SEQ ID NO: 8488232 - DNA, 22 bp, Homo sapiens
taaaatgacttcctccaacatc

SEQ ID NO: 8488233 - DNA, 22 bp, Homo sapiens
taaaatgacttcctccaacatc

SEQ ID NO: 8488234 - DNA, 22 bp, Homo sapiens
taaaatgacttcctccaacatc

SEQ ID NO: 8488235 - DNA, 22 bp, Homo sapiens
taaaatgacttcctccaacatc

SEQ ID NO: 8488236 - DNA, 22 bp, Homo sapiens
taaaatcattctggtgtcagta

SEQ ID NO: 8488237 - DNA, 22 bp, Homo sapiens
taaaatcattctggtgtcagta

SEQ ID NO: 8488238 - DNA, 22 bp, Homo sapiens
taaaatcattctggtgtcagta

SEQ ID NO: 8488239 - DNA, 22 bp, Homo sapiens
taaaatcattctggtgtcagta

SEQ ID NO: 8488240 - DNA, 22 bp, Homo sapiens
taaaatcagccgaccatggtgg

SEQ ID NO: 8488241 - DNA, 22 bp, Homo sapiens
taaaatcagccgaccatggtgg

SEQ ID NO: 8488242 - DNA, 22 bp, Homo sapiens
taaaaatcttatgaatggcaag

SEQ ID NO: 8488243 - DNA, 22 bp, Homo sapiens
taaaatagcatgtgcagtgaaa

SEQ ID NO: 8488244 - DNA, 22 bp, Homo sapiens
taaaatagcatgtgcagtgaaa

SEQ ID NO: 8488245 - DNA, 22 bp, Homo sapiens
taaaatagcttatgtcttttga

SEQ ID NO: 8488246 - DNA, 22 bp, Homo sapiens
taaaatagccagtgcccctctg

SEQ ID NO: 8488247 - DNA, 22 bp, Homo sapiens
taaaaagttgaaaggacttatc

SEQ ID NO: 8488248 - DNA, 22 bp, Homo sapiens
taaaaagttgaaaggacttatc

SEQ ID NO: 8488249 - DNA, 22 bp, Homo sapiens
taaaaagttgaaaggacttatc

SEQ ID NO: 8488250 - DNA, 22 bp, Homo sapiens
caggagactatggcccaaggcc

SEQ ID NO: 8488251 - DNA, 22 bp, Homo sapiens
caggagactatggcccaaggcc

SEQ ID NO: 8488252 - DNA, 22 bp, Homo sapiens
caggagactatggcccaaggcc

SEQ ID NO: 8488253 - DNA, 22 bp, Homo sapiens
caggagacctggtaagccaagt

SEQ ID NO: 8488254 - DNA, 22 bp, Homo sapiens
caggagacaatggctgtggggc

SEQ ID NO: 8488255 - DNA, 22 bp, Homo sapiens
caggagacaatggctgtggggc

SEQ ID NO: 8488256 - DNA, 22 bp, Homo sapiens
caggagacaagttagcagctga

SEQ ID NO: 8488257 - DNA, 22 bp, Homo sapiens
caggagacaagttagcagctga

SEQ ID NO: 8488258 - DNA, 22 bp, Homo sapiens
caggagaaggtttggagtgcag

SEQ ID NO: 8488259 - DNA, 22 bp, Homo sapiens
caggaccccatattcactgaac

SEQ ID NO: 8488260 - DNA, 22 bp, Homo sapiens
caggaccccatattcactgaac

SEQ ID NO: 8488261 - DNA, 22 bp, Homo sapiens
caggagaagtctctagggggtg

SEQ ID NO: 8488262 - DNA, 22 bp, Homo sapiens
caggagaagtctctagggggtg

SEQ ID NO: 8488263 - DNA, 22 bp, Homo sapiens
caggagaaggtttggagtgcag

SEQ ID NO: 8488264 - DNA, 19 bp, Homo sapiens
caggacagtttgccaagaa

SEQ ID NO: 8488265 - DNA, 22 bp, Homo sapiens
caggacagtttgctttgccctg

SEQ ID NO: 8488266 - DNA, 22 bp, Homo sapiens
caggacccaacctccctgctct

SEQ ID NO: 8488267 - DNA, 23 bp, Homo sapiens
caggacatgggaggaagtatggc

SEQ ID NO: 8488268 - DNA, 22 bp, Homo sapiens
caggacatcgtcatcatgggga

SEQ ID NO: 8488269 - DNA, 19 bp, Homo sapiens
caggacagtttgccaagaa

SEQ ID NO: 8488270 - DNA, 22 bp, Homo sapiens
taaaccaagtgtccatattagt

SEQ ID NO: 8488271 - DNA, 18 bp, Homo sapiens
taaaccagatgacagttg

SEQ ID NO: 8488272 - DNA, 18 bp, Homo sapiens
taaaccagatgacagttg

SEQ ID NO: 8488273 - DNA, 22 bp, Homo sapiens
taaaccaggtaaagaagctctc

SEQ ID NO: 8488274 - DNA, 18 bp, Homo sapiens
taaaccagatgacagttg

SEQ ID NO: 8488275 - DNA, 21 bp, Homo sapiens
taaacctggcgctgttcaaag

SEQ ID NO: 8488276 - DNA, 21 bp, Homo sapiens
taaacctggcgctgttcaaag

SEQ ID NO: 8488277 - DNA, 22 bp, Homo sapiens
taaacctgtagttgatgtaatt

SEQ ID NO: 8488278 - DNA, 22 bp, Homo sapiens
taaacctgcaactatagccacc

SEQ ID NO: 8488279 - DNA, 18 bp, Homo sapiens
taaacctgagaagcgtgt

SEQ ID NO: 8488280 - DNA, 22 bp, Homo sapiens
taaaccattcagactgaaccac

SEQ ID NO: 8488281 - DNA, 22 bp, Homo sapiens
taaacatttgttattcttgttt

SEQ ID NO: 8488282 - DNA, 22 bp, Homo sapiens
taaacatttgttattcttgttt

SEQ ID NO: 8488283 - DNA, 22 bp, Homo sapiens
taaaccttcatgatggtcatta

SEQ ID NO: 8488284 - DNA, 22 bp, Homo sapiens
taaactcttctgtagaatcaga

SEQ ID NO: 8488285 - DNA, 22 bp, Homo sapiens
taaactatctgtgtttgaagtt

SEQ ID NO: 8488286 - DNA, 22 bp, Homo sapiens
taaactatctgtgtttgaagtt

SEQ ID NO: 8488287 - DNA, 22 bp, Homo sapiens
caggacagtgcaggtccatcct

SEQ ID NO: 8488288 - DNA, 22 bp, Homo sapiens
caggacagtgcaggtccatcct

SEQ ID NO: 8488289 - DNA, 22 bp, Homo sapiens
caggacagttggcatctgctgc

SEQ ID NO: 8488290 - DNA, 22 bp, Homo sapiens
caggacagttggcatctgctgc

SEQ ID NO: 8488291 - DNA, 22 bp, Homo sapiens
caggaatgacccaacagtttca

SEQ ID NO: 8488292 - DNA, 22 bp, Homo sapiens
caggaatgaaaggtcagggttg

SEQ ID NO: 8488293 - DNA, 22 bp, Homo sapiens
caggaagttgtgtgttcgaggc

SEQ ID NO: 8488294 - DNA, 22 bp, Homo sapiens
caggaagtcgcagagctggggg

SEQ ID NO: 8488295 - DNA, 22 bp, Homo sapiens
caggaagtgcctggtgagagga

SEQ ID NO: 8488296 - DNA, 22 bp, Homo sapiens
caggaagtggctgggctgggtt

SEQ ID NO: 8488297 - DNA, 22 bp, Homo sapiens
caggaagtggggtcatggagta

SEQ ID NO: 8488298 - DNA, 22 bp, Homo sapiens
caggaagtgtgagggtggtgta

SEQ ID NO: 8488299 - DNA, 22 bp, Homo sapiens
caggaagtgtgagggtggtgta

SEQ ID NO: 8488300 - DNA, 22 bp, Homo sapiens
caggaagctgagctgcactgca

SEQ ID NO: 8488301 - DNA, 22 bp, Homo sapiens
caggaagctgccggtgagcgag

SEQ ID NO: 8488302 - DNA, 22 bp, Homo sapiens
caggaaggaaagggtgtggaga

SEQ ID NO: 8488303 - DNA, 22 bp, Homo sapiens
caggaagctgtgaaggagacgg

SEQ ID NO: 8488304 - DNA, 22 bp, Homo sapiens
caggaagggggatccttggaag

SEQ ID NO: 8488305 - DNA, 22 bp, Homo sapiens
caggaaggaaagggtgtggaga

SEQ ID NO: 8488306 - DNA, 22 bp, Homo sapiens
gtttggcactatgatgaggcta

SEQ ID NO: 8488307 - DNA, 22 bp, Homo sapiens
gtttggaagttaagtgcagcag

SEQ ID NO: 8488308 - DNA, 18 bp, Homo sapiens
gtttggcataactgatgc

SEQ ID NO: 8488309 - DNA, 18 bp, Homo sapiens
gtttggcataactgatgc

SEQ ID NO: 8488310 - DNA, 22 bp, Homo sapiens
gtttggcagtgttatgtaggtt

SEQ ID NO: 8488311 - DNA, 22 bp, Homo sapiens
gtttggcagttttagagtgcaa

SEQ ID NO: 8488312 - DNA, 22 bp, Homo sapiens
gtttggggtctgcagagcggcg

SEQ ID NO: 8488313 - DNA, 22 bp, Homo sapiens
gtttggctctgggtgcctgtgc

SEQ ID NO: 8488314 - DNA, 22 bp, Homo sapiens
gtttggggtctgcagagcggcg

SEQ ID NO: 8488315 - DNA, 22 bp, Homo sapiens
gtttggggagttcctttaggcc

SEQ ID NO: 8488316 - DNA, 23 bp, Homo sapiens
caggaagcagatggggtagaaga

SEQ ID NO: 8488317 - DNA, 23 bp, Homo sapiens
caggaagcagatggggtagaaga

SEQ ID NO: 8488318 - DNA, 22 bp, Homo sapiens
gtttgtatgaatgttttatgct

SEQ ID NO: 8488319 - DNA, 22 bp, Homo sapiens
caggaagccttccttgtctgct

SEQ ID NO: 8488320 - DNA, 22 bp, Homo sapiens
caggaagccacaggacaggtag

SEQ ID NO: 8488321 - DNA, 22 bp, Homo sapiens
caggaagccacaggacaggtag

SEQ ID NO: 8488322 - DNA, 22 bp, Homo sapiens
gttttccactggattgtttgga

SEQ ID NO: 8488323 - DNA, 22 bp, Homo sapiens
gttttccatggaggtctgacct

SEQ ID NO: 8488324 - DNA, 22 bp, Homo sapiens
caggacagtataggctttagga

SEQ ID NO: 8488325 - DNA, 22 bp, Homo sapiens
caggacagtataggctttagga

SEQ ID NO: 8488326 - DNA, 22 bp, Homo sapiens
caggacaggtgttctagatcag

SEQ ID NO: 8488327 - DNA, 22 bp, Homo sapiens
caggacaggtgttctagatcag

SEQ ID NO: 8488328 - DNA, 22 bp, Homo sapiens
caggacaggccctgtggggtct

SEQ ID NO: 8488329 - DNA, 22 bp, Homo sapiens
caggacaggagtggggtcaaag

SEQ ID NO: 8488330 - DNA, 22 bp, Homo sapiens
caggacaggccctgtggggtct

SEQ ID NO: 8488331 - DNA, 22 bp, Homo sapiens
caggacaggagtggggtcaaag

SEQ ID NO: 8488332 - DNA, 22 bp, Homo sapiens
caggacaggagtggggtcaaag

SEQ ID NO: 8488333 - DNA, 22 bp, Homo sapiens
caggacagctgggccaccacca

SEQ ID NO: 8488334 - DNA, 22 bp, Homo sapiens
caggacagctcaacacctcctc

SEQ ID NO: 8488335 - DNA, 22 bp, Homo sapiens
caggacactacagatgggaggg

SEQ ID NO: 8488336 - DNA, 22 bp, Homo sapiens
caggacacttgttcttctctgc

SEQ ID NO: 8488337 - DNA, 22 bp, Homo sapiens
caggacacagggtgtggctgat

SEQ ID NO: 8488338 - DNA, 22 bp, Homo sapiens
caggacacagggtgtggctgat

SEQ ID NO: 8488339 - DNA, 22 bp, Homo sapiens
caggacacagggtgtggctgat

SEQ ID NO: 8488340 - DNA, 22 bp, Homo sapiens
caggacacagggtgtggctgat

SEQ ID NO: 8488341 - DNA, 22 bp, Homo sapiens
caggacaattttgagccacctg

SEQ ID NO: 8488342 - DNA, 22 bp, Homo sapiens
caggacacagaataaggcagtt

SEQ ID NO: 8488343 - DNA, 22 bp, Homo sapiens
caggacacagaataaggcagtt

SEQ ID NO: 8488344 - DNA, 22 bp, Homo sapiens
caggaatgtttgtgctccttta

SEQ ID NO: 8488345 - DNA, 22 bp, Homo sapiens
caggaatgtccttgtcatttca

SEQ ID NO: 8488346 - DNA, 22 bp, Homo sapiens
caggacaatctcgtcgggtcct

SEQ ID NO: 8488347 - DNA, 18 bp, Homo sapiens
caggaatggatgggattt

SEQ ID NO: 8488348 - DNA, 22 bp, Homo sapiens
caggaatgtagcagcgatggaa

SEQ ID NO: 8488349 - DNA, 22 bp, Homo sapiens
caggaatgatctgctgagtgat

SEQ ID NO: 8488350 - DNA, 22 bp, Homo sapiens
caggaatgatattcgaggagat

SEQ ID NO: 8488351 - DNA, 22 bp, Homo sapiens
caggaatgccaaccagtgcatg

SEQ ID NO: 8488352 - DNA, 22 bp, Homo sapiens
caggaatgcattctagaatggc

SEQ ID NO: 8488353 - DNA, 19 bp, Homo sapiens
caggaatgaggtaatggct

SEQ ID NO: 8488354 - DNA, 22 bp, Homo sapiens
taaagccacgctggaaatcagg

SEQ ID NO: 8488355 - DNA, 22 bp, Homo sapiens
taaagctacacattattaatcc

SEQ ID NO: 8488356 - DNA, 22 bp, Homo sapiens
taaagccatactgaaagccact

SEQ ID NO: 8488357 - DNA, 22 bp, Homo sapiens
taaagcatgtttcagtaaggtt

SEQ ID NO: 8488358 - DNA, 22 bp, Homo sapiens
taaagcatgtgttagaagtgca

SEQ ID NO: 8488359 - DNA, 22 bp, Homo sapiens
taaagtcatctttaaacatgcc

SEQ ID NO: 8488360 - DNA, 22 bp, Homo sapiens
taaagtcatctttacatctttg

SEQ ID NO: 8488361 - DNA, 22 bp, Homo sapiens
taaagtcatctttacatctttg

SEQ ID NO: 8488362 - DNA, 22 bp, Homo sapiens
taaagtcatctttacatctttg

SEQ ID NO: 8488363 - DNA, 22 bp, Homo sapiens
taaagtcatctttacatctttg

SEQ ID NO: 8488364 - DNA, 22 bp, Homo sapiens
taaagtgaagttcagaatggct

SEQ ID NO: 8488365 - DNA, 22 bp, Homo sapiens
taaagtgaaggtcataatgatt

SEQ ID NO: 8488366 - DNA, 22 bp, Homo sapiens
taaagtcagggagattgaggct

SEQ ID NO: 8488367 - DNA, 22 bp, Homo sapiens
taaagtcagatatctgggttga

SEQ ID NO: 8488368 - DNA, 22 bp, Homo sapiens
taaagtcagatatctgggttga

SEQ ID NO: 8488369 - DNA, 22 bp, Homo sapiens
taaagtcataagagtggatccg

SEQ ID NO: 8488370 - DNA, 22 bp, Homo sapiens
taaagtcatctttaaacatgcc

SEQ ID NO: 8488371 - DNA, 23 bp, Homo sapiens
taaagtcacatattagagtgagc

SEQ ID NO: 8488372 - DNA, 23 bp, Homo sapiens
taaagtcacatattagagtgagc

SEQ ID NO: 8488373 - DNA, 22 bp, Homo sapiens
taaatcacaaattttctcattt

SEQ ID NO: 8488374 - DNA, 22 bp, Homo sapiens
taaatcacatcgaaatctgggt

SEQ ID NO: 8488375 - DNA, 22 bp, Homo sapiens
taaatcacatcgaaatctgggt

SEQ ID NO: 8488376 - DNA, 22 bp, Homo sapiens
taaatcacatcgaaatctgggt

SEQ ID NO: 8488377 - DNA, 22 bp, Homo sapiens
taaatgcttagattcatagaaa

SEQ ID NO: 8488378 - DNA, 22 bp, Homo sapiens
taaatcacattcgtctgctcct

SEQ ID NO: 8488379 - DNA, 22 bp, Homo sapiens
taaatcacattttctttgtgtt

SEQ ID NO: 8488380 - DNA, 22 bp, Homo sapiens
taaatgctttctatgaaagagg

SEQ ID NO: 8488381 - DNA, 22 bp, Homo sapiens
taaatatgcatgtatccttatc

SEQ ID NO: 8488382 - DNA, 22 bp, Homo sapiens
taaatatcagtccagctcttcc

SEQ ID NO: 8488383 - DNA, 22 bp, Homo sapiens
taaatatcagtccagctcttcc

SEQ ID NO: 8488384 - DNA, 22 bp, Homo sapiens
taaatatcacctggaattgtta

SEQ ID NO: 8488385 - DNA, 22 bp, Homo sapiens
taaatatcacctggaattgtta

SEQ ID NO: 8488386 - DNA, 18 bp, Homo sapiens
taaatatatttccccctt

SEQ ID NO: 8488387 - DNA, 18 bp, Homo sapiens
taaatatatttccccctt

SEQ ID NO: 8488388 - DNA, 18 bp, Homo sapiens
taaatatatttccccctt

SEQ ID NO: 8488389 - DNA, 18 bp, Homo sapiens
taaatatatttccccctt

SEQ ID NO: 8488390 - DNA, 22 bp, Homo sapiens
taaatagagaatcagcttggag

SEQ ID NO: 8488391 - DNA, 22 bp, Homo sapiens
taaatagagaatcagcttggag

SEQ ID NO: 8488392 - DNA, 22 bp, Homo sapiens
taaagtgcagattgtgattcag

SEQ ID NO: 8488393 - DNA, 22 bp, Homo sapiens
taaagtgcagactcccggaaac

SEQ ID NO: 8488394 - DNA, 22 bp, Homo sapiens
taaagtgcaggctactcagaag

SEQ ID NO: 8488395 - DNA, 22 bp, Homo sapiens
taaagtgcaggctactcagaag

SEQ ID NO: 8488396 - DNA, 22 bp, Homo sapiens
taaagtgcatgcggggccagat

SEQ ID NO: 8488397 - DNA, 22 bp, Homo sapiens
taaagcagtgtggttgtgtccc

SEQ ID NO: 8488398 - DNA, 22 bp, Homo sapiens
taaagcataatgaatatctaga

SEQ ID NO: 8488399 - DNA, 22 bp, Homo sapiens
taaagcataatgaatatctaga

SEQ ID NO: 8488400 - DNA, 22 bp, Homo sapiens
taaagcataatgaatatctaga

SEQ ID NO: 8488401 - DNA, 22 bp, Homo sapiens
caggagctcttaaggatgtgat

SEQ ID NO: 8488402 - DNA, 22 bp, Homo sapiens
caggagctggataggaccacaa

SEQ ID NO: 8488403 - DNA, 22 bp, Homo sapiens
caggagctcttaaggatgtgat

SEQ ID NO: 8488404 - DNA, 22 bp, Homo sapiens
caggagctcttaaggatgtgat

SEQ ID NO: 8488405 - DNA, 22 bp, Homo sapiens
caggagctctcatcgtcagggc

SEQ ID NO: 8488406 - DNA, 22 bp, Homo sapiens
caggagctcaagaccaccctgg

SEQ ID NO: 8488407 - DNA, 22 bp, Homo sapiens
caggagctactcaggttgggtt

SEQ ID NO: 8488408 - DNA, 22 bp, Homo sapiens
caggagctactcaggttgggtt

SEQ ID NO: 8488409 - DNA, 22 bp, Homo sapiens
caggagctactcaggttgggtt

SEQ ID NO: 8488410 - DNA, 22 bp, Homo sapiens
caggagctactcaggttgggtt

SEQ ID NO: 8488411 - DNA, 22 bp, Homo sapiens
caggagctcagatgacatctca

SEQ ID NO: 8488412 - DNA, 22 bp, Homo sapiens
caggagccctggtgggtggaca

SEQ ID NO: 8488413 - DNA, 22 bp, Homo sapiens
caggagcccgttgctccggcgg

SEQ ID NO: 8488414 - DNA, 22 bp, Homo sapiens
caggagcccgttgctccggcgg

SEQ ID NO: 8488415 - DNA, 22 bp, Homo sapiens
caggagcccgttgctccggcgg

SEQ ID NO: 8488416 - DNA, 22 bp, Homo sapiens
caggagccccaggctgacaata

SEQ ID NO: 8488417 - DNA, 22 bp, Homo sapiens
caggagagatatgagtccccac

SEQ ID NO: 8488418 - DNA, 19 bp, Homo sapiens
caggagagcatgcactttg

SEQ ID NO: 8488419 - DNA, 22 bp, Homo sapiens
caggagagatatgagtccccac

SEQ ID NO: 8488420 - DNA, 22 bp, Homo sapiens
caggagagatatgagtccccac

SEQ ID NO: 8488421 - DNA, 22 bp, Homo sapiens
caggagactcagcatccaggat

SEQ ID NO: 8488422 - DNA, 22 bp, Homo sapiens
caggagaggaggctacttctta

SEQ ID NO: 8488423 - DNA, 22 bp, Homo sapiens
caggagagcccgggtccgggct

SEQ ID NO: 8488424 - DNA, 22 bp, Homo sapiens
caggagataaaagagatgcttt

SEQ ID NO: 8488425 - DNA, 22 bp, Homo sapiens
caggagataaaagagatgcttt

SEQ ID NO: 8488426 - DNA, 22 bp, Homo sapiens
caggagatcttaggaattctta

SEQ ID NO: 8488427 - DNA, 22 bp, Homo sapiens
caggagatgacagggaagaacc

SEQ ID NO: 8488428 - DNA, 23 bp, Homo sapiens
caggagatggctgctgtgtcagc

SEQ ID NO: 8488429 - DNA, 22 bp, Homo sapiens
caggagatgacagggaagaacc

SEQ ID NO: 8488430 - DNA, 22 bp, Homo sapiens
caggagatgtacctgtttttga

SEQ ID NO: 8488431 - DNA, 22 bp, Homo sapiens
caggagcaaatccaaaagaatt

SEQ ID NO: 8488432 - DNA, 22 bp, Homo sapiens
caggagatgtaagacttctgtt

SEQ ID NO: 8488433 - DNA, 22 bp, Homo sapiens
caggagctgggtctggaagcag

SEQ ID NO: 8488434 - DNA, 22 bp, Homo sapiens
caggagctgggtctggaagcag

SEQ ID NO: 8488435 - DNA, 22 bp, Homo sapiens
caggagctggatctccttgcgg

SEQ ID NO: 8488436 - DNA, 22 bp, Homo sapiens
caggagctggatctccttgcgg

SEQ ID NO: 8488437 - DNA, 22 bp, Homo sapiens
caggagctgggtctggaagcag

SEQ ID NO: 8488438 - DNA, 22 bp, Homo sapiens
taaatgtgaccttcattttata

SEQ ID NO: 8488439 - DNA, 21 bp, Homo sapiens
taaatgtgagcagggctgggc

SEQ ID NO: 8488440 - DNA, 22 bp, Homo sapiens
taaatgtgaccttcattttata

SEQ ID NO: 8488441 - DNA, 21 bp, Homo sapiens
taaatgtgagcagggctgggc

SEQ ID NO: 8488442 - DNA, 22 bp, Homo sapiens
taaatgtgagtgatgcggtgaa

SEQ ID NO: 8488443 - DNA, 22 bp, Homo sapiens
taaatgtgcacaggttagaagg

SEQ ID NO: 8488444 - DNA, 22 bp, Homo sapiens
caggagcttctgcccatggcca

SEQ ID NO: 8488445 - DNA, 22 bp, Homo sapiens
caggagcttctgcccatggcca

SEQ ID NO: 8488446 - DNA, 22 bp, Homo sapiens
caggagcttctgcccatggcca

SEQ ID NO: 8488447 - DNA, 22 bp, Homo sapiens
caggagctgggtctggaagcag

SEQ ID NO: 8488448 - DNA, 22 bp, Homo sapiens
caggagctttcttcccaaactt

SEQ ID NO: 8488449 - DNA, 22 bp, Homo sapiens
caggaggaaactggattcactt

SEQ ID NO: 8488450 - DNA, 22 bp, Homo sapiens
caggagcttctgcccatggcca

SEQ ID NO: 8488451 - DNA, 22 bp, Homo sapiens
caggagcttctgcccatggcca

SEQ ID NO: 8488452 - DNA, 22 bp, Homo sapiens
taaatgtataggcactaaacct

SEQ ID NO: 8488453 - DNA, 22 bp, Homo sapiens
taaatgtataggcactaaacct

SEQ ID NO: 8488454 - DNA, 22 bp, Homo sapiens
taaatgtagtcaaaggagcctc

SEQ ID NO: 8488455 - DNA, 22 bp, Homo sapiens
taaatgtataggcactaaacct

SEQ ID NO: 8488456 - DNA, 22 bp, Homo sapiens
taaatgtataggcactaaacct

SEQ ID NO: 8488457 - DNA, 22 bp, Homo sapiens
taaatgtaaatggcgtcttgcg

SEQ ID NO: 8488458 - DNA, 22 bp, Homo sapiens
taaatgctttctatgaaagagg

SEQ ID NO: 8488459 - DNA, 22 bp, Homo sapiens
taaatgtactgaggcaacagga

SEQ ID NO: 8488460 - DNA, 22 bp, Homo sapiens
taaatgtactgaggcaacagga

SEQ ID NO: 8488461 - DNA, 22 bp, Homo sapiens
taaatgtaccttctgccttact

SEQ ID NO: 8488462 - DNA, 22 bp, Homo sapiens
taaatgtaccttctgccttact

SEQ ID NO: 8488463 - DNA, 22 bp, Homo sapiens
caggaggaacaagaggttctgg

SEQ ID NO: 8488464 - DNA, 22 bp, Homo sapiens
caggaggaacaagaggttctgg

SEQ ID NO: 8488465 - DNA, 22 bp, Homo sapiens
caggaggaacaagaggttctgg

SEQ ID NO: 8488466 - DNA, 22 bp, Homo sapiens
caggaggaaatgtgaccctgct

SEQ ID NO: 8488467 - DNA, 20 bp, Homo sapiens
caggaggcaaggtcaaggtc

SEQ ID NO: 8488468 - DNA, 22 bp, Homo sapiens
caggaggcagaggatgcccagt

SEQ ID NO: 8488469 - DNA, 22 bp, Homo sapiens
caggaggacatactggctcaca

SEQ ID NO: 8488470 - DNA, 22 bp, Homo sapiens
caggaggcagaggatgcccagt

SEQ ID NO: 8488471 - DNA, 22 bp, Homo sapiens
caggaggcagaggttgcagtga

SEQ ID NO: 8488472 - DNA, 22 bp, Homo sapiens
caggaggcagaggttgcagcga

SEQ ID NO: 8488473 - DNA, 22 bp, Homo sapiens
caggaggcagaggttgcagtga

SEQ ID NO: 8488474 - DNA, 22 bp, Homo sapiens
caggaggcaggtgcattttgag

SEQ ID NO: 8488475 - DNA, 22 bp, Homo sapiens
caggaggcagcgctctcaggac

SEQ ID NO: 8488476 - DNA, 22 bp, Homo sapiens
caggaggcagcgctctcaggac

SEQ ID NO: 8488477 - DNA, 22 bp, Homo sapiens
caggaggcatcatggagcggac

SEQ ID NO: 8488478 - DNA, 22 bp, Homo sapiens
caggaggccaactgtgggactt

SEQ ID NO: 8488479 - DNA, 22 bp, Homo sapiens
caggaggccaactgtgggactt

SEQ ID NO: 8488480 - DNA, 22 bp, Homo sapiens
caggaggccaactgtgggactt

SEQ ID NO: 8488481 - DNA, 22 bp, Homo sapiens
caggaggcccaaagggcgcaga

SEQ ID NO: 8488482 - DNA, 22 bp, Homo sapiens
caggaggcccaaagggcgcaga

SEQ ID NO: 8488483 - DNA, 22 bp, Homo sapiens
caggaggcccacaggcccctgc

SEQ ID NO: 8488484 - DNA, 22 bp, Homo sapiens
caggaggctcctagggctctgt

SEQ ID NO: 8488485 - DNA, 22 bp, Homo sapiens
caggaggctcctagggctctgt

SEQ ID NO: 8488486 - DNA, 22 bp, Homo sapiens
caggaggctcctagggctctgt

SEQ ID NO: 8488487 - DNA, 22 bp, Homo sapiens
caggaggcgtcttcagtttgtt

SEQ ID NO: 8488488 - DNA, 22 bp, Homo sapiens
caggaggcgtcttcagtttgtt

SEQ ID NO: 8488489 - DNA, 22 bp, Homo sapiens
caggaggctcctagggctctgt

SEQ ID NO: 8488490 - DNA, 22 bp, Homo sapiens
caggagtgtctccacacagcaa

SEQ ID NO: 8488491 - DNA, 22 bp, Homo sapiens
caggagtgtctccacacagcaa

SEQ ID NO: 8488492 - DNA, 22 bp, Homo sapiens
caggagtgtcgggtcactaggt

SEQ ID NO: 8488493 - DNA, 22 bp, Homo sapiens
caggagtgtcgggtcactaggt

SEQ ID NO: 8488494 - DNA, 22 bp, Homo sapiens
caggagtggtgtgagggactcc

SEQ ID NO: 8488495 - DNA, 22 bp, Homo sapiens
caggagtggtgtgagggactcc

SEQ ID NO: 8488496 - DNA, 22 bp, Homo sapiens
caggagtggtgtgagggactcc

SEQ ID NO: 8488497 - DNA, 22 bp, Homo sapiens
caggagtgcaggtggtgaggca

SEQ ID NO: 8488498 - DNA, 22 bp, Homo sapiens
caggagtgcaggtggtgaggca

SEQ ID NO: 8488499 - DNA, 22 bp, Homo sapiens
caggagtgcaggtggtgaggca

SEQ ID NO: 8488500 - DNA, 22 bp, Homo sapiens
caggagtgcaggtggtgaggca

SEQ ID NO: 8488501 - DNA, 22 bp, Homo sapiens
caggagtgagttggggtctaca

SEQ ID NO: 8488502 - DNA, 22 bp, Homo sapiens
caggagtgagatgcgatcactt

SEQ ID NO: 8488503 - DNA, 22 bp, Homo sapiens
caggagtgaaatgaggcccagg

SEQ ID NO: 8488504 - DNA, 22 bp, Homo sapiens
taacaaaggttgccaaactaag

SEQ ID NO: 8488505 - DNA, 22 bp, Homo sapiens
taacaaaggttgccaaactaag

SEQ ID NO: 8488506 - DNA, 22 bp, Homo sapiens
taacaaagtaccatagactgga

SEQ ID NO: 8488507 - DNA, 22 bp, Homo sapiens
caggagtgtctccacacagcaa

SEQ ID NO: 8488508 - DNA, 22 bp, Homo sapiens
caggagtttctattgttccaaa

SEQ ID NO: 8488509 - DNA, 22 bp, Homo sapiens
caggataacagaaaatagctga

SEQ ID NO: 8488510 - DNA, 22 bp, Homo sapiens
caggataaatagtaaatgtaag

SEQ ID NO: 8488511 - DNA, 22 bp, Homo sapiens
cctggggacctgcctcagccct

SEQ ID NO: 8488512 - DNA, 22 bp, Homo sapiens
cctggggaatcttgcaggggaa

SEQ ID NO: 8488513 - DNA, 22 bp, Homo sapiens
tgtgttcaccaaagtgtagaaa

SEQ ID NO: 8488514 - DNA, 22 bp, Homo sapiens
tgtgttcagaatttgctgcttt

SEQ ID NO: 8488515 - DNA, 22 bp, Homo sapiens
cctggggctccagagcagcgga

SEQ ID NO: 8488516 - DNA, 22 bp, Homo sapiens
tgtgttctccaactgtagattt

SEQ ID NO: 8488517 - DNA, 19 bp, Homo sapiens
cctgggtccactcagacta

SEQ ID NO: 8488518 - DNA, 22 bp, Homo sapiens
tgtgttcatttctctctgctgt

SEQ ID NO: 8488519 - DNA, 23 bp, Homo sapiens
tgtgttctcacacagatgcagta

SEQ ID NO: 8488520 - DNA, 19 bp, Homo sapiens
tgtgttcattcatcagagg

SEQ ID NO: 8488521 - DNA, 22 bp, Homo sapiens
cctgggtcccagccaggctttg

SEQ ID NO: 8488522 - DNA, 22 bp, Homo sapiens
cctgggtcttggttcatgctct

SEQ ID NO: 8488523 - DNA, 22 bp, Homo sapiens
cctgggtcttggttcatgctct

SEQ ID NO: 8488524 - DNA, 22 bp, Homo sapiens
cctgggtgacagagtgagacct

SEQ ID NO: 8488525 - DNA, 22 bp, Homo sapiens
cctgggtgaaatagtcctcaag

SEQ ID NO: 8488526 - DNA, 22 bp, Homo sapiens
cctgggtgaaatagtcctcaag

SEQ ID NO: 8488527 - DNA, 22 bp, Homo sapiens
cctgggtgaaatctctcctgca

SEQ ID NO: 8488528 - DNA, 22 bp, Homo sapiens
cctgggtgacagagtgagacct

SEQ ID NO: 8488529 - DNA, 22 bp, Homo sapiens
cctgggtgacccgtgagcgtcc

SEQ ID NO: 8488530 - DNA, 22 bp, Homo sapiens
cctgggtgatgtgctgccctcg

SEQ ID NO: 8488531 - DNA, 22 bp, Homo sapiens
cctgggtgacccgtgagcgtcc

SEQ ID NO: 8488532 - DNA, 22 bp, Homo sapiens
cctgggtgacccgtgagcgtcc

SEQ ID NO: 8488533 - DNA, 22 bp, Homo sapiens
cctgggtgatgtgctgccctcg

SEQ ID NO: 8488534 - DNA, 22 bp, Homo sapiens
cctgggtggcagaggttgcagt

SEQ ID NO: 8488535 - DNA, 22 bp, Homo sapiens
tgtgtgtctggaagctcaggga

SEQ ID NO: 8488536 - DNA, 22 bp, Homo sapiens
cctgggcctctcaaagtgctgg

SEQ ID NO: 8488537 - DNA, 19 bp, Homo sapiens
cctgggcctccatcacccc

SEQ ID NO: 8488538 - DNA, 22 bp, Homo sapiens
tgtgtgtcatttagggtggagc

SEQ ID NO: 8488539 - DNA, 22 bp, Homo sapiens
tgtgtgtctgcacatgtataat

SEQ ID NO: 8488540 - DNA, 22 bp, Homo sapiens
tgtgtgtctgcacatgtataat

SEQ ID NO: 8488541 - DNA, 22 bp, Homo sapiens
tgtgtgtccttgacctcagtgg

SEQ ID NO: 8488542 - DNA, 22 bp, Homo sapiens
tgtgtgtcagtcttgtttaggg

SEQ ID NO: 8488543 - DNA, 22 bp, Homo sapiens
tgtgtgtcatttagggtggagc

SEQ ID NO: 8488544 - DNA, 22 bp, Homo sapiens
tgtgtgtccttgacctcagtgg

SEQ ID NO: 8488545 - DNA, 22 bp, Homo sapiens
cctgggcctgaaaacatttctc

SEQ ID NO: 8488546 - DNA, 22 bp, Homo sapiens
cctgggcctggcgggtcggctc

SEQ ID NO: 8488547 - DNA, 22 bp, Homo sapiens
cctgggcctgaaaacatttctc

SEQ ID NO: 8488548 - DNA, 22 bp, Homo sapiens
cctgggcctctcaaagtgctgg

SEQ ID NO: 8488549 - DNA, 19 bp, Homo sapiens
cctgggcctccatcacccc

SEQ ID NO: 8488550 - DNA, 22 bp, Homo sapiens
cctgggcctctcaaagtgctgg

SEQ ID NO: 8488551 - DNA, 22 bp, Homo sapiens
tgtgtgtaatgtttctctcttc

SEQ ID NO: 8488552 - DNA, 22 bp, Homo sapiens
tgtgtgtaaggaagctttatgg

SEQ ID NO: 8488553 - DNA, 22 bp, Homo sapiens
tgtgtgggtggtaaggaaggcc

SEQ ID NO: 8488554 - DNA, 22 bp, Homo sapiens
tgtgtgggtggtaaggaaggcc

SEQ ID NO: 8488555 - DNA, 19 bp, Homo sapiens
tgtgtgggtttagagtagt

SEQ ID NO: 8488556 - DNA, 22 bp, Homo sapiens
tgtgtgtataataatgtctgca

SEQ ID NO: 8488557 - DNA, 22 bp, Homo sapiens
tgtgtgtataataatgtctgca

SEQ ID NO: 8488558 - DNA, 22 bp, Homo sapiens
tgtgtgtataataatgtctgca

SEQ ID NO: 8488559 - DNA, 22 bp, Homo sapiens
tgtgtgtagaaagggccctggt

SEQ ID NO: 8488560 - DNA, 22 bp, Homo sapiens
tgtgtgtataataatgtctgca

SEQ ID NO: 8488561 - DNA, 22 bp, Homo sapiens
tgtgtgtactctccagtcctga

SEQ ID NO: 8488562 - DNA, 22 bp, Homo sapiens
tgtgtgtcagagtctccatggt

SEQ ID NO: 8488563 - DNA, 22 bp, Homo sapiens
tgtgtgtcagcccaagggcctt

SEQ ID NO: 8488564 - DNA, 22 bp, Homo sapiens
tgtgtgtcagtcttgtttaggg

SEQ ID NO: 8488565 - DNA, 22 bp, Homo sapiens
tgtgtgtatccattagaggcca

SEQ ID NO: 8488566 - DNA, 22 bp, Homo sapiens
tgtgtgtatatgcatttatcta

SEQ ID NO: 8488567 - DNA, 22 bp, Homo sapiens
tgtgtgtatatgcatttatcta

SEQ ID NO: 8488568 - DNA, 22 bp, Homo sapiens
tgtgtgtatatgcatttatcta

SEQ ID NO: 8488569 - DNA, 21 bp, Homo sapiens
tgtgtgtatgcacacacatgc

SEQ ID NO: 8488570 - DNA, 22 bp, Homo sapiens
tgtgtgtatgtttacttttcct

SEQ ID NO: 8488571 - DNA, 22 bp, Homo sapiens
tgtgtgtcactgaaagaaatct

SEQ ID NO: 8488572 - DNA, 19 bp, Homo sapiens
tgtgtgtatttcagttctt

SEQ ID NO: 8488573 - DNA, 22 bp, Homo sapiens
cctggggaagtcacttctcttt

SEQ ID NO: 8488574 - DNA, 22 bp, Homo sapiens
cctggggaatagagtcaagggg

SEQ ID NO: 8488575 - DNA, 22 bp, Homo sapiens
cctggggaatagagtcaagggg

SEQ ID NO: 8488576 - DNA, 22 bp, Homo sapiens
cctggggaagtcacttctcttt

SEQ ID NO: 8488577 - DNA, 22 bp, Homo sapiens
cctggggaatagagtcaagggg

SEQ ID NO: 8488578 - DNA, 22 bp, Homo sapiens
cctgggcttccacgagcagagg

SEQ ID NO: 8488579 - DNA, 22 bp, Homo sapiens
cctgggctttgctggcaaggcc

SEQ ID NO: 8488580 - DNA, 22 bp, Homo sapiens
cctgggcttccacgagcagagg

SEQ ID NO: 8488581 - DNA, 22 bp, Homo sapiens
cctgggcttccacgagcagagg

SEQ ID NO: 8488582 - DNA, 22 bp, Homo sapiens
cctgggcctggcgggtcggctc

SEQ ID NO: 8488583 - DNA, 22 bp, Homo sapiens
cctgggccttgacctcgtgggc

SEQ ID NO: 8488584 - DNA, 22 bp, Homo sapiens
cctgggccttgacctcgtgggc

SEQ ID NO: 8488585 - DNA, 20 bp, Homo sapiens
cctgggctcaaagcatcctc

SEQ ID NO: 8488586 - DNA, 22 bp, Homo sapiens
cctgggcctatcctagaaccaa

SEQ ID NO: 8488587 - DNA, 22 bp, Homo sapiens
cctgggcctatcctagaaccaa

SEQ ID NO: 8488588 - DNA, 22 bp, Homo sapiens
cctgggcctcacccagctcttg

SEQ ID NO: 8488589 - DNA, 22 bp, Homo sapiens
cctgggcctcacccagctcttg

SEQ ID NO: 8488590 - DNA, 22 bp, Homo sapiens
cctgggcctcacccagctcttg

SEQ ID NO: 8488591 - DNA, 22 bp, Homo sapiens
tgtggggatcttctagcttttc

SEQ ID NO: 8488592 - DNA, 22 bp, Homo sapiens
tgtggggcttacaaaggcagat

SEQ ID NO: 8488593 - DNA, 22 bp, Homo sapiens
tgtggggctgtggtgttcttct

SEQ ID NO: 8488594 - DNA, 22 bp, Homo sapiens
tgtgggggtacacgtacacatg

SEQ ID NO: 8488595 - DNA, 22 bp, Homo sapiens
tgtgtctgtcctcggttgatgc

SEQ ID NO: 8488596 - DNA, 22 bp, Homo sapiens
tgtgggggtacacgtacacatg

SEQ ID NO: 8488597 - DNA, 22 bp, Homo sapiens
tgtgtgggcgaagacagccttt

SEQ ID NO: 8488598 - DNA, 22 bp, Homo sapiens
tgtgtgggcatgcttttaattt

SEQ ID NO: 8488599 - DNA, 22 bp, Homo sapiens
tgtgtgggtacagatgattgtt

SEQ ID NO: 8488600 - DNA, 22 bp, Homo sapiens
tgtgtgggtacagatgattgtt

SEQ ID NO: 8488601 - DNA, 22 bp, Homo sapiens
tgtgtgggtggtaaggaaggcc

SEQ ID NO: 8488602 - DNA, 21 bp, Homo sapiens
tgtgtgggcatatctgctgca

SEQ ID NO: 8488603 - DNA, 22 bp, Homo sapiens
tgtgtctgtcctcggttgatgc

SEQ ID NO: 8488604 - DNA, 22 bp, Homo sapiens
tgtgtctgtgtatacacggcat

SEQ ID NO: 8488605 - DNA, 23 bp, Homo sapiens
tgtgtctgtttagggaggatgtg

SEQ ID NO: 8488606 - DNA, 22 bp, Homo sapiens
cctgggcagcctgctcaaggac

SEQ ID NO: 8488607 - DNA, 22 bp, Homo sapiens
cctgggcatcaacaagcagaga

SEQ ID NO: 8488608 - DNA, 22 bp, Homo sapiens
cctgggcatcaacaagcagaga

SEQ ID NO: 8488609 - DNA, 22 bp, Homo sapiens
cctgggcatcaacaagcagaga

SEQ ID NO: 8488610 - DNA, 22 bp, Homo sapiens
cctgggaggcggaggttgcagt

SEQ ID NO: 8488611 - DNA, 22 bp, Homo sapiens
cctgggcaatatagtgaggccc

SEQ ID NO: 8488612 - DNA, 22 bp, Homo sapiens
cctgggcaatatagtgaggccc

SEQ ID NO: 8488613 - DNA, 22 bp, Homo sapiens
cctgggcaatatagtgaggccc

SEQ ID NO: 8488614 - DNA, 22 bp, Homo sapiens
cctgggcagcctgctcaaggac

SEQ ID NO: 8488615 - DNA, 22 bp, Homo sapiens
cctgggaggcggaggttgcagt

SEQ ID NO: 8488616 - DNA, 22 bp, Homo sapiens
cctgggaggcggaggttgcagg

SEQ ID NO: 8488617 - DNA, 19 bp, Homo sapiens
cctgggaggcggaggttgc

SEQ ID NO: 8488618 - DNA, 22 bp, Homo sapiens
cctgggaggcggaggttgcagg

SEQ ID NO: 8488619 - DNA, 22 bp, Homo sapiens
cctgggccaggcttgggaatgc

SEQ ID NO: 8488620 - DNA, 21 bp, Homo sapiens
cctgggccaaattccctggac

SEQ ID NO: 8488621 - DNA, 22 bp, Homo sapiens
cctgggccaggcttgggaatgc

SEQ ID NO: 8488622 - DNA, 22 bp, Homo sapiens
cctgggccctcaccgccggtgg

SEQ ID NO: 8488623 - DNA, 22 bp, Homo sapiens
cctgggccctcaccgccggtgg

SEQ ID NO: 8488624 - DNA, 22 bp, Homo sapiens
cctgggcctatcctagaaccaa

SEQ ID NO: 8488625 - DNA, 22 bp, Homo sapiens
cctgggcatctcatgcacctgc

SEQ ID NO: 8488626 - DNA, 22 bp, Homo sapiens
cctgggcatctcatgcacctgc

SEQ ID NO: 8488627 - DNA, 22 bp, Homo sapiens
cctgggcatctcatgcacctgc

SEQ ID NO: 8488628 - DNA, 22 bp, Homo sapiens
cctgggcattctttgagttctc

SEQ ID NO: 8488629 - DNA, 22 bp, Homo sapiens
cctgggcatctcatgcacctgc

SEQ ID NO: 8488630 - DNA, 23 bp, Homo sapiens
cctgggcattggctgcagcttct

SEQ ID NO: 8488631 - DNA, 23 bp, Homo sapiens
cctgggcattggctgcagcttct

SEQ ID NO: 8488632 - DNA, 21 bp, Homo sapiens
cctgggccaaattccctggac

SEQ ID NO: 8488633 - DNA, 21 bp, Homo sapiens
cctgggccaaattccctggac

SEQ ID NO: 8488634 - DNA, 22 bp, Homo sapiens
tgtggctgtgccgtcacacgtg

SEQ ID NO: 8488635 - DNA, 22 bp, Homo sapiens
tgtggctgtggatgctttccag

SEQ ID NO: 8488636 - DNA, 22 bp, Homo sapiens
tgtggctgtgtccacctgctgc

SEQ ID NO: 8488637 - DNA, 22 bp, Homo sapiens
tgtggctgtgtccacctgctgc

SEQ ID NO: 8488638 - DNA, 22 bp, Homo sapiens
tgtggctgtggttttcataaat

SEQ ID NO: 8488639 - DNA, 22 bp, Homo sapiens
tgtggctgtctgttctcctagg

SEQ ID NO: 8488640 - DNA, 22 bp, Homo sapiens
tgtggctggtctccgagcgtcg

SEQ ID NO: 8488641 - DNA, 22 bp, Homo sapiens
tgtggctgtctgttctcctagg

SEQ ID NO: 8488642 - DNA, 18 bp, Homo sapiens
tgtggctggtccacactg

SEQ ID NO: 8488643 - DNA, 22 bp, Homo sapiens
tgtggctgggctaataggcaaa

SEQ ID NO: 8488644 - DNA, 22 bp, Homo sapiens
tgtggctgggaagaaggtaact

SEQ ID NO: 8488645 - DNA, 15 bp, Homo sapiens
tgtggctggctcctg

SEQ ID NO: 8488646 - DNA, 22 bp, Homo sapiens
tgtggctggattgattttacct

SEQ ID NO: 8488647 - DNA, 22 bp, Homo sapiens
tgtggctgctcctgggtggtca

SEQ ID NO: 8488648 - DNA, 17 bp, Homo sapiens
cctgggaggagttatga

SEQ ID NO: 8488649 - DNA, 22 bp, Homo sapiens
cctgggaggcagaggttgcagt

SEQ ID NO: 8488650 - DNA, 22 bp, Homo sapiens
cctgggaggcagaggttgcagt

SEQ ID NO: 8488651 - DNA, 19 bp, Homo sapiens
cctgggaggcggaggttgc

SEQ ID NO: 8488652 - DNA, 22 bp, Homo sapiens
cctgggagctgtggaaaggctg

SEQ ID NO: 8488653 - DNA, 22 bp, Homo sapiens
cctgggagctgtggaaaggctg

SEQ ID NO: 8488654 - DNA, 22 bp, Homo sapiens
tgtgggaaatgggagtggaaga

SEQ ID NO: 8488655 - DNA, 22 bp, Homo sapiens
tgtggctgttgaggaccccaag

SEQ ID NO: 8488656 - DNA, 22 bp, Homo sapiens
tgtggcttttgctagctttgca

SEQ ID NO: 8488657 - DNA, 22 bp, Homo sapiens
tgtggcttaagaatgcctttaa

SEQ ID NO: 8488658 - DNA, 22 bp, Homo sapiens
tgtggcttccacgatggtcacc

SEQ ID NO: 8488659 - DNA, 22 bp, Homo sapiens
tgtggcttttgctagctttgca

SEQ ID NO: 8488660 - DNA, 22 bp, Homo sapiens
tgtgcttttctctgctcctgga

SEQ ID NO: 8488661 - DNA, 22 bp, Homo sapiens
tgtgctttggttttacaggatg

SEQ ID NO: 8488662 - DNA, 20 bp, Homo sapiens
tgtggaaaaacagaagcaga

SEQ ID NO: 8488663 - DNA, 22 bp, Homo sapiens
tgtggcaggaagagcttctgag

SEQ ID NO: 8488664 - DNA, 22 bp, Homo sapiens
tgtggaaaaaccacaagtttgg

SEQ ID NO: 8488665 - DNA, 22 bp, Homo sapiens
tgtggcagctggaggtggagaa

SEQ ID NO: 8488666 - DNA, 22 bp, Homo sapiens
tgtggcagctggaggtggagaa

SEQ ID NO: 8488667 - DNA, 22 bp, Homo sapiens
tgtggcagggcgtgacatttgg

SEQ ID NO: 8488668 - DNA, 22 bp, Homo sapiens
tgtggcaggctaggctttttgg

SEQ ID NO: 8488669 - DNA, 18 bp, Homo sapiens
tgtggcaggggtgggaga

SEQ ID NO: 8488670 - DNA, 21 bp, Homo sapiens
tgtggctgcctctggccctgg

SEQ ID NO: 8488671 - DNA, 22 bp, Homo sapiens
tgtggctgctcaggtgcagacc

SEQ ID NO: 8488672 - DNA, 22 bp, Homo sapiens
tgtggctgctcaggtgcagacc

SEQ ID NO: 8488673 - DNA, 22 bp, Homo sapiens
cctggcttttgtttataaattc

SEQ ID NO: 8488674 - DNA, 20 bp, Homo sapiens
cctggctttgcatctgtgat

SEQ ID NO: 8488675 - DNA, 20 bp, Homo sapiens
cctggctttgcatctgtgat

SEQ ID NO: 8488676 - DNA, 22 bp, Homo sapiens
cctgggaaagtgaggtcattat

SEQ ID NO: 8488677 - DNA, 22 bp, Homo sapiens
cctggcttctgggtctgtgaga

SEQ ID NO: 8488678 - DNA, 22 bp, Homo sapiens
cctggcttcctggagctcacaa

SEQ ID NO: 8488679 - DNA, 18 bp, Homo sapiens
cctggcttccatcttggt

SEQ ID NO: 8488680 - DNA, 21 bp, Homo sapiens
cctggcttcagggtgcactgg

SEQ ID NO: 8488681 - DNA, 22 bp, Homo sapiens
cctggctgtgtgaccttggcaa

SEQ ID NO: 8488682 - DNA, 22 bp, Homo sapiens
cctggctgtggcggtgctctca

SEQ ID NO: 8488683 - DNA, 22 bp, Homo sapiens
cctggctgtggcggtgctctca

SEQ ID NO: 8488684 - DNA, 23 bp, Homo sapiens
cctggctgtggatttgggcctgc

SEQ ID NO: 8488685 - DNA, 22 bp, Homo sapiens
cctggctgtggcggtgctctca

SEQ ID NO: 8488686 - DNA, 19 bp, Homo sapiens
cctggctgtgaagcctgca

SEQ ID NO: 8488687 - DNA, 19 bp, Homo sapiens
cctggctgtgaagcctgca

SEQ ID NO: 8488688 - DNA, 22 bp, Homo sapiens
cctggctgtgcattgccggccc

SEQ ID NO: 8488689 - DNA, 22 bp, Homo sapiens
cctggctgctgtcactgaccat

SEQ ID NO: 8488690 - DNA, 22 bp, Homo sapiens
cctggctgctctgatgagcgcc

SEQ ID NO: 8488691 - DNA, 22 bp, Homo sapiens
cctggctgctgtcactgaccat

SEQ ID NO: 8488692 - DNA, 22 bp, Homo sapiens
cctggctggttgtctgattcta

SEQ ID NO: 8488693 - DNA, 22 bp, Homo sapiens
cctggctgtcgttttgtgaaat

SEQ ID NO: 8488694 - DNA, 19 bp, Homo sapiens
cctggctgtgaagcctgca

SEQ ID NO: 8488695 - DNA, 22 bp, Homo sapiens
cctggctgctatagcagcatgt

SEQ ID NO: 8488696 - DNA, 22 bp, Homo sapiens
cctggctgctatagcagcatgt

SEQ ID NO: 8488697 - DNA, 22 bp, Homo sapiens
cctggctgccgagtgtgcagcg

SEQ ID NO: 8488698 - DNA, 22 bp, Homo sapiens
cctggctgccgagtgtgcagcg

SEQ ID NO: 8488699 - DNA, 22 bp, Homo sapiens
cctggctgccgagtgtgcagcg

SEQ ID NO: 8488700 - DNA, 22 bp, Homo sapiens
cctggctgcccatggaccctct

SEQ ID NO: 8488701 - DNA, 22 bp, Homo sapiens
cctggctgcccatggaccctct

SEQ ID NO: 8488702 - DNA, 22 bp, Homo sapiens
cctggctgcccatggaccctct

SEQ ID NO: 8488703 - DNA, 22 bp, Homo sapiens
cctggctgcattttgctggatg

SEQ ID NO: 8488704 - DNA, 22 bp, Homo sapiens
cctggctgcattttgctggatg

SEQ ID NO: 8488705 - DNA, 20 bp, Homo sapiens
cctggctgcattcaggacgg

SEQ ID NO: 8488706 - DNA, 20 bp, Homo sapiens
cctggctgcattcaggacgg

SEQ ID NO: 8488707 - DNA, 20 bp, Homo sapiens
tgtgcccaatgtccaggttc

SEQ ID NO: 8488708 - DNA, 22 bp, Homo sapiens
tgtgcccatccctctggagtgt

SEQ ID NO: 8488709 - DNA, 22 bp, Homo sapiens
tgtgcccatccctctggagtgt

SEQ ID NO: 8488710 - DNA, 22 bp, Homo sapiens
tgtgcccattacacagaggcat

SEQ ID NO: 8488711 - DNA, 22 bp, Homo sapiens
tgtgcccatctcccagcttgac

SEQ ID NO: 8488712 - DNA, 22 bp, Homo sapiens
tgtgcccatctcccagcttgac

SEQ ID NO: 8488713 - DNA, 22 bp, Homo sapiens
tgtgcccatccctctggagtgt

SEQ ID NO: 8488714 - DNA, 22 bp, Homo sapiens
tgtgccagtcatccagatgtgt

SEQ ID NO: 8488715 - DNA, 22 bp, Homo sapiens
tgtgccatctgatataagagcc

SEQ ID NO: 8488716 - DNA, 22 bp, Homo sapiens
tgtgccatttctattctgcagc

SEQ ID NO: 8488717 - DNA, 20 bp, Homo sapiens
tgtgcccaatgtccaggttc

SEQ ID NO: 8488718 - DNA, 22 bp, Homo sapiens
tgtgcccaacgtgcaggtttgt

SEQ ID NO: 8488719 - DNA, 22 bp, Homo sapiens
tgtgccatgaggctctgatatg

SEQ ID NO: 8488720 - DNA, 22 bp, Homo sapiens
tgtgccattgagaggtttcaga

SEQ ID NO: 8488721 - DNA, 23 bp, Homo sapiens
tgtgccattgaggctgaggctca

SEQ ID NO: 8488722 - DNA, 22 bp, Homo sapiens
tgtgcttctctttctcacttaa

SEQ ID NO: 8488723 - DNA, 22 bp, Homo sapiens
tgtgcttctgcagagactattt

SEQ ID NO: 8488724 - DNA, 22 bp, Homo sapiens
tgtgcttctgcagagactattt

SEQ ID NO: 8488725 - DNA, 22 bp, Homo sapiens
tgtgcttcttgcagctcctgta

SEQ ID NO: 8488726 - DNA, 22 bp, Homo sapiens
tgtgcttctcacatcactgttg

SEQ ID NO: 8488727 - DNA, 22 bp, Homo sapiens
tgtgcttcatcacttctcagtt

SEQ ID NO: 8488728 - DNA, 22 bp, Homo sapiens
tgtgcttactttgaattatata

SEQ ID NO: 8488729 - DNA, 22 bp, Homo sapiens
tgtgctgtgggactcaggctcc

SEQ ID NO: 8488730 - DNA, 22 bp, Homo sapiens
tgtgctggtacatgtgaggatg

SEQ ID NO: 8488731 - DNA, 22 bp, Homo sapiens
tgtgcccattacacagaggcat

SEQ ID NO: 8488732 - DNA, 22 bp, Homo sapiens
tgtgcccattccacttgagtac

SEQ ID NO: 8488733 - DNA, 22 bp, Homo sapiens
cctgggaagcccatagcagctt

SEQ ID NO: 8488734 - DNA, 22 bp, Homo sapiens
cctgggaagagctgacaggagg

SEQ ID NO: 8488735 - DNA, 21 bp, Homo sapiens
cctgggagaattgggtgtggc

SEQ ID NO: 8488736 - DNA, 22 bp, Homo sapiens
cctgggagagccatctgtggcc

SEQ ID NO: 8488737 - DNA, 22 bp, Homo sapiens
cctgggagagtctgtggtctcc

SEQ ID NO: 8488738 - DNA, 22 bp, Homo sapiens
cctgggagagtctgtggtctcc

SEQ ID NO: 8488739 - DNA, 22 bp, Homo sapiens
cctgggagagtctgtggtctcc

SEQ ID NO: 8488740 - DNA, 22 bp, Homo sapiens
cctgggagagtctgtggtctcc

SEQ ID NO: 8488741 - DNA, 22 bp, Homo sapiens
cctgggagagtctgtggtctcc

SEQ ID NO: 8488742 - DNA, 21 bp, Homo sapiens
cctgggagatcagctgccttc

SEQ ID NO: 8488743 - DNA, 22 bp, Homo sapiens
cctgggagagccatctgtggcc

SEQ ID NO: 8488744 - DNA, 22 bp, Homo sapiens
cctgggagagccatctgtggcc

SEQ ID NO: 8488745 - DNA, 22 bp, Homo sapiens
cctgggagagctgcccgggtga

SEQ ID NO: 8488746 - DNA, 22 bp, Homo sapiens
cctgggagccaagcctctgtgt

SEQ ID NO: 8488747 - DNA, 22 bp, Homo sapiens
cctgggagccaagcctctgtgt

SEQ ID NO: 8488748 - DNA, 22 bp, Homo sapiens
cctgggagccaagcctctgtgt

SEQ ID NO: 8488749 - DNA, 22 bp, Homo sapiens
cctgggagccaagcctctgtgt

SEQ ID NO: 8488750 - DNA, 22 bp, Homo sapiens
cctgggagccaagcctctgtgt

SEQ ID NO: 8488751 - DNA, 22 bp, Homo sapiens
cctgggagccgactgactgtgc

SEQ ID NO: 8488752 - DNA, 21 bp, Homo sapiens
cctgggagatcagctgccttc

SEQ ID NO: 8488753 - DNA, 21 bp, Homo sapiens
cctgggagatcagctgccttc

SEQ ID NO: 8488754 - DNA, 21 bp, Homo sapiens
cctgggagatcagctgccttc

SEQ ID NO: 8488755 - DNA, 21 bp, Homo sapiens
cctgggagatcagctgccttc

SEQ ID NO: 8488756 - DNA, 21 bp, Homo sapiens
cctgggagatcagctgccttc

SEQ ID NO: 8488757 - DNA, 21 bp, Homo sapiens
cctgggagatcagctgccttc

SEQ ID NO: 8488758 - DNA, 22 bp, Homo sapiens
tgtgccagcctctggctgtgtc

SEQ ID NO: 8488759 - DNA, 22 bp, Homo sapiens
tgtgccagcctctggctgtgtc

SEQ ID NO: 8488760 - DNA, 22 bp, Homo sapiens
tgtgccaggcacttgcccaggc

SEQ ID NO: 8488761 - DNA, 22 bp, Homo sapiens
tgtgccaggcacttgcccaggc

SEQ ID NO: 8488762 - DNA, 22 bp, Homo sapiens
cctgggagccgactgactgtgc

SEQ ID NO: 8488763 - DNA, 22 bp, Homo sapiens
cctgggagctgtggaaaggctg

SEQ ID NO: 8488764 - DNA, 22 bp, Homo sapiens
cctgggagccgactgactgtgc

SEQ ID NO: 8488765 - DNA, 22 bp, Homo sapiens
tgtgccagaaaatatgctgagg

SEQ ID NO: 8488766 - DNA, 22 bp, Homo sapiens
tgtgccagaaaatatgctgagg

SEQ ID NO: 8488767 - DNA, 22 bp, Homo sapiens
tgtgccagaatgtttttataca

SEQ ID NO: 8488768 - DNA, 22 bp, Homo sapiens
tgtgaggcctagacagcctggg

SEQ ID NO: 8488769 - DNA, 22 bp, Homo sapiens
tgtgaggcctctgcaggagcag

SEQ ID NO: 8488770 - DNA, 22 bp, Homo sapiens
tgtgaggcctagacagcctggg

SEQ ID NO: 8488771 - DNA, 21 bp, Homo sapiens
cctggctgcacagttgctggt

SEQ ID NO: 8488772 - DNA, 22 bp, Homo sapiens
tgtgaggcgaggccagtgagct

SEQ ID NO: 8488773 - DNA, 22 bp, Homo sapiens
tgtgaggctacctgccagggtc

SEQ ID NO: 8488774 - DNA, 23 bp, Homo sapiens
tgtgaaggtgggtccaagggctg

SEQ ID NO: 8488775 - DNA, 22 bp, Homo sapiens
tgtgagcttaggacagggctat

SEQ ID NO: 8488776 - DNA, 22 bp, Homo sapiens
tgtgaggagaggcccagctccc

SEQ ID NO: 8488777 - DNA, 22 bp, Homo sapiens
tgtgaggacctcagcagagtct

SEQ ID NO: 8488778 - DNA, 22 bp, Homo sapiens
tgtgaaggtaaggaggggcaag

SEQ ID NO: 8488779 - DNA, 22 bp, Homo sapiens
tgtgaaggcagcagctctgtcc

SEQ ID NO: 8488780 - DNA, 22 bp, Homo sapiens
tgtgaaggagatgaagggagtg

SEQ ID NO: 8488781 - DNA, 22 bp, Homo sapiens
tgtgaaggagatgaagggagtg

SEQ ID NO: 8488782 - DNA, 22 bp, Homo sapiens
tgtgaaggagcatgcagagggg

SEQ ID NO: 8488783 - DNA, 22 bp, Homo sapiens
tgtgaagcatagattctgtaga

SEQ ID NO: 8488784 - DNA, 22 bp, Homo sapiens
tgtgaagcatagattctgtaga

SEQ ID NO: 8488785 - DNA, 22 bp, Homo sapiens
tgtgaagctggatcctggagct

SEQ ID NO: 8488786 - DNA, 22 bp, Homo sapiens
tgtgaagatcagggtcctagag

SEQ ID NO: 8488787 - DNA, 22 bp, Homo sapiens
tgtgaagatttggcatgcagaa

SEQ ID NO: 8488788 - DNA, 21 bp, Homo sapiens
tgtctttggcctcattcccag

SEQ ID NO: 8488789 - DNA, 18 bp, Homo sapiens
tgtctttggaccactgaa

SEQ ID NO: 8488790 - DNA, 18 bp, Homo sapiens
tgtctttggaccactgaa

SEQ ID NO: 8488791 - DNA, 22 bp, Homo sapiens
tgtctttggaatatttagctga

SEQ ID NO: 8488792 - DNA, 22 bp, Homo sapiens
tgtctttggaatatttagctga

SEQ ID NO: 8488793 - DNA, 22 bp, Homo sapiens
tgtgaagaattaatgtgaatca

SEQ ID NO: 8488794 - DNA, 22 bp, Homo sapiens
tgtgaacttactgtccccacag

SEQ ID NO: 8488795 - DNA, 22 bp, Homo sapiens
tgtgaacttaagattccttatc

SEQ ID NO: 8488796 - DNA, 22 bp, Homo sapiens
tgtgaagaattaatgtgaatca

SEQ ID NO: 8488797 - DNA, 22 bp, Homo sapiens
tgtctttagttttactgtctgg

SEQ ID NO: 8488798 - DNA, 23 bp, Homo sapiens
tgtctttgaatgggctgtagaca

SEQ ID NO: 8488799 - DNA, 22 bp, Homo sapiens
tgtctttctgcaccacctcaca

SEQ ID NO: 8488800 - DNA, 21 bp, Homo sapiens
cctggctgcacagttgctggt

SEQ ID NO: 8488801 - DNA, 22 bp, Homo sapiens
tgtctggggaactgtgcatcca

SEQ ID NO: 8488802 - DNA, 21 bp, Homo sapiens
cctggctgcacagttgctggt

SEQ ID NO: 8488803 - DNA, 23 bp, Homo sapiens
tgtctggggcgccagaagagaga

SEQ ID NO: 8488804 - DNA, 22 bp, Homo sapiens
tgtctgggtcacccctcctggc

SEQ ID NO: 8488805 - DNA, 22 bp, Homo sapiens
tgtctggtgggttgacaggcag

SEQ ID NO: 8488806 - DNA, 22 bp, Homo sapiens
cctggctgagggacctcgggta

SEQ ID NO: 8488807 - DNA, 22 bp, Homo sapiens
cctggctgaggggccaaggacc

SEQ ID NO: 8488808 - DNA, 19 bp, Homo sapiens
cctggctctgagcccagcc

SEQ ID NO: 8488809 - DNA, 19 bp, Homo sapiens
cctggctctgagcccagcc

SEQ ID NO: 8488810 - DNA, 22 bp, Homo sapiens
cctggctcttcgggagtttgtt

SEQ ID NO: 8488811 - DNA, 22 bp, Homo sapiens
cctggctgaaccaatgaagtgg

SEQ ID NO: 8488812 - DNA, 23 bp, Homo sapiens
cctggctgacctgaaggtgtagt

SEQ ID NO: 8488813 - DNA, 23 bp, Homo sapiens
cctggctgacctgaaggtgtagt

SEQ ID NO: 8488814 - DNA, 22 bp, Homo sapiens
cctggctgaacaaagtccctcc

SEQ ID NO: 8488815 - DNA, 22 bp, Homo sapiens
cctggctgaacaaagtccctcc

SEQ ID NO: 8488816 - DNA, 22 bp, Homo sapiens
tgtctttagttgcttagatttg

SEQ ID NO: 8488817 - DNA, 22 bp, Homo sapiens
tgtctttagttgcttagatttg

SEQ ID NO: 8488818 - DNA, 22 bp, Homo sapiens
tgtctttagccagcagtcttct

SEQ ID NO: 8488819 - DNA, 22 bp, Homo sapiens
tgtctgtctttagtgagattgc

SEQ ID NO: 8488820 - DNA, 22 bp, Homo sapiens
tgtctttacttaataaatatac

SEQ ID NO: 8488821 - DNA, 22 bp, Homo sapiens
tgtctttacttagaagttcagg

SEQ ID NO: 8488822 - DNA, 22 bp, Homo sapiens
tgtctttacttagaagttcagg

SEQ ID NO: 8488823 - DNA, 22 bp, Homo sapiens
tgtctttagaaagaagcagaca

SEQ ID NO: 8488824 - DNA, 22 bp, Homo sapiens
tgtctgtaatagtcactatgtg

SEQ ID NO: 8488825 - DNA, 22 bp, Homo sapiens
tgtctgtaaggtgtttatgtta

SEQ ID NO: 8488826 - DNA, 22 bp, Homo sapiens
tgtctgtacaaattttctgtgt

SEQ ID NO: 8488827 - DNA, 22 bp, Homo sapiens
tgtctgtacaaattttctgtgt

SEQ ID NO: 8488828 - DNA, 23 bp, Homo sapiens
tgtctggtttcttttatttagca

SEQ ID NO: 8488829 - DNA, 22 bp, Homo sapiens
tgtctggtgggttgacaggcag

SEQ ID NO: 8488830 - DNA, 22 bp, Homo sapiens
tgtctggtgggttgacaggcag

SEQ ID NO: 8488831 - DNA, 22 bp, Homo sapiens
tgtctggtgggttgacaggcag

SEQ ID NO: 8488832 - DNA, 22 bp, Homo sapiens
tgtctgtatatcacttttgtcc

SEQ ID NO: 8488833 - DNA, 22 bp, Homo sapiens
tgtctgtcagatattaagtttc

SEQ ID NO: 8488834 - DNA, 22 bp, Homo sapiens
tgtctgtattgaggtgcatatt

SEQ ID NO: 8488835 - DNA, 17 bp, Homo sapiens
tgtctgtcatcagttcc

SEQ ID NO: 8488836 - DNA, 22 bp, Homo sapiens
tgtctcatctcttaaccccact

SEQ ID NO: 8488837 - DNA, 22 bp, Homo sapiens
tgtctctggcccatgagcagag

SEQ ID NO: 8488838 - DNA, 22 bp, Homo sapiens
tgtctctggcccatgagcagag

SEQ ID NO: 8488839 - DNA, 22 bp, Homo sapiens
tgtctcatctcttaaccccact

SEQ ID NO: 8488840 - DNA, 22 bp, Homo sapiens
tgtctcagttcccttctctgga

SEQ ID NO: 8488841 - DNA, 22 bp, Homo sapiens
tgtctcatctcttaaccccact

SEQ ID NO: 8488842 - DNA, 22 bp, Homo sapiens
tgtctcagtacactccgatgtt

SEQ ID NO: 8488843 - DNA, 19 bp, Homo sapiens
tgtctcagtgtcccttcct

SEQ ID NO: 8488844 - DNA, 22 bp, Homo sapiens
tgtctctgggtgattcagtcct

SEQ ID NO: 8488845 - DNA, 22 bp, Homo sapiens
tgtctctgggtgattcagtcct

SEQ ID NO: 8488846 - DNA, 22 bp, Homo sapiens
tgtctctgtctcccaggttgtg

SEQ ID NO: 8488847 - DNA, 22 bp, Homo sapiens
tgtctctgtctcccaggttgtg

SEQ ID NO: 8488848 - DNA, 22 bp, Homo sapiens
tgtctctggtattaggtgaaaa

SEQ ID NO: 8488849 - DNA, 22 bp, Homo sapiens
tgtctctgtgactccttccgcc

SEQ ID NO: 8488850 - DNA, 22 bp, Homo sapiens
tgtctctgtgactccttccgcc

SEQ ID NO: 8488851 - DNA, 22 bp, Homo sapiens
tgtctctgtgactccttccgcc

SEQ ID NO: 8488852 - DNA, 22 bp, Homo sapiens
tgtctcttggctctatcactta

SEQ ID NO: 8488853 - DNA, 22 bp, Homo sapiens
tgtctcttggattgcttgctct

SEQ ID NO: 8488854 - DNA, 22 bp, Homo sapiens
tgtctcttggagggtctagtga

SEQ ID NO: 8488855 - DNA, 22 bp, Homo sapiens
tgtctcttgagctgcctgatgc

SEQ ID NO: 8488856 - DNA, 22 bp, Homo sapiens
tgtctcttctgcctccagctgt

SEQ ID NO: 8488857 - DNA, 22 bp, Homo sapiens
tgtctcttgagtttgttttaat

SEQ ID NO: 8488858 - DNA, 22 bp, Homo sapiens
tgtctctgtgcatttgtgcttc

SEQ ID NO: 8488859 - DNA, 22 bp, Homo sapiens
tgtctcttactttgattcttgg

SEQ ID NO: 8488860 - DNA, 22 bp, Homo sapiens
tgtctctgtgagatctgacgat

SEQ ID NO: 8488861 - DNA, 22 bp, Homo sapiens
tgtctctgtgcatttgtgcttc

SEQ ID NO: 8488862 - DNA, 22 bp, Homo sapiens
tgtctcttactttgattcttgg

SEQ ID NO: 8488863 - DNA, 22 bp, Homo sapiens
tgtctcttcagcccatggcttc

SEQ ID NO: 8488864 - DNA, 22 bp, Homo sapiens
tgtctcttctgcctccagctgt

SEQ ID NO: 8488865 - DNA, 22 bp, Homo sapiens
tgtctcttcccactcagacccc

SEQ ID NO: 8488866 - DNA, 22 bp, Homo sapiens
tgtcctggacaacagcccctag

SEQ ID NO: 8488867 - DNA, 22 bp, Homo sapiens
tgtcctggaaaaatggagagtt

SEQ ID NO: 8488868 - DNA, 22 bp, Homo sapiens
tgtcctggaaaaatggagagtt

SEQ ID NO: 8488869 - DNA, 22 bp, Homo sapiens
tgtcctggagttataatgcctg

SEQ ID NO: 8488870 - DNA, 22 bp, Homo sapiens
tgtcctggagacacaaggtggt

SEQ ID NO: 8488871 - DNA, 22 bp, Homo sapiens
tgtcctggagtgcttgggggaa

SEQ ID NO: 8488872 - DNA, 22 bp, Homo sapiens
tgtcctcttccagtgctccttc

SEQ ID NO: 8488873 - DNA, 22 bp, Homo sapiens
tgtcctcttccagtgctccttc

SEQ ID NO: 8488874 - DNA, 22 bp, Homo sapiens
tgtcctctccaacagcctctgt

SEQ ID NO: 8488875 - DNA, 22 bp, Homo sapiens
tgtcctctccaacagcctctgt

SEQ ID NO: 8488876 - DNA, 22 bp, Homo sapiens
tgtcctgcaagccctaatgaat

SEQ ID NO: 8488877 - DNA, 22 bp, Homo sapiens
tgtctattaattccacataaaa

SEQ ID NO: 8488878 - DNA, 22 bp, Homo sapiens
tgtcctggatcatgcctctgaa

SEQ ID NO: 8488879 - DNA, 22 bp, Homo sapiens
tgtctatgtatacatgtgtata

SEQ ID NO: 8488880 - DNA, 22 bp, Homo sapiens
tgtctatttgaattatcctaat

SEQ ID NO: 8488881 - DNA, 21 bp, Homo sapiens
tgtctcaatcagaagtcatta

SEQ ID NO: 8488882 - DNA, 18 bp, Homo sapiens
tgtctcaggctgaaacag

SEQ ID NO: 8488883 - DNA, 22 bp, Homo sapiens
tgtctcaggcccaagccagtaa

SEQ ID NO: 8488884 - DNA, 22 bp, Homo sapiens
tgtctcagatacgccatcaagg

SEQ ID NO: 8488885 - DNA, 22 bp, Homo sapiens
tgtctcagaatggctcataata

SEQ ID NO: 8488886 - DNA, 22 bp, Homo sapiens
cctggctctagaggccactcct

SEQ ID NO: 8488887 - DNA, 22 bp, Homo sapiens
cctggctctctgcagatcctgg

SEQ ID NO: 8488888 - DNA, 22 bp, Homo sapiens
cctggctctctgcagatcctgg

SEQ ID NO: 8488889 - DNA, 22 bp, Homo sapiens
cctggctcctgcctctgcaggg

SEQ ID NO: 8488890 - DNA, 22 bp, Homo sapiens
cctggctcctgcctctgcaggg

SEQ ID NO: 8488891 - DNA, 22 bp, Homo sapiens
cctggctcgctgacctcagggg

SEQ ID NO: 8488892 - DNA, 22 bp, Homo sapiens
cctggctcgctgacctcagggg

SEQ ID NO: 8488893 - DNA, 22 bp, Homo sapiens
cctggctcctgcacagatcttt

SEQ ID NO: 8488894 - DNA, 22 bp, Homo sapiens
cctggctcctgcctctgcaggg

SEQ ID NO: 8488895 - DNA, 22 bp, Homo sapiens
cctggctcctgcctctgcaggg

SEQ ID NO: 8488896 - DNA, 22 bp, Homo sapiens
cctggctcctgcctctgcaggg

SEQ ID NO: 8488897 - DNA, 22 bp, Homo sapiens
cctggcctgtgaatctgagagc

SEQ ID NO: 8488898 - DNA, 22 bp, Homo sapiens
cctggcctgtgaatctgagagc

SEQ ID NO: 8488899 - DNA, 22 bp, Homo sapiens
cctggcctgtgaatctgagagc

SEQ ID NO: 8488900 - DNA, 22 bp, Homo sapiens
cctggcctgtgaatctgagagc

SEQ ID NO: 8488901 - DNA, 22 bp, Homo sapiens
cctggctccagctgcctgtcct

SEQ ID NO: 8488902 - DNA, 22 bp, Homo sapiens
cctggctccagctgcctgtcct

SEQ ID NO: 8488903 - DNA, 22 bp, Homo sapiens
cctggcctcagcctagggctga

SEQ ID NO: 8488904 - DNA, 22 bp, Homo sapiens
cctggcctcctggccttctcat

SEQ ID NO: 8488905 - DNA, 22 bp, Homo sapiens
cctggcctcgtgctcacggctc

SEQ ID NO: 8488906 - DNA, 19 bp, Homo sapiens
cctggccctgctgcgcggg

SEQ ID NO: 8488907 - DNA, 19 bp, Homo sapiens
cctggccctgctgcgcggg

SEQ ID NO: 8488908 - DNA, 22 bp, Homo sapiens
cctggcagtggtgaagaagagg

SEQ ID NO: 8488909 - DNA, 22 bp, Homo sapiens
cctggcagttttgcccaggatt

SEQ ID NO: 8488910 - DNA, 22 bp, Homo sapiens
cctggcagttttgcccaggatt

SEQ ID NO: 8488911 - DNA, 22 bp, Homo sapiens
cctggcagttttgcccaggatt

SEQ ID NO: 8488912 - DNA, 22 bp, Homo sapiens
cctggcatgtcctcctggcatg

SEQ ID NO: 8488913 - DNA, 22 bp, Homo sapiens
cctggccagccagggctggggt

SEQ ID NO: 8488914 - DNA, 22 bp, Homo sapiens
cctggccagcgccggctgctcg

SEQ ID NO: 8488915 - DNA, 22 bp, Homo sapiens
cctggccagcgccggctgctcg

SEQ ID NO: 8488916 - DNA, 22 bp, Homo sapiens
cctggccaggcatggagtcaca

SEQ ID NO: 8488917 - DNA, 22 bp, Homo sapiens
cctggccaggcatggagtcaca

SEQ ID NO: 8488918 - DNA, 22 bp, Homo sapiens
cctggccagggtctgggctgct

SEQ ID NO: 8488919 - DNA, 22 bp, Homo sapiens
cctggccagggtctgggctgct

SEQ ID NO: 8488920 - DNA, 22 bp, Homo sapiens
cctggccagggtctgggctgct

SEQ ID NO: 8488921 - DNA, 22 bp, Homo sapiens
tgtccagtccttggggtgctgt

SEQ ID NO: 8488922 - DNA, 22 bp, Homo sapiens
tgtccaggttagcttcaaacac

SEQ ID NO: 8488923 - DNA, 22 bp, Homo sapiens
tgtccagtgattctcatgagcc

SEQ ID NO: 8488924 - DNA, 22 bp, Homo sapiens
tgtccagtgattctcatgagcc

SEQ ID NO: 8488925 - DNA, 17 bp, Homo sapiens
tgtccatttgcctggag

SEQ ID NO: 8488926 - DNA, 22 bp, Homo sapiens
tgtccatggagaagctcagggc

SEQ ID NO: 8488927 - DNA, 22 bp, Homo sapiens
tgtcctccagcagcatggtatg

SEQ ID NO: 8488928 - DNA, 22 bp, Homo sapiens
tgtcctcatcctccagtctgtc

SEQ ID NO: 8488929 - DNA, 22 bp, Homo sapiens
tgtcctcatcctccagtctgtc

SEQ ID NO: 8488930 - DNA, 22 bp, Homo sapiens
tgtcccagcactttgggagtct

SEQ ID NO: 8488931 - DNA, 22 bp, Homo sapiens
tgtcccagcactttgggagtct

SEQ ID NO: 8488932 - DNA, 22 bp, Homo sapiens
tgtcccagcactttgggagtct

SEQ ID NO: 8488933 - DNA, 19 bp, Homo sapiens
tgtcccagactccgtgtct

SEQ ID NO: 8488934 - DNA, 22 bp, Homo sapiens
tgtcccagacataagtggacat

SEQ ID NO: 8488935 - DNA, 22 bp, Homo sapiens
tgtcccagacataagtggacat

SEQ ID NO: 8488936 - DNA, 22 bp, Homo sapiens
tgtcccagacacagtatgcgct

SEQ ID NO: 8488937 - DNA, 22 bp, Homo sapiens
tgtcccactgacttcacatcca

SEQ ID NO: 8488938 - DNA, 23 bp, Homo sapiens
tgtcccagagggagggataggct

SEQ ID NO: 8488939 - DNA, 23 bp, Homo sapiens
tgtcccagagggagggataggct

SEQ ID NO: 8488940 - DNA, 22 bp, Homo sapiens
tgtcccagatactggacataga

SEQ ID NO: 8488941 - DNA, 22 bp, Homo sapiens
tgtcccagatactggacataga

SEQ ID NO: 8488942 - DNA, 22 bp, Homo sapiens
tgtcccagatactggacataga

SEQ ID NO: 8488943 - DNA, 22 bp, Homo sapiens
tgtcccagatcacaggagggga

SEQ ID NO: 8488944 - DNA, 22 bp, Homo sapiens
tgtcccagatcacaggagggga

SEQ ID NO: 8488945 - DNA, 22 bp, Homo sapiens
cctggcagactgtgagggcagg

SEQ ID NO: 8488946 - DNA, 22 bp, Homo sapiens
cctggcagactgtgagggcagg

SEQ ID NO: 8488947 - DNA, 23 bp, Homo sapiens
cctggcagcaaacgaggaggtta

SEQ ID NO: 8488948 - DNA, 22 bp, Homo sapiens
tgtcattagtttcagccattct

SEQ ID NO: 8488949 - DNA, 22 bp, Homo sapiens
tgtcattatgaggattacaata

SEQ ID NO: 8488950 - DNA, 22 bp, Homo sapiens
tgtcattatttgcctactgact

SEQ ID NO: 8488951 - DNA, 22 bp, Homo sapiens
tgtcatgtttcatgtttgtagg

SEQ ID NO: 8488952 - DNA, 18 bp, Homo sapiens
cctggcagccatgcgcgc

SEQ ID NO: 8488953 - DNA, 18 bp, Homo sapiens
cctggcagccatgcgcgc

SEQ ID NO: 8488954 - DNA, 22 bp, Homo sapiens
cctggcagcattggtagagatt

SEQ ID NO: 8488955 - DNA, 22 bp, Homo sapiens
cctggcagcattggtagagatt

SEQ ID NO: 8488956 - DNA, 22 bp, Homo sapiens
cctggcagcaggtgggcccgtg

SEQ ID NO: 8488957 - DNA, 22 bp, Homo sapiens
cctggcagcagcacatgccttc

SEQ ID NO: 8488958 - DNA, 22 bp, Homo sapiens
cctggcagcagcacatgccttc

SEQ ID NO: 8488959 - DNA, 22 bp, Homo sapiens
cctggcagcagcacatgccttc

SEQ ID NO: 8488960 - DNA, 22 bp, Homo sapiens
cctggcagcaggtgggcccgtg

SEQ ID NO: 8488961 - DNA, 23 bp, Homo sapiens
cctggcagcaaacgaggaggtta

SEQ ID NO: 8488962 - DNA, 23 bp, Homo sapiens
cctggcagcaaacgaggaggtta

SEQ ID NO: 8488963 - DNA, 23 bp, Homo sapiens
cctggcagcaaacgaggaggtta

SEQ ID NO: 8488964 - DNA, 22 bp, Homo sapiens
cctggcagcagcacatgccttc

SEQ ID NO: 8488965 - DNA, 22 bp, Homo sapiens
cctggcaggtggaggttgcagt

SEQ ID NO: 8488966 - DNA, 22 bp, Homo sapiens
cctggcagtcaggggagtcctt

SEQ ID NO: 8488967 - DNA, 22 bp, Homo sapiens
cctggcagtcaggggagtcctt

SEQ ID NO: 8488968 - DNA, 22 bp, Homo sapiens
cctggcaggtggcgccctcggc

SEQ ID NO: 8488969 - DNA, 22 bp, Homo sapiens
cctggcaggtggcgccctcggc

SEQ ID NO: 8488970 - DNA, 22 bp, Homo sapiens
cctggcaggttacaaccagtta

SEQ ID NO: 8488971 - DNA, 22 bp, Homo sapiens
cctggcaggcccctcctggatt

SEQ ID NO: 8488972 - DNA, 22 bp, Homo sapiens
cctggcaggcaagaggaaggga

SEQ ID NO: 8488973 - DNA, 22 bp, Homo sapiens
cctggcaggctggggacagtgc

SEQ ID NO: 8488974 - DNA, 22 bp, Homo sapiens
cctggcaggctggggacagtgc

SEQ ID NO: 8488975 - DNA, 22 bp, Homo sapiens
cctggcaggctggggacagtgc

SEQ ID NO: 8488976 - DNA, 22 bp, Homo sapiens
tggtgccttgggcctacagcgc

SEQ ID NO: 8488977 - DNA, 22 bp, Homo sapiens
tggtgctgacagttctgagtgc

SEQ ID NO: 8488978 - DNA, 22 bp, Homo sapiens
tggtgctgataatggcaggatt

SEQ ID NO: 8488979 - DNA, 17 bp, Homo sapiens
cctgcccagagacagat

SEQ ID NO: 8488980 - DNA, 22 bp, Homo sapiens
tggtctttaaggtagctgtcat

SEQ ID NO: 8488981 - DNA, 17 bp, Homo sapiens
cctgcccagagacagat

SEQ ID NO: 8488982 - DNA, 22 bp, Homo sapiens
cctgcccactgcccggtcagcc

SEQ ID NO: 8488983 - DNA, 17 bp, Homo sapiens
cctgcccagagacagat

SEQ ID NO: 8488984 - DNA, 17 bp, Homo sapiens
cctgcccagagacagat

SEQ ID NO: 8488985 - DNA, 22 bp, Homo sapiens
cctgcccactccaggagcaact

SEQ ID NO: 8488986 - DNA, 22 bp, Homo sapiens
cctgcccacagagagggtgcat

SEQ ID NO: 8488987 - DNA, 22 bp, Homo sapiens
cctgcccacagagagggtgcat

SEQ ID NO: 8488988 - DNA, 22 bp, Homo sapiens
cctgccagtgaagctgacgggc

SEQ ID NO: 8488989 - DNA, 20 bp, Homo sapiens
tggtcctcacaggtcctccc

SEQ ID NO: 8488990 - DNA, 22 bp, Homo sapiens
tggtccctttctactgagcaca

SEQ ID NO: 8488991 - DNA, 22 bp, Homo sapiens
cctctgtgcctcgtgtcctctg

SEQ ID NO: 8488992 - DNA, 22 bp, Homo sapiens
cctctgtgcctcagtttcatgt

SEQ ID NO: 8488993 - DNA, 21 bp, Homo sapiens
cctctgtgctaaagggctccc

SEQ ID NO: 8488994 - DNA, 22 bp, Homo sapiens
cctctgtgctttgtccagcctc

SEQ ID NO: 8488995 - DNA, 22 bp, Homo sapiens
cctctgtgctttgtccagcctc

SEQ ID NO: 8488996 - DNA, 22 bp, Homo sapiens
cctctgtggccctgactctctt

SEQ ID NO: 8488997 - DNA, 22 bp, Homo sapiens
cctctgtgctttgtccagcctc

SEQ ID NO: 8488998 - DNA, 22 bp, Homo sapiens
tggtagggacactatgcagaaa

SEQ ID NO: 8488999 - DNA, 17 bp, Homo sapiens
tggtccaggtggagcca

SEQ ID NO: 8489000 - DNA, 22 bp, Homo sapiens
tggtccctgatctaatgtctca

SEQ ID NO: 8489001 - DNA, 22 bp, Homo sapiens
tggtccctgcctgccaagtgct

SEQ ID NO: 8489002 - DNA, 22 bp, Homo sapiens
tggtccatgtcctccatctctc

SEQ ID NO: 8489003 - DNA, 22 bp, Homo sapiens
tggtccagtttagcattgagtg

SEQ ID NO: 8489004 - DNA, 22 bp, Homo sapiens
tggtccctaaagatgtctacat

SEQ ID NO: 8489005 - DNA, 22 bp, Homo sapiens
tggtccctaaagatgtctacat

SEQ ID NO: 8489006 - DNA, 22 bp, Homo sapiens
cctggagacctgatggcagcgg

SEQ ID NO: 8489007 - DNA, 22 bp, Homo sapiens
cctggagacctgatggcagcgg

SEQ ID NO: 8489008 - DNA, 22 bp, Homo sapiens
cctggagacccacttctgccaa

SEQ ID NO: 8489009 - DNA, 22 bp, Homo sapiens
cctggagacctgatggcagcgg

SEQ ID NO: 8489010 - DNA, 22 bp, Homo sapiens
cctggagacgaggctggaccat

SEQ ID NO: 8489011 - DNA, 22 bp, Homo sapiens
cctggagacgaggctggaccat

SEQ ID NO: 8489012 - DNA, 22 bp, Homo sapiens
cctggagacgaggctggaccat

SEQ ID NO: 8489013 - DNA, 22 bp, Homo sapiens
cctggagacgaggctggaccat

SEQ ID NO: 8489014 - DNA, 22 bp, Homo sapiens
cctggagagagaggccaactgc

SEQ ID NO: 8489015 - DNA, 22 bp, Homo sapiens
cctggagagagaggccaactgc

SEQ ID NO: 8489016 - DNA, 22 bp, Homo sapiens
tgtaaacataccagagccaagt

SEQ ID NO: 8489017 - DNA, 22 bp, Homo sapiens
tgtaaacataccagagccaagt

SEQ ID NO: 8489018 - DNA, 22 bp, Homo sapiens
cctggagagagaggccaactgc

SEQ ID NO: 8489019 - DNA, 22 bp, Homo sapiens
tgtaaacagccccatggagagc

SEQ ID NO: 8489020 - DNA, 22 bp, Homo sapiens
cctggagagctcgggccaggca

SEQ ID NO: 8489021 - DNA, 22 bp, Homo sapiens
tgtaaacagccccatggagagc

SEQ ID NO: 8489022 - DNA, 22 bp, Homo sapiens
cctggagagctcgggccaggca

SEQ ID NO: 8489023 - DNA, 22 bp, Homo sapiens
cctggactgtgtcctgtggtca

SEQ ID NO: 8489024 - DNA, 22 bp, Homo sapiens
cctggacttgatattctctttc

SEQ ID NO: 8489025 - DNA, 22 bp, Homo sapiens
cctggactttcaggactactgt

SEQ ID NO: 8489026 - DNA, 21 bp, Homo sapiens
cctggagacaaagacagggtg

SEQ ID NO: 8489027 - DNA, 21 bp, Homo sapiens
cctggagacaaagacagggtg

SEQ ID NO: 8489028 - DNA, 22 bp, Homo sapiens
cctggactttcatttccccttg

SEQ ID NO: 8489029 - DNA, 21 bp, Homo sapiens
cctggagacaaagacagggtg

SEQ ID NO: 8489030 - DNA, 21 bp, Homo sapiens
cctggagacaaagacagggtg

SEQ ID NO: 8489031 - DNA, 21 bp, Homo sapiens
cctggagacaaagacagggtg

SEQ ID NO: 8489032 - DNA, 22 bp, Homo sapiens
cctggagaccagaggatacttc

SEQ ID NO: 8489033 - DNA, 22 bp, Homo sapiens
cctggagaccagaggatacttc

SEQ ID NO: 8489034 - DNA, 22 bp, Homo sapiens
cctggagaccagaggatacttc

SEQ ID NO: 8489035 - DNA, 22 bp, Homo sapiens
cctggagacccacttctgccaa

SEQ ID NO: 8489036 - DNA, 22 bp, Homo sapiens
cctggactcaggctgtgggcac

SEQ ID NO: 8489037 - DNA, 22 bp, Homo sapiens
cctggactcagaggtgctggtg

SEQ ID NO: 8489038 - DNA, 22 bp, Homo sapiens
cctggactgtgtcctgtggtca

SEQ ID NO: 8489039 - DNA, 21 bp, Homo sapiens
cctggactgggagcagcactg

SEQ ID NO: 8489040 - DNA, 22 bp, Homo sapiens
cctggaaacacatgatgatgaa

SEQ ID NO: 8489041 - DNA, 22 bp, Homo sapiens
tggtgggacatctgaggagagg

SEQ ID NO: 8489042 - DNA, 22 bp, Homo sapiens
tggtgctgtggaggggcagaag

SEQ ID NO: 8489043 - DNA, 22 bp, Homo sapiens
tggtgctgcctcagatgcctta

SEQ ID NO: 8489044 - DNA, 22 bp, Homo sapiens
tggtggctcacacctgtaatcc

SEQ ID NO: 8489045 - DNA, 22 bp, Homo sapiens
tggtggccgaagccctctctca

SEQ ID NO: 8489046 - DNA, 22 bp, Homo sapiens
tggtggccttgatggcatctgc

SEQ ID NO: 8489047 - DNA, 17 bp, Homo sapiens
tggtggctggagtcagg

SEQ ID NO: 8489048 - DNA, 17 bp, Homo sapiens
tggtggctggagtcagg

SEQ ID NO: 8489049 - DNA, 22 bp, Homo sapiens
tggtggctcacgtctgtaatct

SEQ ID NO: 8489050 - DNA, 22 bp, Homo sapiens
tggtggcttctgaggatggcga

SEQ ID NO: 8489051 - DNA, 23 bp, Homo sapiens
tggtggcttgtggtggccaccag

SEQ ID NO: 8489052 - DNA, 23 bp, Homo sapiens
tggtggcttgtggtggccaccag

SEQ ID NO: 8489053 - DNA, 22 bp, Homo sapiens
tggtggctgttgcagaactgag

SEQ ID NO: 8489054 - DNA, 22 bp, Homo sapiens
tggtggctgttgcagaactgag

SEQ ID NO: 8489055 - DNA, 22 bp, Homo sapiens
tggtggctgtaagggagagaag

SEQ ID NO: 8489056 - DNA, 22 bp, Homo sapiens
tggtggctgtaagggagagaag

SEQ ID NO: 8489057 - DNA, 17 bp, Homo sapiens
tggtggctggagtcagg

SEQ ID NO: 8489058 - DNA, 22 bp, Homo sapiens
tgtaggtctcagtgtctgagct

SEQ ID NO: 8489059 - DNA, 22 bp, Homo sapiens
tgtagggagaagagaggcacct

SEQ ID NO: 8489060 - DNA, 22 bp, Homo sapiens
tgtaggattttcaccagacctt

SEQ ID NO: 8489061 - DNA, 23 bp, Homo sapiens
tgtaggctaagtcccataaatca

SEQ ID NO: 8489062 - DNA, 22 bp, Homo sapiens
tgtaggctgaagatgaagtgga

SEQ ID NO: 8489063 - DNA, 23 bp, Homo sapiens
tgtaggctgtagtttgtaggtcc

SEQ ID NO: 8489064 - DNA, 22 bp, Homo sapiens
tgtaggagtccaatcaggagac

SEQ ID NO: 8489065 - DNA, 22 bp, Homo sapiens
tgtaggagtccaatcaggagac

SEQ ID NO: 8489066 - DNA, 22 bp, Homo sapiens
tgtaggaatgtttttaagttgg

SEQ ID NO: 8489067 - DNA, 22 bp, Homo sapiens
tgtaggaattccagtgacttca

SEQ ID NO: 8489068 - DNA, 22 bp, Homo sapiens
tgtaaagaaagacgcagagtta

SEQ ID NO: 8489069 - DNA, 22 bp, Homo sapiens
tgtaaagaaatagcatttgtag

SEQ ID NO: 8489070 - DNA, 22 bp, Homo sapiens
tgtaaagaaatagcatttgtag

SEQ ID NO: 8489071 - DNA, 22 bp, Homo sapiens
tgtaccactctactaagggttc

SEQ ID NO: 8489072 - DNA, 22 bp, Homo sapiens
tgtaccaagacaaatcagaaac

SEQ ID NO: 8489073 - DNA, 22 bp, Homo sapiens
tgtaccaaacccatcataacta

SEQ ID NO: 8489074 - DNA, 23 bp, Homo sapiens
tgtaccaggagtttcagcagact

SEQ ID NO: 8489075 - DNA, 23 bp, Homo sapiens
tgtaaacatcaccccctggagtt

SEQ ID NO: 8489076 - DNA, 22 bp, Homo sapiens
tgtaaacatatgtatgtatgta

SEQ ID NO: 8489077 - DNA, 22 bp, Homo sapiens
tgtaaacatatgtatgtatgta

SEQ ID NO: 8489078 - DNA, 22 bp, Homo sapiens
tgtaaacatatgtatgtatgta

SEQ ID NO: 8489079 - DNA, 22 bp, Homo sapiens
tgtaaaccagggtcatccttag

SEQ ID NO: 8489080 - DNA, 22 bp, Homo sapiens
tgtaaactgcttctcaccaagg

SEQ ID NO: 8489081 - DNA, 22 bp, Homo sapiens
cctggagaggcgctgcagagga

SEQ ID NO: 8489082 - DNA, 22 bp, Homo sapiens
cctggagaggcgctgcagagga

SEQ ID NO: 8489083 - DNA, 22 bp, Homo sapiens
cctggagaggcgctgcagagga

SEQ ID NO: 8489084 - DNA, 22 bp, Homo sapiens
cctggagaggcgctgcagagga

SEQ ID NO: 8489085 - DNA, 22 bp, Homo sapiens
cctggagagctcgggccaggca

SEQ ID NO: 8489086 - DNA, 22 bp, Homo sapiens
cctggagagctcgggccaggca

SEQ ID NO: 8489087 - DNA, 22 bp, Homo sapiens
cctggagaggagaaagggccca

SEQ ID NO: 8489088 - DNA, 22 bp, Homo sapiens
cctggagaggagaaagggccca

SEQ ID NO: 8489089 - DNA, 22 bp, Homo sapiens
cctggagaggagaaagggccca

SEQ ID NO: 8489090 - DNA, 22 bp, Homo sapiens
tgtagtccaggaattgtgtctg

SEQ ID NO: 8489091 - DNA, 22 bp, Homo sapiens
tgtagtagcattcacgaagtgt

SEQ ID NO: 8489092 - DNA, 22 bp, Homo sapiens
tgtagtagcattcacgaagtgt

SEQ ID NO: 8489093 - DNA, 22 bp, Homo sapiens
tgtagtaagtgcgcaataaata

SEQ ID NO: 8489094 - DNA, 22 bp, Homo sapiens
tgtagtgtgacataggtgtcca

SEQ ID NO: 8489095 - DNA, 22 bp, Homo sapiens
tgtagtgtggcctatctttgcc

SEQ ID NO: 8489096 - DNA, 22 bp, Homo sapiens
tgtagtgtgacataggtgtcca

SEQ ID NO: 8489097 - DNA, 22 bp, Homo sapiens
cctggagcaaaaatctaaggag

SEQ ID NO: 8489098 - DNA, 22 bp, Homo sapiens
cctggagcacagcccagtccca

SEQ ID NO: 8489099 - DNA, 22 bp, Homo sapiens
cctggagcacagcccagtccca

SEQ ID NO: 8489100 - DNA, 22 bp, Homo sapiens
cctggagcacagcccagtccca

SEQ ID NO: 8489101 - DNA, 22 bp, Homo sapiens
cctggagcacagcccagtccca

SEQ ID NO: 8489102 - DNA, 22 bp, Homo sapiens
cctggagatttcttcaagcttt

SEQ ID NO: 8489103 - DNA, 22 bp, Homo sapiens
cctggagatttcttcaagcttt

SEQ ID NO: 8489104 - DNA, 22 bp, Homo sapiens
cctggagatttcttcaagcttt

SEQ ID NO: 8489105 - DNA, 22 bp, Homo sapiens
cctggagcaaaaatctaaggag

SEQ ID NO: 8489106 - DNA, 22 bp, Homo sapiens
cctggagattatttggtccaat

SEQ ID NO: 8489107 - DNA, 22 bp, Homo sapiens
cctggagattatttggtccaat

SEQ ID NO: 8489108 - DNA, 22 bp, Homo sapiens
cctggagattatttggtccaat

SEQ ID NO: 8489109 - DNA, 22 bp, Homo sapiens
cctggagattatttggtccaat

SEQ ID NO: 8489110 - DNA, 22 bp, Homo sapiens
cctggaggtggaggttgcagtg

SEQ ID NO: 8489111 - DNA, 22 bp, Homo sapiens
cctggaggtggaggttgcagtg

SEQ ID NO: 8489112 - DNA, 22 bp, Homo sapiens
cctggagcacatggcaggaggc

SEQ ID NO: 8489113 - DNA, 22 bp, Homo sapiens
tgtatgtatgtatgtatttggg

SEQ ID NO: 8489114 - DNA, 22 bp, Homo sapiens
tgtatgtgcttgagaaggtggg

SEQ ID NO: 8489115 - DNA, 22 bp, Homo sapiens
tgtatgtgcaatgtttatatgt

SEQ ID NO: 8489116 - DNA, 22 bp, Homo sapiens
tgtatgtgtatgtacatatgca

SEQ ID NO: 8489117 - DNA, 22 bp, Homo sapiens
tgtatgtgtatgtacatatgca

SEQ ID NO: 8489118 - DNA, 22 bp, Homo sapiens
tgtatgtgcttgagaaggtggg

SEQ ID NO: 8489119 - DNA, 22 bp, Homo sapiens
tgtatgtggctacttttcttgc

SEQ ID NO: 8489120 - DNA, 22 bp, Homo sapiens
tgtatgtgtcctaattcaagca

SEQ ID NO: 8489121 - DNA, 22 bp, Homo sapiens
tgtatgtgtggatagatgtata

SEQ ID NO: 8489122 - DNA, 22 bp, Homo sapiens
cctggcagacagcactgaagct

SEQ ID NO: 8489123 - DNA, 22 bp, Homo sapiens
tgtatgtatacactgatcatca

SEQ ID NO: 8489124 - DNA, 22 bp, Homo sapiens
cctggcagacagcactgaagct

SEQ ID NO: 8489125 - DNA, 22 bp, Homo sapiens
cctggcagacagcactgaagct

SEQ ID NO: 8489126 - DNA, 22 bp, Homo sapiens
cctggcagaatattaaagtgca

SEQ ID NO: 8489127 - DNA, 22 bp, Homo sapiens
cctggcagaaagagttacacct

SEQ ID NO: 8489128 - DNA, 21 bp, Homo sapiens
cctggcagaagcctgatatgc

SEQ ID NO: 8489129 - DNA, 21 bp, Homo sapiens
cctggcagaagcctgatatgc

SEQ ID NO: 8489130 - DNA, 22 bp, Homo sapiens
cctggcactgaccaggcactga

SEQ ID NO: 8489131 - DNA, 21 bp, Homo sapiens
cctggcactggcctgctgagc

SEQ ID NO: 8489132 - DNA, 22 bp, Homo sapiens
cctggcacctgtgttttctgga

SEQ ID NO: 8489133 - DNA, 22 bp, Homo sapiens
cctggcacgaagggctgaggtt

SEQ ID NO: 8489134 - DNA, 22 bp, Homo sapiens
cctggcacatctaactcactct

SEQ ID NO: 8489135 - DNA, 22 bp, Homo sapiens
cctggcacctgtgttttctgga

SEQ ID NO: 8489136 - DNA, 22 bp, Homo sapiens
cctggcacatgatagatgctca

SEQ ID NO: 8489137 - DNA, 22 bp, Homo sapiens
cctggcacatgatagatgctca

SEQ ID NO: 8489138 - DNA, 22 bp, Homo sapiens
tgtcatgggcatttattgaggg

SEQ ID NO: 8489139 - DNA, 22 bp, Homo sapiens
tgtcatggggaaaataacagac

SEQ ID NO: 8489140 - DNA, 21 bp, Homo sapiens
tgtcagctccctgtcctgtgt

SEQ ID NO: 8489141 - DNA, 22 bp, Homo sapiens
tgtcaggagccaccagcactcc

SEQ ID NO: 8489142 - DNA, 22 bp, Homo sapiens
tgtcatgggtctaaacattgat

SEQ ID NO: 8489143 - DNA, 22 bp, Homo sapiens
tgtcatgggtctaaacattgat

SEQ ID NO: 8489144 - DNA, 22 bp, Homo sapiens
tgtcatgtggcaattaaagcag

SEQ ID NO: 8489145 - DNA, 22 bp, Homo sapiens
tgtattatgattgttgttcatg

SEQ ID NO: 8489146 - DNA, 22 bp, Homo sapiens
tgtattatcaagtaaatacatg

SEQ ID NO: 8489147 - DNA, 22 bp, Homo sapiens
tgtattatcaagtaaatacatg

SEQ ID NO: 8489148 - DNA, 22 bp, Homo sapiens
tgtattatcaagtaaatacatg

SEQ ID NO: 8489149 - DNA, 22 bp, Homo sapiens
tgtattcagggacatatatgta

SEQ ID NO: 8489150 - DNA, 22 bp, Homo sapiens
tgtattagagcagtagaattat

SEQ ID NO: 8489151 - DNA, 22 bp, Homo sapiens
tgtattagatctgagaacttct

SEQ ID NO: 8489152 - DNA, 22 bp, Homo sapiens
tgtattaacattaataaaatgg

SEQ ID NO: 8489153 - DNA, 22 bp, Homo sapiens
tgtattaacattaataaaatgg

SEQ ID NO: 8489154 - DNA, 22 bp, Homo sapiens
tgtattaacattaataaaatgg

SEQ ID NO: 8489155 - DNA, 22 bp, Homo sapiens
tgtattaacattaataaaatgg

SEQ ID NO: 8489156 - DNA, 22 bp, Homo sapiens
tgtattaacattaataaaatgg

SEQ ID NO: 8489157 - DNA, 22 bp, Homo sapiens
tggagctgagagccaggctggc

SEQ ID NO: 8489158 - DNA, 22 bp, Homo sapiens
tggagctgagagccaggctggc

SEQ ID NO: 8489159 - DNA, 22 bp, Homo sapiens
tggagctgagagccaggctggc

SEQ ID NO: 8489160 - DNA, 22 bp, Homo sapiens
tggagctgagaagtggagctct

SEQ ID NO: 8489161 - DNA, 22 bp, Homo sapiens
tggagctgagagccaggctggc

SEQ ID NO: 8489162 - DNA, 22 bp, Homo sapiens
tggagctgactcacaccagcta

SEQ ID NO: 8489163 - DNA, 23 bp, Homo sapiens
tggagctgacagtcagagggagg

SEQ ID NO: 8489164 - DNA, 23 bp, Homo sapiens
tggagctgacagtcagagggagg

SEQ ID NO: 8489165 - DNA, 23 bp, Homo sapiens
tggagctgacagtcagagggagg

SEQ ID NO: 8489166 - DNA, 22 bp, Homo sapiens
tggagctgactcacaccagcta

SEQ ID NO: 8489167 - DNA, 22 bp, Homo sapiens
tggagctgactcacaccagcta

SEQ ID NO: 8489168 - DNA, 22 bp, Homo sapiens
tggagctgagaagtggagctct

SEQ ID NO: 8489169 - DNA, 22 bp, Homo sapiens
tggagctgagaagtggagctct

SEQ ID NO: 8489170 - DNA, 22 bp, Homo sapiens
tggagctgagaagtggagctct

SEQ ID NO: 8489171 - DNA, 22 bp, Homo sapiens
ccctggagatcgggagaggaag

SEQ ID NO: 8489172 - DNA, 22 bp, Homo sapiens
ccctggagatcgggagaggaag

SEQ ID NO: 8489173 - DNA, 22 bp, Homo sapiens
ccctggagatcgggagaggaag

SEQ ID NO: 8489174 - DNA, 22 bp, Homo sapiens
ccctggagatcgggagaggaag

SEQ ID NO: 8489175 - DNA, 22 bp, Homo sapiens
ccctggagctagtctgagcaga

SEQ ID NO: 8489176 - DNA, 22 bp, Homo sapiens
ccctggagctagtctgagcaga

SEQ ID NO: 8489177 - DNA, 22 bp, Homo sapiens
ccctggagctagtctgagcaga

SEQ ID NO: 8489178 - DNA, 22 bp, Homo sapiens
ccctggagcatctctgctgtct

SEQ ID NO: 8489179 - DNA, 22 bp, Homo sapiens
ccctggagcatctctgctgtct

SEQ ID NO: 8489180 - DNA, 22 bp, Homo sapiens
ccctggagcatctctgctgtct

SEQ ID NO: 8489181 - DNA, 22 bp, Homo sapiens
ccctggagcatctctgctgtct

SEQ ID NO: 8489182 - DNA, 20 bp, Homo sapiens
ccctggagagaagctccacg

SEQ ID NO: 8489183 - DNA, 20 bp, Homo sapiens
ccctggagagaagctccacg

SEQ ID NO: 8489184 - DNA, 20 bp, Homo sapiens
ccctggagagaagctccacg

SEQ ID NO: 8489185 - DNA, 20 bp, Homo sapiens
ccctggagagaagctccacg

SEQ ID NO: 8489186 - DNA, 22 bp, Homo sapiens
ccctggagaggactcacccctg

SEQ ID NO: 8489187 - DNA, 22 bp, Homo sapiens
ccctggagaggactcacccctg

SEQ ID NO: 8489188 - DNA, 22 bp, Homo sapiens
ccctggagaggactcacccctg

SEQ ID NO: 8489189 - DNA, 20 bp, Homo sapiens
ccctggagagaagctccacg

SEQ ID NO: 8489190 - DNA, 20 bp, Homo sapiens
ccctggagagaagctccacg

SEQ ID NO: 8489191 - DNA, 19 bp, Homo sapiens
ccctggagaataccctgga

SEQ ID NO: 8489192 - DNA, 19 bp, Homo sapiens
ccctggagaataccctgga

SEQ ID NO: 8489193 - DNA, 20 bp, Homo sapiens
ccctccagcaaccaggactt

SEQ ID NO: 8489194 - DNA, 22 bp, Homo sapiens
ccctccagagcttgacctgctg

SEQ ID NO: 8489195 - DNA, 22 bp, Homo sapiens
ccctccagagcttgacctgctg

SEQ ID NO: 8489196 - DNA, 22 bp, Homo sapiens
ccctccagccatggacccaggt

SEQ ID NO: 8489197 - DNA, 22 bp, Homo sapiens
ccctccagccatggacccaggt

SEQ ID NO: 8489198 - DNA, 20 bp, Homo sapiens
ccctccagcaaccaggactt

SEQ ID NO: 8489199 - DNA, 20 bp, Homo sapiens
ccctccagcaaccaggactt

SEQ ID NO: 8489200 - DNA, 20 bp, Homo sapiens
ccctccagcaaccaggactt

SEQ ID NO: 8489201 - DNA, 22 bp, Homo sapiens
ccctcatgccagacagcatgca

SEQ ID NO: 8489202 - DNA, 22 bp, Homo sapiens
ccctcaggtgaaaggaaaaatt

SEQ ID NO: 8489203 - DNA, 22 bp, Homo sapiens
ccctccaccaagcagggcgcca

SEQ ID NO: 8489204 - DNA, 19 bp, Homo sapiens
ccctcattcacttattctc

SEQ ID NO: 8489205 - DNA, 22 bp, Homo sapiens
ccctccaccaagcagggcgcca

SEQ ID NO: 8489206 - DNA, 22 bp, Homo sapiens
ccctccagctcaaagcaaccgg

SEQ ID NO: 8489207 - DNA, 22 bp, Homo sapiens
ccctccagctcaaagcaaccgg

SEQ ID NO: 8489208 - DNA, 22 bp, Homo sapiens
ccctccagctcaaagcaaccgg

SEQ ID NO: 8489209 - DNA, 22 bp, Homo sapiens
ccctccaggcactgccctcttc

SEQ ID NO: 8489210 - DNA, 22 bp, Homo sapiens
ccctccaggcctgtcatgttcc

SEQ ID NO: 8489211 - DNA, 22 bp, Homo sapiens
ccctggagaaggggacgcggag

SEQ ID NO: 8489212 - DNA, 22 bp, Homo sapiens
ccctggagaaggggacgcggag

SEQ ID NO: 8489213 - DNA, 22 bp, Homo sapiens
ccctccagggagccatgctggg

SEQ ID NO: 8489214 - DNA, 22 bp, Homo sapiens
ccctccagggagccatgctggg

SEQ ID NO: 8489215 - DNA, 22 bp, Homo sapiens
ccctccagggagccatgctggg

SEQ ID NO: 8489216 - DNA, 22 bp, Homo sapiens
ccctccagggagccatgctggg

SEQ ID NO: 8489217 - DNA, 22 bp, Homo sapiens
tggagctgagcacctccagggc

SEQ ID NO: 8489218 - DNA, 18 bp, Homo sapiens
tggagctgagggcaatgc

SEQ ID NO: 8489219 - DNA, 18 bp, Homo sapiens
tggagctgagggcaatgc

SEQ ID NO: 8489220 - DNA, 22 bp, Homo sapiens
ccctggcaaaacactctcttga

SEQ ID NO: 8489221 - DNA, 22 bp, Homo sapiens
ccctggcaaaacactctcttga

SEQ ID NO: 8489222 - DNA, 18 bp, Homo sapiens
tggagctgagggcaatgc

SEQ ID NO: 8489223 - DNA, 22 bp, Homo sapiens
ccctggcctccaggcagtcctg

SEQ ID NO: 8489224 - DNA, 17 bp, Homo sapiens
ccctggctctaggtgga

SEQ ID NO: 8489225 - DNA, 17 bp, Homo sapiens
ccctggctctaggtgga

SEQ ID NO: 8489226 - DNA, 22 bp, Homo sapiens
ccctggctcttcaccacctgcc

SEQ ID NO: 8489227 - DNA, 22 bp, Homo sapiens
ccctggctgccagtcaccagac

SEQ ID NO: 8489228 - DNA, 22 bp, Homo sapiens
tggcaagaatattggaccagaa

SEQ ID NO: 8489229 - DNA, 22 bp, Homo sapiens
tggatgagtctgagattgggca

SEQ ID NO: 8489230 - DNA, 22 bp, Homo sapiens
tggatgagtctgagattgggca

SEQ ID NO: 8489231 - DNA, 22 bp, Homo sapiens
tggatgagggctgagcactggg

SEQ ID NO: 8489232 - DNA, 22 bp, Homo sapiens
tggatgagttcaatgaggcaga

SEQ ID NO: 8489233 - DNA, 22 bp, Homo sapiens
tggatgcctgggcctccttcca

SEQ ID NO: 8489234 - DNA, 22 bp, Homo sapiens
tggatgagttcaatgaggcaga

SEQ ID NO: 8489235 - DNA, 22 bp, Homo sapiens
tggatgagttcaatgaggcaga

SEQ ID NO: 8489236 - DNA, 17 bp, Homo sapiens
tggcaagaatggaaatg

SEQ ID NO: 8489237 - DNA, 22 bp, Homo sapiens
tggcaagagggatgcaaggttt

SEQ ID NO: 8489238 - DNA, 22 bp, Homo sapiens
tggcaaggaagagcctggtgca

SEQ ID NO: 8489239 - DNA, 22 bp, Homo sapiens
tggatgagaaactctggtgact

SEQ ID NO: 8489240 - DNA, 22 bp, Homo sapiens
tggatgaggctgggttaggcag

SEQ ID NO: 8489241 - DNA, 22 bp, Homo sapiens
tggatgagattaaagtgaggtt

SEQ ID NO: 8489242 - DNA, 22 bp, Homo sapiens
tggatgagattaaagtgaggtt

SEQ ID NO: 8489243 - DNA, 22 bp, Homo sapiens
tggatgagattaaagtgaggtt

SEQ ID NO: 8489244 - DNA, 22 bp, Homo sapiens
tggatgagggctgagcactggg

SEQ ID NO: 8489245 - DNA, 22 bp, Homo sapiens
tggatgagggctgagcactggg

SEQ ID NO: 8489246 - DNA, 22 bp, Homo sapiens
tggatctgctctatgaactgct

SEQ ID NO: 8489247 - DNA, 22 bp, Homo sapiens
tggatctcggcaatgcgggact

SEQ ID NO: 8489248 - DNA, 22 bp, Homo sapiens
tggatcatgtgatgtcaggagt

SEQ ID NO: 8489249 - DNA, 22 bp, Homo sapiens
tggatcatcttaagaagtgatt

SEQ ID NO: 8489250 - DNA, 22 bp, Homo sapiens
tggatccagctgctcctatgag

SEQ ID NO: 8489251 - DNA, 22 bp, Homo sapiens
tggcagctgtgtccaggtagaa

SEQ ID NO: 8489252 - DNA, 22 bp, Homo sapiens
tggcagctgtgtccaggtagaa

SEQ ID NO: 8489253 - DNA, 23 bp, Homo sapiens
tggcagctgtgtaagagaaagca

SEQ ID NO: 8489254 - DNA, 22 bp, Homo sapiens
tggcagctgtgtccaggtagaa

SEQ ID NO: 8489255 - DNA, 22 bp, Homo sapiens
tggcagctgtgtccaggtagaa

SEQ ID NO: 8489256 - DNA, 22 bp, Homo sapiens
tggcagcttgaatgcagtcttt

SEQ ID NO: 8489257 - DNA, 22 bp, Homo sapiens
tggcagcttcctgctcatagga

SEQ ID NO: 8489258 - DNA, 22 bp, Homo sapiens
tggcagcttcctgctcatagga

SEQ ID NO: 8489259 - DNA, 22 bp, Homo sapiens
tggcagcttcctgctcatagga

SEQ ID NO: 8489260 - DNA, 22 bp, Homo sapiens
tggcagctgtctgtggggtctc

SEQ ID NO: 8489261 - DNA, 23 bp, Homo sapiens
tggcagctgtgtaagagaaagca

SEQ ID NO: 8489262 - DNA, 22 bp, Homo sapiens
tggccagctttgactgtaaacc

SEQ ID NO: 8489263 - DNA, 22 bp, Homo sapiens
tggccaggaggctgcttctgac

SEQ ID NO: 8489264 - DNA, 22 bp, Homo sapiens
tggccaggaggctgcttctgac

SEQ ID NO: 8489265 - DNA, 22 bp, Homo sapiens
tggccaggaggctgcttctgac

SEQ ID NO: 8489266 - DNA, 22 bp, Homo sapiens
tggcagcttgaatgcagtcttt

SEQ ID NO: 8489267 - DNA, 22 bp, Homo sapiens
tggcagcttgaatgcagtcttt

SEQ ID NO: 8489268 - DNA, 22 bp, Homo sapiens
tggcagcttgaatgcagtcttt

SEQ ID NO: 8489269 - DNA, 22 bp, Homo sapiens
cctagggagcctgagagcagtg

SEQ ID NO: 8489270 - DNA, 22 bp, Homo sapiens
cctaggctggctgtcttcaggt

SEQ ID NO: 8489271 - DNA, 22 bp, Homo sapiens
cctaggctaattcagtccagta

SEQ ID NO: 8489272 - DNA, 21 bp, Homo sapiens
cctagtgttaaaacagtttaa

SEQ ID NO: 8489273 - DNA, 22 bp, Homo sapiens
cctagtcttccgcgtccccacc

SEQ ID NO: 8489274 - DNA, 23 bp, Homo sapiens
tggccaggcataaaggtgggtgg

SEQ ID NO: 8489275 - DNA, 22 bp, Homo sapiens
tggccaggcattcagataagac

SEQ ID NO: 8489276 - DNA, 23 bp, Homo sapiens
tggccaggcataaaggtgggtgg

SEQ ID NO: 8489277 - DNA, 23 bp, Homo sapiens
tggccaggcataaaggtgggtgg

SEQ ID NO: 8489278 - DNA, 22 bp, Homo sapiens
tggccaggcaggtagaacggcc

SEQ ID NO: 8489279 - DNA, 22 bp, Homo sapiens
tggccaggcaggtagaacggcc

SEQ ID NO: 8489280 - DNA, 22 bp, Homo sapiens
tggccaggcaggtagaacggcc

SEQ ID NO: 8489281 - DNA, 22 bp, Homo sapiens
tggcacagtcctgggtgcctgc

SEQ ID NO: 8489282 - DNA, 22 bp, Homo sapiens
tggcacagtcctgggtgcctgc

SEQ ID NO: 8489283 - DNA, 22 bp, Homo sapiens
tggcacagggcttggtcgctca

SEQ ID NO: 8489284 - DNA, 22 bp, Homo sapiens
tggcacagggcttggtcgctca

SEQ ID NO: 8489285 - DNA, 22 bp, Homo sapiens
tggcacaggagcactgccctgg

SEQ ID NO: 8489286 - DNA, 22 bp, Homo sapiens
tggcacaggatctcagcggcca

SEQ ID NO: 8489287 - DNA, 22 bp, Homo sapiens
tggcacaggaatttagatgcag

SEQ ID NO: 8489288 - DNA, 22 bp, Homo sapiens
tggcaagggattgtggagaact

SEQ ID NO: 8489289 - DNA, 22 bp, Homo sapiens
tggcaagggattgtggagaact

SEQ ID NO: 8489290 - DNA, 22 bp, Homo sapiens
tggcaaggctgtgggggcagag

SEQ ID NO: 8489291 - DNA, 22 bp, Homo sapiens
tggcaaggctgtgggggcagag

SEQ ID NO: 8489292 - DNA, 22 bp, Homo sapiens
tggcaaggccacaggtgcagtt

SEQ ID NO: 8489293 - DNA, 23 bp, Homo sapiens
tggcaaggaatgggatggagact

SEQ ID NO: 8489294 - DNA, 22 bp, Homo sapiens
tggcagcaatttgtgatgttga

SEQ ID NO: 8489295 - DNA, 22 bp, Homo sapiens
tggcagcaatttgtgatgttga

SEQ ID NO: 8489296 - DNA, 22 bp, Homo sapiens
tggcagcacaaggtggcccatg

SEQ ID NO: 8489297 - DNA, 22 bp, Homo sapiens
tggcagcacaaggtggcccatg

SEQ ID NO: 8489298 - DNA, 22 bp, Homo sapiens
tggcagcacaaggtggcccatg

SEQ ID NO: 8489299 - DNA, 21 bp, Homo sapiens
tggcagcacccacaccctctg

SEQ ID NO: 8489300 - DNA, 22 bp, Homo sapiens
tggcagcacattgacccgggct

SEQ ID NO: 8489301 - DNA, 22 bp, Homo sapiens
tggcagcacattgacccgggct

SEQ ID NO: 8489302 - DNA, 22 bp, Homo sapiens
tggcagcacggcatccactctc

SEQ ID NO: 8489303 - DNA, 22 bp, Homo sapiens
tggcagcactaggtactgagct

SEQ ID NO: 8489304 - DNA, 22 bp, Homo sapiens
tggcagcactaggtactgagct

SEQ ID NO: 8489305 - DNA, 22 bp, Homo sapiens
tggcagctggagggcaatggcc

SEQ ID NO: 8489306 - DNA, 22 bp, Homo sapiens
tggcagcaaaaccagaatcaga

SEQ ID NO: 8489307 - DNA, 22 bp, Homo sapiens
tggcagcaaaaccagaatcaga

SEQ ID NO: 8489308 - DNA, 22 bp, Homo sapiens
tggcagcaaaaccagaatcaga

SEQ ID NO: 8489309 - DNA, 22 bp, Homo sapiens
tggcagcaagttcttgggaggt

SEQ ID NO: 8489310 - DNA, 22 bp, Homo sapiens
tggcagcaattagctagagctg

SEQ ID NO: 8489311 - DNA, 22 bp, Homo sapiens
tggcagcaattagctagagctg

SEQ ID NO: 8489312 - DNA, 22 bp, Homo sapiens
tggcagcaattagctagagctg

SEQ ID NO: 8489313 - DNA, 22 bp, Homo sapiens
tggcagattttctctggaggag

SEQ ID NO: 8489314 - DNA, 22 bp, Homo sapiens
tggcagatttaacattggaact

SEQ ID NO: 8489315 - DNA, 22 bp, Homo sapiens
tggcagatgtggtttgagacag

SEQ ID NO: 8489316 - DNA, 22 bp, Homo sapiens
tggcagatgtggcatagagcat

SEQ ID NO: 8489317 - DNA, 22 bp, Homo sapiens
tggcagaggtatattgggagga

SEQ ID NO: 8489318 - DNA, 22 bp, Homo sapiens
tggcagaggtatattgggagga

SEQ ID NO: 8489319 - DNA, 22 bp, Homo sapiens
tggcagatggcctggaaccaaa

SEQ ID NO: 8489320 - DNA, 22 bp, Homo sapiens
cctctgggggtcctcagagtct

SEQ ID NO: 8489321 - DNA, 22 bp, Homo sapiens
cctctgggggtcctcagagtct

SEQ ID NO: 8489322 - DNA, 22 bp, Homo sapiens
cctctgggggtcctcagagtct

SEQ ID NO: 8489323 - DNA, 22 bp, Homo sapiens
cctctggggtgagtgggccact

SEQ ID NO: 8489324 - DNA, 22 bp, Homo sapiens
cctctggggtgagtgggccact

SEQ ID NO: 8489325 - DNA, 22 bp, Homo sapiens
cctctggggtgagtgggccact

SEQ ID NO: 8489326 - DNA, 22 bp, Homo sapiens
cctctgggtgacagactcttgg

SEQ ID NO: 8489327 - DNA, 22 bp, Homo sapiens
cctctgggtgggaggccgggcg

SEQ ID NO: 8489328 - DNA, 22 bp, Homo sapiens
cctctgggtatctgtggaagta

SEQ ID NO: 8489329 - DNA, 22 bp, Homo sapiens
cctctgggtatctgtggaagta

SEQ ID NO: 8489330 - DNA, 22 bp, Homo sapiens
cctctgtgatttctgagccaat

SEQ ID NO: 8489331 - DNA, 22 bp, Homo sapiens
cctctgtccccagtgcaggcct

SEQ ID NO: 8489332 - DNA, 22 bp, Homo sapiens
cctctgtcctggggagtggagc

SEQ ID NO: 8489333 - DNA, 22 bp, Homo sapiens
cctctgtccccagtgcaggcct

SEQ ID NO: 8489334 - DNA, 22 bp, Homo sapiens
cctctgtccccagtgcaggcct

SEQ ID NO: 8489335 - DNA, 22 bp, Homo sapiens
cctctgtgacaaacagtcctgg

SEQ ID NO: 8489336 - DNA, 22 bp, Homo sapiens
cctctgtgacaaacagtcctgg

SEQ ID NO: 8489337 - DNA, 18 bp, Homo sapiens
cctctgggttttgttccc

SEQ ID NO: 8489338 - DNA, 22 bp, Homo sapiens
cctctggtcccagctctgctgc

SEQ ID NO: 8489339 - DNA, 22 bp, Homo sapiens
cctctggtcccagctctgctgc

SEQ ID NO: 8489340 - DNA, 22 bp, Homo sapiens
cctctgagaacacctggcgtcc

SEQ ID NO: 8489341 - DNA, 22 bp, Homo sapiens
cctctgagagaaggccttcagc

SEQ ID NO: 8489342 - DNA, 22 bp, Homo sapiens
cctctgagaacacctggcgtcc

SEQ ID NO: 8489343 - DNA, 22 bp, Homo sapiens
cctctgactcctggacttgggg

SEQ ID NO: 8489344 - DNA, 22 bp, Homo sapiens
cctctgagaccagctctgcacc

SEQ ID NO: 8489345 - DNA, 22 bp, Homo sapiens
cctctgagaccagctctgcacc

SEQ ID NO: 8489346 - DNA, 22 bp, Homo sapiens
cctctctttcctacaccttgga

SEQ ID NO: 8489347 - DNA, 22 bp, Homo sapiens
cctctctttcctacaccttgga

SEQ ID NO: 8489348 - DNA, 22 bp, Homo sapiens
cctctctgtagcagcccccagt

SEQ ID NO: 8489349 - DNA, 22 bp, Homo sapiens
cctctcttggccgcagtcttct

SEQ ID NO: 8489350 - DNA, 22 bp, Homo sapiens
cctctcttggccgcagtcttct

SEQ ID NO: 8489351 - DNA, 22 bp, Homo sapiens
cctctcttggccgcagtcttct

SEQ ID NO: 8489352 - DNA, 22 bp, Homo sapiens
cctctgactccacacttgaact

SEQ ID NO: 8489353 - DNA, 23 bp, Homo sapiens
cctctctttttaggtggtgtttg

SEQ ID NO: 8489354 - DNA, 23 bp, Homo sapiens
cctctctttttaggtggtgtttg

SEQ ID NO: 8489355 - DNA, 23 bp, Homo sapiens
cctctgacaatgatgtcacctgc

SEQ ID NO: 8489356 - DNA, 22 bp, Homo sapiens
cctctgaggtgagcccagctgg

SEQ ID NO: 8489357 - DNA, 22 bp, Homo sapiens
cctctggctgtaccactggcac

SEQ ID NO: 8489358 - DNA, 22 bp, Homo sapiens
cctctgaggtcatggacttggc

SEQ ID NO: 8489359 - DNA, 22 bp, Homo sapiens
cctctgagctggcctgtggggc

SEQ ID NO: 8489360 - DNA, 22 bp, Homo sapiens
cctctgagcctgtgtgcggcac

SEQ ID NO: 8489361 - DNA, 22 bp, Homo sapiens
cctctgagcctgtgtgcggcac

SEQ ID NO: 8489362 - DNA, 22 bp, Homo sapiens
cctctggggcatcagacaaagg

SEQ ID NO: 8489363 - DNA, 22 bp, Homo sapiens
cctctgggggcttccttaccct

SEQ ID NO: 8489364 - DNA, 22 bp, Homo sapiens
cctctgggctgcctgcacgggt

SEQ ID NO: 8489365 - DNA, 22 bp, Homo sapiens
cctctctgtgtggcctctccat

SEQ ID NO: 8489366 - DNA, 22 bp, Homo sapiens
cctctctgtgtggcctctccat

SEQ ID NO: 8489367 - DNA, 16 bp, Homo sapiens
cctctcttattcctcc

SEQ ID NO: 8489368 - DNA, 22 bp, Homo sapiens
cctctcttggatgtggatgggt

SEQ ID NO: 8489369 - DNA, 22 bp, Homo sapiens
cctctcttggatgtggatgggt

SEQ ID NO: 8489370 - DNA, 16 bp, Homo sapiens
cctctcttattcctcc

SEQ ID NO: 8489371 - DNA, 16 bp, Homo sapiens
cctctcttattcctcc

SEQ ID NO: 8489372 - DNA, 22 bp, Homo sapiens
cctctctgtaagggtccctccc

SEQ ID NO: 8489373 - DNA, 22 bp, Homo sapiens
cctctctgtaagggtccctccc

SEQ ID NO: 8489374 - DNA, 20 bp, Homo sapiens
cctctctgccctgcaaggcc

SEQ ID NO: 8489375 - DNA, 22 bp, Homo sapiens
tggctgcctttcacctcatctc

SEQ ID NO: 8489376 - DNA, 22 bp, Homo sapiens
tggctgcctttcacctcatctc

SEQ ID NO: 8489377 - DNA, 22 bp, Homo sapiens
tggctgcgttttccgatgtatt

SEQ ID NO: 8489378 - DNA, 19 bp, Homo sapiens
cctctccgcccaccagccc

SEQ ID NO: 8489379 - DNA, 20 bp, Homo sapiens
cctctctgaagaggtcatct

SEQ ID NO: 8489380 - DNA, 20 bp, Homo sapiens
cctctctgaagaggtcatct

SEQ ID NO: 8489381 - DNA, 20 bp, Homo sapiens
cctctctgaagaggtcatct

SEQ ID NO: 8489382 - DNA, 20 bp, Homo sapiens
cctctctgcatgctccctga

SEQ ID NO: 8489383 - DNA, 20 bp, Homo sapiens
cctctctgccctgcaaggcc

SEQ ID NO: 8489384 - DNA, 22 bp, Homo sapiens
tggctgccgactggctcttggc

SEQ ID NO: 8489385 - DNA, 21 bp, Homo sapiens
tggctgcctacatgctgcagg

SEQ ID NO: 8489386 - DNA, 22 bp, Homo sapiens
tggctgccctcatgggcctgat

SEQ ID NO: 8489387 - DNA, 22 bp, Homo sapiens
tggctgcctagtccctcagcct

SEQ ID NO: 8489388 - DNA, 21 bp, Homo sapiens
tggctgcctacatgctgcagg

SEQ ID NO: 8489389 - DNA, 22 bp, Homo sapiens
tggctgcctagtccctcagcct

SEQ ID NO: 8489390 - DNA, 22 bp, Homo sapiens
tggctgcctagtgtctgagcag

SEQ ID NO: 8489391 - DNA, 22 bp, Homo sapiens
tggctgcctgaatgcaagacag

SEQ ID NO: 8489392 - DNA, 22 bp, Homo sapiens
tggctgcctgaatgcaagacag

SEQ ID NO: 8489393 - DNA, 22 bp, Homo sapiens
tggctgccttccctgctggagg

SEQ ID NO: 8489394 - DNA, 22 bp, Homo sapiens
cctctcagccggactgtcaggc

SEQ ID NO: 8489395 - DNA, 22 bp, Homo sapiens
cctctcaaaagcacaacattga

SEQ ID NO: 8489396 - DNA, 22 bp, Homo sapiens
cctctatgtacacatttccagc

SEQ ID NO: 8489397 - DNA, 22 bp, Homo sapiens
cctctatagatgtgtgcatcta

SEQ ID NO: 8489398 - DNA, 22 bp, Homo sapiens
cctctatagatgtgtgcatcta

SEQ ID NO: 8489399 - DNA, 22 bp, Homo sapiens
cctctaaattgtttgaagttgg

SEQ ID NO: 8489400 - DNA, 22 bp, Homo sapiens
cctctacagggcatagcccaaa

SEQ ID NO: 8489401 - DNA, 22 bp, Homo sapiens
cctctacttaccactcagccag

SEQ ID NO: 8489402 - DNA, 22 bp, Homo sapiens
cctctacagggcatagcccaaa

SEQ ID NO: 8489403 - DNA, 23 bp, Homo sapiens
cctctccagacactgggccttgt

SEQ ID NO: 8489404 - DNA, 23 bp, Homo sapiens
cctctccagacactgggccttgt

SEQ ID NO: 8489405 - DNA, 22 bp, Homo sapiens
cctctcatcattatcgctttgt

SEQ ID NO: 8489406 - DNA, 22 bp, Homo sapiens
cctctcatagtctgtatccttt

SEQ ID NO: 8489407 - DNA, 22 bp, Homo sapiens
cctctcatagtctgtatccttt

SEQ ID NO: 8489408 - DNA, 22 bp, Homo sapiens
cctcggctgggccttggccact

SEQ ID NO: 8489409 - DNA, 22 bp, Homo sapiens
cctcggagaaaggcagctccac

SEQ ID NO: 8489410 - DNA, 22 bp, Homo sapiens
cctcggagaaaggcagctccac

SEQ ID NO: 8489411 - DNA, 22 bp, Homo sapiens
cctcggagcgggtcagagaggg

SEQ ID NO: 8489412 - DNA, 22 bp, Homo sapiens
cctcggaggcggaggctgcagt

SEQ ID NO: 8489413 - DNA, 23 bp, Homo sapiens
cctcctcatatctttgactagtg

SEQ ID NO: 8489414 - DNA, 23 bp, Homo sapiens
cctcctcatatctttgactagtg

SEQ ID NO: 8489415 - DNA, 22 bp, Homo sapiens
cctcctggtccagcatctcttt

SEQ ID NO: 8489416 - DNA, 22 bp, Homo sapiens
cctcctggtccagcatctcttt

SEQ ID NO: 8489417 - DNA, 22 bp, Homo sapiens
cctcctctgggaagattcagag

SEQ ID NO: 8489418 - DNA, 22 bp, Homo sapiens
cctcctggtccagcatctcttt

SEQ ID NO: 8489419 - DNA, 22 bp, Homo sapiens
cctccctgtctacctgttgtgg

SEQ ID NO: 8489420 - DNA, 22 bp, Homo sapiens
cctccctgtctacctgttgtgg

SEQ ID NO: 8489421 - DNA, 22 bp, Homo sapiens
cctcccttcagtagagcccaat

SEQ ID NO: 8489422 - DNA, 22 bp, Homo sapiens
cctcctagaggaaccccagggc

SEQ ID NO: 8489423 - DNA, 22 bp, Homo sapiens
cctcccttttggtgtctgcata

SEQ ID NO: 8489424 - DNA, 22 bp, Homo sapiens
cctcccttggccatagccagcc

SEQ ID NO: 8489425 - DNA, 22 bp, Homo sapiens
cctccctttgttgcaagggaaa

SEQ ID NO: 8489426 - DNA, 22 bp, Homo sapiens
cctcccttccccagtagtcaag

SEQ ID NO: 8489427 - DNA, 22 bp, Homo sapiens
cctcccttggccatagccagcc

SEQ ID NO: 8489428 - DNA, 22 bp, Homo sapiens
cctccctggtggctctggtcta

SEQ ID NO: 8489429 - DNA, 22 bp, Homo sapiens
cctccctgggtgctgggattgc

SEQ ID NO: 8489430 - DNA, 22 bp, Homo sapiens
cctccctgggtgacgggctcct

SEQ ID NO: 8489431 - DNA, 22 bp, Homo sapiens
cctccctgggtgctgggattgc

SEQ ID NO: 8489432 - DNA, 22 bp, Homo sapiens
cctccctgggtgacgggctcct

SEQ ID NO: 8489433 - DNA, 22 bp, Homo sapiens
cctccctggccagagcagcagc

SEQ ID NO: 8489434 - DNA, 22 bp, Homo sapiens
cctccctggccagagcagcagc

SEQ ID NO: 8489435 - DNA, 23 bp, Homo sapiens
tggctgaggtccaggtagtttca

SEQ ID NO: 8489436 - DNA, 22 bp, Homo sapiens
cctccctgctcctcaactggca

SEQ ID NO: 8489437 - DNA, 22 bp, Homo sapiens
cctccactgcttcccagctttg

SEQ ID NO: 8489438 - DNA, 22 bp, Homo sapiens
cctccaagtttgactcaggaca

SEQ ID NO: 8489439 - DNA, 22 bp, Homo sapiens
cctccaagtttgactcaggaca

SEQ ID NO: 8489440 - DNA, 22 bp, Homo sapiens
cctccacaggagctgcagtgct

SEQ ID NO: 8489441 - DNA, 22 bp, Homo sapiens
cctccacaggagctgcagtgct

SEQ ID NO: 8489442 - DNA, 22 bp, Homo sapiens
cctccagcattactggcccatg

SEQ ID NO: 8489443 - DNA, 22 bp, Homo sapiens
cctccagcattactggcccatg

SEQ ID NO: 8489444 - DNA, 22 bp, Homo sapiens
cctccagactttggccatcctc

SEQ ID NO: 8489445 - DNA, 22 bp, Homo sapiens
cctccagagggtttcccatgaa

SEQ ID NO: 8489446 - DNA, 22 bp, Homo sapiens
tggctgagggggctctgctcag

SEQ ID NO: 8489447 - DNA, 22 bp, Homo sapiens
tggctgagggggcagttcagga

SEQ ID NO: 8489448 - DNA, 22 bp, Homo sapiens
tggctgaggtaactatgaataa

SEQ ID NO: 8489449 - DNA, 22 bp, Homo sapiens
tggctgagggggctctgctcag

SEQ ID NO: 8489450 - DNA, 22 bp, Homo sapiens
tggctgagggggctctgctcag

SEQ ID NO: 8489451 - DNA, 23 bp, Homo sapiens
tggctgaggtccaggtagtttca

SEQ ID NO: 8489452 - DNA, 22 bp, Homo sapiens
tggctgaggtaactatgaataa

SEQ ID NO: 8489453 - DNA, 23 bp, Homo sapiens
tggctgaggtccaggtagtttca

SEQ ID NO: 8489454 - DNA, 23 bp, Homo sapiens
tggctgaggtccaggtagtttca

SEQ ID NO: 8489455 - DNA, 22 bp, Homo sapiens
tggctgagggggcagttcagga

SEQ ID NO: 8489456 - DNA, 22 bp, Homo sapiens
tggctgagggggcagttcagga

SEQ ID NO: 8489457 - DNA, 22 bp, Homo sapiens
tggctgagagcaattgactctg

SEQ ID NO: 8489458 - DNA, 22 bp, Homo sapiens
cctccagcgcgatccactccgg

SEQ ID NO: 8489459 - DNA, 22 bp, Homo sapiens
tggccctgctggccaaaggcta

SEQ ID NO: 8489460 - DNA, 22 bp, Homo sapiens
tggccctgctgggtcagagctg

SEQ ID NO: 8489461 - DNA, 22 bp, Homo sapiens
tggccctgctgggtcagagctg

SEQ ID NO: 8489462 - DNA, 22 bp, Homo sapiens
tggccctgctgggtcagagctg

SEQ ID NO: 8489463 - DNA, 22 bp, Homo sapiens
tggccctgctgtatcatctgct

SEQ ID NO: 8489464 - DNA, 22 bp, Homo sapiens
tggccctgctgtatcatctgct

SEQ ID NO: 8489465 - DNA, 22 bp, Homo sapiens
tggccctgctgtatcatctgct

SEQ ID NO: 8489466 - DNA, 22 bp, Homo sapiens
tggccctgctgtatcatctgct

SEQ ID NO: 8489467 - DNA, 22 bp, Homo sapiens
tggctcagctgtcacagcctgg

SEQ ID NO: 8489468 - DNA, 22 bp, Homo sapiens
tggccctgcttatgtctctctt

SEQ ID NO: 8489469 - DNA, 22 bp, Homo sapiens
tggccctgcttatgtctctctt

SEQ ID NO: 8489470 - DNA, 22 bp, Homo sapiens
tggctcagtttagcagctcagt

SEQ ID NO: 8489471 - DNA, 22 bp, Homo sapiens
tggctcagtttagcagctcagt

SEQ ID NO: 8489472 - DNA, 21 bp, Homo sapiens
tggctcagttgctgggcacag

SEQ ID NO: 8489473 - DNA, 22 bp, Homo sapiens
tggctcagtttgggggattgaa

SEQ ID NO: 8489474 - DNA, 22 bp, Homo sapiens
tggctcatattgagtgatttct

SEQ ID NO: 8489475 - DNA, 22 bp, Homo sapiens
tggctcatctttttagacttat

SEQ ID NO: 8489476 - DNA, 22 bp, Homo sapiens
tggctcatgcatcttttctaca

SEQ ID NO: 8489477 - DNA, 22 bp, Homo sapiens
tggctcatgcctgtaatcttag

SEQ ID NO: 8489478 - DNA, 22 bp, Homo sapiens
tggctcagtttctgcccagctg

SEQ ID NO: 8489479 - DNA, 22 bp, Homo sapiens
tggctcagtttcagtcctggtt

SEQ ID NO: 8489480 - DNA, 22 bp, Homo sapiens
tggctcagtttcagtcctggtt

SEQ ID NO: 8489481 - DNA, 22 bp, Homo sapiens
tggctcagtttagcagctcagt

SEQ ID NO: 8489482 - DNA, 22 bp, Homo sapiens
tggctcagtttcagtcctggtt

SEQ ID NO: 8489483 - DNA, 22 bp, Homo sapiens
tggctcagtttcagtcctggtt

SEQ ID NO: 8489484 - DNA, 22 bp, Homo sapiens
tggccctgctggacacgcctgc

SEQ ID NO: 8489485 - DNA, 22 bp, Homo sapiens
tggccctgctatgatcctgcaa

SEQ ID NO: 8489486 - DNA, 22 bp, Homo sapiens
tggccctgctggccaaaggcta

SEQ ID NO: 8489487 - DNA, 22 bp, Homo sapiens
tggccctgctggccaaaggcta

SEQ ID NO: 8489488 - DNA, 22 bp, Homo sapiens
tggccctgctggacacgcctgc

SEQ ID NO: 8489489 - DNA, 22 bp, Homo sapiens
tggccctgctatgatcctgcaa

SEQ ID NO: 8489490 - DNA, 22 bp, Homo sapiens
tggcccgaagatccgagggtca

SEQ ID NO: 8489491 - DNA, 18 bp, Homo sapiens
tggccccttatcagtcct

SEQ ID NO: 8489492 - DNA, 22 bp, Homo sapiens
tggccccattttacagatgaaa

SEQ ID NO: 8489493 - DNA, 22 bp, Homo sapiens
tggcccagtgcttatgctctga

SEQ ID NO: 8489494 - DNA, 22 bp, Homo sapiens
tggcccagtgcttatgctctga

SEQ ID NO: 8489495 - DNA, 23 bp, Homo sapiens
cccagctgcagacaagggagggt

SEQ ID NO: 8489496 - DNA, 17 bp, Homo sapiens
cccagctgcgtctgagg

SEQ ID NO: 8489497 - DNA, 17 bp, Homo sapiens
cccagctgcgtctgagg

SEQ ID NO: 8489498 - DNA, 23 bp, Homo sapiens
cccagctgcagacaagggagggt

SEQ ID NO: 8489499 - DNA, 22 bp, Homo sapiens
cccagctgcacctctatggcct

SEQ ID NO: 8489500 - DNA, 23 bp, Homo sapiens
cccagctgcagacaagggagggt

SEQ ID NO: 8489501 - DNA, 23 bp, Homo sapiens
cccagctgcagacaagggagggt

SEQ ID NO: 8489502 - DNA, 23 bp, Homo sapiens
cccagctggaagttagaggacca

SEQ ID NO: 8489503 - DNA, 23 bp, Homo sapiens
cccagctggaagttagaggacca

SEQ ID NO: 8489504 - DNA, 23 bp, Homo sapiens
cccagctggaagttagaggacca

SEQ ID NO: 8489505 - DNA, 17 bp, Homo sapiens
cccagctggcagtgccg

SEQ ID NO: 8489506 - DNA, 17 bp, Homo sapiens
cccagctggcagtgccg

SEQ ID NO: 8489507 - DNA, 17 bp, Homo sapiens
cccagctggcagtgccg

SEQ ID NO: 8489508 - DNA, 23 bp, Homo sapiens
cccagctggaagttagaggacca

SEQ ID NO: 8489509 - DNA, 22 bp, Homo sapiens
cccagctgtaacgggtctgcac

SEQ ID NO: 8489510 - DNA, 22 bp, Homo sapiens
cccagctgtggcagaggccggg

SEQ ID NO: 8489511 - DNA, 18 bp, Homo sapiens
cccagctggtgggtcagt

SEQ ID NO: 8489512 - DNA, 22 bp, Homo sapiens
cccagctgtaacgggtctgcac

SEQ ID NO: 8489513 - DNA, 18 bp, Homo sapiens
cccagctggtgggtcagt

SEQ ID NO: 8489514 - DNA, 18 bp, Homo sapiens
cccagctggtgggtcagt

SEQ ID NO: 8489515 - DNA, 18 bp, Homo sapiens
cccagctggtgggtcagt

SEQ ID NO: 8489516 - DNA, 22 bp, Homo sapiens
cccagctggccaggtggctttg

SEQ ID NO: 8489517 - DNA, 22 bp, Homo sapiens
cccagctcttcaagtcaccccc

SEQ ID NO: 8489518 - DNA, 22 bp, Homo sapiens
cccagctcttcctgggagctaa

SEQ ID NO: 8489519 - DNA, 22 bp, Homo sapiens
cccagctcttttagcggcatct

SEQ ID NO: 8489520 - DNA, 22 bp, Homo sapiens
cccagctcttcctgggagctaa

SEQ ID NO: 8489521 - DNA, 22 bp, Homo sapiens
cccagctcttttagcggcatct

SEQ ID NO: 8489522 - DNA, 22 bp, Homo sapiens
cccagctgaacttgcattccaa

SEQ ID NO: 8489523 - DNA, 22 bp, Homo sapiens
cccagctcttttagcggcatct

SEQ ID NO: 8489524 - DNA, 22 bp, Homo sapiens
cccagctgcacctctatggcct

SEQ ID NO: 8489525 - DNA, 22 bp, Homo sapiens
cccagctgcacctctatggcct

SEQ ID NO: 8489526 - DNA, 22 bp, Homo sapiens
cccagctgatttttgcagagat

SEQ ID NO: 8489527 - DNA, 22 bp, Homo sapiens
cccagctgatttttgcagagat

SEQ ID NO: 8489528 - DNA, 22 bp, Homo sapiens
cccagctgatttttgcagagat

SEQ ID NO: 8489529 - DNA, 23 bp, Homo sapiens
cccagctgagacttcctgaactc

SEQ ID NO: 8489530 - DNA, 23 bp, Homo sapiens
cccagctgagacttcctgaactc

SEQ ID NO: 8489531 - DNA, 22 bp, Homo sapiens
cccagctgatttttgcagagat

SEQ ID NO: 8489532 - DNA, 22 bp, Homo sapiens
cccagctgatttttgcagagat

SEQ ID NO: 8489533 - DNA, 22 bp, Homo sapiens
cccagctgatttttgcagagat

SEQ ID NO: 8489534 - DNA, 22 bp, Homo sapiens
tgcattaagtgtctgcatatgg

SEQ ID NO: 8489535 - DNA, 20 bp, Homo sapiens
tgcattaagtggcattgagc

SEQ ID NO: 8489536 - DNA, 22 bp, Homo sapiens
tgcattaaggtaattgtataat

SEQ ID NO: 8489537 - DNA, 22 bp, Homo sapiens
tgcattaatttttgccaggttc

SEQ ID NO: 8489538 - DNA, 22 bp, Homo sapiens
tgcattaaggccattgaaattt

SEQ ID NO: 8489539 - DNA, 22 bp, Homo sapiens
tgcattaaggccattgaaattt

SEQ ID NO: 8489540 - DNA, 22 bp, Homo sapiens
tgcattaagggcctggagatac

SEQ ID NO: 8489541 - DNA, 22 bp, Homo sapiens
tgcattaagaatttctgaggat

SEQ ID NO: 8489542 - DNA, 22 bp, Homo sapiens
tgcattaagcacacttttgaat

SEQ ID NO: 8489543 - DNA, 22 bp, Homo sapiens
tgcattaaatataatctgttga

SEQ ID NO: 8489544 - DNA, 22 bp, Homo sapiens
tgcattaaaatgtgcctctctt

SEQ ID NO: 8489545 - DNA, 22 bp, Homo sapiens
tgcattaaaatgatggagaaat

SEQ ID NO: 8489546 - DNA, 22 bp, Homo sapiens
tgcattaaaaccatcgaccatc

SEQ ID NO: 8489547 - DNA, 22 bp, Homo sapiens
tgcatgtttgtgtctgagaact

SEQ ID NO: 8489548 - DNA, 22 bp, Homo sapiens
tgcatcaacctaatatcagctc

SEQ ID NO: 8489549 - DNA, 19 bp, Homo sapiens
cccagctgttcttccacca

SEQ ID NO: 8489550 - DNA, 19 bp, Homo sapiens
cccagctgttcttccacca

SEQ ID NO: 8489551 - DNA, 19 bp, Homo sapiens
cccagctgttcttccacca

SEQ ID NO: 8489552 - DNA, 22 bp, Homo sapiens
cccagctgtggcagaggccggg

SEQ ID NO: 8489553 - DNA, 19 bp, Homo sapiens
cccagcttgaccacctgct

SEQ ID NO: 8489554 - DNA, 22 bp, Homo sapiens
cccagcttgcccaggactgagg

SEQ ID NO: 8489555 - DNA, 22 bp, Homo sapiens
cccagcttgctcaccattccca

SEQ ID NO: 8489556 - DNA, 23 bp, Homo sapiens
cccagctttcccactgccgagag

SEQ ID NO: 8489557 - DNA, 22 bp, Homo sapiens
cccaggaaagtggaggcggctg

SEQ ID NO: 8489558 - DNA, 22 bp, Homo sapiens
cccaggaaagtggaggcggctg

SEQ ID NO: 8489559 - DNA, 22 bp, Homo sapiens
cccagccttccaccctggacta

SEQ ID NO: 8489560 - DNA, 22 bp, Homo sapiens
cccagccttccaccctggacta

SEQ ID NO: 8489561 - DNA, 22 bp, Homo sapiens
cccagccttccaccctggacta

SEQ ID NO: 8489562 - DNA, 22 bp, Homo sapiens
cccagcctttgcttcctggttc

SEQ ID NO: 8489563 - DNA, 22 bp, Homo sapiens
cccagcctttgcttcctggttc

SEQ ID NO: 8489564 - DNA, 22 bp, Homo sapiens
cccagcctttgcttcctggttc

SEQ ID NO: 8489565 - DNA, 22 bp, Homo sapiens
cccagcctttgcttcctggttc

SEQ ID NO: 8489566 - DNA, 22 bp, Homo sapiens
cccagcctgtctttcccaatga

SEQ ID NO: 8489567 - DNA, 22 bp, Homo sapiens
cccagcctgtctttcccaatga

SEQ ID NO: 8489568 - DNA, 22 bp, Homo sapiens
cccagcctgtgacagccgtcct

SEQ ID NO: 8489569 - DNA, 22 bp, Homo sapiens
cccagcctgtgacagccgtcct

SEQ ID NO: 8489570 - DNA, 22 bp, Homo sapiens
cccagcctactctgccatagca

SEQ ID NO: 8489571 - DNA, 22 bp, Homo sapiens
cccagcctggtgcactgtgggg

SEQ ID NO: 8489572 - DNA, 22 bp, Homo sapiens
cccagcctactctgccatagca

SEQ ID NO: 8489573 - DNA, 22 bp, Homo sapiens
tctgtggcctgtgtccaagtgc

SEQ ID NO: 8489574 - DNA, 22 bp, Homo sapiens
tctgtggcgcatagttgtctct

SEQ ID NO: 8489575 - DNA, 21 bp, Homo sapiens
tctgtggcggactctaggccc

SEQ ID NO: 8489576 - DNA, 22 bp, Homo sapiens
tctgtggcatggtatctggagg

SEQ ID NO: 8489577 - DNA, 22 bp, Homo sapiens
tctgtggcctgcctcctcattt

SEQ ID NO: 8489578 - DNA, 22 bp, Homo sapiens
cccagcgagtttgccggtgaac

SEQ ID NO: 8489579 - DNA, 22 bp, Homo sapiens
cccagcgagtttgccggtgaac

SEQ ID NO: 8489580 - DNA, 22 bp, Homo sapiens
cccagcgagtttgccggtgaac

SEQ ID NO: 8489581 - DNA, 23 bp, Homo sapiens
cccagcgctgagccctgcaggca

SEQ ID NO: 8489582 - DNA, 23 bp, Homo sapiens
cccagcgctgagccctgcaggca

SEQ ID NO: 8489583 - DNA, 23 bp, Homo sapiens
cccagcgctgagccctgcaggca

SEQ ID NO: 8489584 - DNA, 22 bp, Homo sapiens
cccagctcaagcagagagctaa

SEQ ID NO: 8489585 - DNA, 22 bp, Homo sapiens
cccagctcaagcagagagctaa

SEQ ID NO: 8489586 - DNA, 22 bp, Homo sapiens
cccagctcaagcagagagctaa

SEQ ID NO: 8489587 - DNA, 22 bp, Homo sapiens
cccagctacctctgctaggaga

SEQ ID NO: 8489588 - DNA, 23 bp, Homo sapiens
cccagcgctgagccctgcaggca

SEQ ID NO: 8489589 - DNA, 22 bp, Homo sapiens
tgcagggaatgcttgcagcatg

SEQ ID NO: 8489590 - DNA, 22 bp, Homo sapiens
tgcagggacacgaagacaaata

SEQ ID NO: 8489591 - DNA, 22 bp, Homo sapiens
tgcagggaatgcttgcagcatg

SEQ ID NO: 8489592 - DNA, 22 bp, Homo sapiens
cccagctccgagctccgagccg

SEQ ID NO: 8489593 - DNA, 22 bp, Homo sapiens
tgcagggagggcccagcaatct

SEQ ID NO: 8489594 - DNA, 22 bp, Homo sapiens
cccagctccgagctccgagccg

SEQ ID NO: 8489595 - DNA, 22 bp, Homo sapiens
cccagctccgagctccgagccg

SEQ ID NO: 8489596 - DNA, 22 bp, Homo sapiens
cccagctccttacagggccgaa

SEQ ID NO: 8489597 - DNA, 22 bp, Homo sapiens
cccagctccttacagggccgaa

SEQ ID NO: 8489598 - DNA, 22 bp, Homo sapiens
cccagctcttcaagtcaccccc

SEQ ID NO: 8489599 - DNA, 22 bp, Homo sapiens
cccagctccttacagggccgaa

SEQ ID NO: 8489600 - DNA, 22 bp, Homo sapiens
cccagctccttacagggccgaa

SEQ ID NO: 8489601 - DNA, 22 bp, Homo sapiens
cccaggcagggacgtgctctgg

SEQ ID NO: 8489602 - DNA, 22 bp, Homo sapiens
cccaggcagggacgtgctctgg

SEQ ID NO: 8489603 - DNA, 22 bp, Homo sapiens
cccaggcagggacgtgctctgg

SEQ ID NO: 8489604 - DNA, 22 bp, Homo sapiens
cccaggcagtgctgatccctca

SEQ ID NO: 8489605 - DNA, 22 bp, Homo sapiens
cccaggcagtctggctctaaag

SEQ ID NO: 8489606 - DNA, 22 bp, Homo sapiens
cccaggcagtctggctctaaag

SEQ ID NO: 8489607 - DNA, 16 bp, Homo sapiens
tgcctgctctgatctc

SEQ ID NO: 8489608 - DNA, 22 bp, Homo sapiens
cccaggcagccccagaagcttg

SEQ ID NO: 8489609 - DNA, 20 bp, Homo sapiens
cccaggcagagctagcggca

SEQ ID NO: 8489610 - DNA, 20 bp, Homo sapiens
cccaggcagagctagcggca

SEQ ID NO: 8489611 - DNA, 22 bp, Homo sapiens
cccaggcagccccagaagcttg

SEQ ID NO: 8489612 - DNA, 22 bp, Homo sapiens
cccaggcagcctgcagggaagg

SEQ ID NO: 8489613 - DNA, 22 bp, Homo sapiens
cccaggcagcctgcagggaagg

SEQ ID NO: 8489614 - DNA, 22 bp, Homo sapiens
cccaggcagcggggtctccttg

SEQ ID NO: 8489615 - DNA, 22 bp, Homo sapiens
cccaggcagcggggtctccttg

SEQ ID NO: 8489616 - DNA, 22 bp, Homo sapiens
cccaggcagcggggtctccttg

SEQ ID NO: 8489617 - DNA, 21 bp, Homo sapiens
tgccaggcctgagctggggtc

SEQ ID NO: 8489618 - DNA, 21 bp, Homo sapiens
tgccaggcctgagctggggtc

SEQ ID NO: 8489619 - DNA, 21 bp, Homo sapiens
tgccaggcctgagctggggtc

SEQ ID NO: 8489620 - DNA, 21 bp, Homo sapiens
tgccaggcctgagctggggtc

SEQ ID NO: 8489621 - DNA, 21 bp, Homo sapiens
tgccaggcctgagctggggtc

SEQ ID NO: 8489622 - DNA, 22 bp, Homo sapiens
tgccaggcgtggtggtgcgcac

SEQ ID NO: 8489623 - DNA, 22 bp, Homo sapiens
tgccaggcgtggtggtgcgcac

SEQ ID NO: 8489624 - DNA, 22 bp, Homo sapiens
cccaggagttagaggttgtggt

SEQ ID NO: 8489625 - DNA, 22 bp, Homo sapiens
cccaggagttcgaggctgtagt

SEQ ID NO: 8489626 - DNA, 22 bp, Homo sapiens
cccaggagttcgaggctgtagt

SEQ ID NO: 8489627 - DNA, 22 bp, Homo sapiens
cccaggagttcgaggctgtagt

SEQ ID NO: 8489628 - DNA, 22 bp, Homo sapiens
cccaggagttcgaggctgtagt

SEQ ID NO: 8489629 - DNA, 22 bp, Homo sapiens
cccaggatgtcgaggctgcagt

SEQ ID NO: 8489630 - DNA, 22 bp, Homo sapiens
cccaggcacactgaagtgacat

SEQ ID NO: 8489631 - DNA, 22 bp, Homo sapiens
cccaggcagaattagtgtttca

SEQ ID NO: 8489632 - DNA, 22 bp, Homo sapiens
cccaggcagagagctggtgagc

SEQ ID NO: 8489633 - DNA, 22 bp, Homo sapiens
cccaggaggtgtgcccaactcg

SEQ ID NO: 8489634 - DNA, 22 bp, Homo sapiens
cccaggaggttgaggctgcagt

SEQ ID NO: 8489635 - DNA, 22 bp, Homo sapiens
cccaggaggttgaggctgcagt

SEQ ID NO: 8489636 - DNA, 22 bp, Homo sapiens
tgccaggcctcaggagtctcca

SEQ ID NO: 8489637 - DNA, 22 bp, Homo sapiens
tgccaggcctcaggagtctcca

SEQ ID NO: 8489638 - DNA, 22 bp, Homo sapiens
tgccaggcctcaggagtctcca

SEQ ID NO: 8489639 - DNA, 22 bp, Homo sapiens
tgccaggcctcaggagtctcca

SEQ ID NO: 8489640 - DNA, 22 bp, Homo sapiens
cccaggaggtggagttcacagt

SEQ ID NO: 8489641 - DNA, 22 bp, Homo sapiens
cccaggaggtggagttcacagt

SEQ ID NO: 8489642 - DNA, 22 bp, Homo sapiens
cccaggaggtgtagctgcgtgg

SEQ ID NO: 8489643 - DNA, 22 bp, Homo sapiens
cccaggaggtggaggttgcagt

SEQ ID NO: 8489644 - DNA, 22 bp, Homo sapiens
cccaggaggtggagttcacagt

SEQ ID NO: 8489645 - DNA, 22 bp, Homo sapiens
cccaggaggtggagttcacagt

SEQ ID NO: 8489646 - DNA, 22 bp, Homo sapiens
cccaggaggtggaggttgcggt

SEQ ID NO: 8489647 - DNA, 22 bp, Homo sapiens
cccaggaggtggaggctgcagt

SEQ ID NO: 8489648 - DNA, 22 bp, Homo sapiens
cccaggaggtggaggctgcagt

SEQ ID NO: 8489649 - DNA, 22 bp, Homo sapiens
cccaggaggtggaggttgcagc

SEQ ID NO: 8489650 - DNA, 22 bp, Homo sapiens
cccaggaggtggaggttgcagt

SEQ ID NO: 8489651 - DNA, 22 bp, Homo sapiens
cccaggaggtggaggttgcagt

SEQ ID NO: 8489652 - DNA, 22 bp, Homo sapiens
cccaggaggtggaggttgcagc

SEQ ID NO: 8489653 - DNA, 22 bp, Homo sapiens
cccaggaggtggaggttgcagc

SEQ ID NO: 8489654 - DNA, 22 bp, Homo sapiens
cccaggaggtggaggctgcagt

SEQ ID NO: 8489655 - DNA, 22 bp, Homo sapiens
cccaggaggtggaggctgcagt

SEQ ID NO: 8489656 - DNA, 21 bp, Homo sapiens
cccaggaggctgagaagagca

SEQ ID NO: 8489657 - DNA, 22 bp, Homo sapiens
tgccacagagcaattctgctga

SEQ ID NO: 8489658 - DNA, 22 bp, Homo sapiens
tgccaattagagacatccatct

SEQ ID NO: 8489659 - DNA, 22 bp, Homo sapiens
tgccacacaattactgctgcta

SEQ ID NO: 8489660 - DNA, 22 bp, Homo sapiens
tgccaagtgcttacttggccct

SEQ ID NO: 8489661 - DNA, 22 bp, Homo sapiens
tgccaagggtatgggcaagata

SEQ ID NO: 8489662 - DNA, 22 bp, Homo sapiens
tgccaagggtatgggcaagata

SEQ ID NO: 8489663 - DNA, 22 bp, Homo sapiens
tgccacagacaggacagaacag

SEQ ID NO: 8489664 - DNA, 22 bp, Homo sapiens
tgccacactcccctgctgcagt

SEQ ID NO: 8489665 - DNA, 22 bp, Homo sapiens
tgccacaccaacatctttcagc

SEQ ID NO: 8489666 - DNA, 22 bp, Homo sapiens
tgcattcaatacagtaagaata

SEQ ID NO: 8489667 - DNA, 22 bp, Homo sapiens
tgcattcatcatttgaaagccc

SEQ ID NO: 8489668 - DNA, 22 bp, Homo sapiens
tgcattcagttggtcagctttt

SEQ ID NO: 8489669 - DNA, 22 bp, Homo sapiens
tgcattcagttggtcagctttt

SEQ ID NO: 8489670 - DNA, 22 bp, Homo sapiens
tgcattataactgaatgttgtt

SEQ ID NO: 8489671 - DNA, 22 bp, Homo sapiens
tgcattatacttttagaaattt

SEQ ID NO: 8489672 - DNA, 23 bp, Homo sapiens
tgcattatcctctctgaagacca

SEQ ID NO: 8489673 - DNA, 22 bp, Homo sapiens
tgcattatctttaatgttctca

SEQ ID NO: 8489674 - DNA, 22 bp, Homo sapiens
tgcattatgcttgtgctgtata

SEQ ID NO: 8489675 - DNA, 22 bp, Homo sapiens
tgcattatgctacccagaagct

SEQ ID NO: 8489676 - DNA, 22 bp, Homo sapiens
tgcattcaaatctccaggctca

SEQ ID NO: 8489677 - DNA, 22 bp, Homo sapiens
tgcattatttgcatgtgcctgt

SEQ ID NO: 8489678 - DNA, 22 bp, Homo sapiens
tgctctggagtggcttgtgcac

SEQ ID NO: 8489679 - DNA, 22 bp, Homo sapiens
cccagggattataaaggtgaaa

SEQ ID NO: 8489680 - DNA, 22 bp, Homo sapiens
tgctctggagtggcttgtgcac

SEQ ID NO: 8489681 - DNA, 22 bp, Homo sapiens
tgctctggagtggcttgtgcac

SEQ ID NO: 8489682 - DNA, 22 bp, Homo sapiens
tgctctggagtggcttgtgcac

SEQ ID NO: 8489683 - DNA, 22 bp, Homo sapiens
tgctctggagtggcttgtgcac

SEQ ID NO: 8489684 - DNA, 22 bp, Homo sapiens
tgctgaagtccatctgtttgac

SEQ ID NO: 8489685 - DNA, 23 bp, Homo sapiens
tgctgaagtgttggccctgccca

SEQ ID NO: 8489686 - DNA, 22 bp, Homo sapiens
cccagggatgtggcagatgtta

SEQ ID NO: 8489687 - DNA, 22 bp, Homo sapiens
cccagggatgtggcagatgtta

SEQ ID NO: 8489688 - DNA, 22 bp, Homo sapiens
cccagggaggtagcaggagaaa

SEQ ID NO: 8489689 - DNA, 22 bp, Homo sapiens
cccagggatgtggcagatgtta

SEQ ID NO: 8489690 - DNA, 22 bp, Homo sapiens
cccagggaggtagcaggagaaa

SEQ ID NO: 8489691 - DNA, 22 bp, Homo sapiens
cccagggaggtagcaggagaaa

SEQ ID NO: 8489692 - DNA, 22 bp, Homo sapiens
cccagggaggtagcaggagaaa

SEQ ID NO: 8489693 - DNA, 22 bp, Homo sapiens
cccagggaggtagcaggagaaa

SEQ ID NO: 8489694 - DNA, 22 bp, Homo sapiens
cccagggaggcccaggctctgc

SEQ ID NO: 8489695 - DNA, 22 bp, Homo sapiens
cccagggagagcgcggaggcgg

SEQ ID NO: 8489696 - DNA, 22 bp, Homo sapiens
cccagggagagcgcggaggcgg

SEQ ID NO: 8489697 - DNA, 22 bp, Homo sapiens
cccagggactcgggattctagg

SEQ ID NO: 8489698 - DNA, 22 bp, Homo sapiens
cccagggactcgggattctagg

SEQ ID NO: 8489699 - DNA, 22 bp, Homo sapiens
tgctcccaaacgacctactgtg

SEQ ID NO: 8489700 - DNA, 22 bp, Homo sapiens
tgctcccaaacgacctactgtg

SEQ ID NO: 8489701 - DNA, 22 bp, Homo sapiens
tgctcccacactactcggaggc

SEQ ID NO: 8489702 - DNA, 22 bp, Homo sapiens
tgctcccacactactcggaggc

SEQ ID NO: 8489703 - DNA, 20 bp, Homo sapiens
cccagggacctgagctccat

SEQ ID NO: 8489704 - DNA, 17 bp, Homo sapiens
cccagggaccactgctt

SEQ ID NO: 8489705 - DNA, 22 bp, Homo sapiens
tgctcccagctcctgcagcaac

SEQ ID NO: 8489706 - DNA, 22 bp, Homo sapiens
tgctgcagaaattctgtgagga

SEQ ID NO: 8489707 - DNA, 22 bp, Homo sapiens
tgctgcagaaattctgtgagga

SEQ ID NO: 8489708 - DNA, 22 bp, Homo sapiens
tgctgcacaattggaaagtatc

SEQ ID NO: 8489709 - DNA, 22 bp, Homo sapiens
tgctgcactcaccaacagataa

SEQ ID NO: 8489710 - DNA, 22 bp, Homo sapiens
tgctgcacgataaataatttct

SEQ ID NO: 8489711 - DNA, 22 bp, Homo sapiens
tgctgagaagagggccgaccca

SEQ ID NO: 8489712 - DNA, 22 bp, Homo sapiens
tgctgagaatcacaggttataa

SEQ ID NO: 8489713 - DNA, 19 bp, Homo sapiens
tgctgactgagctgcaaaa

SEQ ID NO: 8489714 - DNA, 19 bp, Homo sapiens
tgctgactgggcctcaccg

SEQ ID NO: 8489715 - DNA, 22 bp, Homo sapiens
tgctgactcctggctgtgacac

SEQ ID NO: 8489716 - DNA, 22 bp, Homo sapiens
tgctgagaggaaagaatgcaca

SEQ ID NO: 8489717 - DNA, 22 bp, Homo sapiens
tgctgagataagctatgaccag

SEQ ID NO: 8489718 - DNA, 22 bp, Homo sapiens
tgctgagaggaaggtgcactgg

SEQ ID NO: 8489719 - DNA, 22 bp, Homo sapiens
tgctgagacacctaaggtaaat

SEQ ID NO: 8489720 - DNA, 22 bp, Homo sapiens
tgctgagagccagggctggcat

SEQ ID NO: 8489721 - DNA, 22 bp, Homo sapiens
tgctgagagatttaaagggcca

SEQ ID NO: 8489722 - DNA, 19 bp, Homo sapiens
tgctgaagttgtcagtctg

SEQ ID NO: 8489723 - DNA, 22 bp, Homo sapiens
tgctgaataataagattactca

SEQ ID NO: 8489724 - DNA, 22 bp, Homo sapiens
tgcctgggagtgaccaagactc

SEQ ID NO: 8489725 - DNA, 22 bp, Homo sapiens
tgcctgggagtgaccaagactc

SEQ ID NO: 8489726 - DNA, 22 bp, Homo sapiens
tgcctgggagtgaccaagactc

SEQ ID NO: 8489727 - DNA, 22 bp, Homo sapiens
tgcctgggacatgctgtggact

SEQ ID NO: 8489728 - DNA, 22 bp, Homo sapiens
tgcctgggactgtactaaattt

SEQ ID NO: 8489729 - DNA, 20 bp, Homo sapiens
tgcctgggaaggcgtggagg

SEQ ID NO: 8489730 - DNA, 22 bp, Homo sapiens
tgcctgggacatgctgtggact

SEQ ID NO: 8489731 - DNA, 22 bp, Homo sapiens
tgcctgctcttaccactctccc

SEQ ID NO: 8489732 - DNA, 22 bp, Homo sapiens
tgcctgctctgtgccacagttg

SEQ ID NO: 8489733 - DNA, 22 bp, Homo sapiens
tgcctgctcttgagacttacaa

SEQ ID NO: 8489734 - DNA, 22 bp, Homo sapiens
tgcctgctcttgagacttacaa

SEQ ID NO: 8489735 - DNA, 22 bp, Homo sapiens
tgcctgggcctctgaggaaggc

SEQ ID NO: 8489736 - DNA, 22 bp, Homo sapiens
tgcctgggcctctgaggaaggc

SEQ ID NO: 8489737 - DNA, 22 bp, Homo sapiens
tgcctgggccttcccacctctg

SEQ ID NO: 8489738 - DNA, 22 bp, Homo sapiens
tgcctgggccttcccacctctg

SEQ ID NO: 8489739 - DNA, 22 bp, Homo sapiens
tgcctgggccttcccacctctg

SEQ ID NO: 8489740 - DNA, 22 bp, Homo sapiens
tgcctgggatctgtgccctttg

SEQ ID NO: 8489741 - DNA, 22 bp, Homo sapiens
tgcctgggcctctgaggaaggc

SEQ ID NO: 8489742 - DNA, 22 bp, Homo sapiens
tgcctgggccttcccacctctg

SEQ ID NO: 8489743 - DNA, 22 bp, Homo sapiens
tgcctgggccttcccacctctg

SEQ ID NO: 8489744 - DNA, 22 bp, Homo sapiens
tgcctgggctcaccgcctcttt

SEQ ID NO: 8489745 - DNA, 22 bp, Homo sapiens
cccaggctcctactgtattctg

SEQ ID NO: 8489746 - DNA, 22 bp, Homo sapiens
cccaggctcctagaggcccaga

SEQ ID NO: 8489747 - DNA, 22 bp, Homo sapiens
cccaggctcctagaggcccaga

SEQ ID NO: 8489748 - DNA, 22 bp, Homo sapiens
tgctccatctctcgtggttcca

SEQ ID NO: 8489749 - DNA, 22 bp, Homo sapiens
tgctccatgcgctcggccggcg

SEQ ID NO: 8489750 - DNA, 22 bp, Homo sapiens
tgctccagtgcctgccccacag

SEQ ID NO: 8489751 - DNA, 22 bp, Homo sapiens
tgctccagtgcctgccccacag

SEQ ID NO: 8489752 - DNA, 22 bp, Homo sapiens
tgctccagtgcctgccccacag

SEQ ID NO: 8489753 - DNA, 22 bp, Homo sapiens
tgctccaggtgtgcctctcatg

SEQ ID NO: 8489754 - DNA, 23 bp, Homo sapiens
tgctccaggtacagaactccagg

SEQ ID NO: 8489755 - DNA, 23 bp, Homo sapiens
tgctccaggtacagaactccagg

SEQ ID NO: 8489756 - DNA, 22 bp, Homo sapiens
tgctccagggctgccagaccct

SEQ ID NO: 8489757 - DNA, 22 bp, Homo sapiens
tgctccaggtgtgcctctcatg

SEQ ID NO: 8489758 - DNA, 22 bp, Homo sapiens
tgctccaggtgtgcctctcatg

SEQ ID NO: 8489759 - DNA, 22 bp, Homo sapiens
tgctccagtgagctggccatcc

SEQ ID NO: 8489760 - DNA, 22 bp, Homo sapiens
tgctccagtgagctggccatcc

SEQ ID NO: 8489761 - DNA, 22 bp, Homo sapiens
tgctccagtgagctggccatcc

SEQ ID NO: 8489762 - DNA, 22 bp, Homo sapiens
tgctccagtgagctggccatcc

SEQ ID NO: 8489763 - DNA, 21 bp, Homo sapiens
tgctcagtaaatgctgagtga

SEQ ID NO: 8489764 - DNA, 22 bp, Homo sapiens
tgctccagggctgccagaccct

SEQ ID NO: 8489765 - DNA, 22 bp, Homo sapiens
tgctcagtagcagtgtgctgct

SEQ ID NO: 8489766 - DNA, 22 bp, Homo sapiens
cccaggctcttatgtgacttgc

SEQ ID NO: 8489767 - DNA, 22 bp, Homo sapiens
cccaggctcttatgtgacttgc

SEQ ID NO: 8489768 - DNA, 21 bp, Homo sapiens
cccaggctgaattaaaaatat

SEQ ID NO: 8489769 - DNA, 22 bp, Homo sapiens
cccaggctcctgactcattcta

SEQ ID NO: 8489770 - DNA, 22 bp, Homo sapiens
cccaggctcctgactcattcta

SEQ ID NO: 8489771 - DNA, 22 bp, Homo sapiens
cccaggctcctgctgtgttgac

SEQ ID NO: 8489772 - DNA, 22 bp, Homo sapiens
cccaggctcctgctgtgttgac

SEQ ID NO: 8489773 - DNA, 22 bp, Homo sapiens
cccaggctcctgctgtgttgac

SEQ ID NO: 8489774 - DNA, 22 bp, Homo sapiens
ccccagccagcttgtagtagaa

SEQ ID NO: 8489775 - DNA, 22 bp, Homo sapiens
ccccagccagcttgtagtagaa

SEQ ID NO: 8489776 - DNA, 22 bp, Homo sapiens
ccccagccagcaggacctctga

SEQ ID NO: 8489777 - DNA, 22 bp, Homo sapiens
ccccagccagcaggacctctga

SEQ ID NO: 8489778 - DNA, 22 bp, Homo sapiens
ccccagccagcaggacctctga

SEQ ID NO: 8489779 - DNA, 22 bp, Homo sapiens
ccccagcagactcagggcaggt

SEQ ID NO: 8489780 - DNA, 22 bp, Homo sapiens
ccccagcagcacctggggcagt

SEQ ID NO: 8489781 - DNA, 22 bp, Homo sapiens
ccccagcaggaatacaggggtc

SEQ ID NO: 8489782 - DNA, 22 bp, Homo sapiens
tgctgcagcagtgcgggcagct

SEQ ID NO: 8489783 - DNA, 22 bp, Homo sapiens
tgctgcagctaaggtgaggtgc

SEQ ID NO: 8489784 - DNA, 22 bp, Homo sapiens
tgctgcagcggcatggtctttg

SEQ ID NO: 8489785 - DNA, 22 bp, Homo sapiens
tgctgcagatcagctgagtcct

SEQ ID NO: 8489786 - DNA, 22 bp, Homo sapiens
tgctgcaggaacttaagaagct

SEQ ID NO: 8489787 - DNA, 22 bp, Homo sapiens
tgctgcaggaattctcaaggga

SEQ ID NO: 8489788 - DNA, 22 bp, Homo sapiens
ccccacctgtgcgtctgccgca

SEQ ID NO: 8489789 - DNA, 22 bp, Homo sapiens
ccccactctcggccagataggc

SEQ ID NO: 8489790 - DNA, 22 bp, Homo sapiens
ccccaggcctgttggatggcgc

SEQ ID NO: 8489791 - DNA, 22 bp, Homo sapiens
tgctggagcatctgagagcatc

SEQ ID NO: 8489792 - DNA, 22 bp, Homo sapiens
tgctggagcatctgagagcatc

SEQ ID NO: 8489793 - DNA, 22 bp, Homo sapiens
tgctggagcatctgagagcatc

SEQ ID NO: 8489794 - DNA, 22 bp, Homo sapiens
tgctggagagccttggccaagg

SEQ ID NO: 8489795 - DNA, 22 bp, Homo sapiens
tgctggagagctagttctgcag

SEQ ID NO: 8489796 - DNA, 22 bp, Homo sapiens
tgctggagagccttggccaagg

SEQ ID NO: 8489797 - DNA, 22 bp, Homo sapiens
tgctggagaggaaggtggggtc

SEQ ID NO: 8489798 - DNA, 22 bp, Homo sapiens
tgctggagatgaaagggccctg

SEQ ID NO: 8489799 - DNA, 22 bp, Homo sapiens
tgctggagatcattaatgttca

SEQ ID NO: 8489800 - DNA, 22 bp, Homo sapiens
tgctggagatcattaatgttca

SEQ ID NO: 8489801 - DNA, 22 bp, Homo sapiens
ccccagcccacaagcatattaa

SEQ ID NO: 8489802 - DNA, 22 bp, Homo sapiens
ccccagcccacaagcatattaa

SEQ ID NO: 8489803 - DNA, 22 bp, Homo sapiens
ccccagccttccatgggaattg

SEQ ID NO: 8489804 - DNA, 22 bp, Homo sapiens
ccccagccttccatgggaattg

SEQ ID NO: 8489805 - DNA, 22 bp, Homo sapiens
ccccagccttccatgggaattg

SEQ ID NO: 8489806 - DNA, 23 bp, Homo sapiens
tgctggagacaagtgtgagaagg

SEQ ID NO: 8489807 - DNA, 22 bp, Homo sapiens
ccccagctcagtgcagggacat

SEQ ID NO: 8489808 - DNA, 22 bp, Homo sapiens
tgctggagactcactcaggtgc

SEQ ID NO: 8489809 - DNA, 22 bp, Homo sapiens
tgctggagagccttggccaagg

SEQ ID NO: 8489810 - DNA, 22 bp, Homo sapiens
tgctggagacatagcaggcagc

SEQ ID NO: 8489811 - DNA, 22 bp, Homo sapiens
tgctggagacatagcaggcagc

SEQ ID NO: 8489812 - DNA, 22 bp, Homo sapiens
tgctggagacctgcttgcacca

SEQ ID NO: 8489813 - DNA, 22 bp, Homo sapiens
cccctcaggtacccgtgcagca

SEQ ID NO: 8489814 - DNA, 22 bp, Homo sapiens
cccctcaggtacccgtgcagca

SEQ ID NO: 8489815 - DNA, 22 bp, Homo sapiens
cccctcaggtacccgtgcagca

SEQ ID NO: 8489816 - DNA, 21 bp, Homo sapiens
cccctcatacactctccttgc

SEQ ID NO: 8489817 - DNA, 22 bp, Homo sapiens
ccccctggcaggctggcctctc

SEQ ID NO: 8489818 - DNA, 22 bp, Homo sapiens
ccccctggcaggctggcctctc

SEQ ID NO: 8489819 - DNA, 22 bp, Homo sapiens
ccccgaggctggagtgcagtgg

SEQ ID NO: 8489820 - DNA, 22 bp, Homo sapiens
ccccgccctgcgcggggataac

SEQ ID NO: 8489821 - DNA, 22 bp, Homo sapiens
ccccgcgcgttgtcccgcaggt

SEQ ID NO: 8489822 - DNA, 16 bp, Homo sapiens
cccctcaggaagtaca

SEQ ID NO: 8489823 - DNA, 22 bp, Homo sapiens
ccccctctgccggggtccttca

SEQ ID NO: 8489824 - DNA, 22 bp, Homo sapiens
cccccatccatgtcaggagagg

SEQ ID NO: 8489825 - DNA, 22 bp, Homo sapiens
cccccagtctgaacagcagctg

SEQ ID NO: 8489826 - DNA, 22 bp, Homo sapiens
cccccaggctctgacacaggag

SEQ ID NO: 8489827 - DNA, 22 bp, Homo sapiens
cccccaggctctgacacaggag

SEQ ID NO: 8489828 - DNA, 22 bp, Homo sapiens
cccccaggctctgacacaggag

SEQ ID NO: 8489829 - DNA, 22 bp, Homo sapiens
cccccaggctctgacacaggag

SEQ ID NO: 8489830 - DNA, 22 bp, Homo sapiens
cccccaggctctgacacaggag

SEQ ID NO: 8489831 - DNA, 22 bp, Homo sapiens
cccccagatgcgagccatagcc

SEQ ID NO: 8489832 - DNA, 22 bp, Homo sapiens
cccccagccagcagtgctcagc

SEQ ID NO: 8489833 - DNA, 22 bp, Homo sapiens
ccccagggaagctttgcttact

SEQ ID NO: 8489834 - DNA, 22 bp, Homo sapiens
ccccagggaagctttgcttact

SEQ ID NO: 8489835 - DNA, 22 bp, Homo sapiens
cccccaaagtttgcacggataa

SEQ ID NO: 8489836 - DNA, 22 bp, Homo sapiens
cccccaaagtttgcacggataa

SEQ ID NO: 8489837 - DNA, 22 bp, Homo sapiens
cccccaccgtgttcctgctcgg

SEQ ID NO: 8489838 - DNA, 22 bp, Homo sapiens
cccccaccgtgttcctgctcgg

SEQ ID NO: 8489839 - DNA, 22 bp, Homo sapiens
cccccaccgtgttcctgctcgg

SEQ ID NO: 8489840 - DNA, 22 bp, Homo sapiens
cccccacctgaggacagtctta

SEQ ID NO: 8489841 - DNA, 22 bp, Homo sapiens
cccccacctgaggacagtctta

SEQ ID NO: 8489842 - DNA, 22 bp, Homo sapiens
cccctctccctcacttatcaat

SEQ ID NO: 8489843 - DNA, 22 bp, Homo sapiens
cccctctgcaaatagccaggct

SEQ ID NO: 8489844 - DNA, 22 bp, Homo sapiens
cccctctccctcacttatcaat

SEQ ID NO: 8489845 - DNA, 22 bp, Homo sapiens
cccctcctggccacactgtcag

SEQ ID NO: 8489846 - DNA, 22 bp, Homo sapiens
cccctctggtcaaccagtcaca

SEQ ID NO: 8489847 - DNA, 20 bp, Homo sapiens
ccctaggaacgcagcaggag

SEQ ID NO: 8489848 - DNA, 22 bp, Homo sapiens
cccctccctgacctggttgggc

SEQ ID NO: 8489849 - DNA, 22 bp, Homo sapiens
cccctccctgacctggttgggc

SEQ ID NO: 8489850 - DNA, 22 bp, Homo sapiens
cccctccctgacctggttgggc

SEQ ID NO: 8489851 - DNA, 22 bp, Homo sapiens
cccctccctgacctggttgggc

SEQ ID NO: 8489852 - DNA, 22 bp, Homo sapiens
cccctcctggccacactgtcag

SEQ ID NO: 8489853 - DNA, 22 bp, Homo sapiens
ccctcagggaccactgacttca

SEQ ID NO: 8489854 - DNA, 22 bp, Homo sapiens
ccctcagggaccactgacttca

SEQ ID NO: 8489855 - DNA, 19 bp, Homo sapiens
ccctcaggtctgagcagtc

SEQ ID NO: 8489856 - DNA, 19 bp, Homo sapiens
ccctcaggtctgagcagtc

SEQ ID NO: 8489857 - DNA, 19 bp, Homo sapiens
ccctcaggtctgagcagtc

SEQ ID NO: 8489858 - DNA, 19 bp, Homo sapiens
ccctcaggtctgagcagtc

SEQ ID NO: 8489859 - DNA, 22 bp, Homo sapiens
ccctcaggagatgtcagctgga

SEQ ID NO: 8489860 - DNA, 22 bp, Homo sapiens
ccctcaggatgcagtggaagtg

SEQ ID NO: 8489861 - DNA, 22 bp, Homo sapiens
ccctcaggatgcagtggaagtg

SEQ ID NO: 8489862 - DNA, 22 bp, Homo sapiens
ccctcagctccaccctcagcag

SEQ ID NO: 8489863 - DNA, 22 bp, Homo sapiens
ccctcagcttctccctgcagct

SEQ ID NO: 8489864 - DNA, 22 bp, Homo sapiens
ccctcaggagatgtcagctgga

SEQ ID NO: 8489865 - DNA, 22 bp, Homo sapiens
ccctcaggagatgtcagctgga

SEQ ID NO: 8489866 - DNA, 21 bp, Homo sapiens
ccctcaggaaacagaatgcac

SEQ ID NO: 8489867 - DNA, 22 bp, Homo sapiens
ttggccacactcactagagccc

SEQ ID NO: 8489868 - DNA, 22 bp, Homo sapiens
ttggccagacactacccccctt

SEQ ID NO: 8489869 - DNA, 22 bp, Homo sapiens
ttggccagacactacccccctt

SEQ ID NO: 8489870 - DNA, 22 bp, Homo sapiens
ttggccagaggtttctctcatg

SEQ ID NO: 8489871 - DNA, 22 bp, Homo sapiens
ttggccagaggtttctctcatg

SEQ ID NO: 8489872 - DNA, 22 bp, Homo sapiens
ttggccaaaggaaagactactg

SEQ ID NO: 8489873 - DNA, 22 bp, Homo sapiens
ctcataatgtgactgtatttga

SEQ ID NO: 8489874 - DNA, 22 bp, Homo sapiens
ctcataaagtgagaatatgacc

SEQ ID NO: 8489875 - DNA, 22 bp, Homo sapiens
ctcataaacattattcattatt

SEQ ID NO: 8489876 - DNA, 22 bp, Homo sapiens
ttggccagatctgaggatactg

SEQ ID NO: 8489877 - DNA, 22 bp, Homo sapiens
ctcatagatttagatagatcga

SEQ ID NO: 8489878 - DNA, 22 bp, Homo sapiens
ctcatattcagtcactgatgca

SEQ ID NO: 8489879 - DNA, 22 bp, Homo sapiens
ctcatacatatgccattcctgc

SEQ ID NO: 8489880 - DNA, 22 bp, Homo sapiens
ctcatagacaagcctcttttaa

SEQ ID NO: 8489881 - DNA, 22 bp, Homo sapiens
ctcatccaccctcactaggaaa

SEQ ID NO: 8489882 - DNA, 22 bp, Homo sapiens
ctcatcaccacatataacaaag

SEQ ID NO: 8489883 - DNA, 22 bp, Homo sapiens
ctcatattgctggtggtctaag

SEQ ID NO: 8489884 - DNA, 22 bp, Homo sapiens
ctcatcagaaatacctgacaaa

SEQ ID NO: 8489885 - DNA, 22 bp, Homo sapiens
ttgggcagcattgcagttccct

SEQ ID NO: 8489886 - DNA, 22 bp, Homo sapiens
ctcatctgctcttattatctta

SEQ ID NO: 8489887 - DNA, 22 bp, Homo sapiens
ctcatctgataaatcactctta

SEQ ID NO: 8489888 - DNA, 22 bp, Homo sapiens
ctcatctgataaatcactctta

SEQ ID NO: 8489889 - DNA, 20 bp, Homo sapiens
ctcatctctgagcctcctgg

SEQ ID NO: 8489890 - DNA, 22 bp, Homo sapiens
ctcatccaccgcagcccctcag

SEQ ID NO: 8489891 - DNA, 22 bp, Homo sapiens
ttgggaggtaatggagccaagt

SEQ ID NO: 8489892 - DNA, 22 bp, Homo sapiens
ttgggaggtcataaatctgttc

SEQ ID NO: 8489893 - DNA, 22 bp, Homo sapiens
ttgggaggtcataaatctgttc

SEQ ID NO: 8489894 - DNA, 22 bp, Homo sapiens
ttgctttgccaccagaagtcta

SEQ ID NO: 8489895 - DNA, 22 bp, Homo sapiens
ctcagtttttgctgtctggttc

SEQ ID NO: 8489896 - DNA, 22 bp, Homo sapiens
ctcagttttgctagctggagtt

SEQ ID NO: 8489897 - DNA, 22 bp, Homo sapiens
ctcagtttctgacattaaaatc

SEQ ID NO: 8489898 - DNA, 22 bp, Homo sapiens
ctcagtttctgacattaaaatc

SEQ ID NO: 8489899 - DNA, 22 bp, Homo sapiens
ctcagtttgtgtgatattgtct

SEQ ID NO: 8489900 - DNA, 22 bp, Homo sapiens
ctcagtttgaggggtaggtgtt

SEQ ID NO: 8489901 - DNA, 22 bp, Homo sapiens
ctcagtttcttactctgtataa

SEQ ID NO: 8489902 - DNA, 22 bp, Homo sapiens
ctcagtttgaatgctgacactg

SEQ ID NO: 8489903 - DNA, 22 bp, Homo sapiens
ctcagtgctttggatcctggat

SEQ ID NO: 8489904 - DNA, 22 bp, Homo sapiens
ctcagtttccccggcctgggcg

SEQ ID NO: 8489905 - DNA, 22 bp, Homo sapiens
ctcagtttcctcaactgcaaaa

SEQ ID NO: 8489906 - DNA, 22 bp, Homo sapiens
ctcagtttcctcttctgttgaa

SEQ ID NO: 8489907 - DNA, 22 bp, Homo sapiens
ttgatattagagtatttgtttg

SEQ ID NO: 8489908 - DNA, 22 bp, Homo sapiens
ttgatacaggctctatttcatc

SEQ ID NO: 8489909 - DNA, 22 bp, Homo sapiens
ttgatacatagcacagtttagg

SEQ ID NO: 8489910 - DNA, 22 bp, Homo sapiens
ttgatacatagcacagtttagg

SEQ ID NO: 8489911 - DNA, 22 bp, Homo sapiens
ttgatacaggctctatttcatc

SEQ ID NO: 8489912 - DNA, 22 bp, Homo sapiens
ttgatacaggctctatttcatc

SEQ ID NO: 8489913 - DNA, 22 bp, Homo sapiens
ttgatacatagcacagtttagg

SEQ ID NO: 8489914 - DNA, 22 bp, Homo sapiens
ttgatacatgctctagagttga

SEQ ID NO: 8489915 - DNA, 22 bp, Homo sapiens
ttgatacatttttaggataaac

SEQ ID NO: 8489916 - DNA, 22 bp, Homo sapiens
ttgcttttgggaaaacatgcct

SEQ ID NO: 8489917 - DNA, 22 bp, Homo sapiens
ttgcttttaattaatcattgct

SEQ ID NO: 8489918 - DNA, 18 bp, Homo sapiens
ttgctttgtaagcttgca

SEQ ID NO: 8489919 - DNA, 18 bp, Homo sapiens
ttgctttgtaagcttgca

SEQ ID NO: 8489920 - DNA, 22 bp, Homo sapiens
ttgctttgtggtggttcttcca

SEQ ID NO: 8489921 - DNA, 22 bp, Homo sapiens
ttgctttgtggtggttcttcca

SEQ ID NO: 8489922 - DNA, 22 bp, Homo sapiens
ttgcttttaatctttgtacatc

SEQ ID NO: 8489923 - DNA, 22 bp, Homo sapiens
ttgctttgttactgcagtttcc

SEQ ID NO: 8489924 - DNA, 22 bp, Homo sapiens
ttggcatttttcctcagctgga

SEQ ID NO: 8489925 - DNA, 22 bp, Homo sapiens
ttggatgaagtctagctttagt

SEQ ID NO: 8489926 - DNA, 22 bp, Homo sapiens
ttggcattgaagtttcattggt

SEQ ID NO: 8489927 - DNA, 22 bp, Homo sapiens
ttggcattggagatgcaagaac

SEQ ID NO: 8489928 - DNA, 22 bp, Homo sapiens
ttggcattgaagtttcattggt

SEQ ID NO: 8489929 - DNA, 22 bp, Homo sapiens
ttggaaaacttacacagagctg

SEQ ID NO: 8489930 - DNA, 22 bp, Homo sapiens
ttggaaaacttacacagagctg

SEQ ID NO: 8489931 - DNA, 22 bp, Homo sapiens
ttgctttttaattaggaggcag

SEQ ID NO: 8489932 - DNA, 22 bp, Homo sapiens
ttggaaaagcgttctctgtagc

SEQ ID NO: 8489933 - DNA, 22 bp, Homo sapiens
ctccagtctagtagagcctgct

SEQ ID NO: 8489934 - DNA, 22 bp, Homo sapiens
ctccagtgagtgagcaggcgac

SEQ ID NO: 8489935 - DNA, 22 bp, Homo sapiens
ctccagtgagtgagcaggcgac

SEQ ID NO: 8489936 - DNA, 22 bp, Homo sapiens
ctccagtgagtgagcaggcgac

SEQ ID NO: 8489937 - DNA, 22 bp, Homo sapiens
ctccagtgagcgcggggcatgg

SEQ ID NO: 8489938 - DNA, 22 bp, Homo sapiens
ctccagtgagcgcggggcatgg

SEQ ID NO: 8489939 - DNA, 22 bp, Homo sapiens
ctccaggttttacaaggtctat

SEQ ID NO: 8489940 - DNA, 22 bp, Homo sapiens
ctccaggttgacttcagtcaat

SEQ ID NO: 8489941 - DNA, 22 bp, Homo sapiens
ctccaggttacttagcctagct

SEQ ID NO: 8489942 - DNA, 22 bp, Homo sapiens
ctccaggtagttatttcaagaa

SEQ ID NO: 8489943 - DNA, 22 bp, Homo sapiens
ctccaggtattactgttttccc

SEQ ID NO: 8489944 - DNA, 22 bp, Homo sapiens
ctccaggtgcagaaggactcag

SEQ ID NO: 8489945 - DNA, 22 bp, Homo sapiens
ctccaggtgcagaaggactcag

SEQ ID NO: 8489946 - DNA, 22 bp, Homo sapiens
tttaaaaaactagtctgagtct

SEQ ID NO: 8489947 - DNA, 22 bp, Homo sapiens
ttgtttcatggggatgtttatt

SEQ ID NO: 8489948 - DNA, 22 bp, Homo sapiens
ttgtttcatgagtgtaaaggga

SEQ ID NO: 8489949 - DNA, 22 bp, Homo sapiens
ttgtttcagctgtatgctatgt

SEQ ID NO: 8489950 - DNA, 22 bp, Homo sapiens
ctccagtgccctccttgggggc

SEQ ID NO: 8489951 - DNA, 22 bp, Homo sapiens
ctccagtgcacccagaggattt

SEQ ID NO: 8489952 - DNA, 22 bp, Homo sapiens
ctccagtgcacccagaggattt

SEQ ID NO: 8489953 - DNA, 22 bp, Homo sapiens
ttgttaaaatgaggtcattctg

SEQ ID NO: 8489954 - DNA, 22 bp, Homo sapiens
ttgttaaaatgaggtcattctg

SEQ ID NO: 8489955 - DNA, 22 bp, Homo sapiens
ttgttaaaatattggagaaagg

SEQ ID NO: 8489956 - DNA, 22 bp, Homo sapiens
ttgttaaaactccattggtttg

SEQ ID NO: 8489957 - DNA, 22 bp, Homo sapiens
ttgttaaaatattggagaaagg

SEQ ID NO: 8489958 - DNA, 22 bp, Homo sapiens
ttgttaaaatattggagaaagg

SEQ ID NO: 8489959 - DNA, 22 bp, Homo sapiens
ttgttaaaattggagccgagag

SEQ ID NO: 8489960 - DNA, 22 bp, Homo sapiens
ttgttaaaatgcatattctggt

SEQ ID NO: 8489961 - DNA, 22 bp, Homo sapiens
ttgttaaaatgcatattctggt

SEQ ID NO: 8489962 - DNA, 22 bp, Homo sapiens
ttgttaaaatgcatattctggt

SEQ ID NO: 8489963 - DNA, 22 bp, Homo sapiens
ttgtattttgttatgctactgc

SEQ ID NO: 8489964 - DNA, 22 bp, Homo sapiens
ttgtattttgttatgctactgc

SEQ ID NO: 8489965 - DNA, 22 bp, Homo sapiens
ttgtgtacaggtgtttccaagt

SEQ ID NO: 8489966 - DNA, 22 bp, Homo sapiens
ttgtgtactacagtatgccaca

SEQ ID NO: 8489967 - DNA, 22 bp, Homo sapiens
ttgtattttgttatgctactgc

SEQ ID NO: 8489968 - DNA, 22 bp, Homo sapiens
ttgttaaaactccattggtttg

SEQ ID NO: 8489969 - DNA, 22 bp, Homo sapiens
ttgttaaaaatagatttccagg

SEQ ID NO: 8489970 - DNA, 22 bp, Homo sapiens
ttgttaaaactccattggtttg

SEQ ID NO: 8489971 - DNA, 22 bp, Homo sapiens
ttgtgtactgttggttgatatt

SEQ ID NO: 8489972 - DNA, 22 bp, Homo sapiens
ttgttaaaaatagatttccagg

SEQ ID NO: 8489973 - DNA, 22 bp, Homo sapiens
ttgttacacataataacatttt

SEQ ID NO: 8489974 - DNA, 22 bp, Homo sapiens
ttgttacagcagcaatagaaaa

SEQ ID NO: 8489975 - DNA, 22 bp, Homo sapiens
ttgttacacataataacatttt

SEQ ID NO: 8489976 - DNA, 22 bp, Homo sapiens
ttgttacagcagcaatagaaaa

SEQ ID NO: 8489977 - DNA, 22 bp, Homo sapiens
ctccagggttccccgatccact

SEQ ID NO: 8489978 - DNA, 22 bp, Homo sapiens
ctccaggtagctaagtcctggg

SEQ ID NO: 8489979 - DNA, 22 bp, Homo sapiens
ctccaggtagctaagtcctggg

SEQ ID NO: 8489980 - DNA, 22 bp, Homo sapiens
ctccagggttccccgatccact

SEQ ID NO: 8489981 - DNA, 18 bp, Homo sapiens
ctccaggtaattctgata

SEQ ID NO: 8489982 - DNA, 22 bp, Homo sapiens
ttgttaaagatgcagattccat

SEQ ID NO: 8489983 - DNA, 22 bp, Homo sapiens
ttgttaaaggcaaaacaagcac

SEQ ID NO: 8489984 - DNA, 22 bp, Homo sapiens
ttgttaaaggcaaaacaagcac

SEQ ID NO: 8489985 - DNA, 21 bp, Homo sapiens
ttgttacaatgcaagagtatg

SEQ ID NO: 8489986 - DNA, 21 bp, Homo sapiens
ttgttacaatgcaagagtatg

SEQ ID NO: 8489987 - DNA, 22 bp, Homo sapiens
ttgttaacggaaaactgttttc

SEQ ID NO: 8489988 - DNA, 22 bp, Homo sapiens
ttgttaaatggatgcagaataa

SEQ ID NO: 8489989 - DNA, 22 bp, Homo sapiens
ttgttaaatggatgcagaataa

SEQ ID NO: 8489990 - DNA, 22 bp, Homo sapiens
ttgttaaatggatgcagaataa

SEQ ID NO: 8489991 - DNA, 22 bp, Homo sapiens
ttgttaaaggcaaaacaagcac

SEQ ID NO: 8489992 - DNA, 22 bp, Homo sapiens
ctccaggggccagaagcctggc

SEQ ID NO: 8489993 - DNA, 20 bp, Homo sapiens
ctccaggggaagagccttcc

SEQ ID NO: 8489994 - DNA, 20 bp, Homo sapiens
ctccaggggaagagccttcc

SEQ ID NO: 8489995 - DNA, 22 bp, Homo sapiens
ctccagggggcatccacacagc

SEQ ID NO: 8489996 - DNA, 22 bp, Homo sapiens
ctccaggggccagaagcctggc

SEQ ID NO: 8489997 - DNA, 22 bp, Homo sapiens
ctccagggcagcatggcagtgg

SEQ ID NO: 8489998 - DNA, 22 bp, Homo sapiens
ctccagggcagcatggcagtgg

SEQ ID NO: 8489999 - DNA, 22 bp, Homo sapiens
ctccagggcagcatggcagtgg

SEQ ID NO: 8490000 - DNA, 22 bp, Homo sapiens
ctccagggcagcatggcagtgg

SEQ ID NO: 8490001 - DNA, 20 bp, Homo sapiens
ctccaggggaagagccttcc

SEQ ID NO: 8490002 - DNA, 20 bp, Homo sapiens
ctccaggggaagagccttcc

SEQ ID NO: 8490003 - DNA, 22 bp, Homo sapiens
ctccagggatgagacagagtag

SEQ ID NO: 8490004 - DNA, 22 bp, Homo sapiens
ctccagggatgagacagagtag

SEQ ID NO: 8490005 - DNA, 22 bp, Homo sapiens
ctccagggaggtctgcaggact

SEQ ID NO: 8490006 - DNA, 22 bp, Homo sapiens
ctccagggaggagcacgggttc

SEQ ID NO: 8490007 - DNA, 22 bp, Homo sapiens
ctccagggaggtctgcaggact

SEQ ID NO: 8490008 - DNA, 22 bp, Homo sapiens
ctccagggaggtctgcaggact

SEQ ID NO: 8490009 - DNA, 22 bp, Homo sapiens
ctccagggaggtctgcaggact

SEQ ID NO: 8490010 - DNA, 22 bp, Homo sapiens
ttgtatttcttccggtctcatt

SEQ ID NO: 8490011 - DNA, 22 bp, Homo sapiens
ttgtatttcttccggtctcatt

SEQ ID NO: 8490012 - DNA, 22 bp, Homo sapiens
ttgtatttgattgtcatatcgt

SEQ ID NO: 8490013 - DNA, 22 bp, Homo sapiens
ttgtatttgattgtcatatcgt

SEQ ID NO: 8490014 - DNA, 22 bp, Homo sapiens
ttgtatttctccactttctgtt

SEQ ID NO: 8490015 - DNA, 22 bp, Homo sapiens
ttgtatttctccactttctgtt

SEQ ID NO: 8490016 - DNA, 22 bp, Homo sapiens
ctccagggggcatccacacagc

SEQ ID NO: 8490017 - DNA, 22 bp, Homo sapiens
ttgtatttgggtagtatagaga

SEQ ID NO: 8490018 - DNA, 22 bp, Homo sapiens
ttgtatttgggtagtatagaga

SEQ ID NO: 8490019 - DNA, 22 bp, Homo sapiens
ttgtatttgggtagtatagaga

SEQ ID NO: 8490020 - DNA, 22 bp, Homo sapiens
ttgtatttgggtagtatagaga

SEQ ID NO: 8490021 - DNA, 22 bp, Homo sapiens
ttgtattttgttatgctactgc

SEQ ID NO: 8490022 - DNA, 22 bp, Homo sapiens
ttgtatttgattgtcatatcgt

SEQ ID NO: 8490023 - DNA, 22 bp, Homo sapiens
ttgtatttgattgtcatatcgt

SEQ ID NO: 8490024 - DNA, 22 bp, Homo sapiens
ctccaggcgcttaccaagcgct

SEQ ID NO: 8490025 - DNA, 22 bp, Homo sapiens
ctccagggagctgtggaggttt

SEQ ID NO: 8490026 - DNA, 22 bp, Homo sapiens
ctccagggagctgcgggagcca

SEQ ID NO: 8490027 - DNA, 22 bp, Homo sapiens
ctccagggagctgtggaggttt

SEQ ID NO: 8490028 - DNA, 22 bp, Homo sapiens
ctccagggagctgtggaggttt

SEQ ID NO: 8490029 - DNA, 22 bp, Homo sapiens
ctccagggagctgtggaggttt

SEQ ID NO: 8490030 - DNA, 22 bp, Homo sapiens
ctccagggagcttggaaagacc

SEQ ID NO: 8490031 - DNA, 22 bp, Homo sapiens
ctccagggaggagcacgggttc

SEQ ID NO: 8490032 - DNA, 22 bp, Homo sapiens
ttgggtgctgtcatggggcacg

SEQ ID NO: 8490033 - DNA, 22 bp, Homo sapiens
ttgggtctacgtagaaagaaca

SEQ ID NO: 8490034 - DNA, 22 bp, Homo sapiens
ttggggtgttggatggagcaag

SEQ ID NO: 8490035 - DNA, 22 bp, Homo sapiens
ttgggtggtggggagagttcag

SEQ ID NO: 8490036 - DNA, 22 bp, Homo sapiens
ttgggtggtggggagagttcag

SEQ ID NO: 8490037 - DNA, 22 bp, Homo sapiens
ttggtaaataacaatcacagtg

SEQ ID NO: 8490038 - DNA, 22 bp, Homo sapiens
ttggtacatgttaaggaagagt

SEQ ID NO: 8490039 - DNA, 22 bp, Homo sapiens
ctctccagatctgctgagccag

SEQ ID NO: 8490040 - DNA, 22 bp, Homo sapiens
ctctccagcagatgtagtctgt

SEQ ID NO: 8490041 - DNA, 22 bp, Homo sapiens
ctctccagcagatgtagtctgt

SEQ ID NO: 8490042 - DNA, 22 bp, Homo sapiens
ctctccagatctgctgagccag

SEQ ID NO: 8490043 - DNA, 22 bp, Homo sapiens
ctctccagagcccttccggccc

SEQ ID NO: 8490044 - DNA, 22 bp, Homo sapiens
ctctccagagcccttccggccc

SEQ ID NO: 8490045 - DNA, 22 bp, Homo sapiens
ctctccagcctttagcccacgc

SEQ ID NO: 8490046 - DNA, 22 bp, Homo sapiens
ctctccagccacagaagctgct

SEQ ID NO: 8490047 - DNA, 22 bp, Homo sapiens
ctctccagccacagaagctgct

SEQ ID NO: 8490048 - DNA, 22 bp, Homo sapiens
ctctccagccaggggcttcctg

SEQ ID NO: 8490049 - DNA, 22 bp, Homo sapiens
ctctccagccaggggcttcctg

SEQ ID NO: 8490050 - DNA, 18 bp, Homo sapiens
ctcctgggctgcagatgc

SEQ ID NO: 8490051 - DNA, 22 bp, Homo sapiens
ctcctgggctgggaactcagcc

SEQ ID NO: 8490052 - DNA, 22 bp, Homo sapiens
ctcctgggctgtcggcgctctg

SEQ ID NO: 8490053 - DNA, 22 bp, Homo sapiens
ctctccactgtcctttgctggt

SEQ ID NO: 8490054 - DNA, 22 bp, Homo sapiens
ctctccagaattattactatta

SEQ ID NO: 8490055 - DNA, 22 bp, Homo sapiens
ctctccagaattattactatta

SEQ ID NO: 8490056 - DNA, 19 bp, Homo sapiens
ctctcactcgccacatcct

SEQ ID NO: 8490057 - DNA, 21 bp, Homo sapiens
ctcctgggctaagatatagtg

SEQ ID NO: 8490058 - DNA, 22 bp, Homo sapiens
ctcctgggctatgtctgcttgg

SEQ ID NO: 8490059 - DNA, 22 bp, Homo sapiens
ctcctgggctcatatcattcag

SEQ ID NO: 8490060 - DNA, 18 bp, Homo sapiens
ctcctgggctgcagatgc

SEQ ID NO: 8490061 - DNA, 22 bp, Homo sapiens
ctcctgggctcaagtgatcctc

SEQ ID NO: 8490062 - DNA, 22 bp, Homo sapiens
ctcctgggagtcttcctggatg

SEQ ID NO: 8490063 - DNA, 22 bp, Homo sapiens
ctcctgggagtcttcctggatg

SEQ ID NO: 8490064 - DNA, 22 bp, Homo sapiens
ctcctgggagtcttcctggatg

SEQ ID NO: 8490065 - DNA, 22 bp, Homo sapiens
ctcctgggaggatgcggacccg

SEQ ID NO: 8490066 - DNA, 22 bp, Homo sapiens
ctcctgggagctgtggcagagc

SEQ ID NO: 8490067 - DNA, 22 bp, Homo sapiens
ctcctgggagctgtggcagagc

SEQ ID NO: 8490068 - DNA, 22 bp, Homo sapiens
ctcctgggagctgtggcagagc

SEQ ID NO: 8490069 - DNA, 22 bp, Homo sapiens
ctcctgggagctgtggcagagc

SEQ ID NO: 8490070 - DNA, 22 bp, Homo sapiens
ctcctgggagcagggatggatg

SEQ ID NO: 8490071 - DNA, 22 bp, Homo sapiens
ctcctgggagcagggatggatg

SEQ ID NO: 8490072 - DNA, 22 bp, Homo sapiens
ctcctgggagcagggatggatg

SEQ ID NO: 8490073 - DNA, 22 bp, Homo sapiens
ctcctggctcgcccccagctga

SEQ ID NO: 8490074 - DNA, 19 bp, Homo sapiens
ctctccagctccagtagct

SEQ ID NO: 8490075 - DNA, 22 bp, Homo sapiens
ctctccaggagagcactttgag

SEQ ID NO: 8490076 - DNA, 22 bp, Homo sapiens
tttcagtgtgtaaattgaaata

SEQ ID NO: 8490077 - DNA, 22 bp, Homo sapiens
ctctccaggactttggcccaat

SEQ ID NO: 8490078 - DNA, 22 bp, Homo sapiens
tttcagttagctgagacccagg

SEQ ID NO: 8490079 - DNA, 22 bp, Homo sapiens
tttcagttcagtttattatatc

SEQ ID NO: 8490080 - DNA, 22 bp, Homo sapiens
tttcagtgtgtaaattgaaata

SEQ ID NO: 8490081 - DNA, 22 bp, Homo sapiens
tttcagttaagtggctagtccc

SEQ ID NO: 8490082 - DNA, 22 bp, Homo sapiens
tttcagttactgctatatcatt

SEQ ID NO: 8490083 - DNA, 22 bp, Homo sapiens
tttcagttactgctatatcatt

SEQ ID NO: 8490084 - DNA, 22 bp, Homo sapiens
tttcagttaagtggctagtccc

SEQ ID NO: 8490085 - DNA, 21 bp, Homo sapiens
ctctccagtggttcctgattc

SEQ ID NO: 8490086 - DNA, 22 bp, Homo sapiens
tttcagtttaagtaactgctat

SEQ ID NO: 8490087 - DNA, 21 bp, Homo sapiens
ctctccagtggttcctgattc

SEQ ID NO: 8490088 - DNA, 23 bp, Homo sapiens
tttcagttgagaatgcacggacc

SEQ ID NO: 8490089 - DNA, 22 bp, Homo sapiens
tttcagttgattgcttgggtta

SEQ ID NO: 8490090 - DNA, 22 bp, Homo sapiens
tttcagttgcagtggttgtcta

SEQ ID NO: 8490091 - DNA, 22 bp, Homo sapiens
tttcagttgcagtggttgtcta

SEQ ID NO: 8490092 - DNA, 20 bp, Homo sapiens
tttcagttggttaatggcat

SEQ ID NO: 8490093 - DNA, 22 bp, Homo sapiens
tttcagttgccaagctaattct

SEQ ID NO: 8490094 - DNA, 23 bp, Homo sapiens
tttcagttccagaaaaggggagc

SEQ ID NO: 8490095 - DNA, 22 bp, Homo sapiens
tttcagttcatctgtgaagatt

SEQ ID NO: 8490096 - DNA, 22 bp, Homo sapiens
tttcagttcatctgtgaagatt

SEQ ID NO: 8490097 - DNA, 22 bp, Homo sapiens
ctctcctcagaacaggccctct

SEQ ID NO: 8490098 - DNA, 22 bp, Homo sapiens
ctctcctcagaacaggccctct

SEQ ID NO: 8490099 - DNA, 22 bp, Homo sapiens
ctctcctcagaacaggccctct

SEQ ID NO: 8490100 - DNA, 22 bp, Homo sapiens
ctctcctccaacagccctgccg

SEQ ID NO: 8490101 - DNA, 22 bp, Homo sapiens
ctctcctccaggaactcacagt

SEQ ID NO: 8490102 - DNA, 22 bp, Homo sapiens
ctctcctccaggaactcacagt

SEQ ID NO: 8490103 - DNA, 22 bp, Homo sapiens
ctctccctggccagctgtgcag

SEQ ID NO: 8490104 - DNA, 20 bp, Homo sapiens
ctctcctcacccgtgtcagg

SEQ ID NO: 8490105 - DNA, 22 bp, Homo sapiens
ctctcctattgtgtggtaagga

SEQ ID NO: 8490106 - DNA, 22 bp, Homo sapiens
ctctccccggtacgagcggccg

SEQ ID NO: 8490107 - DNA, 22 bp, Homo sapiens
ctctcccccacagcagccttct

SEQ ID NO: 8490108 - DNA, 22 bp, Homo sapiens
ctctcccccacagcagccttct

SEQ ID NO: 8490109 - DNA, 22 bp, Homo sapiens
ctctcccccacagcagccttct

SEQ ID NO: 8490110 - DNA, 22 bp, Homo sapiens
tttacacatacctctttaaagt

SEQ ID NO: 8490111 - DNA, 22 bp, Homo sapiens
tttacacatacctctttaaagt

SEQ ID NO: 8490112 - DNA, 22 bp, Homo sapiens
tttacagttaagaaatgttacc

SEQ ID NO: 8490113 - DNA, 22 bp, Homo sapiens
tttacacatacctctttaaagt

SEQ ID NO: 8490114 - DNA, 22 bp, Homo sapiens
tttacagttccatgtgataggc

SEQ ID NO: 8490115 - DNA, 22 bp, Homo sapiens
tttacagttaagaaatgttacc

SEQ ID NO: 8490116 - DNA, 22 bp, Homo sapiens
tttacatggaatattgtcttgt

SEQ ID NO: 8490117 - DNA, 22 bp, Homo sapiens
tttacatctcaccagattcata

SEQ ID NO: 8490118 - DNA, 20 bp, Homo sapiens
tttacatccccaccagcaat

SEQ ID NO: 8490119 - DNA, 22 bp, Homo sapiens
tttacatttccctctgtcagtt

SEQ ID NO: 8490120 - DNA, 17 bp, Homo sapiens
tttagaatacaatgttt

SEQ ID NO: 8490121 - DNA, 22 bp, Homo sapiens
tttacattgcattaggtattat

SEQ ID NO: 8490122 - DNA, 22 bp, Homo sapiens
tttacattgcattaggtattat

SEQ ID NO: 8490123 - DNA, 22 bp, Homo sapiens
tttacatttccctctgtcagtt

SEQ ID NO: 8490124 - DNA, 22 bp, Homo sapiens
tttacatggaatattgtcttgt

SEQ ID NO: 8490125 - DNA, 22 bp, Homo sapiens
tttacatggaatattgtcttgt

SEQ ID NO: 8490126 - DNA, 22 bp, Homo sapiens
tttacatggaatattgtcttgt

SEQ ID NO: 8490127 - DNA, 22 bp, Homo sapiens
tttacatgagtagcagatgttc

SEQ ID NO: 8490128 - DNA, 22 bp, Homo sapiens
tttacatgtaatgttatacaaa

SEQ ID NO: 8490129 - DNA, 22 bp, Homo sapiens
tttacatgtaatgttatacaaa

SEQ ID NO: 8490130 - DNA, 22 bp, Homo sapiens
tttacatgtaatgttatacaaa

SEQ ID NO: 8490131 - DNA, 22 bp, Homo sapiens
tttacatgtaatgttatacaaa

SEQ ID NO: 8490132 - DNA, 22 bp, Homo sapiens
tttaaaagttatcatctgtcca

SEQ ID NO: 8490133 - DNA, 22 bp, Homo sapiens
tttaaaagttatcatctgtcca

SEQ ID NO: 8490134 - DNA, 22 bp, Homo sapiens
tttaaaaggggtattaagtcca

SEQ ID NO: 8490135 - DNA, 22 bp, Homo sapiens
tttaaaaccaaagaaagcctct

SEQ ID NO: 8490136 - DNA, 22 bp, Homo sapiens
tttaaaaaactagtctgagtct

SEQ ID NO: 8490137 - DNA, 22 bp, Homo sapiens
tttaaaaaactagtctgagtct

SEQ ID NO: 8490138 - DNA, 22 bp, Homo sapiens
tttaaaaaactagtctgagtct

SEQ ID NO: 8490139 - DNA, 22 bp, Homo sapiens
tttaaaaaactagtctgagtct

SEQ ID NO: 8490140 - DNA, 22 bp, Homo sapiens
tttaaaaaactagtctgagtct

SEQ ID NO: 8490141 - DNA, 22 bp, Homo sapiens
tttaaaaaactagtctgagtct

SEQ ID NO: 8490142 - DNA, 22 bp, Homo sapiens
tttaaatttagaagaaacactg

SEQ ID NO: 8490143 - DNA, 22 bp, Homo sapiens
tttaaatttgtgtttagagggt

SEQ ID NO: 8490144 - DNA, 22 bp, Homo sapiens
tttaacagatagtttcttctgt

SEQ ID NO: 8490145 - DNA, 22 bp, Homo sapiens
tttaaattctgtctgccgctta

SEQ ID NO: 8490146 - DNA, 22 bp, Homo sapiens
tttaaattctgtctgccgctta

SEQ ID NO: 8490147 - DNA, 22 bp, Homo sapiens
tttaaatttagaagaaacactg

SEQ ID NO: 8490148 - DNA, 22 bp, Homo sapiens
tttaaatttagaagaaacactg

SEQ ID NO: 8490149 - DNA, 22 bp, Homo sapiens
tttaaatttagaagaaacactg

SEQ ID NO: 8490150 - DNA, 22 bp, Homo sapiens
tttaaatttagaagaaacactg

SEQ ID NO: 8490151 - DNA, 22 bp, Homo sapiens
tttaaatttagaagaaacactg

SEQ ID NO: 8490152 - DNA, 22 bp, Homo sapiens
ctcctcccaattgccaagtgct

SEQ ID NO: 8490153 - DNA, 22 bp, Homo sapiens
ctcctcccaattgccaagtgct

SEQ ID NO: 8490154 - DNA, 22 bp, Homo sapiens
ctcctctctggagttatgcaga

SEQ ID NO: 8490155 - DNA, 22 bp, Homo sapiens
ctcctctggcttcctggaggca

SEQ ID NO: 8490156 - DNA, 22 bp, Homo sapiens
ctcctctggaaattcctctgcc

SEQ ID NO: 8490157 - DNA, 22 bp, Homo sapiens
ctcctctggaaattcctctgcc

SEQ ID NO: 8490158 - DNA, 22 bp, Homo sapiens
ctcctctggaaattcctctgcc

SEQ ID NO: 8490159 - DNA, 22 bp, Homo sapiens
tttagaatgttagcgttaaagg

SEQ ID NO: 8490160 - DNA, 17 bp, Homo sapiens
tttagaatacaatgttt

SEQ ID NO: 8490161 - DNA, 22 bp, Homo sapiens
tttagaatgtgactgtatttga

SEQ ID NO: 8490162 - DNA, 22 bp, Homo sapiens
tttagacacactttgtatattt

SEQ ID NO: 8490163 - DNA, 22 bp, Homo sapiens
tttagacacactttgtatattt

SEQ ID NO: 8490164 - DNA, 22 bp, Homo sapiens
ctcctctgtctaccacgagggt

SEQ ID NO: 8490165 - DNA, 22 bp, Homo sapiens
ctcctctgtctggccctgagcc

SEQ ID NO: 8490166 - DNA, 22 bp, Homo sapiens
ctcctctgtctggccctgagcc

SEQ ID NO: 8490167 - DNA, 22 bp, Homo sapiens
ctcctcttctgagtaccaggga

SEQ ID NO: 8490168 - DNA, 22 bp, Homo sapiens
ctcctctgtattgattgggact

SEQ ID NO: 8490169 - DNA, 22 bp, Homo sapiens
ctcctctgggtcctggtggcca

SEQ ID NO: 8490170 - DNA, 22 bp, Homo sapiens
ctcctctgtattgattgggact

SEQ ID NO: 8490171 - DNA, 22 bp, Homo sapiens
ctcctgagaaataagcaagtaa

SEQ ID NO: 8490172 - DNA, 22 bp, Homo sapiens
ctcctgacttgtgagcccctcc

SEQ ID NO: 8490173 - DNA, 22 bp, Homo sapiens
ctcctgaattgtccctcacagc

SEQ ID NO: 8490174 - DNA, 22 bp, Homo sapiens
ctcctctttggggatttacaca

SEQ ID NO: 8490175 - DNA, 22 bp, Homo sapiens
ctcctgagaattttcagttgga

SEQ ID NO: 8490176 - DNA, 22 bp, Homo sapiens
ctcctgagaggatctctgttgt

SEQ ID NO: 8490177 - DNA, 22 bp, Homo sapiens
ctcctgagaggatctctgttgt

SEQ ID NO: 8490178 - DNA, 22 bp, Homo sapiens
ctcctggctcgcccccagctga

SEQ ID NO: 8490179 - DNA, 22 bp, Homo sapiens
ttgataaaatgatatcttcttt

SEQ ID NO: 8490180 - DNA, 22 bp, Homo sapiens
ttgataaaatgatgaaatcact

SEQ ID NO: 8490181 - DNA, 22 bp, Homo sapiens
ttgagttctgtgtatcctttgt

SEQ ID NO: 8490182 - DNA, 22 bp, Homo sapiens
ttgagttctggtcttttaaaag

SEQ ID NO: 8490183 - DNA, 22 bp, Homo sapiens
ttgatacaggccttctagatga

SEQ ID NO: 8490184 - DNA, 22 bp, Homo sapiens
ttgatacagcagcctgtgatcc

SEQ ID NO: 8490185 - DNA, 22 bp, Homo sapiens
ttgatacagcagcctgtgatcc

SEQ ID NO: 8490186 - DNA, 23 bp, Homo sapiens
ttgatacagaagaatcagtttgt

SEQ ID NO: 8490187 - DNA, 23 bp, Homo sapiens
ttgatacagaagaatcagtttgt

SEQ ID NO: 8490188 - DNA, 22 bp, Homo sapiens
ttgatacacaatggaacaatgt

SEQ ID NO: 8490189 - DNA, 22 bp, Homo sapiens
ttgatacacaatggaacaatgt

SEQ ID NO: 8490190 - DNA, 22 bp, Homo sapiens
ttgatacacaatggaacaatgt

SEQ ID NO: 8490191 - DNA, 22 bp, Homo sapiens
ttgatacacaatggaacaatgt

SEQ ID NO: 8490192 - DNA, 22 bp, Homo sapiens
ttgaggaggcctttcagggctt

SEQ ID NO: 8490193 - DNA, 22 bp, Homo sapiens
ttgaggaaaggaatttatttta

SEQ ID NO: 8490194 - DNA, 23 bp, Homo sapiens
ttgaggacaatttacatggtgtt

SEQ ID NO: 8490195 - DNA, 22 bp, Homo sapiens
ttgaggagcaggatgggaggct

SEQ ID NO: 8490196 - DNA, 22 bp, Homo sapiens
ttgaggacagtgcttggggccc

SEQ ID NO: 8490197 - DNA, 22 bp, Homo sapiens
ttgagcttgaggagttatttga

SEQ ID NO: 8490198 - DNA, 22 bp, Homo sapiens
ttgagctgtatacctatgactg

SEQ ID NO: 8490199 - DNA, 22 bp, Homo sapiens
ttgagctgtaaggtgggatgtg

SEQ ID NO: 8490200 - DNA, 22 bp, Homo sapiens
ttgagctcccgcttcttctttg

SEQ ID NO: 8490201 - DNA, 22 bp, Homo sapiens
ttgagaaacatctaatctttgt

SEQ ID NO: 8490202 - DNA, 22 bp, Homo sapiens
ttgagaaacatctaatctttgt

SEQ ID NO: 8490203 - DNA, 22 bp, Homo sapiens
ttgagaaacatctaatctttgt

SEQ ID NO: 8490204 - DNA, 22 bp, Homo sapiens
ttgagaaaagctgtgtaaggat

SEQ ID NO: 8490205 - DNA, 22 bp, Homo sapiens
ttgacttttcttggtcacatga

SEQ ID NO: 8490206 - DNA, 22 bp, Homo sapiens
ttgagaaaacacagagtttatt

SEQ ID NO: 8490207 - DNA, 22 bp, Homo sapiens
ttgacttttcttggtcacatga

SEQ ID NO: 8490208 - DNA, 22 bp, Homo sapiens
ttgagaaaaccatcgtaagaat

SEQ ID NO: 8490209 - DNA, 22 bp, Homo sapiens
ttgagaaaacacagagtttatt

SEQ ID NO: 8490210 - DNA, 22 bp, Homo sapiens
ttgactatactctggcggaaaa

SEQ ID NO: 8490211 - DNA, 22 bp, Homo sapiens
ttgactctaaatttacttttcc

SEQ ID NO: 8490212 - DNA, 22 bp, Homo sapiens
ttgactgtacaaccttttgtag

SEQ ID NO: 8490213 - DNA, 22 bp, Homo sapiens
ttgacctatgtttcttcatctg

SEQ ID NO: 8490214 - DNA, 22 bp, Homo sapiens
ttgacttcccagacttgtgttt

SEQ ID NO: 8490215 - DNA, 22 bp, Homo sapiens
ttgacttcccagacttgtgttt

SEQ ID NO: 8490216 - DNA, 22 bp, Homo sapiens
ttgactttaaagctttgtctct

SEQ ID NO: 8490217 - DNA, 22 bp, Homo sapiens
ttgactttacagttttcttagg

SEQ ID NO: 8490218 - DNA, 22 bp, Homo sapiens
ttgactttacagttttcttagg

SEQ ID NO: 8490219 - DNA, 22 bp, Homo sapiens
ttgactttacagttttcttagg

SEQ ID NO: 8490220 - DNA, 22 bp, Homo sapiens
ttgactttatgtgtatgtttac

SEQ ID NO: 8490221 - DNA, 22 bp, Homo sapiens
ttgacttcagaatgttgatggt

SEQ ID NO: 8490222 - DNA, 22 bp, Homo sapiens
ttgacttcagcctgtacttgta

SEQ ID NO: 8490223 - DNA, 22 bp, Homo sapiens
ttgactgttaagacttggctct

SEQ ID NO: 8490224 - DNA, 17 bp, Homo sapiens
ttgactgttaatgggtt

SEQ ID NO: 8490225 - DNA, 22 bp, Homo sapiens
ctcagcagcagggaagaggtca

SEQ ID NO: 8490226 - DNA, 20 bp, Homo sapiens
ctcagcagattcttctagaa

SEQ ID NO: 8490227 - DNA, 22 bp, Homo sapiens
ctcagcaggcactgtgccttac

SEQ ID NO: 8490228 - DNA, 22 bp, Homo sapiens
ctattttgcctgcctagaaatc

SEQ ID NO: 8490229 - DNA, 17 bp, Homo sapiens
ctattttggagattaaa

SEQ ID NO: 8490230 - DNA, 23 bp, Homo sapiens
ctcagaggcctgtccagggtggt

SEQ ID NO: 8490231 - DNA, 22 bp, Homo sapiens
ctatttttctgtaccctaattt

SEQ ID NO: 8490232 - DNA, 22 bp, Homo sapiens
ctcagcaccccgacaggacatt

SEQ ID NO: 8490233 - DNA, 22 bp, Homo sapiens
ctcagcagagaccagggaggaa

SEQ ID NO: 8490234 - DNA, 22 bp, Homo sapiens
ttcttgttccatgaaagacaga

SEQ ID NO: 8490235 - DNA, 22 bp, Homo sapiens
ttcttgttctcctcatttagag

SEQ ID NO: 8490236 - DNA, 22 bp, Homo sapiens
ttcttgttctggttctgttagc

SEQ ID NO: 8490237 - DNA, 22 bp, Homo sapiens
ttcttgttctggttctgttagc

SEQ ID NO: 8490238 - DNA, 22 bp, Homo sapiens
ttcttgttctggttctgttagc

SEQ ID NO: 8490239 - DNA, 22 bp, Homo sapiens
ttcttgggtgtgaccagtctga

SEQ ID NO: 8490240 - DNA, 22 bp, Homo sapiens
ttcttgtactggagatacatga

SEQ ID NO: 8490241 - DNA, 22 bp, Homo sapiens
ttctttaaaatagtgagaaaga

SEQ ID NO: 8490242 - DNA, 22 bp, Homo sapiens
ttcttgtttattaagatataaa

SEQ ID NO: 8490243 - DNA, 22 bp, Homo sapiens
ctattttaagaggccattaggt

SEQ ID NO: 8490244 - DNA, 22 bp, Homo sapiens
ctattttaagaggccattaggt

SEQ ID NO: 8490245 - DNA, 22 bp, Homo sapiens
ctattttaacttgattacctct

SEQ ID NO: 8490246 - DNA, 22 bp, Homo sapiens
ctattttctgtctctatagagt

SEQ ID NO: 8490247 - DNA, 22 bp, Homo sapiens
ctattttctgtctctatagagt

SEQ ID NO: 8490248 - DNA, 22 bp, Homo sapiens
ctattttccgcagcaggaagta

SEQ ID NO: 8490249 - DNA, 22 bp, Homo sapiens
ctattttcattcttacattgtc

SEQ ID NO: 8490250 - DNA, 22 bp, Homo sapiens
ctattttcccatatggttgaca

SEQ ID NO: 8490251 - DNA, 22 bp, Homo sapiens
ctattttccgcagcaggaagta

SEQ ID NO: 8490252 - DNA, 22 bp, Homo sapiens
ctattttcccatatggttgaca

SEQ ID NO: 8490253 - DNA, 22 bp, Homo sapiens
ctattttcattcttacattgtc

SEQ ID NO: 8490254 - DNA, 22 bp, Homo sapiens
ctattttcattcttacattgtc

SEQ ID NO: 8490255 - DNA, 22 bp, Homo sapiens
ctattttaagaggccattaggt

SEQ ID NO: 8490256 - DNA, 22 bp, Homo sapiens
ctattttaagaggccattaggt

SEQ ID NO: 8490257 - DNA, 22 bp, Homo sapiens
ttctgtatctctgtgtttcttg

SEQ ID NO: 8490258 - DNA, 22 bp, Homo sapiens
ttctgtatgccaatgggttttt

SEQ ID NO: 8490259 - DNA, 22 bp, Homo sapiens
ttctgtatttagtttgaggaca

SEQ ID NO: 8490260 - DNA, 22 bp, Homo sapiens
ttctgtatgtacatatgtgtat

SEQ ID NO: 8490261 - DNA, 22 bp, Homo sapiens
ttctgtatttcaatgtctttat

SEQ ID NO: 8490262 - DNA, 22 bp, Homo sapiens
ttctgtaggcatggaacaggga

SEQ ID NO: 8490263 - DNA, 22 bp, Homo sapiens
ttctgtaggcatggaacaggga

SEQ ID NO: 8490264 - DNA, 22 bp, Homo sapiens
ttctgtacttcaggggctctgt

SEQ ID NO: 8490265 - DNA, 22 bp, Homo sapiens
ctattttaacttgattacctct

SEQ ID NO: 8490266 - DNA, 22 bp, Homo sapiens
ctattttaacttgattacctct

SEQ ID NO: 8490267 - DNA, 22 bp, Homo sapiens
ctatttgtacagcattcgagtt

SEQ ID NO: 8490268 - DNA, 22 bp, Homo sapiens
ctatttgtcacaactggtgttt

SEQ ID NO: 8490269 - DNA, 22 bp, Homo sapiens
ctatttgtcagtttggctttaa

SEQ ID NO: 8490270 - DNA, 22 bp, Homo sapiens
ttctgtcatttagcattgtcat

SEQ ID NO: 8490271 - DNA, 22 bp, Homo sapiens
ttcttggaaatacattcaataa

SEQ ID NO: 8490272 - DNA, 22 bp, Homo sapiens
ttcttggaaatacattcaataa

SEQ ID NO: 8490273 - DNA, 22 bp, Homo sapiens
ttcttggagataaattcttaca

SEQ ID NO: 8490274 - DNA, 22 bp, Homo sapiens
ttcttggatgccctcatgcctt

SEQ ID NO: 8490275 - DNA, 22 bp, Homo sapiens
ttcttggatgccctcatgcctt

SEQ ID NO: 8490276 - DNA, 22 bp, Homo sapiens
ttcttggaaatacattcaataa

SEQ ID NO: 8490277 - DNA, 22 bp, Homo sapiens
ttctgtcacagtgctggtatca

SEQ ID NO: 8490278 - DNA, 22 bp, Homo sapiens
ttctgtcacttaggaggtcata

SEQ ID NO: 8490279 - DNA, 22 bp, Homo sapiens
ttctgtcacagtgctggtatca

SEQ ID NO: 8490280 - DNA, 22 bp, Homo sapiens
ttctgtcacttaggaggtcata

SEQ ID NO: 8490281 - DNA, 22 bp, Homo sapiens
ttctgtcacttaggaggtcata

SEQ ID NO: 8490282 - DNA, 22 bp, Homo sapiens
ttctgtcatgctcatgtaattg

SEQ ID NO: 8490283 - DNA, 22 bp, Homo sapiens
ctatttctgcctaatgacctgt

SEQ ID NO: 8490284 - DNA, 22 bp, Homo sapiens
ctatttgaaaccaagaatgccg

SEQ ID NO: 8490285 - DNA, 22 bp, Homo sapiens
ctatttggccaagctgcccaca

SEQ ID NO: 8490286 - DNA, 22 bp, Homo sapiens
ctatttggatgttagcctcagt

SEQ ID NO: 8490287 - DNA, 22 bp, Homo sapiens
ctatttggccagaagagggtca

SEQ ID NO: 8490288 - DNA, 22 bp, Homo sapiens
ctatttgtacagcattagtaat

SEQ ID NO: 8490289 - DNA, 22 bp, Homo sapiens
ctatttggccatagtgcagtta

SEQ ID NO: 8490290 - DNA, 22 bp, Homo sapiens
ctatttggggtagaagatggat

SEQ ID NO: 8490291 - DNA, 22 bp, Homo sapiens
ctatttgtaagagccccacacc

SEQ ID NO: 8490292 - DNA, 22 bp, Homo sapiens
ctatttgtaaagtgcctggtgt

SEQ ID NO: 8490293 - DNA, 22 bp, Homo sapiens
ctatttcatgttcctatggccg

SEQ ID NO: 8490294 - DNA, 22 bp, Homo sapiens
ctatttcagctgcctttgactg

SEQ ID NO: 8490295 - DNA, 22 bp, Homo sapiens
ctatttctaaacctataagtga

SEQ ID NO: 8490296 - DNA, 22 bp, Homo sapiens
ctagggagtggcagagctggga

SEQ ID NO: 8490297 - DNA, 22 bp, Homo sapiens
ctagggccaaaggctgtgatgc

SEQ ID NO: 8490298 - DNA, 22 bp, Homo sapiens
ctattcagttgtgggcaacaat

SEQ ID NO: 8490299 - DNA, 22 bp, Homo sapiens
ctattcagcctctaagacaagt

SEQ ID NO: 8490300 - DNA, 22 bp, Homo sapiens
ctatttatgtgctattttgtat

SEQ ID NO: 8490301 - DNA, 22 bp, Homo sapiens
ctatttatgtgctattttgtat

SEQ ID NO: 8490302 - DNA, 22 bp, Homo sapiens
ctatttattgtgggtatccagg

SEQ ID NO: 8490303 - DNA, 22 bp, Homo sapiens
ctatttattgtgggtatccagg

SEQ ID NO: 8490304 - DNA, 22 bp, Homo sapiens
ttcctttcacgttttaatgcac

SEQ ID NO: 8490305 - DNA, 22 bp, Homo sapiens
ttcctttccctcacagcctcgg

SEQ ID NO: 8490306 - DNA, 22 bp, Homo sapiens
ttccttctaattttacacctga

SEQ ID NO: 8490307 - DNA, 22 bp, Homo sapiens
ttccttctaattttacacctga

SEQ ID NO: 8490308 - DNA, 22 bp, Homo sapiens
ttccttctaattttacacctga

SEQ ID NO: 8490309 - DNA, 22 bp, Homo sapiens
ttcctttctctggactgcagcc

SEQ ID NO: 8490310 - DNA, 22 bp, Homo sapiens
ttcctttgggaaatcactaagg

SEQ ID NO: 8490311 - DNA, 20 bp, Homo sapiens
ttccttttcgcctctctccc

SEQ ID NO: 8490312 - DNA, 22 bp, Homo sapiens
ttccttttcttaaacatatgtg

SEQ ID NO: 8490313 - DNA, 20 bp, Homo sapiens
ctaggcagcgagtgactgag

SEQ ID NO: 8490314 - DNA, 22 bp, Homo sapiens
ctaggcagatggagaagtggct

SEQ ID NO: 8490315 - DNA, 22 bp, Homo sapiens
ctagccatgggcattaaaggta

SEQ ID NO: 8490316 - DNA, 22 bp, Homo sapiens
ctagcccaggaatgccgtggcc

SEQ ID NO: 8490317 - DNA, 20 bp, Homo sapiens
ctagcctggccttgctctgg

SEQ ID NO: 8490318 - DNA, 22 bp, Homo sapiens
ctaggccagttaggaagagaag

SEQ ID NO: 8490319 - DNA, 22 bp, Homo sapiens
ctaggccatattttgagaactg

SEQ ID NO: 8490320 - DNA, 22 bp, Homo sapiens
ctaggctgagctgggctgagct

SEQ ID NO: 8490321 - DNA, 22 bp, Homo sapiens
ctaggctcagtctctggtctgt

SEQ ID NO: 8490322 - DNA, 22 bp, Homo sapiens
ctaggccagagagacctcatga

SEQ ID NO: 8490323 - DNA, 22 bp, Homo sapiens
ctaggcagtcctgacggtacta

SEQ ID NO: 8490324 - DNA, 23 bp, Homo sapiens
ctaggcaggattgtaggcgggta

SEQ ID NO: 8490325 - DNA, 22 bp, Homo sapiens
ctaggctggagtgcagtggcac

SEQ ID NO: 8490326 - DNA, 22 bp, Homo sapiens
ctaggctgcagatgcatggaat

SEQ ID NO: 8490327 - DNA, 22 bp, Homo sapiens
ctaggctgtgcattgcatgaca

SEQ ID NO: 8490328 - DNA, 22 bp, Homo sapiens
ctaggctgtaaagagctaggag

SEQ ID NO: 8490329 - DNA, 22 bp, Homo sapiens
ctaggctggagtgcattggcgt

SEQ ID NO: 8490330 - DNA, 22 bp, Homo sapiens
ctaggctggagtgcattggcgt

SEQ ID NO: 8490331 - DNA, 22 bp, Homo sapiens
ctaggctggagtgcagtggcat

SEQ ID NO: 8490332 - DNA, 22 bp, Homo sapiens
ctagggaacaagatgcccaggg

SEQ ID NO: 8490333 - DNA, 22 bp, Homo sapiens
ctagggaaataaactgagtggt

SEQ ID NO: 8490334 - DNA, 22 bp, Homo sapiens
ctagggagactcgcaggactca

SEQ ID NO: 8490335 - DNA, 22 bp, Homo sapiens
ctagggagcactagctgccttg

SEQ ID NO: 8490336 - DNA, 22 bp, Homo sapiens
cggcagtgggcgccaggtctcc

SEQ ID NO: 8490337 - DNA, 22 bp, Homo sapiens
cggcatgggcgtccccctcact

SEQ ID NO: 8490338 - DNA, 22 bp, Homo sapiens
cggaagagggacagcgccagcc

SEQ ID NO: 8490339 - DNA, 22 bp, Homo sapiens
cgctttggatttcgctttccaa

SEQ ID NO: 8490340 - DNA, 22 bp, Homo sapiens
cgctttaacgtgagaagaaggg

SEQ ID NO: 8490341 - DNA, 22 bp, Homo sapiens
cgctttggagtccctgctttac

SEQ ID NO: 8490342 - DNA, 22 bp, Homo sapiens
cgcttaattttctatagaaaag

SEQ ID NO: 8490343 - DNA, 22 bp, Homo sapiens
cgctgtgtttacatcattgctg

SEQ ID NO: 8490344 - DNA, 22 bp, Homo sapiens
cgctgtgtgcagactgaaaatg

SEQ ID NO: 8490345 - DNA, 22 bp, Homo sapiens
cgctggtcaccatggcgtcctg

SEQ ID NO: 8490346 - DNA, 22 bp, Homo sapiens
cgctggggctttttgcttgaga

SEQ ID NO: 8490347 - DNA, 22 bp, Homo sapiens
cgctgggcgccgacctgctggc

SEQ ID NO: 8490348 - DNA, 22 bp, Homo sapiens
cgctgggcgcgctccgaacccg

SEQ ID NO: 8490349 - DNA, 22 bp, Homo sapiens
cgctgggcgcgctccgaacccg

SEQ ID NO: 8490350 - DNA, 22 bp, Homo sapiens
cgctgggggaacagcgagggtg

SEQ ID NO: 8490351 - DNA, 22 bp, Homo sapiens
ttcacatggcaatagagaggga

SEQ ID NO: 8490352 - DNA, 22 bp, Homo sapiens
ttcacattaagcctcctcctac

SEQ ID NO: 8490353 - DNA, 22 bp, Homo sapiens
cgctgggcaggtccacttgtta

SEQ ID NO: 8490354 - DNA, 22 bp, Homo sapiens
cgctgggcgccgacctgctggc

SEQ ID NO: 8490355 - DNA, 22 bp, Homo sapiens
cgctgggcatggtgccttattt

SEQ ID NO: 8490356 - DNA, 22 bp, Homo sapiens
cgctgggcgccgacctgctggc

SEQ ID NO: 8490357 - DNA, 22 bp, Homo sapiens
ttcacagtgtgatctatgggca

SEQ ID NO: 8490358 - DNA, 22 bp, Homo sapiens
ttcacagtggtagtgcatttag

SEQ ID NO: 8490359 - DNA, 22 bp, Homo sapiens
ttcacagtggtagtgcatttag

SEQ ID NO: 8490360 - DNA, 22 bp, Homo sapiens
ttcacagtggcttaggctatgg

SEQ ID NO: 8490361 - DNA, 22 bp, Homo sapiens
ttcacagactttccatagattg

SEQ ID NO: 8490362 - DNA, 22 bp, Homo sapiens
cctgggtggcagaggttgcagt

SEQ ID NO: 8490363 - DNA, 22 bp, Homo sapiens
cctgggtggcagaggttgcagt

SEQ ID NO: 8490364 - DNA, 22 bp, Homo sapiens
cctgggtggttccggcaaggag

SEQ ID NO: 8490365 - DNA, 22 bp, Homo sapiens
cctgggtggttccggcaaggag

SEQ ID NO: 8490366 - DNA, 22 bp, Homo sapiens
ttcacagacattgcagactgaa

SEQ ID NO: 8490367 - DNA, 22 bp, Homo sapiens
ttcacataaatagatcacatca

SEQ ID NO: 8490368 - DNA, 22 bp, Homo sapiens
ttcacatgaaagtaggaaagga

SEQ ID NO: 8490369 - DNA, 22 bp, Homo sapiens
ttcacataggagcatggttttt

SEQ ID NO: 8490370 - DNA, 22 bp, Homo sapiens
ttcagaaaggttaatctggatt

SEQ ID NO: 8490371 - DNA, 22 bp, Homo sapiens
ttcagaaaggttaatctggatt

SEQ ID NO: 8490372 - DNA, 21 bp, Homo sapiens
ttcatgagataaccagctgta

SEQ ID NO: 8490373 - DNA, 22 bp, Homo sapiens
ttcatgagcagaagggaggggt

SEQ ID NO: 8490374 - DNA, 23 bp, Homo sapiens
ttcatgagattatctgcatgtgt

SEQ ID NO: 8490375 - DNA, 22 bp, Homo sapiens
ttcagaaaggttaatctggatt

SEQ ID NO: 8490376 - DNA, 22 bp, Homo sapiens
ttcagaaaggtaaatggatttc

SEQ ID NO: 8490377 - DNA, 22 bp, Homo sapiens
ttcagaaaggtaaatggatttc

SEQ ID NO: 8490378 - DNA, 22 bp, Homo sapiens
ttcagaaaggataattggaagg

SEQ ID NO: 8490379 - DNA, 22 bp, Homo sapiens
ttcattccttctgtaccttgcc

SEQ ID NO: 8490380 - DNA, 22 bp, Homo sapiens
ttcattccttccctaagcaact

SEQ ID NO: 8490381 - DNA, 22 bp, Homo sapiens
ttcattcctgagcccatattta

SEQ ID NO: 8490382 - DNA, 22 bp, Homo sapiens
ttcattccttccctaagcaact

SEQ ID NO: 8490383 - DNA, 23 bp, Homo sapiens
ttcatgagttggacaagactggg

SEQ ID NO: 8490384 - DNA, 20 bp, Homo sapiens
ttcattcattccacaacttc

SEQ ID NO: 8490385 - DNA, 22 bp, Homo sapiens
ttcattcccttatattagcatt

SEQ ID NO: 8490386 - DNA, 22 bp, Homo sapiens
ttcattcccaagagtaaacata

SEQ ID NO: 8490387 - DNA, 22 bp, Homo sapiens
ttcattctgcagttctcagctc

SEQ ID NO: 8490388 - DNA, 22 bp, Homo sapiens
ttcattctgtttggaaaggtgg

SEQ ID NO: 8490389 - DNA, 22 bp, Homo sapiens
ttcattctcttagcatagtcct

SEQ ID NO: 8490390 - DNA, 22 bp, Homo sapiens
ttcattctcttagcatagtcct

SEQ ID NO: 8490391 - DNA, 22 bp, Homo sapiens
ttccaaactcatagtatggtgt

SEQ ID NO: 8490392 - DNA, 22 bp, Homo sapiens
ttcattcttgtctttgtatagt

SEQ ID NO: 8490393 - DNA, 22 bp, Homo sapiens
ttcattcttgggatcagagagt

SEQ ID NO: 8490394 - DNA, 22 bp, Homo sapiens
cggctgaggatctccaggcctg

SEQ ID NO: 8490395 - DNA, 22 bp, Homo sapiens
cggctgagcagtgctgatggaa

SEQ ID NO: 8490396 - DNA, 22 bp, Homo sapiens
cggctgagacggccatagacac

SEQ ID NO: 8490397 - DNA, 22 bp, Homo sapiens
cggctggaagctggacaggccg

SEQ ID NO: 8490398 - DNA, 22 bp, Homo sapiens
cggctggagctgagaaaggagc

SEQ ID NO: 8490399 - DNA, 22 bp, Homo sapiens
cggctggagctttgaacctgat

SEQ ID NO: 8490400 - DNA, 22 bp, Homo sapiens
cggctggggctgtccccatgac

SEQ ID NO: 8490401 - DNA, 22 bp, Homo sapiens
cggctggggctgtccccatgac

SEQ ID NO: 8490402 - DNA, 22 bp, Homo sapiens
cggctgggtagaggtgccgggt

SEQ ID NO: 8490403 - DNA, 22 bp, Homo sapiens
cggctgggtagaggtgccgggt

SEQ ID NO: 8490404 - DNA, 22 bp, Homo sapiens
ttcagaaaaaacttcaataagt

SEQ ID NO: 8490405 - DNA, 22 bp, Homo sapiens
ttcacttatttcttgagtagca

SEQ ID NO: 8490406 - DNA, 22 bp, Homo sapiens
ttcagaaaaaacttcaataagt

SEQ ID NO: 8490407 - DNA, 22 bp, Homo sapiens
ttcagaaaggataattggaagg

SEQ ID NO: 8490408 - DNA, 22 bp, Homo sapiens
ttcagaaaggataattggaagg

SEQ ID NO: 8490409 - DNA, 22 bp, Homo sapiens
ttcagaaacatcagtggatgga

SEQ ID NO: 8490410 - DNA, 22 bp, Homo sapiens
ttcagaaaaagaccattgcaat

SEQ ID NO: 8490411 - DNA, 22 bp, Homo sapiens
ttcagaaaaagaccattgcaat

SEQ ID NO: 8490412 - DNA, 22 bp, Homo sapiens
ttcagaaaaagaccattgcaat

SEQ ID NO: 8490413 - DNA, 22 bp, Homo sapiens
ttcagaaacagagtgagtgagt

SEQ ID NO: 8490414 - DNA, 22 bp, Homo sapiens
ttcccacagtgttgaatcctct

SEQ ID NO: 8490415 - DNA, 22 bp, Homo sapiens
ttcccacagtgactccagagaa

SEQ ID NO: 8490416 - DNA, 22 bp, Homo sapiens
ttcccacagtgttgaatcctct

SEQ ID NO: 8490417 - DNA, 22 bp, Homo sapiens
ttcccacagttcagaacaaagg

SEQ ID NO: 8490418 - DNA, 22 bp, Homo sapiens
ttcccacattctttacattcat

SEQ ID NO: 8490419 - DNA, 23 bp, Homo sapiens
ttcccacatcttccacagctatg

SEQ ID NO: 8490420 - DNA, 22 bp, Homo sapiens
ttcccacattctttacattcat

SEQ ID NO: 8490421 - DNA, 22 bp, Homo sapiens
ttcccacacccatattgtgatt

SEQ ID NO: 8490422 - DNA, 22 bp, Homo sapiens
ttcccacacccatattgtgatt

SEQ ID NO: 8490423 - DNA, 22 bp, Homo sapiens
ttcccacagagattacattgaa

SEQ ID NO: 8490424 - DNA, 22 bp, Homo sapiens
ttcccacactccatataattca

SEQ ID NO: 8490425 - DNA, 22 bp, Homo sapiens
ttcccacagagattacattgaa

SEQ ID NO: 8490426 - DNA, 22 bp, Homo sapiens
ttcccacagagattacattgaa

SEQ ID NO: 8490427 - DNA, 22 bp, Homo sapiens
ttcccacaggatgagagctgag

SEQ ID NO: 8490428 - DNA, 22 bp, Homo sapiens
ttcccacaggatgagagctgag

SEQ ID NO: 8490429 - DNA, 22 bp, Homo sapiens
ttcccacagtcactgggagaag

SEQ ID NO: 8490430 - DNA, 22 bp, Homo sapiens
ttccctggttaaccattttctg

SEQ ID NO: 8490431 - DNA, 22 bp, Homo sapiens
ttcccttcctcactctacttgt

SEQ ID NO: 8490432 - DNA, 22 bp, Homo sapiens
ttcccttaaattatggcatcta

SEQ ID NO: 8490433 - DNA, 22 bp, Homo sapiens
ttccctttgttaaattggaaga

SEQ ID NO: 8490434 - DNA, 22 bp, Homo sapiens
ttccgagggctcggcggccgcc

SEQ ID NO: 8490435 - DNA, 21 bp, Homo sapiens
ttcccttctggttttgagaga

SEQ ID NO: 8490436 - DNA, 21 bp, Homo sapiens
ttcccttctggttttgagaga

SEQ ID NO: 8490437 - DNA, 22 bp, Homo sapiens
ttcccttctagttttgagagac

SEQ ID NO: 8490438 - DNA, 22 bp, Homo sapiens
ttcccttctagttttgagagac

SEQ ID NO: 8490439 - DNA, 22 bp, Homo sapiens
ttcccttcctcactctacttgt

SEQ ID NO: 8490440 - DNA, 22 bp, Homo sapiens
ctaactttttgattcttgggga

SEQ ID NO: 8490441 - DNA, 22 bp, Homo sapiens
ctaaggatgcatatgttttgtt

SEQ ID NO: 8490442 - DNA, 22 bp, Homo sapiens
ctaactttgtcatcttcccttt

SEQ ID NO: 8490443 - DNA, 22 bp, Homo sapiens
ctaacttttacagtcatgttgc

SEQ ID NO: 8490444 - DNA, 22 bp, Homo sapiens
ttccggaaggttctctagaatt

SEQ ID NO: 8490445 - DNA, 22 bp, Homo sapiens
ttccgctgtttagttgaagttt

SEQ ID NO: 8490446 - DNA, 22 bp, Homo sapiens
ttccaaatgttggacaactgta

SEQ ID NO: 8490447 - DNA, 22 bp, Homo sapiens
ttccaaatggagaagatgagtt

SEQ ID NO: 8490448 - DNA, 22 bp, Homo sapiens
ttccatttggcacttcactgag

SEQ ID NO: 8490449 - DNA, 22 bp, Homo sapiens
ttccaggcacatcccaactcca

SEQ ID NO: 8490450 - DNA, 22 bp, Homo sapiens
ttcccacaacagatctgtatta

SEQ ID NO: 8490451 - DNA, 22 bp, Homo sapiens
ttcccacaatctgcgtgtgtat

SEQ ID NO: 8490452 - DNA, 22 bp, Homo sapiens
ttcccacaatctgcgtgtgtat

SEQ ID NO: 8490453 - DNA, 22 bp, Homo sapiens
ttcccacacaattaagtcattt

SEQ ID NO: 8490454 - DNA, 22 bp, Homo sapiens
ttcccaaaatataacagttaac

SEQ ID NO: 8490455 - DNA, 22 bp, Homo sapiens
ttcccaaaatataacagttaac

SEQ ID NO: 8490456 - DNA, 22 bp, Homo sapiens
ttccatttttctaactctcaga

SEQ ID NO: 8490457 - DNA, 22 bp, Homo sapiens
ttccatttggcacttcactgag

SEQ ID NO: 8490458 - DNA, 22 bp, Homo sapiens
ttccaaagtcatgttgctgata

SEQ ID NO: 8490459 - DNA, 22 bp, Homo sapiens
ttccaaagtcatgttgctgata

SEQ ID NO: 8490460 - DNA, 22 bp, Homo sapiens
ttccaaagtgctggaattacat

SEQ ID NO: 8490461 - DNA, 22 bp, Homo sapiens
ttccaaagttattcaagcagta

SEQ ID NO: 8490462 - DNA, 22 bp, Homo sapiens
ttccaaatgcccatctacacag

SEQ ID NO: 8490463 - DNA, 22 bp, Homo sapiens
ttccaaatgagttccatcgaat

SEQ ID NO: 8490464 - DNA, 22 bp, Homo sapiens
ttccaaagcacttgatgtaaag

SEQ ID NO: 8490465 - DNA, 22 bp, Homo sapiens
ttccaaagctgctttatttagt

SEQ ID NO: 8490466 - DNA, 22 bp, Homo sapiens
ttccaaaggaatggggagctat

SEQ ID NO: 8490467 - DNA, 22 bp, Homo sapiens
ttccaaaggaatggggagctat

SEQ ID NO: 8490468 - DNA, 22 bp, Homo sapiens
ttccaaagaaattgaccaagac

SEQ ID NO: 8490469 - DNA, 22 bp, Homo sapiens
ttccttctaatattctgcctgt

SEQ ID NO: 8490470 - DNA, 22 bp, Homo sapiens
ttccttctaatattctgcctgt

SEQ ID NO: 8490471 - DNA, 22 bp, Homo sapiens
ttccttcctgtcttccttactg

SEQ ID NO: 8490472 - DNA, 22 bp, Homo sapiens
ttccttcctctttcacaacagc

SEQ ID NO: 8490473 - DNA, 22 bp, Homo sapiens
ttccttccgggcaccaggcact

SEQ ID NO: 8490474 - DNA, 22 bp, Homo sapiens
ttccttccctcagtggctgaag

SEQ ID NO: 8490475 - DNA, 22 bp, Homo sapiens
ttccttccatagcaaaacatgc

SEQ ID NO: 8490476 - DNA, 22 bp, Homo sapiens
ctacaaaagtaattgtggtttt

SEQ ID NO: 8490477 - DNA, 22 bp, Homo sapiens
ctacaaaagtaattgtggtttt

SEQ ID NO: 8490478 - DNA, 22 bp, Homo sapiens
ctacaaatataaaacacagata

SEQ ID NO: 8490479 - DNA, 22 bp, Homo sapiens
ttcctggggacttaccgtcatt

SEQ ID NO: 8490480 - DNA, 22 bp, Homo sapiens
ttccttcagcaagtcctgagca

SEQ ID NO: 8490481 - DNA, 22 bp, Homo sapiens
ttccttcagttcagggaaccct

SEQ ID NO: 8490482 - DNA, 22 bp, Homo sapiens
ctacaaatatgttaaggtgttt

SEQ ID NO: 8490483 - DNA, 22 bp, Homo sapiens
ctacaaaagtaattgtggtttt

SEQ ID NO: 8490484 - DNA, 22 bp, Homo sapiens
ctacaaaagtaattgtggtttt

SEQ ID NO: 8490485 - DNA, 22 bp, Homo sapiens
ctaattatgttgttataatcaa

SEQ ID NO: 8490486 - DNA, 22 bp, Homo sapiens
ctaattgtaagctccttgaggg

SEQ ID NO: 8490487 - DNA, 22 bp, Homo sapiens
ctaatttaatgaatgagtctta

SEQ ID NO: 8490488 - DNA, 22 bp, Homo sapiens
ctaatcatctttctcttaaagc

SEQ ID NO: 8490489 - DNA, 22 bp, Homo sapiens
ctaataatagaggtggcatttg

SEQ ID NO: 8490490 - DNA, 22 bp, Homo sapiens
ctaatactcatttctgtaactc

SEQ ID NO: 8490491 - DNA, 22 bp, Homo sapiens
ctaaggttggcagtggaattgg

SEQ ID NO: 8490492 - DNA, 22 bp, Homo sapiens
ctaataacatgaactactttct

SEQ ID NO: 8490493 - DNA, 22 bp, Homo sapiens
ctaataacatgaactactttct

SEQ ID NO: 8490494 - DNA, 22 bp, Homo sapiens
ctaagggttgaaacagcaagaa

SEQ ID NO: 8490495 - DNA, 22 bp, Homo sapiens
ttttattctcaagacaatggga

SEQ ID NO: 8490496 - DNA, 22 bp, Homo sapiens
ttttattcaaatagttcacact

SEQ ID NO: 8490497 - DNA, 22 bp, Homo sapiens
ttttattcatagggatggagag

SEQ ID NO: 8490498 - DNA, 22 bp, Homo sapiens
ttttattctcagctccagagag

SEQ ID NO: 8490499 - DNA, 22 bp, Homo sapiens
ttttattctcagctccagagag

SEQ ID NO: 8490500 - DNA, 23 bp, Homo sapiens
ttttattgatatgtagctgttgt

SEQ ID NO: 8490501 - DNA, 23 bp, Homo sapiens
ttttattgatatgtagctgttgt

SEQ ID NO: 8490502 - DNA, 21 bp, Homo sapiens
ctctgggccattttcttccac

SEQ ID NO: 8490503 - DNA, 22 bp, Homo sapiens
ctctgggccatgctactgctct

SEQ ID NO: 8490504 - DNA, 22 bp, Homo sapiens
ttttagttgtactgtcaacagt

SEQ ID NO: 8490505 - DNA, 22 bp, Homo sapiens
ttttagttgtactgtcaacagt

SEQ ID NO: 8490506 - DNA, 22 bp, Homo sapiens
ttttattatctttgaatgggac

SEQ ID NO: 8490507 - DNA, 22 bp, Homo sapiens
ctctgggctccttcagcccttt

SEQ ID NO: 8490508 - DNA, 22 bp, Homo sapiens
ttttagttactgcagtagcaaa

SEQ ID NO: 8490509 - DNA, 22 bp, Homo sapiens
ctctgggcaggaccagtggacc

SEQ ID NO: 8490510 - DNA, 22 bp, Homo sapiens
ctctgggcaggaccagtggacc

SEQ ID NO: 8490511 - DNA, 22 bp, Homo sapiens
ctctgggcaggaccagtggacc

SEQ ID NO: 8490512 - DNA, 22 bp, Homo sapiens
ctctgggccaccgctggtgtat

SEQ ID NO: 8490513 - DNA, 22 bp, Homo sapiens
ctctgggcaccaaagagcagct

SEQ ID NO: 8490514 - DNA, 17 bp, Homo sapiens
ctctgggcagcctgggg

SEQ ID NO: 8490515 - DNA, 22 bp, Homo sapiens
ctctgggatgaggcctaggcac

SEQ ID NO: 8490516 - DNA, 22 bp, Homo sapiens
ctctgggcaaagatgcctcatc

SEQ ID NO: 8490517 - DNA, 22 bp, Homo sapiens
ctctgggcaaagatgcctcatc

SEQ ID NO: 8490518 - DNA, 22 bp, Homo sapiens
ctctgggatagagcctcggtct

SEQ ID NO: 8490519 - DNA, 22 bp, Homo sapiens
ctctggcttctaccttgcagtt

SEQ ID NO: 8490520 - DNA, 22 bp, Homo sapiens
ctctggcttctaccttgcagtt

SEQ ID NO: 8490521 - DNA, 22 bp, Homo sapiens
ctctggcttctaccttgcagtt

SEQ ID NO: 8490522 - DNA, 22 bp, Homo sapiens
ctctggcttctaccttgcagtt

SEQ ID NO: 8490523 - DNA, 19 bp, Homo sapiens
ctctgggcaagtcacttaa

SEQ ID NO: 8490524 - DNA, 22 bp, Homo sapiens
ctctgggcaagtttcttcatga

SEQ ID NO: 8490525 - DNA, 22 bp, Homo sapiens
ctctgggcaagtttcttcatga

SEQ ID NO: 8490526 - DNA, 22 bp, Homo sapiens
ctctgggcaagtttcttcatga

SEQ ID NO: 8490527 - DNA, 22 bp, Homo sapiens
ctctgggcacattttccaggac

SEQ ID NO: 8490528 - DNA, 22 bp, Homo sapiens
ctctgggcaagtatgatagaaa

SEQ ID NO: 8490529 - DNA, 22 bp, Homo sapiens
ctctgggcaaagatgcctcatc

SEQ ID NO: 8490530 - DNA, 22 bp, Homo sapiens
ctctgggcaaagatgcctcatc

SEQ ID NO: 8490531 - DNA, 20 bp, Homo sapiens
ctctggctccgcgtgaccgc

SEQ ID NO: 8490532 - DNA, 22 bp, Homo sapiens
tttgtgacttgcttctcagaat

SEQ ID NO: 8490533 - DNA, 22 bp, Homo sapiens
tttgtgaattcttggaagattg

SEQ ID NO: 8490534 - DNA, 22 bp, Homo sapiens
tttgtgaatggaatccacagac

SEQ ID NO: 8490535 - DNA, 22 bp, Homo sapiens
tttgtgaatggaatccacagac

SEQ ID NO: 8490536 - DNA, 22 bp, Homo sapiens
tttgtgaataggttggcttcca

SEQ ID NO: 8490537 - DNA, 22 bp, Homo sapiens
tttgtgaataggttggcttcca

SEQ ID NO: 8490538 - DNA, 22 bp, Homo sapiens
tttgtgaataggttggcttcca

SEQ ID NO: 8490539 - DNA, 22 bp, Homo sapiens
tttgtgaataggttggcttcca

SEQ ID NO: 8490540 - DNA, 22 bp, Homo sapiens
tttgtgaataggttggcttcca

SEQ ID NO: 8490541 - DNA, 22 bp, Homo sapiens
ctctggctgcctctcaggcctg

SEQ ID NO: 8490542 - DNA, 22 bp, Homo sapiens
ctctggctggcacctgatctga

SEQ ID NO: 8490543 - DNA, 22 bp, Homo sapiens
ctctggctggcacctgatctga

SEQ ID NO: 8490544 - DNA, 22 bp, Homo sapiens
ctctggctctgacagttgatcc

SEQ ID NO: 8490545 - DNA, 22 bp, Homo sapiens
ctctggctctgttgagatttgt

SEQ ID NO: 8490546 - DNA, 22 bp, Homo sapiens
ctctggctgcctctcaggcctg

SEQ ID NO: 8490547 - DNA, 22 bp, Homo sapiens
ctctggctggctgggcctcagt

SEQ ID NO: 8490548 - DNA, 22 bp, Homo sapiens
ctctggctggcattgctggact

SEQ ID NO: 8490549 - DNA, 22 bp, Homo sapiens
ctctggctggcacctgatctga

SEQ ID NO: 8490550 - DNA, 22 bp, Homo sapiens
ctctggctgtcccgatgagcag

SEQ ID NO: 8490551 - DNA, 19 bp, Homo sapiens
ctctggcttccaaagcatc

SEQ ID NO: 8490552 - DNA, 22 bp, Homo sapiens
ctctggctgtttgcagctcaag

SEQ ID NO: 8490553 - DNA, 22 bp, Homo sapiens
ctctggctgtttgcagctcaag

SEQ ID NO: 8490554 - DNA, 22 bp, Homo sapiens
ctctggcttagtatgctccaaa

SEQ ID NO: 8490555 - DNA, 22 bp, Homo sapiens
tttgtcttggcctcagttttct

SEQ ID NO: 8490556 - DNA, 22 bp, Homo sapiens
tttgtcttggcctcagttttct

SEQ ID NO: 8490557 - DNA, 22 bp, Homo sapiens
ctctcctggggagcacacacac

SEQ ID NO: 8490558 - DNA, 22 bp, Homo sapiens
ctctcctggggagcacacacac

SEQ ID NO: 8490559 - DNA, 22 bp, Homo sapiens
tttgtacatcctaattctgagt

SEQ ID NO: 8490560 - DNA, 22 bp, Homo sapiens
tttgtacatcctaattctgagt

SEQ ID NO: 8490561 - DNA, 22 bp, Homo sapiens
tttgtacatcctaattctgagt

SEQ ID NO: 8490562 - DNA, 22 bp, Homo sapiens
ctctcctgggctgaccgtccga

SEQ ID NO: 8490563 - DNA, 22 bp, Homo sapiens
ctctcctgggctgaccgtccga

SEQ ID NO: 8490564 - DNA, 23 bp, Homo sapiens
ctctcctgaaggacaagctgccg

SEQ ID NO: 8490565 - DNA, 23 bp, Homo sapiens
ctctcctgaaggacaagctgccg

SEQ ID NO: 8490566 - DNA, 22 bp, Homo sapiens
ctctcctctgaagtggtgaccc

SEQ ID NO: 8490567 - DNA, 22 bp, Homo sapiens
ctctcctctgaagtggtgaccc

SEQ ID NO: 8490568 - DNA, 22 bp, Homo sapiens
ctctcctctgaagtggtgaccc

SEQ ID NO: 8490569 - DNA, 22 bp, Homo sapiens
tttgtgaaatgaagtcacaact

SEQ ID NO: 8490570 - DNA, 22 bp, Homo sapiens
tttgtgaaatgaagtcacaact

SEQ ID NO: 8490571 - DNA, 23 bp, Homo sapiens
tttgtgaaagtgttgagaggaga

SEQ ID NO: 8490572 - DNA, 22 bp, Homo sapiens
tttgtgaaatgaagtcacaact

SEQ ID NO: 8490573 - DNA, 22 bp, Homo sapiens
tttgtctttcccctcctcattg

SEQ ID NO: 8490574 - DNA, 22 bp, Homo sapiens
tttgtgaataagagaatgacag

SEQ ID NO: 8490575 - DNA, 22 bp, Homo sapiens
tttgtgaagggaacagaagtgt

SEQ ID NO: 8490576 - DNA, 22 bp, Homo sapiens
tttgtgaagggaacagaagtgt

SEQ ID NO: 8490577 - DNA, 22 bp, Homo sapiens
tttgtgaagggaacagaagtgt

SEQ ID NO: 8490578 - DNA, 19 bp, Homo sapiens
tttgtgaagaaaatgatgc

SEQ ID NO: 8490579 - DNA, 19 bp, Homo sapiens
tttgtgaagaaaatgatgc

SEQ ID NO: 8490580 - DNA, 19 bp, Homo sapiens
tttgtgaagaaaatgatgc

SEQ ID NO: 8490581 - DNA, 22 bp, Homo sapiens
tttgtgaacttaggcaattagg

SEQ ID NO: 8490582 - DNA, 22 bp, Homo sapiens
tttgtgaacaaacatgaagatg

SEQ ID NO: 8490583 - DNA, 22 bp, Homo sapiens
tttgtgaacaaacatgaagatg

SEQ ID NO: 8490584 - DNA, 22 bp, Homo sapiens
tttgtgaacactgcgcagaact

SEQ ID NO: 8490585 - DNA, 22 bp, Homo sapiens
tttgtgaacaaacatgaagatg

SEQ ID NO: 8490586 - DNA, 22 bp, Homo sapiens
tttgtgaacactgcgcagaact

SEQ ID NO: 8490587 - DNA, 23 bp, Homo sapiens
ctgaagagccaacaaaaagcttg

SEQ ID NO: 8490588 - DNA, 22 bp, Homo sapiens
ctgaagaggacgcagcagcaag

SEQ ID NO: 8490589 - DNA, 22 bp, Homo sapiens
ctgaagaggacgcagcagcaag

SEQ ID NO: 8490590 - DNA, 22 bp, Homo sapiens
ctgactgtgagagcaggaatgg

SEQ ID NO: 8490591 - DNA, 22 bp, Homo sapiens
ctgactgtaattctgttcttaa

SEQ ID NO: 8490592 - DNA, 22 bp, Homo sapiens
ctgaagatgtctgagatgctca

SEQ ID NO: 8490593 - DNA, 17 bp, Homo sapiens
ctgaagataatggcaac

SEQ ID NO: 8490594 - DNA, 22 bp, Homo sapiens
ctgacttcagggataaaaagta

SEQ ID NO: 8490595 - DNA, 22 bp, Homo sapiens
ctgactgtttgctgaaaggtct

SEQ ID NO: 8490596 - DNA, 22 bp, Homo sapiens
ctgactgttgctgttgatgagg

SEQ ID NO: 8490597 - DNA, 22 bp, Homo sapiens
ctgagaaagtgagggttaaaca

SEQ ID NO: 8490598 - DNA, 22 bp, Homo sapiens
ctgagaaagtttatgtttattt

SEQ ID NO: 8490599 - DNA, 22 bp, Homo sapiens
ctgagaaatgcatttttccagc

SEQ ID NO: 8490600 - DNA, 22 bp, Homo sapiens
ctgagaaatacccaagtctggt

SEQ ID NO: 8490601 - DNA, 22 bp, Homo sapiens
ctgagaatggacagcagggcag

SEQ ID NO: 8490602 - DNA, 22 bp, Homo sapiens
ctgagaataaagccagcaggag

SEQ ID NO: 8490603 - DNA, 22 bp, Homo sapiens
ctgagaataaagccagcaggag

SEQ ID NO: 8490604 - DNA, 22 bp, Homo sapiens
ctgagaaggaagcctccactct

SEQ ID NO: 8490605 - DNA, 22 bp, Homo sapiens
ctgagaaggtgtggagatgggc

SEQ ID NO: 8490606 - DNA, 22 bp, Homo sapiens
ctgagaaattctttctttcact

SEQ ID NO: 8490607 - DNA, 22 bp, Homo sapiens
ctgagaacatcattcagatatt

SEQ ID NO: 8490608 - DNA, 22 bp, Homo sapiens
ctgaaaggagagctgcaaggat

SEQ ID NO: 8490609 - DNA, 22 bp, Homo sapiens
ctgaaaggaataaggctctttg

SEQ ID NO: 8490610 - DNA, 22 bp, Homo sapiens
ctgaaagcattaactccacttc

SEQ ID NO: 8490611 - DNA, 20 bp, Homo sapiens
ctgaaaggagtcgggatgtc

SEQ ID NO: 8490612 - DNA, 22 bp, Homo sapiens
ctgaaaggagagctgcaaggat

SEQ ID NO: 8490613 - DNA, 19 bp, Homo sapiens
tttttaatgggctggagca

SEQ ID NO: 8490614 - DNA, 19 bp, Homo sapiens
tttttaatgggctggagca

SEQ ID NO: 8490615 - DNA, 22 bp, Homo sapiens
ctgaacagtacttggccagttt

SEQ ID NO: 8490616 - DNA, 22 bp, Homo sapiens
ctgaacagtacttggccagttt

SEQ ID NO: 8490617 - DNA, 22 bp, Homo sapiens
ctgaacatcccgcagtgcacga

SEQ ID NO: 8490618 - DNA, 22 bp, Homo sapiens
ctgaacaaagaaatagtcatgg

SEQ ID NO: 8490619 - DNA, 22 bp, Homo sapiens
ctgaacattcttgaacatctgt

SEQ ID NO: 8490620 - DNA, 22 bp, Homo sapiens
ctgaacattcttgaacatctgt

SEQ ID NO: 8490621 - DNA, 22 bp, Homo sapiens
ctgaaccactaatattttgatt

SEQ ID NO: 8490622 - DNA, 22 bp, Homo sapiens
ctgaactcatgatatgcttttg

SEQ ID NO: 8490623 - DNA, 15 bp, Homo sapiens
ctgaactctaaacca

SEQ ID NO: 8490624 - DNA, 22 bp, Homo sapiens
ctgaactctttatgacagcttg

SEQ ID NO: 8490625 - DNA, 22 bp, Homo sapiens
ctgaactctttatgacagcttg

SEQ ID NO: 8490626 - DNA, 22 bp, Homo sapiens
ctgaaccatctctgttctgtat

SEQ ID NO: 8490627 - DNA, 22 bp, Homo sapiens
ctgaactgacagactgcctgct

SEQ ID NO: 8490628 - DNA, 22 bp, Homo sapiens
ctgaacttattgagtgcttgct

SEQ ID NO: 8490629 - DNA, 22 bp, Homo sapiens
ctgaacttctctgagcctcagt

SEQ ID NO: 8490630 - DNA, 22 bp, Homo sapiens
ctgaagaaatatgattgcttaa

SEQ ID NO: 8490631 - DNA, 22 bp, Homo sapiens
ctgaagagaaagggagctcttc

SEQ ID NO: 8490632 - DNA, 20 bp, Homo sapiens
ctgaagagactggaggggca

SEQ ID NO: 8490633 - DNA, 22 bp, Homo sapiens
ctcttttaattgtcataacaac

SEQ ID NO: 8490634 - DNA, 22 bp, Homo sapiens
ctctttgtggaacggcagtgtc

SEQ ID NO: 8490635 - DNA, 21 bp, Homo sapiens
ctctttgtggcaatgtatttt

SEQ ID NO: 8490636 - DNA, 22 bp, Homo sapiens
ctctttgtgctattatgatcct

SEQ ID NO: 8490637 - DNA, 22 bp, Homo sapiens
ctctttgtagcctttgcatatt

SEQ ID NO: 8490638 - DNA, 22 bp, Homo sapiens
ctctggttcagggctccctggc

SEQ ID NO: 8490639 - DNA, 22 bp, Homo sapiens
ctctggtgtcctttagaattta

SEQ ID NO: 8490640 - DNA, 22 bp, Homo sapiens
ctctgggttctggcctgcaccc

SEQ ID NO: 8490641 - DNA, 22 bp, Homo sapiens
ctctgggttctggcctgcaccc

SEQ ID NO: 8490642 - DNA, 22 bp, Homo sapiens
ctctgggttcagaacagcaagc

SEQ ID NO: 8490643 - DNA, 22 bp, Homo sapiens
ctctgggttcactgaggctctg

SEQ ID NO: 8490644 - DNA, 22 bp, Homo sapiens
ctctgggttcactgaggctctg

SEQ ID NO: 8490645 - DNA, 21 bp, Homo sapiens
ttttattgatgaatggccact

SEQ ID NO: 8490646 - DNA, 22 bp, Homo sapiens
ttttgttttcttagaaacctgg

SEQ ID NO: 8490647 - DNA, 22 bp, Homo sapiens
tttttaagagattctccagtct

SEQ ID NO: 8490648 - DNA, 22 bp, Homo sapiens
tttttaagagattctccagtct

SEQ ID NO: 8490649 - DNA, 22 bp, Homo sapiens
tttttaagagattctccagtct

SEQ ID NO: 8490650 - DNA, 19 bp, Homo sapiens
ctgaaaaacattctcagga

SEQ ID NO: 8490651 - DNA, 22 bp, Homo sapiens
ttttgttttcttagaaacctgg

SEQ ID NO: 8490652 - DNA, 22 bp, Homo sapiens
tttttaagctcctttgatgtca

SEQ ID NO: 8490653 - DNA, 22 bp, Homo sapiens
tttttaagctcctttgatgtca

SEQ ID NO: 8490654 - DNA, 22 bp, Homo sapiens
tttttaagctcctttgatgtca

SEQ ID NO: 8490655 - DNA, 22 bp, Homo sapiens
tttttaagagtctggaaatagt

SEQ ID NO: 8490656 - DNA, 22 bp, Homo sapiens
tttttaagagtctggaaatagt

SEQ ID NO: 8490657 - DNA, 17 bp, Homo sapiens
ctcttttgtcttcttcc

SEQ ID NO: 8490658 - DNA, 20 bp, Homo sapiens
ctcttttcactctcagtggt

SEQ ID NO: 8490659 - DNA, 22 bp, Homo sapiens
ctcttttcaaacctgtttatgg

SEQ ID NO: 8490660 - DNA, 22 bp, Homo sapiens
ctcttttcaaaatttcactgca

SEQ ID NO: 8490661 - DNA, 22 bp, Homo sapiens
ctcttttcaaaatttcactgca

SEQ ID NO: 8490662 - DNA, 22 bp, Homo sapiens
ctcttttcaaacctgtttatgg

SEQ ID NO: 8490663 - DNA, 22 bp, Homo sapiens
ctcttttcaaacctgtttatgg

SEQ ID NO: 8490664 - DNA, 19 bp, Homo sapiens
ctgaaaaacattctcagga

SEQ ID NO: 8490665 - DNA, 19 bp, Homo sapiens
ctgaaaaacattctcagga

SEQ ID NO: 8490666 - DNA, 19 bp, Homo sapiens
ctgaaaaacattctcagga

SEQ ID NO: 8490667 - DNA, 22 bp, Homo sapiens
ctctttttcacctctgtcagcg

SEQ ID NO: 8490668 - DNA, 22 bp, Homo sapiens
ctctttttcagccttaccaaag

SEQ ID NO: 8490669 - DNA, 22 bp, Homo sapiens
ctctttttcagccttaccaaag

SEQ ID NO: 8490670 - DNA, 22 bp, Homo sapiens
ctgccctgggtgctggggatcc

SEQ ID NO: 8490671 - DNA, 22 bp, Homo sapiens
ctgccctggggggcctccttgc

SEQ ID NO: 8490672 - DNA, 22 bp, Homo sapiens
ctgccatgcagttagtccctca

SEQ ID NO: 8490673 - DNA, 22 bp, Homo sapiens
ctgccatgcagttagtccctca

SEQ ID NO: 8490674 - DNA, 22 bp, Homo sapiens
ctgcctagaaaaccaggctcct

SEQ ID NO: 8490675 - DNA, 22 bp, Homo sapiens
ctgcctagatttgaatcctggc

SEQ ID NO: 8490676 - DNA, 22 bp, Homo sapiens
ctgcctagaaaaccaggctcct

SEQ ID NO: 8490677 - DNA, 22 bp, Homo sapiens
ctgccgagtgggtcatgaggca

SEQ ID NO: 8490678 - DNA, 22 bp, Homo sapiens
ctgccgtgtttttcatgttaaa

SEQ ID NO: 8490679 - DNA, 22 bp, Homo sapiens
ctgccgtgtttttcatgttaaa

SEQ ID NO: 8490680 - DNA, 22 bp, Homo sapiens
ctgccaggttggcgctcgctct

SEQ ID NO: 8490681 - DNA, 22 bp, Homo sapiens
ctgccaggttggcgctcgctct

SEQ ID NO: 8490682 - DNA, 22 bp, Homo sapiens
ctgccaggtaaactgcaggaat

SEQ ID NO: 8490683 - DNA, 22 bp, Homo sapiens
ctgccagtctatgctgctcggc

SEQ ID NO: 8490684 - DNA, 22 bp, Homo sapiens
ctgccagtgaaattgtgtcagt

SEQ ID NO: 8490685 - DNA, 22 bp, Homo sapiens
ctgccagtgaaattgtgtcagt

SEQ ID NO: 8490686 - DNA, 20 bp, Homo sapiens
ctgccatgattgatagagtg

SEQ ID NO: 8490687 - DNA, 22 bp, Homo sapiens
ctgccatctgagccaaaagtgc

SEQ ID NO: 8490688 - DNA, 22 bp, Homo sapiens
ctgcctcctcacgtccacagtg

SEQ ID NO: 8490689 - DNA, 22 bp, Homo sapiens
ctgcctcctcacgtccacagtg

SEQ ID NO: 8490690 - DNA, 22 bp, Homo sapiens
ctgcctccaggctcaccttgac

SEQ ID NO: 8490691 - DNA, 22 bp, Homo sapiens
ctgcctcctcacgtccacagtg

SEQ ID NO: 8490692 - DNA, 22 bp, Homo sapiens
ctgcctcctgccgtgcagcttc

SEQ ID NO: 8490693 - DNA, 22 bp, Homo sapiens
ctgcctcctgccgtgcagcttc

SEQ ID NO: 8490694 - DNA, 22 bp, Homo sapiens
ctgcctcctgccgtgcagcttc

SEQ ID NO: 8490695 - DNA, 22 bp, Homo sapiens
ctgcctgcgttgcctcgtgcct

SEQ ID NO: 8490696 - DNA, 22 bp, Homo sapiens
ctgcctgcgttgcctcgtgcct

SEQ ID NO: 8490697 - DNA, 22 bp, Homo sapiens
ctgcctagggtctggtaccaca

SEQ ID NO: 8490698 - DNA, 22 bp, Homo sapiens
ctgcctcacattggctgtgtga

SEQ ID NO: 8490699 - DNA, 22 bp, Homo sapiens
ctgcctcacattggctgtgtga

SEQ ID NO: 8490700 - DNA, 22 bp, Homo sapiens
ctgcctcagcgttgtggcccta

SEQ ID NO: 8490701 - DNA, 22 bp, Homo sapiens
ctgcctcagccttctgggtgac

SEQ ID NO: 8490702 - DNA, 22 bp, Homo sapiens
ctgcctcagccttctgggtgac

SEQ ID NO: 8490703 - DNA, 22 bp, Homo sapiens
ctgcctcagcgttgtggcccta

SEQ ID NO: 8490704 - DNA, 22 bp, Homo sapiens
ctgcctcatgctgcctgcagcc

SEQ ID NO: 8490705 - DNA, 22 bp, Homo sapiens
ctgcctcatgctgcctgcagcc

SEQ ID NO: 8490706 - DNA, 22 bp, Homo sapiens
ctgcctcatgctgcctgcagcc

SEQ ID NO: 8490707 - DNA, 22 bp, Homo sapiens
ctgcctcatgctgcctgcagcc

SEQ ID NO: 8490708 - DNA, 22 bp, Homo sapiens
ctgcctcatgctgcctgcagcc

SEQ ID NO: 8490709 - DNA, 22 bp, Homo sapiens
ctgcctcatgctgcctgcagcc

SEQ ID NO: 8490710 - DNA, 22 bp, Homo sapiens
ctgccaggcctggggtgctgtc

SEQ ID NO: 8490711 - DNA, 22 bp, Homo sapiens
ctgccagggaggctgggaagtt

SEQ ID NO: 8490712 - DNA, 22 bp, Homo sapiens
ctgccaggctgtcccaggtccg

SEQ ID NO: 8490713 - DNA, 22 bp, Homo sapiens
ctgccaggctgtcccaggtccg

SEQ ID NO: 8490714 - DNA, 22 bp, Homo sapiens
ctgccagggcatcctgtggtgg

SEQ ID NO: 8490715 - DNA, 22 bp, Homo sapiens
ctgccaggggcctcacaggcca

SEQ ID NO: 8490716 - DNA, 22 bp, Homo sapiens
ctgccaggggcctcacaggcca

SEQ ID NO: 8490717 - DNA, 22 bp, Homo sapiens
ctgccaggcctccgctgtcccc

SEQ ID NO: 8490718 - DNA, 22 bp, Homo sapiens
ctgccaggcctccgctgtcccc

SEQ ID NO: 8490719 - DNA, 22 bp, Homo sapiens
ctgccaggcctccgctgtcccc

SEQ ID NO: 8490720 - DNA, 22 bp, Homo sapiens
ctgccagctggagaccaaggaa

SEQ ID NO: 8490721 - DNA, 22 bp, Homo sapiens
ctgcagccacgagtcacagccc

SEQ ID NO: 8490722 - DNA, 23 bp, Homo sapiens
ctgcagccgcgtggggacgtgga

SEQ ID NO: 8490723 - DNA, 22 bp, Homo sapiens
ctgccagctctctggaggctct

SEQ ID NO: 8490724 - DNA, 22 bp, Homo sapiens
ctgccagctctctggaggctct

SEQ ID NO: 8490725 - DNA, 23 bp, Homo sapiens
ctgcagccgcgtggggacgtgga

SEQ ID NO: 8490726 - DNA, 22 bp, Homo sapiens
ctgcagcatcgccacctgcctc

SEQ ID NO: 8490727 - DNA, 22 bp, Homo sapiens
ctgcagcagtactcagcagcca

SEQ ID NO: 8490728 - DNA, 22 bp, Homo sapiens
ctgcagaggtcttgctgatggt

SEQ ID NO: 8490729 - DNA, 22 bp, Homo sapiens
ctgcagaggttggttctaagat

SEQ ID NO: 8490730 - DNA, 22 bp, Homo sapiens
ctgcagaggttggttctaagat

SEQ ID NO: 8490731 - DNA, 22 bp, Homo sapiens
ctgcagagtggagcctcggctg

SEQ ID NO: 8490732 - DNA, 22 bp, Homo sapiens
ctgcagatggtattgttctggt

SEQ ID NO: 8490733 - DNA, 22 bp, Homo sapiens
ctgcagatttggtgtctggtga

SEQ ID NO: 8490734 - DNA, 22 bp, Homo sapiens
ctgcagattggcctgatgttca

SEQ ID NO: 8490735 - DNA, 22 bp, Homo sapiens
ctgcagcaaatgttaagtgact

SEQ ID NO: 8490736 - DNA, 22 bp, Homo sapiens
ctgcagcaagagaagtgctgac

SEQ ID NO: 8490737 - DNA, 22 bp, Homo sapiens
ctgcagcagaataatctgctca

SEQ ID NO: 8490738 - DNA, 22 bp, Homo sapiens
ctgcagcaggaggctcctgcag

SEQ ID NO: 8490739 - DNA, 22 bp, Homo sapiens
ctgcagagcttgtctggatgtg

SEQ ID NO: 8490740 - DNA, 22 bp, Homo sapiens
ctgcagagcttgtctggatgtg

SEQ ID NO: 8490741 - DNA, 22 bp, Homo sapiens
ctgcagagcttgtctggatgtg

SEQ ID NO: 8490742 - DNA, 22 bp, Homo sapiens
ctgcagagctttctgaatgaag

SEQ ID NO: 8490743 - DNA, 22 bp, Homo sapiens
ctgcagagctttctgaatgaag

SEQ ID NO: 8490744 - DNA, 22 bp, Homo sapiens
ctgcagaggcctcgcctcctct

SEQ ID NO: 8490745 - DNA, 22 bp, Homo sapiens
ctgcagagctttctgaatgaag

SEQ ID NO: 8490746 - DNA, 22 bp, Homo sapiens
ctgcagagctaggctgagtgaa

SEQ ID NO: 8490747 - DNA, 22 bp, Homo sapiens
ctgcagaggtcttgctgatggt

SEQ ID NO: 8490748 - DNA, 22 bp, Homo sapiens
ctgcagagggtttgagcatcct

SEQ ID NO: 8490749 - DNA, 22 bp, Homo sapiens
ctgcagagggtttgagcatcct

SEQ ID NO: 8490750 - DNA, 22 bp, Homo sapiens
ctgcagaggcctcgcctcctct

SEQ ID NO: 8490751 - DNA, 22 bp, Homo sapiens
ctgcagaggggttgaagggtcc

SEQ ID NO: 8490752 - DNA, 22 bp, Homo sapiens
ctgcagaggggttgaagggtcc

SEQ ID NO: 8490753 - DNA, 22 bp, Homo sapiens
ctgaggcactggtaatgggcat

SEQ ID NO: 8490754 - DNA, 22 bp, Homo sapiens
ctgaggcactgtcagctgaggc

SEQ ID NO: 8490755 - DNA, 22 bp, Homo sapiens
ctgaggcactaacaaggacaag

SEQ ID NO: 8490756 - DNA, 22 bp, Homo sapiens
ctgaggagtgggtgggcagtga

SEQ ID NO: 8490757 - DNA, 22 bp, Homo sapiens
ctgaggagtcagttccactcag

SEQ ID NO: 8490758 - DNA, 22 bp, Homo sapiens
ctgaggatggtgtggtcttctc

SEQ ID NO: 8490759 - DNA, 17 bp, Homo sapiens
ctgaggattatggttgt

SEQ ID NO: 8490760 - DNA, 22 bp, Homo sapiens
ctgaggatctaattattgggtc

SEQ ID NO: 8490761 - DNA, 22 bp, Homo sapiens
ctgagactttcatgtgctttta

SEQ ID NO: 8490762 - DNA, 22 bp, Homo sapiens
ctgagagaaacatgactcagga

SEQ ID NO: 8490763 - DNA, 22 bp, Homo sapiens
ctgagagaaacatgactcagga

SEQ ID NO: 8490764 - DNA, 22 bp, Homo sapiens
ctgagagaatcatgctgcaggt

SEQ ID NO: 8490765 - DNA, 22 bp, Homo sapiens
ctgagacacggagaggctgtgt

SEQ ID NO: 8490766 - DNA, 22 bp, Homo sapiens
ctgagacacggagaggctgtgt

SEQ ID NO: 8490767 - DNA, 19 bp, Homo sapiens
ctgagaatcctacttattt

SEQ ID NO: 8490768 - DNA, 22 bp, Homo sapiens
ctgagacatggtttgactggca

SEQ ID NO: 8490769 - DNA, 22 bp, Homo sapiens
ctgagaattactctgatgagta

SEQ ID NO: 8490770 - DNA, 22 bp, Homo sapiens
ctgagaatgttttctgattgat

SEQ ID NO: 8490771 - DNA, 22 bp, Homo sapiens
ctgagaatgttttctgattgat

SEQ ID NO: 8490772 - DNA, 22 bp, Homo sapiens
ctgagaattactctgatgagta

SEQ ID NO: 8490773 - DNA, 22 bp, Homo sapiens
ctgagagaatcatgctgcaggt

SEQ ID NO: 8490774 - DNA, 22 bp, Homo sapiens
ctgagagaatcatgctgcaggt

SEQ ID NO: 8490775 - DNA, 22 bp, Homo sapiens
ctgagagagtaaagtagaatta

SEQ ID NO: 8490776 - DNA, 22 bp, Homo sapiens
ctgagagagtaaagtagaatta

SEQ ID NO: 8490777 - DNA, 22 bp, Homo sapiens
ctgagagactgtttgtaatatt

SEQ ID NO: 8490778 - DNA, 22 bp, Homo sapiens
ctgagagactgtttgtaatatt

SEQ ID NO: 8490779 - DNA, 22 bp, Homo sapiens
ctgaggagaaagatggtccaag

SEQ ID NO: 8490780 - DNA, 22 bp, Homo sapiens
ctgagtccagggacagaggcgt

SEQ ID NO: 8490781 - DNA, 22 bp, Homo sapiens
ctgagtccagggacagaggcgt

SEQ ID NO: 8490782 - DNA, 22 bp, Homo sapiens
ctgagtccagggacagaggcgt

SEQ ID NO: 8490783 - DNA, 22 bp, Homo sapiens
ctgaggtttgtccatccttggt

SEQ ID NO: 8490784 - DNA, 19 bp, Homo sapiens
ctgagtcaaaggttgtggg

SEQ ID NO: 8490785 - DNA, 19 bp, Homo sapiens
ctgagtcaaaggttgtggg

SEQ ID NO: 8490786 - DNA, 22 bp, Homo sapiens
ctgagtcattgcagatgtggag

SEQ ID NO: 8490787 - DNA, 22 bp, Homo sapiens
ctgagtcattgcagatgtggag

SEQ ID NO: 8490788 - DNA, 22 bp, Homo sapiens
ctgagtccttgggcttagagtg

SEQ ID NO: 8490789 - DNA, 22 bp, Homo sapiens
ctgatcttaagtaacattattt

SEQ ID NO: 8490790 - DNA, 22 bp, Homo sapiens
ctgatctgtcctcctcagagcc

SEQ ID NO: 8490791 - DNA, 22 bp, Homo sapiens
ctgatcttaagtaacattattt

SEQ ID NO: 8490792 - DNA, 22 bp, Homo sapiens
ctgatctgtcctcctcagagcc

SEQ ID NO: 8490793 - DNA, 22 bp, Homo sapiens
ctgatctcaagtgatccaccca

SEQ ID NO: 8490794 - DNA, 22 bp, Homo sapiens
ctgatgtgttttagtttggtaa

SEQ ID NO: 8490795 - DNA, 22 bp, Homo sapiens
ctgattaggctaagcaagaggg

SEQ ID NO: 8490796 - DNA, 22 bp, Homo sapiens
ctgattaggctaagcaagaggg

SEQ ID NO: 8490797 - DNA, 22 bp, Homo sapiens
ctgattagagtgttaatgagga

SEQ ID NO: 8490798 - DNA, 22 bp, Homo sapiens
ctgatgcctctcttcttggctt

SEQ ID NO: 8490799 - DNA, 22 bp, Homo sapiens
ctgatgctataagccacagtgg

SEQ ID NO: 8490800 - DNA, 22 bp, Homo sapiens
ctgatgctctggatgtagtcaa

SEQ ID NO: 8490801 - DNA, 22 bp, Homo sapiens
ctgatgctctggatgtagtcaa

SEQ ID NO: 8490802 - DNA, 22 bp, Homo sapiens
ctgcagaaacctttcctgattt

SEQ ID NO: 8490803 - DNA, 22 bp, Homo sapiens
ctgcaaaagtcattgtggtttt

SEQ ID NO: 8490804 - DNA, 22 bp, Homo sapiens
ctgcaaaagtaattgcaggttt

SEQ ID NO: 8490805 - DNA, 22 bp, Homo sapiens
ctgcagacctctgaggtccatg

SEQ ID NO: 8490806 - DNA, 22 bp, Homo sapiens
ctgcagaaatatggatgtgata

SEQ ID NO: 8490807 - DNA, 22 bp, Homo sapiens
ctgcagaaagctgagatgatta

SEQ ID NO: 8490808 - DNA, 22 bp, Homo sapiens
ctgcagaaatatggatgtgata

SEQ ID NO: 8490809 - DNA, 22 bp, Homo sapiens
ctgcagaaagctgagatgatta

SEQ ID NO: 8490810 - DNA, 22 bp, Homo sapiens
ctgcagagcataaatctgaata

SEQ ID NO: 8490811 - DNA, 22 bp, Homo sapiens
ctgcagagcatgaggaggtctg

SEQ ID NO: 8490812 - DNA, 22 bp, Homo sapiens
ctgcagagcataaatctgaata

SEQ ID NO: 8490813 - DNA, 22 bp, Homo sapiens
ctgcagagcatgaggaggtctg

SEQ ID NO: 8490814 - DNA, 22 bp, Homo sapiens
ctgcagagcatgaggaggtctg

SEQ ID NO: 8490815 - DNA, 22 bp, Homo sapiens
ctgcagagcatgaggaggtctg

SEQ ID NO: 8490816 - DNA, 22 bp, Homo sapiens
ctgattttcaaaatgtgttaaa

SEQ ID NO: 8490817 - DNA, 23 bp, Homo sapiens
ctgatttgagcagaataaaatag

SEQ ID NO: 8490818 - DNA, 22 bp, Homo sapiens
ctgattgtgttcctgggagctg

SEQ ID NO: 8490819 - DNA, 22 bp, Homo sapiens
ctgattgagaaggaaggggatc

SEQ ID NO: 8490820 - DNA, 22 bp, Homo sapiens
ctgattcctgattcatgctctt

SEQ ID NO: 8490821 - DNA, 22 bp, Homo sapiens
ctgattccctggtgcctccgtt

SEQ ID NO: 8490822 - DNA, 22 bp, Homo sapiens
ctggctccactccctgcctgac

SEQ ID NO: 8490823 - DNA, 22 bp, Homo sapiens
ctggctccactccctgcctgac

SEQ ID NO: 8490824 - DNA, 22 bp, Homo sapiens
ctggctccctcgctgaggtgct

SEQ ID NO: 8490825 - DNA, 22 bp, Homo sapiens
ctggctcctccaaggcctggag

SEQ ID NO: 8490826 - DNA, 23 bp, Homo sapiens
ctggctccgaagactccaggatc

SEQ ID NO: 8490827 - DNA, 22 bp, Homo sapiens
ctggcctggtctggcctctcca

SEQ ID NO: 8490828 - DNA, 22 bp, Homo sapiens
ctggcctggggggacacatccc

SEQ ID NO: 8490829 - DNA, 22 bp, Homo sapiens
ctggcctggggcctcagctgct

SEQ ID NO: 8490830 - DNA, 22 bp, Homo sapiens
ctggcctggggcctcagctgct

SEQ ID NO: 8490831 - DNA, 22 bp, Homo sapiens
ctggcctggggcctcagctgct

SEQ ID NO: 8490832 - DNA, 22 bp, Homo sapiens
ctggcctggggcctcagctgct

SEQ ID NO: 8490833 - DNA, 22 bp, Homo sapiens
ctggcctggggcctcagctgct

SEQ ID NO: 8490834 - DNA, 22 bp, Homo sapiens
ctggcctggggcctcagctgct

SEQ ID NO: 8490835 - DNA, 22 bp, Homo sapiens
ctggcctggggcctcagctgct

SEQ ID NO: 8490836 - DNA, 22 bp, Homo sapiens
ctggcctggcgcagtggctcac

SEQ ID NO: 8490837 - DNA, 22 bp, Homo sapiens
ctggcctgggagctgctagcgt

SEQ ID NO: 8490838 - DNA, 22 bp, Homo sapiens
ctggcctgggagctgctagcgt

SEQ ID NO: 8490839 - DNA, 22 bp, Homo sapiens
ctggcctgggagctgctagcgt

SEQ ID NO: 8490840 - DNA, 22 bp, Homo sapiens
ctggcctggcaggggacctcta

SEQ ID NO: 8490841 - DNA, 22 bp, Homo sapiens
ctggcctggcaggggacctcta

SEQ ID NO: 8490842 - DNA, 22 bp, Homo sapiens
ctggcctggcgcagtggctcac

SEQ ID NO: 8490843 - DNA, 22 bp, Homo sapiens
ctggcctggcgcagtggctcac

SEQ ID NO: 8490844 - DNA, 22 bp, Homo sapiens
ctggctctgggcctcagacact

SEQ ID NO: 8490845 - DNA, 22 bp, Homo sapiens
ctggctctgagtggtatcttga

SEQ ID NO: 8490846 - DNA, 22 bp, Homo sapiens
ctggctctgagtggctctaatt

SEQ ID NO: 8490847 - DNA, 22 bp, Homo sapiens
ctggctctgagtggtatcttga

SEQ ID NO: 8490848 - DNA, 22 bp, Homo sapiens
ctggctctgagcccacctccag

SEQ ID NO: 8490849 - DNA, 22 bp, Homo sapiens
ctggctctgagcccacctccag

SEQ ID NO: 8490850 - DNA, 22 bp, Homo sapiens
ctggctctgactccgcatattt

SEQ ID NO: 8490851 - DNA, 22 bp, Homo sapiens
ctggctctgaccgcgctggcct

SEQ ID NO: 8490852 - DNA, 22 bp, Homo sapiens
ctggctctgtcaccctttctcc

SEQ ID NO: 8490853 - DNA, 22 bp, Homo sapiens
ctggctctgggctaagctccca

SEQ ID NO: 8490854 - DNA, 23 bp, Homo sapiens
ctggctctgtaggtggcatcctt

SEQ ID NO: 8490855 - DNA, 22 bp, Homo sapiens
ctggctctgtcaccctttctcc

SEQ ID NO: 8490856 - DNA, 22 bp, Homo sapiens
ctggctctgtggcttccttcat

SEQ ID NO: 8490857 - DNA, 22 bp, Homo sapiens
ctggctctgtggcttccttcat

SEQ ID NO: 8490858 - DNA, 22 bp, Homo sapiens
ctggctctgtgggacctggcct

SEQ ID NO: 8490859 - DNA, 22 bp, Homo sapiens
ctggctcctgaggcttggcccc

SEQ ID NO: 8490860 - DNA, 22 bp, Homo sapiens
ctggctctaagtgtcagctccc

SEQ ID NO: 8490861 - DNA, 22 bp, Homo sapiens
ctggctctaagtgtcagctccc

SEQ ID NO: 8490862 - DNA, 22 bp, Homo sapiens
ctggctctaagtgtcagctccc

SEQ ID NO: 8490863 - DNA, 22 bp, Homo sapiens
ctggctctatctccaaggctgg

SEQ ID NO: 8490864 - DNA, 22 bp, Homo sapiens
ctggctctctgatttcacattc

SEQ ID NO: 8490865 - DNA, 22 bp, Homo sapiens
ctggctctctgagatattgagt

SEQ ID NO: 8490866 - DNA, 22 bp, Homo sapiens
ctggctctctgagatattgagt

SEQ ID NO: 8490867 - DNA, 22 bp, Homo sapiens
ctggctctcgctgggagtactt

SEQ ID NO: 8490868 - DNA, 22 bp, Homo sapiens
ctggctctatctccaaggctgg

SEQ ID NO: 8490869 - DNA, 22 bp, Homo sapiens
ctggcccagagctctggccttt

SEQ ID NO: 8490870 - DNA, 22 bp, Homo sapiens
ctggcccagagctctggccttt

SEQ ID NO: 8490871 - DNA, 22 bp, Homo sapiens
ctggcccaggagagcaggcatt

SEQ ID NO: 8490872 - DNA, 22 bp, Homo sapiens
ctggcccaggagagcaggcatt

SEQ ID NO: 8490873 - DNA, 22 bp, Homo sapiens
ctggcccaggctcctggggcac

SEQ ID NO: 8490874 - DNA, 22 bp, Homo sapiens
ctggcccaggctcctggggcac

SEQ ID NO: 8490875 - DNA, 22 bp, Homo sapiens
ctggccagttgccttcctgggt

SEQ ID NO: 8490876 - DNA, 22 bp, Homo sapiens
ctggccagttgtcctggcttgg

SEQ ID NO: 8490877 - DNA, 22 bp, Homo sapiens
ctggccagttgtcctggcttgg

SEQ ID NO: 8490878 - DNA, 22 bp, Homo sapiens
ctggccagttgtcctggcttgg

SEQ ID NO: 8490879 - DNA, 22 bp, Homo sapiens
ctggccagtgtggctctgatct

SEQ ID NO: 8490880 - DNA, 22 bp, Homo sapiens
ctggccagtgtggctctgatct

SEQ ID NO: 8490881 - DNA, 17 bp, Homo sapiens
ctggccagtgtacttgg

SEQ ID NO: 8490882 - DNA, 22 bp, Homo sapiens
ctggcccagagagcagagctta

SEQ ID NO: 8490883 - DNA, 22 bp, Homo sapiens
ctggccagttgtcctggcttgg

SEQ ID NO: 8490884 - DNA, 22 bp, Homo sapiens
ctggcctgagaatgctaccctt

SEQ ID NO: 8490885 - DNA, 22 bp, Homo sapiens
ctggcctgagaatgctaccctt

SEQ ID NO: 8490886 - DNA, 22 bp, Homo sapiens
ctggcctgagaatgctaccctt

SEQ ID NO: 8490887 - DNA, 22 bp, Homo sapiens
ctggcccttaggaaaacaaagt

SEQ ID NO: 8490888 - DNA, 22 bp, Homo sapiens
ctggccctgtggcctaaggact

SEQ ID NO: 8490889 - DNA, 22 bp, Homo sapiens
ctggccctgtggaggcaggaac

SEQ ID NO: 8490890 - DNA, 22 bp, Homo sapiens
ctggcctgaggccgccttcaga

SEQ ID NO: 8490891 - DNA, 22 bp, Homo sapiens
ctggcctgaggccgccttcaga

SEQ ID NO: 8490892 - DNA, 22 bp, Homo sapiens
ctggcctgaggccgccttcaga

SEQ ID NO: 8490893 - DNA, 22 bp, Homo sapiens
ctggcctgagcacagcggctgc

SEQ ID NO: 8490894 - DNA, 22 bp, Homo sapiens
ctggcctgagcacagcggctgc

SEQ ID NO: 8490895 - DNA, 22 bp, Homo sapiens
ctggcctgaggccgccttcaga

SEQ ID NO: 8490896 - DNA, 22 bp, Homo sapiens
ctggcctgagcacagcggctgc

SEQ ID NO: 8490897 - DNA, 22 bp, Homo sapiens
ctggcctggcagggagggcatg

SEQ ID NO: 8490898 - DNA, 22 bp, Homo sapiens
ctggcctggcaggggacctcta

SEQ ID NO: 8490899 - DNA, 22 bp, Homo sapiens
ctggcctggcaggggacctcta

SEQ ID NO: 8490900 - DNA, 22 bp, Homo sapiens
ctggcctggcaggggacctcta

SEQ ID NO: 8490901 - DNA, 22 bp, Homo sapiens
ctggcctggcagggagggcatg

SEQ ID NO: 8490902 - DNA, 22 bp, Homo sapiens
ctggcctgctgggtgaggtcct

SEQ ID NO: 8490903 - DNA, 22 bp, Homo sapiens
ctggcctgatctcatgctgtcc

SEQ ID NO: 8490904 - DNA, 22 bp, Homo sapiens
ctggcctgcagatcccagggtc

SEQ ID NO: 8490905 - DNA, 22 bp, Homo sapiens
ctggcctgaggtcggctgtagg

SEQ ID NO: 8490906 - DNA, 22 bp, Homo sapiens
ctggcctgaggtcggctgtagg

SEQ ID NO: 8490907 - DNA, 22 bp, Homo sapiens
ctggcctgctgggtgaggtcct

SEQ ID NO: 8490908 - DNA, 22 bp, Homo sapiens
ctggcctgctgggtgaggtcct

SEQ ID NO: 8490909 - DNA, 22 bp, Homo sapiens
ctggcctgcagatcccagggtc

SEQ ID NO: 8490910 - DNA, 22 bp, Homo sapiens
ctggcctgcagatcccagggtc

SEQ ID NO: 8490911 - DNA, 22 bp, Homo sapiens
ctggccacaactagcccaggac

SEQ ID NO: 8490912 - DNA, 22 bp, Homo sapiens
ctggccaatatagggaaatctt

SEQ ID NO: 8490913 - DNA, 22 bp, Homo sapiens
ctggccacaactagcccaggac

SEQ ID NO: 8490914 - DNA, 22 bp, Homo sapiens
ctggccaacttgcttgttggca

SEQ ID NO: 8490915 - DNA, 22 bp, Homo sapiens
ctggcattcttgtttctggaaa

SEQ ID NO: 8490916 - DNA, 18 bp, Homo sapiens
ctggcattcttccctgga

SEQ ID NO: 8490917 - DNA, 22 bp, Homo sapiens
ctggcatgcccagggtatgtgg

SEQ ID NO: 8490918 - DNA, 22 bp, Homo sapiens
ctggcatgccttgggtgcctct

SEQ ID NO: 8490919 - DNA, 22 bp, Homo sapiens
ctggcatgccttgggtgcctct

SEQ ID NO: 8490920 - DNA, 22 bp, Homo sapiens
ctggccaggcggcccctgcatg

SEQ ID NO: 8490921 - DNA, 22 bp, Homo sapiens
ctggccaggcggcccctgcatg

SEQ ID NO: 8490922 - DNA, 22 bp, Homo sapiens
ctggccaggctctcacgtggtc

SEQ ID NO: 8490923 - DNA, 17 bp, Homo sapiens
ctggccagtgtacttgg

SEQ ID NO: 8490924 - DNA, 19 bp, Homo sapiens
ctggccacacctgctggtt

SEQ ID NO: 8490925 - DNA, 22 bp, Homo sapiens
ctggccacatgtgtgctgagca

SEQ ID NO: 8490926 - DNA, 23 bp, Homo sapiens
ctggccaccatctttctggcttc

SEQ ID NO: 8490927 - DNA, 22 bp, Homo sapiens
ctggccacatgtgtgctgagca

SEQ ID NO: 8490928 - DNA, 22 bp, Homo sapiens
ctggcagtgtccagctcgtgat

SEQ ID NO: 8490929 - DNA, 22 bp, Homo sapiens
ctggcagtctgcctcttcactg

SEQ ID NO: 8490930 - DNA, 22 bp, Homo sapiens
ctggcagtctggtggaaggcct

SEQ ID NO: 8490931 - DNA, 22 bp, Homo sapiens
ctggcagtggaggaagaaaact

SEQ ID NO: 8490932 - DNA, 22 bp, Homo sapiens
ctggcagtgcccagtcactgtt

SEQ ID NO: 8490933 - DNA, 22 bp, Homo sapiens
ctggcagtgacattgcaggtgc

SEQ ID NO: 8490934 - DNA, 22 bp, Homo sapiens
ctggcagcattaacagagagca

SEQ ID NO: 8490935 - DNA, 22 bp, Homo sapiens
ctggcagggtgggctttgcttt

SEQ ID NO: 8490936 - DNA, 22 bp, Homo sapiens
ctggcagggtgggctttgcttt

SEQ ID NO: 8490937 - DNA, 22 bp, Homo sapiens
ctggcagcagttatgaaacaat

SEQ ID NO: 8490938 - DNA, 22 bp, Homo sapiens
ctggcagcatggagcctgtgct

SEQ ID NO: 8490939 - DNA, 22 bp, Homo sapiens
ctggcagcatggagcctgtgct

SEQ ID NO: 8490940 - DNA, 22 bp, Homo sapiens
ctggcagcatggagcctgtgct

SEQ ID NO: 8490941 - DNA, 22 bp, Homo sapiens
ctggcagcattaacagagagca

SEQ ID NO: 8490942 - DNA, 22 bp, Homo sapiens
ctggcagcattaacagagagca

SEQ ID NO: 8490943 - DNA, 22 bp, Homo sapiens
ctggcagagtctgctgtctgca

SEQ ID NO: 8490944 - DNA, 22 bp, Homo sapiens
ctggcagatatttgcagacatg

SEQ ID NO: 8490945 - DNA, 22 bp, Homo sapiens
ctggcagatagtaagtgatcaa

SEQ ID NO: 8490946 - DNA, 22 bp, Homo sapiens
ctggcagatagtaagtgatcaa

SEQ ID NO: 8490947 - DNA, 22 bp, Homo sapiens
ctggcagcagcttctggatcga

SEQ ID NO: 8490948 - DNA, 22 bp, Homo sapiens
ctggcagcagcttctggatcga

SEQ ID NO: 8490949 - DNA, 22 bp, Homo sapiens
ctggcagcagcttctggatcga

SEQ ID NO: 8490950 - DNA, 22 bp, Homo sapiens
ctggcagatatttgcagacatg

SEQ ID NO: 8490951 - DNA, 22 bp, Homo sapiens
ctggcacctccagctcatggcc

SEQ ID NO: 8490952 - DNA, 22 bp, Homo sapiens
ctggcacctccagctcatggcc

SEQ ID NO: 8490953 - DNA, 22 bp, Homo sapiens
ctggcacattgtaatatataca

SEQ ID NO: 8490954 - DNA, 22 bp, Homo sapiens
ctggcactcataggccagttca

SEQ ID NO: 8490955 - DNA, 22 bp, Homo sapiens
ctggcacatagtcagcactcaa

SEQ ID NO: 8490956 - DNA, 22 bp, Homo sapiens
ctggcacatagtaggtgcacag

SEQ ID NO: 8490957 - DNA, 22 bp, Homo sapiens
ctggatccatcgggtcccgagt

SEQ ID NO: 8490958 - DNA, 22 bp, Homo sapiens
ctggataaatgtttgctttaga

SEQ ID NO: 8490959 - DNA, 22 bp, Homo sapiens
ctggataagagttttacttcct

SEQ ID NO: 8490960 - DNA, 22 bp, Homo sapiens
ctggatctgtttgtgcttgtgg

SEQ ID NO: 8490961 - DNA, 22 bp, Homo sapiens
ctggatgataacagcaatattt

SEQ ID NO: 8490962 - DNA, 22 bp, Homo sapiens
ctggatggtcccatgagcagct

SEQ ID NO: 8490963 - DNA, 22 bp, Homo sapiens
ctggatgcttcctctctgctag

SEQ ID NO: 8490964 - DNA, 18 bp, Homo sapiens
ctggattaagacagtgct

SEQ ID NO: 8490965 - DNA, 22 bp, Homo sapiens
ctggattaagtaaaatagagga

SEQ ID NO: 8490966 - DNA, 22 bp, Homo sapiens
ctggcaagaaatatatatctta

SEQ ID NO: 8490967 - DNA, 22 bp, Homo sapiens
ctggcaagaaatatatatctta

SEQ ID NO: 8490968 - DNA, 22 bp, Homo sapiens
ctggcaagaaatatatatctta

SEQ ID NO: 8490969 - DNA, 22 bp, Homo sapiens
ctgctttgactgttaagaacca

SEQ ID NO: 8490970 - DNA, 22 bp, Homo sapiens
ctgctttgattagaagagtaca

SEQ ID NO: 8490971 - DNA, 22 bp, Homo sapiens
ctgctttctgcaccccaggtcg

SEQ ID NO: 8490972 - DNA, 23 bp, Homo sapiens
ctgctttcccactccatgctctt

SEQ ID NO: 8490973 - DNA, 22 bp, Homo sapiens
ctgctttcttgttgcatcttaa

SEQ ID NO: 8490974 - DNA, 22 bp, Homo sapiens
ctgctttctgcaccccaggtcg

SEQ ID NO: 8490975 - DNA, 22 bp, Homo sapiens
ctgctttgtggaatcacactgg

SEQ ID NO: 8490976 - DNA, 22 bp, Homo sapiens
ctgctttgggcagctttgtggc

SEQ ID NO: 8490977 - DNA, 22 bp, Homo sapiens
ctgctttgtaaaatagacataa

SEQ ID NO: 8490978 - DNA, 22 bp, Homo sapiens
ctgctttgtaaaatagacataa

SEQ ID NO: 8490979 - DNA, 22 bp, Homo sapiens
ctgctttggacaactattcttg

SEQ ID NO: 8490980 - DNA, 22 bp, Homo sapiens
ctgctttgcatagctgccagag

SEQ ID NO: 8490981 - DNA, 22 bp, Homo sapiens
ctgctttttctaggaggacaat

SEQ ID NO: 8490982 - DNA, 22 bp, Homo sapiens
ctggaaaatgaagaagcagagg

SEQ ID NO: 8490983 - DNA, 22 bp, Homo sapiens
ctggaaaatgaagaagcagagg

SEQ ID NO: 8490984 - DNA, 22 bp, Homo sapiens
ctggaaagacagagggcatggg

SEQ ID NO: 8490985 - DNA, 22 bp, Homo sapiens
ctggaaagggtcctcattctgt

SEQ ID NO: 8490986 - DNA, 22 bp, Homo sapiens
ctggaagtataggggagatgat

SEQ ID NO: 8490987 - DNA, 23 bp, Homo sapiens
ctggaagtgcttttatagctttg

SEQ ID NO: 8490988 - DNA, 22 bp, Homo sapiens
ctggaaagtacagtgtgtcaca

SEQ ID NO: 8490989 - DNA, 22 bp, Homo sapiens
ctggaaggttctttgtgtgcct

SEQ ID NO: 8490990 - DNA, 22 bp, Homo sapiens
ctggaaggttctttgtgtgcct

SEQ ID NO: 8490991 - DNA, 22 bp, Homo sapiens
ctggacaaccactcagcctcag

SEQ ID NO: 8490992 - DNA, 22 bp, Homo sapiens
ctggaattgcataatatgtcct

SEQ ID NO: 8490993 - DNA, 19 bp, Homo sapiens
ctggaatgtggctggtgca

SEQ ID NO: 8490994 - DNA, 22 bp, Homo sapiens
ctggacagaaaaggccactgga

SEQ ID NO: 8490995 - DNA, 22 bp, Homo sapiens
ctggacagaaaaggccactgga

SEQ ID NO: 8490996 - DNA, 22 bp, Homo sapiens
ctggacagaaagggctgctgtg

SEQ ID NO: 8490997 - DNA, 22 bp, Homo sapiens
ctggacagaaaccagtcctggg

SEQ ID NO: 8490998 - DNA, 22 bp, Homo sapiens
ctggacagaaaccagtcctggg

SEQ ID NO: 8490999 - DNA, 22 bp, Homo sapiens
ctggacagaaaccagtcctggg

SEQ ID NO: 8491000 - DNA, 22 bp, Homo sapiens
ctggacagaagtggctgggcag

SEQ ID NO: 8491001 - DNA, 22 bp, Homo sapiens
ctggacagaaagggctgctgtg

SEQ ID NO: 8491002 - DNA, 22 bp, Homo sapiens
ctggacagaagtggctgggcag

SEQ ID NO: 8491003 - DNA, 22 bp, Homo sapiens
ctggacagaagtggctgggcag

SEQ ID NO: 8491004 - DNA, 22 bp, Homo sapiens
ctggacagaagtggctgggcag

SEQ ID NO: 8491005 - DNA, 22 bp, Homo sapiens
ctggacaggctggggactgcaa

SEQ ID NO: 8491006 - DNA, 22 bp, Homo sapiens
ctggacaggctggggactgcaa

SEQ ID NO: 8491007 - DNA, 22 bp, Homo sapiens
ctggacagccctcactgtgtgc

SEQ ID NO: 8491008 - DNA, 22 bp, Homo sapiens
ctggacagaagtggctgggcag

SEQ ID NO: 8491009 - DNA, 22 bp, Homo sapiens
ctggacagccctcactgtgtgc

SEQ ID NO: 8491010 - DNA, 22 bp, Homo sapiens
ctggacaggctggggactgcaa

SEQ ID NO: 8491011 - DNA, 22 bp, Homo sapiens
ctgcctggagcattctgaaggt

SEQ ID NO: 8491012 - DNA, 22 bp, Homo sapiens
ctgcctggagcattctgaaggt

SEQ ID NO: 8491013 - DNA, 22 bp, Homo sapiens
ctgcctggaccggcagccctcc

SEQ ID NO: 8491014 - DNA, 22 bp, Homo sapiens
ctgcctggaccggcagccctcc

SEQ ID NO: 8491015 - DNA, 22 bp, Homo sapiens
ctgcctggaccggcagccctcc

SEQ ID NO: 8491016 - DNA, 22 bp, Homo sapiens
ctgcctggacagctcttacctt

SEQ ID NO: 8491017 - DNA, 22 bp, Homo sapiens
ctgcctgctacctgaaatgcca

SEQ ID NO: 8491018 - DNA, 22 bp, Homo sapiens
ctgcctgctcaccagggctctg

SEQ ID NO: 8491019 - DNA, 22 bp, Homo sapiens
ctgcctgctcaccagggctctg

SEQ ID NO: 8491020 - DNA, 22 bp, Homo sapiens
ctgcctgctcaccagggctctg

SEQ ID NO: 8491021 - DNA, 22 bp, Homo sapiens
ctgcctgctacctgaaatgcca

SEQ ID NO: 8491022 - DNA, 22 bp, Homo sapiens
ctgcctgcgttgcctcgtgcct

SEQ ID NO: 8491023 - DNA, 22 bp, Homo sapiens
ctgcctggaatgccagcttctc

SEQ ID NO: 8491024 - DNA, 22 bp, Homo sapiens
ctgcctggaatgccagcttctc

SEQ ID NO: 8491025 - DNA, 22 bp, Homo sapiens
ctgcctggaatgccagcttctc

SEQ ID NO: 8491026 - DNA, 22 bp, Homo sapiens
ctgcctgctctatccaggcctg

SEQ ID NO: 8491027 - DNA, 22 bp, Homo sapiens
ctgcctgctctatccaggcctg

SEQ ID NO: 8491028 - DNA, 17 bp, Homo sapiens
ctgcctggagtcccatc

SEQ ID NO: 8491029 - DNA, 22 bp, Homo sapiens
ctgcctggatgaatggcgcctt

SEQ ID NO: 8491030 - DNA, 22 bp, Homo sapiens
ctgcctggatgaatggcgcctt

SEQ ID NO: 8491031 - DNA, 22 bp, Homo sapiens
ctgcctggatgaatggcgcctt

SEQ ID NO: 8491032 - DNA, 20 bp, Homo sapiens
ctgcctggaggcctctacct

SEQ ID NO: 8491033 - DNA, 20 bp, Homo sapiens
ctgcctggaggcctctacct

SEQ ID NO: 8491034 - DNA, 20 bp, Homo sapiens
ctgcctggaggcctctacct

SEQ ID NO: 8491035 - DNA, 20 bp, Homo sapiens
ctgcctggaggcctctacct

SEQ ID NO: 8491036 - DNA, 22 bp, Homo sapiens
ctgcctggccacaacccagggt

SEQ ID NO: 8491037 - DNA, 22 bp, Homo sapiens
ctgcctggccacaacccagggt

SEQ ID NO: 8491038 - DNA, 22 bp, Homo sapiens
ctgcctggcatggagaagagaa

SEQ ID NO: 8491039 - DNA, 22 bp, Homo sapiens
ctgcctggcatggagaagagaa

SEQ ID NO: 8491040 - DNA, 22 bp, Homo sapiens
ctgcctggcatggagaagagaa

SEQ ID NO: 8491041 - DNA, 22 bp, Homo sapiens
ctgcctggcatggagaagagaa

SEQ ID NO: 8491042 - DNA, 22 bp, Homo sapiens
ctgcctggcatggagaagagaa

SEQ ID NO: 8491043 - DNA, 22 bp, Homo sapiens
ctgcctgggccggccaccctct

SEQ ID NO: 8491044 - DNA, 22 bp, Homo sapiens
ctgcctgggccggccaccctct

SEQ ID NO: 8491045 - DNA, 23 bp, Homo sapiens
ctgcttccttgcttcattgctgg

SEQ ID NO: 8491046 - DNA, 19 bp, Homo sapiens
ctgcttccttccctcactg

SEQ ID NO: 8491047 - DNA, 22 bp, Homo sapiens
ctgcttctaagaacctgcagct

SEQ ID NO: 8491048 - DNA, 22 bp, Homo sapiens
ctgcctggctaaactcaagtcg

SEQ ID NO: 8491049 - DNA, 22 bp, Homo sapiens
ctgcctggcctgatctccacgc

SEQ ID NO: 8491050 - DNA, 22 bp, Homo sapiens
ctgcctggctaaactcaagtcg

SEQ ID NO: 8491051 - DNA, 22 bp, Homo sapiens
ctgcctggctaaactcaagtcg

SEQ ID NO: 8491052 - DNA, 22 bp, Homo sapiens
ctgcctggcccagggatgggcc

SEQ ID NO: 8491053 - DNA, 22 bp, Homo sapiens
ctgcctggcccagggatgggcc

SEQ ID NO: 8491054 - DNA, 22 bp, Homo sapiens
ctgcctggcctgatctccacgc

SEQ ID NO: 8491055 - DNA, 22 bp, Homo sapiens
ctgcctggcccagggatgggcc

SEQ ID NO: 8491056 - DNA, 23 bp, Homo sapiens
ctgctttcccactccatgctctt

SEQ ID NO: 8491057 - DNA, 21 bp, Homo sapiens
ctgctttacttcagaggatct

SEQ ID NO: 8491058 - DNA, 21 bp, Homo sapiens
ctgctttacttcagaggatct

SEQ ID NO: 8491059 - DNA, 22 bp, Homo sapiens
ctgcttctaagaacctgcagct

SEQ ID NO: 8491060 - DNA, 22 bp, Homo sapiens
ctgcttctaagaacctgcagct

SEQ ID NO: 8491061 - DNA, 22 bp, Homo sapiens
ctggagggagattcaaaggagg

SEQ ID NO: 8491062 - DNA, 22 bp, Homo sapiens
ctggaggggctggcatggtagc

SEQ ID NO: 8491063 - DNA, 22 bp, Homo sapiens
ctggaggggccatccacagtct

SEQ ID NO: 8491064 - DNA, 22 bp, Homo sapiens
ctggaggggccatccacagtct

SEQ ID NO: 8491065 - DNA, 21 bp, Homo sapiens
ctggagggtagagttgggctg

SEQ ID NO: 8491066 - DNA, 22 bp, Homo sapiens
ctggagggtgagcctcatctct

SEQ ID NO: 8491067 - DNA, 22 bp, Homo sapiens
ctggagggtgagcctcatctct

SEQ ID NO: 8491068 - DNA, 21 bp, Homo sapiens
ctggagggtagagttgggctg

SEQ ID NO: 8491069 - DNA, 22 bp, Homo sapiens
ctggaggtaagaggccctgggc

SEQ ID NO: 8491070 - DNA, 21 bp, Homo sapiens
ctggagtcattttctgagtag

SEQ ID NO: 8491071 - DNA, 22 bp, Homo sapiens
ctggagtctccccaggagcgtg

SEQ ID NO: 8491072 - DNA, 22 bp, Homo sapiens
ctggagtcctgcatttgctctt

SEQ ID NO: 8491073 - DNA, 22 bp, Homo sapiens
ctggagtacaggaatcttccca

SEQ ID NO: 8491074 - DNA, 22 bp, Homo sapiens
ctggagtcactcatgtagctgc

SEQ ID NO: 8491075 - DNA, 22 bp, Homo sapiens
ctggagtcactcatgtagctgc

SEQ ID NO: 8491076 - DNA, 22 bp, Homo sapiens
ctggaggtgcttcgctggccac

SEQ ID NO: 8491077 - DNA, 22 bp, Homo sapiens
ctggaggttgggtccaggccag

SEQ ID NO: 8491078 - DNA, 22 bp, Homo sapiens
ctggagtaagttaagatgttcc

SEQ ID NO: 8491079 - DNA, 22 bp, Homo sapiens
ctggagtctcttctgtagctac

SEQ ID NO: 8491080 - DNA, 22 bp, Homo sapiens
ctggagtgtaaagagcatagaa

SEQ ID NO: 8491081 - DNA, 22 bp, Homo sapiens
ctggagttagagtagacactga

SEQ ID NO: 8491082 - DNA, 22 bp, Homo sapiens
ctggagttctatgtgcttgtga

SEQ ID NO: 8491083 - DNA, 22 bp, Homo sapiens
ctggaggcacccttagagaggc

SEQ ID NO: 8491084 - DNA, 22 bp, Homo sapiens
ctggaggcaaagcagaggcatg

SEQ ID NO: 8491085 - DNA, 22 bp, Homo sapiens
ctggaggcaaagcagaggcatg

SEQ ID NO: 8491086 - DNA, 22 bp, Homo sapiens
ctggaggagcatggactggagt

SEQ ID NO: 8491087 - DNA, 22 bp, Homo sapiens
ctggaggcaaagcagaggcatg

SEQ ID NO: 8491088 - DNA, 22 bp, Homo sapiens
ctggaggacccctgcctggaag

SEQ ID NO: 8491089 - DNA, 22 bp, Homo sapiens
ctggaggacccctgcctggaag

SEQ ID NO: 8491090 - DNA, 22 bp, Homo sapiens
ctggaggagaacttgaggaagg

SEQ ID NO: 8491091 - DNA, 22 bp, Homo sapiens
ctggaggagagtctgaatgaca

SEQ ID NO: 8491092 - DNA, 21 bp, Homo sapiens
ctggaggcaggtggtgccagg

SEQ ID NO: 8491093 - DNA, 21 bp, Homo sapiens
ctggaggcaggtggtgccagg

SEQ ID NO: 8491094 - DNA, 22 bp, Homo sapiens
ctggaggcaaagcagaggcatg

SEQ ID NO: 8491095 - DNA, 22 bp, Homo sapiens
ctggaggcacccttagagaggc

SEQ ID NO: 8491096 - DNA, 21 bp, Homo sapiens
ctggaggcaggtggtgccagg

SEQ ID NO: 8491097 - DNA, 21 bp, Homo sapiens
ctggaggcaggtggtgccagg

SEQ ID NO: 8491098 - DNA, 21 bp, Homo sapiens
ctggaggcaggtggtgccagg

SEQ ID NO: 8491099 - DNA, 22 bp, Homo sapiens
ctggaggctggcttcccctggc

SEQ ID NO: 8491100 - DNA, 22 bp, Homo sapiens
ctggaggctgagttgggtctcc

SEQ ID NO: 8491101 - DNA, 22 bp, Homo sapiens
ctggactcagggtgctccagcg

SEQ ID NO: 8491102 - DNA, 22 bp, Homo sapiens
ctggactcagggtgctccagcg

SEQ ID NO: 8491103 - DNA, 23 bp, Homo sapiens
ctggactcaggggatgtgaagga

SEQ ID NO: 8491104 - DNA, 22 bp, Homo sapiens
ctggactcatccatagaggtga

SEQ ID NO: 8491105 - DNA, 22 bp, Homo sapiens
ctggactctgcagagaaaagta

SEQ ID NO: 8491106 - DNA, 22 bp, Homo sapiens
ctggactttggcccatctgcca

SEQ ID NO: 8491107 - DNA, 22 bp, Homo sapiens
ctggagctctccagagccccgt

SEQ ID NO: 8491108 - DNA, 21 bp, Homo sapiens
ctggactgaggagacagtcgc

SEQ ID NO: 8491109 - DNA, 20 bp, Homo sapiens
ctggacttgctgctcacctg

SEQ ID NO: 8491110 - DNA, 22 bp, Homo sapiens
ctggacttctcttcaaagacag

SEQ ID NO: 8491111 - DNA, 22 bp, Homo sapiens
ctggactcactatggcttcaga

SEQ ID NO: 8491112 - DNA, 23 bp, Homo sapiens
ctggactcaggggatgtgaagga

SEQ ID NO: 8491113 - DNA, 22 bp, Homo sapiens
ctggacatcagtgtgcctggct

SEQ ID NO: 8491114 - DNA, 22 bp, Homo sapiens
ctggaccagaaaggacatggct

SEQ ID NO: 8491115 - DNA, 22 bp, Homo sapiens
ctggacatcagtgtgcctggct

SEQ ID NO: 8491116 - DNA, 22 bp, Homo sapiens
ctggacttggggaggctagatt

SEQ ID NO: 8491117 - DNA, 22 bp, Homo sapiens
ctggagctctgtgtgttcctga

SEQ ID NO: 8491118 - DNA, 22 bp, Homo sapiens
ctggagctctccagagccccgt

SEQ ID NO: 8491119 - DNA, 22 bp, Homo sapiens
ctggagctctgtgtgttcctga

SEQ ID NO: 8491120 - DNA, 22 bp, Homo sapiens
ctggagctcttctgagtgtgct

SEQ ID NO: 8491121 - DNA, 22 bp, Homo sapiens
ctggaggaataatggcatcttg

SEQ ID NO: 8491122 - DNA, 22 bp, Homo sapiens
ctggagctgccagacgggcaca

SEQ ID NO: 8491123 - DNA, 22 bp, Homo sapiens
ctggaggaataatctcctaccc

SEQ ID NO: 8491124 - DNA, 22 bp, Homo sapiens
ctggaggaataatctcctaccc

SEQ ID NO: 8491125 - DNA, 22 bp, Homo sapiens
ctggaggaataatggcatcttg

SEQ ID NO: 8491126 - DNA, 22 bp, Homo sapiens
ctggaggaatcacagaaggctt

SEQ ID NO: 8491127 - DNA, 22 bp, Homo sapiens
ctggaggaccacagaagctggt

SEQ ID NO: 8491128 - DNA, 22 bp, Homo sapiens
ctggaggaccacagaagctggt

SEQ ID NO: 8491129 - DNA, 22 bp, Homo sapiens
ctggaggaccacagaagctggt

SEQ ID NO: 8491130 - DNA, 22 bp, Homo sapiens
ctggaggacagaggccatgtct

SEQ ID NO: 8491131 - DNA, 22 bp, Homo sapiens
ctggaggacagaggccatgtct

SEQ ID NO: 8491132 - DNA, 21 bp, Homo sapiens
gattaaatttaagctacatgc

SEQ ID NO: 8491133 - DNA, 22 bp, Homo sapiens
gattaagattacatatttaagt

SEQ ID NO: 8491134 - DNA, 22 bp, Homo sapiens
gattaagagaagtttcttatcg

SEQ ID NO: 8491135 - DNA, 22 bp, Homo sapiens
gattaacatttctaagatgcca

SEQ ID NO: 8491136 - DNA, 21 bp, Homo sapiens
gattaaatttaagctacatgc

SEQ ID NO: 8491137 - DNA, 21 bp, Homo sapiens
gattaaatttaagctacatgc

SEQ ID NO: 8491138 - DNA, 21 bp, Homo sapiens
gattaaatttaagctacatgc

SEQ ID NO: 8491139 - DNA, 22 bp, Homo sapiens
gattaacaaatttcatatccaa

SEQ ID NO: 8491140 - DNA, 22 bp, Homo sapiens
gattacattctccttgtattag

SEQ ID NO: 8491141 - DNA, 22 bp, Homo sapiens
gattacacgtttttaatcacat

SEQ ID NO: 8491142 - DNA, 22 bp, Homo sapiens
gattacaaaactcatctatgac

SEQ ID NO: 8491143 - DNA, 22 bp, Homo sapiens
gattaagattacatatttaagt

SEQ ID NO: 8491144 - DNA, 22 bp, Homo sapiens
gattaattcaggatcaggaaat

SEQ ID NO: 8491145 - DNA, 22 bp, Homo sapiens
gatgttcagtggttgaccataa

SEQ ID NO: 8491146 - DNA, 22 bp, Homo sapiens
gatgttctagaagtgtggtgtt

SEQ ID NO: 8491147 - DNA, 22 bp, Homo sapiens
gatgttcttataccattgtggg

SEQ ID NO: 8491148 - DNA, 22 bp, Homo sapiens
gatgtgtttccaggatttgttt

SEQ ID NO: 8491149 - DNA, 22 bp, Homo sapiens
gatgtgtgtttatacatatatt

SEQ ID NO: 8491150 - DNA, 22 bp, Homo sapiens
gatgtgtttccaggatttgttt

SEQ ID NO: 8491151 - DNA, 22 bp, Homo sapiens
gatgtgtttgtttctggaggag

SEQ ID NO: 8491152 - DNA, 22 bp, Homo sapiens
gattgaaaggtctttaaattgg

SEQ ID NO: 8491153 - DNA, 22 bp, Homo sapiens
gattgaaatataaatatgtgtt

SEQ ID NO: 8491154 - DNA, 21 bp, Homo sapiens
gattgaaaccatggcagtgag

SEQ ID NO: 8491155 - DNA, 22 bp, Homo sapiens
gattgaaagactgtttgggaga

SEQ ID NO: 8491156 - DNA, 22 bp, Homo sapiens
gattgaaaggaaaaccagagtg

SEQ ID NO: 8491157 - DNA, 22 bp, Homo sapiens
gattctttggcctttattgaca

SEQ ID NO: 8491158 - DNA, 22 bp, Homo sapiens
gattgaaacataggcagtcgag

SEQ ID NO: 8491159 - DNA, 22 bp, Homo sapiens
gattctttacatctctgctgac

SEQ ID NO: 8491160 - DNA, 22 bp, Homo sapiens
gattcacaactgccctgaaggg

SEQ ID NO: 8491161 - DNA, 22 bp, Homo sapiens
gattcacagaacttagtcaagc

SEQ ID NO: 8491162 - DNA, 22 bp, Homo sapiens
gattcaagacctagctcagcca

SEQ ID NO: 8491163 - DNA, 22 bp, Homo sapiens
gattcaatgttgcagatggaat

SEQ ID NO: 8491164 - DNA, 22 bp, Homo sapiens
gattcaatgttgcagatggaat

SEQ ID NO: 8491165 - DNA, 22 bp, Homo sapiens
gattagttgattaagagtcaga

SEQ ID NO: 8491166 - DNA, 22 bp, Homo sapiens
gattatataatggaagctcttg

SEQ ID NO: 8491167 - DNA, 22 bp, Homo sapiens
gattagtatccttattaagaga

SEQ ID NO: 8491168 - DNA, 22 bp, Homo sapiens
gattatataatggaagctcttg

SEQ ID NO: 8491169 - DNA, 22 bp, Homo sapiens
gattatggagaaataattagaa

SEQ ID NO: 8491170 - DNA, 22 bp, Homo sapiens
gattatggtagaaacaagaagt

SEQ ID NO: 8491171 - DNA, 22 bp, Homo sapiens
gattatggagaagaacaatgaa

SEQ ID NO: 8491172 - DNA, 22 bp, Homo sapiens
gattatggatggacagtggagc

SEQ ID NO: 8491173 - DNA, 22 bp, Homo sapiens
gattatggtaacaatgattaaa

SEQ ID NO: 8491174 - DNA, 22 bp, Homo sapiens
gattcaaaagtttgagctccaa

SEQ ID NO: 8491175 - DNA, 22 bp, Homo sapiens
gattcaaagacagactcatttc

SEQ ID NO: 8491176 - DNA, 22 bp, Homo sapiens
gattcaaaaataagctcctatt

SEQ ID NO: 8491177 - DNA, 22 bp, Homo sapiens
gattattttgtgcaataatcgg

SEQ ID NO: 8491178 - DNA, 22 bp, Homo sapiens
gattcaaagttaatgaagatgc

SEQ ID NO: 8491179 - DNA, 22 bp, Homo sapiens
gattcaaagttaatgaagatgc

SEQ ID NO: 8491180 - DNA, 21 bp, Homo sapiens
gatttataagccttaagccta

SEQ ID NO: 8491181 - DNA, 22 bp, Homo sapiens
gatttatagtatgtgctttcag

SEQ ID NO: 8491182 - DNA, 22 bp, Homo sapiens
gatttataaaggttgcactgga

SEQ ID NO: 8491183 - DNA, 22 bp, Homo sapiens
gatttagtggcccttggtacac

SEQ ID NO: 8491184 - DNA, 22 bp, Homo sapiens
gatttagagaatgttttgtaag

SEQ ID NO: 8491185 - DNA, 22 bp, Homo sapiens
gatttacagctatacccaatgg

SEQ ID NO: 8491186 - DNA, 22 bp, Homo sapiens
gatttatttttaatcagcaggg

SEQ ID NO: 8491187 - DNA, 22 bp, Homo sapiens
gatttatttttaatcagcaggg

SEQ ID NO: 8491188 - DNA, 22 bp, Homo sapiens
gatttatttttaatcagcaggg

SEQ ID NO: 8491189 - DNA, 22 bp, Homo sapiens
gatttcaacctaacagtatgac

SEQ ID NO: 8491190 - DNA, 22 bp, Homo sapiens
gatttattgtccctgtcctgct

SEQ ID NO: 8491191 - DNA, 22 bp, Homo sapiens
gatttattgtccctgtcctgct

SEQ ID NO: 8491192 - DNA, 22 bp, Homo sapiens
gatttattggtctttcattggt

SEQ ID NO: 8491193 - DNA, 22 bp, Homo sapiens
gatttattggtctttcattggt

SEQ ID NO: 8491194 - DNA, 22 bp, Homo sapiens
gatttattggtctttcattggt

SEQ ID NO: 8491195 - DNA, 22 bp, Homo sapiens
gatttatagtatgtgctttcag

SEQ ID NO: 8491196 - DNA, 22 bp, Homo sapiens
gattgtaaaacagatcattatc

SEQ ID NO: 8491197 - DNA, 22 bp, Homo sapiens
gattggagagtggaacatgctg

SEQ ID NO: 8491198 - DNA, 22 bp, Homo sapiens
gattgagtctgaggatgctgca

SEQ ID NO: 8491199 - DNA, 22 bp, Homo sapiens
gattgcaaatcattacaaagga

SEQ ID NO: 8491200 - DNA, 22 bp, Homo sapiens
gattgagtctgaggatgctgca

SEQ ID NO: 8491201 - DNA, 22 bp, Homo sapiens
gattgagtctgaggatgctgca

SEQ ID NO: 8491202 - DNA, 22 bp, Homo sapiens
gattgcgtctgtgtcaccttca

SEQ ID NO: 8491203 - DNA, 22 bp, Homo sapiens
gatttaaagtagacctttgttt

SEQ ID NO: 8491204 - DNA, 19 bp, Homo sapiens
gatttaaacgtggctctat

SEQ ID NO: 8491205 - DNA, 22 bp, Homo sapiens
gatgctgggaccacagagtgtt

SEQ ID NO: 8491206 - DNA, 22 bp, Homo sapiens
gatgctgggaccacagagtgtt

SEQ ID NO: 8491207 - DNA, 22 bp, Homo sapiens
gatgctgagaggtggagggaac

SEQ ID NO: 8491208 - DNA, 22 bp, Homo sapiens
gatgctttccaagaaatcctca

SEQ ID NO: 8491209 - DNA, 22 bp, Homo sapiens
gatgcttaagatgttggtggca

SEQ ID NO: 8491210 - DNA, 22 bp, Homo sapiens
gatgcttacatagcccaagtgt

SEQ ID NO: 8491211 - DNA, 22 bp, Homo sapiens
gatggaagaaaaatgcatgtct

SEQ ID NO: 8491212 - DNA, 22 bp, Homo sapiens
gatgcctgtggtgagcacacat

SEQ ID NO: 8491213 - DNA, 22 bp, Homo sapiens
gatgcctgcatttcaggagagt

SEQ ID NO: 8491214 - DNA, 22 bp, Homo sapiens
gatgcattacaaaagtgattat

SEQ ID NO: 8491215 - DNA, 22 bp, Homo sapiens
gatgcattcgggatgtttactt

SEQ ID NO: 8491216 - DNA, 22 bp, Homo sapiens
gatgctcatctgtcctttgatg

SEQ ID NO: 8491217 - DNA, 22 bp, Homo sapiens
gatgctgagagattggagacta

SEQ ID NO: 8491218 - DNA, 22 bp, Homo sapiens
gatgctgaagtgaagtgatctt

SEQ ID NO: 8491219 - DNA, 22 bp, Homo sapiens
gatgcgggcccgctccactgcc

SEQ ID NO: 8491220 - DNA, 22 bp, Homo sapiens
gatgcgggcccgctccactgcc

SEQ ID NO: 8491221 - DNA, 22 bp, Homo sapiens
gatgcgggcccgctccactgcc

SEQ ID NO: 8491222 - DNA, 22 bp, Homo sapiens
gatgcgggcccgctccactgcc

SEQ ID NO: 8491223 - DNA, 22 bp, Homo sapiens
gatggaggaaaagttggaatgc

SEQ ID NO: 8491224 - DNA, 22 bp, Homo sapiens
gatggaggagatggcagggtgc

SEQ ID NO: 8491225 - DNA, 22 bp, Homo sapiens
gatggaatgaatggcagataca

SEQ ID NO: 8491226 - DNA, 22 bp, Homo sapiens
gatggacacctcctgaggttct

SEQ ID NO: 8491227 - DNA, 22 bp, Homo sapiens
gatggacacctcctgaggttct

SEQ ID NO: 8491228 - DNA, 22 bp, Homo sapiens
gatggcctcatggctgcaggcc

SEQ ID NO: 8491229 - DNA, 22 bp, Homo sapiens
gatggcctcatggctgcaggcc

SEQ ID NO: 8491230 - DNA, 22 bp, Homo sapiens
gatggcctcatggctgcaggcc

SEQ ID NO: 8491231 - DNA, 22 bp, Homo sapiens
gatggcccgctagctggcctct

SEQ ID NO: 8491232 - DNA, 22 bp, Homo sapiens
gatggcctcatggctgcaggcc

SEQ ID NO: 8491233 - DNA, 22 bp, Homo sapiens
gatggctttgcctgctgtgagg

SEQ ID NO: 8491234 - DNA, 22 bp, Homo sapiens
gatggctttgaggaatttgaat

SEQ ID NO: 8491235 - DNA, 20 bp, Homo sapiens
gatggctttagaagctggta

SEQ ID NO: 8491236 - DNA, 22 bp, Homo sapiens
gatggctttgtgcaccatgatt

SEQ ID NO: 8491237 - DNA, 20 bp, Homo sapiens
gatgggaatcggagctggta

SEQ ID NO: 8491238 - DNA, 18 bp, Homo sapiens
gatgggagcaagagaaga

SEQ ID NO: 8491239 - DNA, 22 bp, Homo sapiens
gatggcttctctctagcttggt

SEQ ID NO: 8491240 - DNA, 22 bp, Homo sapiens
gatggcttccttctcactgtgt

SEQ ID NO: 8491241 - DNA, 22 bp, Homo sapiens
gatggcttgttttctggctgaa

SEQ ID NO: 8491242 - DNA, 22 bp, Homo sapiens
gatggcttctgaatcagggcct

SEQ ID NO: 8491243 - DNA, 22 bp, Homo sapiens
gatggcttgcttagtgacagca

SEQ ID NO: 8491244 - DNA, 22 bp, Homo sapiens
gatggcttcacttacatggctg

SEQ ID NO: 8491245 - DNA, 22 bp, Homo sapiens
gatggcttcagtctccttgggt

SEQ ID NO: 8491246 - DNA, 22 bp, Homo sapiens
gatggcttaagagtaaaaggca

SEQ ID NO: 8491247 - DNA, 22 bp, Homo sapiens
gatggcttacagacagttagga

SEQ ID NO: 8491248 - DNA, 22 bp, Homo sapiens
gatgggcatcaaacatgacgtg

SEQ ID NO: 8491249 - DNA, 22 bp, Homo sapiens
gatgggaggaacctgggtccct

SEQ ID NO: 8491250 - DNA, 18 bp, Homo sapiens
gatgggagcaagagaaga

SEQ ID NO: 8491251 - DNA, 22 bp, Homo sapiens
gatgggaggaacctgggtccct

SEQ ID NO: 8491252 - DNA, 22 bp, Homo sapiens
gatgtacaatgtcactatgacc

SEQ ID NO: 8491253 - DNA, 22 bp, Homo sapiens
gatggtgcaggtgaagtgctgg

SEQ ID NO: 8491254 - DNA, 22 bp, Homo sapiens
gatggtgtcccaggctcaggct

SEQ ID NO: 8491255 - DNA, 22 bp, Homo sapiens
gatgtaaaaactcctttcgaaa

SEQ ID NO: 8491256 - DNA, 18 bp, Homo sapiens
gatgtaaaatagtagctt

SEQ ID NO: 8491257 - DNA, 22 bp, Homo sapiens
gatggggatgagaagtgagcag

SEQ ID NO: 8491258 - DNA, 22 bp, Homo sapiens
gatggggatgagaagtgagcag

SEQ ID NO: 8491259 - DNA, 22 bp, Homo sapiens
gatggggatgagaagtgagcag

SEQ ID NO: 8491260 - DNA, 22 bp, Homo sapiens
gatggggatgagaagtgagcag

SEQ ID NO: 8491261 - DNA, 22 bp, Homo sapiens
gatggggatgagaagtgagcag

SEQ ID NO: 8491262 - DNA, 18 bp, Homo sapiens
gatggggtccaggcatag

SEQ ID NO: 8491263 - DNA, 22 bp, Homo sapiens
gatggggtccttgacctggcca

SEQ ID NO: 8491264 - DNA, 22 bp, Homo sapiens
gatgggggccagggcctgcttt

SEQ ID NO: 8491265 - DNA, 22 bp, Homo sapiens
gatgggggccagggcctgcttt

SEQ ID NO: 8491266 - DNA, 22 bp, Homo sapiens
gatggggttttgccaggctggt

SEQ ID NO: 8491267 - DNA, 22 bp, Homo sapiens
gatggggttttgccaggctggt

SEQ ID NO: 8491268 - DNA, 22 bp, Homo sapiens
gatgggtagaagtggaagaggt

SEQ ID NO: 8491269 - DNA, 22 bp, Homo sapiens
gatgggtattggcagaagaggg

SEQ ID NO: 8491270 - DNA, 20 bp, Homo sapiens
gatgggtattgaagtcacct

SEQ ID NO: 8491271 - DNA, 22 bp, Homo sapiens
gatgggtagcctttcaatagca

SEQ ID NO: 8491272 - DNA, 18 bp, Homo sapiens
gatgggtaaaggcataaa

SEQ ID NO: 8491273 - DNA, 22 bp, Homo sapiens
gatgggtgggttctgtgagagg

SEQ ID NO: 8491274 - DNA, 22 bp, Homo sapiens
gatggtctttgtctctgataag

SEQ ID NO: 8491275 - DNA, 22 bp, Homo sapiens
gatgggtggtctcagacttgcc

SEQ ID NO: 8491276 - DNA, 22 bp, Homo sapiens
gatgggtggtctcagacttgcc

SEQ ID NO: 8491277 - DNA, 21 bp, Homo sapiens
gatggtagcctcatagaagta

SEQ ID NO: 8491278 - DNA, 22 bp, Homo sapiens
gatgtgtgtgccctgggcctgc

SEQ ID NO: 8491279 - DNA, 22 bp, Homo sapiens
gatgtgtgcttttcgcagtgtc

SEQ ID NO: 8491280 - DNA, 22 bp, Homo sapiens
gatgtgtgctgcatagtatatt

SEQ ID NO: 8491281 - DNA, 22 bp, Homo sapiens
gatgtgtgcttttcgcagtgtc

SEQ ID NO: 8491282 - DNA, 22 bp, Homo sapiens
gatgtcttaagcccagaagttc

SEQ ID NO: 8491283 - DNA, 22 bp, Homo sapiens
gatgtcttaagcccagaagttc

SEQ ID NO: 8491284 - DNA, 22 bp, Homo sapiens
gatgtcttactaactagccttt

SEQ ID NO: 8491285 - DNA, 22 bp, Homo sapiens
gatgtcttactaactagccttt

SEQ ID NO: 8491286 - DNA, 22 bp, Homo sapiens
gatgtcttactaactagccttt

SEQ ID NO: 8491287 - DNA, 22 bp, Homo sapiens
gatgtcatcaggctaagacact

SEQ ID NO: 8491288 - DNA, 22 bp, Homo sapiens
gatgtcctgcagaaacatgaga

SEQ ID NO: 8491289 - DNA, 18 bp, Homo sapiens
gatgtctcgaggagacta

SEQ ID NO: 8491290 - DNA, 22 bp, Homo sapiens
gatgtagacacttggaggctta

SEQ ID NO: 8491291 - DNA, 22 bp, Homo sapiens
gatgtagacacttggaggctta

SEQ ID NO: 8491292 - DNA, 22 bp, Homo sapiens
gatgtagagggaagattttaaa

SEQ ID NO: 8491293 - DNA, 22 bp, Homo sapiens
gatttcttgataattcaaatcc

SEQ ID NO: 8491294 - DNA, 22 bp, Homo sapiens
gatttctttaggtgtaatagtg

SEQ ID NO: 8491295 - DNA, 22 bp, Homo sapiens
gatttctttaggtgtaatagtg

SEQ ID NO: 8491296 - DNA, 22 bp, Homo sapiens
gatttctttatgaagtacagaa

SEQ ID NO: 8491297 - DNA, 21 bp, Homo sapiens
gatttgcagaaactagacagg

SEQ ID NO: 8491298 - DNA, 22 bp, Homo sapiens
gatttggcttggatgattaaac

SEQ ID NO: 8491299 - DNA, 22 bp, Homo sapiens
gatttctttgcaagctgtgttc

SEQ ID NO: 8491300 - DNA, 22 bp, Homo sapiens
gatttctttgcaagctgtgttc

SEQ ID NO: 8491301 - DNA, 22 bp, Homo sapiens
gatttcttcattcattagatgg

SEQ ID NO: 8491302 - DNA, 22 bp, Homo sapiens
gatttcttcaggagcagaggag

SEQ ID NO: 8491303 - DNA, 22 bp, Homo sapiens
gatttcttgagcaagttgctta

SEQ ID NO: 8491304 - DNA, 22 bp, Homo sapiens
gatttcttgacccctgtctcag

SEQ ID NO: 8491305 - DNA, 22 bp, Homo sapiens
gatttcttgataagtagtgtga

SEQ ID NO: 8491306 - DNA, 22 bp, Homo sapiens
gatttcttgataagtagtgtga

SEQ ID NO: 8491307 - DNA, 22 bp, Homo sapiens
gatttcttcatttgtggtgaat

SEQ ID NO: 8491308 - DNA, 22 bp, Homo sapiens
gatttcttcattcattagatgg

SEQ ID NO: 8491309 - DNA, 22 bp, Homo sapiens
gatttcttctctcccaagagga

SEQ ID NO: 8491310 - DNA, 22 bp, Homo sapiens
gatttcttgacccctgtctcag

SEQ ID NO: 8491311 - DNA, 22 bp, Homo sapiens
gattttatagtcaggaaaaaga

SEQ ID NO: 8491312 - DNA, 22 bp, Homo sapiens
gattttaattataggaggtcct

SEQ ID NO: 8491313 - DNA, 22 bp, Homo sapiens
gattttatatggcatactgtgg

SEQ ID NO: 8491314 - DNA, 22 bp, Homo sapiens
gattttaattataggaggtcct

SEQ ID NO: 8491315 - DNA, 21 bp, Homo sapiens
gattttaaagagactgccaca

SEQ ID NO: 8491316 - DNA, 21 bp, Homo sapiens
gattttaaagagactgccaca

SEQ ID NO: 8491317 - DNA, 21 bp, Homo sapiens
gattttaaagagactgccaca

SEQ ID NO: 8491318 - DNA, 22 bp, Homo sapiens
gatttgtggtgtgaggaagagc

SEQ ID NO: 8491319 - DNA, 22 bp, Homo sapiens
gatttgtttcaagttagcatct

SEQ ID NO: 8491320 - DNA, 22 bp, Homo sapiens
gatttgtctatattcaaatatg

SEQ ID NO: 8491321 - DNA, 22 bp, Homo sapiens
gatttgtgctcattttccatta

SEQ ID NO: 8491322 - DNA, 22 bp, Homo sapiens
gatttgtcacggttgagagcca

SEQ ID NO: 8491323 - DNA, 22 bp, Homo sapiens
gattttatctttgtgtgcagta

SEQ ID NO: 8491324 - DNA, 22 bp, Homo sapiens
gattttatctttgtgtgcagta

SEQ ID NO: 8491325 - DNA, 22 bp, Homo sapiens
gattttattagcccaaactttg

SEQ ID NO: 8491326 - DNA, 22 bp, Homo sapiens
gattttatatggcatactgtgg

SEQ ID NO: 8491327 - DNA, 22 bp, Homo sapiens
gattttatcgtcatccttctgg

SEQ ID NO: 8491328 - DNA, 22 bp, Homo sapiens
gattttattagcccaaactttg

SEQ ID NO: 8491329 - DNA, 22 bp, Homo sapiens
gattttcatgataaacttgtga

SEQ ID NO: 8491330 - DNA, 22 bp, Homo sapiens
gattttcatgataaacttgtga

SEQ ID NO: 8491331 - DNA, 22 bp, Homo sapiens
gattttcatgataaacttgtga

SEQ ID NO: 8491332 - DNA, 22 bp, Homo sapiens
gattttcatgataaacttgtga

SEQ ID NO: 8491333 - DNA, 22 bp, Homo sapiens
gattttcattatagctagtttc

SEQ ID NO: 8491334 - DNA, 22 bp, Homo sapiens
gattttcattatagctagtttc

SEQ ID NO: 8491335 - DNA, 22 bp, Homo sapiens
gattttcatttgcactctagaa

SEQ ID NO: 8491336 - DNA, 22 bp, Homo sapiens
gattttcatttgcactctagaa

SEQ ID NO: 8491337 - DNA, 22 bp, Homo sapiens
gattttcattatagctagtttc

SEQ ID NO: 8491338 - DNA, 22 bp, Homo sapiens
gattttcatttgcactctagaa

SEQ ID NO: 8491339 - DNA, 22 bp, Homo sapiens
gattttcattatagctagtttc

SEQ ID NO: 8491340 - DNA, 22 bp, Homo sapiens
gcaatcaatgatttatatttgt

SEQ ID NO: 8491341 - DNA, 17 bp, Homo sapiens
gcaatctcagtctcctt

SEQ ID NO: 8491342 - DNA, 22 bp, Homo sapiens
gcaatataaccagttgtcatgc

SEQ ID NO: 8491343 - DNA, 22 bp, Homo sapiens
gcaatgaggagtggtagggata

SEQ ID NO: 8491344 - DNA, 22 bp, Homo sapiens
gcaatgcaatctttattatatt

SEQ ID NO: 8491345 - DNA, 20 bp, Homo sapiens
gcaattaatttttggttaca

SEQ ID NO: 8491346 - DNA, 22 bp, Homo sapiens
gcaatgggcacagcccagccca

SEQ ID NO: 8491347 - DNA, 22 bp, Homo sapiens
gcaatgcataacagagtgggcc

SEQ ID NO: 8491348 - DNA, 22 bp, Homo sapiens
gcaatgcatatgtgggtagcat

SEQ ID NO: 8491349 - DNA, 22 bp, Homo sapiens
gcacaaaggtggaaggaggaag

SEQ ID NO: 8491350 - DNA, 22 bp, Homo sapiens
gcacaaactgcaattacttttg

SEQ ID NO: 8491351 - DNA, 22 bp, Homo sapiens
gcacaagcacgagcagcgtgcg

SEQ ID NO: 8491352 - DNA, 22 bp, Homo sapiens
gcacaaggagcagtgtatgaaa

SEQ ID NO: 8491353 - DNA, 22 bp, Homo sapiens
gcacaacaccaagggaggtatc

SEQ ID NO: 8491354 - DNA, 17 bp, Homo sapiens
gcacaaatcaattacta

SEQ ID NO: 8491355 - DNA, 22 bp, Homo sapiens
gcacaaatacaaagttgagaaa

SEQ ID NO: 8491356 - DNA, 22 bp, Homo sapiens
gcacaagaaatcatggactgaa

SEQ ID NO: 8491357 - DNA, 22 bp, Homo sapiens
gcaaacatgttgtgagatacca

SEQ ID NO: 8491358 - DNA, 22 bp, Homo sapiens
gcaaacatgctgagaaataaga

SEQ ID NO: 8491359 - DNA, 22 bp, Homo sapiens
gcaaactggcaaacctgtctgt

SEQ ID NO: 8491360 - DNA, 22 bp, Homo sapiens
gatttttatataaagtgagaaa

SEQ ID NO: 8491361 - DNA, 22 bp, Homo sapiens
gatttttatataaagtgagaaa

SEQ ID NO: 8491362 - DNA, 22 bp, Homo sapiens
gcaaacagaaatgcaggacgct

SEQ ID NO: 8491363 - DNA, 22 bp, Homo sapiens
gcaaacagccaggcgcagaagt

SEQ ID NO: 8491364 - DNA, 22 bp, Homo sapiens
gattttctgagccttcaaattt

SEQ ID NO: 8491365 - DNA, 22 bp, Homo sapiens
gattttcttgggaaacaatgag

SEQ ID NO: 8491366 - DNA, 22 bp, Homo sapiens
gattttgtcaaattccaaatgt

SEQ ID NO: 8491367 - DNA, 22 bp, Homo sapiens
gatttttatataaagtgagaaa

SEQ ID NO: 8491368 - DNA, 22 bp, Homo sapiens
gcacccaggcttgggcagcaac

SEQ ID NO: 8491369 - DNA, 22 bp, Homo sapiens
gcacccaggcttgggcagcaac

SEQ ID NO: 8491370 - DNA, 22 bp, Homo sapiens
gcacccaggccggcgactgcag

SEQ ID NO: 8491371 - DNA, 22 bp, Homo sapiens
gcacccagggacttggctggcc

SEQ ID NO: 8491372 - DNA, 22 bp, Homo sapiens
gcacccagggacttggctggcc

SEQ ID NO: 8491373 - DNA, 22 bp, Homo sapiens
gcacccagggacttggctggcc

SEQ ID NO: 8491374 - DNA, 22 bp, Homo sapiens
gcacccaggcttgggcagcaac

SEQ ID NO: 8491375 - DNA, 22 bp, Homo sapiens
gcacccagtgggatgcttagca

SEQ ID NO: 8491376 - DNA, 22 bp, Homo sapiens
gcacccagggcaggaagtgagg

SEQ ID NO: 8491377 - DNA, 22 bp, Homo sapiens
gcacccagggcaggaagtgagg

SEQ ID NO: 8491378 - DNA, 22 bp, Homo sapiens
gcacccagtttgtctcagggtt

SEQ ID NO: 8491379 - DNA, 22 bp, Homo sapiens
gcacccatgctcttgtctcagg

SEQ ID NO: 8491380 - DNA, 16 bp, Homo sapiens
gcacacacatcaatga

SEQ ID NO: 8491381 - DNA, 16 bp, Homo sapiens
gcacacacatcaatga

SEQ ID NO: 8491382 - DNA, 22 bp, Homo sapiens
gcacaataacagccaaggttat

SEQ ID NO: 8491383 - DNA, 22 bp, Homo sapiens
gcacacacatgtgagtacatgc

SEQ ID NO: 8491384 - DNA, 22 bp, Homo sapiens
gcacacacatgtgagtacatgc

SEQ ID NO: 8491385 - DNA, 22 bp, Homo sapiens
gcacacactgttttcctcacat

SEQ ID NO: 8491386 - DNA, 22 bp, Homo sapiens
gcacacactgttttcctcacat

SEQ ID NO: 8491387 - DNA, 22 bp, Homo sapiens
gcacacactgttttcctcacat

SEQ ID NO: 8491388 - DNA, 22 bp, Homo sapiens
gcacccaggccggcgactgcag

SEQ ID NO: 8491389 - DNA, 22 bp, Homo sapiens
gcacccaggcactttcctttct

SEQ ID NO: 8491390 - DNA, 22 bp, Homo sapiens
gcaccgccttggaccgcccgct

SEQ ID NO: 8491391 - DNA, 22 bp, Homo sapiens
gcaccgccttggaccgcccgct

SEQ ID NO: 8491392 - DNA, 22 bp, Homo sapiens
gcacccctgcgtgccttccctt

SEQ ID NO: 8491393 - DNA, 19 bp, Homo sapiens
gcaccccatcttcctcctg

SEQ ID NO: 8491394 - DNA, 22 bp, Homo sapiens
gcacccctggacggtagggcca

SEQ ID NO: 8491395 - DNA, 22 bp, Homo sapiens
gcaccctagagttgcctgagga

SEQ ID NO: 8491396 - DNA, 22 bp, Homo sapiens
gcaccctctgagctccgctccg

SEQ ID NO: 8491397 - DNA, 22 bp, Homo sapiens
gcacctcattttgcaggtagaa

SEQ ID NO: 8491398 - DNA, 22 bp, Homo sapiens
gcacctgaggaggcatctggag

SEQ ID NO: 8491399 - DNA, 20 bp, Homo sapiens
gcacctgaatgcatcttgga

SEQ ID NO: 8491400 - DNA, 22 bp, Homo sapiens
gcacctgctggaatcagtctgt

SEQ ID NO: 8491401 - DNA, 22 bp, Homo sapiens
gcacctgcctgggactgaagat

SEQ ID NO: 8491402 - DNA, 22 bp, Homo sapiens
gcacctgcaggatgagccaggg

SEQ ID NO: 8491403 - DNA, 22 bp, Homo sapiens
gcacctgcaggatgagccaggg

SEQ ID NO: 8491404 - DNA, 22 bp, Homo sapiens
gcacctgattgatttcactgct

SEQ ID NO: 8491405 - DNA, 22 bp, Homo sapiens
gcacctggctgcccaggtggag

SEQ ID NO: 8491406 - DNA, 22 bp, Homo sapiens
gcacctgctggggctgatgaga

SEQ ID NO: 8491407 - DNA, 20 bp, Homo sapiens
gcacttggctgctgcttctc

SEQ ID NO: 8491408 - DNA, 22 bp, Homo sapiens
gcacttgggcagagacgcacag

SEQ ID NO: 8491409 - DNA, 22 bp, Homo sapiens
gcagagccagaatggccaggac

SEQ ID NO: 8491410 - DNA, 22 bp, Homo sapiens
gcagagccagaatggccaggac

SEQ ID NO: 8491411 - DNA, 22 bp, Homo sapiens
gcagagccagaatggccaggac

SEQ ID NO: 8491412 - DNA, 22 bp, Homo sapiens
gcagagccaggagagacccttg

SEQ ID NO: 8491413 - DNA, 22 bp, Homo sapiens
gcagagccaggagagacccttg

SEQ ID NO: 8491414 - DNA, 22 bp, Homo sapiens
gcagagccaggagcccaggatc

SEQ ID NO: 8491415 - DNA, 22 bp, Homo sapiens
gcagagccaggagcccaggatc

SEQ ID NO: 8491416 - DNA, 22 bp, Homo sapiens
gcagagccaggagcccaggatc

SEQ ID NO: 8491417 - DNA, 22 bp, Homo sapiens
gcagagcccctcaagccagcct

SEQ ID NO: 8491418 - DNA, 22 bp, Homo sapiens
gcagagcccctcaagccagcct

SEQ ID NO: 8491419 - DNA, 22 bp, Homo sapiens
gcagagcccctcaagccagcct

SEQ ID NO: 8491420 - DNA, 22 bp, Homo sapiens
gcagagcccctcaagccagcct

SEQ ID NO: 8491421 - DNA, 22 bp, Homo sapiens
gcagagccccattgctggcggg

SEQ ID NO: 8491422 - DNA, 22 bp, Homo sapiens
gcagagccccattgctggcggg

SEQ ID NO: 8491423 - DNA, 22 bp, Homo sapiens
gcagagccatgggaggtttttg

SEQ ID NO: 8491424 - DNA, 22 bp, Homo sapiens
gcagagccaggctggggcaggt

SEQ ID NO: 8491425 - DNA, 22 bp, Homo sapiens
gcagagccaggctggggcaggt

SEQ ID NO: 8491426 - DNA, 22 bp, Homo sapiens
gcagagccaggctggggcaggt

SEQ ID NO: 8491427 - DNA, 22 bp, Homo sapiens
gcagagcagtgcttgcccagcg

SEQ ID NO: 8491428 - DNA, 22 bp, Homo sapiens
gcagagcatgtcctcaggacag

SEQ ID NO: 8491429 - DNA, 22 bp, Homo sapiens
gcagagcattggagggaccctg

SEQ ID NO: 8491430 - DNA, 22 bp, Homo sapiens
gcagaagctgggcagcgaggtg

SEQ ID NO: 8491431 - DNA, 22 bp, Homo sapiens
gcagaagctgggcagcgaggtg

SEQ ID NO: 8491432 - DNA, 22 bp, Homo sapiens
gcagaagctgggcagcgaggtg

SEQ ID NO: 8491433 - DNA, 22 bp, Homo sapiens
gcagaagctgttcgaaggccgc

SEQ ID NO: 8491434 - DNA, 22 bp, Homo sapiens
gcagaagctgttcgaaggccgc

SEQ ID NO: 8491435 - DNA, 22 bp, Homo sapiens
gcagagcagtgcttgcccagcg

SEQ ID NO: 8491436 - DNA, 22 bp, Homo sapiens
gcagaagctgggagaagggatt

SEQ ID NO: 8491437 - DNA, 22 bp, Homo sapiens
gcagaagctgggcagcgaggtg

SEQ ID NO: 8491438 - DNA, 22 bp, Homo sapiens
gcagaagcccggtcagcgcacg

SEQ ID NO: 8491439 - DNA, 22 bp, Homo sapiens
gcagaagaccatggtggaaaga

SEQ ID NO: 8491440 - DNA, 22 bp, Homo sapiens
gcagaagaccatggtggaaaga

SEQ ID NO: 8491441 - DNA, 22 bp, Homo sapiens
gcagaagcacaggtgacgggcc

SEQ ID NO: 8491442 - DNA, 22 bp, Homo sapiens
gcagaacaacgtaggagtggag

SEQ ID NO: 8491443 - DNA, 22 bp, Homo sapiens
gcagaaccataaattcaggtaa

SEQ ID NO: 8491444 - DNA, 22 bp, Homo sapiens
gcagaacatttcacagtatctt

SEQ ID NO: 8491445 - DNA, 22 bp, Homo sapiens
gcagaacatttcacagtatctt

SEQ ID NO: 8491446 - DNA, 22 bp, Homo sapiens
gcagaaagctccttgcgatctg

SEQ ID NO: 8491447 - DNA, 22 bp, Homo sapiens
gcagaaagcttagagggtttgc

SEQ ID NO: 8491448 - DNA, 23 bp, Homo sapiens
gcagaaattctcacactgaggcc

SEQ ID NO: 8491449 - DNA, 21 bp, Homo sapiens
gcagaaaggaatcttaggtcc

SEQ ID NO: 8491450 - DNA, 22 bp, Homo sapiens
gcactttgtggattgtatttcc

SEQ ID NO: 8491451 - DNA, 17 bp, Homo sapiens
gcagaaaagtcaaggga

SEQ ID NO: 8491452 - DNA, 17 bp, Homo sapiens
gcagaaaagtcaaggga

SEQ ID NO: 8491453 - DNA, 17 bp, Homo sapiens
gcagaaaagtcaaggga

SEQ ID NO: 8491454 - DNA, 17 bp, Homo sapiens
gcagaaaagtcaaggga

SEQ ID NO: 8491455 - DNA, 22 bp, Homo sapiens
gcatgtgtggaggagatgtgct

SEQ ID NO: 8491456 - DNA, 22 bp, Homo sapiens
gcatgtgtccctcagtctgtgc

SEQ ID NO: 8491457 - DNA, 22 bp, Homo sapiens
gcatgtgtggaggagatgtgct

SEQ ID NO: 8491458 - DNA, 22 bp, Homo sapiens
gcatgtgtctccccagtggagg

SEQ ID NO: 8491459 - DNA, 22 bp, Homo sapiens
gcatgtgtctccccagtggagg

SEQ ID NO: 8491460 - DNA, 22 bp, Homo sapiens
gcatgtgtccctcagtctgtgc

SEQ ID NO: 8491461 - DNA, 22 bp, Homo sapiens
gcatgtggccttcaggctggaa

SEQ ID NO: 8491462 - DNA, 22 bp, Homo sapiens
gcatgtggcccaaggaggctgt

SEQ ID NO: 8491463 - DNA, 22 bp, Homo sapiens
gcatggcttctgccaggcacct

SEQ ID NO: 8491464 - DNA, 22 bp, Homo sapiens
gcatgggaggacagtctgggct

SEQ ID NO: 8491465 - DNA, 22 bp, Homo sapiens
gcagtgttgctaggtgcggtga

SEQ ID NO: 8491466 - DNA, 22 bp, Homo sapiens
gcatggcttcggggtgctgcct

SEQ ID NO: 8491467 - DNA, 22 bp, Homo sapiens
gcatgggaggacagtctgggct

SEQ ID NO: 8491468 - DNA, 22 bp, Homo sapiens
gcatgggcaagaggactggggg

SEQ ID NO: 8491469 - DNA, 22 bp, Homo sapiens
gcatgggcaagaggactggggg

SEQ ID NO: 8491470 - DNA, 22 bp, Homo sapiens
gcatgtggaatctctccatggt

SEQ ID NO: 8491471 - DNA, 22 bp, Homo sapiens
gcatgtaatcactctaggaagg

SEQ ID NO: 8491472 - DNA, 22 bp, Homo sapiens
gcatggtggccttagggtagcc

SEQ ID NO: 8491473 - DNA, 22 bp, Homo sapiens
gcatggtggagtctgagcaggg

SEQ ID NO: 8491474 - DNA, 22 bp, Homo sapiens
gccacagcaacaataatgcagc

SEQ ID NO: 8491475 - DNA, 22 bp, Homo sapiens
gccacacttattctcatgcaca

SEQ ID NO: 8491476 - DNA, 22 bp, Homo sapiens
gccacagacagagagtctagtg

SEQ ID NO: 8491477 - DNA, 22 bp, Homo sapiens
gccacactgcttctttgagcct

SEQ ID NO: 8491478 - DNA, 23 bp, Homo sapiens
gccaatttttgactgtcagtagg

SEQ ID NO: 8491479 - DNA, 22 bp, Homo sapiens
gccaatttatcttactcgtgct

SEQ ID NO: 8491480 - DNA, 22 bp, Homo sapiens
gccaatttcctgaggtaaagct

SEQ ID NO: 8491481 - DNA, 22 bp, Homo sapiens
gccacagcccgagcaccatgag

SEQ ID NO: 8491482 - DNA, 22 bp, Homo sapiens
gccacagcagggccctctcagg

SEQ ID NO: 8491483 - DNA, 22 bp, Homo sapiens
gccacagcctctgggaaaactc

SEQ ID NO: 8491484 - DNA, 22 bp, Homo sapiens
gccacagcccgagcaccatgag

SEQ ID NO: 8491485 - DNA, 22 bp, Homo sapiens
gccaatgacagtctcagttctg

SEQ ID NO: 8491486 - DNA, 23 bp, Homo sapiens
gccaatttagtaaaggcagtggg

SEQ ID NO: 8491487 - DNA, 22 bp, Homo sapiens
gccaatttatagccaaaaatca

SEQ ID NO: 8491488 - DNA, 22 bp, Homo sapiens
gcatgtgttggtttatgcatgt

SEQ ID NO: 8491489 - DNA, 22 bp, Homo sapiens
gcatgttatgtatctgcccagc

SEQ ID NO: 8491490 - DNA, 22 bp, Homo sapiens
gcatgtgttattttatgtatga

SEQ ID NO: 8491491 - DNA, 21 bp, Homo sapiens
gcatgtgtggtgtgctccaca

SEQ ID NO: 8491492 - DNA, 22 bp, Homo sapiens
gcatgtgttatttctctgtggg

SEQ ID NO: 8491493 - DNA, 22 bp, Homo sapiens
gcatgtgttagagtgtgcatgc

SEQ ID NO: 8491494 - DNA, 22 bp, Homo sapiens
gcatgtgttattttatgtatga

SEQ ID NO: 8491495 - DNA, 22 bp, Homo sapiens
gcatgtgttatttctctgtggg

SEQ ID NO: 8491496 - DNA, 22 bp, Homo sapiens
gcatgtgttagagtgtgcatgc

SEQ ID NO: 8491497 - DNA, 19 bp, Homo sapiens
gccacaggatgaagtttgg

SEQ ID NO: 8491498 - DNA, 22 bp, Homo sapiens
gccacaggaaagcaccctggag

SEQ ID NO: 8491499 - DNA, 22 bp, Homo sapiens
gccacaggcacttaagggctgg

SEQ ID NO: 8491500 - DNA, 22 bp, Homo sapiens
gccacaggcacttaagggctgg

SEQ ID NO: 8491501 - DNA, 22 bp, Homo sapiens
gccacaggaaagcaccctggag

SEQ ID NO: 8491502 - DNA, 22 bp, Homo sapiens
gccacaggaaagcaccctggag

SEQ ID NO: 8491503 - DNA, 22 bp, Homo sapiens
gccacagcttttaacctcgggg

SEQ ID NO: 8491504 - DNA, 22 bp, Homo sapiens
gccacagctcacgttccccatt

SEQ ID NO: 8491505 - DNA, 22 bp, Homo sapiens
gccacagcggggccgctagagc

SEQ ID NO: 8491506 - DNA, 22 bp, Homo sapiens
gccacagctccagtcaggtgac

SEQ ID NO: 8491507 - DNA, 22 bp, Homo sapiens
gccacagcttagatcacagcct

SEQ ID NO: 8491508 - DNA, 22 bp, Homo sapiens
gccagatttacagatttgccct

SEQ ID NO: 8491509 - DNA, 22 bp, Homo sapiens
gccagcaaagcaagttgtcagc

SEQ ID NO: 8491510 - DNA, 22 bp, Homo sapiens
gccagatttacagatttgccct

SEQ ID NO: 8491511 - DNA, 22 bp, Homo sapiens
gccagatttacagatttgccct

SEQ ID NO: 8491512 - DNA, 22 bp, Homo sapiens
gccagatgtagatagcaaggta

SEQ ID NO: 8491513 - DNA, 20 bp, Homo sapiens
gccagaggccggcaggggct

SEQ ID NO: 8491514 - DNA, 20 bp, Homo sapiens
gccagaggccggcaggggct

SEQ ID NO: 8491515 - DNA, 22 bp, Homo sapiens
gccacaggctccagcatcagta

SEQ ID NO: 8491516 - DNA, 22 bp, Homo sapiens
gccacaggctccagcatcagta

SEQ ID NO: 8491517 - DNA, 22 bp, Homo sapiens
gccacaggctccagcatcagta

SEQ ID NO: 8491518 - DNA, 22 bp, Homo sapiens
gccacaggcacttaagggctgg

SEQ ID NO: 8491519 - DNA, 20 bp, Homo sapiens
gccagaggccggcaggggct

SEQ ID NO: 8491520 - DNA, 22 bp, Homo sapiens
gccagcagggaagccttgggct

SEQ ID NO: 8491521 - DNA, 22 bp, Homo sapiens
gccagcagcttcttctcatcct

SEQ ID NO: 8491522 - DNA, 22 bp, Homo sapiens
gccagcagctgtggggtggcca

SEQ ID NO: 8491523 - DNA, 22 bp, Homo sapiens
gccagcagctgtggggtggcca

SEQ ID NO: 8491524 - DNA, 22 bp, Homo sapiens
gccagcagcgagagtttaacct

SEQ ID NO: 8491525 - DNA, 22 bp, Homo sapiens
gccagcagcccagaaggacttt

SEQ ID NO: 8491526 - DNA, 20 bp, Homo sapiens
gccagcacagggagcagttc

SEQ ID NO: 8491527 - DNA, 22 bp, Homo sapiens
gccagcagccacagaagtcact

SEQ ID NO: 8491528 - DNA, 22 bp, Homo sapiens
gccagcagccacagaagtcact

SEQ ID NO: 8491529 - DNA, 19 bp, Homo sapiens
gccagcagaatgatgaggc

SEQ ID NO: 8491530 - DNA, 19 bp, Homo sapiens
gccagcagaatgatgaggc

SEQ ID NO: 8491531 - DNA, 19 bp, Homo sapiens
gccagcagaatgatgaggc

SEQ ID NO: 8491532 - DNA, 19 bp, Homo sapiens
gccagcagaatgatgaggc

SEQ ID NO: 8491533 - DNA, 22 bp, Homo sapiens
gcaggtggtgggggagccgttc

SEQ ID NO: 8491534 - DNA, 23 bp, Homo sapiens
gcaggtggttcgaacagaagttt

SEQ ID NO: 8491535 - DNA, 22 bp, Homo sapiens
gcaggtggtccccgtggagtgg

SEQ ID NO: 8491536 - DNA, 22 bp, Homo sapiens
gcaggtgggagccgctgcctga

SEQ ID NO: 8491537 - DNA, 22 bp, Homo sapiens
gcaggtggggctgctaccagaa

SEQ ID NO: 8491538 - DNA, 22 bp, Homo sapiens
gcaggtgggggtcggtgcatct

SEQ ID NO: 8491539 - DNA, 22 bp, Homo sapiens
gcaggtgggggtcggtgcatct

SEQ ID NO: 8491540 - DNA, 22 bp, Homo sapiens
gcagggtgacgttgcccacctc

SEQ ID NO: 8491541 - DNA, 22 bp, Homo sapiens
gcagggtgatagtgaggctcag

SEQ ID NO: 8491542 - DNA, 22 bp, Homo sapiens
gcagggtgccgacttcagggat

SEQ ID NO: 8491543 - DNA, 22 bp, Homo sapiens
gcagggtgatagtgaggctcag

SEQ ID NO: 8491544 - DNA, 22 bp, Homo sapiens
gcagggtggatggcagggccag

SEQ ID NO: 8491545 - DNA, 22 bp, Homo sapiens
gcaggtggcagaggtgggatct

SEQ ID NO: 8491546 - DNA, 22 bp, Homo sapiens
gcaggtggattatcagaagtgc

SEQ ID NO: 8491547 - DNA, 22 bp, Homo sapiens
gcaggtggattatcagaagtgc

SEQ ID NO: 8491548 - DNA, 22 bp, Homo sapiens
gcaggtggagcagtagtctggt

SEQ ID NO: 8491549 - DNA, 22 bp, Homo sapiens
gcagtgggcctgaggaagggtg

SEQ ID NO: 8491550 - DNA, 22 bp, Homo sapiens
gcagtatatccattacttcata

SEQ ID NO: 8491551 - DNA, 22 bp, Homo sapiens
gcagtgggcaacaagagctgga

SEQ ID NO: 8491552 - DNA, 22 bp, Homo sapiens
gcagtggtccagttcacaccca

SEQ ID NO: 8491553 - DNA, 22 bp, Homo sapiens
gcagtggtccagttcacaccca

SEQ ID NO: 8491554 - DNA, 22 bp, Homo sapiens
gcagtggggcgctgggagttgg

SEQ ID NO: 8491555 - DNA, 22 bp, Homo sapiens
gcagtggggcgctgggagttgg

SEQ ID NO: 8491556 - DNA, 22 bp, Homo sapiens
gcagtggggaatgctggggaga

SEQ ID NO: 8491557 - DNA, 22 bp, Homo sapiens
gcagtggggaatgctggggaga

SEQ ID NO: 8491558 - DNA, 22 bp, Homo sapiens
gcagtggggcaatcatagctca

SEQ ID NO: 8491559 - DNA, 22 bp, Homo sapiens
gcagtgttatgttttctataat

SEQ ID NO: 8491560 - DNA, 22 bp, Homo sapiens
gcagtgttcagtgaagcaggag

SEQ ID NO: 8491561 - DNA, 22 bp, Homo sapiens
gcagtgttccttctactggggc

SEQ ID NO: 8491562 - DNA, 22 bp, Homo sapiens
gcagtgttctaaattgggtgtg

SEQ ID NO: 8491563 - DNA, 22 bp, Homo sapiens
gcagtgttcttgttgcttttat

SEQ ID NO: 8491564 - DNA, 22 bp, Homo sapiens
gcagtgttgagccagctggggg

SEQ ID NO: 8491565 - DNA, 22 bp, Homo sapiens
gcagtgttgagtggtggctgaa

SEQ ID NO: 8491566 - DNA, 22 bp, Homo sapiens
gcagtgttgactatggtatgag

SEQ ID NO: 8491567 - DNA, 22 bp, Homo sapiens
gcagtggtggagcttacatatc

SEQ ID NO: 8491568 - DNA, 22 bp, Homo sapiens
gcagtggtggagcttacatatc

SEQ ID NO: 8491569 - DNA, 23 bp, Homo sapiens
gcagtgtgaatccagtgtttcag

SEQ ID NO: 8491570 - DNA, 22 bp, Homo sapiens
gcagtgttaggaataaaaatga

SEQ ID NO: 8491571 - DNA, 23 bp, Homo sapiens
gcagtgtgaatccagtgtttcag

SEQ ID NO: 8491572 - DNA, 22 bp, Homo sapiens
gcagtaggagggacaactacct

SEQ ID NO: 8491573 - DNA, 22 bp, Homo sapiens
gcagtatatactctttgagggg

SEQ ID NO: 8491574 - DNA, 22 bp, Homo sapiens
gcagtgggcaacaagagctgga

SEQ ID NO: 8491575 - DNA, 22 bp, Homo sapiens
gcagtagttcgtctgtgttccc

SEQ ID NO: 8491576 - DNA, 22 bp, Homo sapiens
gcagtagttctgattggaactt

SEQ ID NO: 8491577 - DNA, 22 bp, Homo sapiens
gcagtataagtggattatgtcc

SEQ ID NO: 8491578 - DNA, 22 bp, Homo sapiens
gcagtatacactgatacatgag

SEQ ID NO: 8491579 - DNA, 22 bp, Homo sapiens
gcagtagtttatggctaaacct

SEQ ID NO: 8491580 - DNA, 23 bp, Homo sapiens
gcaggtggttcgaacagaagttt

SEQ ID NO: 8491581 - DNA, 22 bp, Homo sapiens
gcagtacacacatatgtattcg

SEQ ID NO: 8491582 - DNA, 22 bp, Homo sapiens
gcagtaagttaatagtgctggt

SEQ ID NO: 8491583 - DNA, 22 bp, Homo sapiens
gcagtactttaagggatgaagc

SEQ ID NO: 8491584 - DNA, 22 bp, Homo sapiens
gcagtactttatcacatggaat

SEQ ID NO: 8491585 - DNA, 22 bp, Homo sapiens
gcagagcctgtgtctgagcaaa

SEQ ID NO: 8491586 - DNA, 22 bp, Homo sapiens
gcagagcctgggggtctgcgga

SEQ ID NO: 8491587 - DNA, 21 bp, Homo sapiens
gcagagcctgaggttcttgag

SEQ ID NO: 8491588 - DNA, 22 bp, Homo sapiens
gcagagccttgcgtcatgtgcc

SEQ ID NO: 8491589 - DNA, 22 bp, Homo sapiens
gcagagcctgtgtctgagcaaa

SEQ ID NO: 8491590 - DNA, 22 bp, Homo sapiens
gcagagccttgcgtcatgtgcc

SEQ ID NO: 8491591 - DNA, 22 bp, Homo sapiens
gcagagccttgcgtcatgtgcc

SEQ ID NO: 8491592 - DNA, 22 bp, Homo sapiens
gcagagccttgcgtcatgtgcc

SEQ ID NO: 8491593 - DNA, 20 bp, Homo sapiens
gcagagcctcactgcaaggg

SEQ ID NO: 8491594 - DNA, 22 bp, Homo sapiens
gcagagccgtgaatggatttca

SEQ ID NO: 8491595 - DNA, 20 bp, Homo sapiens
gcagagcctcactgcaaggg

SEQ ID NO: 8491596 - DNA, 22 bp, Homo sapiens
gcagagcctgacgggatttttc

SEQ ID NO: 8491597 - DNA, 22 bp, Homo sapiens
gcagagccctgggggtatggtg

SEQ ID NO: 8491598 - DNA, 21 bp, Homo sapiens
gcagagccggggcgagaaggc

SEQ ID NO: 8491599 - DNA, 21 bp, Homo sapiens
gcagagccggggcgagaaggc

SEQ ID NO: 8491600 - DNA, 21 bp, Homo sapiens
gcagagccggggcgagaaggc

SEQ ID NO: 8491601 - DNA, 21 bp, Homo sapiens
gcagagccggggcgagaaggc

SEQ ID NO: 8491602 - DNA, 22 bp, Homo sapiens
gcagagctatcttctggatttg

SEQ ID NO: 8491603 - DNA, 22 bp, Homo sapiens
gcagagctcaaggtgttcagct

SEQ ID NO: 8491604 - DNA, 22 bp, Homo sapiens
gcagagctcaaggtgttcagct

SEQ ID NO: 8491605 - DNA, 22 bp, Homo sapiens
gcagagctcatgcctgcacctc

SEQ ID NO: 8491606 - DNA, 22 bp, Homo sapiens
gcagcctctgatgatggccgta

SEQ ID NO: 8491607 - DNA, 22 bp, Homo sapiens
gcagcctctgatgatggccgta

SEQ ID NO: 8491608 - DNA, 22 bp, Homo sapiens
gcagcctctgatgatggccgta

SEQ ID NO: 8491609 - DNA, 22 bp, Homo sapiens
gcagcctctgcagttcaggagg

SEQ ID NO: 8491610 - DNA, 22 bp, Homo sapiens
gcagcctctgcagttcaggagg

SEQ ID NO: 8491611 - DNA, 22 bp, Homo sapiens
gcagcgtggggctgagtcagct

SEQ ID NO: 8491612 - DNA, 22 bp, Homo sapiens
gcagctctggggcaggcctgag

SEQ ID NO: 8491613 - DNA, 22 bp, Homo sapiens
gcagctctctggcctgccctgg

SEQ ID NO: 8491614 - DNA, 22 bp, Homo sapiens
gcagctgaatgtccattgctgc

SEQ ID NO: 8491615 - DNA, 22 bp, Homo sapiens
gcagctgaatgtccattgctgc

SEQ ID NO: 8491616 - DNA, 18 bp, Homo sapiens
gcagctgacactggagtt

SEQ ID NO: 8491617 - DNA, 22 bp, Homo sapiens
gcagctgaagctgcagttccag

SEQ ID NO: 8491618 - DNA, 20 bp, Homo sapiens
gcagctgaaagtatgacacc

SEQ ID NO: 8491619 - DNA, 22 bp, Homo sapiens
gcagctgaaagggatctctaca

SEQ ID NO: 8491620 - DNA, 22 bp, Homo sapiens
gcagctgaaagggatctctaca

SEQ ID NO: 8491621 - DNA, 22 bp, Homo sapiens
gcagctgaaagggatctctaca

SEQ ID NO: 8491622 - DNA, 22 bp, Homo sapiens
gcagctcccttgaacttctcct

SEQ ID NO: 8491623 - DNA, 22 bp, Homo sapiens
gcagctcccatcagggcacaga

SEQ ID NO: 8491624 - DNA, 22 bp, Homo sapiens
gcagctccttcaatctcaccat

SEQ ID NO: 8491625 - DNA, 22 bp, Homo sapiens
gcagctcctttaggctgcaaag

SEQ ID NO: 8491626 - DNA, 22 bp, Homo sapiens
gcagctcctcctgggctggaga

SEQ ID NO: 8491627 - DNA, 22 bp, Homo sapiens
gcagctcacagtctccgccatc

SEQ ID NO: 8491628 - DNA, 18 bp, Homo sapiens
gcagctagccaggggggc

SEQ ID NO: 8491629 - DNA, 22 bp, Homo sapiens
gcagctattgtctcctgggccc

SEQ ID NO: 8491630 - DNA, 22 bp, Homo sapiens
gcaggagaaatgaagattgggt

SEQ ID NO: 8491631 - DNA, 22 bp, Homo sapiens
gcaggagaaatgaagattgggt

SEQ ID NO: 8491632 - DNA, 22 bp, Homo sapiens
gcaggagaacaaagcaagctgc

SEQ ID NO: 8491633 - DNA, 22 bp, Homo sapiens
gcaggagactggctgtggtagt

SEQ ID NO: 8491634 - DNA, 22 bp, Homo sapiens
gcaggagagccagcaggcttcc

SEQ ID NO: 8491635 - DNA, 22 bp, Homo sapiens
gcaggagagccagcaggcttcc

SEQ ID NO: 8491636 - DNA, 22 bp, Homo sapiens
gcaggagagccagcaggcttcc

SEQ ID NO: 8491637 - DNA, 22 bp, Homo sapiens
gcaggagaacaaagcaagctgc

SEQ ID NO: 8491638 - DNA, 22 bp, Homo sapiens
gcaggagactggctgtggtagt

SEQ ID NO: 8491639 - DNA, 19 bp, Homo sapiens
gcaggactcccagctcctc

SEQ ID NO: 8491640 - DNA, 22 bp, Homo sapiens
gcaggacttgaatccaggcagt

SEQ ID NO: 8491641 - DNA, 22 bp, Homo sapiens
gcaggacaggcgttggtccagt

SEQ ID NO: 8491642 - DNA, 22 bp, Homo sapiens
gcagctgagcgtgaggaagagt

SEQ ID NO: 8491643 - DNA, 22 bp, Homo sapiens
gcagctgagagaagaacagggc

SEQ ID NO: 8491644 - DNA, 22 bp, Homo sapiens
gcagctgacatctggctgggcc

SEQ ID NO: 8491645 - DNA, 22 bp, Homo sapiens
gcagctgatggaagtcctattg

SEQ ID NO: 8491646 - DNA, 22 bp, Homo sapiens
gcaggacaggcgttggtccagt

SEQ ID NO: 8491647 - DNA, 22 bp, Homo sapiens
gcagctgagagaagaacagggc

SEQ ID NO: 8491648 - DNA, 22 bp, Homo sapiens
gcaggagccctggcatgttctt

SEQ ID NO: 8491649 - DNA, 22 bp, Homo sapiens
gcaggagccaggccgagctggt

SEQ ID NO: 8491650 - DNA, 22 bp, Homo sapiens
gcaggagccacttcagggatgc

SEQ ID NO: 8491651 - DNA, 22 bp, Homo sapiens
gcaggagccaggccgagctggt

SEQ ID NO: 8491652 - DNA, 22 bp, Homo sapiens
gcaggagctcgtttccaggctg

SEQ ID NO: 8491653 - DNA, 22 bp, Homo sapiens
gcaggagctcgtttccaggctg

SEQ ID NO: 8491654 - DNA, 22 bp, Homo sapiens
gcaggagctcgtttccaggctg

SEQ ID NO: 8491655 - DNA, 22 bp, Homo sapiens
gcaggagctgctctcctgacga

SEQ ID NO: 8491656 - DNA, 22 bp, Homo sapiens
gcaggagctgctctcctgacga

SEQ ID NO: 8491657 - DNA, 22 bp, Homo sapiens
gcaggagttaggcgtcgtggat

SEQ ID NO: 8491658 - DNA, 22 bp, Homo sapiens
gcaggagttagggtaaaaatga

SEQ ID NO: 8491659 - DNA, 22 bp, Homo sapiens
gcaggagttcaattgcccatga

SEQ ID NO: 8491660 - DNA, 23 bp, Homo sapiens
gcaggagttcctggactccagga

SEQ ID NO: 8491661 - DNA, 19 bp, Homo sapiens
gcaggcacagccctgggtg

SEQ ID NO: 8491662 - DNA, 19 bp, Homo sapiens
gcaggcacagccctgggtg

SEQ ID NO: 8491663 - DNA, 22 bp, Homo sapiens
gcaggcaccacggctcaggtct

SEQ ID NO: 8491664 - DNA, 22 bp, Homo sapiens
gcaggcagagaaggaacattta

SEQ ID NO: 8491665 - DNA, 22 bp, Homo sapiens
gcaggcagagaaggaacattta

SEQ ID NO: 8491666 - DNA, 22 bp, Homo sapiens
gcaggcagagaaggaacattta

SEQ ID NO: 8491667 - DNA, 22 bp, Homo sapiens
gcaggcagagaggggtttccag

SEQ ID NO: 8491668 - DNA, 22 bp, Homo sapiens
gcaggcactcctaggaccatca

SEQ ID NO: 8491669 - DNA, 22 bp, Homo sapiens
gcaggctgccaccttctgagtt

SEQ ID NO: 8491670 - DNA, 22 bp, Homo sapiens
gcaggcagaggtggaggagaca

SEQ ID NO: 8491671 - DNA, 22 bp, Homo sapiens
gcaggcagaggtggaggagaca

SEQ ID NO: 8491672 - DNA, 22 bp, Homo sapiens
gcaggctgccctcttgtgttga

SEQ ID NO: 8491673 - DNA, 22 bp, Homo sapiens
gcaggctgctgagatccttagg

SEQ ID NO: 8491674 - DNA, 22 bp, Homo sapiens
gcaggctgctgagatccttagg

SEQ ID NO: 8491675 - DNA, 22 bp, Homo sapiens
gcaggctggaggctgttctggg

SEQ ID NO: 8491676 - DNA, 22 bp, Homo sapiens
gcaggctggaggctgttctggg

SEQ ID NO: 8491677 - DNA, 22 bp, Homo sapiens
gcaggctggaggctgttctggg

SEQ ID NO: 8491678 - DNA, 22 bp, Homo sapiens
gcaggcttgcccggcctccttc

SEQ ID NO: 8491679 - DNA, 22 bp, Homo sapiens
gcaggctgtggtatgttgggca

SEQ ID NO: 8491680 - DNA, 22 bp, Homo sapiens
gcaggctgtggtatgttgggca

SEQ ID NO: 8491681 - DNA, 22 bp, Homo sapiens
gcaggctggtctgaccatccct

SEQ ID NO: 8491682 - DNA, 21 bp, Homo sapiens
gcaggctggtcaaacctcagt

SEQ ID NO: 8491683 - DNA, 21 bp, Homo sapiens
gcaggctggtcaaacctcagt

SEQ ID NO: 8491684 - DNA, 22 bp, Homo sapiens
gcaggctggggtagccccactt

SEQ ID NO: 8491685 - DNA, 22 bp, Homo sapiens
gcaggctggggtagccccactt

SEQ ID NO: 8491686 - DNA, 21 bp, Homo sapiens
gcaggctggtcaaacctcagt

SEQ ID NO: 8491687 - DNA, 22 bp, Homo sapiens
gcaggctggggtagccccactt

SEQ ID NO: 8491688 - DNA, 21 bp, Homo sapiens
gcaggctggtcaaacctcagt

SEQ ID NO: 8491689 - DNA, 22 bp, Homo sapiens
gcagggaaacaggtgctaagga

SEQ ID NO: 8491690 - DNA, 22 bp, Homo sapiens
gcaggcttgggacgagctggag

SEQ ID NO: 8491691 - DNA, 19 bp, Homo sapiens
gcaggcttgggtctcccca

SEQ ID NO: 8491692 - DNA, 22 bp, Homo sapiens
gcagggaagacccggagcagcg

SEQ ID NO: 8491693 - DNA, 22 bp, Homo sapiens
gcagggacgccagggacagcaa

SEQ ID NO: 8491694 - DNA, 22 bp, Homo sapiens
gcagggcagagggagaatctct

SEQ ID NO: 8491695 - DNA, 22 bp, Homo sapiens
gcagggcagacctccagcctat

SEQ ID NO: 8491696 - DNA, 22 bp, Homo sapiens
gcagggcagacctccagcctat

SEQ ID NO: 8491697 - DNA, 22 bp, Homo sapiens
gcagggcagaaggtgctgagga

SEQ ID NO: 8491698 - DNA, 22 bp, Homo sapiens
gcagggcacagacagtgccaag

SEQ ID NO: 8491699 - DNA, 22 bp, Homo sapiens
gcagggcacagacagtgccaag

SEQ ID NO: 8491700 - DNA, 22 bp, Homo sapiens
gcagggcagaaggtgctgagga

SEQ ID NO: 8491701 - DNA, 22 bp, Homo sapiens
gcagggcagaaggtgctgagga

SEQ ID NO: 8491702 - DNA, 22 bp, Homo sapiens
gcagggcagaaggtgctgagga

SEQ ID NO: 8491703 - DNA, 22 bp, Homo sapiens
gcagggcacaaggacgcacagg

SEQ ID NO: 8491704 - DNA, 22 bp, Homo sapiens
gcagggcacacaagaatgataa

SEQ ID NO: 8491705 - DNA, 22 bp, Homo sapiens
gcagggcacacaagaatgataa

SEQ ID NO: 8491706 - DNA, 22 bp, Homo sapiens
gcagggcacaaggacgcacagg

SEQ ID NO: 8491707 - DNA, 22 bp, Homo sapiens
gcagggcaatgatcccgagagg

SEQ ID NO: 8491708 - DNA, 22 bp, Homo sapiens
gcagggcaatgatcccgagagg

SEQ ID NO: 8491709 - DNA, 20 bp, Homo sapiens
gcagggcaagggatatgaaa

SEQ ID NO: 8491710 - DNA, 22 bp, Homo sapiens
gcagggcaaatgtggaaaggag

SEQ ID NO: 8491711 - DNA, 22 bp, Homo sapiens
gcagggcaaatgtggaaaggag

SEQ ID NO: 8491712 - DNA, 22 bp, Homo sapiens
gcagggcaaacccaggtgttca

SEQ ID NO: 8491713 - DNA, 22 bp, Homo sapiens
gcagggggatggagttgaaatg

SEQ ID NO: 8491714 - DNA, 22 bp, Homo sapiens
gcagggggtcattcacgctggc

SEQ ID NO: 8491715 - DNA, 22 bp, Homo sapiens
gcagggggtcattcacgctggc

SEQ ID NO: 8491716 - DNA, 22 bp, Homo sapiens
gcagggggatggagttgaaatg

SEQ ID NO: 8491717 - DNA, 22 bp, Homo sapiens
gcaggggctgagcaccagcggg

SEQ ID NO: 8491718 - DNA, 22 bp, Homo sapiens
gcaggggctgctgggaactcgg

SEQ ID NO: 8491719 - DNA, 22 bp, Homo sapiens
gcaggggctgagcaccagcggg

SEQ ID NO: 8491720 - DNA, 22 bp, Homo sapiens
gcaggggctgctgggaactcgg

SEQ ID NO: 8491721 - DNA, 22 bp, Homo sapiens
gcaggggctgctgggaactcgg

SEQ ID NO: 8491722 - DNA, 22 bp, Homo sapiens
gcaggggctgctgggaactcgg

SEQ ID NO: 8491723 - DNA, 22 bp, Homo sapiens
gcaggggctgagcaccagcggg

SEQ ID NO: 8491724 - DNA, 22 bp, Homo sapiens
gcaggggctgagcaccagcggg

SEQ ID NO: 8491725 - DNA, 21 bp, Homo sapiens
gcaggggatagaaatggtctg

SEQ ID NO: 8491726 - DNA, 21 bp, Homo sapiens
gcaggggatagaaatggtctg

SEQ ID NO: 8491727 - DNA, 22 bp, Homo sapiens
gcaggggcaggagatctcaggc

SEQ ID NO: 8491728 - DNA, 22 bp, Homo sapiens
gcaggggcaggagatctcaggc

SEQ ID NO: 8491729 - DNA, 22 bp, Homo sapiens
gcaggggcaggagatctcaggc

SEQ ID NO: 8491730 - DNA, 22 bp, Homo sapiens
gcaggggcaggagatctcaggc

SEQ ID NO: 8491731 - DNA, 22 bp, Homo sapiens
gcaggggcaggagatctcaggc

SEQ ID NO: 8491732 - DNA, 22 bp, Homo sapiens
gcaggggcaggagatctcaggc

SEQ ID NO: 8491733 - DNA, 22 bp, Homo sapiens
gcaggggctaaggacacagaga

SEQ ID NO: 8491734 - DNA, 22 bp, Homo sapiens
gcaggggctaaggacacagaga

SEQ ID NO: 8491735 - DNA, 22 bp, Homo sapiens
gcaggggctaaggacacagaga

SEQ ID NO: 8491736 - DNA, 22 bp, Homo sapiens
gcaggggcggctgggtttccag

SEQ ID NO: 8491737 - DNA, 22 bp, Homo sapiens
gcaggggcggctgggtttccag

SEQ ID NO: 8491738 - DNA, 22 bp, Homo sapiens
gcaggggctactctgagcttcc

SEQ ID NO: 8491739 - DNA, 22 bp, Homo sapiens
gcaggggctactctgagcttcc

SEQ ID NO: 8491740 - DNA, 22 bp, Homo sapiens
gcaggggctaaggacacagaga

SEQ ID NO: 8491741 - DNA, 22 bp, Homo sapiens
gcaggggctactctgagcttcc

SEQ ID NO: 8491742 - DNA, 22 bp, Homo sapiens
gcccttacagggtggtcagcca

SEQ ID NO: 8491743 - DNA, 22 bp, Homo sapiens
gcccttacagggtggtcagcca

SEQ ID NO: 8491744 - DNA, 22 bp, Homo sapiens
gcccttaggcaagcagaagccc

SEQ ID NO: 8491745 - DNA, 22 bp, Homo sapiens
gcccttacagggtggtcagcca

SEQ ID NO: 8491746 - DNA, 22 bp, Homo sapiens
gccctctggcacagagatgcag

SEQ ID NO: 8491747 - DNA, 22 bp, Homo sapiens
gccctctggcacagagatgcag

SEQ ID NO: 8491748 - DNA, 22 bp, Homo sapiens
gccctgttctggacaggcacaa

SEQ ID NO: 8491749 - DNA, 22 bp, Homo sapiens
gccctctgctggcctcacctcg

SEQ ID NO: 8491750 - DNA, 22 bp, Homo sapiens
gccctctgctcagctcctcagc

SEQ ID NO: 8491751 - DNA, 22 bp, Homo sapiens
gccctctgctcagctcctcagc

SEQ ID NO: 8491752 - DNA, 20 bp, Homo sapiens
gccctctgcctccctcagcg

SEQ ID NO: 8491753 - DNA, 20 bp, Homo sapiens
gccctctgcctccctcagcg

SEQ ID NO: 8491754 - DNA, 22 bp, Homo sapiens
gccctctcttctgcagcctcca

SEQ ID NO: 8491755 - DNA, 22 bp, Homo sapiens
gccctctgcacagctctgagca

SEQ ID NO: 8491756 - DNA, 22 bp, Homo sapiens
gccctctgcacagctctgagca

SEQ ID NO: 8491757 - DNA, 22 bp, Homo sapiens
gcccttcagttactccttgatg

SEQ ID NO: 8491758 - DNA, 22 bp, Homo sapiens
gcccttccttagacagcaggat

SEQ ID NO: 8491759 - DNA, 22 bp, Homo sapiens
gcccttccaacccagagggcaa

SEQ ID NO: 8491760 - DNA, 22 bp, Homo sapiens
gcccttccttagacagcaggat

SEQ ID NO: 8491761 - DNA, 22 bp, Homo sapiens
gcccttggaacagcctcctgct

SEQ ID NO: 8491762 - DNA, 22 bp, Homo sapiens
gcccttgggaggttccactggg

SEQ ID NO: 8491763 - DNA, 22 bp, Homo sapiens
gcccttgggaggttccactggg

SEQ ID NO: 8491764 - DNA, 22 bp, Homo sapiens
gcccttggcaaattctccttta

SEQ ID NO: 8491765 - DNA, 22 bp, Homo sapiens
gccgaacttgagggccaggcgg

SEQ ID NO: 8491766 - DNA, 22 bp, Homo sapiens
gcccttggggtgtctgtaataa

SEQ ID NO: 8491767 - DNA, 15 bp, Homo sapiens
gccctcaggcgacac

SEQ ID NO: 8491768 - DNA, 22 bp, Homo sapiens
gccctcaggcagggagtctttc

SEQ ID NO: 8491769 - DNA, 19 bp, Homo sapiens
gccctcaggcagctccatc

SEQ ID NO: 8491770 - DNA, 19 bp, Homo sapiens
gccctcaggcagctccatc

SEQ ID NO: 8491771 - DNA, 23 bp, Homo sapiens
gccctcagtagaaaatgttagaa

SEQ ID NO: 8491772 - DNA, 22 bp, Homo sapiens
gccctcagtgaccactgattca

SEQ ID NO: 8491773 - DNA, 20 bp, Homo sapiens
gccctcagtcttgtctttat

SEQ ID NO: 8491774 - DNA, 21 bp, Homo sapiens
gccctcaggggaggatggcct

SEQ ID NO: 8491775 - DNA, 23 bp, Homo sapiens
gccctcagtagaaaatgttagaa

SEQ ID NO: 8491776 - DNA, 21 bp, Homo sapiens
gccctcaggggaggatggcct

SEQ ID NO: 8491777 - DNA, 21 bp, Homo sapiens
gccctcaggggaggatggcct

SEQ ID NO: 8491778 - DNA, 22 bp, Homo sapiens
gccctcctttgcttctcctagt

SEQ ID NO: 8491779 - DNA, 22 bp, Homo sapiens
gccctctaccttggctatagaa

SEQ ID NO: 8491780 - DNA, 22 bp, Homo sapiens
gccctcagtggattcttattgt

SEQ ID NO: 8491781 - DNA, 22 bp, Homo sapiens
gccctctcggcatagcaggggc

SEQ ID NO: 8491782 - DNA, 22 bp, Homo sapiens
gccctctcggcatagcaggggc

SEQ ID NO: 8491783 - DNA, 22 bp, Homo sapiens
gccctctcggcatagcaggggc

SEQ ID NO: 8491784 - DNA, 22 bp, Homo sapiens
gccctctcttctgcagcctcca

SEQ ID NO: 8491785 - DNA, 22 bp, Homo sapiens
gccctcagctcctggacacatg

SEQ ID NO: 8491786 - DNA, 22 bp, Homo sapiens
gccctcagctcctggacacatg

SEQ ID NO: 8491787 - DNA, 22 bp, Homo sapiens
gccctcagctcctggacacatg

SEQ ID NO: 8491788 - DNA, 22 bp, Homo sapiens
gccctcagcttgatgttgttct

SEQ ID NO: 8491789 - DNA, 22 bp, Homo sapiens
gccctcaggacaaggttacgct

SEQ ID NO: 8491790 - DNA, 17 bp, Homo sapiens
gccctcagctttaacca

SEQ ID NO: 8491791 - DNA, 22 bp, Homo sapiens
gccctcagcatcctcagggcca

SEQ ID NO: 8491792 - DNA, 22 bp, Homo sapiens
gccctcagctcctggacacatg

SEQ ID NO: 8491793 - DNA, 22 bp, Homo sapiens
gccctcagcatcctcagggcca

SEQ ID NO: 8491794 - DNA, 22 bp, Homo sapiens
gccctcagcaggaaagatcaac

SEQ ID NO: 8491795 - DNA, 22 bp, Homo sapiens
gccctcagagttccccacagtg

SEQ ID NO: 8491796 - DNA, 22 bp, Homo sapiens
gccctcagagttccccacagtg

SEQ ID NO: 8491797 - DNA, 22 bp, Homo sapiens
gccctcagagttccccacagtg

SEQ ID NO: 8491798 - DNA, 22 bp, Homo sapiens
gccctcagcaggaaagatcaac

SEQ ID NO: 8491799 - DNA, 22 bp, Homo sapiens
gccctcagatgggaaaggaggg

SEQ ID NO: 8491800 - DNA, 22 bp, Homo sapiens
gccctcagatgggaaaggaggg

SEQ ID NO: 8491801 - DNA, 22 bp, Homo sapiens
gcccaggctggagtgcagtggc

SEQ ID NO: 8491802 - DNA, 22 bp, Homo sapiens
gcctctgctctcaggtagcctc

SEQ ID NO: 8491803 - DNA, 22 bp, Homo sapiens
gcctctgctctcaggtagcctc

SEQ ID NO: 8491804 - DNA, 19 bp, Homo sapiens
gcctctgctggggacaggc

SEQ ID NO: 8491805 - DNA, 19 bp, Homo sapiens
gcctctgctggggacaggc

SEQ ID NO: 8491806 - DNA, 19 bp, Homo sapiens
gcctctgctggggacaggc

SEQ ID NO: 8491807 - DNA, 22 bp, Homo sapiens
gcctctgcggagctgtacatca

SEQ ID NO: 8491808 - DNA, 22 bp, Homo sapiens
gcctctgccctcctgggactgc

SEQ ID NO: 8491809 - DNA, 22 bp, Homo sapiens
gcctctgcatcatcactccagc

SEQ ID NO: 8491810 - DNA, 22 bp, Homo sapiens
gcctctgcatcatcactccagc

SEQ ID NO: 8491811 - DNA, 22 bp, Homo sapiens
gcctctgcatcatcactccagc

SEQ ID NO: 8491812 - DNA, 22 bp, Homo sapiens
gcctctgcatcttcgccgcact

SEQ ID NO: 8491813 - DNA, 22 bp, Homo sapiens
gcctctgcatgctcagcaccca

SEQ ID NO: 8491814 - DNA, 22 bp, Homo sapiens
gcctctgcactgtggcacacca

SEQ ID NO: 8491815 - DNA, 22 bp, Homo sapiens
gcctctgcaattacattgtgcc

SEQ ID NO: 8491816 - DNA, 22 bp, Homo sapiens
gcctctgcaattacattgtgcc

SEQ ID NO: 8491817 - DNA, 22 bp, Homo sapiens
gcctcctgtcccaggctgagga

SEQ ID NO: 8491818 - DNA, 22 bp, Homo sapiens
gccgggttcaagccattctcct

SEQ ID NO: 8491819 - DNA, 22 bp, Homo sapiens
gccgtccacctcgatggccact

SEQ ID NO: 8491820 - DNA, 22 bp, Homo sapiens
gccgggttcaagccattctcct

SEQ ID NO: 8491821 - DNA, 22 bp, Homo sapiens
gccgaggctctgcccagctgct

SEQ ID NO: 8491822 - DNA, 22 bp, Homo sapiens
gccgaagacgctgggcgtgggc

SEQ ID NO: 8491823 - DNA, 20 bp, Homo sapiens
gccgactgccttgtgagcct

SEQ ID NO: 8491824 - DNA, 22 bp, Homo sapiens
gccgaggctctgcccagctgct

SEQ ID NO: 8491825 - DNA, 22 bp, Homo sapiens
gccggggctggggagagacatg

SEQ ID NO: 8491826 - DNA, 22 bp, Homo sapiens
gccggggctggggagagacatg

SEQ ID NO: 8491827 - DNA, 22 bp, Homo sapiens
gccggggctggggagagacatg

SEQ ID NO: 8491828 - DNA, 22 bp, Homo sapiens
gccgggaccaaggccacggagc

SEQ ID NO: 8491829 - DNA, 22 bp, Homo sapiens
gccgggaccaaggccacggagc

SEQ ID NO: 8491830 - DNA, 22 bp, Homo sapiens
gccaggctcttccatttgggtc

SEQ ID NO: 8491831 - DNA, 22 bp, Homo sapiens
gccaggctcttggttatgtttt

SEQ ID NO: 8491832 - DNA, 19 bp, Homo sapiens
gccaggctcttattctgtg

SEQ ID NO: 8491833 - DNA, 19 bp, Homo sapiens
gccaggctcttattctgtg

SEQ ID NO: 8491834 - DNA, 22 bp, Homo sapiens
gccagcagggcccaaatgctgg

SEQ ID NO: 8491835 - DNA, 22 bp, Homo sapiens
gccaggctctcagtgactgccc

SEQ ID NO: 8491836 - DNA, 22 bp, Homo sapiens
gccaggctgccttatctctagc

SEQ ID NO: 8491837 - DNA, 22 bp, Homo sapiens
gccaggctgaggctctggaaga

SEQ ID NO: 8491838 - DNA, 22 bp, Homo sapiens
gccaggctgaggctctggaaga

SEQ ID NO: 8491839 - DNA, 22 bp, Homo sapiens
gccaggctgactcccccggcct

SEQ ID NO: 8491840 - DNA, 22 bp, Homo sapiens
gccaggctcttggttatgtttt

SEQ ID NO: 8491841 - DNA, 22 bp, Homo sapiens
gccaggctggttatttaatgag

SEQ ID NO: 8491842 - DNA, 22 bp, Homo sapiens
gccaggctgtggggaacttgaa

SEQ ID NO: 8491843 - DNA, 22 bp, Homo sapiens
gccaggctggtgtcacaactct

SEQ ID NO: 8491844 - DNA, 22 bp, Homo sapiens
gccaggctgctggctgctgtcc

SEQ ID NO: 8491845 - DNA, 22 bp, Homo sapiens
gccaggctggtgtcacaactct

SEQ ID NO: 8491846 - DNA, 22 bp, Homo sapiens
gccaggctggtgtcacaactct

SEQ ID NO: 8491847 - DNA, 22 bp, Homo sapiens
gccaggctggtgtcacaactct

SEQ ID NO: 8491848 - DNA, 22 bp, Homo sapiens
gccaggctgctccagggaggcc

SEQ ID NO: 8491849 - DNA, 22 bp, Homo sapiens
gccaggctgctccagggaggcc

SEQ ID NO: 8491850 - DNA, 22 bp, Homo sapiens
gccaggctgccttatctctagc

SEQ ID NO: 8491851 - DNA, 22 bp, Homo sapiens
gccaggctgctggctgctgtcc

SEQ ID NO: 8491852 - DNA, 22 bp, Homo sapiens
gccaggctgctggctgctgtcc

SEQ ID NO: 8491853 - DNA, 22 bp, Homo sapiens
gccaggctgctccagggaggcc

SEQ ID NO: 8491854 - DNA, 19 bp, Homo sapiens
gccagtgtgtggtacagtg

SEQ ID NO: 8491855 - DNA, 22 bp, Homo sapiens
gccagtggtgagattccctggg

SEQ ID NO: 8491856 - DNA, 22 bp, Homo sapiens
gccatcacatccaggctacctc

SEQ ID NO: 8491857 - DNA, 22 bp, Homo sapiens
gccataaattgctggtcaaaat

SEQ ID NO: 8491858 - DNA, 22 bp, Homo sapiens
gccagttcctgtggagtcagag

SEQ ID NO: 8491859 - DNA, 22 bp, Homo sapiens
gccagtgtttatagcagtgagg

SEQ ID NO: 8491860 - DNA, 22 bp, Homo sapiens
gccaggctgtggggaacttgaa

SEQ ID NO: 8491861 - DNA, 22 bp, Homo sapiens
gccaggctgtttttattactgt

SEQ ID NO: 8491862 - DNA, 22 bp, Homo sapiens
gccaggctgtttttattactgt

SEQ ID NO: 8491863 - DNA, 22 bp, Homo sapiens
gccaggctgtttttattactgt

SEQ ID NO: 8491864 - DNA, 22 bp, Homo sapiens
gcccaggagttggaggctgcag

SEQ ID NO: 8491865 - DNA, 22 bp, Homo sapiens
gcccaggagttggaggctgcag

SEQ ID NO: 8491866 - DNA, 22 bp, Homo sapiens
gcccaggagttgaatgcagcag

SEQ ID NO: 8491867 - DNA, 22 bp, Homo sapiens
gcccaggaggtcaagtagctat

SEQ ID NO: 8491868 - DNA, 22 bp, Homo sapiens
gcccaggaggcagaggttgtgg

SEQ ID NO: 8491869 - DNA, 22 bp, Homo sapiens
gcccaggaggcagaggttgtgg

SEQ ID NO: 8491870 - DNA, 22 bp, Homo sapiens
gccattaatgagatcaagaatc

SEQ ID NO: 8491871 - DNA, 22 bp, Homo sapiens
gccattcatattttagcattaa

SEQ ID NO: 8491872 - DNA, 22 bp, Homo sapiens
gccatttagggaggcaaggtga

SEQ ID NO: 8491873 - DNA, 21 bp, Homo sapiens
gccatttcacacagacatttg

SEQ ID NO: 8491874 - DNA, 22 bp, Homo sapiens
gcccaggaggagaggctgcagt

SEQ ID NO: 8491875 - DNA, 22 bp, Homo sapiens
gcccaggaggagaggctgcagt

SEQ ID NO: 8491876 - DNA, 23 bp, Homo sapiens
gccatcacgttcaaccaaagcct

SEQ ID NO: 8491877 - DNA, 19 bp, Homo sapiens
gccatgggctggcagcaga

SEQ ID NO: 8491878 - DNA, 22 bp, Homo sapiens
gccatgggtctgctggctcagc

SEQ ID NO: 8491879 - DNA, 21 bp, Homo sapiens
gccatgtttccttactaagag

SEQ ID NO: 8491880 - DNA, 22 bp, Homo sapiens
gccatgttttggtaaataccat

SEQ ID NO: 8491881 - DNA, 22 bp, Homo sapiens
gccatggggctcagctgcacta

SEQ ID NO: 8491882 - DNA, 22 bp, Homo sapiens
gccatggggacttcatggattt

SEQ ID NO: 8491883 - DNA, 22 bp, Homo sapiens
gccatggggagggcagcgcctg

SEQ ID NO: 8491884 - DNA, 22 bp, Homo sapiens
gcccaggatctgctcagatcat

SEQ ID NO: 8491885 - DNA, 20 bp, Homo sapiens
gcccaggatctctgaggcat

SEQ ID NO: 8491886 - DNA, 20 bp, Homo sapiens
gcccaggatctctgaggcat

SEQ ID NO: 8491887 - DNA, 22 bp, Homo sapiens
gcccaggatctgctcagatcat

SEQ ID NO: 8491888 - DNA, 22 bp, Homo sapiens
gcccaggatggagaatagtggt

SEQ ID NO: 8491889 - DNA, 22 bp, Homo sapiens
gcccaggatggagaatagtggt

SEQ ID NO: 8491890 - DNA, 22 bp, Homo sapiens
gcccaggatggctggaggtgct

SEQ ID NO: 8491891 - DNA, 22 bp, Homo sapiens
gcccaggatggctggaggtgct

SEQ ID NO: 8491892 - DNA, 22 bp, Homo sapiens
gcccaggagttggtggctgcag

SEQ ID NO: 8491893 - DNA, 22 bp, Homo sapiens
gcccaggagttggtggctgcag

SEQ ID NO: 8491894 - DNA, 22 bp, Homo sapiens
gcccaggagtttgcattttaac

SEQ ID NO: 8491895 - DNA, 22 bp, Homo sapiens
gcccaggagttggtggctgcag

SEQ ID NO: 8491896 - DNA, 22 bp, Homo sapiens
gcccaggataatgctgtccctg

SEQ ID NO: 8491897 - DNA, 22 bp, Homo sapiens
gcccaggagtttgcattttaac

SEQ ID NO: 8491898 - DNA, 22 bp, Homo sapiens
gcccaggataatgctgtccctg

SEQ ID NO: 8491899 - DNA, 22 bp, Homo sapiens
gcccaggatggtgtgtagtggt

SEQ ID NO: 8491900 - DNA, 22 bp, Homo sapiens
gcccaggatggtgtgtagtggt

SEQ ID NO: 8491901 - DNA, 22 bp, Homo sapiens
gcccaggctagcgtagagtgca

SEQ ID NO: 8491902 - DNA, 22 bp, Homo sapiens
gcccaggattctttcttcctta

SEQ ID NO: 8491903 - DNA, 22 bp, Homo sapiens
gcccaggattctttcttcctta

SEQ ID NO: 8491904 - DNA, 22 bp, Homo sapiens
gcccaggctggagtgcagtggc

SEQ ID NO: 8491905 - DNA, 22 bp, Homo sapiens
gcccaggctggagtgcagtggc

SEQ ID NO: 8491906 - DNA, 22 bp, Homo sapiens
gcccaggctggagtgcagtagc

SEQ ID NO: 8491907 - DNA, 17 bp, Homo sapiens
gcctctgcttgtgtcat

SEQ ID NO: 8491908 - DNA, 20 bp, Homo sapiens
gcctctggagccaaggacca

SEQ ID NO: 8491909 - DNA, 23 bp, Homo sapiens
gcctctggagccccagtgctcag

SEQ ID NO: 8491910 - DNA, 23 bp, Homo sapiens
gcctctggagccccagtgctcag

SEQ ID NO: 8491911 - DNA, 22 bp, Homo sapiens
gcctgcctcaaaatcccagttc

SEQ ID NO: 8491912 - DNA, 22 bp, Homo sapiens
gcctgcctcaaaatcccagttc

SEQ ID NO: 8491913 - DNA, 22 bp, Homo sapiens
gcctgcctcaaaatcccagttc

SEQ ID NO: 8491914 - DNA, 18 bp, Homo sapiens
gcctgcctagagcttgcc

SEQ ID NO: 8491915 - DNA, 20 bp, Homo sapiens
gcctgcctcagctagctgag

SEQ ID NO: 8491916 - DNA, 20 bp, Homo sapiens
gcctgcctcagctagctgag

SEQ ID NO: 8491917 - DNA, 22 bp, Homo sapiens
gcctgcctcaaaatcccagttc

SEQ ID NO: 8491918 - DNA, 20 bp, Homo sapiens
gcctgcctcagctagctgag

SEQ ID NO: 8491919 - DNA, 20 bp, Homo sapiens
gcctgcctcagctagctgag

SEQ ID NO: 8491920 - DNA, 22 bp, Homo sapiens
gcctgcctgaaggctgtaccag

SEQ ID NO: 8491921 - DNA, 22 bp, Homo sapiens
gcctgcctgaaggctgtaccag

SEQ ID NO: 8491922 - DNA, 22 bp, Homo sapiens
gcctgcctgaaggctgtaccag

SEQ ID NO: 8491923 - DNA, 23 bp, Homo sapiens
gcctgcctgacctgtgcaaagtc

SEQ ID NO: 8491924 - DNA, 21 bp, Homo sapiens
gcctgcctgcgtgaccctctt

SEQ ID NO: 8491925 - DNA, 23 bp, Homo sapiens
gcctgcctgacctgtgcaaagtc

SEQ ID NO: 8491926 - DNA, 22 bp, Homo sapiens
gcctgccttcggtgcgcagcgg

SEQ ID NO: 8491927 - DNA, 22 bp, Homo sapiens
gcctgccttcggtgcgcagcgg

SEQ ID NO: 8491928 - DNA, 22 bp, Homo sapiens
gcctgcctttgtatgaccctga

SEQ ID NO: 8491929 - DNA, 22 bp, Homo sapiens
gcctgcctttgtatgaccctga

SEQ ID NO: 8491930 - DNA, 22 bp, Homo sapiens
gcctgcctttgtatgaccctga

SEQ ID NO: 8491931 - DNA, 22 bp, Homo sapiens
gcctgcctttgtatgaccctga

SEQ ID NO: 8491932 - DNA, 22 bp, Homo sapiens
gcctgcctgttggctgaggtgc

SEQ ID NO: 8491933 - DNA, 22 bp, Homo sapiens
gcctgcctgttggctgaggtgc

SEQ ID NO: 8491934 - DNA, 22 bp, Homo sapiens
gcctgcctgttggctgaggtgc

SEQ ID NO: 8491935 - DNA, 22 bp, Homo sapiens
gcctgcctgttggctgaggtgc

SEQ ID NO: 8491936 - DNA, 22 bp, Homo sapiens
gcctgcctgttggctgaggtgc

SEQ ID NO: 8491937 - DNA, 22 bp, Homo sapiens
gcctgccttcggtgcgcagcgg

SEQ ID NO: 8491938 - DNA, 22 bp, Homo sapiens
gcctgcctgttggctgaggtgc

SEQ ID NO: 8491939 - DNA, 19 bp, Homo sapiens
gcctgcctgggtttctgag

SEQ ID NO: 8491940 - DNA, 19 bp, Homo sapiens
gcctgcctgggtttctgag

SEQ ID NO: 8491941 - DNA, 19 bp, Homo sapiens
gcctgcctgggtttctgag

SEQ ID NO: 8491942 - DNA, 21 bp, Homo sapiens
gcctgcctgcgtgaccctctt

SEQ ID NO: 8491943 - DNA, 21 bp, Homo sapiens
gcctgcctgcgtgaccctctt

SEQ ID NO: 8491944 - DNA, 21 bp, Homo sapiens
gcctgcctgcgtgaccctctt

SEQ ID NO: 8491945 - DNA, 22 bp, Homo sapiens
gcctgcctgctgtcatctgcct

SEQ ID NO: 8491946 - DNA, 22 bp, Homo sapiens
gcctgcctgctgtcatctgcct

SEQ ID NO: 8491947 - DNA, 22 bp, Homo sapiens
gcctgcctgctgtcatctgcct

SEQ ID NO: 8491948 - DNA, 22 bp, Homo sapiens
gcctgcctgctgtcatctgcct

SEQ ID NO: 8491949 - DNA, 22 bp, Homo sapiens
gcctgcctggagcttgaggtga

SEQ ID NO: 8491950 - DNA, 22 bp, Homo sapiens
gcctgcctggagcttgaggtga

SEQ ID NO: 8491951 - DNA, 19 bp, Homo sapiens
gcctgcctgggtttctgag

SEQ ID NO: 8491952 - DNA, 22 bp, Homo sapiens
gcctgcctggagcttgaggtga

SEQ ID NO: 8491953 - DNA, 22 bp, Homo sapiens
gcctgcctgctgtgtgcaagtt

SEQ ID NO: 8491954 - DNA, 22 bp, Homo sapiens
gcctgcctgctgtgtgcaagtt

SEQ ID NO: 8491955 - DNA, 22 bp, Homo sapiens
gcctgcctgctgtgtgcaagtt

SEQ ID NO: 8491956 - DNA, 22 bp, Homo sapiens
gcctgctttaagtctgttgcct

SEQ ID NO: 8491957 - DNA, 22 bp, Homo sapiens
gcctgctttgtgcctgatcttt

SEQ ID NO: 8491958 - DNA, 22 bp, Homo sapiens
gcctgcttccttttcatagatg

SEQ ID NO: 8491959 - DNA, 22 bp, Homo sapiens
gcctgcttctcagtcagcttgg

SEQ ID NO: 8491960 - DNA, 22 bp, Homo sapiens
gcctgctgttgagggaagagct

SEQ ID NO: 8491961 - DNA, 22 bp, Homo sapiens
gcctgctgttaactgcaggaat

SEQ ID NO: 8491962 - DNA, 22 bp, Homo sapiens
gcctgctgttaactgcaggaat

SEQ ID NO: 8491963 - DNA, 22 bp, Homo sapiens
gcctgctgttaactgcaggaat

SEQ ID NO: 8491964 - DNA, 22 bp, Homo sapiens
gcctgctcccagttggcgcctc

SEQ ID NO: 8491965 - DNA, 22 bp, Homo sapiens
gcctgctctccggatccctgat

SEQ ID NO: 8491966 - DNA, 22 bp, Homo sapiens
gcctgctctgacatccatccca

SEQ ID NO: 8491967 - DNA, 22 bp, Homo sapiens
gcctgcctttgtgaggaagcgg

SEQ ID NO: 8491968 - DNA, 22 bp, Homo sapiens
gcctgcctttgtgaggaagcgg

SEQ ID NO: 8491969 - DNA, 22 bp, Homo sapiens
gcctgccttttggaggcacatt

SEQ ID NO: 8491970 - DNA, 22 bp, Homo sapiens
gcctgccttttggaggcacatt

SEQ ID NO: 8491971 - DNA, 22 bp, Homo sapiens
gcctgccttttggaggcacatt

SEQ ID NO: 8491972 - DNA, 22 bp, Homo sapiens
gcctgccttttggaggcacatt

SEQ ID NO: 8491973 - DNA, 22 bp, Homo sapiens
gcctgctcagacctagcaggcc

SEQ ID NO: 8491974 - DNA, 22 bp, Homo sapiens
gcctggagggtccctctctgga

SEQ ID NO: 8491975 - DNA, 22 bp, Homo sapiens
gcctggagggtccctctctgga

SEQ ID NO: 8491976 - DNA, 22 bp, Homo sapiens
gcctggagggtccctctctgga

SEQ ID NO: 8491977 - DNA, 22 bp, Homo sapiens
gcctggagggtccctctctgga

SEQ ID NO: 8491978 - DNA, 22 bp, Homo sapiens
gcctggagggtccctctctgga

SEQ ID NO: 8491979 - DNA, 22 bp, Homo sapiens
gcctggaggggccagggtggta

SEQ ID NO: 8491980 - DNA, 22 bp, Homo sapiens
gcctggaggggccagggtggta

SEQ ID NO: 8491981 - DNA, 22 bp, Homo sapiens
gcctggaggggccagggtggta

SEQ ID NO: 8491982 - DNA, 22 bp, Homo sapiens
gcctggaggggccagggtggta

SEQ ID NO: 8491983 - DNA, 22 bp, Homo sapiens
gcctggaggggccagggtggta

SEQ ID NO: 8491984 - DNA, 22 bp, Homo sapiens
gcctggaggggccagggtggta

SEQ ID NO: 8491985 - DNA, 22 bp, Homo sapiens
gcctggaggggacagtctctgg

SEQ ID NO: 8491986 - DNA, 22 bp, Homo sapiens
gcctggaggggacagtctctgg

SEQ ID NO: 8491987 - DNA, 22 bp, Homo sapiens
gcctggaggggacagtctctgg

SEQ ID NO: 8491988 - DNA, 22 bp, Homo sapiens
gcctggaggggacagtctctgg

SEQ ID NO: 8491989 - DNA, 22 bp, Homo sapiens
gcctggaggggacagtctctgg

SEQ ID NO: 8491990 - DNA, 22 bp, Homo sapiens
gcctggagggctctagagaggc

SEQ ID NO: 8491991 - DNA, 22 bp, Homo sapiens
gcctggagggctctagagaggc

SEQ ID NO: 8491992 - DNA, 22 bp, Homo sapiens
gcctggagggctctagagaggc

SEQ ID NO: 8491993 - DNA, 22 bp, Homo sapiens
gcctggagggctctagagaggc

SEQ ID NO: 8491994 - DNA, 22 bp, Homo sapiens
gcctggagggctctagagaggc

SEQ ID NO: 8491995 - DNA, 22 bp, Homo sapiens
gcctggagggctctagagaggc

SEQ ID NO: 8491996 - DNA, 22 bp, Homo sapiens
gcctggagggctctagagaggc

SEQ ID NO: 8491997 - DNA, 22 bp, Homo sapiens
gcctggagcctcagcaaggagg

SEQ ID NO: 8491998 - DNA, 20 bp, Homo sapiens
gcctggaggcaatgggaaga

SEQ ID NO: 8491999 - DNA, 20 bp, Homo sapiens
gcctggaggcaatgggaaga

SEQ ID NO: 8492000 - DNA, 20 bp, Homo sapiens
gcctggaggcaatgggaaga

SEQ ID NO: 8492001 - DNA, 20 bp, Homo sapiens
gcctggaggcaatgggaaga

SEQ ID NO: 8492002 - DNA, 20 bp, Homo sapiens
gcctggaggcaatgggaaga

SEQ ID NO: 8492003 - DNA, 22 bp, Homo sapiens
gcctggagcctcagcaaggagg

SEQ ID NO: 8492004 - DNA, 22 bp, Homo sapiens
gcctggagcctcagcaaggagg

SEQ ID NO: 8492005 - DNA, 22 bp, Homo sapiens
gcctggagcctcagcaaggagg

SEQ ID NO: 8492006 - DNA, 22 bp, Homo sapiens
gcctggagcctcagcaaggagg

SEQ ID NO: 8492007 - DNA, 22 bp, Homo sapiens
gcctggagggatagaatgcaag

SEQ ID NO: 8492008 - DNA, 22 bp, Homo sapiens
gcctggagggatagaatgcaag

SEQ ID NO: 8492009 - DNA, 22 bp, Homo sapiens
gcctggagggatagaatgcaag

SEQ ID NO: 8492010 - DNA, 22 bp, Homo sapiens
gcctggaggcgagaacccaatg

SEQ ID NO: 8492011 - DNA, 22 bp, Homo sapiens
gcctggaggcgagaacccaatg

SEQ ID NO: 8492012 - DNA, 20 bp, Homo sapiens
gcctggaggcagagataaag

SEQ ID NO: 8492013 - DNA, 20 bp, Homo sapiens
gcctggaggcagagataaag

SEQ ID NO: 8492014 - DNA, 20 bp, Homo sapiens
gcctggaggcagagataaag

SEQ ID NO: 8492015 - DNA, 22 bp, Homo sapiens
gcctggccgctccgagctccgc

SEQ ID NO: 8492016 - DNA, 22 bp, Homo sapiens
gcctggccgctccgagctccgc

SEQ ID NO: 8492017 - DNA, 22 bp, Homo sapiens
gcctggcccagggctcttgttg

SEQ ID NO: 8492018 - DNA, 22 bp, Homo sapiens
gcctggcccagggctccgcagg

SEQ ID NO: 8492019 - DNA, 22 bp, Homo sapiens
gcctggcccagggctcttgttg

SEQ ID NO: 8492020 - DNA, 22 bp, Homo sapiens
gcctggcccagggctccgcagg

SEQ ID NO: 8492021 - DNA, 22 bp, Homo sapiens
gcctggcccagggctccgcagg

SEQ ID NO: 8492022 - DNA, 22 bp, Homo sapiens
gcctggcccagggctccgcagg

SEQ ID NO: 8492023 - DNA, 17 bp, Homo sapiens
gcctggcccagcctggc

SEQ ID NO: 8492024 - DNA, 17 bp, Homo sapiens
gcctggcccagcctggc

SEQ ID NO: 8492025 - DNA, 23 bp, Homo sapiens
gcctggccaccccagggctgctt

SEQ ID NO: 8492026 - DNA, 23 bp, Homo sapiens
gcctggccaccccagggctgctt

SEQ ID NO: 8492027 - DNA, 22 bp, Homo sapiens
gcctggccaacgtggtgaaacc

SEQ ID NO: 8492028 - DNA, 22 bp, Homo sapiens
gcctggcttttgcctcatgttc

SEQ ID NO: 8492029 - DNA, 22 bp, Homo sapiens
gcctggcctgaactaggaggtg

SEQ ID NO: 8492030 - DNA, 22 bp, Homo sapiens
gcctggccgggtcttggatttt

SEQ ID NO: 8492031 - DNA, 22 bp, Homo sapiens
gcctggccgctccgagctccgc

SEQ ID NO: 8492032 - DNA, 22 bp, Homo sapiens
gcctggccgctccgagctccgc

SEQ ID NO: 8492033 - DNA, 21 bp, Homo sapiens
gcctgggaaatctgggaagcc

SEQ ID NO: 8492034 - DNA, 22 bp, Homo sapiens
gcctgggaaagagtagggaaat

SEQ ID NO: 8492035 - DNA, 22 bp, Homo sapiens
gcctgggaaagagtagggaaat

SEQ ID NO: 8492036 - DNA, 22 bp, Homo sapiens
gcctgggaaagagtagggaaat

SEQ ID NO: 8492037 - DNA, 22 bp, Homo sapiens
gcctgggaaatggtggggtcag

SEQ ID NO: 8492038 - DNA, 22 bp, Homo sapiens
gcctgggaaatggtggggtcag

SEQ ID NO: 8492039 - DNA, 21 bp, Homo sapiens
gcctgggaaatctgggaagcc

SEQ ID NO: 8492040 - DNA, 22 bp, Homo sapiens
gcctggagtagcatggcaagcc

SEQ ID NO: 8492041 - DNA, 22 bp, Homo sapiens
gcctggagtagcatggcaagcc

SEQ ID NO: 8492042 - DNA, 22 bp, Homo sapiens
gcctggagtagcatggcaagcc

SEQ ID NO: 8492043 - DNA, 22 bp, Homo sapiens
gcctggagtagcatggcaagcc

SEQ ID NO: 8492044 - DNA, 22 bp, Homo sapiens
gcctggagtactccttgaagtg

SEQ ID NO: 8492045 - DNA, 22 bp, Homo sapiens
gcctggagtactccttgaagtg

SEQ ID NO: 8492046 - DNA, 22 bp, Homo sapiens
gcctggagtactccttgaagtg

SEQ ID NO: 8492047 - DNA, 22 bp, Homo sapiens
gcctggagtactccttgaagtg

SEQ ID NO: 8492048 - DNA, 22 bp, Homo sapiens
gcctggagtactccttgaagtg

SEQ ID NO: 8492049 - DNA, 22 bp, Homo sapiens
gcctggagtactccttgaagtg

SEQ ID NO: 8492050 - DNA, 22 bp, Homo sapiens
gcctggagtactccttgaagtg

SEQ ID NO: 8492051 - DNA, 22 bp, Homo sapiens
gcctggagggttgaggttttgt

SEQ ID NO: 8492052 - DNA, 22 bp, Homo sapiens
gcctggagggttgaggttttgt

SEQ ID NO: 8492053 - DNA, 22 bp, Homo sapiens
gcctggagggttgaggttttgt

SEQ ID NO: 8492054 - DNA, 22 bp, Homo sapiens
gcctggagggttgaggttttgt

SEQ ID NO: 8492055 - DNA, 22 bp, Homo sapiens
gcctggcaggcctgggccagca

SEQ ID NO: 8492056 - DNA, 22 bp, Homo sapiens
gcctggcaggcctgggccagca

SEQ ID NO: 8492057 - DNA, 22 bp, Homo sapiens
gcctggcaggcctgttggggct

SEQ ID NO: 8492058 - DNA, 22 bp, Homo sapiens
gcctggcaggcctgttggggct

SEQ ID NO: 8492059 - DNA, 22 bp, Homo sapiens
gcctggcagtgatgtcttttgg

SEQ ID NO: 8492060 - DNA, 21 bp, Homo sapiens
gcctggcaggtggaagggctc

SEQ ID NO: 8492061 - DNA, 22 bp, Homo sapiens
gcctggcaggggcctgggagtg

SEQ ID NO: 8492062 - DNA, 22 bp, Homo sapiens
gcctggcaggggcctgggagtg

SEQ ID NO: 8492063 - DNA, 23 bp, Homo sapiens
gcctgggactcaggaggagctca

SEQ ID NO: 8492064 - DNA, 22 bp, Homo sapiens
gcctgggactgcagatccccag

SEQ ID NO: 8492065 - DNA, 23 bp, Homo sapiens
gcctgggactcaggaggagctca

SEQ ID NO: 8492066 - DNA, 23 bp, Homo sapiens
gcctgggactcaggaggagctca

SEQ ID NO: 8492067 - DNA, 23 bp, Homo sapiens
gcctgggactcaggaggagctca

SEQ ID NO: 8492068 - DNA, 23 bp, Homo sapiens
gcctgggactcaggaggagctca

SEQ ID NO: 8492069 - DNA, 22 bp, Homo sapiens
gcctgggactggatgtgtttgt

SEQ ID NO: 8492070 - DNA, 23 bp, Homo sapiens
gcctgggactggtagtgtgacct

SEQ ID NO: 8492071 - DNA, 23 bp, Homo sapiens
gcctgggactggtagtgtgacct

SEQ ID NO: 8492072 - DNA, 23 bp, Homo sapiens
gcctgggactggtagtgtgacct

SEQ ID NO: 8492073 - DNA, 21 bp, Homo sapiens
gcctgggaagagaaaggtaag

SEQ ID NO: 8492074 - DNA, 21 bp, Homo sapiens
gcctgggaagagaaaggtaag

SEQ ID NO: 8492075 - DNA, 22 bp, Homo sapiens
gcctgggacccttagctcttgg

SEQ ID NO: 8492076 - DNA, 21 bp, Homo sapiens
gcctgggaagagaaaggtaag

SEQ ID NO: 8492077 - DNA, 22 bp, Homo sapiens
gcctgggacccttagctcttgg

SEQ ID NO: 8492078 - DNA, 22 bp, Homo sapiens
gcctgggaagactaagtgggag

SEQ ID NO: 8492079 - DNA, 22 bp, Homo sapiens
gcctgggaagactaagtgggag

SEQ ID NO: 8492080 - DNA, 22 bp, Homo sapiens
gcctgggaactctgatctcctg

SEQ ID NO: 8492081 - DNA, 21 bp, Homo sapiens
gcctgggatagtggcctccgg

SEQ ID NO: 8492082 - DNA, 21 bp, Homo sapiens
gcctgggatagtggcctccgg

SEQ ID NO: 8492083 - DNA, 19 bp, Homo sapiens
gcctgggatgggcagaact

SEQ ID NO: 8492084 - DNA, 21 bp, Homo sapiens
gcctgggatagtggcctccgg

SEQ ID NO: 8492085 - DNA, 21 bp, Homo sapiens
gcctgggatagtggcctccgg

SEQ ID NO: 8492086 - DNA, 22 bp, Homo sapiens
gcctgggagaatgacctccaac

SEQ ID NO: 8492087 - DNA, 22 bp, Homo sapiens
gcctgggatagaggcaatgcat

SEQ ID NO: 8492088 - DNA, 22 bp, Homo sapiens
gcctgggatagaggcaatgcat

SEQ ID NO: 8492089 - DNA, 22 bp, Homo sapiens
gcctgggatagaggcaatgcat

SEQ ID NO: 8492090 - DNA, 22 bp, Homo sapiens
gcctgggatagaggcaatgcat

SEQ ID NO: 8492091 - DNA, 20 bp, Homo sapiens
gcctgggattatccactggt

SEQ ID NO: 8492092 - DNA, 20 bp, Homo sapiens
gcctgggattatccactggt

SEQ ID NO: 8492093 - DNA, 19 bp, Homo sapiens
gcctgggatgggcagaact

SEQ ID NO: 8492094 - DNA, 19 bp, Homo sapiens
gcctgggatgggcagaact

SEQ ID NO: 8492095 - DNA, 19 bp, Homo sapiens
gcctgggatgggcagaact

SEQ ID NO: 8492096 - DNA, 19 bp, Homo sapiens
gcctgggatgggcagaact

SEQ ID NO: 8492097 - DNA, 22 bp, Homo sapiens
gcctgggattcccagaggggca

SEQ ID NO: 8492098 - DNA, 22 bp, Homo sapiens
gcctgggattcccagaggggca

SEQ ID NO: 8492099 - DNA, 22 bp, Homo sapiens
gcctgggattcccagaggggca

SEQ ID NO: 8492100 - DNA, 22 bp, Homo sapiens
gcctgggattctcaaaggggtg

SEQ ID NO: 8492101 - DNA, 22 bp, Homo sapiens
gcctgggattctcaaaggggtg

SEQ ID NO: 8492102 - DNA, 22 bp, Homo sapiens
gcctgtcaattttgtgtacaat

SEQ ID NO: 8492103 - DNA, 22 bp, Homo sapiens
gcctggtgtgcgccgcgcagct

SEQ ID NO: 8492104 - DNA, 22 bp, Homo sapiens
gcctggtgtccagaggcgagtg

SEQ ID NO: 8492105 - DNA, 22 bp, Homo sapiens
gcctgggattgtgtaagtgaat

SEQ ID NO: 8492106 - DNA, 22 bp, Homo sapiens
gcctgggattgtgtaagtgaat

SEQ ID NO: 8492107 - DNA, 21 bp, Homo sapiens
gcctgtgtaaattgagtttcc

SEQ ID NO: 8492108 - DNA, 21 bp, Homo sapiens
gcctgtgtaaattgagtttcc

SEQ ID NO: 8492109 - DNA, 22 bp, Homo sapiens
gcctgtgtggatgcgccggtgc

SEQ ID NO: 8492110 - DNA, 22 bp, Homo sapiens
gctctgcccaggaccgtccttg

SEQ ID NO: 8492111 - DNA, 22 bp, Homo sapiens
gctctgtgtccacagctggaaa

SEQ ID NO: 8492112 - DNA, 22 bp, Homo sapiens
gctctgtgttccctccaggctc

SEQ ID NO: 8492113 - DNA, 22 bp, Homo sapiens
gctctgttaacagtccagcttt

SEQ ID NO: 8492114 - DNA, 21 bp, Homo sapiens
gctctgttattttctatgcag

SEQ ID NO: 8492115 - DNA, 22 bp, Homo sapiens
gctctgtgttccctccaggctc

SEQ ID NO: 8492116 - DNA, 22 bp, Homo sapiens
gctctgtgttgtcagaggcacc

SEQ ID NO: 8492117 - DNA, 22 bp, Homo sapiens
gctctgtgttgtcagaggcacc

SEQ ID NO: 8492118 - DNA, 22 bp, Homo sapiens
gctcttctaaagaatgtacagg

SEQ ID NO: 8492119 - DNA, 22 bp, Homo sapiens
gctcttctcagattgtacactc

SEQ ID NO: 8492120 - DNA, 22 bp, Homo sapiens
gctcttctcagattgtacactc

SEQ ID NO: 8492121 - DNA, 22 bp, Homo sapiens
gctcttgaaaatcaaaagggaa

SEQ ID NO: 8492122 - DNA, 22 bp, Homo sapiens
gctcttccatttctcttgaact

SEQ ID NO: 8492123 - DNA, 22 bp, Homo sapiens
gctgagagtgggtgcagtgctt

SEQ ID NO: 8492124 - DNA, 22 bp, Homo sapiens
gctgagagtgggtgcagtgctt

SEQ ID NO: 8492125 - DNA, 22 bp, Homo sapiens
gctgagcagcctaagcaaattt

SEQ ID NO: 8492126 - DNA, 22 bp, Homo sapiens
gctgagcagggtggggaaaggc

SEQ ID NO: 8492127 - DNA, 22 bp, Homo sapiens
gctgagcacagcaaagagacaa

SEQ ID NO: 8492128 - DNA, 22 bp, Homo sapiens
gctgagcacacctagggtagag

SEQ ID NO: 8492129 - DNA, 22 bp, Homo sapiens
gctgagagtgtgagatcagatt

SEQ ID NO: 8492130 - DNA, 22 bp, Homo sapiens
gctgagagtgtgagatcagatt

SEQ ID NO: 8492131 - DNA, 22 bp, Homo sapiens
gctgagattacgggcatgagcc

SEQ ID NO: 8492132 - DNA, 22 bp, Homo sapiens
gctgagcacacctagggtagag

SEQ ID NO: 8492133 - DNA, 18 bp, Homo sapiens
gctgagcaaattcctccc

SEQ ID NO: 8492134 - DNA, 17 bp, Homo sapiens
gctgaacaaggaaaata

SEQ ID NO: 8492135 - DNA, 19 bp, Homo sapiens
gctgaacaagtcagcaacc

SEQ ID NO: 8492136 - DNA, 22 bp, Homo sapiens
gctgaactacatgaagttgccg

SEQ ID NO: 8492137 - DNA, 18 bp, Homo sapiens
gctgaaattctaaacaaa

SEQ ID NO: 8492138 - DNA, 22 bp, Homo sapiens
gctgaaattcagattcctaggc

SEQ ID NO: 8492139 - DNA, 22 bp, Homo sapiens
gctgaaatgtctttagcagtgt

SEQ ID NO: 8492140 - DNA, 22 bp, Homo sapiens
gctgaaattagactgcagaagt

SEQ ID NO: 8492141 - DNA, 22 bp, Homo sapiens
gctcttgatacatcaagaactt

SEQ ID NO: 8492142 - DNA, 22 bp, Homo sapiens
gctcttgaccttggagaactcg

SEQ ID NO: 8492143 - DNA, 22 bp, Homo sapiens
gctcttgatttccaggagctag

SEQ ID NO: 8492144 - DNA, 22 bp, Homo sapiens
gctgaaatgccttgtaaatatt

SEQ ID NO: 8492145 - DNA, 22 bp, Homo sapiens
gctgaaatgggcactgaaggcc

SEQ ID NO: 8492146 - DNA, 22 bp, Homo sapiens
gctctctttgtgccacttaagg

SEQ ID NO: 8492147 - DNA, 22 bp, Homo sapiens
gctctctttgtgccacttaagg

SEQ ID NO: 8492148 - DNA, 22 bp, Homo sapiens
gctctctttttccagtggtggt

SEQ ID NO: 8492149 - DNA, 22 bp, Homo sapiens
gctctctttttccagtggtggt

SEQ ID NO: 8492150 - DNA, 22 bp, Homo sapiens
gctctctttcacagaggtagga

SEQ ID NO: 8492151 - DNA, 22 bp, Homo sapiens
gctctctttcacagaggtagga

SEQ ID NO: 8492152 - DNA, 22 bp, Homo sapiens
gctctctttccatgtggaggat

SEQ ID NO: 8492153 - DNA, 22 bp, Homo sapiens
gctctctttccatgtggaggat

SEQ ID NO: 8492154 - DNA, 22 bp, Homo sapiens
gctcctgggctctaccttgcta

SEQ ID NO: 8492155 - DNA, 22 bp, Homo sapiens
gctcctgggtgtggctgcccct

SEQ ID NO: 8492156 - DNA, 22 bp, Homo sapiens
gctctctttaaactgcatggct

SEQ ID NO: 8492157 - DNA, 22 bp, Homo sapiens
gctctcttggtggctgtcctgg

SEQ ID NO: 8492158 - DNA, 22 bp, Homo sapiens
gctctctttaaactgcatggct

SEQ ID NO: 8492159 - DNA, 22 bp, Homo sapiens
gctctctttaaactgcatggct

SEQ ID NO: 8492160 - DNA, 22 bp, Homo sapiens
gctcctggtctggagcttcaag

SEQ ID NO: 8492161 - DNA, 22 bp, Homo sapiens
gctcctggctctggccaaggga

SEQ ID NO: 8492162 - DNA, 22 bp, Homo sapiens
gctcctggcttcactgacatca

SEQ ID NO: 8492163 - DNA, 22 bp, Homo sapiens
gctcctggcttcactgacatca

SEQ ID NO: 8492164 - DNA, 16 bp, Homo sapiens
gctcctgggccctcga

SEQ ID NO: 8492165 - DNA, 19 bp, Homo sapiens
gctcctgggcctcactcat

SEQ ID NO: 8492166 - DNA, 19 bp, Homo sapiens
gctcctgggcctcactcat

SEQ ID NO: 8492167 - DNA, 19 bp, Homo sapiens
gctcctgggcctcactcat

SEQ ID NO: 8492168 - DNA, 22 bp, Homo sapiens
gctctgccaaggacccattctc

SEQ ID NO: 8492169 - DNA, 23 bp, Homo sapiens
gctctgccacttaatagctgtgt

SEQ ID NO: 8492170 - DNA, 22 bp, Homo sapiens
gctctgagtgattaaggagctt

SEQ ID NO: 8492171 - DNA, 22 bp, Homo sapiens
gctctgagccgggggcctgtcc

SEQ ID NO: 8492172 - DNA, 22 bp, Homo sapiens
gctccaaggtatccaccagggt

SEQ ID NO: 8492173 - DNA, 20 bp, Homo sapiens
gctccaagcccctttagagg

SEQ ID NO: 8492174 - DNA, 22 bp, Homo sapiens
gctcattcagccagggcccggt

SEQ ID NO: 8492175 - DNA, 21 bp, Homo sapiens
gctcatggtggagaaaagcag

SEQ ID NO: 8492176 - DNA, 21 bp, Homo sapiens
gctccagaactctatgctaac

SEQ ID NO: 8492177 - DNA, 17 bp, Homo sapiens
gctccagaattctagtc

SEQ ID NO: 8492178 - DNA, 22 bp, Homo sapiens
gctccagagcagagactaggtt

SEQ ID NO: 8492179 - DNA, 22 bp, Homo sapiens
gctccacttgcagctaggcttg

SEQ ID NO: 8492180 - DNA, 22 bp, Homo sapiens
gctccaggaagggaaatctcca

SEQ ID NO: 8492181 - DNA, 22 bp, Homo sapiens
gctccaggaagggaaatctcca

SEQ ID NO: 8492182 - DNA, 22 bp, Homo sapiens
gctccaggagagggaagcagat

SEQ ID NO: 8492183 - DNA, 22 bp, Homo sapiens
gctccaggagagggaagcagat

SEQ ID NO: 8492184 - DNA, 22 bp, Homo sapiens
gctccagctcgtggctcccagc

SEQ ID NO: 8492185 - DNA, 22 bp, Homo sapiens
gctccagctcgtggctcccagc

SEQ ID NO: 8492186 - DNA, 22 bp, Homo sapiens
gctccagcacctagagcaggtc

SEQ ID NO: 8492187 - DNA, 22 bp, Homo sapiens
gctccagatgaatgcacttgtt

SEQ ID NO: 8492188 - DNA, 22 bp, Homo sapiens
gctccagctccggctccgaagc

SEQ ID NO: 8492189 - DNA, 22 bp, Homo sapiens
gctccagatgaaaggccagagg

SEQ ID NO: 8492190 - DNA, 22 bp, Homo sapiens
gctccagagtgtggcatctggg

SEQ ID NO: 8492191 - DNA, 22 bp, Homo sapiens
gctccagagtgtggcatctggg

SEQ ID NO: 8492192 - DNA, 22 bp, Homo sapiens
gctcctggctccaggcagccaa

SEQ ID NO: 8492193 - DNA, 22 bp, Homo sapiens
gctcctggctccaggcagccaa

SEQ ID NO: 8492194 - DNA, 22 bp, Homo sapiens
gctcctggctccaggcagccaa

SEQ ID NO: 8492195 - DNA, 22 bp, Homo sapiens
gctcctggctccaggcagccaa

SEQ ID NO: 8492196 - DNA, 22 bp, Homo sapiens
gctcctggctctctgagggctg

SEQ ID NO: 8492197 - DNA, 22 bp, Homo sapiens
gctcctggctctctgagggctg

SEQ ID NO: 8492198 - DNA, 22 bp, Homo sapiens
gctcctggcatcctgcttttaa

SEQ ID NO: 8492199 - DNA, 22 bp, Homo sapiens
gctcctggccagcacagggccc

SEQ ID NO: 8492200 - DNA, 22 bp, Homo sapiens
gctcctggccagcacagggccc

SEQ ID NO: 8492201 - DNA, 22 bp, Homo sapiens
gctcctggccagcacagggccc

SEQ ID NO: 8492202 - DNA, 22 bp, Homo sapiens
gctccaggaggatgaccttcct

SEQ ID NO: 8492203 - DNA, 22 bp, Homo sapiens
gctccaggagctcacagctcgc

SEQ ID NO: 8492204 - DNA, 22 bp, Homo sapiens
gctccaggagctcacagctcgc

SEQ ID NO: 8492205 - DNA, 22 bp, Homo sapiens
gctccaggagctcacagctcgc

SEQ ID NO: 8492206 - DNA, 22 bp, Homo sapiens
gctccaggagagggaagcagat

SEQ ID NO: 8492207 - DNA, 22 bp, Homo sapiens
gctccaggagagggaagcagat

SEQ ID NO: 8492208 - DNA, 22 bp, Homo sapiens
gctccaggagagggaagcagat

SEQ ID NO: 8492209 - DNA, 22 bp, Homo sapiens
gctcctggcaggcagtgtgtgt

SEQ ID NO: 8492210 - DNA, 22 bp, Homo sapiens
gctcctcttatttcatcagggc

SEQ ID NO: 8492211 - DNA, 22 bp, Homo sapiens
gctcctcttatttcatcagggc

SEQ ID NO: 8492212 - DNA, 22 bp, Homo sapiens
gctcctctcccagagctgcagg

SEQ ID NO: 8492213 - DNA, 22 bp, Homo sapiens
gctccaggaggatgaccttcct

SEQ ID NO: 8492214 - DNA, 22 bp, Homo sapiens
gctccaggaggatgaccttcct

SEQ ID NO: 8492215 - DNA, 22 bp, Homo sapiens
gctcctctgtcaaatgagagtg

SEQ ID NO: 8492216 - DNA, 22 bp, Homo sapiens
gctcagagatgtctgctgcctt

SEQ ID NO: 8492217 - DNA, 22 bp, Homo sapiens
gctcagagatggggaatgaaaa

SEQ ID NO: 8492218 - DNA, 22 bp, Homo sapiens
gctcagagatgttcagtagctt

SEQ ID NO: 8492219 - DNA, 22 bp, Homo sapiens
gctcagagatgttcagtagctt

SEQ ID NO: 8492220 - DNA, 22 bp, Homo sapiens
gctcagagcactcagactcagc

SEQ ID NO: 8492221 - DNA, 22 bp, Homo sapiens
gctcagagatgttcagtagctt

SEQ ID NO: 8492222 - DNA, 22 bp, Homo sapiens
gctcactggcctgaagaggacg

SEQ ID NO: 8492223 - DNA, 22 bp, Homo sapiens
gctcacttaatttcatgctaca

SEQ ID NO: 8492224 - DNA, 22 bp, Homo sapiens
gctcagaaatggcagatggaga

SEQ ID NO: 8492225 - DNA, 22 bp, Homo sapiens
gctcagaagatatttgatgctg

SEQ ID NO: 8492226 - DNA, 22 bp, Homo sapiens
gctcagagcagatggtactcag

SEQ ID NO: 8492227 - DNA, 22 bp, Homo sapiens
gctcagagcactcagactcagc

SEQ ID NO: 8492228 - DNA, 22 bp, Homo sapiens
gctcagagcatcccagtgaatg

SEQ ID NO: 8492229 - DNA, 22 bp, Homo sapiens
gctcagagcatcccagtgaatg

SEQ ID NO: 8492230 - DNA, 22 bp, Homo sapiens
gctcagagcatcccagtgaatg

SEQ ID NO: 8492231 - DNA, 19 bp, Homo sapiens
gctcagagccatgggggct

SEQ ID NO: 8492232 - DNA, 22 bp, Homo sapiens
gctcagagcccgaggcttgcat

SEQ ID NO: 8492233 - DNA, 22 bp, Homo sapiens
gctcagagcccgaggcttgcat

SEQ ID NO: 8492234 - DNA, 22 bp, Homo sapiens
gctcatgactgtaatcccagca

SEQ ID NO: 8492235 - DNA, 22 bp, Homo sapiens
gctcatgactgtaatcccagca

SEQ ID NO: 8492236 - DNA, 22 bp, Homo sapiens
gctcatgactgtaatcccagca

SEQ ID NO: 8492237 - DNA, 22 bp, Homo sapiens
gctcatgggcccagagcagccc

SEQ ID NO: 8492238 - DNA, 22 bp, Homo sapiens
gctcactgcaagctctgcctcc

SEQ ID NO: 8492239 - DNA, 22 bp, Homo sapiens
gctcactgcaagctctgcctcc

SEQ ID NO: 8492240 - DNA, 22 bp, Homo sapiens
gctcactgcaagctctgcctcc

SEQ ID NO: 8492241 - DNA, 22 bp, Homo sapiens
gctcactgcaagctccgcctcc

SEQ ID NO: 8492242 - DNA, 22 bp, Homo sapiens
gctcactgcaagctccgcctcc

SEQ ID NO: 8492243 - DNA, 22 bp, Homo sapiens
gctcactggcctgaagaggacg

SEQ ID NO: 8492244 - DNA, 22 bp, Homo sapiens
gctcactgccattctctagatg

SEQ ID NO: 8492245 - DNA, 22 bp, Homo sapiens
gctcactgcctgggcaacaaga

SEQ ID NO: 8492246 - DNA, 22 bp, Homo sapiens
gctcactgcaagctctgcctcc

SEQ ID NO: 8492247 - DNA, 22 bp, Homo sapiens
gctcactgccattctctagatg

SEQ ID NO: 8492248 - DNA, 22 bp, Homo sapiens
gctcactgccattctctagatg

SEQ ID NO: 8492249 - DNA, 22 bp, Homo sapiens
gctcactgcaacctccgccttc

SEQ ID NO: 8492250 - DNA, 22 bp, Homo sapiens
gctcactgcaacctccgccttc

SEQ ID NO: 8492251 - DNA, 22 bp, Homo sapiens
gctcactgcaacctctgcctcc

SEQ ID NO: 8492252 - DNA, 22 bp, Homo sapiens
gctcactgcaacctctgcctcc

SEQ ID NO: 8492253 - DNA, 22 bp, Homo sapiens
gctcactgcaacctctgcctcc

SEQ ID NO: 8492254 - DNA, 22 bp, Homo sapiens
gctcactgcaacctctgcctcc

SEQ ID NO: 8492255 - DNA, 22 bp, Homo sapiens
gctcactgcaacctctgcttcc

SEQ ID NO: 8492256 - DNA, 22 bp, Homo sapiens
gctcactgcaacctctgcttcc

SEQ ID NO: 8492257 - DNA, 22 bp, Homo sapiens
gcctgttgggtaacagagttca

SEQ ID NO: 8492258 - DNA, 22 bp, Homo sapiens
gcctgtttactttgccgcagga

SEQ ID NO: 8492259 - DNA, 22 bp, Homo sapiens
gctgctctgtgacagcctccgg

SEQ ID NO: 8492260 - DNA, 22 bp, Homo sapiens
gctgctctgtgacagcctccgg

SEQ ID NO: 8492261 - DNA, 22 bp, Homo sapiens
gctgctctgtgacagcctccgg

SEQ ID NO: 8492262 - DNA, 22 bp, Homo sapiens
gctgctctgtgacagcctccgg

SEQ ID NO: 8492263 - DNA, 22 bp, Homo sapiens
gctgctctgtgacagcctccgg

SEQ ID NO: 8492264 - DNA, 22 bp, Homo sapiens
gctgctctgttaattgctgtaa

SEQ ID NO: 8492265 - DNA, 22 bp, Homo sapiens
gctgctcttgaggggctcactg

SEQ ID NO: 8492266 - DNA, 22 bp, Homo sapiens
gctgctgcaagagccagctctt

SEQ ID NO: 8492267 - DNA, 22 bp, Homo sapiens
gctgctgcaagagccagctctt

SEQ ID NO: 8492268 - DNA, 22 bp, Homo sapiens
gctgctgcatgaacagcggtca

SEQ ID NO: 8492269 - DNA, 21 bp, Homo sapiens
gctgctgcccctagtgaggcc

SEQ ID NO: 8492270 - DNA, 21 bp, Homo sapiens
gctgctgcccctagtgaggcc

SEQ ID NO: 8492271 - DNA, 22 bp, Homo sapiens
gctgctcttttcagagatgaga

SEQ ID NO: 8492272 - DNA, 22 bp, Homo sapiens
gctgctcttgaggggctcactg

SEQ ID NO: 8492273 - DNA, 22 bp, Homo sapiens
gctgctcttttcagagatgaga

SEQ ID NO: 8492274 - DNA, 22 bp, Homo sapiens
gctgctgagaattgcaggcaag

SEQ ID NO: 8492275 - DNA, 19 bp, Homo sapiens
gctgctgctcctccctcgc

SEQ ID NO: 8492276 - DNA, 22 bp, Homo sapiens
gctgctgcgcttgtctactgtt

SEQ ID NO: 8492277 - DNA, 22 bp, Homo sapiens
gctgctgctggtctggggccac

SEQ ID NO: 8492278 - DNA, 22 bp, Homo sapiens
gctgctgctgaggatgcacctg

SEQ ID NO: 8492279 - DNA, 22 bp, Homo sapiens
gctgctgccgcggccgctggga

SEQ ID NO: 8492280 - DNA, 22 bp, Homo sapiens
gctgctgcctgtagccagggtg

SEQ ID NO: 8492281 - DNA, 22 bp, Homo sapiens
gctgctgcctgtagccagggtg

SEQ ID NO: 8492282 - DNA, 22 bp, Homo sapiens
gctgctgcgcttgtctactgtt

SEQ ID NO: 8492283 - DNA, 22 bp, Homo sapiens
gctgctgcgcttgtctactgtt

SEQ ID NO: 8492284 - DNA, 22 bp, Homo sapiens
gctgctgcctgtagccagggtg

SEQ ID NO: 8492285 - DNA, 16 bp, Homo sapiens
gctgctgcttcctgct

SEQ ID NO: 8492286 - DNA, 21 bp, Homo sapiens
gctggagagccaggcaggggc

SEQ ID NO: 8492287 - DNA, 21 bp, Homo sapiens
gctggagagccaggcaggggc

SEQ ID NO: 8492288 - DNA, 21 bp, Homo sapiens
gctggagagccaggcaggggc

SEQ ID NO: 8492289 - DNA, 21 bp, Homo sapiens
gctggagagccaggcaggggc

SEQ ID NO: 8492290 - DNA, 22 bp, Homo sapiens
gctggagaggatcccaaagcca

SEQ ID NO: 8492291 - DNA, 21 bp, Homo sapiens
gctggagagccaggcaggggc

SEQ ID NO: 8492292 - DNA, 22 bp, Homo sapiens
gctggagaggggtcactctgag

SEQ ID NO: 8492293 - DNA, 22 bp, Homo sapiens
gctggagaggggtcactctgag

SEQ ID NO: 8492294 - DNA, 22 bp, Homo sapiens
gctgcctggtttctcagctgca

SEQ ID NO: 8492295 - DNA, 22 bp, Homo sapiens
gctgcctggtttctcagctgca

SEQ ID NO: 8492296 - DNA, 22 bp, Homo sapiens
gctgcctggtttctcagctgca

SEQ ID NO: 8492297 - DNA, 22 bp, Homo sapiens
gctgcctggtttctcagctgca

SEQ ID NO: 8492298 - DNA, 22 bp, Homo sapiens
gctgcctgggcaggaggcgctg

SEQ ID NO: 8492299 - DNA, 22 bp, Homo sapiens
gctgcctgggcaggaggcgctg

SEQ ID NO: 8492300 - DNA, 22 bp, Homo sapiens
gctgcctgggcaggaggcgctg

SEQ ID NO: 8492301 - DNA, 22 bp, Homo sapiens
gctgcctgggctggcattccca

SEQ ID NO: 8492302 - DNA, 22 bp, Homo sapiens
gctgcctgggctggcattccca

SEQ ID NO: 8492303 - DNA, 20 bp, Homo sapiens
gctgctcgctgcagtcactc

SEQ ID NO: 8492304 - DNA, 22 bp, Homo sapiens
gctgctctacccatgcatctgt

SEQ ID NO: 8492305 - DNA, 22 bp, Homo sapiens
gctgctctacccatgcatctgt

SEQ ID NO: 8492306 - DNA, 22 bp, Homo sapiens
gctgctctcagagctcatgctg

SEQ ID NO: 8492307 - DNA, 22 bp, Homo sapiens
gctgctctacccatgcatctgt

SEQ ID NO: 8492308 - DNA, 22 bp, Homo sapiens
gctgcctgtcccaggatgagga

SEQ ID NO: 8492309 - DNA, 22 bp, Homo sapiens
gctgcctgtcccaggatgagga

SEQ ID NO: 8492310 - DNA, 22 bp, Homo sapiens
gctgcctgtcccaggatgagga

SEQ ID NO: 8492311 - DNA, 22 bp, Homo sapiens
gctgcctgtcccaggatgagga

SEQ ID NO: 8492312 - DNA, 22 bp, Homo sapiens
gctgctctctccctaagttggg

SEQ ID NO: 8492313 - DNA, 22 bp, Homo sapiens
gctgctctctccctaagttggg

SEQ ID NO: 8492314 - DNA, 22 bp, Homo sapiens
gctgctctgaaaatgactgttg

SEQ ID NO: 8492315 - DNA, 22 bp, Homo sapiens
gctgctctgaaaatgactgttg

SEQ ID NO: 8492316 - DNA, 22 bp, Homo sapiens
gctgctctggctctgcagtgtc

SEQ ID NO: 8492317 - DNA, 22 bp, Homo sapiens
gctgctctgctgtgtaagcagg

SEQ ID NO: 8492318 - DNA, 22 bp, Homo sapiens
gctgctctgaaaatgactgttg

SEQ ID NO: 8492319 - DNA, 19 bp, Homo sapiens
gctgctctgggtctcatct

SEQ ID NO: 8492320 - DNA, 19 bp, Homo sapiens
gctgctctgggtctcatct

SEQ ID NO: 8492321 - DNA, 19 bp, Homo sapiens
gctgctctgggtctcatct

SEQ ID NO: 8492322 - DNA, 19 bp, Homo sapiens
gctgctctgggtctcatct

SEQ ID NO: 8492323 - DNA, 19 bp, Homo sapiens
gctgctctgggtctcatct

SEQ ID NO: 8492324 - DNA, 22 bp, Homo sapiens
gctgctctggctctgcagtgtc

SEQ ID NO: 8492325 - DNA, 22 bp, Homo sapiens
gctgctctggctctgcagtgtc

SEQ ID NO: 8492326 - DNA, 22 bp, Homo sapiens
gctgctctggctctgcagtgtc

SEQ ID NO: 8492327 - DNA, 22 bp, Homo sapiens
gctgctctccatggccgtgagt

SEQ ID NO: 8492328 - DNA, 22 bp, Homo sapiens
gctgctctctccctaagttggg

SEQ ID NO: 8492329 - DNA, 20 bp, Homo sapiens
gctgctctccacggtctgca

SEQ ID NO: 8492330 - DNA, 22 bp, Homo sapiens
gctgctctccatggccgtgagt

SEQ ID NO: 8492331 - DNA, 20 bp, Homo sapiens
gctgctctccacggtctgca

SEQ ID NO: 8492332 - DNA, 20 bp, Homo sapiens
gctgctctccacggtctgca

SEQ ID NO: 8492333 - DNA, 22 bp, Homo sapiens
gctgctctccaagcctccttga

SEQ ID NO: 8492334 - DNA, 22 bp, Homo sapiens
gctgctctccaagcctccttga

SEQ ID NO: 8492335 - DNA, 22 bp, Homo sapiens
gctgctctcagagctcatgctg

SEQ ID NO: 8492336 - DNA, 22 bp, Homo sapiens
gctgctctcagagctcatgctg

SEQ ID NO: 8492337 - DNA, 22 bp, Homo sapiens
gctgctctcagagctcatgctg

SEQ ID NO: 8492338 - DNA, 22 bp, Homo sapiens
gctgctctcatagatggcttca

SEQ ID NO: 8492339 - DNA, 22 bp, Homo sapiens
gctgctctcatagatggcttca

SEQ ID NO: 8492340 - DNA, 22 bp, Homo sapiens
gctgctctccaagcctccttga

SEQ ID NO: 8492341 - DNA, 22 bp, Homo sapiens
gctgcctgcttcatgtgggaga

SEQ ID NO: 8492342 - DNA, 22 bp, Homo sapiens
gctgcctgctcggctcctggga

SEQ ID NO: 8492343 - DNA, 22 bp, Homo sapiens
gctgcctgctcggctcctggga

SEQ ID NO: 8492344 - DNA, 22 bp, Homo sapiens
gctgcctgctcggctcctggga

SEQ ID NO: 8492345 - DNA, 22 bp, Homo sapiens
gctgcctgctcggctcctggga

SEQ ID NO: 8492346 - DNA, 22 bp, Homo sapiens
gctgcctgctcggctcctggga

SEQ ID NO: 8492347 - DNA, 22 bp, Homo sapiens
gctgcctgccttgcctggagga

SEQ ID NO: 8492348 - DNA, 22 bp, Homo sapiens
gctgcctgctcacccggcctgg

SEQ ID NO: 8492349 - DNA, 22 bp, Homo sapiens
gctgcctgctcacccggcctgg

SEQ ID NO: 8492350 - DNA, 22 bp, Homo sapiens
gctgcctgctcacccggcctgg

SEQ ID NO: 8492351 - DNA, 22 bp, Homo sapiens
gctgcctgatgtccagcaggac

SEQ ID NO: 8492352 - DNA, 22 bp, Homo sapiens
gctgcctgatgtccagcaggac

SEQ ID NO: 8492353 - DNA, 22 bp, Homo sapiens
gctgcctgatgtccagcaggac

SEQ ID NO: 8492354 - DNA, 22 bp, Homo sapiens
gctgcctgatcatacaccaggg

SEQ ID NO: 8492355 - DNA, 22 bp, Homo sapiens
gctgcctgatcatacaccaggg

SEQ ID NO: 8492356 - DNA, 22 bp, Homo sapiens
gctgcctgatcatacaccaggg

SEQ ID NO: 8492357 - DNA, 22 bp, Homo sapiens
gctgcctggaataacggctggc

SEQ ID NO: 8492358 - DNA, 22 bp, Homo sapiens
gctgcctggaataacggctggc

SEQ ID NO: 8492359 - DNA, 22 bp, Homo sapiens
gctgcctggaataacggctggc

SEQ ID NO: 8492360 - DNA, 22 bp, Homo sapiens
gctgcctggaataacggctggc

SEQ ID NO: 8492361 - DNA, 22 bp, Homo sapiens
gctgcctggagaggcagggatg

SEQ ID NO: 8492362 - DNA, 22 bp, Homo sapiens
gctgcctggagaggcagggatg

SEQ ID NO: 8492363 - DNA, 22 bp, Homo sapiens
gctgcctggagaggcagggatg

SEQ ID NO: 8492364 - DNA, 22 bp, Homo sapiens
gctgcctggagctcagcctgcc

SEQ ID NO: 8492365 - DNA, 22 bp, Homo sapiens
gctgcctggagctcagcctgcc

SEQ ID NO: 8492366 - DNA, 22 bp, Homo sapiens
gctgcctggctttagtccactt

SEQ ID NO: 8492367 - DNA, 22 bp, Homo sapiens
gctgcctggctgatgaaaattc

SEQ ID NO: 8492368 - DNA, 22 bp, Homo sapiens
gctgcctggctttagtccactt

SEQ ID NO: 8492369 - DNA, 22 bp, Homo sapiens
gctgcctggctttagtccactt

SEQ ID NO: 8492370 - DNA, 22 bp, Homo sapiens
gctgcctggatttgcaatcctc

SEQ ID NO: 8492371 - DNA, 22 bp, Homo sapiens
gctgcctggatttgcaatcctc

SEQ ID NO: 8492372 - DNA, 22 bp, Homo sapiens
gctgcctggagctcagcctgcc

SEQ ID NO: 8492373 - DNA, 22 bp, Homo sapiens
gctgcctggatttgcaatcctc

SEQ ID NO: 8492374 - DNA, 22 bp, Homo sapiens
gctgcctggagctcagcctgcc

SEQ ID NO: 8492375 - DNA, 22 bp, Homo sapiens
gctgcctggagctcagcctgcc

SEQ ID NO: 8492376 - DNA, 22 bp, Homo sapiens
gctgcctggagctcagcctgcc

SEQ ID NO: 8492377 - DNA, 22 bp, Homo sapiens
gctgcctggagctcagcctgcc

SEQ ID NO: 8492378 - DNA, 22 bp, Homo sapiens
gctgagccatgaggcctcttgc

SEQ ID NO: 8492379 - DNA, 22 bp, Homo sapiens
gctgagcaggtttgatgctttt

SEQ ID NO: 8492380 - DNA, 22 bp, Homo sapiens
gctgagcaggtgtaaggaaggc

SEQ ID NO: 8492381 - DNA, 22 bp, Homo sapiens
gctgagcaggtgtaaggaaggc

SEQ ID NO: 8492382 - DNA, 22 bp, Homo sapiens
gctgagccacaggcagtgcact

SEQ ID NO: 8492383 - DNA, 22 bp, Homo sapiens
gctgagccacaggcagtgcact

SEQ ID NO: 8492384 - DNA, 22 bp, Homo sapiens
gctgagctagaaaaggaccaca

SEQ ID NO: 8492385 - DNA, 22 bp, Homo sapiens
gctgagctagctatctcagtct

SEQ ID NO: 8492386 - DNA, 22 bp, Homo sapiens
gctgagctagaaaaggaccaca

SEQ ID NO: 8492387 - DNA, 22 bp, Homo sapiens
gctgagctagaaaaggaccaca

SEQ ID NO: 8492388 - DNA, 22 bp, Homo sapiens
gctgagcctagctgtctcctgt

SEQ ID NO: 8492389 - DNA, 22 bp, Homo sapiens
gctgagctcccagcagtatctg

SEQ ID NO: 8492390 - DNA, 22 bp, Homo sapiens
gctgaggaggtgtggttaggtg

SEQ ID NO: 8492391 - DNA, 20 bp, Homo sapiens
gctgaggattcctggcccct

SEQ ID NO: 8492392 - DNA, 22 bp, Homo sapiens
gctgaggatatagcaggaacaa

SEQ ID NO: 8492393 - DNA, 22 bp, Homo sapiens
gctgaggattacttgaagtcag

SEQ ID NO: 8492394 - DNA, 22 bp, Homo sapiens
gctgaggattacttgaagtcag

SEQ ID NO: 8492395 - DNA, 22 bp, Homo sapiens
gctgcctgatcatacaccaggg

SEQ ID NO: 8492396 - DNA, 22 bp, Homo sapiens
gctgcctgaatgaaccttgttc

SEQ ID NO: 8492397 - DNA, 22 bp, Homo sapiens
gctggagatgctatgcagaggg

SEQ ID NO: 8492398 - DNA, 22 bp, Homo sapiens
gctggagatgctatgcagaggg

SEQ ID NO: 8492399 - DNA, 22 bp, Homo sapiens
gctggagatgctatgcagaggg

SEQ ID NO: 8492400 - DNA, 22 bp, Homo sapiens
gctggagatgctatgcagaggg

SEQ ID NO: 8492401 - DNA, 22 bp, Homo sapiens
gctggagatgctatgcagaggg

SEQ ID NO: 8492402 - DNA, 22 bp, Homo sapiens
gctggagccattggcttggcct

SEQ ID NO: 8492403 - DNA, 22 bp, Homo sapiens
gctggagccattggcttggcct

SEQ ID NO: 8492404 - DNA, 22 bp, Homo sapiens
gctggagccattggcttggcct

SEQ ID NO: 8492405 - DNA, 22 bp, Homo sapiens
gctggagccaagctgctcttgg

SEQ ID NO: 8492406 - DNA, 22 bp, Homo sapiens
gctggagctgagttccctgggc

SEQ ID NO: 8492407 - DNA, 22 bp, Homo sapiens
gctggagctgagttccctgggc

SEQ ID NO: 8492408 - DNA, 22 bp, Homo sapiens
gctggagcgtgatccttgatct

SEQ ID NO: 8492409 - DNA, 22 bp, Homo sapiens
gctggagctgagttccctgggc

SEQ ID NO: 8492410 - DNA, 22 bp, Homo sapiens
gctggagctgagttccctgggc

SEQ ID NO: 8492411 - DNA, 22 bp, Homo sapiens
gctggagccttctgctctgttg

SEQ ID NO: 8492412 - DNA, 22 bp, Homo sapiens
gctggagcgggttcgggccgct

SEQ ID NO: 8492413 - DNA, 22 bp, Homo sapiens
gctggagcgggttcgggccgct

SEQ ID NO: 8492414 - DNA, 22 bp, Homo sapiens
gctggagccttctgctctgttg

SEQ ID NO: 8492415 - DNA, 22 bp, Homo sapiens
gctggagccttctgctctgttg

SEQ ID NO: 8492416 - DNA, 22 bp, Homo sapiens
gctggagccttctgctctgttg

SEQ ID NO: 8492417 - DNA, 22 bp, Homo sapiens
gctggagccttctgctctgttg

SEQ ID NO: 8492418 - DNA, 22 bp, Homo sapiens
gctggagatagtaggatccata

SEQ ID NO: 8492419 - DNA, 22 bp, Homo sapiens
gctggagatagtaggatccata

SEQ ID NO: 8492420 - DNA, 22 bp, Homo sapiens
gctggagatagtaggatccata

SEQ ID NO: 8492421 - DNA, 22 bp, Homo sapiens
gctggagatagaatggccactg

SEQ ID NO: 8492422 - DNA, 22 bp, Homo sapiens
gctggagatagaatggccactg

SEQ ID NO: 8492423 - DNA, 22 bp, Homo sapiens
gctggagatactgctcagtatc

SEQ ID NO: 8492424 - DNA, 22 bp, Homo sapiens
gctggagatactgctcagtatc

SEQ ID NO: 8492425 - DNA, 22 bp, Homo sapiens
gctggagagtagtaagcagtta

SEQ ID NO: 8492426 - DNA, 22 bp, Homo sapiens
gctggagagtagtaagcagtta

SEQ ID NO: 8492427 - DNA, 22 bp, Homo sapiens
gctggagagtagtaagcagtta

SEQ ID NO: 8492428 - DNA, 22 bp, Homo sapiens
gctggagagtgaggggagcaag

SEQ ID NO: 8492429 - DNA, 22 bp, Homo sapiens
gctggagagtgaggggagcaag

SEQ ID NO: 8492430 - DNA, 22 bp, Homo sapiens
gctggagagtgaggggagcaag

SEQ ID NO: 8492431 - DNA, 22 bp, Homo sapiens
gctggagatactgctcagtatc

SEQ ID NO: 8492432 - DNA, 22 bp, Homo sapiens
gctggagatactgctcagtatc

SEQ ID NO: 8492433 - DNA, 22 bp, Homo sapiens
gctggagatactgctcagtatc

SEQ ID NO: 8492434 - DNA, 22 bp, Homo sapiens
gctggcctgacctgaggctggg

SEQ ID NO: 8492435 - DNA, 22 bp, Homo sapiens
gctggcctgacctgaggctggg

SEQ ID NO: 8492436 - DNA, 22 bp, Homo sapiens
gctggcctgaccagccacaggc

SEQ ID NO: 8492437 - DNA, 22 bp, Homo sapiens
gctggcctgagggccgaggctc

SEQ ID NO: 8492438 - DNA, 22 bp, Homo sapiens
gctggcctgcaaagcccggctg

SEQ ID NO: 8492439 - DNA, 22 bp, Homo sapiens
gctggcctgcaaagcccggctg

SEQ ID NO: 8492440 - DNA, 22 bp, Homo sapiens
gctggcctgaccagccacaggc

SEQ ID NO: 8492441 - DNA, 22 bp, Homo sapiens
gctggcctgaccagccacaggc

SEQ ID NO: 8492442 - DNA, 22 bp, Homo sapiens
gctggcctcgcaggcaggatgt

SEQ ID NO: 8492443 - DNA, 22 bp, Homo sapiens
gctggcctcgcaggcaggatgt

SEQ ID NO: 8492444 - DNA, 22 bp, Homo sapiens
gctggcctctacaggccggcca

SEQ ID NO: 8492445 - DNA, 22 bp, Homo sapiens
gctggcctctacaggccggcca

SEQ ID NO: 8492446 - DNA, 22 bp, Homo sapiens
gctggccccgagtgctacgctc

SEQ ID NO: 8492447 - DNA, 22 bp, Homo sapiens
gctggcctcatcactgacttct

SEQ ID NO: 8492448 - DNA, 22 bp, Homo sapiens
gctggcctcgcaggcaggatgt

SEQ ID NO: 8492449 - DNA, 22 bp, Homo sapiens
gctggccagtgtcccagggatc

SEQ ID NO: 8492450 - DNA, 22 bp, Homo sapiens
gctggccaggtgctttggttct

SEQ ID NO: 8492451 - DNA, 22 bp, Homo sapiens
gctggagctgcagcctgggcct

SEQ ID NO: 8492452 - DNA, 22 bp, Homo sapiens
gctggagctgcagcctgggcct

SEQ ID NO: 8492453 - DNA, 22 bp, Homo sapiens
gctggccagggctgctcgcgga

SEQ ID NO: 8492454 - DNA, 22 bp, Homo sapiens
gctggagctgcagcctgggcct

SEQ ID NO: 8492455 - DNA, 22 bp, Homo sapiens
gctgggcaaggctgaagctacc

SEQ ID NO: 8492456 - DNA, 22 bp, Homo sapiens
gctgggcaatgccagagaggag

SEQ ID NO: 8492457 - DNA, 22 bp, Homo sapiens
gctgggcaatgccagagaggag

SEQ ID NO: 8492458 - DNA, 22 bp, Homo sapiens
gctgggcaatgccagagaggag

SEQ ID NO: 8492459 - DNA, 22 bp, Homo sapiens
gctgggcagcaggctctccggg

SEQ ID NO: 8492460 - DNA, 22 bp, Homo sapiens
gctgggcactgtcccataggct

SEQ ID NO: 8492461 - DNA, 22 bp, Homo sapiens
gctgggcactgtcccataggct

SEQ ID NO: 8492462 - DNA, 22 bp, Homo sapiens
gctgggcacctctcccagattg

SEQ ID NO: 8492463 - DNA, 22 bp, Homo sapiens
gctgggcacctctcccagattg

SEQ ID NO: 8492464 - DNA, 22 bp, Homo sapiens
gctgggcaatgccagagaggag

SEQ ID NO: 8492465 - DNA, 22 bp, Homo sapiens
gctgggcaccggagagacccca

SEQ ID NO: 8492466 - DNA, 22 bp, Homo sapiens
gctgggcaccggagagacccca

SEQ ID NO: 8492467 - DNA, 22 bp, Homo sapiens
gctgggcagctgaggcctctca

SEQ ID NO: 8492468 - DNA, 22 bp, Homo sapiens
gctgggcagcctggccgctgcc

SEQ ID NO: 8492469 - DNA, 22 bp, Homo sapiens
gctgggcagcctggccgctgcc

SEQ ID NO: 8492470 - DNA, 22 bp, Homo sapiens
gctgggcagcccctacagagag

SEQ ID NO: 8492471 - DNA, 22 bp, Homo sapiens
gctgggcagcaggctctccggg

SEQ ID NO: 8492472 - DNA, 22 bp, Homo sapiens
gctgggcagcccctacagagag

SEQ ID NO: 8492473 - DNA, 22 bp, Homo sapiens
gctgggcagcccctacagagag

SEQ ID NO: 8492474 - DNA, 22 bp, Homo sapiens
gctgggcagctgaggcctctca

SEQ ID NO: 8492475 - DNA, 22 bp, Homo sapiens
gctgggcaggcctcgtgagggc

SEQ ID NO: 8492476 - DNA, 22 bp, Homo sapiens
gctgggcagtgagtgagtcctt

SEQ ID NO: 8492477 - DNA, 22 bp, Homo sapiens
gctggccttgtgtctgaggaag

SEQ ID NO: 8492478 - DNA, 22 bp, Homo sapiens
gctggccttgtgtctgaggaag

SEQ ID NO: 8492479 - DNA, 22 bp, Homo sapiens
gctggccttgtgtctgaggaag

SEQ ID NO: 8492480 - DNA, 22 bp, Homo sapiens
gctggccttgtgtctgaggaag

SEQ ID NO: 8492481 - DNA, 22 bp, Homo sapiens
gctggccttgtgtctgaggaag

SEQ ID NO: 8492482 - DNA, 22 bp, Homo sapiens
gctggcctgggctcaagaccag

SEQ ID NO: 8492483 - DNA, 22 bp, Homo sapiens
gctggcctgtctagagccttac

SEQ ID NO: 8492484 - DNA, 22 bp, Homo sapiens
gctggcctgggcagcctgtcgg

SEQ ID NO: 8492485 - DNA, 22 bp, Homo sapiens
gctggcctgggctcaagaccag

SEQ ID NO: 8492486 - DNA, 22 bp, Homo sapiens
gctggcctgggcagaggctatg

SEQ ID NO: 8492487 - DNA, 22 bp, Homo sapiens
gctggcctgggcagcctgtcgg

SEQ ID NO: 8492488 - DNA, 22 bp, Homo sapiens
gctggcctgggcagcctgtcgg

SEQ ID NO: 8492489 - DNA, 22 bp, Homo sapiens
gctggcctgcgagggcaggctg

SEQ ID NO: 8492490 - DNA, 22 bp, Homo sapiens
gctggcctgcgagggcaggctg

SEQ ID NO: 8492491 - DNA, 22 bp, Homo sapiens
gctggcctgctgggcaccaccg

SEQ ID NO: 8492492 - DNA, 22 bp, Homo sapiens
gctggcctgctgggcaccaccg

SEQ ID NO: 8492493 - DNA, 22 bp, Homo sapiens
gctgggagttactgtctccttt

SEQ ID NO: 8492494 - DNA, 22 bp, Homo sapiens
gctgggagtgggcaagatgaga

SEQ ID NO: 8492495 - DNA, 22 bp, Homo sapiens
gctgggagtttgatttgactgg

SEQ ID NO: 8492496 - DNA, 22 bp, Homo sapiens
gctgggcaacggaagagagaaa

SEQ ID NO: 8492497 - DNA, 22 bp, Homo sapiens
gctgggatgcgtcttcccaggc

SEQ ID NO: 8492498 - DNA, 22 bp, Homo sapiens
gctgggagtgggcaagatgaga

SEQ ID NO: 8492499 - DNA, 22 bp, Homo sapiens
gctgggagtgggcaagatgaga

SEQ ID NO: 8492500 - DNA, 22 bp, Homo sapiens
gctgggagttactgtctccttt

SEQ ID NO: 8492501 - DNA, 22 bp, Homo sapiens
gctgggagtgggcaagatgaga

SEQ ID NO: 8492502 - DNA, 22 bp, Homo sapiens
gctggcctttgaggaagctgcg

SEQ ID NO: 8492503 - DNA, 22 bp, Homo sapiens
gaactgtataggagcagtgttt

SEQ ID NO: 8492504 - DNA, 22 bp, Homo sapiens
gaactgtcattggggacatcag

SEQ ID NO: 8492505 - DNA, 22 bp, Homo sapiens
gaactgtgggtaatatattaga

SEQ ID NO: 8492506 - DNA, 22 bp, Homo sapiens
gaactgtgtacattgtagataa

SEQ ID NO: 8492507 - DNA, 22 bp, Homo sapiens
gaactgtttctggtgaaagagt

SEQ ID NO: 8492508 - DNA, 22 bp, Homo sapiens
gaaggaagccgtttctctccag

SEQ ID NO: 8492509 - DNA, 22 bp, Homo sapiens
gaaggaagctgtctggatgtgt

SEQ ID NO: 8492510 - DNA, 22 bp, Homo sapiens
gaaggaagccgtttctctccag

SEQ ID NO: 8492511 - DNA, 22 bp, Homo sapiens
gaaggaagggctggctgtcttg

SEQ ID NO: 8492512 - DNA, 22 bp, Homo sapiens
gaaggaagggctggctgtcttg

SEQ ID NO: 8492513 - DNA, 22 bp, Homo sapiens
gaaggaagctgtctggatgtgt

SEQ ID NO: 8492514 - DNA, 21 bp, Homo sapiens
gaaggagaaagcaagtgctgc

SEQ ID NO: 8492515 - DNA, 22 bp, Homo sapiens
gaaggaagtgctcatactagtt

SEQ ID NO: 8492516 - DNA, 22 bp, Homo sapiens
gaaggaagtgctcatactagtt

SEQ ID NO: 8492517 - DNA, 22 bp, Homo sapiens
gaaggaagtcattagtgcagac

SEQ ID NO: 8492518 - DNA, 20 bp, Homo sapiens
gaaggaagggggcaaggtga

SEQ ID NO: 8492519 - DNA, 22 bp, Homo sapiens
gaaggagaggattgtgaggctg

SEQ ID NO: 8492520 - DNA, 22 bp, Homo sapiens
gaaggagaggattgtgaggctg

SEQ ID NO: 8492521 - DNA, 19 bp, Homo sapiens
gaaggagagctgagttagg

SEQ ID NO: 8492522 - DNA, 22 bp, Homo sapiens
gaaggagagggtcaaggataat

SEQ ID NO: 8492523 - DNA, 22 bp, Homo sapiens
gaaggagaggattgtgaggctg

SEQ ID NO: 8492524 - DNA, 22 bp, Homo sapiens
gaaggcctagggatgctctgcg

SEQ ID NO: 8492525 - DNA, 22 bp, Homo sapiens
gaaggcctcactctgcagcata

SEQ ID NO: 8492526 - DNA, 22 bp, Homo sapiens
gaaggctgagcagacaggccaa

SEQ ID NO: 8492527 - DNA, 22 bp, Homo sapiens
gaaggctctggggattgagata

SEQ ID NO: 8492528 - DNA, 22 bp, Homo sapiens
gaaggctgatgacagattctgc

SEQ ID NO: 8492529 - DNA, 22 bp, Homo sapiens
gaaggttttgattccactgaat

SEQ ID NO: 8492530 - DNA, 22 bp, Homo sapiens
gaaggttttgtttgcaaatcat

SEQ ID NO: 8492531 - DNA, 22 bp, Homo sapiens
gaagtacaaaggacatggaaac

SEQ ID NO: 8492532 - DNA, 22 bp, Homo sapiens
gaagtacaaaggacatggaaac

SEQ ID NO: 8492533 - DNA, 22 bp, Homo sapiens
gaaggttttcaggagcctagtc

SEQ ID NO: 8492534 - DNA, 22 bp, Homo sapiens
gaagtgatgacgctgtgttttt

SEQ ID NO: 8492535 - DNA, 22 bp, Homo sapiens
gaagtgcaacctgaaatactag

SEQ ID NO: 8492536 - DNA, 22 bp, Homo sapiens
gaagtgcaaaaccacatggtaa

SEQ ID NO: 8492537 - DNA, 22 bp, Homo sapiens
gaagtgaagagattagaaatca

SEQ ID NO: 8492538 - DNA, 22 bp, Homo sapiens
gaagtgaaggttactctagatt

SEQ ID NO: 8492539 - DNA, 18 bp, Homo sapiens
gaagtgaagtgactcaat

SEQ ID NO: 8492540 - DNA, 22 bp, Homo sapiens
gaagtgggctttgtggtcagct

SEQ ID NO: 8492541 - DNA, 22 bp, Homo sapiens
gaagtgggtggtgatatcactg

SEQ ID NO: 8492542 - DNA, 22 bp, Homo sapiens
gaagtgggctttgtggtcagct

SEQ ID NO: 8492543 - DNA, 20 bp, Homo sapiens
gaagtgtcttgtttctggat

SEQ ID NO: 8492544 - DNA, 22 bp, Homo sapiens
gaagtgtgcacatcttacaagt

SEQ ID NO: 8492545 - DNA, 22 bp, Homo sapiens
gaagttactctcgttaaatatg

SEQ ID NO: 8492546 - DNA, 22 bp, Homo sapiens
gaagttaccgaacctctccatg

SEQ ID NO: 8492547 - DNA, 22 bp, Homo sapiens
gacacagagctcacagtctcct

SEQ ID NO: 8492548 - DNA, 22 bp, Homo sapiens
gacacagagctcacagtctcct

SEQ ID NO: 8492549 - DNA, 22 bp, Homo sapiens
gacacagagctcacagtctcct

SEQ ID NO: 8492550 - DNA, 22 bp, Homo sapiens
gacacagagataggcctgtgtt

SEQ ID NO: 8492551 - DNA, 22 bp, Homo sapiens
gacacagagggcaccagatatg

SEQ ID NO: 8492552 - DNA, 22 bp, Homo sapiens
gacacagatatctctgagatta

SEQ ID NO: 8492553 - DNA, 22 bp, Homo sapiens
gacacagatatctctgagatta

SEQ ID NO: 8492554 - DNA, 22 bp, Homo sapiens
gacacagatgatcaggtgtgga

SEQ ID NO: 8492555 - DNA, 22 bp, Homo sapiens
gacacagatgatcaggtgtgga

SEQ ID NO: 8492556 - DNA, 22 bp, Homo sapiens
gacacagcttgatgagggcttt

SEQ ID NO: 8492557 - DNA, 22 bp, Homo sapiens
gacacaggattcctggctctgc

SEQ ID NO: 8492558 - DNA, 22 bp, Homo sapiens
gacacaggattcctggctctgc

SEQ ID NO: 8492559 - DNA, 23 bp, Homo sapiens
gacacaggagcacccagctgagc

SEQ ID NO: 8492560 - DNA, 23 bp, Homo sapiens
gacacaggagcacccagctgagc

SEQ ID NO: 8492561 - DNA, 20 bp, Homo sapiens
gacacaggcagtcctcagag

SEQ ID NO: 8492562 - DNA, 18 bp, Homo sapiens
gacacaggagagagtccc

SEQ ID NO: 8492563 - DNA, 22 bp, Homo sapiens
gacacaggaatcaccttggatg

SEQ ID NO: 8492564 - DNA, 22 bp, Homo sapiens
gacacagctttctgaagagcat

SEQ ID NO: 8492565 - DNA, 22 bp, Homo sapiens
gacaggaatgtgtggatgcgga

SEQ ID NO: 8492566 - DNA, 22 bp, Homo sapiens
gacaggaagtctgaaggaggga

SEQ ID NO: 8492567 - DNA, 22 bp, Homo sapiens
gacaggaacataaatgtaggag

SEQ ID NO: 8492568 - DNA, 19 bp, Homo sapiens
gacaggaaggctaccagta

SEQ ID NO: 8492569 - DNA, 20 bp, Homo sapiens
gacaggagagttaggtaggt

SEQ ID NO: 8492570 - DNA, 20 bp, Homo sapiens
gacaggagagttaggtaggt

SEQ ID NO: 8492571 - DNA, 22 bp, Homo sapiens
gacaggacttcactgtgttgcc

SEQ ID NO: 8492572 - DNA, 22 bp, Homo sapiens
gacaggaatgtgtggatgcgga

SEQ ID NO: 8492573 - DNA, 19 bp, Homo sapiens
gacaggacgaagggaagtt

SEQ ID NO: 8492574 - DNA, 22 bp, Homo sapiens
gacacagggggatgtgtggacg

SEQ ID NO: 8492575 - DNA, 22 bp, Homo sapiens
gacacagggggatgtgtggacg

SEQ ID NO: 8492576 - DNA, 22 bp, Homo sapiens
gacacaggggggcgctagaaga

SEQ ID NO: 8492577 - DNA, 22 bp, Homo sapiens
gacacagggggatgtgtggacg

SEQ ID NO: 8492578 - DNA, 22 bp, Homo sapiens
gacacagggacgtgctctgcct

SEQ ID NO: 8492579 - DNA, 22 bp, Homo sapiens
gacagctgtggagaggcatgtg

SEQ ID NO: 8492580 - DNA, 22 bp, Homo sapiens
gacagctgtggagaggcatgtg

SEQ ID NO: 8492581 - DNA, 22 bp, Homo sapiens
gacagctgtggagaggcatgtg

SEQ ID NO: 8492582 - DNA, 22 bp, Homo sapiens
gacagctgtggagaggcatgtg

SEQ ID NO: 8492583 - DNA, 22 bp, Homo sapiens
gacagctgtggagaggcatgtg

SEQ ID NO: 8492584 - DNA, 22 bp, Homo sapiens
gacagctgtgcaggagaagggg

SEQ ID NO: 8492585 - DNA, 22 bp, Homo sapiens
gacagctgtgcaggagaagggg

SEQ ID NO: 8492586 - DNA, 22 bp, Homo sapiens
gaattctagtcacacacattca

SEQ ID NO: 8492587 - DNA, 22 bp, Homo sapiens
gaattctagggtaaatatccta

SEQ ID NO: 8492588 - DNA, 22 bp, Homo sapiens
gaattcttttctttctgaaagt

SEQ ID NO: 8492589 - DNA, 23 bp, Homo sapiens
gaattcttaaggtcactaaagtc

SEQ ID NO: 8492590 - DNA, 22 bp, Homo sapiens
gaattgaattcatttactcaaa

SEQ ID NO: 8492591 - DNA, 22 bp, Homo sapiens
gaattgattgatatgtactgta

SEQ ID NO: 8492592 - DNA, 22 bp, Homo sapiens
gaattgtattgatttttcagag

SEQ ID NO: 8492593 - DNA, 22 bp, Homo sapiens
gaattgtatgctgtcttgatag

SEQ ID NO: 8492594 - DNA, 22 bp, Homo sapiens
gaattgtatgcagttacttgga

SEQ ID NO: 8492595 - DNA, 22 bp, Homo sapiens
gaattgtagagggaacagaagc

SEQ ID NO: 8492596 - DNA, 22 bp, Homo sapiens
gaatttaaaggccagacctgag

SEQ ID NO: 8492597 - DNA, 21 bp, Homo sapiens
gaattgtgccccttggtgttg

SEQ ID NO: 8492598 - DNA, 22 bp, Homo sapiens
gaattgtcttggccagtgagaa

SEQ ID NO: 8492599 - DNA, 22 bp, Homo sapiens
gaattgtacgctttacataggt

SEQ ID NO: 8492600 - DNA, 22 bp, Homo sapiens
gaatttaaatttaaatctacca

SEQ ID NO: 8492601 - DNA, 22 bp, Homo sapiens
gaatttaagaggatgaatctgt

SEQ ID NO: 8492602 - DNA, 22 bp, Homo sapiens
gaatttaagaggatgaatctgt

SEQ ID NO: 8492603 - DNA, 22 bp, Homo sapiens
gaatttaaggaccaagcatttt

SEQ ID NO: 8492604 - DNA, 22 bp, Homo sapiens
gacacagagataggcctgtgtt

SEQ ID NO: 8492605 - DNA, 22 bp, Homo sapiens
gaagttcaggtgggaattgagc

SEQ ID NO: 8492606 - DNA, 22 bp, Homo sapiens
gaagttcaggtgggaattgagc

SEQ ID NO: 8492607 - DNA, 22 bp, Homo sapiens
gaagttataaacttttcctccc

SEQ ID NO: 8492608 - DNA, 22 bp, Homo sapiens
gaagttatcaggattaaagttg

SEQ ID NO: 8492609 - DNA, 22 bp, Homo sapiens
gaagttatcaggattaaagttg

SEQ ID NO: 8492610 - DNA, 22 bp, Homo sapiens
gaagttatcaaagatgtattct

SEQ ID NO: 8492611 - DNA, 22 bp, Homo sapiens
gaagttatcaaagatgtattct

SEQ ID NO: 8492612 - DNA, 22 bp, Homo sapiens
gaagttatagctatgatcttaa

SEQ ID NO: 8492613 - DNA, 22 bp, Homo sapiens
gaagttatagctatgatcttaa

SEQ ID NO: 8492614 - DNA, 22 bp, Homo sapiens
gaagttatcaaagatgtattct

SEQ ID NO: 8492615 - DNA, 22 bp, Homo sapiens
gaagttattttacctgttaaag

SEQ ID NO: 8492616 - DNA, 22 bp, Homo sapiens
gaagttattttacctgttaaag

SEQ ID NO: 8492617 - DNA, 22 bp, Homo sapiens
gaagttatttgctatctactga

SEQ ID NO: 8492618 - DNA, 22 bp, Homo sapiens
gaagttattttacctgttaaag

SEQ ID NO: 8492619 - DNA, 22 bp, Homo sapiens
gaagttattttacctgttaaag

SEQ ID NO: 8492620 - DNA, 22 bp, Homo sapiens
gaagttatttcctggtgttgga

SEQ ID NO: 8492621 - DNA, 22 bp, Homo sapiens
gaagttatttgctatctactga

SEQ ID NO: 8492622 - DNA, 22 bp, Homo sapiens
gaagttatttgctatctactga

SEQ ID NO: 8492623 - DNA, 22 bp, Homo sapiens
gaagttatgaaatttggacagc

SEQ ID NO: 8492624 - DNA, 22 bp, Homo sapiens
gaagttattgcctgtgatgaaa

SEQ ID NO: 8492625 - DNA, 22 bp, Homo sapiens
gaagttattgcctgtgatgaaa

SEQ ID NO: 8492626 - DNA, 22 bp, Homo sapiens
gaattataggtttgcatgctaa

SEQ ID NO: 8492627 - DNA, 22 bp, Homo sapiens
gaattccactttggcttttggg

SEQ ID NO: 8492628 - DNA, 22 bp, Homo sapiens
gaattacatgaccctgagtaga

SEQ ID NO: 8492629 - DNA, 22 bp, Homo sapiens
gaattataggcaaagcagtcat

SEQ ID NO: 8492630 - DNA, 22 bp, Homo sapiens
gaattataaactagtgacttca

SEQ ID NO: 8492631 - DNA, 22 bp, Homo sapiens
gaattataaactagtgacttca

SEQ ID NO: 8492632 - DNA, 22 bp, Homo sapiens
gactgtacgtcattgaaggcca

SEQ ID NO: 8492633 - DNA, 22 bp, Homo sapiens
gactgtacttgagagaggaact

SEQ ID NO: 8492634 - DNA, 22 bp, Homo sapiens
gactgtacttgagagaggaact

SEQ ID NO: 8492635 - DNA, 22 bp, Homo sapiens
gactgtcattctagtgcccatg

SEQ ID NO: 8492636 - DNA, 22 bp, Homo sapiens
gactgtccagaattcctaggtg

SEQ ID NO: 8492637 - DNA, 22 bp, Homo sapiens
gactgtcattctagtgcccatg

SEQ ID NO: 8492638 - DNA, 22 bp, Homo sapiens
gacccagggtttctgcacaggg

SEQ ID NO: 8492639 - DNA, 22 bp, Homo sapiens
gacccagggtttctgcacaggg

SEQ ID NO: 8492640 - DNA, 22 bp, Homo sapiens
gacccagggtttctgcacaggg

SEQ ID NO: 8492641 - DNA, 22 bp, Homo sapiens
gacccagggtttctgcacaggg

SEQ ID NO: 8492642 - DNA, 22 bp, Homo sapiens
gacccagggtttctgcacaggg

SEQ ID NO: 8492643 - DNA, 22 bp, Homo sapiens
gactgcttatatgttaaagata

SEQ ID NO: 8492644 - DNA, 22 bp, Homo sapiens
gactggtcttttgtgatggatg

SEQ ID NO: 8492645 - DNA, 22 bp, Homo sapiens
gactggaaagcctgtcctcaga

SEQ ID NO: 8492646 - DNA, 22 bp, Homo sapiens
gactggaaagcctgtcctcaga

SEQ ID NO: 8492647 - DNA, 22 bp, Homo sapiens
gactggggtaaggtgaggaggt

SEQ ID NO: 8492648 - DNA, 19 bp, Homo sapiens
gacttctgatgtccagatg

SEQ ID NO: 8492649 - DNA, 22 bp, Homo sapiens
gacttctcggcaccctttggca

SEQ ID NO: 8492650 - DNA, 22 bp, Homo sapiens
gacttctccagactgcctggta

SEQ ID NO: 8492651 - DNA, 21 bp, Homo sapiens
gacttcatgggtcaaccaatt

SEQ ID NO: 8492652 - DNA, 22 bp, Homo sapiens
gacttcagatattttttaagtt

SEQ ID NO: 8492653 - DNA, 22 bp, Homo sapiens
gacttcataatattgagcatgt

SEQ ID NO: 8492654 - DNA, 22 bp, Homo sapiens
gacttcatgacattcaggtcag

SEQ ID NO: 8492655 - DNA, 22 bp, Homo sapiens
gacttcacaataatgtgacact

SEQ ID NO: 8492656 - DNA, 22 bp, Homo sapiens
gactgtgtccatgtgctggatt

SEQ ID NO: 8492657 - DNA, 22 bp, Homo sapiens
gactgttacctatatttatgtg

SEQ ID NO: 8492658 - DNA, 22 bp, Homo sapiens
gactgtgtccatgtgctggatt

SEQ ID NO: 8492659 - DNA, 22 bp, Homo sapiens
gacttaaaggctgaatgtagga

SEQ ID NO: 8492660 - DNA, 22 bp, Homo sapiens
gacttgggagtcttctgagatg

SEQ ID NO: 8492661 - DNA, 22 bp, Homo sapiens
gacttgggagtcttctgagatg

SEQ ID NO: 8492662 - DNA, 22 bp, Homo sapiens
gacttgggggctttggataggc

SEQ ID NO: 8492663 - DNA, 22 bp, Homo sapiens
gacttgggtggattgtgactct

SEQ ID NO: 8492664 - DNA, 22 bp, Homo sapiens
gacttgggtggattgtgactct

SEQ ID NO: 8492665 - DNA, 22 bp, Homo sapiens
gactttaaaatgctagaacagg

SEQ ID NO: 8492666 - DNA, 22 bp, Homo sapiens
gacaggcaattaccagcgccca

SEQ ID NO: 8492667 - DNA, 21 bp, Homo sapiens
gacaggcaaggagtcacttag

SEQ ID NO: 8492668 - DNA, 22 bp, Homo sapiens
gacaggcagacctgtgccctgg

SEQ ID NO: 8492669 - DNA, 22 bp, Homo sapiens
gacaggcagacctgtgccctgg

SEQ ID NO: 8492670 - DNA, 22 bp, Homo sapiens
gacaggcaggccagggctgtgg

SEQ ID NO: 8492671 - DNA, 22 bp, Homo sapiens
gacaggcacgaaattgggctgg

SEQ ID NO: 8492672 - DNA, 22 bp, Homo sapiens
gacaggcacgaaattgggctgg

SEQ ID NO: 8492673 - DNA, 22 bp, Homo sapiens
gacaggaggcagagctcaggtg

SEQ ID NO: 8492674 - DNA, 22 bp, Homo sapiens
gacaggaggcagagctcaggtg

SEQ ID NO: 8492675 - DNA, 22 bp, Homo sapiens
gacaggaggcagagctcaggtg

SEQ ID NO: 8492676 - DNA, 22 bp, Homo sapiens
gacaggaggcagagctcaggtg

SEQ ID NO: 8492677 - DNA, 20 bp, Homo sapiens
gacaggagagttaggtaggt

SEQ ID NO: 8492678 - DNA, 22 bp, Homo sapiens
gacaggaggcagagctcaggtg

SEQ ID NO: 8492679 - DNA, 22 bp, Homo sapiens
gacaggaggcagagctcaggtg

SEQ ID NO: 8492680 - DNA, 22 bp, Homo sapiens
gacaggaggcagagctcaggtg

SEQ ID NO: 8492681 - DNA, 22 bp, Homo sapiens
gacaggcaggccagggctgtgg

SEQ ID NO: 8492682 - DNA, 22 bp, Homo sapiens
gacaggcaggccagggctgtgg

SEQ ID NO: 8492683 - DNA, 22 bp, Homo sapiens
gacaggcagttttccagatcag

SEQ ID NO: 8492684 - DNA, 22 bp, Homo sapiens
gacaggcagttttccagatcag

SEQ ID NO: 8492685 - DNA, 22 bp, Homo sapiens
gaccatcctggccaacgtggta

SEQ ID NO: 8492686 - DNA, 22 bp, Homo sapiens
gaccagtcattactcatgccct

SEQ ID NO: 8492687 - DNA, 22 bp, Homo sapiens
gaccagtcattactcatgccct

SEQ ID NO: 8492688 - DNA, 22 bp, Homo sapiens
gaccagggtcactcacagggct

SEQ ID NO: 8492689 - DNA, 22 bp, Homo sapiens
gaccagggtcactcacagggct

SEQ ID NO: 8492690 - DNA, 22 bp, Homo sapiens
gacccaggggcagggagaaagt

SEQ ID NO: 8492691 - DNA, 22 bp, Homo sapiens
gacccaggggcagggagaaagt

SEQ ID NO: 8492692 - DNA, 22 bp, Homo sapiens
gacccagggtatccagagctgc

SEQ ID NO: 8492693 - DNA, 22 bp, Homo sapiens
gacccagggtatccagagctgc

SEQ ID NO: 8492694 - DNA, 22 bp, Homo sapiens
gacccagggtatccagagctgc

SEQ ID NO: 8492695 - DNA, 22 bp, Homo sapiens
gacccagggtggtcacctgaaa

SEQ ID NO: 8492696 - DNA, 22 bp, Homo sapiens
gacccaggagagagggttgcat

SEQ ID NO: 8492697 - DNA, 22 bp, Homo sapiens
gacccaggagtgcagagagtgg

SEQ ID NO: 8492698 - DNA, 22 bp, Homo sapiens
gacccaggagtgcagagagtgg

SEQ ID NO: 8492699 - DNA, 22 bp, Homo sapiens
gacccaggcctggggcttaagg

SEQ ID NO: 8492700 - DNA, 22 bp, Homo sapiens
gacccaggctcgtgggacggct

SEQ ID NO: 8492701 - DNA, 22 bp, Homo sapiens
gacccaggcccaaggctgccag

SEQ ID NO: 8492702 - DNA, 22 bp, Homo sapiens
gacccaggcccaaggctgccag

SEQ ID NO: 8492703 - DNA, 22 bp, Homo sapiens
gacccagcttaagtcacatgtt

SEQ ID NO: 8492704 - DNA, 22 bp, Homo sapiens
gaccatttctaggaatcagact

SEQ ID NO: 8492705 - DNA, 22 bp, Homo sapiens
gaccatttgttgaaaagattat

SEQ ID NO: 8492706 - DNA, 22 bp, Homo sapiens
gaccatttgctagtaaattgca

SEQ ID NO: 8492707 - DNA, 22 bp, Homo sapiens
gaccatttttacagagcattca

SEQ ID NO: 8492708 - DNA, 22 bp, Homo sapiens
gagaaaatagcatgtgtagtat

SEQ ID NO: 8492709 - DNA, 22 bp, Homo sapiens
gagaaaatagcatgtgtagtat

SEQ ID NO: 8492710 - DNA, 22 bp, Homo sapiens
gagaaaagcgaaggacctggag

SEQ ID NO: 8492711 - DNA, 22 bp, Homo sapiens
gactttgtgccaaacgccagaa

SEQ ID NO: 8492712 - DNA, 22 bp, Homo sapiens
gagaaaagcgaaggacctggag

SEQ ID NO: 8492713 - DNA, 22 bp, Homo sapiens
gagaaacaacacttgatgcctt

SEQ ID NO: 8492714 - DNA, 22 bp, Homo sapiens
gagacacaagaagacatgcaca

SEQ ID NO: 8492715 - DNA, 22 bp, Homo sapiens
gagaaacaacacttgatgcctt

SEQ ID NO: 8492716 - DNA, 22 bp, Homo sapiens
gagaaaatcttgggtcaagaat

SEQ ID NO: 8492717 - DNA, 22 bp, Homo sapiens
gagaaaatgtcagacttggtcg

SEQ ID NO: 8492718 - DNA, 22 bp, Homo sapiens
gagaaaatgtcagacttggtcg

SEQ ID NO: 8492719 - DNA, 22 bp, Homo sapiens
gactttattttaacggagattc

SEQ ID NO: 8492720 - DNA, 22 bp, Homo sapiens
gactttatttccttatttgtga

SEQ ID NO: 8492721 - DNA, 22 bp, Homo sapiens
gactttattatagtggcaatag

SEQ ID NO: 8492722 - DNA, 22 bp, Homo sapiens
gactttattatagtggcaatag

SEQ ID NO: 8492723 - DNA, 22 bp, Homo sapiens
gactttattcgttaactgttaa

SEQ ID NO: 8492724 - DNA, 22 bp, Homo sapiens
gactttattactaaccctgtga

SEQ ID NO: 8492725 - DNA, 22 bp, Homo sapiens
gactttatcttgtccttcctgc

SEQ ID NO: 8492726 - DNA, 22 bp, Homo sapiens
gactttatgaagagatgaccaa

SEQ ID NO: 8492727 - DNA, 20 bp, Homo sapiens
gactttacatcagcactctt

SEQ ID NO: 8492728 - DNA, 22 bp, Homo sapiens
gactttataaatgagaggcgga

SEQ ID NO: 8492729 - DNA, 22 bp, Homo sapiens
gactttatcctgcctgaccacg

SEQ ID NO: 8492730 - DNA, 22 bp, Homo sapiens
gagacagagaggtactcaacat

SEQ ID NO: 8492731 - DNA, 21 bp, Homo sapiens
gagacagactttcgtcccctg

SEQ ID NO: 8492732 - DNA, 22 bp, Homo sapiens
gagacacttgctgtgaggtcgc

SEQ ID NO: 8492733 - DNA, 22 bp, Homo sapiens
gagacacttgctgtgaggtcgc

SEQ ID NO: 8492734 - DNA, 22 bp, Homo sapiens
gagacactcaacaaagatatga

SEQ ID NO: 8492735 - DNA, 22 bp, Homo sapiens
gagacactcaacaaagatatga

SEQ ID NO: 8492736 - DNA, 22 bp, Homo sapiens
gagacacagttatcaggcatac

SEQ ID NO: 8492737 - DNA, 22 bp, Homo sapiens
gagacacagttatcaggcatac

SEQ ID NO: 8492738 - DNA, 22 bp, Homo sapiens
gagacacaggtggttcctgtca

SEQ ID NO: 8492739 - DNA, 22 bp, Homo sapiens
gagacacagttatcaggcatac

SEQ ID NO: 8492740 - DNA, 22 bp, Homo sapiens
gagacacagttatcaggcatac

SEQ ID NO: 8492741 - DNA, 22 bp, Homo sapiens
gagacacagcagatattcaatc

SEQ ID NO: 8492742 - DNA, 22 bp, Homo sapiens
gagacacagcagatattcaatc

SEQ ID NO: 8492743 - DNA, 22 bp, Homo sapiens
gagacacaggcacagaagaggc

SEQ ID NO: 8492744 - DNA, 22 bp, Homo sapiens
gagacacaagaagacatgcaca

SEQ ID NO: 8492745 - DNA, 18 bp, Homo sapiens
gagacacaagggcctgga

SEQ ID NO: 8492746 - DNA, 18 bp, Homo sapiens
gagacacaagggcctgga

SEQ ID NO: 8492747 - DNA, 18 bp, Homo sapiens
gagacacaagggcctgga

SEQ ID NO: 8492748 - DNA, 22 bp, Homo sapiens
gagacacaatctcatttacatt

SEQ ID NO: 8492749 - DNA, 22 bp, Homo sapiens
gagacacaatttccccatccta

SEQ ID NO: 8492750 - DNA, 22 bp, Homo sapiens
gagacacacccaaggttatgag

SEQ ID NO: 8492751 - DNA, 22 bp, Homo sapiens
gagacacacccaaggttatgag

SEQ ID NO: 8492752 - DNA, 22 bp, Homo sapiens
gagacacacccaaggttatgag

SEQ ID NO: 8492753 - DNA, 22 bp, Homo sapiens
gagacacacacaggaggtggca

SEQ ID NO: 8492754 - DNA, 22 bp, Homo sapiens
gagacacacattctggagagaa

SEQ ID NO: 8492755 - DNA, 20 bp, Homo sapiens
gagagctggaaataaagtcc

SEQ ID NO: 8492756 - DNA, 20 bp, Homo sapiens
gagagctggaaataaagtcc

SEQ ID NO: 8492757 - DNA, 17 bp, Homo sapiens
gagagctgctgcttccg

SEQ ID NO: 8492758 - DNA, 17 bp, Homo sapiens
gagagctgctgcttccg

SEQ ID NO: 8492759 - DNA, 17 bp, Homo sapiens
gagagctgctgcttccg

SEQ ID NO: 8492760 - DNA, 17 bp, Homo sapiens
gagagctgctgcttccg

SEQ ID NO: 8492761 - DNA, 18 bp, Homo sapiens
gagagctgctacctagct

SEQ ID NO: 8492762 - DNA, 17 bp, Homo sapiens
gagagctgctgcttccg

SEQ ID NO: 8492763 - DNA, 22 bp, Homo sapiens
gagagctgcattctcagacaca

SEQ ID NO: 8492764 - DNA, 22 bp, Homo sapiens
gagagctgcattctcagacaca

SEQ ID NO: 8492765 - DNA, 22 bp, Homo sapiens
gagagctgcattctcagacaca

SEQ ID NO: 8492766 - DNA, 22 bp, Homo sapiens
gagagctgcagccgagaggggg

SEQ ID NO: 8492767 - DNA, 22 bp, Homo sapiens
gagagctgcagccgagaggggg

SEQ ID NO: 8492768 - DNA, 22 bp, Homo sapiens
gagagctgcagccgagaggggg

SEQ ID NO: 8492769 - DNA, 22 bp, Homo sapiens
gagagctgcagccgagaggggg

SEQ ID NO: 8492770 - DNA, 22 bp, Homo sapiens
gagagctgcaaggtagggcggg

SEQ ID NO: 8492771 - DNA, 22 bp, Homo sapiens
gagagctgcaaggtagggcggg

SEQ ID NO: 8492772 - DNA, 22 bp, Homo sapiens
gagagctgcaaggtagggcggg

SEQ ID NO: 8492773 - DNA, 23 bp, Homo sapiens
gagagctgactgtcaagactgtt

SEQ ID NO: 8492774 - DNA, 22 bp, Homo sapiens
gagagctgatagatgagctact

SEQ ID NO: 8492775 - DNA, 22 bp, Homo sapiens
gagagctgatagatgagctact

SEQ ID NO: 8492776 - DNA, 22 bp, Homo sapiens
gagagctgatagatgagctact

SEQ ID NO: 8492777 - DNA, 22 bp, Homo sapiens
gagagctgatagatgagctact

SEQ ID NO: 8492778 - DNA, 22 bp, Homo sapiens
gagacagagatcttgctgagtc

SEQ ID NO: 8492779 - DNA, 22 bp, Homo sapiens
gagacagagatcttgctgagtc

SEQ ID NO: 8492780 - DNA, 22 bp, Homo sapiens
gagacagagatcttgctgagtc

SEQ ID NO: 8492781 - DNA, 22 bp, Homo sapiens
gagacagagtttcactcttgtt

SEQ ID NO: 8492782 - DNA, 22 bp, Homo sapiens
gagacagatctcggctccatgc

SEQ ID NO: 8492783 - DNA, 22 bp, Homo sapiens
gagacagagtttcactcttgtt

SEQ ID NO: 8492784 - DNA, 22 bp, Homo sapiens
gagagctatttggcaagcattt

SEQ ID NO: 8492785 - DNA, 22 bp, Homo sapiens
gagagctaggccactggggctt

SEQ ID NO: 8492786 - DNA, 22 bp, Homo sapiens
gagagctatttggcaagcattt

SEQ ID NO: 8492787 - DNA, 23 bp, Homo sapiens
gagagctgactgtcaagactgtt

SEQ ID NO: 8492788 - DNA, 23 bp, Homo sapiens
gagagctgactgtcaagactgtt

SEQ ID NO: 8492789 - DNA, 22 bp, Homo sapiens
gagagccctgctcctatcccag

SEQ ID NO: 8492790 - DNA, 21 bp, Homo sapiens
gagagctaacagtgacagctc

SEQ ID NO: 8492791 - DNA, 22 bp, Homo sapiens
gagagctaactacctggaaatg

SEQ ID NO: 8492792 - DNA, 22 bp, Homo sapiens
gagagctgggaaagccgtggag

SEQ ID NO: 8492793 - DNA, 22 bp, Homo sapiens
gagagctgggaaagccgtggag

SEQ ID NO: 8492794 - DNA, 22 bp, Homo sapiens
gagagctggccagcttcagtat

SEQ ID NO: 8492795 - DNA, 22 bp, Homo sapiens
gagagctggccagcttcagtat

SEQ ID NO: 8492796 - DNA, 22 bp, Homo sapiens
gagagctggattctggataggt

SEQ ID NO: 8492797 - DNA, 22 bp, Homo sapiens
gagagctggattctggataggt

SEQ ID NO: 8492798 - DNA, 22 bp, Homo sapiens
gagagctggattctggataggt

SEQ ID NO: 8492799 - DNA, 22 bp, Homo sapiens
gagagctggattctggataggt

SEQ ID NO: 8492800 - DNA, 22 bp, Homo sapiens
gagagctgggctttgggtgaag

SEQ ID NO: 8492801 - DNA, 22 bp, Homo sapiens
gagagctgggctttgggtgaag

SEQ ID NO: 8492802 - DNA, 22 bp, Homo sapiens
gagagctgggctttgggtgaag

SEQ ID NO: 8492803 - DNA, 22 bp, Homo sapiens
gagagctgggaaagccgtggag

SEQ ID NO: 8492804 - DNA, 22 bp, Homo sapiens
gagagctgggctttgggtgaag

SEQ ID NO: 8492805 - DNA, 20 bp, Homo sapiens
gagagctggggatgaggctg

SEQ ID NO: 8492806 - DNA, 20 bp, Homo sapiens
gagagctggggatgaggctg

SEQ ID NO: 8492807 - DNA, 22 bp, Homo sapiens
gagagctgggggactgtggatg

SEQ ID NO: 8492808 - DNA, 22 bp, Homo sapiens
gagagctgggttcaagtagctg

SEQ ID NO: 8492809 - DNA, 22 bp, Homo sapiens
gagagctgggttcaagtagctg

SEQ ID NO: 8492810 - DNA, 22 bp, Homo sapiens
gagagctgggttcaagtagctg

SEQ ID NO: 8492811 - DNA, 22 bp, Homo sapiens
gagagctgtaatagtcatgtct

SEQ ID NO: 8492812 - DNA, 22 bp, Homo sapiens
gagagctgtaatagtcatgtct

SEQ ID NO: 8492813 - DNA, 22 bp, Homo sapiens
gagagctgggggactgtggatg

SEQ ID NO: 8492814 - DNA, 22 bp, Homo sapiens
gagagctgggggactgtggatg

SEQ ID NO: 8492815 - DNA, 22 bp, Homo sapiens
gagagctgggggactgtggatg

SEQ ID NO: 8492816 - DNA, 20 bp, Homo sapiens
gagagctggggatgaggctg

SEQ ID NO: 8492817 - DNA, 22 bp, Homo sapiens
gagagtccttagtttgcaggta

SEQ ID NO: 8492818 - DNA, 22 bp, Homo sapiens
gagagtccttagtttgcaggta

SEQ ID NO: 8492819 - DNA, 22 bp, Homo sapiens
gagaggtagaggctctgcttaa

SEQ ID NO: 8492820 - DNA, 22 bp, Homo sapiens
gagaggtacggaaagagcgtgg

SEQ ID NO: 8492821 - DNA, 22 bp, Homo sapiens
gagaggtacaccctttaaactt

SEQ ID NO: 8492822 - DNA, 22 bp, Homo sapiens
gagaggtacggaaagagcgtgg

SEQ ID NO: 8492823 - DNA, 22 bp, Homo sapiens
gagagtctaggaacctcatata

SEQ ID NO: 8492824 - DNA, 22 bp, Homo sapiens
gagagtctaggaacctcatata

SEQ ID NO: 8492825 - DNA, 22 bp, Homo sapiens
gaaagtttcttcattaagatgt

SEQ ID NO: 8492826 - DNA, 22 bp, Homo sapiens
gaaataatacagtgctcttctc

SEQ ID NO: 8492827 - DNA, 22 bp, Homo sapiens
gaaataatacagtgctcttctc

SEQ ID NO: 8492828 - DNA, 22 bp, Homo sapiens
gaaataatacagtgctcttctc

SEQ ID NO: 8492829 - DNA, 22 bp, Homo sapiens
gaaataagagtccatgccaggt

SEQ ID NO: 8492830 - DNA, 22 bp, Homo sapiens
gaaataacctcatgcaccatga

SEQ ID NO: 8492831 - DNA, 22 bp, Homo sapiens
gaaataacctcatgcaccatga

SEQ ID NO: 8492832 - DNA, 22 bp, Homo sapiens
gaaataacagctctggaagagt

SEQ ID NO: 8492833 - DNA, 22 bp, Homo sapiens
gaaataacagctctggaagagt

SEQ ID NO: 8492834 - DNA, 22 bp, Homo sapiens
gaaagttttctcacacagtaat

SEQ ID NO: 8492835 - DNA, 22 bp, Homo sapiens
gaaataatttagaaggtattcc

SEQ ID NO: 8492836 - DNA, 22 bp, Homo sapiens
gaaataatttagaaggtattcc

SEQ ID NO: 8492837 - DNA, 22 bp, Homo sapiens
gaaataatttagaaggtattcc

SEQ ID NO: 8492838 - DNA, 22 bp, Homo sapiens
gaaataattctgtgtctgaaca

SEQ ID NO: 8492839 - DNA, 22 bp, Homo sapiens
gaaataattctgtgtctgaaca

SEQ ID NO: 8492840 - DNA, 22 bp, Homo sapiens
gaaataattctgtgtctgaaca

SEQ ID NO: 8492841 - DNA, 22 bp, Homo sapiens
gaaataatacagtgctcttctc

SEQ ID NO: 8492842 - DNA, 22 bp, Homo sapiens
gaaataatttagaaggtattcc

SEQ ID NO: 8492843 - DNA, 22 bp, Homo sapiens
gaaatacaaagccagccatttt

SEQ ID NO: 8492844 - DNA, 22 bp, Homo sapiens
gaaatacaaagccagccatttt

SEQ ID NO: 8492845 - DNA, 22 bp, Homo sapiens
gaaatacaaatgcctagatcct

SEQ ID NO: 8492846 - DNA, 22 bp, Homo sapiens
gaacacagcagggataaccact

SEQ ID NO: 8492847 - DNA, 22 bp, Homo sapiens
gaacacaagcgtatgtctttgt

SEQ ID NO: 8492848 - DNA, 22 bp, Homo sapiens
gaaatttattatctacatcatt

SEQ ID NO: 8492849 - DNA, 22 bp, Homo sapiens
gaaatttacaactttctcatgg

SEQ ID NO: 8492850 - DNA, 22 bp, Homo sapiens
gaaatttacaactttctcatgg

SEQ ID NO: 8492851 - DNA, 22 bp, Homo sapiens
gaacactgacattttcctgact

SEQ ID NO: 8492852 - DNA, 22 bp, Homo sapiens
gaacactgagaaagtcagcttt

SEQ ID NO: 8492853 - DNA, 22 bp, Homo sapiens
gaacacatttctctgactgtag

SEQ ID NO: 8492854 - DNA, 22 bp, Homo sapiens
gaacacatgtcctccttggatt

SEQ ID NO: 8492855 - DNA, 22 bp, Homo sapiens
gaacacagtcaagggctgctgt

SEQ ID NO: 8492856 - DNA, 22 bp, Homo sapiens
gaacacagtacttttcctgatg

SEQ ID NO: 8492857 - DNA, 22 bp, Homo sapiens
gaacacagtcaagggctgctgt

SEQ ID NO: 8492858 - DNA, 22 bp, Homo sapiens
gaacacagtgtgatcgtatgtc

SEQ ID NO: 8492859 - DNA, 22 bp, Homo sapiens
gaacagagctgactacaaggca

SEQ ID NO: 8492860 - DNA, 22 bp, Homo sapiens
gaacagagaagctttactaaag

SEQ ID NO: 8492861 - DNA, 22 bp, Homo sapiens
gaacagactttgccaattacag

SEQ ID NO: 8492862 - DNA, 22 bp, Homo sapiens
gaacagatgcctgattcatagg

SEQ ID NO: 8492863 - DNA, 22 bp, Homo sapiens
gaacagatgggctcagatcctg

SEQ ID NO: 8492864 - DNA, 22 bp, Homo sapiens
gaacagagttgaaacaaggctg

SEQ ID NO: 8492865 - DNA, 21 bp, Homo sapiens
gaacccagcagcagtgctctg

SEQ ID NO: 8492866 - DNA, 23 bp, Homo sapiens
gaacccagctctgccacttgcca

SEQ ID NO: 8492867 - DNA, 23 bp, Homo sapiens
gaacccagctctgccacttgcca

SEQ ID NO: 8492868 - DNA, 22 bp, Homo sapiens
gaacccaggaggttgcagtgag

SEQ ID NO: 8492869 - DNA, 23 bp, Homo sapiens
gaacccagctctgccacttgcca

SEQ ID NO: 8492870 - DNA, 22 bp, Homo sapiens
gaacccagtccaggtgcagcct

SEQ ID NO: 8492871 - DNA, 22 bp, Homo sapiens
gaacccaggaggttgcagtgag

SEQ ID NO: 8492872 - DNA, 22 bp, Homo sapiens
gaacctctagtttgttctttga

SEQ ID NO: 8492873 - DNA, 22 bp, Homo sapiens
gaaccccaacttataagacaga

SEQ ID NO: 8492874 - DNA, 22 bp, Homo sapiens
gaacagaagaggctggtgccac

SEQ ID NO: 8492875 - DNA, 22 bp, Homo sapiens
gaacagaattaccgaagatctg

SEQ ID NO: 8492876 - DNA, 22 bp, Homo sapiens
gaacacttgctgttaataagtg

SEQ ID NO: 8492877 - DNA, 22 bp, Homo sapiens
gaacactgaggacactgagaat

SEQ ID NO: 8492878 - DNA, 22 bp, Homo sapiens
gaacactgaggacactgagaat

SEQ ID NO: 8492879 - DNA, 22 bp, Homo sapiens
gaacactgaggacactgagaat

SEQ ID NO: 8492880 - DNA, 22 bp, Homo sapiens
gaacactgtttcttcgtgaaca

SEQ ID NO: 8492881 - DNA, 22 bp, Homo sapiens
gaacactggggtatcattgagc

SEQ ID NO: 8492882 - DNA, 22 bp, Homo sapiens
gaacactggggtatcattgagc

SEQ ID NO: 8492883 - DNA, 22 bp, Homo sapiens
gaacctctttaaagaacagaat

SEQ ID NO: 8492884 - DNA, 22 bp, Homo sapiens
gaacctctttagtgcatccttc

SEQ ID NO: 8492885 - DNA, 22 bp, Homo sapiens
gaacctctttgtgcttcagctt

SEQ ID NO: 8492886 - DNA, 22 bp, Homo sapiens
gaacctctatatttgtgacatc

SEQ ID NO: 8492887 - DNA, 22 bp, Homo sapiens
gaacctctcagcagccatgatc

SEQ ID NO: 8492888 - DNA, 20 bp, Homo sapiens
gaacctctcccagcccctgg

SEQ ID NO: 8492889 - DNA, 22 bp, Homo sapiens
gaacctgatccaatatttactc

SEQ ID NO: 8492890 - DNA, 21 bp, Homo sapiens
gaacctgagtgaagacttggg

SEQ ID NO: 8492891 - DNA, 22 bp, Homo sapiens
gaacctgagcgggcagcaagcg

SEQ ID NO: 8492892 - DNA, 22 bp, Homo sapiens
gaacctgagcccaggtggcatt

SEQ ID NO: 8492893 - DNA, 22 bp, Homo sapiens
gaacctgtaagtatagatgtgg

SEQ ID NO: 8492894 - DNA, 22 bp, Homo sapiens
gaacctgtcctgagtgaggagt

SEQ ID NO: 8492895 - DNA, 22 bp, Homo sapiens
gaacctgtttatgttacctgcg

SEQ ID NO: 8492896 - DNA, 22 bp, Homo sapiens
gaacctggaatctattacaagg

SEQ ID NO: 8492897 - DNA, 22 bp, Homo sapiens
gaacctggaatgtggcgcccaa

SEQ ID NO: 8492898 - DNA, 22 bp, Homo sapiens
gaacctggcagccctatatctg

SEQ ID NO: 8492899 - DNA, 20 bp, Homo sapiens
gaacctggggaaggagtagg

SEQ ID NO: 8492900 - DNA, 20 bp, Homo sapiens
gaacctggggaaggagtagg

SEQ ID NO: 8492901 - DNA, 22 bp, Homo sapiens
gaactaaaagctaacatcaggc

SEQ ID NO: 8492902 - DNA, 22 bp, Homo sapiens
gaactaaaagctaacatcaggc

SEQ ID NO: 8492903 - DNA, 22 bp, Homo sapiens
gaactaaatgaaattactggtg

SEQ ID NO: 8492904 - DNA, 22 bp, Homo sapiens
gaactaaatgaaattactggtg

SEQ ID NO: 8492905 - DNA, 22 bp, Homo sapiens
gaactacagtgcattttcttaa

SEQ ID NO: 8492906 - DNA, 22 bp, Homo sapiens
gaactacagtgcattttcttaa

SEQ ID NO: 8492907 - DNA, 22 bp, Homo sapiens
gaactacagtaagaattgatgt

SEQ ID NO: 8492908 - DNA, 22 bp, Homo sapiens
gaactacaggtgcagcaagtga

SEQ ID NO: 8492909 - DNA, 22 bp, Homo sapiens
gaactacagtaagaattgatgt

SEQ ID NO: 8492910 - DNA, 22 bp, Homo sapiens
gaactaaatttgacagacaaca

SEQ ID NO: 8492911 - DNA, 22 bp, Homo sapiens
gaactccagatgactcaggaac

SEQ ID NO: 8492912 - DNA, 22 bp, Homo sapiens
gaactatatcttcaagaaaatg

SEQ ID NO: 8492913 - DNA, 22 bp, Homo sapiens
gaactatatcttcaagaaaatg

SEQ ID NO: 8492914 - DNA, 22 bp, Homo sapiens
gaactgggtccttgagtctaga

SEQ ID NO: 8492915 - DNA, 22 bp, Homo sapiens
gaaaggttcttgggagttcaca

SEQ ID NO: 8492916 - DNA, 22 bp, Homo sapiens
gaaaggttgggtgaatggtgga

SEQ ID NO: 8492917 - DNA, 22 bp, Homo sapiens
gaaagtgcatgtgcccaccatt

SEQ ID NO: 8492918 - DNA, 22 bp, Homo sapiens
gaaagtgccagaataggaggcc

SEQ ID NO: 8492919 - DNA, 22 bp, Homo sapiens
gaaagtgcatgtgcccaccatt

SEQ ID NO: 8492920 - DNA, 18 bp, Homo sapiens
gaaagtgcggggcagggg

SEQ ID NO: 8492921 - DNA, 18 bp, Homo sapiens
gaaagtgcggggcagggg

SEQ ID NO: 8492922 - DNA, 22 bp, Homo sapiens
gaaagtgcctcagtcctcttat

SEQ ID NO: 8492923 - DNA, 22 bp, Homo sapiens
gaaagtgccagaataggaggcc

SEQ ID NO: 8492924 - DNA, 22 bp, Homo sapiens
gaaagtgcctcagtcctcttat

SEQ ID NO: 8492925 - DNA, 22 bp, Homo sapiens
gaaaggtgccccataggcagga

SEQ ID NO: 8492926 - DNA, 22 bp, Homo sapiens
gaaagggtctttgatttccctc

SEQ ID NO: 8492927 - DNA, 22 bp, Homo sapiens
gaaaggggcatgtagggatcac

SEQ ID NO: 8492928 - DNA, 22 bp, Homo sapiens
gaaagtgcttagagtgtggtat

SEQ ID NO: 8492929 - DNA, 22 bp, Homo sapiens
gaaagtgctctctctatacaca

SEQ ID NO: 8492930 - DNA, 22 bp, Homo sapiens
gaaagtgctctctctatacaca

SEQ ID NO: 8492931 - DNA, 22 bp, Homo sapiens
gaaagtgctaggaagtgttaga

SEQ ID NO: 8492932 - DNA, 22 bp, Homo sapiens
gaaagtgctaggaagtgttaga

SEQ ID NO: 8492933 - DNA, 22 bp, Homo sapiens
gaaagtgcttttgagtgtgtgc

SEQ ID NO: 8492934 - DNA, 22 bp, Homo sapiens
gaaagtgcttttgagtgtgtgc

SEQ ID NO: 8492935 - DNA, 22 bp, Homo sapiens
gaaagtgcttagagtgtggtat

SEQ ID NO: 8492936 - DNA, 22 bp, Homo sapiens
gaaagtttctcacacatgcaga

SEQ ID NO: 8492937 - DNA, 22 bp, Homo sapiens
gaaagtttataggttatataat

SEQ ID NO: 8492938 - DNA, 22 bp, Homo sapiens
gaaaggcatcttcagtctctga

SEQ ID NO: 8492939 - DNA, 18 bp, Homo sapiens
gaaaatactctgggctca

SEQ ID NO: 8492940 - DNA, 21 bp, Homo sapiens
gaaaatacaatgagcttgacc

SEQ ID NO: 8492941 - DNA, 22 bp, Homo sapiens
gaaaatacaaatagccttgaaa

SEQ ID NO: 8492942 - DNA, 22 bp, Homo sapiens
gaaaagtatgtttattttgact

SEQ ID NO: 8492943 - DNA, 22 bp, Homo sapiens
gaaaagttcatcatatattcag

SEQ ID NO: 8492944 - DNA, 22 bp, Homo sapiens
gaaaagtatgtttattttgact

SEQ ID NO: 8492945 - DNA, 22 bp, Homo sapiens
gaaaagttcatcatatattcag

SEQ ID NO: 8492946 - DNA, 22 bp, Homo sapiens
gaaaagttcatcatatattcag

SEQ ID NO: 8492947 - DNA, 22 bp, Homo sapiens
gaaaagtatgtttattttgact

SEQ ID NO: 8492948 - DNA, 22 bp, Homo sapiens
gaaaggccacgtgccaagatta

SEQ ID NO: 8492949 - DNA, 22 bp, Homo sapiens
gaaaggccagctcacagatgag

SEQ ID NO: 8492950 - DNA, 22 bp, Homo sapiens
ctttgtgatagtgttaagacca

SEQ ID NO: 8492951 - DNA, 22 bp, Homo sapiens
ctttgtgatgaggcctaagaca

SEQ ID NO: 8492952 - DNA, 22 bp, Homo sapiens
ctttgttagcagccaatttgtt

SEQ ID NO: 8492953 - DNA, 22 bp, Homo sapiens
ctttgtgtctgttaataattat

SEQ ID NO: 8492954 - DNA, 22 bp, Homo sapiens
ctttgtgtctgttaataattat

SEQ ID NO: 8492955 - DNA, 22 bp, Homo sapiens
ctttgttcatgacatctgcttc

SEQ ID NO: 8492956 - DNA, 22 bp, Homo sapiens
ctttgttatctgtaaatggtta

SEQ ID NO: 8492957 - DNA, 22 bp, Homo sapiens
ctttgtttatatttctcctcga

SEQ ID NO: 8492958 - DNA, 22 bp, Homo sapiens
ctttgttgttaattggcgctta

SEQ ID NO: 8492959 - DNA, 22 bp, Homo sapiens
cttttaatgagcattgctgtct

SEQ ID NO: 8492960 - DNA, 22 bp, Homo sapiens
cttttaagggataataagatgt

SEQ ID NO: 8492961 - DNA, 23 bp, Homo sapiens
cttttaacttgatctgagaccag

SEQ ID NO: 8492962 - DNA, 22 bp, Homo sapiens
ctttgttttactcagaggcatg

SEQ ID NO: 8492963 - DNA, 23 bp, Homo sapiens
cttttaacttgatctgagaccag

SEQ ID NO: 8492964 - DNA, 23 bp, Homo sapiens
cttttaactagagtatcagctgc

SEQ ID NO: 8492965 - DNA, 22 bp, Homo sapiens
cttttaatgggagcagtatttg

SEQ ID NO: 8492966 - DNA, 22 bp, Homo sapiens
cttttaatgagcattgctgtct

SEQ ID NO: 8492967 - DNA, 17 bp, Homo sapiens
cttttaatttacttccc

SEQ ID NO: 8492968 - DNA, 22 bp, Homo sapiens
gaaaacactttgatctgaaagt

SEQ ID NO: 8492969 - DNA, 22 bp, Homo sapiens
gaaaacatccagagatagacct

SEQ ID NO: 8492970 - DNA, 22 bp, Homo sapiens
cttttacactcatctgggaggg

SEQ ID NO: 8492971 - DNA, 17 bp, Homo sapiens
cttttaatttacttccc

SEQ ID NO: 8492972 - DNA, 22 bp, Homo sapiens
gaaaaggattggtaaaatatct

SEQ ID NO: 8492973 - DNA, 22 bp, Homo sapiens
gaaaaggattggtaaaatatct

SEQ ID NO: 8492974 - DNA, 22 bp, Homo sapiens
gaaaaggattggtaaaatatct

SEQ ID NO: 8492975 - DNA, 22 bp, Homo sapiens
gaaaagtacacagcccaaacat

SEQ ID NO: 8492976 - DNA, 22 bp, Homo sapiens
gaaaagtatgtttattttgact

SEQ ID NO: 8492977 - DNA, 22 bp, Homo sapiens
gaaaagtatgtttattttgact

SEQ ID NO: 8492978 - DNA, 22 bp, Homo sapiens
gaaaacatccagagatagacct

SEQ ID NO: 8492979 - DNA, 22 bp, Homo sapiens
gaaaacatccagagatagacct

SEQ ID NO: 8492980 - DNA, 22 bp, Homo sapiens
gaaaagctaggccagttcagct

SEQ ID NO: 8492981 - DNA, 22 bp, Homo sapiens
gaaaaggaaatttatagagatc

SEQ ID NO: 8492982 - DNA, 22 bp, Homo sapiens
gaaaaggaaatttatagagatc

SEQ ID NO: 8492983 - DNA, 21 bp, Homo sapiens
gaaaagcaagggagtagaaca

SEQ ID NO: 8492984 - DNA, 22 bp, Homo sapiens
ctggctggttactatttctggt

SEQ ID NO: 8492985 - DNA, 22 bp, Homo sapiens
ctggctggttactatttctggt

SEQ ID NO: 8492986 - DNA, 22 bp, Homo sapiens
ctggctgtcttggaggaaggag

SEQ ID NO: 8492987 - DNA, 22 bp, Homo sapiens
ctggctgtcttctgggagctgt

SEQ ID NO: 8492988 - DNA, 22 bp, Homo sapiens
ctggctgtattagtttgatcct

SEQ ID NO: 8492989 - DNA, 22 bp, Homo sapiens
ctggctgtattagtttgatcct

SEQ ID NO: 8492990 - DNA, 22 bp, Homo sapiens
ctggctgtatgctggcctcaga

SEQ ID NO: 8492991 - DNA, 22 bp, Homo sapiens
ctggctgtatgctggcctcaga

SEQ ID NO: 8492992 - DNA, 22 bp, Homo sapiens
ctggctgtaagcgtgtttccta

SEQ ID NO: 8492993 - DNA, 22 bp, Homo sapiens
ctggctgtaacattttgccata

SEQ ID NO: 8492994 - DNA, 22 bp, Homo sapiens
cttctcagttgcaagtgtcaga

SEQ ID NO: 8492995 - DNA, 22 bp, Homo sapiens
cttctcagttgcaagtgtcaga

SEQ ID NO: 8492996 - DNA, 22 bp, Homo sapiens
cttctcagtcacctgtgagtct

SEQ ID NO: 8492997 - DNA, 22 bp, Homo sapiens
cttctcagtcacctgtgagtct

SEQ ID NO: 8492998 - DNA, 22 bp, Homo sapiens
cttctcggggttcccgcgccct

SEQ ID NO: 8492999 - DNA, 22 bp, Homo sapiens
cttctccagccacgcccactcc

SEQ ID NO: 8493000 - DNA, 22 bp, Homo sapiens
cttctcattcaagcaaaacaga

SEQ ID NO: 8493001 - DNA, 22 bp, Homo sapiens
cttctctccctggcactcagac

SEQ ID NO: 8493002 - DNA, 22 bp, Homo sapiens
cttctctccctggcactcagac

SEQ ID NO: 8493003 - DNA, 22 bp, Homo sapiens
cttctctacttcctggaagggg

SEQ ID NO: 8493004 - DNA, 22 bp, Homo sapiens
cttctctccctggcactcagac

SEQ ID NO: 8493005 - DNA, 22 bp, Homo sapiens
cttctctcggtgcatccctcac

SEQ ID NO: 8493006 - DNA, 22 bp, Homo sapiens
cttctctcggtgcatccctcac

SEQ ID NO: 8493007 - DNA, 22 bp, Homo sapiens
cttctctcggtgcatccctcac

SEQ ID NO: 8493008 - DNA, 22 bp, Homo sapiens
ctggctggggtaccagttgaac

SEQ ID NO: 8493009 - DNA, 22 bp, Homo sapiens
ctggctgggcagacagaatgct

SEQ ID NO: 8493010 - DNA, 22 bp, Homo sapiens
ctggctggaggtgagtcactga

SEQ ID NO: 8493011 - DNA, 22 bp, Homo sapiens
ctggctgggagctcgcctgcgg

SEQ ID NO: 8493012 - DNA, 22 bp, Homo sapiens
ctggctggagtgcaggtgagtg

SEQ ID NO: 8493013 - DNA, 22 bp, Homo sapiens
ctggctggtcatcagcagtacg

SEQ ID NO: 8493014 - DNA, 22 bp, Homo sapiens
ctggctgggttccaggattcca

SEQ ID NO: 8493015 - DNA, 22 bp, Homo sapiens
ctggctggtaatggaacgacag

SEQ ID NO: 8493016 - DNA, 22 bp, Homo sapiens
ctggctgggttccaggattcca

SEQ ID NO: 8493017 - DNA, 22 bp, Homo sapiens
ctggctggtcctcggggacagc

SEQ ID NO: 8493018 - DNA, 22 bp, Homo sapiens
ctggctggtcatgtcatgagcc

SEQ ID NO: 8493019 - DNA, 22 bp, Homo sapiens
ctggctggtcatgtcatgagcc

SEQ ID NO: 8493020 - DNA, 22 bp, Homo sapiens
cttctcttcccagggacacagg

SEQ ID NO: 8493021 - DNA, 22 bp, Homo sapiens
cttctctggctcctcagcgccc

SEQ ID NO: 8493022 - DNA, 22 bp, Homo sapiens
cttctcttcctttgtcaactga

SEQ ID NO: 8493023 - DNA, 22 bp, Homo sapiens
cttctcttcctttgtcaactga

SEQ ID NO: 8493024 - DNA, 22 bp, Homo sapiens
cttctcttcctttgtcaactga

SEQ ID NO: 8493025 - DNA, 22 bp, Homo sapiens
cttctcttgggtgtggtgtctt

SEQ ID NO: 8493026 - DNA, 22 bp, Homo sapiens
cttctcttcctttgtcaactga

SEQ ID NO: 8493027 - DNA, 22 bp, Homo sapiens
cttctcttggtagttcttgttg

SEQ ID NO: 8493028 - DNA, 22 bp, Homo sapiens
cttcttcttttaataaatgtct

SEQ ID NO: 8493029 - DNA, 22 bp, Homo sapiens
cttcttcttttgtgggtggtaa

SEQ ID NO: 8493030 - DNA, 22 bp, Homo sapiens
cttcttgagcatgggtagtact

SEQ ID NO: 8493031 - DNA, 22 bp, Homo sapiens
cttctctctgcataggcatggg

SEQ ID NO: 8493032 - DNA, 22 bp, Homo sapiens
cttctctctgcataggcatggg

SEQ ID NO: 8493033 - DNA, 22 bp, Homo sapiens
cttctctctgcataggcatggg

SEQ ID NO: 8493034 - DNA, 22 bp, Homo sapiens
cttctctgacagtctgtttcac

SEQ ID NO: 8493035 - DNA, 23 bp, Homo sapiens
cttctctgagctaggaatgctct

SEQ ID NO: 8493036 - DNA, 22 bp, Homo sapiens
cttctctgcaccccacttttgc

SEQ ID NO: 8493037 - DNA, 17 bp, Homo sapiens
cttctctggcagaagat

SEQ ID NO: 8493038 - DNA, 22 bp, Homo sapiens
cttctctgcccataggaaatgc

SEQ ID NO: 8493039 - DNA, 22 bp, Homo sapiens
cttctctggcatagcaagcagg

SEQ ID NO: 8493040 - DNA, 22 bp, Homo sapiens
cttctctggcagatgtgtgtcc

SEQ ID NO: 8493041 - DNA, 22 bp, Homo sapiens
cttctctggctcctcagcgccc

SEQ ID NO: 8493042 - DNA, 22 bp, Homo sapiens
cttctctggctcctcagcgccc

SEQ ID NO: 8493043 - DNA, 22 bp, Homo sapiens
cttgaaaaatatgccttgcttc

SEQ ID NO: 8493044 - DNA, 22 bp, Homo sapiens
cttcttttgaagggcgttgtgt

SEQ ID NO: 8493045 - DNA, 22 bp, Homo sapiens
cttgaaagaagggtcttttaat

SEQ ID NO: 8493046 - DNA, 22 bp, Homo sapiens
cttgaaaataagaaagactttc

SEQ ID NO: 8493047 - DNA, 22 bp, Homo sapiens
cttgaaatgacaggagcacatc

SEQ ID NO: 8493048 - DNA, 19 bp, Homo sapiens
cttgaaatgagactgaagg

SEQ ID NO: 8493049 - DNA, 22 bp, Homo sapiens
cttgaactcaatgtgaggaaga

SEQ ID NO: 8493050 - DNA, 22 bp, Homo sapiens
cttgaagacaatggcagattcc

SEQ ID NO: 8493051 - DNA, 20 bp, Homo sapiens
cttgaactgattctatttcc

SEQ ID NO: 8493052 - DNA, 22 bp, Homo sapiens
cttgaaatccagatttcagagg

SEQ ID NO: 8493053 - DNA, 22 bp, Homo sapiens
cttgaaatccagatttcagagg

SEQ ID NO: 8493054 - DNA, 22 bp, Homo sapiens
cttgaaatgacaggagcacatc

SEQ ID NO: 8493055 - DNA, 22 bp, Homo sapiens
cttgaaatccagatttcagagg

SEQ ID NO: 8493056 - DNA, 22 bp, Homo sapiens
cttctttcccaggcatgtttta

SEQ ID NO: 8493057 - DNA, 22 bp, Homo sapiens
cttctttagggatctcttgctg

SEQ ID NO: 8493058 - DNA, 22 bp, Homo sapiens
cttctttcccaggcatgtttta

SEQ ID NO: 8493059 - DNA, 22 bp, Homo sapiens
cttctttcccaggcatgtttta

SEQ ID NO: 8493060 - DNA, 22 bp, Homo sapiens
cttctttcccaggcatgtttta

SEQ ID NO: 8493061 - DNA, 22 bp, Homo sapiens
cttctttccttcctccagtggc

SEQ ID NO: 8493062 - DNA, 22 bp, Homo sapiens
cttctttgaaaaaggcagtcag

SEQ ID NO: 8493063 - DNA, 22 bp, Homo sapiens
cttctttcttttgatcacaggt

SEQ ID NO: 8493064 - DNA, 22 bp, Homo sapiens
cttctttgtgcctattggtgac

SEQ ID NO: 8493065 - DNA, 22 bp, Homo sapiens
cttctttgttctgttgtctcac

SEQ ID NO: 8493066 - DNA, 22 bp, Homo sapiens
cttctttgttctgttgtctcac

SEQ ID NO: 8493067 - DNA, 22 bp, Homo sapiens
cttctttgttctgttgtctcac

SEQ ID NO: 8493068 - DNA, 22 bp, Homo sapiens
cttcttttacaggtcttgggtt

SEQ ID NO: 8493069 - DNA, 22 bp, Homo sapiens
cttcttttcatggcttgggaag

SEQ ID NO: 8493070 - DNA, 22 bp, Homo sapiens
ctttagaatttgatataatcaa

SEQ ID NO: 8493071 - DNA, 22 bp, Homo sapiens
ctttagaatttcatgtttggtc

SEQ ID NO: 8493072 - DNA, 22 bp, Homo sapiens
ctttagaatttgatataatcaa

SEQ ID NO: 8493073 - DNA, 22 bp, Homo sapiens
ctttagaatttgatataatcaa

SEQ ID NO: 8493074 - DNA, 22 bp, Homo sapiens
ctttagaaatctggatgtattt

SEQ ID NO: 8493075 - DNA, 20 bp, Homo sapiens
ctttagaagaacccaagcat

SEQ ID NO: 8493076 - DNA, 22 bp, Homo sapiens
ctttagaagggtaacggaatta

SEQ ID NO: 8493077 - DNA, 22 bp, Homo sapiens
ctttacaacctaagttgaagct

SEQ ID NO: 8493078 - DNA, 22 bp, Homo sapiens
ctttagtttaagaacatgatga

SEQ ID NO: 8493079 - DNA, 22 bp, Homo sapiens
ctttagttagtagataatggca

SEQ ID NO: 8493080 - DNA, 22 bp, Homo sapiens
ctttagttagtagataatggca

SEQ ID NO: 8493081 - DNA, 20 bp, Homo sapiens
ctttagttattaacagcact

SEQ ID NO: 8493082 - DNA, 22 bp, Homo sapiens
ctttaggttttgcctgagatct

SEQ ID NO: 8493083 - DNA, 22 bp, Homo sapiens
ctttagcaacgatgatgatatt

SEQ ID NO: 8493084 - DNA, 22 bp, Homo sapiens
ctttggcagcctctgctattga

SEQ ID NO: 8493085 - DNA, 22 bp, Homo sapiens
ctttggttctgtccttcccaga

SEQ ID NO: 8493086 - DNA, 21 bp, Homo sapiens
ctttggtttctgacttgcata

SEQ ID NO: 8493087 - DNA, 22 bp, Homo sapiens
ctttgtaagtctttctccaaga

SEQ ID NO: 8493088 - DNA, 22 bp, Homo sapiens
ctttgtattcagttgggctgtg

SEQ ID NO: 8493089 - DNA, 22 bp, Homo sapiens
ctttgtatctaaatatcttgaa

SEQ ID NO: 8493090 - DNA, 22 bp, Homo sapiens
ctttgtagctgcttctgattta

SEQ ID NO: 8493091 - DNA, 22 bp, Homo sapiens
ctttgtaatcattcccttggtt

SEQ ID NO: 8493092 - DNA, 19 bp, Homo sapiens
ctttgtcagaacatgcttc

SEQ ID NO: 8493093 - DNA, 19 bp, Homo sapiens
ctttgtcagaacatgcttc

SEQ ID NO: 8493094 - DNA, 19 bp, Homo sapiens
ctttgtcagaacatgcttc

SEQ ID NO: 8493095 - DNA, 17 bp, Homo sapiens
ctttgtcaccaatgcca

SEQ ID NO: 8493096 - DNA, 22 bp, Homo sapiens
ctttgtattcatccgtaataat

SEQ ID NO: 8493097 - DNA, 22 bp, Homo sapiens
ctttatctagggtaagaaaacc

SEQ ID NO: 8493098 - DNA, 22 bp, Homo sapiens
ctttatcagaaaacacattagg

SEQ ID NO: 8493099 - DNA, 22 bp, Homo sapiens
ctttatcatggaggtaaatatg

SEQ ID NO: 8493100 - DNA, 22 bp, Homo sapiens
ctttatgaacctgttcagcttg

SEQ ID NO: 8493101 - DNA, 22 bp, Homo sapiens
ctttatgaaggaacaatgctcc

SEQ ID NO: 8493102 - DNA, 22 bp, Homo sapiens
ctttatgaaaacctgaattatg

SEQ ID NO: 8493103 - DNA, 22 bp, Homo sapiens
ctttatgaaaaccagattgggg

SEQ ID NO: 8493104 - DNA, 22 bp, Homo sapiens
ctttatgactgagttgtcaatt

SEQ ID NO: 8493105 - DNA, 22 bp, Homo sapiens
ctttatgagccttgtgaaggag

SEQ ID NO: 8493106 - DNA, 22 bp, Homo sapiens
ctttggcagcctcagctgcagg

SEQ ID NO: 8493107 - DNA, 22 bp, Homo sapiens
cttgaatgaaaccaactgatga

SEQ ID NO: 8493108 - DNA, 23 bp, Homo sapiens
cttgaatgggatggaattcactg

SEQ ID NO: 8493109 - DNA, 22 bp, Homo sapiens
cttgaatgaaaccaactgatga

SEQ ID NO: 8493110 - DNA, 22 bp, Homo sapiens
cttgaatcttctgagtatttgc

SEQ ID NO: 8493111 - DNA, 22 bp, Homo sapiens
cttgaatgtaaataatgtacag

SEQ ID NO: 8493112 - DNA, 22 bp, Homo sapiens
cttgaatgtcctgtggcaaagt

SEQ ID NO: 8493113 - DNA, 22 bp, Homo sapiens
cttgaatgtaaataatgtacag

SEQ ID NO: 8493114 - DNA, 22 bp, Homo sapiens
cttgaatggtatgagagtaatt

SEQ ID NO: 8493115 - DNA, 22 bp, Homo sapiens
cttgaatggtatgagagtaatt

SEQ ID NO: 8493116 - DNA, 22 bp, Homo sapiens
cttgaatgggccataagacggt

SEQ ID NO: 8493117 - DNA, 22 bp, Homo sapiens
cttgaatgggccataagacggt

SEQ ID NO: 8493118 - DNA, 22 bp, Homo sapiens
cttggcacttgggcagtgagca

SEQ ID NO: 8493119 - DNA, 22 bp, Homo sapiens
cttggcacttgggcagtgagca

SEQ ID NO: 8493120 - DNA, 22 bp, Homo sapiens
cttggcaccaccaagtggccat

SEQ ID NO: 8493121 - DNA, 21 bp, Homo sapiens
cttggcacagggaagatgcac

SEQ ID NO: 8493122 - DNA, 22 bp, Homo sapiens
cttggctgcttttgtgcacatt

SEQ ID NO: 8493123 - DNA, 22 bp, Homo sapiens
cttggctgtaaaatcagaggct

SEQ ID NO: 8493124 - DNA, 21 bp, Homo sapiens
cttggctgcagtgacaggcat

SEQ ID NO: 8493125 - DNA, 22 bp, Homo sapiens
cttggcttttgctcccagatca

SEQ ID NO: 8493126 - DNA, 22 bp, Homo sapiens
cttggggctgtcactctggcat

SEQ ID NO: 8493127 - DNA, 22 bp, Homo sapiens
ctttacaacctaagttgaagct

SEQ ID NO: 8493128 - DNA, 22 bp, Homo sapiens
cttgggcttagaaggtaagtga

SEQ ID NO: 8493129 - DNA, 22 bp, Homo sapiens
cttggggatgcaaagccagtgt

SEQ ID NO: 8493130 - DNA, 22 bp, Homo sapiens
cttggggattttaaagacctct

SEQ ID NO: 8493131 - DNA, 22 bp, Homo sapiens
cttggggattttaaagacctct

SEQ ID NO: 8493132 - DNA, 22 bp, Homo sapiens
cttggggacacagagcccaggg

SEQ ID NO: 8493133 - DNA, 22 bp, Homo sapiens
cttggggaggacgcagtgtcct

SEQ ID NO: 8493134 - DNA, 23 bp, Homo sapiens
cttgggctagagacttagcagtg

SEQ ID NO: 8493135 - DNA, 22 bp, Homo sapiens
cttgggagtagaggcaggagca

SEQ ID NO: 8493136 - DNA, 22 bp, Homo sapiens
cttgggagacacaagaagacat

SEQ ID NO: 8493137 - DNA, 22 bp, Homo sapiens
cttgggagacacaagaagacat

SEQ ID NO: 8493138 - DNA, 22 bp, Homo sapiens
cttgggagacacaagaagacat

SEQ ID NO: 8493139 - DNA, 22 bp, Homo sapiens
cttgggaggggagcattggcct

SEQ ID NO: 8493140 - DNA, 22 bp, Homo sapiens
cttgggaggcagaggttgcagt

SEQ ID NO: 8493141 - DNA, 22 bp, Homo sapiens
cttgggagtagaggcaggagca

SEQ ID NO: 8493142 - DNA, 22 bp, Homo sapiens
cttgggagtagaggcaggagca

SEQ ID NO: 8493143 - DNA, 22 bp, Homo sapiens
gagtgcagtatgagaggctgct

SEQ ID NO: 8493144 - DNA, 22 bp, Homo sapiens
gagtgcagtatgagaggctgct

SEQ ID NO: 8493145 - DNA, 22 bp, Homo sapiens
gagtgcagtatgagaggctgct

SEQ ID NO: 8493146 - DNA, 22 bp, Homo sapiens
gagtgcagttggggtgagggga

SEQ ID NO: 8493147 - DNA, 22 bp, Homo sapiens
gagtgcagttggggtgagggga

SEQ ID NO: 8493148 - DNA, 22 bp, Homo sapiens
gagtgccaagagaagaggctgg

SEQ ID NO: 8493149 - DNA, 22 bp, Homo sapiens
gagtgccaagagaagaggctgg

SEQ ID NO: 8493150 - DNA, 22 bp, Homo sapiens
gagtgccagatggacctcttgg

SEQ ID NO: 8493151 - DNA, 22 bp, Homo sapiens
gagtgcgtgtttggggatgtgg

SEQ ID NO: 8493152 - DNA, 22 bp, Homo sapiens
gagtgctggggtgcagagaggt

SEQ ID NO: 8493153 - DNA, 17 bp, Homo sapiens
gagtgctggtggagctc

SEQ ID NO: 8493154 - DNA, 17 bp, Homo sapiens
gagtgctggtggagctc

SEQ ID NO: 8493155 - DNA, 22 bp, Homo sapiens
gagtgctgtaggactgagccct

SEQ ID NO: 8493156 - DNA, 22 bp, Homo sapiens
gagtgctgctaatgcaagggtg

SEQ ID NO: 8493157 - DNA, 22 bp, Homo sapiens
gagtgctgcttgggatagtgag

SEQ ID NO: 8493158 - DNA, 22 bp, Homo sapiens
gagtgctggaggtgtgagtggg

SEQ ID NO: 8493159 - DNA, 21 bp, Homo sapiens
gagtggaacgctcttcacacc

SEQ ID NO: 8493160 - DNA, 20 bp, Homo sapiens
gagtgctttggcttgctctc

SEQ ID NO: 8493161 - DNA, 22 bp, Homo sapiens
gagtggagatcgtgccactgca

SEQ ID NO: 8493162 - DNA, 22 bp, Homo sapiens
gagtggagatcgtgccactgca

SEQ ID NO: 8493163 - DNA, 22 bp, Homo sapiens
gagtggagcaaaagaggtagat

SEQ ID NO: 8493164 - DNA, 22 bp, Homo sapiens
gagtggagcaaaagaggtagat

SEQ ID NO: 8493165 - DNA, 22 bp, Homo sapiens
gagtggagcaaaagaggtagat

SEQ ID NO: 8493166 - DNA, 22 bp, Homo sapiens
gagtggagcaaaagaggtagat

SEQ ID NO: 8493167 - DNA, 22 bp, Homo sapiens
gagtggcagaactgggggtcct

SEQ ID NO: 8493168 - DNA, 22 bp, Homo sapiens
gagtggagcaaaagaggtagat

SEQ ID NO: 8493169 - DNA, 22 bp, Homo sapiens
gagtggcatatgtgcctgtgaa

SEQ ID NO: 8493170 - DNA, 21 bp, Homo sapiens
gagtgggacatgggagtggtt

SEQ ID NO: 8493171 - DNA, 21 bp, Homo sapiens
gagtgggacatgggagtggtt

SEQ ID NO: 8493172 - DNA, 21 bp, Homo sapiens
gagtgggacatgggagtggtt

SEQ ID NO: 8493173 - DNA, 21 bp, Homo sapiens
gagtgggacatgggagtggtt

SEQ ID NO: 8493174 - DNA, 22 bp, Homo sapiens
gagtggggctttaaaggctcag

SEQ ID NO: 8493175 - DNA, 22 bp, Homo sapiens
gagtggggctttaaaggctcag

SEQ ID NO: 8493176 - DNA, 22 bp, Homo sapiens
gagtggcatatgtgcctgtgaa

SEQ ID NO: 8493177 - DNA, 22 bp, Homo sapiens
gagtggctgtgtacatgcccag

SEQ ID NO: 8493178 - DNA, 22 bp, Homo sapiens
gagtccttaatacactggtgga

SEQ ID NO: 8493179 - DNA, 21 bp, Homo sapiens
gagtccttccaatgtcctcag

SEQ ID NO: 8493180 - DNA, 19 bp, Homo sapiens
gagtcctgtgctccttgtt

SEQ ID NO: 8493181 - DNA, 21 bp, Homo sapiens
gagtcctggctagggtggcag

SEQ ID NO: 8493182 - DNA, 22 bp, Homo sapiens
gagtcctgcccttgtgtagtcc

SEQ ID NO: 8493183 - DNA, 22 bp, Homo sapiens
gagtcctggagaaacgcaggtg

SEQ ID NO: 8493184 - DNA, 22 bp, Homo sapiens
gagtcctggaaccctgaatgct

SEQ ID NO: 8493185 - DNA, 22 bp, Homo sapiens
gagtccttccagcaggcattta

SEQ ID NO: 8493186 - DNA, 22 bp, Homo sapiens
gagtccttggcatcatcagtac

SEQ ID NO: 8493187 - DNA, 22 bp, Homo sapiens
gagtcctttgttccttgccaca

SEQ ID NO: 8493188 - DNA, 22 bp, Homo sapiens
gagtccttttcatagcagtggg

SEQ ID NO: 8493189 - DNA, 22 bp, Homo sapiens
gagtctctgaccagggtgccaa

SEQ ID NO: 8493190 - DNA, 22 bp, Homo sapiens
gagtctcctactggctgtcctt

SEQ ID NO: 8493191 - DNA, 22 bp, Homo sapiens
gagtctccaatccatgcctgtc

SEQ ID NO: 8493192 - DNA, 22 bp, Homo sapiens
gagtctcctactggctgtcctt

SEQ ID NO: 8493193 - DNA, 18 bp, Homo sapiens
gagtctttgttactgctg

SEQ ID NO: 8493194 - DNA, 22 bp, Homo sapiens
gagtctttggtaaagtctgctg

SEQ ID NO: 8493195 - DNA, 22 bp, Homo sapiens
gagtgactctagaaagtttctt

SEQ ID NO: 8493196 - DNA, 22 bp, Homo sapiens
gagtctggtgatggtcattgtc

SEQ ID NO: 8493197 - DNA, 22 bp, Homo sapiens
gagtcttctacgctcacacaaa

SEQ ID NO: 8493198 - DNA, 22 bp, Homo sapiens
gagtctctggaggggtcagacc

SEQ ID NO: 8493199 - DNA, 22 bp, Homo sapiens
gagtctgagagcctaatgacct

SEQ ID NO: 8493200 - DNA, 22 bp, Homo sapiens
gagtctgagagcctaatgacct

SEQ ID NO: 8493201 - DNA, 22 bp, Homo sapiens
gagtctgaggggagagctgggt

SEQ ID NO: 8493202 - DNA, 22 bp, Homo sapiens
gagtctggaatgatgaagacct

SEQ ID NO: 8493203 - DNA, 22 bp, Homo sapiens
gagtctggccctgatgcatcat

SEQ ID NO: 8493204 - DNA, 22 bp, Homo sapiens
gagtgagtggccaggaggcaga

SEQ ID NO: 8493205 - DNA, 22 bp, Homo sapiens
gagtgagtgctgggctgaggct

SEQ ID NO: 8493206 - DNA, 22 bp, Homo sapiens
gagtgagggccaacatccagct

SEQ ID NO: 8493207 - DNA, 22 bp, Homo sapiens
gagtgagggccaacatccagct

SEQ ID NO: 8493208 - DNA, 22 bp, Homo sapiens
gagtgagggcagcaggggctgc

SEQ ID NO: 8493209 - DNA, 22 bp, Homo sapiens
gagtgagggcagcaggggctgc

SEQ ID NO: 8493210 - DNA, 22 bp, Homo sapiens
gagtgaggctggaatcatggct

SEQ ID NO: 8493211 - DNA, 22 bp, Homo sapiens
gagttttaacctcagctctctg

SEQ ID NO: 8493212 - DNA, 22 bp, Homo sapiens
gagtttgggtggaaggagggta

SEQ ID NO: 8493213 - DNA, 22 bp, Homo sapiens
gataaaataactatggaatact

SEQ ID NO: 8493214 - DNA, 22 bp, Homo sapiens
gataaaagaggaaatttgttca

SEQ ID NO: 8493215 - DNA, 22 bp, Homo sapiens
gataaaagaggaaatttgttca

SEQ ID NO: 8493216 - DNA, 22 bp, Homo sapiens
gagttgaagaaatagttttgat

SEQ ID NO: 8493217 - DNA, 22 bp, Homo sapiens
gagttgttcaacgtgtgtgaaa

SEQ ID NO: 8493218 - DNA, 22 bp, Homo sapiens
gagtttattcaggaaatagcca

SEQ ID NO: 8493219 - DNA, 22 bp, Homo sapiens
gataaacatgggagaaaggaat

SEQ ID NO: 8493220 - DNA, 22 bp, Homo sapiens
gataaacatgggagaaaggaat

SEQ ID NO: 8493221 - DNA, 22 bp, Homo sapiens
gataaactggaaccattgcctc

SEQ ID NO: 8493222 - DNA, 22 bp, Homo sapiens
gataaacatgggagaaaggaat

SEQ ID NO: 8493223 - DNA, 22 bp, Homo sapiens
gataaacactgatgatatgggg

SEQ ID NO: 8493224 - DNA, 22 bp, Homo sapiens
gataaaattcttattttacccg

SEQ ID NO: 8493225 - DNA, 22 bp, Homo sapiens
gataaacacaaggtgatttcat

SEQ ID NO: 8493226 - DNA, 22 bp, Homo sapiens
gataaacacaaggtgatttcat

SEQ ID NO: 8493227 - DNA, 22 bp, Homo sapiens
gataaaataactatggaatact

SEQ ID NO: 8493228 - DNA, 22 bp, Homo sapiens
gataaaatatgtggcctttagt

SEQ ID NO: 8493229 - DNA, 22 bp, Homo sapiens
gataaaatatgtggcctttagt

SEQ ID NO: 8493230 - DNA, 20 bp, Homo sapiens
gataaattgtctcttaagtg

SEQ ID NO: 8493231 - DNA, 20 bp, Homo sapiens
gataaattgtctcttaagtg

SEQ ID NO: 8493232 - DNA, 22 bp, Homo sapiens
gataaacttgtggagttttggt

SEQ ID NO: 8493233 - DNA, 22 bp, Homo sapiens
gataaacttgtggagttttggt

SEQ ID NO: 8493234 - DNA, 22 bp, Homo sapiens
gataaagcaaggatgactgaag

SEQ ID NO: 8493235 - DNA, 21 bp, Homo sapiens
gataaagcagcttgcctaagg

SEQ ID NO: 8493236 - DNA, 22 bp, Homo sapiens
gataaatggctgaagaaatagt

SEQ ID NO: 8493237 - DNA, 22 bp, Homo sapiens
gataaagtagatttgttctaga

SEQ ID NO: 8493238 - DNA, 22 bp, Homo sapiens
gagttaaaggaaaataacttta

SEQ ID NO: 8493239 - DNA, 22 bp, Homo sapiens
gagttaaaggaaaataacttta

SEQ ID NO: 8493240 - DNA, 22 bp, Homo sapiens
gagttaaaggcagttgaggaaa

SEQ ID NO: 8493241 - DNA, 22 bp, Homo sapiens
gagttctattatggttagaagt

SEQ ID NO: 8493242 - DNA, 22 bp, Homo sapiens
gagttctgaactgtgaaatgca

SEQ ID NO: 8493243 - DNA, 22 bp, Homo sapiens
gagttctcaagcaatcaaagag

SEQ ID NO: 8493244 - DNA, 22 bp, Homo sapiens
gagtgtgttctttatgctgtga

SEQ ID NO: 8493245 - DNA, 22 bp, Homo sapiens
gagtgtgttctttatgctgtga

SEQ ID NO: 8493246 - DNA, 22 bp, Homo sapiens
gagtgttcccacaccccagttg

SEQ ID NO: 8493247 - DNA, 22 bp, Homo sapiens
gagtgtgtcggtcagcgtggcg

SEQ ID NO: 8493248 - DNA, 22 bp, Homo sapiens
gagtgtgtgacttcactttagc

SEQ ID NO: 8493249 - DNA, 22 bp, Homo sapiens
gagtgtggtgaacaggagcacc

SEQ ID NO: 8493250 - DNA, 22 bp, Homo sapiens
gagtgtggtgaacaggagcacc

SEQ ID NO: 8493251 - DNA, 22 bp, Homo sapiens
gagtgtgtcggtcagcgtggcg

SEQ ID NO: 8493252 - DNA, 22 bp, Homo sapiens
gagtgtggtatgctctgaggct

SEQ ID NO: 8493253 - DNA, 22 bp, Homo sapiens
gagtgtggtgaacaggagcacc

SEQ ID NO: 8493254 - DNA, 22 bp, Homo sapiens
gagtgtggtatgctctgaggct

SEQ ID NO: 8493255 - DNA, 22 bp, Homo sapiens
gagtgtgggggtgctgaggaca

SEQ ID NO: 8493256 - DNA, 22 bp, Homo sapiens
gagtgtggtatgctctgaggct

SEQ ID NO: 8493257 - DNA, 22 bp, Homo sapiens
gagtgtggtgaacaggagcacc

SEQ ID NO: 8493258 - DNA, 22 bp, Homo sapiens
gagtgtggtgaacaggagcacc

SEQ ID NO: 8493259 - DNA, 22 bp, Homo sapiens
gagtgtggtgaacaggagcacc

SEQ ID NO: 8493260 - DNA, 22 bp, Homo sapiens
gagtgtgggggtgctgaggaca

SEQ ID NO: 8493261 - DNA, 22 bp, Homo sapiens
gagtgtgggggtgctgaggaca

SEQ ID NO: 8493262 - DNA, 22 bp, Homo sapiens
gagtgtgggggtgctgaggaca

SEQ ID NO: 8493263 - DNA, 22 bp, Homo sapiens
gagtgtgggtctcagctttaag

SEQ ID NO: 8493264 - DNA, 22 bp, Homo sapiens
gagtgtgggtctcagctttaag

SEQ ID NO: 8493265 - DNA, 22 bp, Homo sapiens
gagtgtgggcacgggggccttg

SEQ ID NO: 8493266 - DNA, 22 bp, Homo sapiens
gagtgtgggcacgggggccttg

SEQ ID NO: 8493267 - DNA, 22 bp, Homo sapiens
gagtgtggatcccagaagcaga

SEQ ID NO: 8493268 - DNA, 22 bp, Homo sapiens
gagtgtggatcccagaagcaga

SEQ ID NO: 8493269 - DNA, 22 bp, Homo sapiens
gagtgtggatcccagaagcaga

SEQ ID NO: 8493270 - DNA, 22 bp, Homo sapiens
gagtgtctgtgacagctcatga

SEQ ID NO: 8493271 - DNA, 22 bp, Homo sapiens
gagtgtctgtggggcatggaca

SEQ ID NO: 8493272 - DNA, 18 bp, Homo sapiens
gagtgtggcactgggccc

SEQ ID NO: 8493273 - DNA, 22 bp, Homo sapiens
gagtgtgggcacgggggccttg

SEQ ID NO: 8493274 - DNA, 22 bp, Homo sapiens
gagtgtgggcacgggggccttg

SEQ ID NO: 8493275 - DNA, 18 bp, Homo sapiens
gagtgtggcactgggccc

SEQ ID NO: 8493276 - DNA, 18 bp, Homo sapiens
gagtgtggcactgggccc

SEQ ID NO: 8493277 - DNA, 18 bp, Homo sapiens
gagtgtggcactgggccc

SEQ ID NO: 8493278 - DNA, 18 bp, Homo sapiens
gagtgtggcactgggccc

SEQ ID NO: 8493279 - DNA, 22 bp, Homo sapiens
gagtggggggtccgtctcagtg

SEQ ID NO: 8493280 - DNA, 22 bp, Homo sapiens
gagtggggtctgggcatcagtc

SEQ ID NO: 8493281 - DNA, 22 bp, Homo sapiens
gagtggggtctgggcatcagtc

SEQ ID NO: 8493282 - DNA, 22 bp, Homo sapiens
gagtggggggtccgtctcagtg

SEQ ID NO: 8493283 - DNA, 22 bp, Homo sapiens
gagtggggggtccgtctcagtg

SEQ ID NO: 8493284 - DNA, 22 bp, Homo sapiens
gagtggggctttaaaggctcag

SEQ ID NO: 8493285 - DNA, 22 bp, Homo sapiens
gagtggggctttaaaggctcag

SEQ ID NO: 8493286 - DNA, 22 bp, Homo sapiens
gagtggggtctgggcatcagtc

SEQ ID NO: 8493287 - DNA, 22 bp, Homo sapiens
gagtggggtctgggcatcagtc

SEQ ID NO: 8493288 - DNA, 22 bp, Homo sapiens
gagtggggtctgggcatcagtc

SEQ ID NO: 8493289 - DNA, 22 bp, Homo sapiens
gagtggggtctgggcatcagtc

SEQ ID NO: 8493290 - DNA, 22 bp, Homo sapiens
gagtgggtaaaggtgcttggct

SEQ ID NO: 8493291 - DNA, 22 bp, Homo sapiens
gagtgggtaccggagcaggtgc

SEQ ID NO: 8493292 - DNA, 22 bp, Homo sapiens
gagtgtctaatcacgtttcaca

SEQ ID NO: 8493293 - DNA, 22 bp, Homo sapiens
gagtgtccgtgcagccccagac

SEQ ID NO: 8493294 - DNA, 22 bp, Homo sapiens
gagtgtctgtattttgggcaag

SEQ ID NO: 8493295 - DNA, 22 bp, Homo sapiens
gagtgtctgaattagagcacaa

SEQ ID NO: 8493296 - DNA, 22 bp, Homo sapiens
gagtgtctcacagtagcatttt

SEQ ID NO: 8493297 - DNA, 21 bp, Homo sapiens
gagtgtctaatccaggctgtc

SEQ ID NO: 8493298 - DNA, 21 bp, Homo sapiens
gagtgtctaatccaggctgtc

SEQ ID NO: 8493299 - DNA, 22 bp, Homo sapiens
gagtgtctatgtttagtctttc

SEQ ID NO: 8493300 - DNA, 21 bp, Homo sapiens
gagtgtctaatccaggctgtc

SEQ ID NO: 8493301 - DNA, 22 bp, Homo sapiens
gagtggtaggcagtgttaggaa

SEQ ID NO: 8493302 - DNA, 22 bp, Homo sapiens
gagtggttagaagtagtgtggc

SEQ ID NO: 8493303 - DNA, 22 bp, Homo sapiens
gagtgtagttcattccgtccta

SEQ ID NO: 8493304 - DNA, 22 bp, Homo sapiens
gatccagcttctacacagagct

SEQ ID NO: 8493305 - DNA, 22 bp, Homo sapiens
gatccctgccctcagcctggac

SEQ ID NO: 8493306 - DNA, 22 bp, Homo sapiens
gatcccatgtaggagaatgtta

SEQ ID NO: 8493307 - DNA, 22 bp, Homo sapiens
gatcattttgatgcccttttag

SEQ ID NO: 8493308 - DNA, 22 bp, Homo sapiens
gatcattttgatgcccttttag

SEQ ID NO: 8493309 - DNA, 22 bp, Homo sapiens
gatcattttgatgcccttttag

SEQ ID NO: 8493310 - DNA, 22 bp, Homo sapiens
gatcatttgcaggaaacattaa

SEQ ID NO: 8493311 - DNA, 22 bp, Homo sapiens
gatcatttgcaggaaacattaa

SEQ ID NO: 8493312 - DNA, 22 bp, Homo sapiens
gatcatttgactttataaggct

SEQ ID NO: 8493313 - DNA, 22 bp, Homo sapiens
gatctgttataatctcttttat

SEQ ID NO: 8493314 - DNA, 22 bp, Homo sapiens
gatctgttataatctcttttat

SEQ ID NO: 8493315 - DNA, 16 bp, Homo sapiens
gatctgttctatttca

SEQ ID NO: 8493316 - DNA, 22 bp, Homo sapiens
gatctgggctggagactgagaa

SEQ ID NO: 8493317 - DNA, 22 bp, Homo sapiens
gatccgtttgtgtgggagtatt

SEQ ID NO: 8493318 - DNA, 22 bp, Homo sapiens
gatccgttttaacaatgggagt

SEQ ID NO: 8493319 - DNA, 22 bp, Homo sapiens
gatccgttccaccagtctttat

SEQ ID NO: 8493320 - DNA, 22 bp, Homo sapiens
gatccgttgcaaccaattagca

SEQ ID NO: 8493321 - DNA, 22 bp, Homo sapiens
gatccgtttatactgagtttga

SEQ ID NO: 8493322 - DNA, 22 bp, Homo sapiens
gatcttgaaatatcttttccta

SEQ ID NO: 8493323 - DNA, 22 bp, Homo sapiens
gatcttgagcaagttgcatccc

SEQ ID NO: 8493324 - DNA, 22 bp, Homo sapiens
gatcttgagcaagttgcatccc

SEQ ID NO: 8493325 - DNA, 22 bp, Homo sapiens
gatcttgagcaagttgtgtaac

SEQ ID NO: 8493326 - DNA, 22 bp, Homo sapiens
gatctttatactgtaataatga

SEQ ID NO: 8493327 - DNA, 22 bp, Homo sapiens
gatcttgaaatatcttttccta

SEQ ID NO: 8493328 - DNA, 22 bp, Homo sapiens
gatctgtttcattcacagtctg

SEQ ID NO: 8493329 - DNA, 22 bp, Homo sapiens
gatctgtttcattcacagtctg

SEQ ID NO: 8493330 - DNA, 22 bp, Homo sapiens
gatctgttttttcttagacagt

SEQ ID NO: 8493331 - DNA, 22 bp, Homo sapiens
gatgaaaaattgctgtgtcata

SEQ ID NO: 8493332 - DNA, 22 bp, Homo sapiens
gatgaaaaattgctgtgtcata

SEQ ID NO: 8493333 - DNA, 22 bp, Homo sapiens
gatgaaaaattgctgtgtcata

SEQ ID NO: 8493334 - DNA, 22 bp, Homo sapiens
gatgaaaatcttgagatgtcga

SEQ ID NO: 8493335 - DNA, 22 bp, Homo sapiens
gatgaaaatcttgagatgtcga

SEQ ID NO: 8493336 - DNA, 22 bp, Homo sapiens
gatgaaaatcttgagatgtcga

SEQ ID NO: 8493337 - DNA, 22 bp, Homo sapiens
gatgaaaaaagacgagcatata

SEQ ID NO: 8493338 - DNA, 19 bp, Homo sapiens
gatctttgccaatttaagc

SEQ ID NO: 8493339 - DNA, 22 bp, Homo sapiens
gatgaaatccagatcacaggtg

SEQ ID NO: 8493340 - DNA, 22 bp, Homo sapiens
gatgaaatgtgaaagttctggg

SEQ ID NO: 8493341 - DNA, 22 bp, Homo sapiens
gatgaaattcagaattgagggg

SEQ ID NO: 8493342 - DNA, 22 bp, Homo sapiens
gatgaaattgttttgatacttt

SEQ ID NO: 8493343 - DNA, 22 bp, Homo sapiens
gatgatttgaggatttcatgag

SEQ ID NO: 8493344 - DNA, 22 bp, Homo sapiens
gatgattgttggctctcttgat

SEQ ID NO: 8493345 - DNA, 22 bp, Homo sapiens
gatgcaaaccttacatggacct

SEQ ID NO: 8493346 - DNA, 22 bp, Homo sapiens
gatgcaaactgtgacatagagt

SEQ ID NO: 8493347 - DNA, 22 bp, Homo sapiens
gatgcaaactgtgacatagagt

SEQ ID NO: 8493348 - DNA, 22 bp, Homo sapiens
gatgcaaaccttacatggacct

SEQ ID NO: 8493349 - DNA, 22 bp, Homo sapiens
gatgcaaaagtatcattttaat

SEQ ID NO: 8493350 - DNA, 22 bp, Homo sapiens
gatgattttgttggtgattcaa

SEQ ID NO: 8493351 - DNA, 22 bp, Homo sapiens
gatgattttgatgcagtaaaga

SEQ ID NO: 8493352 - DNA, 22 bp, Homo sapiens
gatgcagaaagtagacaccatc

SEQ ID NO: 8493353 - DNA, 22 bp, Homo sapiens
gatgcagggctggcaggagctt

SEQ ID NO: 8493354 - DNA, 22 bp, Homo sapiens
gatgcagggaacttagtgggct

SEQ ID NO: 8493355 - DNA, 22 bp, Homo sapiens
gatgcatgtatggagtgagggt

SEQ ID NO: 8493356 - DNA, 22 bp, Homo sapiens
gatgcatgtatggagtgagggt

SEQ ID NO: 8493357 - DNA, 22 bp, Homo sapiens
gatgcatgtatggagtgagggt

SEQ ID NO: 8493358 - DNA, 22 bp, Homo sapiens
gatgcagggctggcaggagctt

SEQ ID NO: 8493359 - DNA, 22 bp, Homo sapiens
gatgcagggctggcaggagctt

SEQ ID NO: 8493360 - DNA, 22 bp, Homo sapiens
gatgcaaagataaaacagacgc

SEQ ID NO: 8493361 - DNA, 22 bp, Homo sapiens
gatgcacaaagcagagggaatc

SEQ ID NO: 8493362 - DNA, 22 bp, Homo sapiens
gatgcacagtgaccctgccagt

SEQ ID NO: 8493363 - DNA, 22 bp, Homo sapiens
gatgcacagtgaccctgccagt

SEQ ID NO: 8493364 - DNA, 22 bp, Homo sapiens
gatgcacatgtgagtatagaag

SEQ ID NO: 8493365 - DNA, 22 bp, Homo sapiens
gatgcacatgtgagtatagaag

SEQ ID NO: 8493366 - DNA, 20 bp, Homo sapiens
gatgagacccatgcatgaga

SEQ ID NO: 8493367 - DNA, 22 bp, Homo sapiens
gatgagacagaatagcccaagg

SEQ ID NO: 8493368 - DNA, 20 bp, Homo sapiens
gatgacatactcacttaggg

SEQ ID NO: 8493369 - DNA, 22 bp, Homo sapiens
gatgaggaatttgaggttagaa

SEQ ID NO: 8493370 - DNA, 22 bp, Homo sapiens
gatgatgggttgatgtgaaggg

SEQ ID NO: 8493371 - DNA, 22 bp, Homo sapiens
gatgatgggttgatgtgaaggg

SEQ ID NO: 8493372 - DNA, 22 bp, Homo sapiens
gatgaggaaaccaaggctcagg

SEQ ID NO: 8493373 - DNA, 22 bp, Homo sapiens
gatgagctgtgattaataagta

SEQ ID NO: 8493374 - DNA, 20 bp, Homo sapiens
gatgagacccatgcatgaga

SEQ ID NO: 8493375 - DNA, 22 bp, Homo sapiens
gatgagcattgtttcatgtgtt

SEQ ID NO: 8493376 - DNA, 22 bp, Homo sapiens
gatgacaaaagagtaagtaatg

SEQ ID NO: 8493377 - DNA, 22 bp, Homo sapiens
gatgacagcagctgtggctcac

SEQ ID NO: 8493378 - DNA, 22 bp, Homo sapiens
gatgaagctttgaagtctaatc

SEQ ID NO: 8493379 - DNA, 18 bp, Homo sapiens
gatgaagctgctggggat

SEQ ID NO: 8493380 - DNA, 22 bp, Homo sapiens
gatgaagccccagtgtaagtaa

SEQ ID NO: 8493381 - DNA, 22 bp, Homo sapiens
gatcaaaagctgggttctaaaa

SEQ ID NO: 8493382 - DNA, 22 bp, Homo sapiens
gatcaaaagctgggttctaaaa

SEQ ID NO: 8493383 - DNA, 22 bp, Homo sapiens
gatatttttgcagacacctggg

SEQ ID NO: 8493384 - DNA, 22 bp, Homo sapiens
gatcaaaagctgggttctaaaa

SEQ ID NO: 8493385 - DNA, 22 bp, Homo sapiens
gatatttttagtatttctgcct

SEQ ID NO: 8493386 - DNA, 22 bp, Homo sapiens
gatatttttagtatttctgcct

SEQ ID NO: 8493387 - DNA, 22 bp, Homo sapiens
gatcacatgagttatctaactt

SEQ ID NO: 8493388 - DNA, 22 bp, Homo sapiens
gatcacatgaatggaatagaag

SEQ ID NO: 8493389 - DNA, 22 bp, Homo sapiens
gatcagaatcttcattttcagt

SEQ ID NO: 8493390 - DNA, 22 bp, Homo sapiens
gatcacatgaatggaatagaag

SEQ ID NO: 8493391 - DNA, 22 bp, Homo sapiens
gatcacatctttatgagtattt

SEQ ID NO: 8493392 - DNA, 22 bp, Homo sapiens
gatcacagtattttagatgtgt

SEQ ID NO: 8493393 - DNA, 22 bp, Homo sapiens
gatcacataatttggaaacagc

SEQ ID NO: 8493394 - DNA, 22 bp, Homo sapiens
gatcaattcaaactattttcct

SEQ ID NO: 8493395 - DNA, 22 bp, Homo sapiens
gatcaatggtgtaacttgtcct

SEQ ID NO: 8493396 - DNA, 22 bp, Homo sapiens
gatcaatactattaagatcata

SEQ ID NO: 8493397 - DNA, 22 bp, Homo sapiens
gatcagtaagtgaataatgagt

SEQ ID NO: 8493398 - DNA, 22 bp, Homo sapiens
gatcagtaagtgaataatgagt

SEQ ID NO: 8493399 - DNA, 22 bp, Homo sapiens
gatcagtgttttgtgcattctt

SEQ ID NO: 8493400 - DNA, 22 bp, Homo sapiens
gatcagtgaactatactgcctc

SEQ ID NO: 8493401 - DNA, 22 bp, Homo sapiens
gatcagaatttacttataattg

SEQ ID NO: 8493402 - DNA, 22 bp, Homo sapiens
gatcattagcttttcaaaggag

SEQ ID NO: 8493403 - DNA, 22 bp, Homo sapiens
gatcattgaacaggcactggag

SEQ ID NO: 8493404 - DNA, 22 bp, Homo sapiens
gatcattaacaaccttaccctt

SEQ ID NO: 8493405 - DNA, 22 bp, Homo sapiens
gatcattggcctttctgcagtg

SEQ ID NO: 8493406 - DNA, 22 bp, Homo sapiens
gatcattgctgcctttttctat

SEQ ID NO: 8493407 - DNA, 22 bp, Homo sapiens
gatcatttacttgttctggact

SEQ ID NO: 8493408 - DNA, 22 bp, Homo sapiens
gatcatttcagtccagtaaata

SEQ ID NO: 8493409 - DNA, 22 bp, Homo sapiens
gatcatttacttgttctggact

SEQ ID NO: 8493410 - DNA, 22 bp, Homo sapiens
gatcatagcgtcttcttgcagc

SEQ ID NO: 8493411 - DNA, 22 bp, Homo sapiens
gatcatcttttcctgcttccag

SEQ ID NO: 8493412 - DNA, 22 bp, Homo sapiens
gatattttgagaaatcctatga

SEQ ID NO: 8493413 - DNA, 22 bp, Homo sapiens
gatattttgagaaatcctatga

SEQ ID NO: 8493414 - DNA, 22 bp, Homo sapiens
gatattttgagaaatcctatga

SEQ ID NO: 8493415 - DNA, 22 bp, Homo sapiens
gatatttttaggtgatgcaggc

SEQ ID NO: 8493416 - DNA, 22 bp, Homo sapiens
gatattttcattcggatgctca

SEQ ID NO: 8493417 - DNA, 22 bp, Homo sapiens
gatattttcattcggatgctca

SEQ ID NO: 8493418 - DNA, 22 bp, Homo sapiens
gatattttcagtctcctttcaa

SEQ ID NO: 8493419 - DNA, 22 bp, Homo sapiens
gatattttcagtctcctttcaa

SEQ ID NO: 8493420 - DNA, 22 bp, Homo sapiens
gatattttcgcagggagaattc

SEQ ID NO: 8493421 - DNA, 18 bp, Homo sapiens
gatatataggaggaaagt

SEQ ID NO: 8493422 - DNA, 18 bp, Homo sapiens
gatatataggaggaaagt

SEQ ID NO: 8493423 - DNA, 22 bp, Homo sapiens
gatataggttcatagtgttaca

SEQ ID NO: 8493424 - DNA, 22 bp, Homo sapiens
gatatacataggtttctatgca

SEQ ID NO: 8493425 - DNA, 21 bp, Homo sapiens
gatatttatgactcattcctt

SEQ ID NO: 8493426 - DNA, 22 bp, Homo sapiens
gatatttattaagtggttggta

SEQ ID NO: 8493427 - DNA, 22 bp, Homo sapiens
gatatttattaagtggttggta

SEQ ID NO: 8493428 - DNA, 22 bp, Homo sapiens
gatatttacattaagcacattg

SEQ ID NO: 8493429 - DNA, 22 bp, Homo sapiens
gatatatgtaaaagtagacaga

SEQ ID NO: 8493430 - DNA, 20 bp, Homo sapiens
gatacacagcacagagggcc

SEQ ID NO: 8493431 - DNA, 22 bp, Homo sapiens
gatacacacccttgataggact

SEQ ID NO: 8493432 - DNA, 22 bp, Homo sapiens
gatacacattttagctttgtct

SEQ ID NO: 8493433 - DNA, 22 bp, Homo sapiens
gataacattttgaagtgctagt

SEQ ID NO: 8493434 - DNA, 22 bp, Homo sapiens
gataacattttgaagtgctagt

SEQ ID NO: 8493435 - DNA, 22 bp, Homo sapiens
gataagcactatataagtattt

SEQ ID NO: 8493436 - DNA, 22 bp, Homo sapiens
gataagttatgtaacttgctca

SEQ ID NO: 8493437 - DNA, 19 bp, Homo sapiens
gataagtttccaggtaact

SEQ ID NO: 8493438 - DNA, 22 bp, Homo sapiens
gatacatttcaaggaggactgg

SEQ ID NO: 8493439 - DNA, 22 bp, Homo sapiens
gatacatttcaaggaggactgg

SEQ ID NO: 8493440 - DNA, 22 bp, Homo sapiens
gatacatttcaaggaggactgg

SEQ ID NO: 8493441 - DNA, 22 bp, Homo sapiens
gatacattgagggtggaggacc

SEQ ID NO: 8493442 - DNA, 22 bp, Homo sapiens
gataccagacagggagggagaa

SEQ ID NO: 8493443 - DNA, 22 bp, Homo sapiens
gataccagacagggagggagaa

SEQ ID NO: 8493444 - DNA, 22 bp, Homo sapiens
gataccaaaatcatcttatagg

SEQ ID NO: 8493445 - DNA, 22 bp, Homo sapiens
gatacattttatctcctaacag

SEQ ID NO: 8493446 - DNA, 22 bp, Homo sapiens
gatacattttatctcctaacag

SEQ ID NO: 8493447 - DNA, 22 bp, Homo sapiens
gatacattccatttctacttaa

SEQ ID NO: 8493448 - DNA, 22 bp, Homo sapiens
gatacattgagggtggaggacc

SEQ ID NO: 8493449 - DNA, 22 bp, Homo sapiens
gatacattccgggagggctacc

SEQ ID NO: 8493450 - DNA, 22 bp, Homo sapiens
gatacagtatttaaagagcaac

SEQ ID NO: 8493451 - DNA, 22 bp, Homo sapiens
gatacagaaaggctgcattgag

SEQ ID NO: 8493452 - DNA, 23 bp, Homo sapiens
gatacactccctgctgggcactg

SEQ ID NO: 8493453 - DNA, 22 bp, Homo sapiens
gatacactggccaagtggagga

SEQ ID NO: 8493454 - DNA, 22 bp, Homo sapiens
gatataaattaatcaagtgcaa

SEQ ID NO: 8493455 - DNA, 22 bp, Homo sapiens
gatataaattaatcaagtgcaa

SEQ ID NO: 8493456 - DNA, 22 bp, Homo sapiens
gatatacaatccacagttgatt

SEQ ID NO: 8493457 - DNA, 22 bp, Homo sapiens
gatatacagagcattctttgat

SEQ ID NO: 8493458 - DNA, 19 bp, Homo sapiens
gatataaagagatggtgaa

SEQ ID NO: 8493459 - DNA, 22 bp, Homo sapiens
gatagtcacctcccttaacttt

SEQ ID NO: 8493460 - DNA, 22 bp, Homo sapiens
gatagtcacctcccttaacttt

SEQ ID NO: 8493461 - DNA, 22 bp, Homo sapiens
gatagcaacatagaacagaatt

SEQ ID NO: 8493462 - DNA, 19 bp, Homo sapiens
gatagctgatgaccatcat

SEQ ID NO: 8493463 - DNA, 22 bp, Homo sapiens
gatagctgctgggatattttta

SEQ ID NO: 8493464 - DNA, 22 bp, Homo sapiens
gatactttctcatttacccaag

SEQ ID NO: 8493465 - DNA, 22 bp, Homo sapiens
gatactttgtggaatcctggat

SEQ ID NO: 8493466 - DNA, 22 bp, Homo sapiens
gatactttctcatttacccaag

SEQ ID NO: 8493467 - DNA, 22 bp, Homo sapiens
gatactttgtggaatcctggat

SEQ ID NO: 8493468 - DNA, 22 bp, Homo sapiens
gatactttccatccaaatgcat

SEQ ID NO: 8493469 - DNA, 22 bp, Homo sapiens
gatactttccatccaaatgcat

SEQ ID NO: 8493470 - DNA, 22 bp, Homo sapiens
gatagaaagagtggttcttttt

SEQ ID NO: 8493471 - DNA, 22 bp, Homo sapiens
gatagcaacatagaacagaatt

SEQ ID NO: 8493472 - DNA, 22 bp, Homo sapiens
gatagcaacatagaacagaatt

SEQ ID NO: 8493473 - DNA, 22 bp, Homo sapiens
gatagagactataatgctcttt

SEQ ID NO: 8493474 - DNA, 22 bp, Homo sapiens
gaggcagcaaaatatatcataa

SEQ ID NO: 8493475 - DNA, 22 bp, Homo sapiens
gaggcagcagaacatggaagag

SEQ ID NO: 8493476 - DNA, 22 bp, Homo sapiens
gaggcagagtgcaccccaggag

SEQ ID NO: 8493477 - DNA, 22 bp, Homo sapiens
gaggcagagtgcaccccaggag

SEQ ID NO: 8493478 - DNA, 22 bp, Homo sapiens
gaggcagagtcacaaagagtct

SEQ ID NO: 8493479 - DNA, 22 bp, Homo sapiens
gaggcagaggttgttgcagtga

SEQ ID NO: 8493480 - DNA, 22 bp, Homo sapiens
gaggcagaggttgttgcagtga

SEQ ID NO: 8493481 - DNA, 22 bp, Homo sapiens
gaggagggttggccttaggtag

SEQ ID NO: 8493482 - DNA, 22 bp, Homo sapiens
gaggagggttggccttaggtag

SEQ ID NO: 8493483 - DNA, 22 bp, Homo sapiens
gaggaggtcgctgctgagcccc

SEQ ID NO: 8493484 - DNA, 22 bp, Homo sapiens
gaggaggtcgctgctgagcccc

SEQ ID NO: 8493485 - DNA, 22 bp, Homo sapiens
gaggaggtctcctccgcagggg

SEQ ID NO: 8493486 - DNA, 22 bp, Homo sapiens
gaggaggtggaattccaggaat

SEQ ID NO: 8493487 - DNA, 22 bp, Homo sapiens
gaggaggtggaattccaggaat

SEQ ID NO: 8493488 - DNA, 22 bp, Homo sapiens
gaggcagaggttgcagtgagct

SEQ ID NO: 8493489 - DNA, 22 bp, Homo sapiens
gaggcagaggttgcagtgagct

SEQ ID NO: 8493490 - DNA, 22 bp, Homo sapiens
gaggcagaggttgcagtgagct

SEQ ID NO: 8493491 - DNA, 19 bp, Homo sapiens
gaggaggcttcagctttct

SEQ ID NO: 8493492 - DNA, 22 bp, Homo sapiens
gaggaggcttccgggaggcacg

SEQ ID NO: 8493493 - DNA, 22 bp, Homo sapiens
gaggaggctggcgccgcctgcc

SEQ ID NO: 8493494 - DNA, 22 bp, Homo sapiens
gaggaggctggcgccgcctgcc

SEQ ID NO: 8493495 - DNA, 22 bp, Homo sapiens
gaggaggctgtttctctgcatt

SEQ ID NO: 8493496 - DNA, 22 bp, Homo sapiens
gaggaggctgtttctctgcatt

SEQ ID NO: 8493497 - DNA, 22 bp, Homo sapiens
gaggagggagaattaggcttaa

SEQ ID NO: 8493498 - DNA, 22 bp, Homo sapiens
gaggaggcttccgggaggcacg

SEQ ID NO: 8493499 - DNA, 23 bp, Homo sapiens
gaggagggtctgacaagtgtagc

SEQ ID NO: 8493500 - DNA, 23 bp, Homo sapiens
gaggagggtctgacaagtgtagc

SEQ ID NO: 8493501 - DNA, 22 bp, Homo sapiens
gaggagggagctggaagctctt

SEQ ID NO: 8493502 - DNA, 22 bp, Homo sapiens
gaggagggagctggaagctctt

SEQ ID NO: 8493503 - DNA, 22 bp, Homo sapiens
gaggagggagctggaagctctt

SEQ ID NO: 8493504 - DNA, 22 bp, Homo sapiens
gaggcagcaggctgaggaggat

SEQ ID NO: 8493505 - DNA, 22 bp, Homo sapiens
gaggcagcaggctgaggaggat

SEQ ID NO: 8493506 - DNA, 22 bp, Homo sapiens
gaggcccagggtacaggccgct

SEQ ID NO: 8493507 - DNA, 22 bp, Homo sapiens
gaggcccagtcctgcaagcacg

SEQ ID NO: 8493508 - DNA, 22 bp, Homo sapiens
gaggcccaggtcaagcagccac

SEQ ID NO: 8493509 - DNA, 22 bp, Homo sapiens
gaggcccagcattcagggcagg

SEQ ID NO: 8493510 - DNA, 22 bp, Homo sapiens
gaggcagctgaaggagtgacag

SEQ ID NO: 8493511 - DNA, 22 bp, Homo sapiens
gaggcagctgaaggagtgacag

SEQ ID NO: 8493512 - DNA, 22 bp, Homo sapiens
gaggcagctgaaggagtgacag

SEQ ID NO: 8493513 - DNA, 22 bp, Homo sapiens
gaggcagctgggatacaaggga

SEQ ID NO: 8493514 - DNA, 22 bp, Homo sapiens
gaggcagctgggctggtggttt

SEQ ID NO: 8493515 - DNA, 18 bp, Homo sapiens
gaggcctgagaaccaggt

SEQ ID NO: 8493516 - DNA, 22 bp, Homo sapiens
gaggcctgaaaggggacctatg

SEQ ID NO: 8493517 - DNA, 22 bp, Homo sapiens
gaggcctgaaaggggacctatg

SEQ ID NO: 8493518 - DNA, 22 bp, Homo sapiens
gaggcctcctctgagacatctg

SEQ ID NO: 8493519 - DNA, 22 bp, Homo sapiens
gaggcctcctctgagacatctg

SEQ ID NO: 8493520 - DNA, 22 bp, Homo sapiens
gaggcctctgtcccaccaggga

SEQ ID NO: 8493521 - DNA, 22 bp, Homo sapiens
gaggcctctgtcccgccaggga

SEQ ID NO: 8493522 - DNA, 19 bp, Homo sapiens
gaggcccatgagggtgctc

SEQ ID NO: 8493523 - DNA, 22 bp, Homo sapiens
gaggccctccagctgtcagctg

SEQ ID NO: 8493524 - DNA, 21 bp, Homo sapiens
gaggcccatgggacaggggct

SEQ ID NO: 8493525 - DNA, 20 bp, Homo sapiens
gaggcctcagcctcagctcc

SEQ ID NO: 8493526 - DNA, 20 bp, Homo sapiens
gaggcctcagcctcagctcc

SEQ ID NO: 8493527 - DNA, 22 bp, Homo sapiens
gaggccctcttgccacaatgaa

SEQ ID NO: 8493528 - DNA, 22 bp, Homo sapiens
gaggccctgaagacagctgggg

SEQ ID NO: 8493529 - DNA, 22 bp, Homo sapiens
gaggacagagccgcctggcaag

SEQ ID NO: 8493530 - DNA, 22 bp, Homo sapiens
gaggacagagccgcctggcaag

SEQ ID NO: 8493531 - DNA, 22 bp, Homo sapiens
gaggacacatgactccagcagg

SEQ ID NO: 8493532 - DNA, 22 bp, Homo sapiens
gaggacacggccttttggaaaa

SEQ ID NO: 8493533 - DNA, 22 bp, Homo sapiens
gaggacagagccgcctggcaag

SEQ ID NO: 8493534 - DNA, 22 bp, Homo sapiens
gaggacagcttagggcttcctg

SEQ ID NO: 8493535 - DNA, 22 bp, Homo sapiens
gaggacagcttagggcttcctg

SEQ ID NO: 8493536 - DNA, 22 bp, Homo sapiens
gaggacagcttagggcttcctg

SEQ ID NO: 8493537 - DNA, 22 bp, Homo sapiens
gaggacagcttagggcttcctg

SEQ ID NO: 8493538 - DNA, 22 bp, Homo sapiens
gaggaaggtcccatcagaattt

SEQ ID NO: 8493539 - DNA, 22 bp, Homo sapiens
gaggaagtctctctacaagaaa

SEQ ID NO: 8493540 - DNA, 22 bp, Homo sapiens
gaggaagtgcgttatgcctttt

SEQ ID NO: 8493541 - DNA, 22 bp, Homo sapiens
gaggaatgggtgtctcgtgatt

SEQ ID NO: 8493542 - DNA, 21 bp, Homo sapiens
gaggaatggtttgcaaagcac

SEQ ID NO: 8493543 - DNA, 21 bp, Homo sapiens
gaggaatggtttgcaaagcac

SEQ ID NO: 8493544 - DNA, 22 bp, Homo sapiens
gaggacacatgactccagcagg

SEQ ID NO: 8493545 - DNA, 22 bp, Homo sapiens
gagctgggagttatagcatgtt

SEQ ID NO: 8493546 - DNA, 22 bp, Homo sapiens
gagctgggaggactgggaactt

SEQ ID NO: 8493547 - DNA, 22 bp, Homo sapiens
gagctgggaggactgggaactt

SEQ ID NO: 8493548 - DNA, 22 bp, Homo sapiens
gagctgggaggactgggaactt

SEQ ID NO: 8493549 - DNA, 22 bp, Homo sapiens
gagctgggacttggaatccaca

SEQ ID NO: 8493550 - DNA, 18 bp, Homo sapiens
gagctgggagaaggaagg

SEQ ID NO: 8493551 - DNA, 18 bp, Homo sapiens
gagctgggagaaggaagg

SEQ ID NO: 8493552 - DNA, 22 bp, Homo sapiens
gagctgggagctgggatttgga

SEQ ID NO: 8493553 - DNA, 22 bp, Homo sapiens
gaggaagaattggttattggag

SEQ ID NO: 8493554 - DNA, 22 bp, Homo sapiens
gagctgggagttatagcatgtt

SEQ ID NO: 8493555 - DNA, 23 bp, Homo sapiens
gagctgggatacaggcttactgc

SEQ ID NO: 8493556 - DNA, 22 bp, Homo sapiens
gaggaaggtcccatcagaattt

SEQ ID NO: 8493557 - DNA, 22 bp, Homo sapiens
gaggaagggctgcctgccgggc

SEQ ID NO: 8493558 - DNA, 22 bp, Homo sapiens
gaggaagggctgcctgccgggc

SEQ ID NO: 8493559 - DNA, 22 bp, Homo sapiens
gaggaagatggttgagtggtcc

SEQ ID NO: 8493560 - DNA, 22 bp, Homo sapiens
gaggaagggactttattatctg

SEQ ID NO: 8493561 - DNA, 22 bp, Homo sapiens
gagctggccgcagagagggcag

SEQ ID NO: 8493562 - DNA, 22 bp, Homo sapiens
gagctggcctcaggcacaggag

SEQ ID NO: 8493563 - DNA, 22 bp, Homo sapiens
gagctggctaatactgacttat

SEQ ID NO: 8493564 - DNA, 22 bp, Homo sapiens
gagctggcctcaggcacaggag

SEQ ID NO: 8493565 - DNA, 22 bp, Homo sapiens
gagctggctccgccatgctgct

SEQ ID NO: 8493566 - DNA, 22 bp, Homo sapiens
gagctggctgtggttgagtgca

SEQ ID NO: 8493567 - DNA, 22 bp, Homo sapiens
gagctgggaagatagcttgagc

SEQ ID NO: 8493568 - DNA, 22 bp, Homo sapiens
gagctgggacatgggtcctctc

SEQ ID NO: 8493569 - DNA, 22 bp, Homo sapiens
gagctggaagtctgtggtcaga

SEQ ID NO: 8493570 - DNA, 20 bp, Homo sapiens
gagatcctcatctgtaaagt

SEQ ID NO: 8493571 - DNA, 22 bp, Homo sapiens
gagctgcttctgtgtgccgggt

SEQ ID NO: 8493572 - DNA, 22 bp, Homo sapiens
gagctggaggaccaggactggg

SEQ ID NO: 8493573 - DNA, 22 bp, Homo sapiens
gagctggaggcagtgctgaggt

SEQ ID NO: 8493574 - DNA, 22 bp, Homo sapiens
gagctggaggaccaggactggg

SEQ ID NO: 8493575 - DNA, 22 bp, Homo sapiens
gagctggaggaccaggactggg

SEQ ID NO: 8493576 - DNA, 22 bp, Homo sapiens
gagctggactttcagatacatc

SEQ ID NO: 8493577 - DNA, 22 bp, Homo sapiens
gagctggcacagaaggatctta

SEQ ID NO: 8493578 - DNA, 22 bp, Homo sapiens
gagctggcacagaaggatctta

SEQ ID NO: 8493579 - DNA, 22 bp, Homo sapiens
gagctggcaggaggctccccga

SEQ ID NO: 8493580 - DNA, 22 bp, Homo sapiens
gagctggccgcagagagggcag

SEQ ID NO: 8493581 - DNA, 22 bp, Homo sapiens
gagctggccgcagagagggcag

SEQ ID NO: 8493582 - DNA, 22 bp, Homo sapiens
gagatcatggcttctgctgata

SEQ ID NO: 8493583 - DNA, 22 bp, Homo sapiens
gagatcatcttttttagattcc

SEQ ID NO: 8493584 - DNA, 22 bp, Homo sapiens
gagatatttattcatactgtca

SEQ ID NO: 8493585 - DNA, 22 bp, Homo sapiens
gagatatgttagaaagctattg

SEQ ID NO: 8493586 - DNA, 22 bp, Homo sapiens
gagataaagctaccatgttgat

SEQ ID NO: 8493587 - DNA, 22 bp, Homo sapiens
gagataaagctaccatgttgat

SEQ ID NO: 8493588 - DNA, 22 bp, Homo sapiens
gagagttcttgcctgggtatta

SEQ ID NO: 8493589 - DNA, 22 bp, Homo sapiens
gagagttcttgcctgggtatta

SEQ ID NO: 8493590 - DNA, 22 bp, Homo sapiens
gagagtgtctggaggaagctaa

SEQ ID NO: 8493591 - DNA, 22 bp, Homo sapiens
gagagttccagtaagtggattc

SEQ ID NO: 8493592 - DNA, 22 bp, Homo sapiens
gagagttctacctctgaaggcg

SEQ ID NO: 8493593 - DNA, 22 bp, Homo sapiens
gagataactctaggtcttcgag

SEQ ID NO: 8493594 - DNA, 22 bp, Homo sapiens
gagatacagttggctgcaggct

SEQ ID NO: 8493595 - DNA, 22 bp, Homo sapiens
gagataaatttttgataaatat

SEQ ID NO: 8493596 - DNA, 22 bp, Homo sapiens
gagagtgctgaacggcaagggt

SEQ ID NO: 8493597 - DNA, 22 bp, Homo sapiens
gagagtctggtagagcagcaag

SEQ ID NO: 8493598 - DNA, 22 bp, Homo sapiens
gagagtctagtgcacctagttt

SEQ ID NO: 8493599 - DNA, 22 bp, Homo sapiens
gagagtctagtgcacctagttt

SEQ ID NO: 8493600 - DNA, 22 bp, Homo sapiens
gagagtctagtgcacctagttt

SEQ ID NO: 8493601 - DNA, 22 bp, Homo sapiens
gagagtctagtgcacctagttt

SEQ ID NO: 8493602 - DNA, 22 bp, Homo sapiens
gagagtgaggcatcaggggcag

SEQ ID NO: 8493603 - DNA, 22 bp, Homo sapiens
gagagtgaggcctgggaatcta

SEQ ID NO: 8493604 - DNA, 22 bp, Homo sapiens
gagggttggtgcaaatgggatg

SEQ ID NO: 8493605 - DNA, 22 bp, Homo sapiens
gaggggctcttgggcatgaagg

SEQ ID NO: 8493606 - DNA, 22 bp, Homo sapiens
gaggggcgtcctgagtgggcct

SEQ ID NO: 8493607 - DNA, 22 bp, Homo sapiens
gaggggctcttgggcatgaagg

SEQ ID NO: 8493608 - DNA, 22 bp, Homo sapiens
gaggggctcttgggcatgaagg

SEQ ID NO: 8493609 - DNA, 22 bp, Homo sapiens
gaggggcgtcctgagtgggcct

SEQ ID NO: 8493610 - DNA, 22 bp, Homo sapiens
gaggggcgtcctgagtgggcct

SEQ ID NO: 8493611 - DNA, 22 bp, Homo sapiens
gaggggcctggcactgagctgg

SEQ ID NO: 8493612 - DNA, 22 bp, Homo sapiens
gaggggcctggcactgagctgg

SEQ ID NO: 8493613 - DNA, 22 bp, Homo sapiens
gaggggccggcatgtgcctctc

SEQ ID NO: 8493614 - DNA, 22 bp, Homo sapiens
gaggggccggcatgtgcctctc

SEQ ID NO: 8493615 - DNA, 22 bp, Homo sapiens
gaggggccggcatgtgcctctc

SEQ ID NO: 8493616 - DNA, 22 bp, Homo sapiens
gaggggcctggcgaggacatgt

SEQ ID NO: 8493617 - DNA, 22 bp, Homo sapiens
gaggggcctggcgaggacatgt

SEQ ID NO: 8493618 - DNA, 22 bp, Homo sapiens
gaggggcgctgtcgggtcacct

SEQ ID NO: 8493619 - DNA, 22 bp, Homo sapiens
gaggggcctggcactgagctgg

SEQ ID NO: 8493620 - DNA, 22 bp, Homo sapiens
gaggggcctggcgaggacatgt

SEQ ID NO: 8493621 - DNA, 22 bp, Homo sapiens
gaggtatcttagagagtgtaga

SEQ ID NO: 8493622 - DNA, 22 bp, Homo sapiens
gaggtattgactatgggatggc

SEQ ID NO: 8493623 - DNA, 23 bp, Homo sapiens
gaggtcaaggctgcagtgattgc

SEQ ID NO: 8493624 - DNA, 22 bp, Homo sapiens
gaggtatttttgcatgcctgat

SEQ ID NO: 8493625 - DNA, 22 bp, Homo sapiens
gaggtatttgatcctctgcagt

SEQ ID NO: 8493626 - DNA, 22 bp, Homo sapiens
gaggtcaaggtcaagagacaga

SEQ ID NO: 8493627 - DNA, 22 bp, Homo sapiens
gaggtcaggctcaagctgggcc

SEQ ID NO: 8493628 - DNA, 19 bp, Homo sapiens
gaggtcagcaagaagtatt

SEQ ID NO: 8493629 - DNA, 19 bp, Homo sapiens
gaggtcagcaagaagtatt

SEQ ID NO: 8493630 - DNA, 22 bp, Homo sapiens
gaggtaacaactgaaatgagaa

SEQ ID NO: 8493631 - DNA, 22 bp, Homo sapiens
gaggtaggtgtaggaggcctgc

SEQ ID NO: 8493632 - DNA, 22 bp, Homo sapiens
gaggtaggtgtaggaggcctgc

SEQ ID NO: 8493633 - DNA, 22 bp, Homo sapiens
gaggtcaggcttgcagcagggt

SEQ ID NO: 8493634 - DNA, 22 bp, Homo sapiens
gaggtcaggggagaggctgatg

SEQ ID NO: 8493635 - DNA, 22 bp, Homo sapiens
gaggtcaggcttgcagcagggt

SEQ ID NO: 8493636 - DNA, 22 bp, Homo sapiens
gaggtcaggcttgcagcagggt

SEQ ID NO: 8493637 - DNA, 22 bp, Homo sapiens
gaggtcaggggagaggctgatg

SEQ ID NO: 8493638 - DNA, 22 bp, Homo sapiens
gaggtcaggctcaagctgggcc

SEQ ID NO: 8493639 - DNA, 22 bp, Homo sapiens
gaggtcaggctcaagctgggcc

SEQ ID NO: 8493640 - DNA, 22 bp, Homo sapiens
gaggtcaggctcaagctgggcc

SEQ ID NO: 8493641 - DNA, 22 bp, Homo sapiens
gaggtcaggcttgcagcagggt

SEQ ID NO: 8493642 - DNA, 22 bp, Homo sapiens
gaggtcaggcttgcagcagggt

SEQ ID NO: 8493643 - DNA, 22 bp, Homo sapiens
gaggtccactgaggcaacaggg

SEQ ID NO: 8493644 - DNA, 22 bp, Homo sapiens
gaggtccactgaggcaacaggg

SEQ ID NO: 8493645 - DNA, 22 bp, Homo sapiens
gaggtccactgaggcaacaggg

SEQ ID NO: 8493646 - DNA, 22 bp, Homo sapiens
gaggtccaacacaatgggtgtt

SEQ ID NO: 8493647 - DNA, 22 bp, Homo sapiens
gaggtccaacacaatgggtgtt

SEQ ID NO: 8493648 - DNA, 22 bp, Homo sapiens
gaggtcagtcagaccagggttt

SEQ ID NO: 8493649 - DNA, 22 bp, Homo sapiens
gaggtcagtcagaccagggttt

SEQ ID NO: 8493650 - DNA, 22 bp, Homo sapiens
gaggtcagtcagaccagggttt

SEQ ID NO: 8493651 - DNA, 22 bp, Homo sapiens
gaggtcaggggagaggctgatg

SEQ ID NO: 8493652 - DNA, 22 bp, Homo sapiens
gaggtcaggtgaggaattaaga

SEQ ID NO: 8493653 - DNA, 22 bp, Homo sapiens
gaggtcaggtgaggaattaaga

SEQ ID NO: 8493654 - DNA, 22 bp, Homo sapiens
gaggtccagagcaggttcagtg

SEQ ID NO: 8493655 - DNA, 22 bp, Homo sapiens
gaggtccagagcaggttcagtg

SEQ ID NO: 8493656 - DNA, 22 bp, Homo sapiens
gaggtccagccaagcggcaagg

SEQ ID NO: 8493657 - DNA, 22 bp, Homo sapiens
gaggtccagggtggggcctgag

SEQ ID NO: 8493658 - DNA, 22 bp, Homo sapiens
gaggtccagggtggggcctgag

SEQ ID NO: 8493659 - DNA, 22 bp, Homo sapiens
gaggtccagggtggggcctgag

SEQ ID NO: 8493660 - DNA, 22 bp, Homo sapiens
gaggtccattttcacatatgat

SEQ ID NO: 8493661 - DNA, 22 bp, Homo sapiens
gaggtcccccatggctgtgact

SEQ ID NO: 8493662 - DNA, 22 bp, Homo sapiens
gaggtgggagggcagtccctaa

SEQ ID NO: 8493663 - DNA, 22 bp, Homo sapiens
gaggtgggatgtgtgtgctact

SEQ ID NO: 8493664 - DNA, 22 bp, Homo sapiens
gaggtgggcggatcacaaggtc

SEQ ID NO: 8493665 - DNA, 22 bp, Homo sapiens
gaggtgggcggatcacaaggtc

SEQ ID NO: 8493666 - DNA, 22 bp, Homo sapiens
gagtcagaatgtcctcctgcgg

SEQ ID NO: 8493667 - DNA, 22 bp, Homo sapiens
gagtcagaagaaactatttaca

SEQ ID NO: 8493668 - DNA, 22 bp, Homo sapiens
gagtcagaaactcactctatag

SEQ ID NO: 8493669 - DNA, 22 bp, Homo sapiens
gagtcagaagaaactatttaca

SEQ ID NO: 8493670 - DNA, 22 bp, Homo sapiens
gagtcagaagaaactatttaca

SEQ ID NO: 8493671 - DNA, 22 bp, Homo sapiens
gagtcagaccgactgggctcat

SEQ ID NO: 8493672 - DNA, 22 bp, Homo sapiens
gagtcagacagggtcacccaga

SEQ ID NO: 8493673 - DNA, 22 bp, Homo sapiens
gagtcagaattgtattttaaac

SEQ ID NO: 8493674 - DNA, 22 bp, Homo sapiens
gagtcagaattgtattttaaac

SEQ ID NO: 8493675 - DNA, 22 bp, Homo sapiens
gagtcagattgcagacagggct

SEQ ID NO: 8493676 - DNA, 22 bp, Homo sapiens
gagtcaggagtcctgtgtgaga

SEQ ID NO: 8493677 - DNA, 22 bp, Homo sapiens
gagtcagattgcagacagggct

SEQ ID NO: 8493678 - DNA, 22 bp, Homo sapiens
gagtcagattgcagacagggct

SEQ ID NO: 8493679 - DNA, 22 bp, Homo sapiens
gagtcagattgcagacagggct

SEQ ID NO: 8493680 - DNA, 22 bp, Homo sapiens
gagtcagaccgactgggctcat

SEQ ID NO: 8493681 - DNA, 22 bp, Homo sapiens
gagtcagatgaagataaaaggg

SEQ ID NO: 8493682 - DNA, 22 bp, Homo sapiens
gagtcagatgaagataaaaggg

SEQ ID NO: 8493683 - DNA, 22 bp, Homo sapiens
gagtcaggcatgaaggtaatta

SEQ ID NO: 8493684 - DNA, 22 bp, Homo sapiens
gagtcaggcatgaaggtaatta

SEQ ID NO: 8493685 - DNA, 22 bp, Homo sapiens
gagtcaggatgcaaggggatgg

SEQ ID NO: 8493686 - DNA, 22 bp, Homo sapiens
gagtcaggcactgctgctgctc

SEQ ID NO: 8493687 - DNA, 22 bp, Homo sapiens
gagtcaggagttatgctccacc

SEQ ID NO: 8493688 - DNA, 22 bp, Homo sapiens
gagtcaggagtcctgtgtgaga

SEQ ID NO: 8493689 - DNA, 22 bp, Homo sapiens
gagtcaggatgcaaggggatgg

SEQ ID NO: 8493690 - DNA, 22 bp, Homo sapiens
gagtcaggatgcaaggggatgg

SEQ ID NO: 8493691 - DNA, 22 bp, Homo sapiens
gagtcaggctagaggtgagtct

SEQ ID NO: 8493692 - DNA, 22 bp, Homo sapiens
gagtcaggcatgaaggtaatta

SEQ ID NO: 8493693 - DNA, 22 bp, Homo sapiens
gagtcaggctagaggtgagtct

SEQ ID NO: 8493694 - DNA, 22 bp, Homo sapiens
gagtcaggctagaggtgagtct

SEQ ID NO: 8493695 - DNA, 22 bp, Homo sapiens
gagtcaggctagggtgacaggc

SEQ ID NO: 8493696 - DNA, 22 bp, Homo sapiens
gagtcaggctagggtgacaggc

SEQ ID NO: 8493697 - DNA, 22 bp, Homo sapiens
gagtcaggctagggtgacaggc

SEQ ID NO: 8493698 - DNA, 22 bp, Homo sapiens
gagtccagttctttccagcagt

SEQ ID NO: 8493699 - DNA, 22 bp, Homo sapiens
gagtcatttgggggcttcttga

SEQ ID NO: 8493700 - DNA, 22 bp, Homo sapiens
gagtccagacaccatacctgat

SEQ ID NO: 8493701 - DNA, 22 bp, Homo sapiens
gagtccagacaccatacctgat

SEQ ID NO: 8493702 - DNA, 22 bp, Homo sapiens
gagtcaggtttctgcctataga

SEQ ID NO: 8493703 - DNA, 22 bp, Homo sapiens
gagtcattgcacactagctcag

SEQ ID NO: 8493704 - DNA, 22 bp, Homo sapiens
gagtcattgttggtccctcccc

SEQ ID NO: 8493705 - DNA, 22 bp, Homo sapiens
gagtccagttgttcacagaggc

SEQ ID NO: 8493706 - DNA, 22 bp, Homo sapiens
gagtccagttgttcacagaggc

SEQ ID NO: 8493707 - DNA, 22 bp, Homo sapiens
gagtcccaggaatgagcatagt

SEQ ID NO: 8493708 - DNA, 22 bp, Homo sapiens
gagtcctgaatcctgtggcaac

SEQ ID NO: 8493709 - DNA, 22 bp, Homo sapiens
gagtcctcaacggggagaggcg

SEQ ID NO: 8493710 - DNA, 22 bp, Homo sapiens
gagtcccatgatgatagccaca

SEQ ID NO: 8493711 - DNA, 22 bp, Homo sapiens
gagtcccaggatatgtgctgtt

SEQ ID NO: 8493712 - DNA, 22 bp, Homo sapiens
gagtcacatactatgtaataga

SEQ ID NO: 8493713 - DNA, 20 bp, Homo sapiens
gagtcacagaagaagctgaa

SEQ ID NO: 8493714 - DNA, 20 bp, Homo sapiens
gagtcacagaagaagctgaa

SEQ ID NO: 8493715 - DNA, 22 bp, Homo sapiens
gagtcagaaagtagtgtgccta

SEQ ID NO: 8493716 - DNA, 22 bp, Homo sapiens
gagtcagaaagtagtgtgccta

SEQ ID NO: 8493717 - DNA, 22 bp, Homo sapiens
gagtcagaaactcactctatag

SEQ ID NO: 8493718 - DNA, 22 bp, Homo sapiens
gaggtgtcatgagggcctgctc

SEQ ID NO: 8493719 - DNA, 22 bp, Homo sapiens
gaggtggtggtggaggcatagc

SEQ ID NO: 8493720 - DNA, 22 bp, Homo sapiens
gaggtggtggtggaggcatagc

SEQ ID NO: 8493721 - DNA, 22 bp, Homo sapiens
gaggtgggtgtatcacaggtca

SEQ ID NO: 8493722 - DNA, 22 bp, Homo sapiens
gaggtgggtgtatcacaggtca

SEQ ID NO: 8493723 - DNA, 22 bp, Homo sapiens
gaggtgggtgtatcacaggtca

SEQ ID NO: 8493724 - DNA, 19 bp, Homo sapiens
gaggtgggtccccgcagcc

SEQ ID NO: 8493725 - DNA, 19 bp, Homo sapiens
gaggtgggtccccgcagcc

SEQ ID NO: 8493726 - DNA, 22 bp, Homo sapiens
gaggggcagttgattgtgctat

SEQ ID NO: 8493727 - DNA, 22 bp, Homo sapiens
gaggggcagaggtagagaacaa

SEQ ID NO: 8493728 - DNA, 22 bp, Homo sapiens
gaggggcagaggtagagaacaa

SEQ ID NO: 8493729 - DNA, 22 bp, Homo sapiens
gaggggcacagtaaagggtccc

SEQ ID NO: 8493730 - DNA, 22 bp, Homo sapiens
gaggggcacagtaaagggtccc

SEQ ID NO: 8493731 - DNA, 22 bp, Homo sapiens
gaggggcaatgagggaaagagt

SEQ ID NO: 8493732 - DNA, 22 bp, Homo sapiens
gaggggcagaatgtgatcaggg

SEQ ID NO: 8493733 - DNA, 22 bp, Homo sapiens
gaggggagtgtcctccgggccc

SEQ ID NO: 8493734 - DNA, 22 bp, Homo sapiens
gaggggatgcagagaggcttat

SEQ ID NO: 8493735 - DNA, 22 bp, Homo sapiens
gaggggatgcagagaggcttat

SEQ ID NO: 8493736 - DNA, 22 bp, Homo sapiens
gaggggagtaaagtcatgttac

SEQ ID NO: 8493737 - DNA, 22 bp, Homo sapiens
gaggggagtaaagtcatgttac

SEQ ID NO: 8493738 - DNA, 22 bp, Homo sapiens
gaggggagtaaagtcatgttac

SEQ ID NO: 8493739 - DNA, 22 bp, Homo sapiens
gaggggcaatgagggaaagagt

SEQ ID NO: 8493740 - DNA, 22 bp, Homo sapiens
gaggggcaagaagttggcctct

SEQ ID NO: 8493741 - DNA, 22 bp, Homo sapiens
gaggggatgcagagaggcttat

SEQ ID NO: 8493742 - DNA, 22 bp, Homo sapiens
gaggggattggaaggaacaccc

SEQ ID NO: 8493743 - DNA, 22 bp, Homo sapiens
gaggggcacagcagctgttgca

SEQ ID NO: 8493744 - DNA, 22 bp, Homo sapiens
gaggggcacagcagctgttgca

SEQ ID NO: 8493745 - DNA, 22 bp, Homo sapiens
gagggcagtagcctcgtaccct

SEQ ID NO: 8493746 - DNA, 22 bp, Homo sapiens
gagggcagtagcctcgtaccct

SEQ ID NO: 8493747 - DNA, 22 bp, Homo sapiens
gagggcaggggtcttgcacggt

SEQ ID NO: 8493748 - DNA, 22 bp, Homo sapiens
gagggcaggggtcttgcacggt

SEQ ID NO: 8493749 - DNA, 22 bp, Homo sapiens
gagggcaggggtcttgcacggt

SEQ ID NO: 8493750 - DNA, 20 bp, Homo sapiens
gagggcaggcacccatttca

SEQ ID NO: 8493751 - DNA, 22 bp, Homo sapiens
gagggcagagtctaatgatgca

SEQ ID NO: 8493752 - DNA, 22 bp, Homo sapiens
gagggcagagtctaatgatgca

SEQ ID NO: 8493753 - DNA, 20 bp, Homo sapiens
gagggcaggcacccatttca

SEQ ID NO: 8493754 - DNA, 22 bp, Homo sapiens
gagggccaaagagcaagagcct

SEQ ID NO: 8493755 - DNA, 22 bp, Homo sapiens
gagggccaaagagcaagagcct

SEQ ID NO: 8493756 - DNA, 22 bp, Homo sapiens
gagggccaaagagcaagagcct

SEQ ID NO: 8493757 - DNA, 22 bp, Homo sapiens
gagggcagtgaattttgaagct

SEQ ID NO: 8493758 - DNA, 22 bp, Homo sapiens
gagggccaatggatttcaactg

SEQ ID NO: 8493759 - DNA, 22 bp, Homo sapiens
gaggggaaagtgtgaggctgcg

SEQ ID NO: 8493760 - DNA, 22 bp, Homo sapiens
gaggggaaagtgtgaggctgcg

SEQ ID NO: 8493761 - DNA, 22 bp, Homo sapiens
gaggggaaagtgtgaggctgcg

SEQ ID NO: 8493762 - DNA, 22 bp, Homo sapiens
gaggctgggaagtccaagacca

SEQ ID NO: 8493763 - DNA, 22 bp, Homo sapiens
gaggctgggaagtccaagacca

SEQ ID NO: 8493764 - DNA, 22 bp, Homo sapiens
gaggctgggaagtccaagatca

SEQ ID NO: 8493765 - DNA, 22 bp, Homo sapiens
gaggctgggaagtccaagacca

SEQ ID NO: 8493766 - DNA, 16 bp, Homo sapiens
gaggctggcagatgtc

SEQ ID NO: 8493767 - DNA, 22 bp, Homo sapiens
gaggctgggaagtccaagacca

SEQ ID NO: 8493768 - DNA, 16 bp, Homo sapiens
gaggctggcagatgtc

SEQ ID NO: 8493769 - DNA, 22 bp, Homo sapiens
gaggctgggaagtccaagacca

SEQ ID NO: 8493770 - DNA, 22 bp, Homo sapiens
gaggctgggaagtccaagacca

SEQ ID NO: 8493771 - DNA, 22 bp, Homo sapiens
gaggctgggaagtccaagatca

SEQ ID NO: 8493772 - DNA, 22 bp, Homo sapiens
gaggctgggaagtccaagatca

SEQ ID NO: 8493773 - DNA, 22 bp, Homo sapiens
gaggctgggaagtccaagatca

SEQ ID NO: 8493774 - DNA, 22 bp, Homo sapiens
gaggctgggaagtccaatatca

SEQ ID NO: 8493775 - DNA, 22 bp, Homo sapiens
gaggctgggggctgccttcctc

SEQ ID NO: 8493776 - DNA, 22 bp, Homo sapiens
gaggctgggggctgccttcctc

SEQ ID NO: 8493777 - DNA, 22 bp, Homo sapiens
gagggcagagacagtgattcac

SEQ ID NO: 8493778 - DNA, 22 bp, Homo sapiens
gagggatgcagaaacagaggcc

SEQ ID NO: 8493779 - DNA, 22 bp, Homo sapiens
gagggatgcagaaacagaggcc

SEQ ID NO: 8493780 - DNA, 22 bp, Homo sapiens
gaggctgggggctgccttcctc

SEQ ID NO: 8493781 - DNA, 22 bp, Homo sapiens
gaggctggggtctgcctttctg

SEQ ID NO: 8493782 - DNA, 16 bp, Homo sapiens
gagggcagaggcggaa

SEQ ID NO: 8493783 - DNA, 16 bp, Homo sapiens
gagggcagaggcggaa

SEQ ID NO: 8493784 - DNA, 16 bp, Homo sapiens
gagggcagaggcggaa

SEQ ID NO: 8493785 - DNA, 16 bp, Homo sapiens
gagggcagaggcggaa

SEQ ID NO: 8493786 - DNA, 16 bp, Homo sapiens
gagggcagaggcggaa

SEQ ID NO: 8493787 - DNA, 22 bp, Homo sapiens
gagggcagagacagtgattcac

SEQ ID NO: 8493788 - DNA, 22 bp, Homo sapiens
gaggctggcagaaaagcacagg

SEQ ID NO: 8493789 - DNA, 22 bp, Homo sapiens
gaggctggaggtcaaagatgaa

SEQ ID NO: 8493790 - DNA, 22 bp, Homo sapiens
gaggctggcagaaaagcacagg

SEQ ID NO: 8493791 - DNA, 22 bp, Homo sapiens
gaggctggcagaaaagcacagg

SEQ ID NO: 8493792 - DNA, 22 bp, Homo sapiens
gaggctggcagaaaagcacagg

SEQ ID NO: 8493793 - DNA, 16 bp, Homo sapiens
gaggctggcagatgtc

SEQ ID NO: 8493794 - DNA, 16 bp, Homo sapiens
gaggctggcagatgtc

SEQ ID NO: 8493795 - DNA, 22 bp, Homo sapiens
gaggctggcagaaaagcacagg

SEQ ID NO: 8493796 - DNA, 22 bp, Homo sapiens
gaggctggcagaaaagcacagg

SEQ ID NO: 8493797 - DNA, 22 bp, Homo sapiens
gaggctggagatattccaatct

SEQ ID NO: 8493798 - DNA, 22 bp, Homo sapiens
gaggctggaggtcaaagatgaa

SEQ ID NO: 8493799 - DNA, 22 bp, Homo sapiens
gaggctggaggtcaaagatgaa

SEQ ID NO: 8493800 - DNA, 22 bp, Homo sapiens
gaggctggaggtcaaagatgaa

SEQ ID NO: 8493801 - DNA, 22 bp, Homo sapiens
gaggctggaatattagaaatgt

SEQ ID NO: 8493802 - DNA, 22 bp, Homo sapiens
gaggctggacgtgcatttctac

SEQ ID NO: 8493803 - DNA, 22 bp, Homo sapiens
gaggctgcccacacctgcgccg

SEQ ID NO: 8493804 - DNA, 22 bp, Homo sapiens
gaggcctgaggctgcctggagc

SEQ ID NO: 8493805 - DNA, 22 bp, Homo sapiens
gaggcctgctttggcactctgg

SEQ ID NO: 8493806 - DNA, 22 bp, Homo sapiens
gaggctgcccaactggagtgga

SEQ ID NO: 8493807 - DNA, 22 bp, Homo sapiens
ggaaacacatgatcagacatct

SEQ ID NO: 8493808 - DNA, 20 bp, Homo sapiens
ggaaacatttttatttccat

SEQ ID NO: 8493809 - DNA, 22 bp, Homo sapiens
ggaaacattccaagagttgaaa

SEQ ID NO: 8493810 - DNA, 19 bp, Homo sapiens
ggaaacaggggccagagga

SEQ ID NO: 8493811 - DNA, 22 bp, Homo sapiens
ggaaactgcttacactagaggg

SEQ ID NO: 8493812 - DNA, 22 bp, Homo sapiens
gcttctggagtcttcagaggaa

SEQ ID NO: 8493813 - DNA, 22 bp, Homo sapiens
gcttctggggttctggcatgct

SEQ ID NO: 8493814 - DNA, 22 bp, Homo sapiens
gcttctggaggagctgggctga

SEQ ID NO: 8493815 - DNA, 22 bp, Homo sapiens
gcttctggaggagctgggctga

SEQ ID NO: 8493816 - DNA, 22 bp, Homo sapiens
gcttctggaagctgcttctgcc

SEQ ID NO: 8493817 - DNA, 22 bp, Homo sapiens
ggaaacacatgatcagacatct

SEQ ID NO: 8493818 - DNA, 22 bp, Homo sapiens
ggaaaacaagagaatgatgttt

SEQ ID NO: 8493819 - DNA, 20 bp, Homo sapiens
ggaaaaatgcatgctcaaga

SEQ ID NO: 8493820 - DNA, 20 bp, Homo sapiens
ggaaaaatgcatgctcaaga

SEQ ID NO: 8493821 - DNA, 22 bp, Homo sapiens
ggaaaacaagagaatgatgttt

SEQ ID NO: 8493822 - DNA, 19 bp, Homo sapiens
ggaactcacttagagaaac

SEQ ID NO: 8493823 - DNA, 22 bp, Homo sapiens
ggaactcctgctccaagcagct

SEQ ID NO: 8493824 - DNA, 22 bp, Homo sapiens
ggaactcctgctccaagcagct

SEQ ID NO: 8493825 - DNA, 22 bp, Homo sapiens
ggaactcctgctccaagcagct

SEQ ID NO: 8493826 - DNA, 22 bp, Homo sapiens
ggaaagagggacccagcttggt

SEQ ID NO: 8493827 - DNA, 22 bp, Homo sapiens
ggaaagaatagagactttatca

SEQ ID NO: 8493828 - DNA, 22 bp, Homo sapiens
ggaaagaaccctggatggctgg

SEQ ID NO: 8493829 - DNA, 22 bp, Homo sapiens
ggaaagagaagttgggaggaat

SEQ ID NO: 8493830 - DNA, 22 bp, Homo sapiens
ggaaagaatcaagtgatcctgt

SEQ ID NO: 8493831 - DNA, 22 bp, Homo sapiens
ggaaagaatcaagtgatcctgt

SEQ ID NO: 8493832 - DNA, 22 bp, Homo sapiens
ggaaggtcgagctgcatctggc

SEQ ID NO: 8493833 - DNA, 19 bp, Homo sapiens
ggaaggtgacagtggtgaa

SEQ ID NO: 8493834 - DNA, 19 bp, Homo sapiens
ggaaggtgacagtggtgaa

SEQ ID NO: 8493835 - DNA, 19 bp, Homo sapiens
ggaaggtgacagtggtgaa

SEQ ID NO: 8493836 - DNA, 19 bp, Homo sapiens
ggaaggtgacagtggtgaa

SEQ ID NO: 8493837 - DNA, 18 bp, Homo sapiens
ggaaggtgatgtgaaaag

SEQ ID NO: 8493838 - DNA, 22 bp, Homo sapiens
ggaaggtgctccctggacagag

SEQ ID NO: 8493839 - DNA, 22 bp, Homo sapiens
ggaaggggttaggggtccctga

SEQ ID NO: 8493840 - DNA, 22 bp, Homo sapiens
ggaaggggttaggggtccctga

SEQ ID NO: 8493841 - DNA, 22 bp, Homo sapiens
ggaaggggttaggggtccctga

SEQ ID NO: 8493842 - DNA, 22 bp, Homo sapiens
ggaaggggtgtcgcccatggat

SEQ ID NO: 8493843 - DNA, 22 bp, Homo sapiens
ggaaggggtgtcgcccatggat

SEQ ID NO: 8493844 - DNA, 22 bp, Homo sapiens
ggaaggggtgtcgcccatggat

SEQ ID NO: 8493845 - DNA, 22 bp, Homo sapiens
ggaaggggttaggggtccctga

SEQ ID NO: 8493846 - DNA, 22 bp, Homo sapiens
ggaaggggttaggggtccctga

SEQ ID NO: 8493847 - DNA, 22 bp, Homo sapiens
ggaagggtttaagcaggagagt

SEQ ID NO: 8493848 - DNA, 22 bp, Homo sapiens
ggaagggagtagttggaatgca

SEQ ID NO: 8493849 - DNA, 22 bp, Homo sapiens
ggaagaaatctggttaagagat

SEQ ID NO: 8493850 - DNA, 22 bp, Homo sapiens
ggaagaaatctggttaagagat

SEQ ID NO: 8493851 - DNA, 22 bp, Homo sapiens
ggaagaaatgctcttctatgcg

SEQ ID NO: 8493852 - DNA, 22 bp, Homo sapiens
ggaagaaatgctcttctatgcg

SEQ ID NO: 8493853 - DNA, 22 bp, Homo sapiens
ggaaggggtgggtgagcctcag

SEQ ID NO: 8493854 - DNA, 22 bp, Homo sapiens
ggaaggggtgggtgagcctcag

SEQ ID NO: 8493855 - DNA, 22 bp, Homo sapiens
ggaagggcaaaagagatgaact

SEQ ID NO: 8493856 - DNA, 22 bp, Homo sapiens
ggaaggggtcacctcctgatga

SEQ ID NO: 8493857 - DNA, 21 bp, Homo sapiens
ggaaggggtcctcccaacagt

SEQ ID NO: 8493858 - DNA, 17 bp, Homo sapiens
ggaagaaaaggatcatc

SEQ ID NO: 8493859 - DNA, 18 bp, Homo sapiens
ggaagaaaaggaactcag

SEQ ID NO: 8493860 - DNA, 22 bp, Homo sapiens
ggaactgggttagggtctcttc

SEQ ID NO: 8493861 - DNA, 22 bp, Homo sapiens
ggaactggagaatgccctcttt

SEQ ID NO: 8493862 - DNA, 22 bp, Homo sapiens
ggaactgaatgtctcggtataa

SEQ ID NO: 8493863 - DNA, 22 bp, Homo sapiens
ggaagaaaggtggacaacaggt

SEQ ID NO: 8493864 - DNA, 22 bp, Homo sapiens
ggaagaaaggtggacaacaggt

SEQ ID NO: 8493865 - DNA, 22 bp, Homo sapiens
ggaagaaaggtggacaacaggt

SEQ ID NO: 8493866 - DNA, 22 bp, Homo sapiens
ggaagaaatctggttaagagat

SEQ ID NO: 8493867 - DNA, 22 bp, Homo sapiens
ggaagaaatctggttaagagat

SEQ ID NO: 8493868 - DNA, 22 bp, Homo sapiens
ggaagaaagtagaaaaccgtgg

SEQ ID NO: 8493869 - DNA, 22 bp, Homo sapiens
ggaagaaaatgggcaacaggtg

SEQ ID NO: 8493870 - DNA, 22 bp, Homo sapiens
ggaagaaaatgggcaacaggtg

SEQ ID NO: 8493871 - DNA, 22 bp, Homo sapiens
ggaagaaagacatttattttga

SEQ ID NO: 8493872 - DNA, 22 bp, Homo sapiens
ggaagaaagcacacaaacttga

SEQ ID NO: 8493873 - DNA, 22 bp, Homo sapiens
gcttcacagaatcaatagttgg

SEQ ID NO: 8493874 - DNA, 22 bp, Homo sapiens
gcttcagaaatgaacactgtct

SEQ ID NO: 8493875 - DNA, 22 bp, Homo sapiens
gcttcagaaatatcatcattat

SEQ ID NO: 8493876 - DNA, 22 bp, Homo sapiens
gcttcacaggcaagttaagcct

SEQ ID NO: 8493877 - DNA, 22 bp, Homo sapiens
gcttcagaagttgggctctgac

SEQ ID NO: 8493878 - DNA, 22 bp, Homo sapiens
gcttcaaggccaagacacctta

SEQ ID NO: 8493879 - DNA, 22 bp, Homo sapiens
gcttcaagctgttcagaactat

SEQ ID NO: 8493880 - DNA, 22 bp, Homo sapiens
gcttcagacctgaaaggaaaaa

SEQ ID NO: 8493881 - DNA, 22 bp, Homo sapiens
gcttcagactggagcagaggaa

SEQ ID NO: 8493882 - DNA, 22 bp, Homo sapiens
gcttcagattcctcttctgtaa

SEQ ID NO: 8493883 - DNA, 22 bp, Homo sapiens
gcttcagactgtgcttctgttg

SEQ ID NO: 8493884 - DNA, 22 bp, Homo sapiens
gcttcagactggagcagaggaa

SEQ ID NO: 8493885 - DNA, 22 bp, Homo sapiens
gcttcagagatttcactagttt

SEQ ID NO: 8493886 - DNA, 22 bp, Homo sapiens
gcttcagattcttttcatgtct

SEQ ID NO: 8493887 - DNA, 22 bp, Homo sapiens
gcttcagattcttttcatgtct

SEQ ID NO: 8493888 - DNA, 22 bp, Homo sapiens
gcttcagcccatcccagtacat

SEQ ID NO: 8493889 - DNA, 22 bp, Homo sapiens
gcttcatgggtgtgcaacctgt

SEQ ID NO: 8493890 - DNA, 18 bp, Homo sapiens
gcttcatggaagggttgt

SEQ ID NO: 8493891 - DNA, 22 bp, Homo sapiens
gcttcattactgacagtctgtg

SEQ ID NO: 8493892 - DNA, 22 bp, Homo sapiens
gcttcatagcattcattgcctg

SEQ ID NO: 8493893 - DNA, 22 bp, Homo sapiens
gcttcatgccaggaggtttaag

SEQ ID NO: 8493894 - DNA, 22 bp, Homo sapiens
gcttcatgaaaatcactggtca

SEQ ID NO: 8493895 - DNA, 22 bp, Homo sapiens
gcttcatgcttgctccaaagct

SEQ ID NO: 8493896 - DNA, 20 bp, Homo sapiens
gcttcagtttcctcactggt

SEQ ID NO: 8493897 - DNA, 22 bp, Homo sapiens
gcttcctgggacaggctatgtg

SEQ ID NO: 8493898 - DNA, 22 bp, Homo sapiens
gcttcctggagggagagagctg

SEQ ID NO: 8493899 - DNA, 22 bp, Homo sapiens
gcttcctggagggagagagctg

SEQ ID NO: 8493900 - DNA, 22 bp, Homo sapiens
gcttcatttctctctgtagacc

SEQ ID NO: 8493901 - DNA, 22 bp, Homo sapiens
gcttcattaatagaattagtat

SEQ ID NO: 8493902 - DNA, 22 bp, Homo sapiens
gcttcctggaacaactgttgct

SEQ ID NO: 8493903 - DNA, 22 bp, Homo sapiens
gcttcatttgagaacctctgtg

SEQ ID NO: 8493904 - DNA, 22 bp, Homo sapiens
gcttcctgtaggcaggtccaag

SEQ ID NO: 8493905 - DNA, 22 bp, Homo sapiens
gcttcctgtatcctcctgtacc

SEQ ID NO: 8493906 - DNA, 22 bp, Homo sapiens
gcttcctgtatcctcctgtacc

SEQ ID NO: 8493907 - DNA, 22 bp, Homo sapiens
gcttcctgtccaggccccacat

SEQ ID NO: 8493908 - DNA, 22 bp, Homo sapiens
gcttcctgtccctcagccatga

SEQ ID NO: 8493909 - DNA, 17 bp, Homo sapiens
gcttcctgtgctgggga

SEQ ID NO: 8493910 - DNA, 17 bp, Homo sapiens
gcttcctgtgctgggga

SEQ ID NO: 8493911 - DNA, 17 bp, Homo sapiens
gcttcctgtgctgggga

SEQ ID NO: 8493912 - DNA, 17 bp, Homo sapiens
gcttcctgtgctgggga

SEQ ID NO: 8493913 - DNA, 22 bp, Homo sapiens
gcttccttattgttgccatagt

SEQ ID NO: 8493914 - DNA, 22 bp, Homo sapiens
gcttccttattgttgccatagt

SEQ ID NO: 8493915 - DNA, 22 bp, Homo sapiens
gcttccttccttacattggtgg

SEQ ID NO: 8493916 - DNA, 22 bp, Homo sapiens
gcttccttctaccacatcatgc

SEQ ID NO: 8493917 - DNA, 22 bp, Homo sapiens
gcttccttctaccacatcatgc

SEQ ID NO: 8493918 - DNA, 22 bp, Homo sapiens
gcttccttgggaaaattagatg

SEQ ID NO: 8493919 - DNA, 22 bp, Homo sapiens
gcttccttctaccacatcatgc

SEQ ID NO: 8493920 - DNA, 22 bp, Homo sapiens
gcttccttctaccacatcatgc

SEQ ID NO: 8493921 - DNA, 22 bp, Homo sapiens
gcttctgcagggtcctcgctgt

SEQ ID NO: 8493922 - DNA, 23 bp, Homo sapiens
gcttctgccatttgctagctgtg

SEQ ID NO: 8493923 - DNA, 22 bp, Homo sapiens
gcttctgatgtcagacttctgg

SEQ ID NO: 8493924 - DNA, 22 bp, Homo sapiens
gcttctgcagccaaagaagccg

SEQ ID NO: 8493925 - DNA, 22 bp, Homo sapiens
gcttctgcagccaaagaagccg

SEQ ID NO: 8493926 - DNA, 22 bp, Homo sapiens
gcttctgcagagccgtcctgag

SEQ ID NO: 8493927 - DNA, 22 bp, Homo sapiens
gcttctgcagagccgtcctgag

SEQ ID NO: 8493928 - DNA, 22 bp, Homo sapiens
gcttctgcgcacgcttcttccc

SEQ ID NO: 8493929 - DNA, 22 bp, Homo sapiens
gcttctgccttgcactttgtca

SEQ ID NO: 8493930 - DNA, 23 bp, Homo sapiens
gcttctgccatttgctagctgtg

SEQ ID NO: 8493931 - DNA, 23 bp, Homo sapiens
gcttctgccatttgctagctgtg

SEQ ID NO: 8493932 - DNA, 22 bp, Homo sapiens
gcttctgctgttgaagccacca

SEQ ID NO: 8493933 - DNA, 22 bp, Homo sapiens
gcttctgcgcctagcctcaggt

SEQ ID NO: 8493934 - DNA, 22 bp, Homo sapiens
gcttctgctgttgaagccacca

SEQ ID NO: 8493935 - DNA, 22 bp, Homo sapiens
gcttcggggtccaagcgcgtgt

SEQ ID NO: 8493936 - DNA, 22 bp, Homo sapiens
gcttcgctgctagctagttggt

SEQ ID NO: 8493937 - DNA, 22 bp, Homo sapiens
gcttctaattttttacagaata

SEQ ID NO: 8493938 - DNA, 22 bp, Homo sapiens
gcttctacccacgagatgcaaa

SEQ ID NO: 8493939 - DNA, 22 bp, Homo sapiens
gcttctcaattctcaccctcca

SEQ ID NO: 8493940 - DNA, 22 bp, Homo sapiens
gcttctgatgtcagacttctgg

SEQ ID NO: 8493941 - DNA, 22 bp, Homo sapiens
gctgggctccaccctcaactgt

SEQ ID NO: 8493942 - DNA, 22 bp, Homo sapiens
gctgggctccaccctcaactgt

SEQ ID NO: 8493943 - DNA, 22 bp, Homo sapiens
gctgggctccaggccagggtga

SEQ ID NO: 8493944 - DNA, 22 bp, Homo sapiens
gctgggctcagacctagtgaac

SEQ ID NO: 8493945 - DNA, 22 bp, Homo sapiens
gctgggccagagcagcagcact

SEQ ID NO: 8493946 - DNA, 22 bp, Homo sapiens
gctgggccagactttcaatgtc

SEQ ID NO: 8493947 - DNA, 22 bp, Homo sapiens
gctgggccagagcagcagcact

SEQ ID NO: 8493948 - DNA, 22 bp, Homo sapiens
gctgggccagactttcaatgtc

SEQ ID NO: 8493949 - DNA, 22 bp, Homo sapiens
gctgggctccaggccagggtga

SEQ ID NO: 8493950 - DNA, 21 bp, Homo sapiens
gctgggctccagtctgccgct

SEQ ID NO: 8493951 - DNA, 22 bp, Homo sapiens
gctgggctcgttcccacacgcg

SEQ ID NO: 8493952 - DNA, 22 bp, Homo sapiens
gctgggctctgtcatgccttcc

SEQ ID NO: 8493953 - DNA, 22 bp, Homo sapiens
gctgggctctgtcatgccttcc

SEQ ID NO: 8493954 - DNA, 22 bp, Homo sapiens
gctgggctctgtcatgccttcc

SEQ ID NO: 8493955 - DNA, 22 bp, Homo sapiens
gctgggctcttatcacctgtac

SEQ ID NO: 8493956 - DNA, 22 bp, Homo sapiens
gctgggctcttatcacctgtac

SEQ ID NO: 8493957 - DNA, 22 bp, Homo sapiens
gctgggctcttatcacctgtac

SEQ ID NO: 8493958 - DNA, 22 bp, Homo sapiens
gctgggctcttatcacctgtac

SEQ ID NO: 8493959 - DNA, 22 bp, Homo sapiens
gctgggctgagaagttaagcaa

SEQ ID NO: 8493960 - DNA, 22 bp, Homo sapiens
gctgggctgagctagacttggc

SEQ ID NO: 8493961 - DNA, 22 bp, Homo sapiens
gcttaattctggctcagtttcc

SEQ ID NO: 8493962 - DNA, 22 bp, Homo sapiens
gcttacaaacaacagaaattaa

SEQ ID NO: 8493963 - DNA, 22 bp, Homo sapiens
gcttacaagccagctgtaccac

SEQ ID NO: 8493964 - DNA, 22 bp, Homo sapiens
gcttacaagatcgtgctccagt

SEQ ID NO: 8493965 - DNA, 22 bp, Homo sapiens
gcttacaagatcgtgctccagt

SEQ ID NO: 8493966 - DNA, 22 bp, Homo sapiens
gctgggctgagctagacttggc

SEQ ID NO: 8493967 - DNA, 22 bp, Homo sapiens
gctgggctgcccaacctctgac

SEQ ID NO: 8493968 - DNA, 22 bp, Homo sapiens
gctgggctgcccaacctctgac

SEQ ID NO: 8493969 - DNA, 22 bp, Homo sapiens
gcttacaagggtaggaagtcta

SEQ ID NO: 8493970 - DNA, 22 bp, Homo sapiens
gcttacaatcatttcagtttag

SEQ ID NO: 8493971 - DNA, 22 bp, Homo sapiens
gcttagaagtacacatgccttt

SEQ ID NO: 8493972 - DNA, 22 bp, Homo sapiens
gcttattttcaccttctctcag

SEQ ID NO: 8493973 - DNA, 22 bp, Homo sapiens
gcttagtgtaggacctggaata

SEQ ID NO: 8493974 - DNA, 22 bp, Homo sapiens
gcttatactctggagaataaga

SEQ ID NO: 8493975 - DNA, 22 bp, Homo sapiens
gcttagtcaattataaataggc

SEQ ID NO: 8493976 - DNA, 22 bp, Homo sapiens
gcttagtcaattataaataggc

SEQ ID NO: 8493977 - DNA, 22 bp, Homo sapiens
ggagctgaaggggtgggctcag

SEQ ID NO: 8493978 - DNA, 22 bp, Homo sapiens
ggagctcttccagcttgttgct

SEQ ID NO: 8493979 - DNA, 22 bp, Homo sapiens
ggagctctgtgtctctcctgcc

SEQ ID NO: 8493980 - DNA, 22 bp, Homo sapiens
ggagctctcttgtggtactccc

SEQ ID NO: 8493981 - DNA, 22 bp, Homo sapiens
ggagctctgaggatgcattggt

SEQ ID NO: 8493982 - DNA, 22 bp, Homo sapiens
ggagctctgaggatgcattggt

SEQ ID NO: 8493983 - DNA, 22 bp, Homo sapiens
ggagctcagaagtgagtgagtt

SEQ ID NO: 8493984 - DNA, 22 bp, Homo sapiens
ggagctcagtggggggactgtg

SEQ ID NO: 8493985 - DNA, 22 bp, Homo sapiens
ggagctcaggcccagcaaggcc

SEQ ID NO: 8493986 - DNA, 22 bp, Homo sapiens
ggagctcataacaaggtagcca

SEQ ID NO: 8493987 - DNA, 22 bp, Homo sapiens
ggagctcctggcagtgacagag

SEQ ID NO: 8493988 - DNA, 22 bp, Homo sapiens
ggagctctcctgatgtgaagat

SEQ ID NO: 8493989 - DNA, 22 bp, Homo sapiens
ggagctgaggtaacagtgagtg

SEQ ID NO: 8493990 - DNA, 22 bp, Homo sapiens
ggagctgatgacgtcaccatgg

SEQ ID NO: 8493991 - DNA, 22 bp, Homo sapiens
ggagctgcacgctctgaagcct

SEQ ID NO: 8493992 - DNA, 22 bp, Homo sapiens
ggaggaagccctcggtgcccca

SEQ ID NO: 8493993 - DNA, 22 bp, Homo sapiens
ggaggaagcacacggcttgtat

SEQ ID NO: 8493994 - DNA, 16 bp, Homo sapiens
ggaggaaggcatagtg

SEQ ID NO: 8493995 - DNA, 22 bp, Homo sapiens
ggaggaagccctcggtgcccca

SEQ ID NO: 8493996 - DNA, 22 bp, Homo sapiens
ggaggaagccctcggtgcccca

SEQ ID NO: 8493997 - DNA, 22 bp, Homo sapiens
ggaggaagggcccaggctttat

SEQ ID NO: 8493998 - DNA, 22 bp, Homo sapiens
ggaggaagggtagcataatgta

SEQ ID NO: 8493999 - DNA, 22 bp, Homo sapiens
ggaggaagcacacggcttgtat

SEQ ID NO: 8494000 - DNA, 22 bp, Homo sapiens
ggaggaagcacacggcttgtat

SEQ ID NO: 8494001 - DNA, 22 bp, Homo sapiens
ggaggaagcacacggcttgtat

SEQ ID NO: 8494002 - DNA, 22 bp, Homo sapiens
ggaggaagaggttgttctctca

SEQ ID NO: 8494003 - DNA, 22 bp, Homo sapiens
ggaggaagaggttgttctctca

SEQ ID NO: 8494004 - DNA, 22 bp, Homo sapiens
ggaggacaggggctgcagcaca

SEQ ID NO: 8494005 - DNA, 22 bp, Homo sapiens
ggaggaccccagcagctcccca

SEQ ID NO: 8494006 - DNA, 22 bp, Homo sapiens
ggaggacctgctggccctgcaa

SEQ ID NO: 8494007 - DNA, 22 bp, Homo sapiens
ggaggacaggggctgcagcaca

SEQ ID NO: 8494008 - DNA, 22 bp, Homo sapiens
ggaggacaggggctgcagcaca

SEQ ID NO: 8494009 - DNA, 22 bp, Homo sapiens
ggaggacactggctctgccttc

SEQ ID NO: 8494010 - DNA, 22 bp, Homo sapiens
ggaggaagtgcagttctactac

SEQ ID NO: 8494011 - DNA, 22 bp, Homo sapiens
ggaggaagtgcagttctactac

SEQ ID NO: 8494012 - DNA, 22 bp, Homo sapiens
ggaggagcccactcaaagggga

SEQ ID NO: 8494013 - DNA, 22 bp, Homo sapiens
ggaggagctgctgtgggggccc

SEQ ID NO: 8494014 - DNA, 22 bp, Homo sapiens
ggaggccaattttctaactgca

SEQ ID NO: 8494015 - DNA, 22 bp, Homo sapiens
ggaggccaattttctaactgca

SEQ ID NO: 8494016 - DNA, 22 bp, Homo sapiens
ggaggccaattttctaactgca

SEQ ID NO: 8494017 - DNA, 22 bp, Homo sapiens
ggaggccaccatggagtcactt

SEQ ID NO: 8494018 - DNA, 22 bp, Homo sapiens
ggaggccaccatggagtcactt

SEQ ID NO: 8494019 - DNA, 22 bp, Homo sapiens
ggaggccaccatggagtcactt

SEQ ID NO: 8494020 - DNA, 22 bp, Homo sapiens
ggaggccaccatggagtcactt

SEQ ID NO: 8494021 - DNA, 22 bp, Homo sapiens
ggaggccaagtcactgacctgg

SEQ ID NO: 8494022 - DNA, 22 bp, Homo sapiens
ggaggccaagtcactgacctgg

SEQ ID NO: 8494023 - DNA, 22 bp, Homo sapiens
ggaggccaagtcactgacctgg

SEQ ID NO: 8494024 - DNA, 22 bp, Homo sapiens
ggaggccaaggcgggcggatca

SEQ ID NO: 8494025 - DNA, 22 bp, Homo sapiens
ggaggccaaggtgggcggatca

SEQ ID NO: 8494026 - DNA, 22 bp, Homo sapiens
ggaggccaaggcgggcggatca

SEQ ID NO: 8494027 - DNA, 22 bp, Homo sapiens
ggaggccaaggtgggcggatca

SEQ ID NO: 8494028 - DNA, 22 bp, Homo sapiens
ggaggccaaggtgggcggatca

SEQ ID NO: 8494029 - DNA, 22 bp, Homo sapiens
ggaggccacctgacctgctgtt

SEQ ID NO: 8494030 - DNA, 22 bp, Homo sapiens
ggaggccacctgacctgctgtt

SEQ ID NO: 8494031 - DNA, 22 bp, Homo sapiens
ggaggccacctgacctgctgtt

SEQ ID NO: 8494032 - DNA, 22 bp, Homo sapiens
ggaggccacggtttagcaccga

SEQ ID NO: 8494033 - DNA, 22 bp, Homo sapiens
ggaggccacggtttagcaccga

SEQ ID NO: 8494034 - DNA, 22 bp, Homo sapiens
ggaggccagcctgaggctgagg

SEQ ID NO: 8494035 - DNA, 22 bp, Homo sapiens
ggaggccagcctgaggctgagg

SEQ ID NO: 8494036 - DNA, 22 bp, Homo sapiens
ggaggccagaatctgtgttgga

SEQ ID NO: 8494037 - DNA, 22 bp, Homo sapiens
ggaggccacggtttagcaccga

SEQ ID NO: 8494038 - DNA, 22 bp, Homo sapiens
ggaggccacggtttagcaccga

SEQ ID NO: 8494039 - DNA, 22 bp, Homo sapiens
ggaggcagaatagagtgtgggt

SEQ ID NO: 8494040 - DNA, 22 bp, Homo sapiens
ggaggcagaatagagtgtgggt

SEQ ID NO: 8494041 - DNA, 22 bp, Homo sapiens
ggaggccaaggcgggcggatca

SEQ ID NO: 8494042 - DNA, 22 bp, Homo sapiens
ggaggcagaatagagtgtgggt

SEQ ID NO: 8494043 - DNA, 22 bp, Homo sapiens
ggaggaggcaagtaccagatgc

SEQ ID NO: 8494044 - DNA, 22 bp, Homo sapiens
ggaggaggcaagtaccagatgc

SEQ ID NO: 8494045 - DNA, 22 bp, Homo sapiens
ggaggaggcaagtaccagatgc

SEQ ID NO: 8494046 - DNA, 22 bp, Homo sapiens
ggaggaggcaagtaccagatgc

SEQ ID NO: 8494047 - DNA, 22 bp, Homo sapiens
ggaggccatctggctggaggct

SEQ ID NO: 8494048 - DNA, 22 bp, Homo sapiens
ggaggccatctggctggaggct

SEQ ID NO: 8494049 - DNA, 22 bp, Homo sapiens
ggaggccatgaggctctaggtg

SEQ ID NO: 8494050 - DNA, 22 bp, Homo sapiens
ggaggccatgaggctctaggtg

SEQ ID NO: 8494051 - DNA, 22 bp, Homo sapiens
ggaggccatgaggctctaggtg

SEQ ID NO: 8494052 - DNA, 22 bp, Homo sapiens
ggaggccatctggctggaggct

SEQ ID NO: 8494053 - DNA, 22 bp, Homo sapiens
ggaggccatctggctggaggct

SEQ ID NO: 8494054 - DNA, 22 bp, Homo sapiens
ggaggccatctggctggaggct

SEQ ID NO: 8494055 - DNA, 22 bp, Homo sapiens
ggaggccatcagggagggcatt

SEQ ID NO: 8494056 - DNA, 22 bp, Homo sapiens
ggaggccatagtttgggagtca

SEQ ID NO: 8494057 - DNA, 22 bp, Homo sapiens
ggaggccatagtttgggagtca

SEQ ID NO: 8494058 - DNA, 22 bp, Homo sapiens
ggaggccatagtttgggagtca

SEQ ID NO: 8494059 - DNA, 22 bp, Homo sapiens
ggaggccagtcctggccgggct

SEQ ID NO: 8494060 - DNA, 22 bp, Homo sapiens
ggaggccagtcctggccgggct

SEQ ID NO: 8494061 - DNA, 22 bp, Homo sapiens
ggaggccagtcctggccgggct

SEQ ID NO: 8494062 - DNA, 22 bp, Homo sapiens
ggaggccagtcctggccgggct

SEQ ID NO: 8494063 - DNA, 22 bp, Homo sapiens
ggaggccatcagggagggcatt

SEQ ID NO: 8494064 - DNA, 22 bp, Homo sapiens
ggaggccatcagggagggcatt

SEQ ID NO: 8494065 - DNA, 22 bp, Homo sapiens
ggaggccatcagggagggcatt

SEQ ID NO: 8494066 - DNA, 22 bp, Homo sapiens
ggaggccatagtttgggagtca

SEQ ID NO: 8494067 - DNA, 22 bp, Homo sapiens
ggaggccagcctgaggctgagg

SEQ ID NO: 8494068 - DNA, 22 bp, Homo sapiens
ggaggccagcctgaggctgagg

SEQ ID NO: 8494069 - DNA, 22 bp, Homo sapiens
ggaggccagcctgaggctgagg

SEQ ID NO: 8494070 - DNA, 22 bp, Homo sapiens
ggaggccaggaagagccgccct

SEQ ID NO: 8494071 - DNA, 22 bp, Homo sapiens
ggaggccaggaagagccgccct

SEQ ID NO: 8494072 - DNA, 22 bp, Homo sapiens
ggaggccaggaaggctcggaga

SEQ ID NO: 8494073 - DNA, 22 bp, Homo sapiens
ggaggccaggaaggctcggaga

SEQ ID NO: 8494074 - DNA, 22 bp, Homo sapiens
ggaggccaggatgggaactcaa

SEQ ID NO: 8494075 - DNA, 22 bp, Homo sapiens
ggaggccaggaaggctcggaga

SEQ ID NO: 8494076 - DNA, 22 bp, Homo sapiens
ggaggccaggaaggctcggaga

SEQ ID NO: 8494077 - DNA, 22 bp, Homo sapiens
ggaggccaggtgggagtcatct

SEQ ID NO: 8494078 - DNA, 22 bp, Homo sapiens
ggaggccaggtgggagtcatct

SEQ ID NO: 8494079 - DNA, 22 bp, Homo sapiens
ggaggccagggtgggtggatcg

SEQ ID NO: 8494080 - DNA, 22 bp, Homo sapiens
ggaggccaggtgggagtcatct

SEQ ID NO: 8494081 - DNA, 22 bp, Homo sapiens
ggaggccagggtgggtggatcg

SEQ ID NO: 8494082 - DNA, 22 bp, Homo sapiens
ggaggccagggtgggtggatcg

SEQ ID NO: 8494083 - DNA, 22 bp, Homo sapiens
ggaggccagggacccagtcagc

SEQ ID NO: 8494084 - DNA, 22 bp, Homo sapiens
ggaggccagggacccagtcagc

SEQ ID NO: 8494085 - DNA, 22 bp, Homo sapiens
ggaggccaggatgggaactcaa

SEQ ID NO: 8494086 - DNA, 15 bp, Homo sapiens
ggaggccaggctgtg

SEQ ID NO: 8494087 - DNA, 22 bp, Homo sapiens
ggagcctgtggccgtcacgact

SEQ ID NO: 8494088 - DNA, 22 bp, Homo sapiens
ggagcctgtgcccaagcccaga

SEQ ID NO: 8494089 - DNA, 22 bp, Homo sapiens
ggagcctgtgcccaagcccaga

SEQ ID NO: 8494090 - DNA, 22 bp, Homo sapiens
ggagcctgtggccgtcacgact

SEQ ID NO: 8494091 - DNA, 22 bp, Homo sapiens
ggagcctgtggccgtcacgact

SEQ ID NO: 8494092 - DNA, 22 bp, Homo sapiens
ggagcctgtggctgcttgaagc

SEQ ID NO: 8494093 - DNA, 22 bp, Homo sapiens
ggagcctgttagttgagtgctc

SEQ ID NO: 8494094 - DNA, 22 bp, Homo sapiens
ggagcctgtgggatgagatgtg

SEQ ID NO: 8494095 - DNA, 22 bp, Homo sapiens
ggagcctgtgggatgagatgtg

SEQ ID NO: 8494096 - DNA, 22 bp, Homo sapiens
ggagccttccagactgcccaca

SEQ ID NO: 8494097 - DNA, 22 bp, Homo sapiens
ggagcctgttagttgagtgctc

SEQ ID NO: 8494098 - DNA, 22 bp, Homo sapiens
ggagcggtcagctggccacacg

SEQ ID NO: 8494099 - DNA, 22 bp, Homo sapiens
ggagccttgggcgctctcccat

SEQ ID NO: 8494100 - DNA, 22 bp, Homo sapiens
ggagctagtagtttcatgagtt

SEQ ID NO: 8494101 - DNA, 22 bp, Homo sapiens
ggagctcaccttggagtctctg

SEQ ID NO: 8494102 - DNA, 22 bp, Homo sapiens
ggagctaggcaaagctcacgga

SEQ ID NO: 8494103 - DNA, 22 bp, Homo sapiens
ggagatgcaatgtagaatctgg

SEQ ID NO: 8494104 - DNA, 22 bp, Homo sapiens
ggagatgccagaattgcaaatt

SEQ ID NO: 8494105 - DNA, 22 bp, Homo sapiens
ggagcctggttactagagcctg

SEQ ID NO: 8494106 - DNA, 22 bp, Homo sapiens
ggagcctgtgcccaagcccaga

SEQ ID NO: 8494107 - DNA, 22 bp, Homo sapiens
ggagcctggtcaggttggctcc

SEQ ID NO: 8494108 - DNA, 22 bp, Homo sapiens
ggagagggggctccctgcttgg

SEQ ID NO: 8494109 - DNA, 22 bp, Homo sapiens
ggagaggcttggcccagcctgg

SEQ ID NO: 8494110 - DNA, 22 bp, Homo sapiens
ggagaggggaacttgttgcttg

SEQ ID NO: 8494111 - DNA, 23 bp, Homo sapiens
ggagaggggtgtgggcatcttta

SEQ ID NO: 8494112 - DNA, 22 bp, Homo sapiens
ggagagggggctccctgcttgg

SEQ ID NO: 8494113 - DNA, 22 bp, Homo sapiens
ggagaggtgaatggctgctcta

SEQ ID NO: 8494114 - DNA, 22 bp, Homo sapiens
ggagaggtgaatggctgctcta

SEQ ID NO: 8494115 - DNA, 22 bp, Homo sapiens
ggagagggtaggggtcctgccc

SEQ ID NO: 8494116 - DNA, 22 bp, Homo sapiens
ggagagggtaggggtcctgccc

SEQ ID NO: 8494117 - DNA, 22 bp, Homo sapiens
ggagagggtaggggtcctgccc

SEQ ID NO: 8494118 - DNA, 22 bp, Homo sapiens
ggagagggtaggggtcctgccc

SEQ ID NO: 8494119 - DNA, 22 bp, Homo sapiens
ggagaggtgagaggtacaagtt

SEQ ID NO: 8494120 - DNA, 22 bp, Homo sapiens
ggagaggtgagaggtacaagtt

SEQ ID NO: 8494121 - DNA, 22 bp, Homo sapiens
ggagaggtgagaggtacaagtt

SEQ ID NO: 8494122 - DNA, 22 bp, Homo sapiens
ggagaggtgcaggtcagtggca

SEQ ID NO: 8494123 - DNA, 22 bp, Homo sapiens
ggagaggtgtattcagtgggtc

SEQ ID NO: 8494124 - DNA, 17 bp, Homo sapiens
ggagatctggcagaggg

SEQ ID NO: 8494125 - DNA, 17 bp, Homo sapiens
ggagatctggcagaggg

SEQ ID NO: 8494126 - DNA, 22 bp, Homo sapiens
ggagaggtgtattcagtgggtc

SEQ ID NO: 8494127 - DNA, 22 bp, Homo sapiens
ggagaggtgtattcagtgggtc

SEQ ID NO: 8494128 - DNA, 22 bp, Homo sapiens
ggaagtggtagagccatgagtg

SEQ ID NO: 8494129 - DNA, 22 bp, Homo sapiens
ggaagtgaggaaatattttgtt

SEQ ID NO: 8494130 - DNA, 22 bp, Homo sapiens
ggaagtgtttccttgggcagca

SEQ ID NO: 8494131 - DNA, 22 bp, Homo sapiens
ggaagtgtttccttgggcagca

SEQ ID NO: 8494132 - DNA, 22 bp, Homo sapiens
ggaagtgtttgtgcagatggcc

SEQ ID NO: 8494133 - DNA, 22 bp, Homo sapiens
ggaagtgtttgtgcagatggcc

SEQ ID NO: 8494134 - DNA, 18 bp, Homo sapiens
ggaaggtgctggagtgca

SEQ ID NO: 8494135 - DNA, 18 bp, Homo sapiens
ggaaggtgctggagtgca

SEQ ID NO: 8494136 - DNA, 18 bp, Homo sapiens
ggaagtaggaagaggaag

SEQ ID NO: 8494137 - DNA, 22 bp, Homo sapiens
ggaatactatgacacacaggtg

SEQ ID NO: 8494138 - DNA, 22 bp, Homo sapiens
ggaatacaaatctttgttctct

SEQ ID NO: 8494139 - DNA, 22 bp, Homo sapiens
ggaatagggagagaatcgtttg

SEQ ID NO: 8494140 - DNA, 22 bp, Homo sapiens
ggaatatagccagtaacagtca

SEQ ID NO: 8494141 - DNA, 22 bp, Homo sapiens
ggaataaagaatctggttcccc

SEQ ID NO: 8494142 - DNA, 22 bp, Homo sapiens
ggaagtttgggagctggtaatc

SEQ ID NO: 8494143 - DNA, 22 bp, Homo sapiens
ggagaagcaggtgctttgggtc

SEQ ID NO: 8494144 - DNA, 22 bp, Homo sapiens
ggagaagccaggtgataagcaa

SEQ ID NO: 8494145 - DNA, 21 bp, Homo sapiens
ggagaaggacaatgttgagta

SEQ ID NO: 8494146 - DNA, 22 bp, Homo sapiens
ggagaaggaatattggagtagg

SEQ ID NO: 8494147 - DNA, 21 bp, Homo sapiens
ggagaaggacaatgttgagta

SEQ ID NO: 8494148 - DNA, 22 bp, Homo sapiens
ggagaaggcacacccacctctg

SEQ ID NO: 8494149 - DNA, 22 bp, Homo sapiens
ggagaaggtggctcagcaaagg

SEQ ID NO: 8494150 - DNA, 22 bp, Homo sapiens
ggagaaggaatattggagtagg

SEQ ID NO: 8494151 - DNA, 22 bp, Homo sapiens
ggagaaggaagaaagctactat

SEQ ID NO: 8494152 - DNA, 22 bp, Homo sapiens
ggagaaggaagaaagctactat

SEQ ID NO: 8494153 - DNA, 22 bp, Homo sapiens
ggagaaggaagaaagctactat

SEQ ID NO: 8494154 - DNA, 22 bp, Homo sapiens
ggagaaggaagaaagctactat

SEQ ID NO: 8494155 - DNA, 22 bp, Homo sapiens
ggagacagcaggaagaaatatc

SEQ ID NO: 8494156 - DNA, 22 bp, Homo sapiens
ggagacactggaaagtattaca

SEQ ID NO: 8494157 - DNA, 22 bp, Homo sapiens
ggagacagcaggaagaaatatc

SEQ ID NO: 8494158 - DNA, 17 bp, Homo sapiens
ggagacagggtctttaa

SEQ ID NO: 8494159 - DNA, 17 bp, Homo sapiens
ggagacagggtctttaa

SEQ ID NO: 8494160 - DNA, 17 bp, Homo sapiens
ggagacagggtctttaa

SEQ ID NO: 8494161 - DNA, 22 bp, Homo sapiens
ggagaggcttggcccagcctgg

SEQ ID NO: 8494162 - DNA, 22 bp, Homo sapiens
ggagaaggtggctcagcaaagg

SEQ ID NO: 8494163 - DNA, 22 bp, Homo sapiens
ggagaatgatatatagctcagt

SEQ ID NO: 8494164 - DNA, 22 bp, Homo sapiens
ggagaaggtggctcagcaaagg

SEQ ID NO: 8494165 - DNA, 22 bp, Homo sapiens
ggagacaatggaggccaaaaga

SEQ ID NO: 8494166 - DNA, 22 bp, Homo sapiens
ggagacacccacattgctgggt

SEQ ID NO: 8494167 - DNA, 22 bp, Homo sapiens
ggagacacagagcaacaaaata

SEQ ID NO: 8494168 - DNA, 22 bp, Homo sapiens
ggagacacatatacagaaagag

SEQ ID NO: 8494169 - DNA, 22 bp, Homo sapiens
ggagaatgattctttgctcact

SEQ ID NO: 8494170 - DNA, 19 bp, Homo sapiens
ggcagacacagttgacatg

SEQ ID NO: 8494171 - DNA, 22 bp, Homo sapiens
ggcagacacaaaaacataaggt

SEQ ID NO: 8494172 - DNA, 22 bp, Homo sapiens
ggcagacacctttatgtctaat

SEQ ID NO: 8494173 - DNA, 22 bp, Homo sapiens
ggcagacacctttatgtctaat

SEQ ID NO: 8494174 - DNA, 21 bp, Homo sapiens
ggcagagaagctggaagttgg

SEQ ID NO: 8494175 - DNA, 21 bp, Homo sapiens
ggcagagaagctggaagttgg

SEQ ID NO: 8494176 - DNA, 22 bp, Homo sapiens
ggcagactttttctctgaaggg

SEQ ID NO: 8494177 - DNA, 22 bp, Homo sapiens
ggcagactgtaataggagaatt

SEQ ID NO: 8494178 - DNA, 22 bp, Homo sapiens
ggcagagactgggttggcagag

SEQ ID NO: 8494179 - DNA, 23 bp, Homo sapiens
ggcagagagcatggctggggccc

SEQ ID NO: 8494180 - DNA, 22 bp, Homo sapiens
ggcagagactgggttggcagag

SEQ ID NO: 8494181 - DNA, 22 bp, Homo sapiens
ggcagagactgggttggcagag

SEQ ID NO: 8494182 - DNA, 23 bp, Homo sapiens
ggcagagagcatggctggggccc

SEQ ID NO: 8494183 - DNA, 23 bp, Homo sapiens
ggcagagagcatggctggggccc

SEQ ID NO: 8494184 - DNA, 23 bp, Homo sapiens
ggcagagagcatggctggggccc

SEQ ID NO: 8494185 - DNA, 22 bp, Homo sapiens
ggcagagcttgttccttctgtt

SEQ ID NO: 8494186 - DNA, 22 bp, Homo sapiens
ggcagagcttgttccttctgtt

SEQ ID NO: 8494187 - DNA, 22 bp, Homo sapiens
ggcagagcttgttccttctgtt

SEQ ID NO: 8494188 - DNA, 22 bp, Homo sapiens
ggcagaggaagctggaagtggg

SEQ ID NO: 8494189 - DNA, 22 bp, Homo sapiens
ggcacagcaccttttcacattg

SEQ ID NO: 8494190 - DNA, 22 bp, Homo sapiens
ggcacagcactgtaggcctggg

SEQ ID NO: 8494191 - DNA, 22 bp, Homo sapiens
ggcacagcacagtggacccagg

SEQ ID NO: 8494192 - DNA, 22 bp, Homo sapiens
ggcacagagttggcagagctgc

SEQ ID NO: 8494193 - DNA, 23 bp, Homo sapiens
ggcacagatgctgagcatgtgca

SEQ ID NO: 8494194 - DNA, 23 bp, Homo sapiens
ggcacagatgctgagcatgtgca

SEQ ID NO: 8494195 - DNA, 22 bp, Homo sapiens
ggcacagagctccagccttggc

SEQ ID NO: 8494196 - DNA, 22 bp, Homo sapiens
ggcacagagctttgtcccagtt

SEQ ID NO: 8494197 - DNA, 22 bp, Homo sapiens
ggagtgggcagcactgccctgt

SEQ ID NO: 8494198 - DNA, 22 bp, Homo sapiens
ggagtgggaacaatgacatggt

SEQ ID NO: 8494199 - DNA, 22 bp, Homo sapiens
ggagtgggcagcactgccctgt

SEQ ID NO: 8494200 - DNA, 22 bp, Homo sapiens
ggagtggtggtcaggccatggc

SEQ ID NO: 8494201 - DNA, 22 bp, Homo sapiens
ggagtggtggtcaggccatggc

SEQ ID NO: 8494202 - DNA, 22 bp, Homo sapiens
ggagtggtggtcaggccatggc

SEQ ID NO: 8494203 - DNA, 22 bp, Homo sapiens
ggagtggtggtcaggccatggc

SEQ ID NO: 8494204 - DNA, 19 bp, Homo sapiens
ggagtgggtagttagtggt

SEQ ID NO: 8494205 - DNA, 22 bp, Homo sapiens
ggagtggtggtcaggccatggc

SEQ ID NO: 8494206 - DNA, 22 bp, Homo sapiens
ggagtgggaacaatgacatggt

SEQ ID NO: 8494207 - DNA, 22 bp, Homo sapiens
ggagtggctgtttctgccccca

SEQ ID NO: 8494208 - DNA, 22 bp, Homo sapiens
ggagtggctgtttctgccccca

SEQ ID NO: 8494209 - DNA, 22 bp, Homo sapiens
ggagtggctatttgtgctggtt

SEQ ID NO: 8494210 - DNA, 22 bp, Homo sapiens
ggagtggctatttgtgctggtt

SEQ ID NO: 8494211 - DNA, 22 bp, Homo sapiens
ggagtgggaacaatgacatggt

SEQ ID NO: 8494212 - DNA, 22 bp, Homo sapiens
ggagtgggaacaatgacatggt

SEQ ID NO: 8494213 - DNA, 22 bp, Homo sapiens
ggagtgggaacaatgacatggt

SEQ ID NO: 8494214 - DNA, 22 bp, Homo sapiens
ggagtggcactctgaggcgggg

SEQ ID NO: 8494215 - DNA, 22 bp, Homo sapiens
ggagtggcagagagggtatact

SEQ ID NO: 8494216 - DNA, 22 bp, Homo sapiens
ggagtggcagcgaggatcagat

SEQ ID NO: 8494217 - DNA, 22 bp, Homo sapiens
ggagtggcctctcctgtgcagg

SEQ ID NO: 8494218 - DNA, 22 bp, Homo sapiens
ggagtggcctctcctgtgcagg

SEQ ID NO: 8494219 - DNA, 22 bp, Homo sapiens
ggagtggcctctcctgtgcagg

SEQ ID NO: 8494220 - DNA, 22 bp, Homo sapiens
ggagtggcagctaggctgtcag

SEQ ID NO: 8494221 - DNA, 22 bp, Homo sapiens
ggcacacagcttggcaggagat

SEQ ID NO: 8494222 - DNA, 22 bp, Homo sapiens
ggcacacagatggagcactagc

SEQ ID NO: 8494223 - DNA, 22 bp, Homo sapiens
ggcaagggacggccgtgagaca

SEQ ID NO: 8494224 - DNA, 22 bp, Homo sapiens
ggcaagggacggccgtgagaca

SEQ ID NO: 8494225 - DNA, 22 bp, Homo sapiens
ggcaagggacggccgtgagaca

SEQ ID NO: 8494226 - DNA, 22 bp, Homo sapiens
ggcaaggccttgcccagcattc

SEQ ID NO: 8494227 - DNA, 22 bp, Homo sapiens
ggcaaggccttgcccagcattc

SEQ ID NO: 8494228 - DNA, 22 bp, Homo sapiens
ggcacagagcaggccactaatc

SEQ ID NO: 8494229 - DNA, 22 bp, Homo sapiens
ggcacagagaggccctggaagg

SEQ ID NO: 8494230 - DNA, 22 bp, Homo sapiens
ggcacacatggtggttggtgaa

SEQ ID NO: 8494231 - DNA, 22 bp, Homo sapiens
ggcacacatagatctgcactgg

SEQ ID NO: 8494232 - DNA, 22 bp, Homo sapiens
ggagtggtgtcactgagaggaa

SEQ ID NO: 8494233 - DNA, 22 bp, Homo sapiens
ggagtggtgtcactgagaggaa

SEQ ID NO: 8494234 - DNA, 22 bp, Homo sapiens
ggagtggtgtcactgagaggaa

SEQ ID NO: 8494235 - DNA, 22 bp, Homo sapiens
ggagtggtgtcactgagaggaa

SEQ ID NO: 8494236 - DNA, 22 bp, Homo sapiens
ggagtgtgggatggagctcagg

SEQ ID NO: 8494237 - DNA, 22 bp, Homo sapiens
ggagtgtggagaggacatgggt

SEQ ID NO: 8494238 - DNA, 22 bp, Homo sapiens
ggagtgtggagaggacatgggt

SEQ ID NO: 8494239 - DNA, 22 bp, Homo sapiens
ggagtgtggagaggacatgggt

SEQ ID NO: 8494240 - DNA, 22 bp, Homo sapiens
ggagttcactgtgcaggctctg

SEQ ID NO: 8494241 - DNA, 22 bp, Homo sapiens
ggagttaaggcctaagaaatag

SEQ ID NO: 8494242 - DNA, 22 bp, Homo sapiens
ggcaaggaagaagccatgatgt

SEQ ID NO: 8494243 - DNA, 22 bp, Homo sapiens
ggagttgattttggatatatta

SEQ ID NO: 8494244 - DNA, 22 bp, Homo sapiens
ggagttccagaatctgcttttt

SEQ ID NO: 8494245 - DNA, 22 bp, Homo sapiens
ggcagctgtgaagtgcctcaca

SEQ ID NO: 8494246 - DNA, 22 bp, Homo sapiens
ggcagctgtaagatgagtgaat

SEQ ID NO: 8494247 - DNA, 22 bp, Homo sapiens
ggcagctggttctttccattaa

SEQ ID NO: 8494248 - DNA, 22 bp, Homo sapiens
ggcagctgtaagatgagtgaat

SEQ ID NO: 8494249 - DNA, 22 bp, Homo sapiens
ggcagctgtaagatgagtgaat

SEQ ID NO: 8494250 - DNA, 22 bp, Homo sapiens
ggcagctggggcagtgccctgt

SEQ ID NO: 8494251 - DNA, 22 bp, Homo sapiens
ggcagctggggcagtgccctgt

SEQ ID NO: 8494252 - DNA, 22 bp, Homo sapiens
ggcagctggggcagtgccctgt

SEQ ID NO: 8494253 - DNA, 23 bp, Homo sapiens
ggcagctgggcagcactcatggg

SEQ ID NO: 8494254 - DNA, 23 bp, Homo sapiens
ggcagctgggcagcactcatggg

SEQ ID NO: 8494255 - DNA, 22 bp, Homo sapiens
ggcagctggggcagtgccctgt

SEQ ID NO: 8494256 - DNA, 22 bp, Homo sapiens
ggcagctgggtcacaccgatct

SEQ ID NO: 8494257 - DNA, 22 bp, Homo sapiens
ggcagctgggttggccagaaac

SEQ ID NO: 8494258 - DNA, 22 bp, Homo sapiens
ggcagctgggttggccagaaac

SEQ ID NO: 8494259 - DNA, 22 bp, Homo sapiens
ggcagctctgatgatgctctgg

SEQ ID NO: 8494260 - DNA, 17 bp, Homo sapiens
ggcagctgccacttttt

SEQ ID NO: 8494261 - DNA, 22 bp, Homo sapiens
ggcagctgcacgttgtcccgtc

SEQ ID NO: 8494262 - DNA, 22 bp, Homo sapiens
ggcagctgcaaatctgctctgt

SEQ ID NO: 8494263 - DNA, 19 bp, Homo sapiens
ggcagctggacgctgttca

SEQ ID NO: 8494264 - DNA, 22 bp, Homo sapiens
ggcagctggcctcctcgcccac

SEQ ID NO: 8494265 - DNA, 22 bp, Homo sapiens
ggcagaggaagctggaagtggg

SEQ ID NO: 8494266 - DNA, 22 bp, Homo sapiens
ggcagaggaagctggaagtggg

SEQ ID NO: 8494267 - DNA, 22 bp, Homo sapiens
ggcagaggaagctggaagtggg

SEQ ID NO: 8494268 - DNA, 22 bp, Homo sapiens
ggcagaggaagctggaagtggg

SEQ ID NO: 8494269 - DNA, 22 bp, Homo sapiens
ggcagaggaagctggaagtggg

SEQ ID NO: 8494270 - DNA, 22 bp, Homo sapiens
ggcagaggaagctggaagtggg

SEQ ID NO: 8494271 - DNA, 22 bp, Homo sapiens
ggcagaggaagctggaagtggg

SEQ ID NO: 8494272 - DNA, 20 bp, Homo sapiens
ggcagctctagtcgaggccc

SEQ ID NO: 8494273 - DNA, 22 bp, Homo sapiens
ggcagctcgtcaggctgcggcg

SEQ ID NO: 8494274 - DNA, 22 bp, Homo sapiens
ggcagaggaagctggaagtggg

SEQ ID NO: 8494275 - DNA, 22 bp, Homo sapiens
ggcagaggaagctggaagtggg

SEQ ID NO: 8494276 - DNA, 22 bp, Homo sapiens
ggcagaggaagctggaagtggg

SEQ ID NO: 8494277 - DNA, 22 bp, Homo sapiens
ggcaggtgctaagagaggtaaa

SEQ ID NO: 8494278 - DNA, 19 bp, Homo sapiens
ggcaggctggatagagagg

SEQ ID NO: 8494279 - DNA, 22 bp, Homo sapiens
ggcaggctgcttgggtcatgtc

SEQ ID NO: 8494280 - DNA, 22 bp, Homo sapiens
ggcaggctgggagtcatcagag

SEQ ID NO: 8494281 - DNA, 22 bp, Homo sapiens
ggcaggctggctttgttccagg

SEQ ID NO: 8494282 - DNA, 22 bp, Homo sapiens
ggcaggcgtggtggcctcagaa

SEQ ID NO: 8494283 - DNA, 22 bp, Homo sapiens
ggcaggcaggagcgtgcttggg

SEQ ID NO: 8494284 - DNA, 22 bp, Homo sapiens
ggcaggcagcctccatccacag

SEQ ID NO: 8494285 - DNA, 22 bp, Homo sapiens
ggcaggcctgagaggcagggct

SEQ ID NO: 8494286 - DNA, 22 bp, Homo sapiens
ggcaggcctgagaggcagggct

SEQ ID NO: 8494287 - DNA, 22 bp, Homo sapiens
ggcaggctcttggccttatgag

SEQ ID NO: 8494288 - DNA, 22 bp, Homo sapiens
ggcaggctgcttgggtcatgtc

SEQ ID NO: 8494289 - DNA, 22 bp, Homo sapiens
ggcaggctccaagcatcctatg

SEQ ID NO: 8494290 - DNA, 22 bp, Homo sapiens
ggcaggctccgtgttccattcc

SEQ ID NO: 8494291 - DNA, 22 bp, Homo sapiens
ggaggctcctaagctgacttga

SEQ ID NO: 8494292 - DNA, 22 bp, Homo sapiens
ggaggctcccacgcagctcaca

SEQ ID NO: 8494293 - DNA, 22 bp, Homo sapiens
ggaggctcccacgcagctcaca

SEQ ID NO: 8494294 - DNA, 22 bp, Homo sapiens
ggaggctcgctggtcgcacagc

SEQ ID NO: 8494295 - DNA, 22 bp, Homo sapiens
ggaggctctcctggccttgtct

SEQ ID NO: 8494296 - DNA, 22 bp, Homo sapiens
ggaggctctaaactttccttgg

SEQ ID NO: 8494297 - DNA, 22 bp, Homo sapiens
ggaggctgagaagtccaagatc

SEQ ID NO: 8494298 - DNA, 22 bp, Homo sapiens
ggaggctgagaggtcgcagtgg

SEQ ID NO: 8494299 - DNA, 22 bp, Homo sapiens
ggaggctgagaagtccaagatc

SEQ ID NO: 8494300 - DNA, 22 bp, Homo sapiens
ggaggctgagaagtccaagatc

SEQ ID NO: 8494301 - DNA, 22 bp, Homo sapiens
ggaggctgagaagtccaagatc

SEQ ID NO: 8494302 - DNA, 22 bp, Homo sapiens
ggaggctcttgagaggggagta

SEQ ID NO: 8494303 - DNA, 22 bp, Homo sapiens
ggaggctcttgagaggggagta

SEQ ID NO: 8494304 - DNA, 22 bp, Homo sapiens
ggaggctgaggcccctcacagg

SEQ ID NO: 8494305 - DNA, 22 bp, Homo sapiens
ggaggctgaggcccctcacagg

SEQ ID NO: 8494306 - DNA, 22 bp, Homo sapiens
ggaggctgaggcaggcggatca

SEQ ID NO: 8494307 - DNA, 22 bp, Homo sapiens
ggaggctgaggcaggcggatca

SEQ ID NO: 8494308 - DNA, 22 bp, Homo sapiens
ggaggctgagaggtcgcagtgg

SEQ ID NO: 8494309 - DNA, 22 bp, Homo sapiens
ggaggctgctgcctcacgtggg

SEQ ID NO: 8494310 - DNA, 22 bp, Homo sapiens
ggaggctgctgcctcacgtggg

SEQ ID NO: 8494311 - DNA, 22 bp, Homo sapiens
ggaggctgaggcaggcggatca

SEQ ID NO: 8494312 - DNA, 22 bp, Homo sapiens
ggaggctgaggcccctcacagg

SEQ ID NO: 8494313 - DNA, 22 bp, Homo sapiens
ggaggctgctgcctcacgtggg

SEQ ID NO: 8494314 - DNA, 22 bp, Homo sapiens
ggaggcggaggttgcagtgagc

SEQ ID NO: 8494315 - DNA, 22 bp, Homo sapiens
ggaggccttgaggccaggagct

SEQ ID NO: 8494316 - DNA, 22 bp, Homo sapiens
ggaggcctcatcttgccccgtg

SEQ ID NO: 8494317 - DNA, 22 bp, Homo sapiens
ggaggcccagagaggtgaagtg

SEQ ID NO: 8494318 - DNA, 22 bp, Homo sapiens
ggaggcctagaaaagtggttct

SEQ ID NO: 8494319 - DNA, 22 bp, Homo sapiens
ggaggccatgggcagaatcttt

SEQ ID NO: 8494320 - DNA, 22 bp, Homo sapiens
ggaggcccagaaggaagcccag

SEQ ID NO: 8494321 - DNA, 22 bp, Homo sapiens
ggaggctccatgagctcctgca

SEQ ID NO: 8494322 - DNA, 22 bp, Homo sapiens
ggaggctcagtgaggaaatgga

SEQ ID NO: 8494323 - DNA, 22 bp, Homo sapiens
ggaggctccatgagctcctgca

SEQ ID NO: 8494324 - DNA, 23 bp, Homo sapiens
ggaggctcaagtatcacgggcag

SEQ ID NO: 8494325 - DNA, 22 bp, Homo sapiens
ggaggctcagactccatcctca

SEQ ID NO: 8494326 - DNA, 23 bp, Homo sapiens
ggaggctcaagtatcacgggcag

SEQ ID NO: 8494327 - DNA, 22 bp, Homo sapiens
ggaggcggaggttgcagtgagt

SEQ ID NO: 8494328 - DNA, 22 bp, Homo sapiens
ggaggcggggaaggcatcccat

SEQ ID NO: 8494329 - DNA, 22 bp, Homo sapiens
ggaggcggaggttgcagtgagt

SEQ ID NO: 8494330 - DNA, 22 bp, Homo sapiens
ggaggcggaggttgcagtgagt

SEQ ID NO: 8494331 - DNA, 22 bp, Homo sapiens
ggaggcggaggttgcagtgagc

SEQ ID NO: 8494332 - DNA, 23 bp, Homo sapiens
ggagggcttcatcagacccccag

SEQ ID NO: 8494333 - DNA, 22 bp, Homo sapiens
ggagggctgccaggtggagcgg

SEQ ID NO: 8494334 - DNA, 22 bp, Homo sapiens
ggagggctgtagaggagacctg

SEQ ID NO: 8494335 - DNA, 22 bp, Homo sapiens
ggagggctgccaggtggagcgg

SEQ ID NO: 8494336 - DNA, 22 bp, Homo sapiens
ggagggcccctccagtgggcag

SEQ ID NO: 8494337 - DNA, 22 bp, Homo sapiens
ggagggccctgggtgcagctct

SEQ ID NO: 8494338 - DNA, 22 bp, Homo sapiens
ggagggctccctgggagtggat

SEQ ID NO: 8494339 - DNA, 22 bp, Homo sapiens
ggagggctcgtcatccaccact

SEQ ID NO: 8494340 - DNA, 22 bp, Homo sapiens
ggagggctgagactggggtctg

SEQ ID NO: 8494341 - DNA, 22 bp, Homo sapiens
ggagggcccctccagtgggcag

SEQ ID NO: 8494342 - DNA, 22 bp, Homo sapiens
ggagggccctgggtgcagctct

SEQ ID NO: 8494343 - DNA, 22 bp, Homo sapiens
ggagggccatcttgggtgtgat

SEQ ID NO: 8494344 - DNA, 22 bp, Homo sapiens
ggagggcccctccagtgggcag

SEQ ID NO: 8494345 - DNA, 22 bp, Homo sapiens
ggagggcccctccagtgggcag

SEQ ID NO: 8494346 - DNA, 22 bp, Homo sapiens
ggagggccatcttgggtgtgat

SEQ ID NO: 8494347 - DNA, 22 bp, Homo sapiens
ggagggccatcttgggtgtgat

SEQ ID NO: 8494348 - DNA, 22 bp, Homo sapiens
ggagggcatcaatcaggcctgg

SEQ ID NO: 8494349 - DNA, 22 bp, Homo sapiens
ggagggcatcaatcaggcctgg

SEQ ID NO: 8494350 - DNA, 21 bp, Homo sapiens
ggagggcagcccagactggct

SEQ ID NO: 8494351 - DNA, 21 bp, Homo sapiens
ggagggcagcccagactggct

SEQ ID NO: 8494352 - DNA, 21 bp, Homo sapiens
ggagggcagcccagactggct

SEQ ID NO: 8494353 - DNA, 22 bp, Homo sapiens
ggagggcatcaatcaggcctgg

SEQ ID NO: 8494354 - DNA, 22 bp, Homo sapiens
ggagggcatcaatcaggcctgg

SEQ ID NO: 8494355 - DNA, 20 bp, Homo sapiens
ggagggcagctgagagttgg

SEQ ID NO: 8494356 - DNA, 20 bp, Homo sapiens
ggagggcagctgagagttgg

SEQ ID NO: 8494357 - DNA, 20 bp, Homo sapiens
ggagggcagctgagagttgg

SEQ ID NO: 8494358 - DNA, 22 bp, Homo sapiens
ggagggagagtgaccctaccaa

SEQ ID NO: 8494359 - DNA, 22 bp, Homo sapiens
ggagggacccactgcggtgacc

SEQ ID NO: 8494360 - DNA, 22 bp, Homo sapiens
ggagggacccactgcggtgacc

SEQ ID NO: 8494361 - DNA, 22 bp, Homo sapiens
ggagggaatgtctagcattctt

SEQ ID NO: 8494362 - DNA, 22 bp, Homo sapiens
ggagggggactgacactgattt

SEQ ID NO: 8494363 - DNA, 22 bp, Homo sapiens
ggagggggactgacactgattt

SEQ ID NO: 8494364 - DNA, 22 bp, Homo sapiens
ggagggggactgacactgattt

SEQ ID NO: 8494365 - DNA, 22 bp, Homo sapiens
ggagggggactgacactgattt

SEQ ID NO: 8494366 - DNA, 22 bp, Homo sapiens
ggagggggactgacactgattt

SEQ ID NO: 8494367 - DNA, 22 bp, Homo sapiens
ggaggggtctctagcgaggaga

SEQ ID NO: 8494368 - DNA, 22 bp, Homo sapiens
ggaggggtctctagcgaggaga

SEQ ID NO: 8494369 - DNA, 22 bp, Homo sapiens
ggaggggtctctagcgaggaga

SEQ ID NO: 8494370 - DNA, 22 bp, Homo sapiens
ggaggggtgagaatggctgcct

SEQ ID NO: 8494371 - DNA, 22 bp, Homo sapiens
ggaggggtgagaatggctgcct

SEQ ID NO: 8494372 - DNA, 22 bp, Homo sapiens
ggaggggtggaaggagtgcctg

SEQ ID NO: 8494373 - DNA, 22 bp, Homo sapiens
ggaggggtgctcagctgtcacg

SEQ ID NO: 8494374 - DNA, 22 bp, Homo sapiens
ggaggggtgctcagctgtcacg

SEQ ID NO: 8494375 - DNA, 22 bp, Homo sapiens
ggagggtgcattttaccctgtg

SEQ ID NO: 8494376 - DNA, 22 bp, Homo sapiens
ggagggtgcattttaccctgtg

SEQ ID NO: 8494377 - DNA, 22 bp, Homo sapiens
ggagggtgcattttaccctgtg

SEQ ID NO: 8494378 - DNA, 22 bp, Homo sapiens
ggagggtgcttaagttgtgttt

SEQ ID NO: 8494379 - DNA, 22 bp, Homo sapiens
ggagggtccccagcagcatgaa

SEQ ID NO: 8494380 - DNA, 22 bp, Homo sapiens
ggagggtgcagaccctttgcaa

SEQ ID NO: 8494381 - DNA, 22 bp, Homo sapiens
ggagggtgcattttaccctgtg

SEQ ID NO: 8494382 - DNA, 22 bp, Homo sapiens
ggagggtgcagaccctttgcaa

SEQ ID NO: 8494383 - DNA, 22 bp, Homo sapiens
ggaggggtggaaggagtgcctg

SEQ ID NO: 8494384 - DNA, 22 bp, Homo sapiens
ggaggggtggaaggagtgcctg

SEQ ID NO: 8494385 - DNA, 22 bp, Homo sapiens
ggaggggtggtcacctggcagg

SEQ ID NO: 8494386 - DNA, 22 bp, Homo sapiens
ggaggggtggtcgcgaagagca

SEQ ID NO: 8494387 - DNA, 22 bp, Homo sapiens
ggagggtccactgtgaggcaga

SEQ ID NO: 8494388 - DNA, 22 bp, Homo sapiens
ggagggtccactgtgaggcaga

SEQ ID NO: 8494389 - DNA, 22 bp, Homo sapiens
ggagggtccactgtgaggcaga

SEQ ID NO: 8494390 - DNA, 22 bp, Homo sapiens
ggaggggagtctcccaaagccg

SEQ ID NO: 8494391 - DNA, 22 bp, Homo sapiens
ggaggggaggtccagctgatct

SEQ ID NO: 8494392 - DNA, 22 bp, Homo sapiens
ggaggggaggtccagctgatct

SEQ ID NO: 8494393 - DNA, 22 bp, Homo sapiens
ggaggggaggattaatgacaaa

SEQ ID NO: 8494394 - DNA, 22 bp, Homo sapiens
ggaggggaggattaatgacaaa

SEQ ID NO: 8494395 - DNA, 22 bp, Homo sapiens
ggaggggaggattaatgacaaa

SEQ ID NO: 8494396 - DNA, 22 bp, Homo sapiens
ggaggggagatgtttgggctca

SEQ ID NO: 8494397 - DNA, 22 bp, Homo sapiens
ggaggggagatgtttgggctca

SEQ ID NO: 8494398 - DNA, 22 bp, Homo sapiens
ggaggggagatgtttgggctca

SEQ ID NO: 8494399 - DNA, 22 bp, Homo sapiens
ggaggggagatgtttgggctca

SEQ ID NO: 8494400 - DNA, 22 bp, Homo sapiens
ggagggggaattcagccccagc

SEQ ID NO: 8494401 - DNA, 22 bp, Homo sapiens
ggagggggaattcagccccagc

SEQ ID NO: 8494402 - DNA, 22 bp, Homo sapiens
ggagggggaattcagccccagc

SEQ ID NO: 8494403 - DNA, 22 bp, Homo sapiens
ggagggggaattcagccccagc

SEQ ID NO: 8494404 - DNA, 22 bp, Homo sapiens
ggagggggaagaagctaaagac

SEQ ID NO: 8494405 - DNA, 22 bp, Homo sapiens
ggagggggaagaagctaaagac

SEQ ID NO: 8494406 - DNA, 22 bp, Homo sapiens
ggagggggaagaagctaaagac

SEQ ID NO: 8494407 - DNA, 22 bp, Homo sapiens
ggagggggaagaagctaaagac

SEQ ID NO: 8494408 - DNA, 22 bp, Homo sapiens
ggagggggaagaagctaaagac

SEQ ID NO: 8494409 - DNA, 22 bp, Homo sapiens
ggagggggaaactttggctgcc

SEQ ID NO: 8494410 - DNA, 22 bp, Homo sapiens
ggagggggaaactttggctgcc

SEQ ID NO: 8494411 - DNA, 22 bp, Homo sapiens
ggagggggaaactttggctgcc

SEQ ID NO: 8494412 - DNA, 22 bp, Homo sapiens
ggaggggctgagcaactttcag

SEQ ID NO: 8494413 - DNA, 22 bp, Homo sapiens
ggaggggctcctgttcgccccc

SEQ ID NO: 8494414 - DNA, 22 bp, Homo sapiens
ggaggggctcctgttcgccccc

SEQ ID NO: 8494415 - DNA, 22 bp, Homo sapiens
ggaggtgggctaaggactctct

SEQ ID NO: 8494416 - DNA, 22 bp, Homo sapiens
ggaggtgggctaaggactctct

SEQ ID NO: 8494417 - DNA, 22 bp, Homo sapiens
ggaggtgggattaggacctaaa

SEQ ID NO: 8494418 - DNA, 22 bp, Homo sapiens
ggaggtgggattaggacctaaa

SEQ ID NO: 8494419 - DNA, 22 bp, Homo sapiens
ggaggtggtggcagtgacaatt

SEQ ID NO: 8494420 - DNA, 22 bp, Homo sapiens
ggaggtgggctaaggactctct

SEQ ID NO: 8494421 - DNA, 22 bp, Homo sapiens
ggaggtggtttgatttctatat

SEQ ID NO: 8494422 - DNA, 22 bp, Homo sapiens
ggaggtggtggcagtgacaatt

SEQ ID NO: 8494423 - DNA, 22 bp, Homo sapiens
ggaggttctctctttgcagagc

SEQ ID NO: 8494424 - DNA, 22 bp, Homo sapiens
ggaggtggtttgatttctatat

SEQ ID NO: 8494425 - DNA, 22 bp, Homo sapiens
ggaggtggtggcagtgacaatt

SEQ ID NO: 8494426 - DNA, 22 bp, Homo sapiens
ggaggtggtggcagtgacaatt

SEQ ID NO: 8494427 - DNA, 22 bp, Homo sapiens
ggaggtggtggcagtgacaatt

SEQ ID NO: 8494428 - DNA, 22 bp, Homo sapiens
ggagtagctgcattccgagcac

SEQ ID NO: 8494429 - DNA, 22 bp, Homo sapiens
ggagtagctgcattccgagcac

SEQ ID NO: 8494430 - DNA, 22 bp, Homo sapiens
ggagtagctgcattccgagcac

SEQ ID NO: 8494431 - DNA, 22 bp, Homo sapiens
ggaggttctgatttgtcacaac

SEQ ID NO: 8494432 - DNA, 22 bp, Homo sapiens
ggaggtggcctgaaaatgtggc

SEQ ID NO: 8494433 - DNA, 22 bp, Homo sapiens
ggaggtggcctgaaaatgtggc

SEQ ID NO: 8494434 - DNA, 22 bp, Homo sapiens
ggaggtggcctgaaaatgtggc

SEQ ID NO: 8494435 - DNA, 22 bp, Homo sapiens
ggaggtggcagggaacataatt

SEQ ID NO: 8494436 - DNA, 22 bp, Homo sapiens
ggaggtggcctgaaaatgtggc

SEQ ID NO: 8494437 - DNA, 22 bp, Homo sapiens
ggaggtgggagacataggcggc

SEQ ID NO: 8494438 - DNA, 22 bp, Homo sapiens
ggaggtgggagacataggcggc

SEQ ID NO: 8494439 - DNA, 22 bp, Homo sapiens
ggaggtgggagacataggcggc

SEQ ID NO: 8494440 - DNA, 22 bp, Homo sapiens
ggaggtgggagcctccagtggt

SEQ ID NO: 8494441 - DNA, 22 bp, Homo sapiens
ggaggtgggagcctccagtggt

SEQ ID NO: 8494442 - DNA, 22 bp, Homo sapiens
ggaggtgggattaggacctaaa

SEQ ID NO: 8494443 - DNA, 22 bp, Homo sapiens
ggaggtgggagtttagttcttg

SEQ ID NO: 8494444 - DNA, 22 bp, Homo sapiens
ggaggtgggattaggacctaaa

SEQ ID NO: 8494445 - DNA, 22 bp, Homo sapiens
ggaggtggaggttgcagtgagc

SEQ ID NO: 8494446 - DNA, 22 bp, Homo sapiens
ggaggtggaggttgcagtgagc

SEQ ID NO: 8494447 - DNA, 22 bp, Homo sapiens
ggaggtggcagagggacattct

SEQ ID NO: 8494448 - DNA, 22 bp, Homo sapiens
ggaggtggcagagggacattct

SEQ ID NO: 8494449 - DNA, 22 bp, Homo sapiens
ggaggtggaggttgcagtgagc

SEQ ID NO: 8494450 - DNA, 22 bp, Homo sapiens
ggaggtggaggttgcagtgagc

SEQ ID NO: 8494451 - DNA, 22 bp, Homo sapiens
ggaggtggaggttgcagtgagc

SEQ ID NO: 8494452 - DNA, 22 bp, Homo sapiens
ggaggtcatagctgtgcaggta

SEQ ID NO: 8494453 - DNA, 22 bp, Homo sapiens
ggaggtccatgtgaatgtggcc

SEQ ID NO: 8494454 - DNA, 22 bp, Homo sapiens
ggaggtcacaaggtgagtaaag

SEQ ID NO: 8494455 - DNA, 22 bp, Homo sapiens
ggaggtcaaatggagggctggg

SEQ ID NO: 8494456 - DNA, 22 bp, Homo sapiens
ggaggtcacgactgggatgcct

SEQ ID NO: 8494457 - DNA, 22 bp, Homo sapiens
ggaggtcacgactgggatgcct

SEQ ID NO: 8494458 - DNA, 22 bp, Homo sapiens
ggagggtggcagcgtcctgggc

SEQ ID NO: 8494459 - DNA, 22 bp, Homo sapiens
ggagggtggcagcgtcctgggc

SEQ ID NO: 8494460 - DNA, 22 bp, Homo sapiens
ggagggtggcagcgtcctgggc

SEQ ID NO: 8494461 - DNA, 22 bp, Homo sapiens
ggagggtggcagcgtcctgggc

SEQ ID NO: 8494462 - DNA, 22 bp, Homo sapiens
ggagggtggcagcgtcctgggc

SEQ ID NO: 8494463 - DNA, 20 bp, Homo sapiens
ggagggtggaagaaagcaag

SEQ ID NO: 8494464 - DNA, 20 bp, Homo sapiens
ggagggtggaagaaagcaag

SEQ ID NO: 8494465 - DNA, 20 bp, Homo sapiens
ggagggtggaagaaagcaag

SEQ ID NO: 8494466 - DNA, 20 bp, Homo sapiens
ggaggtcaaatgatgagaag

SEQ ID NO: 8494467 - DNA, 20 bp, Homo sapiens
ggaggtcaaatgatgagaag

SEQ ID NO: 8494468 - DNA, 22 bp, Homo sapiens
ggaggtagtctgagtcataggc

SEQ ID NO: 8494469 - DNA, 22 bp, Homo sapiens
ggagggtgggtcattcttacat

SEQ ID NO: 8494470 - DNA, 22 bp, Homo sapiens
ggagggttagcaaaggcacaga

SEQ ID NO: 8494471 - DNA, 20 bp, Homo sapiens
gggcagctcccctcattctg

SEQ ID NO: 8494472 - DNA, 22 bp, Homo sapiens
gggcagctagccctctagccca

SEQ ID NO: 8494473 - DNA, 22 bp, Homo sapiens
gggcagcctcggtgcctgctgc

SEQ ID NO: 8494474 - DNA, 22 bp, Homo sapiens
gggcagcctcggtgcctgctgc

SEQ ID NO: 8494475 - DNA, 22 bp, Homo sapiens
gggcagcctgctttctgatcca

SEQ ID NO: 8494476 - DNA, 22 bp, Homo sapiens
gggcagctctcacagcagccaa

SEQ ID NO: 8494477 - DNA, 22 bp, Homo sapiens
gggcagctctcacagcagccaa

SEQ ID NO: 8494478 - DNA, 21 bp, Homo sapiens
gggccacaccttctgcagacc

SEQ ID NO: 8494479 - DNA, 22 bp, Homo sapiens
gggcagctcctgtggaatccac

SEQ ID NO: 8494480 - DNA, 22 bp, Homo sapiens
gggcagctcctgtggaatccac

SEQ ID NO: 8494481 - DNA, 22 bp, Homo sapiens
gggcagctcggaagtgggaaag

SEQ ID NO: 8494482 - DNA, 22 bp, Homo sapiens
gggccaggtcggtgaatggtca

SEQ ID NO: 8494483 - DNA, 22 bp, Homo sapiens
gggccaggtcggtgaatggtca

SEQ ID NO: 8494484 - DNA, 22 bp, Homo sapiens
gggccaggtcggtgaatggtca

SEQ ID NO: 8494485 - DNA, 22 bp, Homo sapiens
gggccaggtggaccccagcctc

SEQ ID NO: 8494486 - DNA, 22 bp, Homo sapiens
gggccaggagtggagatatggg

SEQ ID NO: 8494487 - DNA, 22 bp, Homo sapiens
gggccacattgaagggtgggta

SEQ ID NO: 8494488 - DNA, 22 bp, Homo sapiens
gggccacaggccttgcccgcag

SEQ ID NO: 8494489 - DNA, 22 bp, Homo sapiens
gggcagcaaatctgagtctggt

SEQ ID NO: 8494490 - DNA, 22 bp, Homo sapiens
gggcagcacagacagtgaaggc

SEQ ID NO: 8494491 - DNA, 18 bp, Homo sapiens
gggcagcacagcagcctc

SEQ ID NO: 8494492 - DNA, 18 bp, Homo sapiens
gggcagcacagcagcctc

SEQ ID NO: 8494493 - DNA, 22 bp, Homo sapiens
gggcagatggggcacaggctga

SEQ ID NO: 8494494 - DNA, 22 bp, Homo sapiens
gggcagaggttcaacttcaaca

SEQ ID NO: 8494495 - DNA, 22 bp, Homo sapiens
gggcagaggttcaacttcaaca

SEQ ID NO: 8494496 - DNA, 22 bp, Homo sapiens
gggcagaggttcaacttcaaca

SEQ ID NO: 8494497 - DNA, 20 bp, Homo sapiens
gggcagcctcgggagtgggt

SEQ ID NO: 8494498 - DNA, 22 bp, Homo sapiens
gggcagccgcgtgacctgccag

SEQ ID NO: 8494499 - DNA, 22 bp, Homo sapiens
gggcagccccagcgcgttggct

SEQ ID NO: 8494500 - DNA, 22 bp, Homo sapiens
gggcagcagaattggacagaaa

SEQ ID NO: 8494501 - DNA, 22 bp, Homo sapiens
gggcagcagaattggacagaaa

SEQ ID NO: 8494502 - DNA, 22 bp, Homo sapiens
gggcagcacgtttcaggaggat

SEQ ID NO: 8494503 - DNA, 22 bp, Homo sapiens
gggcagcacgtttcaggaggat

SEQ ID NO: 8494504 - DNA, 21 bp, Homo sapiens
gggcagcacgtcattcctgtg

SEQ ID NO: 8494505 - DNA, 22 bp, Homo sapiens
gggcagcactcatacctatatt

SEQ ID NO: 8494506 - DNA, 22 bp, Homo sapiens
gggcagcacgtttcaggaggat

SEQ ID NO: 8494507 - DNA, 22 bp, Homo sapiens
gggcagcacgtttcaggaggat

SEQ ID NO: 8494508 - DNA, 22 bp, Homo sapiens
gggcctgtgcacagttctgtta

SEQ ID NO: 8494509 - DNA, 22 bp, Homo sapiens
gggcctgtgtgttcaggagcct

SEQ ID NO: 8494510 - DNA, 22 bp, Homo sapiens
gggcctggtgcttctgactcct

SEQ ID NO: 8494511 - DNA, 22 bp, Homo sapiens
gggcctggtgcttctgactcct

SEQ ID NO: 8494512 - DNA, 22 bp, Homo sapiens
gggcccagcgtggttccatctg

SEQ ID NO: 8494513 - DNA, 22 bp, Homo sapiens
gggcccagcgtggttccatctg

SEQ ID NO: 8494514 - DNA, 22 bp, Homo sapiens
gggcccagcgtggttccatctg

SEQ ID NO: 8494515 - DNA, 19 bp, Homo sapiens
gggcccagcatggagggtt

SEQ ID NO: 8494516 - DNA, 23 bp, Homo sapiens
gggcccagcacaggacctggcag

SEQ ID NO: 8494517 - DNA, 23 bp, Homo sapiens
gggcccagcacaggacctggcag

SEQ ID NO: 8494518 - DNA, 22 bp, Homo sapiens
gggcccactggctgtctgaccc

SEQ ID NO: 8494519 - DNA, 22 bp, Homo sapiens
gggcccagcactggctgggatc

SEQ ID NO: 8494520 - DNA, 22 bp, Homo sapiens
gggcccagcactggctgggatc

SEQ ID NO: 8494521 - DNA, 22 bp, Homo sapiens
gggccatgagaggttcatcaac

SEQ ID NO: 8494522 - DNA, 22 bp, Homo sapiens
gggccatgagaggttcatcaac

SEQ ID NO: 8494523 - DNA, 22 bp, Homo sapiens
gggccatgagaggttcatcaac

SEQ ID NO: 8494524 - DNA, 22 bp, Homo sapiens
gggccatgagaggttcatcaac

SEQ ID NO: 8494525 - DNA, 22 bp, Homo sapiens
gggccatgagaggttcatcaac

SEQ ID NO: 8494526 - DNA, 22 bp, Homo sapiens
gggccagtgagtcgggagagct

SEQ ID NO: 8494527 - DNA, 22 bp, Homo sapiens
gggctactgagctggaactggg

SEQ ID NO: 8494528 - DNA, 22 bp, Homo sapiens
gggctaaatgcagaaatgcaga

SEQ ID NO: 8494529 - DNA, 22 bp, Homo sapiens
gggctaaatgcagaaatgcaga

SEQ ID NO: 8494530 - DNA, 22 bp, Homo sapiens
gggcggggggagctggaatgaa

SEQ ID NO: 8494531 - DNA, 22 bp, Homo sapiens
gggcggggtggctcatgcctgt

SEQ ID NO: 8494532 - DNA, 22 bp, Homo sapiens
gggcggggtggctcatgcctgt

SEQ ID NO: 8494533 - DNA, 22 bp, Homo sapiens
gggcggggtggctcatgcctgt

SEQ ID NO: 8494534 - DNA, 22 bp, Homo sapiens
gggcggtgcctgtctccgaagc

SEQ ID NO: 8494535 - DNA, 22 bp, Homo sapiens
gggcgtggatggtcagtgcagg

SEQ ID NO: 8494536 - DNA, 22 bp, Homo sapiens
gggcggggggagctggaatgaa

SEQ ID NO: 8494537 - DNA, 22 bp, Homo sapiens
gggcggggggagctggaatgaa

SEQ ID NO: 8494538 - DNA, 22 bp, Homo sapiens
gggcggggcttccgtcctccac

SEQ ID NO: 8494539 - DNA, 22 bp, Homo sapiens
gggcggggcttccgtcctccac

SEQ ID NO: 8494540 - DNA, 22 bp, Homo sapiens
gggcggggggagctggaatgaa

SEQ ID NO: 8494541 - DNA, 22 bp, Homo sapiens
gggcggatcatttgaggtcagg

SEQ ID NO: 8494542 - DNA, 22 bp, Homo sapiens
gggcggcgtcggcgaggccatc

SEQ ID NO: 8494543 - DNA, 22 bp, Homo sapiens
gggcggatcatttgaggtcagg

SEQ ID NO: 8494544 - DNA, 22 bp, Homo sapiens
gggcggatcacctgaggtcagg

SEQ ID NO: 8494545 - DNA, 22 bp, Homo sapiens
gggcggatcacctgaggtcagg

SEQ ID NO: 8494546 - DNA, 22 bp, Homo sapiens
gggcggatcatttgaggtcagg

SEQ ID NO: 8494547 - DNA, 22 bp, Homo sapiens
gggcggatcacctgaggtcagg

SEQ ID NO: 8494548 - DNA, 20 bp, Homo sapiens
gggaggcgagggctgagcag

SEQ ID NO: 8494549 - DNA, 22 bp, Homo sapiens
gggaggcgccgagggtagctaa

SEQ ID NO: 8494550 - DNA, 22 bp, Homo sapiens
gggaggctcagtggtgtcctct

SEQ ID NO: 8494551 - DNA, 22 bp, Homo sapiens
gggaggcgccgagggtagctaa

SEQ ID NO: 8494552 - DNA, 22 bp, Homo sapiens
gggaggctctgctcagcccccg

SEQ ID NO: 8494553 - DNA, 22 bp, Homo sapiens
gggaggctcagtggtgtcctct

SEQ ID NO: 8494554 - DNA, 22 bp, Homo sapiens
gggaggctggctctggccacag

SEQ ID NO: 8494555 - DNA, 22 bp, Homo sapiens
gggaggctgccatccttcagga

SEQ ID NO: 8494556 - DNA, 22 bp, Homo sapiens
gggaggagggtgctggctaaac

SEQ ID NO: 8494557 - DNA, 20 bp, Homo sapiens
gggaggccccagagtccagg

SEQ ID NO: 8494558 - DNA, 20 bp, Homo sapiens
gggagaagggctgatgagag

SEQ ID NO: 8494559 - DNA, 22 bp, Homo sapiens
gggaggagcttggagattcact

SEQ ID NO: 8494560 - DNA, 22 bp, Homo sapiens
gggaggagcttggagattcact

SEQ ID NO: 8494561 - DNA, 20 bp, Homo sapiens
gggagaagggctgatgagag

SEQ ID NO: 8494562 - DNA, 20 bp, Homo sapiens
gggagaagggctgatgagag

SEQ ID NO: 8494563 - DNA, 20 bp, Homo sapiens
gggagaagggctgatgagag

SEQ ID NO: 8494564 - DNA, 22 bp, Homo sapiens
gggagaaggaggactgtgctgt

SEQ ID NO: 8494565 - DNA, 22 bp, Homo sapiens
gggagaaggaggactgtgctgt

SEQ ID NO: 8494566 - DNA, 22 bp, Homo sapiens
gggagaaggagctagttcttga

SEQ ID NO: 8494567 - DNA, 22 bp, Homo sapiens
gggagaaggagctagttcttga

SEQ ID NO: 8494568 - DNA, 22 bp, Homo sapiens
gggacgacaggctctgtggtag

SEQ ID NO: 8494569 - DNA, 22 bp, Homo sapiens
gggacgacaggctctgtggtag

SEQ ID NO: 8494570 - DNA, 22 bp, Homo sapiens
gggacgggcacggagggccctc

SEQ ID NO: 8494571 - DNA, 22 bp, Homo sapiens
gggacgggcagtccaaggggtc

SEQ ID NO: 8494572 - DNA, 22 bp, Homo sapiens
gggacgggcacggagggccctc

SEQ ID NO: 8494573 - DNA, 22 bp, Homo sapiens
gggactccataagcacatggat

SEQ ID NO: 8494574 - DNA, 22 bp, Homo sapiens
gggagaaatgtctggcctgctg

SEQ ID NO: 8494575 - DNA, 22 bp, Homo sapiens
gggacgggcagtccaaggggtc

SEQ ID NO: 8494576 - DNA, 17 bp, Homo sapiens
gggactcaagatggggt

SEQ ID NO: 8494577 - DNA, 17 bp, Homo sapiens
gggactcaagatggggt

SEQ ID NO: 8494578 - DNA, 22 bp, Homo sapiens
gggacctgccattgctcacagg

SEQ ID NO: 8494579 - DNA, 22 bp, Homo sapiens
gggaccaggtgggtgcattccg

SEQ ID NO: 8494580 - DNA, 22 bp, Homo sapiens
gggaccaggtcagggctctgac

SEQ ID NO: 8494581 - DNA, 22 bp, Homo sapiens
gggatggctcaaaggagtcagg

SEQ ID NO: 8494582 - DNA, 22 bp, Homo sapiens
gggatggcctagactagcttgg

SEQ ID NO: 8494583 - DNA, 22 bp, Homo sapiens
gggatggctcaaaggagtcagg

SEQ ID NO: 8494584 - DNA, 22 bp, Homo sapiens
gggatggctcaaaggagtcagg

SEQ ID NO: 8494585 - DNA, 22 bp, Homo sapiens
gggatggctgcctgcatcagga

SEQ ID NO: 8494586 - DNA, 22 bp, Homo sapiens
gggatggctcaaaggagtcagg

SEQ ID NO: 8494587 - DNA, 22 bp, Homo sapiens
gggatggctttgtggctgactc

SEQ ID NO: 8494588 - DNA, 22 bp, Homo sapiens
gggatggctgcctgcatcagga

SEQ ID NO: 8494589 - DNA, 22 bp, Homo sapiens
gggatggagggtagagcaagtg

SEQ ID NO: 8494590 - DNA, 22 bp, Homo sapiens
gggatggacttggggactccag

SEQ ID NO: 8494591 - DNA, 22 bp, Homo sapiens
gggatggggagctggaaagggg

SEQ ID NO: 8494592 - DNA, 19 bp, Homo sapiens
gggatgggccctcaccctc

SEQ ID NO: 8494593 - DNA, 19 bp, Homo sapiens
gggatgggccctcaccctc

SEQ ID NO: 8494594 - DNA, 19 bp, Homo sapiens
gggatgggccctcaccctc

SEQ ID NO: 8494595 - DNA, 22 bp, Homo sapiens
gggatggggagctggaaagggg

SEQ ID NO: 8494596 - DNA, 22 bp, Homo sapiens
gggatggggagctggaaagggg

SEQ ID NO: 8494597 - DNA, 22 bp, Homo sapiens
gggatggggagctggaaagggg

SEQ ID NO: 8494598 - DNA, 22 bp, Homo sapiens
gggcagaggggcgcttccctct

SEQ ID NO: 8494599 - DNA, 22 bp, Homo sapiens
gggcagaggggcgcttccctct

SEQ ID NO: 8494600 - DNA, 22 bp, Homo sapiens
gggcagaggggcgcttccctct

SEQ ID NO: 8494601 - DNA, 22 bp, Homo sapiens
gggcagaggggcgcttccctct

SEQ ID NO: 8494602 - DNA, 22 bp, Homo sapiens
gggcagaggggcgcttccctct

SEQ ID NO: 8494603 - DNA, 22 bp, Homo sapiens
gggatggggagctggaaagggg

SEQ ID NO: 8494604 - DNA, 22 bp, Homo sapiens
gggatggggagctggaaagggg

SEQ ID NO: 8494605 - DNA, 22 bp, Homo sapiens
gggatggggagctggaaagggg

SEQ ID NO: 8494606 - DNA, 20 bp, Homo sapiens
gggatgagagtcctagctct

SEQ ID NO: 8494607 - DNA, 22 bp, Homo sapiens
gggatgaggatcaatcagggag

SEQ ID NO: 8494608 - DNA, 22 bp, Homo sapiens
gggatgataatgccagagttaa

SEQ ID NO: 8494609 - DNA, 22 bp, Homo sapiens
gggatgcagactacagggctta

SEQ ID NO: 8494610 - DNA, 22 bp, Homo sapiens
gggatgatggaaaagtctgtta

SEQ ID NO: 8494611 - DNA, 22 bp, Homo sapiens
gggatgcagtcagagcccctgt

SEQ ID NO: 8494612 - DNA, 22 bp, Homo sapiens
gggatggactgacggtagcgcg

SEQ ID NO: 8494613 - DNA, 22 bp, Homo sapiens
gggagggaaagcttgatctgtc

SEQ ID NO: 8494614 - DNA, 22 bp, Homo sapiens
gggaggctggctctggccacag

SEQ ID NO: 8494615 - DNA, 22 bp, Homo sapiens
gggagggaaggtacctgtgtga

SEQ ID NO: 8494616 - DNA, 22 bp, Homo sapiens
gggagggaaggtacctgtgtga

SEQ ID NO: 8494617 - DNA, 22 bp, Homo sapiens
gggagggaaggaccttatgaat

SEQ ID NO: 8494618 - DNA, 22 bp, Homo sapiens
ggggaaggattgagttgaccca

SEQ ID NO: 8494619 - DNA, 23 bp, Homo sapiens
ggggacagagggcagcccgcatc

SEQ ID NO: 8494620 - DNA, 23 bp, Homo sapiens
ggggacagttcccactggggtct

SEQ ID NO: 8494621 - DNA, 22 bp, Homo sapiens
ggggacagttaaagaccaagac

SEQ ID NO: 8494622 - DNA, 22 bp, Homo sapiens
ggggacagttaaagaccaagac

SEQ ID NO: 8494623 - DNA, 22 bp, Homo sapiens
ggggacagtcgatctagtgatt

SEQ ID NO: 8494624 - DNA, 22 bp, Homo sapiens
ggggacagtcgatctagtgatt

SEQ ID NO: 8494625 - DNA, 22 bp, Homo sapiens
ggggacagttaaagaccaagac

SEQ ID NO: 8494626 - DNA, 22 bp, Homo sapiens
gggctggatctcctgcaggcag

SEQ ID NO: 8494627 - DNA, 22 bp, Homo sapiens
gggctggatctcctgcaggcag

SEQ ID NO: 8494628 - DNA, 22 bp, Homo sapiens
gggctggatctcctgcaggcag

SEQ ID NO: 8494629 - DNA, 22 bp, Homo sapiens
gggctggatgtttgatgacgaa

SEQ ID NO: 8494630 - DNA, 17 bp, Homo sapiens
gggctggatggccatgg

SEQ ID NO: 8494631 - DNA, 22 bp, Homo sapiens
gggctggatgggagccttggcc

SEQ ID NO: 8494632 - DNA, 22 bp, Homo sapiens
gggctggatgggagccttggcc

SEQ ID NO: 8494633 - DNA, 22 bp, Homo sapiens
gggctggcaggacctgggctga

SEQ ID NO: 8494634 - DNA, 22 bp, Homo sapiens
gggctggcaggacctgggctga

SEQ ID NO: 8494635 - DNA, 22 bp, Homo sapiens
gggctggattactgaactgagt

SEQ ID NO: 8494636 - DNA, 22 bp, Homo sapiens
gggctggcaggacctgggctga

SEQ ID NO: 8494637 - DNA, 22 bp, Homo sapiens
gggctggcatcagttgccgaga

SEQ ID NO: 8494638 - DNA, 22 bp, Homo sapiens
gggctggaccgcgacccctgag

SEQ ID NO: 8494639 - DNA, 22 bp, Homo sapiens
gggctggaccgcgacccctgag

SEQ ID NO: 8494640 - DNA, 21 bp, Homo sapiens
gggctggacatggtggctcat

SEQ ID NO: 8494641 - DNA, 21 bp, Homo sapiens
gggctggacatggtggctcat

SEQ ID NO: 8494642 - DNA, 22 bp, Homo sapiens
gggctggaccgctcgcctccct

SEQ ID NO: 8494643 - DNA, 22 bp, Homo sapiens
gggctggaccgctcgcctccct

SEQ ID NO: 8494644 - DNA, 22 bp, Homo sapiens
gggctggagacaagtgagccgc

SEQ ID NO: 8494645 - DNA, 22 bp, Homo sapiens
gggctggagagtcccacgtggg

SEQ ID NO: 8494646 - DNA, 22 bp, Homo sapiens
gggctggagagtcccacgtggg

SEQ ID NO: 8494647 - DNA, 22 bp, Homo sapiens
gggctggagacaagtgagccgc

SEQ ID NO: 8494648 - DNA, 22 bp, Homo sapiens
gggctggactgcattgcctcgc

SEQ ID NO: 8494649 - DNA, 22 bp, Homo sapiens
gggctggagccagctgtggctg

SEQ ID NO: 8494650 - DNA, 22 bp, Homo sapiens
gggctggagccagctgtggctg

SEQ ID NO: 8494651 - DNA, 22 bp, Homo sapiens
gggctggagccagctgtggctg

SEQ ID NO: 8494652 - DNA, 16 bp, Homo sapiens
gggctggagatacagt

SEQ ID NO: 8494653 - DNA, 22 bp, Homo sapiens
gggctggagatgcttatggaga

SEQ ID NO: 8494654 - DNA, 22 bp, Homo sapiens
gggctggagcctggcggtggtt

SEQ ID NO: 8494655 - DNA, 22 bp, Homo sapiens
gggctggagccagctgtggctg

SEQ ID NO: 8494656 - DNA, 22 bp, Homo sapiens
gggctggagcctggcggtggtt

SEQ ID NO: 8494657 - DNA, 22 bp, Homo sapiens
gggctggagcctggcggtggtt

SEQ ID NO: 8494658 - DNA, 22 bp, Homo sapiens
gggctgagaattcagctttcct

SEQ ID NO: 8494659 - DNA, 22 bp, Homo sapiens
gggctgagaagttgatcccaag

SEQ ID NO: 8494660 - DNA, 22 bp, Homo sapiens
gggctgagaagttgatcccaag

SEQ ID NO: 8494661 - DNA, 22 bp, Homo sapiens
gggctgagaagttgatcccaag

SEQ ID NO: 8494662 - DNA, 22 bp, Homo sapiens
gggctgagaattcagctttcct

SEQ ID NO: 8494663 - DNA, 22 bp, Homo sapiens
gggctgagaattcagctttcct

SEQ ID NO: 8494664 - DNA, 22 bp, Homo sapiens
gggctgagaattcagctttcct

SEQ ID NO: 8494665 - DNA, 22 bp, Homo sapiens
gggctgagagctggaatctgag

SEQ ID NO: 8494666 - DNA, 22 bp, Homo sapiens
gggctgagacgatggggtcttc

SEQ ID NO: 8494667 - DNA, 22 bp, Homo sapiens
gggctgcttgctggagacagac

SEQ ID NO: 8494668 - DNA, 22 bp, Homo sapiens
gggctgcttatactgatgataa

SEQ ID NO: 8494669 - DNA, 22 bp, Homo sapiens
gggctgcttcctggggaatgct

SEQ ID NO: 8494670 - DNA, 22 bp, Homo sapiens
gggctgcttttaagggtctcag

SEQ ID NO: 8494671 - DNA, 21 bp, Homo sapiens
gggctggacatggtggctcat

SEQ ID NO: 8494672 - DNA, 22 bp, Homo sapiens
gggctggacatctaaggtagct

SEQ ID NO: 8494673 - DNA, 22 bp, Homo sapiens
gggctggaagtgcattgatgct

SEQ ID NO: 8494674 - DNA, 22 bp, Homo sapiens
gggctggaagtgcattgatgct

SEQ ID NO: 8494675 - DNA, 22 bp, Homo sapiens
gggctggaagacaggaaatgct

SEQ ID NO: 8494676 - DNA, 22 bp, Homo sapiens
gggctggaagacaggaaatgct

SEQ ID NO: 8494677 - DNA, 22 bp, Homo sapiens
gggctggaaaaacaacatacaa

SEQ ID NO: 8494678 - DNA, 22 bp, Homo sapiens
gggctggaaaaacaacatacaa

SEQ ID NO: 8494679 - DNA, 22 bp, Homo sapiens
gggctgcttttttcttagcaga

SEQ ID NO: 8494680 - DNA, 22 bp, Homo sapiens
gggctctgtggatgtgagagct

SEQ ID NO: 8494681 - DNA, 22 bp, Homo sapiens
gggctctgtccattccttcata

SEQ ID NO: 8494682 - DNA, 22 bp, Homo sapiens
gggctctgtgcaccccagcacc

SEQ ID NO: 8494683 - DNA, 22 bp, Homo sapiens
gggctctgtgcaccccagcacc

SEQ ID NO: 8494684 - DNA, 22 bp, Homo sapiens
gggctctggtacttcctggctc

SEQ ID NO: 8494685 - DNA, 22 bp, Homo sapiens
gggctagcctcttccctgctcc

SEQ ID NO: 8494686 - DNA, 22 bp, Homo sapiens
gggctagcctcttccctgctcc

SEQ ID NO: 8494687 - DNA, 22 bp, Homo sapiens
gggctctgggtcgtgtctccat

SEQ ID NO: 8494688 - DNA, 22 bp, Homo sapiens
gggctctgggtcgtgtctccat

SEQ ID NO: 8494689 - DNA, 20 bp, Homo sapiens
gggctaggtagccatttggc

SEQ ID NO: 8494690 - DNA, 22 bp, Homo sapiens
gggctaggcttggccagcactg

SEQ ID NO: 8494691 - DNA, 22 bp, Homo sapiens
gggctaggcttggccagcactg

SEQ ID NO: 8494692 - DNA, 22 bp, Homo sapiens
gggctaggcttggccagcactg

SEQ ID NO: 8494693 - DNA, 22 bp, Homo sapiens
gggctaggcttggccagcactg

SEQ ID NO: 8494694 - DNA, 22 bp, Homo sapiens
gggtgggatgccgctgtctcca

SEQ ID NO: 8494695 - DNA, 22 bp, Homo sapiens
gggtgggatgccgctgtctcca

SEQ ID NO: 8494696 - DNA, 22 bp, Homo sapiens
gggtgggatgccgctgtctcca

SEQ ID NO: 8494697 - DNA, 22 bp, Homo sapiens
gggtgggaacaggatgccagga

SEQ ID NO: 8494698 - DNA, 22 bp, Homo sapiens
gggtgggaacaggatgccagga

SEQ ID NO: 8494699 - DNA, 22 bp, Homo sapiens
gggtgggaacaggatgccagga

SEQ ID NO: 8494700 - DNA, 22 bp, Homo sapiens
gggtggctgagaacaggacccc

SEQ ID NO: 8494701 - DNA, 22 bp, Homo sapiens
gggtgaggagctgccagtcatg

SEQ ID NO: 8494702 - DNA, 22 bp, Homo sapiens
gggtgaggagctgccagtcatg

SEQ ID NO: 8494703 - DNA, 22 bp, Homo sapiens
gggtgaggagctgccagtcatg

SEQ ID NO: 8494704 - DNA, 20 bp, Homo sapiens
gggtgagatgtaggagaggg

SEQ ID NO: 8494705 - DNA, 20 bp, Homo sapiens
gggtgagatgtaggagaggg

SEQ ID NO: 8494706 - DNA, 20 bp, Homo sapiens
gggtgagatgtaggagaggg

SEQ ID NO: 8494707 - DNA, 22 bp, Homo sapiens
gggtgggcccagcccagagaag

SEQ ID NO: 8494708 - DNA, 22 bp, Homo sapiens
gggtgggcccagcccagagaag

SEQ ID NO: 8494709 - DNA, 22 bp, Homo sapiens
gggtgggccactgagcagcgtg

SEQ ID NO: 8494710 - DNA, 22 bp, Homo sapiens
gggtgggccactgagcagcgtg

SEQ ID NO: 8494711 - DNA, 22 bp, Homo sapiens
gggtgggccactgagcagcgtg

SEQ ID NO: 8494712 - DNA, 22 bp, Homo sapiens
gggtgggcccagcccagagaag

SEQ ID NO: 8494713 - DNA, 22 bp, Homo sapiens
gggtgggcctgtctggccatgt

SEQ ID NO: 8494714 - DNA, 22 bp, Homo sapiens
gggtgggcctgtctggccatgt

SEQ ID NO: 8494715 - DNA, 23 bp, Homo sapiens
gggtgggccaaattaggtagcct

SEQ ID NO: 8494716 - DNA, 23 bp, Homo sapiens
gggtgggccaaattaggtagcct

SEQ ID NO: 8494717 - DNA, 23 bp, Homo sapiens
gggtgggccaaattaggtagcct

SEQ ID NO: 8494718 - DNA, 22 bp, Homo sapiens
gggtgggatggcaggagccgct

SEQ ID NO: 8494719 - DNA, 22 bp, Homo sapiens
gggtgggatggcaggagccgct

SEQ ID NO: 8494720 - DNA, 22 bp, Homo sapiens
gggtctggagggcagcccttct

SEQ ID NO: 8494721 - DNA, 22 bp, Homo sapiens
gggtctggcatgctgagatgga

SEQ ID NO: 8494722 - DNA, 22 bp, Homo sapiens
gggtctgggcaggcgcttcctc

SEQ ID NO: 8494723 - DNA, 22 bp, Homo sapiens
gggtctgggcaggcgcttcctc

SEQ ID NO: 8494724 - DNA, 22 bp, Homo sapiens
gggtctggcatgctgagatgga

SEQ ID NO: 8494725 - DNA, 22 bp, Homo sapiens
gggtctggcatgctgagatgga

SEQ ID NO: 8494726 - DNA, 20 bp, Homo sapiens
gggtgagatgtaggagaggg

SEQ ID NO: 8494727 - DNA, 22 bp, Homo sapiens
gggtgagagtcaggcagagatt

SEQ ID NO: 8494728 - DNA, 20 bp, Homo sapiens
gggtgagatgtaggagaggg

SEQ ID NO: 8494729 - DNA, 22 bp, Homo sapiens
gggtgagacagaaagagcaaaa

SEQ ID NO: 8494730 - DNA, 22 bp, Homo sapiens
gggtgagagtcaggcagagatt

SEQ ID NO: 8494731 - DNA, 22 bp, Homo sapiens
gggtgaagctcctgcaggggcc

SEQ ID NO: 8494732 - DNA, 22 bp, Homo sapiens
gggtgacatttcccaatgagcc

SEQ ID NO: 8494733 - DNA, 22 bp, Homo sapiens
gggtgacattaggaagatagac

SEQ ID NO: 8494734 - DNA, 22 bp, Homo sapiens
gggtctcctgagagaagatgct

SEQ ID NO: 8494735 - DNA, 22 bp, Homo sapiens
gggtctcctaatggaggatgac

SEQ ID NO: 8494736 - DNA, 22 bp, Homo sapiens
gggtctcctgagagaagatgct

SEQ ID NO: 8494737 - DNA, 22 bp, Homo sapiens
gggtctctcctccccagctgtg

SEQ ID NO: 8494738 - DNA, 21 bp, Homo sapiens
gggtctgaatatctggtgctg

SEQ ID NO: 8494739 - DNA, 22 bp, Homo sapiens
gggtctgacctgggcacaccat

SEQ ID NO: 8494740 - DNA, 22 bp, Homo sapiens
gggtctggacggctgcaggaag

SEQ ID NO: 8494741 - DNA, 22 bp, Homo sapiens
gggtctggacggctgcaggaag

SEQ ID NO: 8494742 - DNA, 22 bp, Homo sapiens
gggtctggagatccgggtgaag

SEQ ID NO: 8494743 - DNA, 22 bp, Homo sapiens
gggtctgagctgaggggaaatc

SEQ ID NO: 8494744 - DNA, 22 bp, Homo sapiens
gggtctgagctgaggggaaatc

SEQ ID NO: 8494745 - DNA, 22 bp, Homo sapiens
gggtctgaggagtaccattgtc

SEQ ID NO: 8494746 - DNA, 22 bp, Homo sapiens
gggtctgagggccttaccactc

SEQ ID NO: 8494747 - DNA, 22 bp, Homo sapiens
gggtctggacggctgcaggaag

SEQ ID NO: 8494748 - DNA, 22 bp, Homo sapiens
gggtccagctacatcagggtgg

SEQ ID NO: 8494749 - DNA, 22 bp, Homo sapiens
gggtccaggcactatgctaagt

SEQ ID NO: 8494750 - DNA, 18 bp, Homo sapiens
ggggtagagtgtcctatt

SEQ ID NO: 8494751 - DNA, 18 bp, Homo sapiens
ggggtagagtgtcctatt

SEQ ID NO: 8494752 - DNA, 22 bp, Homo sapiens
ggggtactggctggagccccac

SEQ ID NO: 8494753 - DNA, 22 bp, Homo sapiens
ggggggcagctgtcctggccat

SEQ ID NO: 8494754 - DNA, 22 bp, Homo sapiens
ggggggcagctgtcctggccat

SEQ ID NO: 8494755 - DNA, 22 bp, Homo sapiens
gggggggtcttcagacctcaga

SEQ ID NO: 8494756 - DNA, 22 bp, Homo sapiens
ggggggtgacaagtagaggttg

SEQ ID NO: 8494757 - DNA, 22 bp, Homo sapiens
ggggggtgctgatcagtggagc

SEQ ID NO: 8494758 - DNA, 22 bp, Homo sapiens
ggggggtgctgatcagtggagc

SEQ ID NO: 8494759 - DNA, 22 bp, Homo sapiens
gggggtcccaagctgggctgct

SEQ ID NO: 8494760 - DNA, 22 bp, Homo sapiens
gggggtaggcagacaaggacat

SEQ ID NO: 8494761 - DNA, 22 bp, Homo sapiens
gggggctgtcctgtgcattgta

SEQ ID NO: 8494762 - DNA, 23 bp, Homo sapiens
gggggctggttgactctctgcag

SEQ ID NO: 8494763 - DNA, 22 bp, Homo sapiens
gggggcttggcccggtctggtt

SEQ ID NO: 8494764 - DNA, 22 bp, Homo sapiens
gggggctgtcctgtgcattgta

SEQ ID NO: 8494765 - DNA, 22 bp, Homo sapiens
gggggctgtcctgtgcattgta

SEQ ID NO: 8494766 - DNA, 22 bp, Homo sapiens
gggggctggactttcccacaca

SEQ ID NO: 8494767 - DNA, 23 bp, Homo sapiens
gggggctggttgactctctgcag

SEQ ID NO: 8494768 - DNA, 22 bp, Homo sapiens
gggggctgaggctgttctgagg

SEQ ID NO: 8494769 - DNA, 22 bp, Homo sapiens
gggggctggaatatccatcaac

SEQ ID NO: 8494770 - DNA, 22 bp, Homo sapiens
gggggctggactttcccacaca

SEQ ID NO: 8494771 - DNA, 22 bp, Homo sapiens
gggggctggaatatccatcaac

SEQ ID NO: 8494772 - DNA, 22 bp, Homo sapiens
gggggctggaatatccatcaac

SEQ ID NO: 8494773 - DNA, 22 bp, Homo sapiens
gggggctggaatatccatcaac

SEQ ID NO: 8494774 - DNA, 22 bp, Homo sapiens
ggggactgccttccacagacac

SEQ ID NO: 8494775 - DNA, 19 bp, Homo sapiens
ggggagaactagagacagc

SEQ ID NO: 8494776 - DNA, 22 bp, Homo sapiens
ggggaccctcaggactgcgtct

SEQ ID NO: 8494777 - DNA, 22 bp, Homo sapiens
ggggaccctcaggactgcgtct

SEQ ID NO: 8494778 - DNA, 22 bp, Homo sapiens
ggggaccctcaggactgcgtct

SEQ ID NO: 8494779 - DNA, 22 bp, Homo sapiens
ggggacgggacttagcatgagt

SEQ ID NO: 8494780 - DNA, 22 bp, Homo sapiens
ggggactgaggcactgaaggtg

SEQ ID NO: 8494781 - DNA, 22 bp, Homo sapiens
ggggactctgcttctgggatca

SEQ ID NO: 8494782 - DNA, 22 bp, Homo sapiens
gggaagagatttccacatcatt

SEQ ID NO: 8494783 - DNA, 23 bp, Homo sapiens
gggaccaggcccttcctggtttg

SEQ ID NO: 8494784 - DNA, 18 bp, Homo sapiens
gggaagaggatctggccc

SEQ ID NO: 8494785 - DNA, 23 bp, Homo sapiens
gggaccaggcccttcctggtttg

SEQ ID NO: 8494786 - DNA, 22 bp, Homo sapiens
gggaagaagacatggtgaaggc

SEQ ID NO: 8494787 - DNA, 21 bp, Homo sapiens
gggaagactgtcaggattcct

SEQ ID NO: 8494788 - DNA, 22 bp, Homo sapiens
gggaagagaggaggtggtttcg

SEQ ID NO: 8494789 - DNA, 22 bp, Homo sapiens
gggaagagaccgtaccctggcc

SEQ ID NO: 8494790 - DNA, 22 bp, Homo sapiens
gggaagaagacatggtgaaggc

SEQ ID NO: 8494791 - DNA, 22 bp, Homo sapiens
gggaacagcatatctgaagggt

SEQ ID NO: 8494792 - DNA, 22 bp, Homo sapiens
ggcttcctatcccatctgagtg

SEQ ID NO: 8494793 - DNA, 22 bp, Homo sapiens
ggcttccctttccgagaggaga

SEQ ID NO: 8494794 - DNA, 22 bp, Homo sapiens
ggcttcctaatactccctacac

SEQ ID NO: 8494795 - DNA, 22 bp, Homo sapiens
ggcttcctaatactccctacac

SEQ ID NO: 8494796 - DNA, 22 bp, Homo sapiens
ggcttcctccttcctgctgtca

SEQ ID NO: 8494797 - DNA, 22 bp, Homo sapiens
ggcttcctggagaaggtctgag

SEQ ID NO: 8494798 - DNA, 22 bp, Homo sapiens
ggcttcctttcactaccctcag

SEQ ID NO: 8494799 - DNA, 22 bp, Homo sapiens
ggcttcctttcactaccctcag

SEQ ID NO: 8494800 - DNA, 22 bp, Homo sapiens
ggcttcctggggcctcctgcaa

SEQ ID NO: 8494801 - DNA, 22 bp, Homo sapiens
ggcttcctggggcctcctgcaa

SEQ ID NO: 8494802 - DNA, 22 bp, Homo sapiens
ggcttcctggggcctcctgcaa

SEQ ID NO: 8494803 - DNA, 22 bp, Homo sapiens
ggcttcctggggcctcctgcaa

SEQ ID NO: 8494804 - DNA, 22 bp, Homo sapiens
ggcttcctgggcatgtgttcta

SEQ ID NO: 8494805 - DNA, 22 bp, Homo sapiens
ggcttcctggagaaggtctgag

SEQ ID NO: 8494806 - DNA, 22 bp, Homo sapiens
ggcttcctggagaaggtctgag

SEQ ID NO: 8494807 - DNA, 18 bp, Homo sapiens
ggcttctcactgacctca

SEQ ID NO: 8494808 - DNA, 22 bp, Homo sapiens
ggcttctcagcacactgtccac

SEQ ID NO: 8494809 - DNA, 22 bp, Homo sapiens
ggcttctccaggtactgagcat

SEQ ID NO: 8494810 - DNA, 18 bp, Homo sapiens
ggcttctcactgacctca

SEQ ID NO: 8494811 - DNA, 22 bp, Homo sapiens
ggcttctcagcacactgtccac

SEQ ID NO: 8494812 - DNA, 22 bp, Homo sapiens
ggctttgggattcagcatgaga

SEQ ID NO: 8494813 - DNA, 22 bp, Homo sapiens
ggctttggggtgtgcagagatg

SEQ ID NO: 8494814 - DNA, 22 bp, Homo sapiens
gggaaaggatcagtgggaggct

SEQ ID NO: 8494815 - DNA, 22 bp, Homo sapiens
gggaaaggatcagtgggaggct

SEQ ID NO: 8494816 - DNA, 22 bp, Homo sapiens
gggaacagaggagggtgttgct

SEQ ID NO: 8494817 - DNA, 22 bp, Homo sapiens
gggaacagaggagggtgttgct

SEQ ID NO: 8494818 - DNA, 22 bp, Homo sapiens
gggaacacagacttgatgatga

SEQ ID NO: 8494819 - DNA, 21 bp, Homo sapiens
gggaaattaggattgctcatc

SEQ ID NO: 8494820 - DNA, 22 bp, Homo sapiens
ggcttccagctgggccttggag

SEQ ID NO: 8494821 - DNA, 22 bp, Homo sapiens
ggcttccaaggtcctctccacc

SEQ ID NO: 8494822 - DNA, 22 bp, Homo sapiens
ggcttcccaaggagccaggatg

SEQ ID NO: 8494823 - DNA, 22 bp, Homo sapiens
ggcttcccagcagagggcgcac

SEQ ID NO: 8494824 - DNA, 22 bp, Homo sapiens
ggcttcatttctgtccttgatt

SEQ ID NO: 8494825 - DNA, 22 bp, Homo sapiens
ggcttcatggaggaggtgagtc

SEQ ID NO: 8494826 - DNA, 22 bp, Homo sapiens
ggcttcagtgagctgagctcac

SEQ ID NO: 8494827 - DNA, 22 bp, Homo sapiens
ggcttcagtgagctgagctcac

SEQ ID NO: 8494828 - DNA, 22 bp, Homo sapiens
ggcttcagtggccagagatgat

SEQ ID NO: 8494829 - DNA, 22 bp, Homo sapiens
ggctgtgtggccgtgggctcta

SEQ ID NO: 8494830 - DNA, 21 bp, Homo sapiens
ggctgtgttcagggcatgcgg

SEQ ID NO: 8494831 - DNA, 22 bp, Homo sapiens
ggctgtgtccccacctgagcag

SEQ ID NO: 8494832 - DNA, 22 bp, Homo sapiens
ggctgtgtcctgtatgattatt

SEQ ID NO: 8494833 - DNA, 22 bp, Homo sapiens
ggcttcagtgactggtgccctc

SEQ ID NO: 8494834 - DNA, 23 bp, Homo sapiens
ggcttcagtgagagtccctgctg

SEQ ID NO: 8494835 - DNA, 22 bp, Homo sapiens
ggctggctgataaagggttgag

SEQ ID NO: 8494836 - DNA, 22 bp, Homo sapiens
ggctggctgataaagggttgag

SEQ ID NO: 8494837 - DNA, 22 bp, Homo sapiens
ggctggctggcttagcagagga

SEQ ID NO: 8494838 - DNA, 22 bp, Homo sapiens
ggctggctggcttagcagagga

SEQ ID NO: 8494839 - DNA, 22 bp, Homo sapiens
ggctggctggcttagcagagga

SEQ ID NO: 8494840 - DNA, 22 bp, Homo sapiens
ggctggctggctggtagacaag

SEQ ID NO: 8494841 - DNA, 22 bp, Homo sapiens
ggctggcttgccaagctcaggg

SEQ ID NO: 8494842 - DNA, 22 bp, Homo sapiens
ggctggcttgccaagctcaggg

SEQ ID NO: 8494843 - DNA, 22 bp, Homo sapiens
ggctgctctccatcccaggcct

SEQ ID NO: 8494844 - DNA, 22 bp, Homo sapiens
ggctgctcggcagctcctgagc

SEQ ID NO: 8494845 - DNA, 22 bp, Homo sapiens
ggctgctctgcacaggggctgg

SEQ ID NO: 8494846 - DNA, 22 bp, Homo sapiens
ggctgctctgccttccagctgg

SEQ ID NO: 8494847 - DNA, 22 bp, Homo sapiens
ggctgctctgccttccagctgg

SEQ ID NO: 8494848 - DNA, 22 bp, Homo sapiens
ggctgctctgccttccagctgg

SEQ ID NO: 8494849 - DNA, 22 bp, Homo sapiens
ggctgccttcatagaccatggg

SEQ ID NO: 8494850 - DNA, 22 bp, Homo sapiens
ggctgctcggagcctcctgtga

SEQ ID NO: 8494851 - DNA, 22 bp, Homo sapiens
ggctgctcggcagctcctgagc

SEQ ID NO: 8494852 - DNA, 22 bp, Homo sapiens
ggctgctcggagcctcctgtga

SEQ ID NO: 8494853 - DNA, 22 bp, Homo sapiens
ggctggcctcagggtcctcgct

SEQ ID NO: 8494854 - DNA, 22 bp, Homo sapiens
ggctggcctcagggtcctcgct

SEQ ID NO: 8494855 - DNA, 23 bp, Homo sapiens
ggctggcccggggctgctcctga

SEQ ID NO: 8494856 - DNA, 23 bp, Homo sapiens
ggctggcccggggctgctcctga

SEQ ID NO: 8494857 - DNA, 23 bp, Homo sapiens
ggctgctcttttcatgctgtttc

SEQ ID NO: 8494858 - DNA, 23 bp, Homo sapiens
ggctggcccggggctgctcctga

SEQ ID NO: 8494859 - DNA, 23 bp, Homo sapiens
ggctggcccggggctgctcctga

SEQ ID NO: 8494860 - DNA, 22 bp, Homo sapiens
ggctggctacattggaggaagg

SEQ ID NO: 8494861 - DNA, 22 bp, Homo sapiens
ggctggcctctacagggaggca

SEQ ID NO: 8494862 - DNA, 22 bp, Homo sapiens
ggctggcctgtgtggccgccac

SEQ ID NO: 8494863 - DNA, 22 bp, Homo sapiens
ggctgcctgtgcccaggcacac

SEQ ID NO: 8494864 - DNA, 22 bp, Homo sapiens
ggctgcctggtttagtgctgac

SEQ ID NO: 8494865 - DNA, 22 bp, Homo sapiens
ggctgcctgggagccctcctct

SEQ ID NO: 8494866 - DNA, 22 bp, Homo sapiens
ggctgcctgggagccctcctct

SEQ ID NO: 8494867 - DNA, 19 bp, Homo sapiens
ggctgcctggagcgagggc

SEQ ID NO: 8494868 - DNA, 22 bp, Homo sapiens
ggctgcctgtgcccaggcacac

SEQ ID NO: 8494869 - DNA, 18 bp, Homo sapiens
ggctgcctgttcctgaag

SEQ ID NO: 8494870 - DNA, 22 bp, Homo sapiens
ggctgcctgtgcccaggcacac

SEQ ID NO: 8494871 - DNA, 22 bp, Homo sapiens
ggctgccttcatagaccatggg

SEQ ID NO: 8494872 - DNA, 22 bp, Homo sapiens
ggctgccttcagactccagctt

SEQ ID NO: 8494873 - DNA, 22 bp, Homo sapiens
ggctgccttcagactccagctt

SEQ ID NO: 8494874 - DNA, 22 bp, Homo sapiens
ggctgccttcagactccagctt

SEQ ID NO: 8494875 - DNA, 22 bp, Homo sapiens
ggctgcaggcagaggctgtctg

SEQ ID NO: 8494876 - DNA, 19 bp, Homo sapiens
ggctgcctggagcgagggc

SEQ ID NO: 8494877 - DNA, 19 bp, Homo sapiens
ggctgcctggagcgagggc

SEQ ID NO: 8494878 - DNA, 22 bp, Homo sapiens
ggctgcaggaacgacggagggg

SEQ ID NO: 8494879 - DNA, 22 bp, Homo sapiens
ggctgcaggaacgacggagggg

SEQ ID NO: 8494880 - DNA, 22 bp, Homo sapiens
ggctgcaggaacgacggagggg

SEQ ID NO: 8494881 - DNA, 22 bp, Homo sapiens
ggctgcaggaacgacggagggg

SEQ ID NO: 8494882 - DNA, 22 bp, Homo sapiens
ggctgcaggatgcccagccgtg

SEQ ID NO: 8494883 - DNA, 22 bp, Homo sapiens
ggctgcaggatgcccagccgtg

SEQ ID NO: 8494884 - DNA, 19 bp, Homo sapiens
ggctgcagagccccggcgc

SEQ ID NO: 8494885 - DNA, 19 bp, Homo sapiens
ggctgcagagccccggcgc

SEQ ID NO: 8494886 - DNA, 19 bp, Homo sapiens
ggctgcagagccccggcgc

SEQ ID NO: 8494887 - DNA, 22 bp, Homo sapiens
ggctgcagagctgggtgggcct

SEQ ID NO: 8494888 - DNA, 22 bp, Homo sapiens
ggctgcagagctgggtgggcct

SEQ ID NO: 8494889 - DNA, 22 bp, Homo sapiens
ggctgcagagctgggtgggcct

SEQ ID NO: 8494890 - DNA, 22 bp, Homo sapiens
ggctgcagaggcgatctgaggt

SEQ ID NO: 8494891 - DNA, 22 bp, Homo sapiens
ggctgcagaggcccccagtggg

SEQ ID NO: 8494892 - DNA, 22 bp, Homo sapiens
ggctgcagaggcccccagtggg

SEQ ID NO: 8494893 - DNA, 22 bp, Homo sapiens
ggctgcagagctggtgccctgg

SEQ ID NO: 8494894 - DNA, 22 bp, Homo sapiens
ggctgatgagcttagctagaga

SEQ ID NO: 8494895 - DNA, 22 bp, Homo sapiens
ggctgatgagcttagctagaga

SEQ ID NO: 8494896 - DNA, 22 bp, Homo sapiens
ggctgatgggcatgagctgtca

SEQ ID NO: 8494897 - DNA, 22 bp, Homo sapiens
ggctgatgggcatgagctgtca

SEQ ID NO: 8494898 - DNA, 22 bp, Homo sapiens
ggctgcagaagtacttccggat

SEQ ID NO: 8494899 - DNA, 19 bp, Homo sapiens
ggctctcccttgagagagc

SEQ ID NO: 8494900 - DNA, 19 bp, Homo sapiens
ggctctcccttgagagagc

SEQ ID NO: 8494901 - DNA, 22 bp, Homo sapiens
ggctctccactatggatgagaa

SEQ ID NO: 8494902 - DNA, 22 bp, Homo sapiens
ggctctccactatggatgagaa

SEQ ID NO: 8494903 - DNA, 22 bp, Homo sapiens
ggctgagttgagaggattactt

SEQ ID NO: 8494904 - DNA, 22 bp, Homo sapiens
ggctgagttgagaggattactt

SEQ ID NO: 8494905 - DNA, 22 bp, Homo sapiens
ggctgagttgagaggattactt

SEQ ID NO: 8494906 - DNA, 22 bp, Homo sapiens
ggctcctggcatctggtgggta

SEQ ID NO: 8494907 - DNA, 22 bp, Homo sapiens
ggctcctggcatctggtgggta

SEQ ID NO: 8494908 - DNA, 23 bp, Homo sapiens
ggctcctggattcaaatcctgcc

SEQ ID NO: 8494909 - DNA, 22 bp, Homo sapiens
ggctcctggaggcaccactggt

SEQ ID NO: 8494910 - DNA, 22 bp, Homo sapiens
ggctcctggaggcaccactggt

SEQ ID NO: 8494911 - DNA, 22 bp, Homo sapiens
ggctcctgggcagctgctccct

SEQ ID NO: 8494912 - DNA, 22 bp, Homo sapiens
ggctcctgggcagctgctccct

SEQ ID NO: 8494913 - DNA, 22 bp, Homo sapiens
ggctcctgggagatagaggtca

SEQ ID NO: 8494914 - DNA, 22 bp, Homo sapiens
ggctcctgggagatagaggtca

SEQ ID NO: 8494915 - DNA, 22 bp, Homo sapiens
ggctcctgggatgggactgagc

SEQ ID NO: 8494916 - DNA, 22 bp, Homo sapiens
ggctcctgggatgggactgagc

SEQ ID NO: 8494917 - DNA, 22 bp, Homo sapiens
ggctccttcaagcctgtcactg

SEQ ID NO: 8494918 - DNA, 22 bp, Homo sapiens
ggctctagagactctagagaaa

SEQ ID NO: 8494919 - DNA, 22 bp, Homo sapiens
ggctcctggggaggtgagcttg

SEQ ID NO: 8494920 - DNA, 22 bp, Homo sapiens
ggctcctgttatttaatgagga

SEQ ID NO: 8494921 - DNA, 22 bp, Homo sapiens
ggccagagctcaaacagtcgca

SEQ ID NO: 8494922 - DNA, 22 bp, Homo sapiens
ggccagagagccgctgttagga

SEQ ID NO: 8494923 - DNA, 22 bp, Homo sapiens
ggccagagagcagccaggattc

SEQ ID NO: 8494924 - DNA, 22 bp, Homo sapiens
ggccagagagcagccaggattc

SEQ ID NO: 8494925 - DNA, 22 bp, Homo sapiens
ggccagagaatatgccttacgt

SEQ ID NO: 8494926 - DNA, 22 bp, Homo sapiens
ggccagaggccacagctgtgtc

SEQ ID NO: 8494927 - DNA, 22 bp, Homo sapiens
ggccagaggccacagctgtgtc

SEQ ID NO: 8494928 - DNA, 22 bp, Homo sapiens
ggccagaggccacagctgtgtc

SEQ ID NO: 8494929 - DNA, 22 bp, Homo sapiens
ggccagaggccatcctcctgct

SEQ ID NO: 8494930 - DNA, 22 bp, Homo sapiens
ggccagaggacctctcatagcc

SEQ ID NO: 8494931 - DNA, 22 bp, Homo sapiens
ggccagaggccacagctgtgtc

SEQ ID NO: 8494932 - DNA, 22 bp, Homo sapiens
ggccagaggccacagctgtgtc

SEQ ID NO: 8494933 - DNA, 18 bp, Homo sapiens
ggccagagggagggtccc

SEQ ID NO: 8494934 - DNA, 18 bp, Homo sapiens
ggccagagggagggtccc

SEQ ID NO: 8494935 - DNA, 18 bp, Homo sapiens
ggccagagggagggtccc

SEQ ID NO: 8494936 - DNA, 18 bp, Homo sapiens
ggccagagggagggtccc

SEQ ID NO: 8494937 - DNA, 22 bp, Homo sapiens
ggccagaggtggtacatagctt

SEQ ID NO: 8494938 - DNA, 22 bp, Homo sapiens
ggccatgggaagaggtggagag

SEQ ID NO: 8494939 - DNA, 22 bp, Homo sapiens
ggccatgggaagaggtggagag

SEQ ID NO: 8494940 - DNA, 17 bp, Homo sapiens
ggccagaggcggggctg

SEQ ID NO: 8494941 - DNA, 17 bp, Homo sapiens
ggccagaggcggggctg

SEQ ID NO: 8494942 - DNA, 18 bp, Homo sapiens
ggccagagggagggtccc

SEQ ID NO: 8494943 - DNA, 22 bp, Homo sapiens
ggccagagggagggcacaaatc

SEQ ID NO: 8494944 - DNA, 22 bp, Homo sapiens
ggcaggtgctctgtgggcctgg

SEQ ID NO: 8494945 - DNA, 22 bp, Homo sapiens
ggcaggtgctgggagcatctca

SEQ ID NO: 8494946 - DNA, 22 bp, Homo sapiens
ggcaggtggaaggtctccattc

SEQ ID NO: 8494947 - DNA, 22 bp, Homo sapiens
ggcaggtggaagttggcagagc

SEQ ID NO: 8494948 - DNA, 22 bp, Homo sapiens
ggccagaaagttaagctgtggc

SEQ ID NO: 8494949 - DNA, 22 bp, Homo sapiens
ggccaccttccagttgcctgca

SEQ ID NO: 8494950 - DNA, 22 bp, Homo sapiens
ggccaccttcctgtggtctctg

SEQ ID NO: 8494951 - DNA, 22 bp, Homo sapiens
ggccacctgggatctcatcctg

SEQ ID NO: 8494952 - DNA, 20 bp, Homo sapiens
ggccacctgcttcagacccc

SEQ ID NO: 8494953 - DNA, 22 bp, Homo sapiens
ggccagagaagtcagacccttg

SEQ ID NO: 8494954 - DNA, 22 bp, Homo sapiens
ggcccagccggcgagtctcgcg

SEQ ID NO: 8494955 - DNA, 22 bp, Homo sapiens
ggcccagccggcgagtctcgcg

SEQ ID NO: 8494956 - DNA, 22 bp, Homo sapiens
ggcccagcccgagtcagccttc

SEQ ID NO: 8494957 - DNA, 22 bp, Homo sapiens
ggcccacttgaaatggagctca

SEQ ID NO: 8494958 - DNA, 22 bp, Homo sapiens
ggcccacactgacagctgagct

SEQ ID NO: 8494959 - DNA, 22 bp, Homo sapiens
ggcccacactgacagctgagct

SEQ ID NO: 8494960 - DNA, 19 bp, Homo sapiens
ggcccaagtactgagtgcc

SEQ ID NO: 8494961 - DNA, 22 bp, Homo sapiens
ggcccaaggtgccaaggcctcc

SEQ ID NO: 8494962 - DNA, 19 bp, Homo sapiens
ggcccaagtactgagtgcc

SEQ ID NO: 8494963 - DNA, 22 bp, Homo sapiens
ggcccaaggcccaggtcgagct

SEQ ID NO: 8494964 - DNA, 22 bp, Homo sapiens
ggcccaaaccaagtacctcaaa

SEQ ID NO: 8494965 - DNA, 20 bp, Homo sapiens
ggccatgggttgcctgaggt

SEQ ID NO: 8494966 - DNA, 20 bp, Homo sapiens
ggccatgggttgcctgaggt

SEQ ID NO: 8494967 - DNA, 22 bp, Homo sapiens
ggccatggggacagagggtgaa

SEQ ID NO: 8494968 - DNA, 22 bp, Homo sapiens
ggccatggtcatgggtgagctt

SEQ ID NO: 8494969 - DNA, 22 bp, Homo sapiens
ggccatggtcatgggtgagctt

SEQ ID NO: 8494970 - DNA, 17 bp, Homo sapiens
ggccatggtgcaaggtt

SEQ ID NO: 8494971 - DNA, 22 bp, Homo sapiens
ggccatggttggggaagacatg

SEQ ID NO: 8494972 - DNA, 22 bp, Homo sapiens
ggccatggttggggaagacatg

SEQ ID NO: 8494973 - DNA, 22 bp, Homo sapiens
ggcccagcctcagacatgccct

SEQ ID NO: 8494974 - DNA, 22 bp, Homo sapiens
ggcccagcctcagacatgccct

SEQ ID NO: 8494975 - DNA, 22 bp, Homo sapiens
ggcccagccggcgagtctcgcg

SEQ ID NO: 8494976 - DNA, 22 bp, Homo sapiens
ggcccagcctggcaacaatgac

SEQ ID NO: 8494977 - DNA, 22 bp, Homo sapiens
ggcccagcctcagacatgccct

SEQ ID NO: 8494978 - DNA, 22 bp, Homo sapiens
ggcccagcctggcaacaatgac

SEQ ID NO: 8494979 - DNA, 22 bp, Homo sapiens
ggcccagccttggggtttcttt

SEQ ID NO: 8494980 - DNA, 22 bp, Homo sapiens
ggccccacgggggagtcctagt

SEQ ID NO: 8494981 - DNA, 22 bp, Homo sapiens
ggccccagattctgggctgggt

SEQ ID NO: 8494982 - DNA, 22 bp, Homo sapiens
ggccccagcagaccctcctctg

SEQ ID NO: 8494983 - DNA, 22 bp, Homo sapiens
ggcccctgcggactgcctagag

SEQ ID NO: 8494984 - DNA, 22 bp, Homo sapiens
ggcccctgcggactgcctagag

SEQ ID NO: 8494985 - DNA, 22 bp, Homo sapiens
ggcccctgcggactgcctagag

SEQ ID NO: 8494986 - DNA, 22 bp, Homo sapiens
ggcccctcttgtggcacatacg

SEQ ID NO: 8494987 - DNA, 19 bp, Homo sapiens
ggcccctctcacaggagtt

SEQ ID NO: 8494988 - DNA, 19 bp, Homo sapiens
ggcccctctcacaggagtt

SEQ ID NO: 8494989 - DNA, 22 bp, Homo sapiens
ggcccctcagcatctgagtcag

SEQ ID NO: 8494990 - DNA, 22 bp, Homo sapiens
ggccttggatccaagctgcggc

SEQ ID NO: 8494991 - DNA, 22 bp, Homo sapiens
ggccttggattttaccctaaag

SEQ ID NO: 8494992 - DNA, 21 bp, Homo sapiens
ggccttggcgggggccgaatt

SEQ ID NO: 8494993 - DNA, 22 bp, Homo sapiens
ggccttggctcctgcagggagt

SEQ ID NO: 8494994 - DNA, 22 bp, Homo sapiens
ggccttgggaggagggtcagaa

SEQ ID NO: 8494995 - DNA, 22 bp, Homo sapiens
ggccttgggaggagggtcagaa

SEQ ID NO: 8494996 - DNA, 22 bp, Homo sapiens
ggccttgggaggagggtcagaa

SEQ ID NO: 8494997 - DNA, 18 bp, Homo sapiens
ggctcagcaggctctctc

SEQ ID NO: 8494998 - DNA, 22 bp, Homo sapiens
ggctcaggatgagccttctcat

SEQ ID NO: 8494999 - DNA, 22 bp, Homo sapiens
ggctcaggatgagccttctcat

SEQ ID NO: 8495000 - DNA, 22 bp, Homo sapiens
ggctcaggactgcagcgtagag

SEQ ID NO: 8495001 - DNA, 20 bp, Homo sapiens
ggctcatcttgtctgctgac

SEQ ID NO: 8495002 - DNA, 22 bp, Homo sapiens
ggctccaaagggcagtgtgagg

SEQ ID NO: 8495003 - DNA, 22 bp, Homo sapiens
ggctccaaagggcagtgtgagg

SEQ ID NO: 8495004 - DNA, 22 bp, Homo sapiens
ggctcaggccagaccacgactc

SEQ ID NO: 8495005 - DNA, 23 bp, Homo sapiens
ggctcctgcttcatgtcccacct

SEQ ID NO: 8495006 - DNA, 22 bp, Homo sapiens
ggctcctgctgtcctttgaagc

SEQ ID NO: 8495007 - DNA, 21 bp, Homo sapiens
ggctcctgctttgtgaggggc

SEQ ID NO: 8495008 - DNA, 21 bp, Homo sapiens
ggctcctgctttgtgaggggc

SEQ ID NO: 8495009 - DNA, 21 bp, Homo sapiens
ggctcctgctttgtgaggggc

SEQ ID NO: 8495010 - DNA, 23 bp, Homo sapiens
ggctcctgcttcatgtcccacct

SEQ ID NO: 8495011 - DNA, 22 bp, Homo sapiens
ggctcctgcacctgtccctctg

SEQ ID NO: 8495012 - DNA, 22 bp, Homo sapiens
ggctccaagtctcagagtgaag

SEQ ID NO: 8495013 - DNA, 22 bp, Homo sapiens
ggctccaagtctcagagtgaag

SEQ ID NO: 8495014 - DNA, 22 bp, Homo sapiens
ggcccctgtaaaatgtacatgt

SEQ ID NO: 8495015 - DNA, 22 bp, Homo sapiens
ggccctccctgagccaggtggg

SEQ ID NO: 8495016 - DNA, 22 bp, Homo sapiens
ggccctccctgagccaggtggg

SEQ ID NO: 8495017 - DNA, 22 bp, Homo sapiens
ggcccctggcaccaggctgatt

SEQ ID NO: 8495018 - DNA, 22 bp, Homo sapiens
ggcccctggcaccaggctgatt

SEQ ID NO: 8495019 - DNA, 22 bp, Homo sapiens
ggccctctgtggctgccatgga

SEQ ID NO: 8495020 - DNA, 22 bp, Homo sapiens
ggccctgaagtgattgtgagtt

SEQ ID NO: 8495021 - DNA, 22 bp, Homo sapiens
ggccctcttttatccatcataa

SEQ ID NO: 8495022 - DNA, 22 bp, Homo sapiens
ggccctctggcttccgcatggg

SEQ ID NO: 8495023 - DNA, 22 bp, Homo sapiens
ggcctgggcccactgtcaagag

SEQ ID NO: 8495024 - DNA, 22 bp, Homo sapiens
ggcctgggcccactgtcaagag

SEQ ID NO: 8495025 - DNA, 22 bp, Homo sapiens
ggcctgggcccactgtcaagag

SEQ ID NO: 8495026 - DNA, 22 bp, Homo sapiens
ggcctgggcctttgtgttttga

SEQ ID NO: 8495027 - DNA, 23 bp, Homo sapiens
ggcctgtgttttgtctgaagtac

SEQ ID NO: 8495028 - DNA, 23 bp, Homo sapiens
ggcctgtgttttgtctgaagtac

SEQ ID NO: 8495029 - DNA, 22 bp, Homo sapiens
ggcctgggcctttgtgttttga

SEQ ID NO: 8495030 - DNA, 22 bp, Homo sapiens
ggcctgggcccactgtcaagag

SEQ ID NO: 8495031 - DNA, 22 bp, Homo sapiens
ggcctgggcccactgtcaagag

SEQ ID NO: 8495032 - DNA, 22 bp, Homo sapiens
ggcctgggcccactgtcaagag

SEQ ID NO: 8495033 - DNA, 22 bp, Homo sapiens
ggcctggctggttcagtaccct

SEQ ID NO: 8495034 - DNA, 22 bp, Homo sapiens
ggccctgagctgaagtactgtg

SEQ ID NO: 8495035 - DNA, 22 bp, Homo sapiens
ggccctgagcacagctcctctc

SEQ ID NO: 8495036 - DNA, 22 bp, Homo sapiens
ggccctgagctgaagtactgtg

SEQ ID NO: 8495037 - DNA, 22 bp, Homo sapiens
ggccctgagtctagctgctctt

SEQ ID NO: 8495038 - DNA, 22 bp, Homo sapiens
ggccctgatctcctggattctt

SEQ ID NO: 8495039 - DNA, 22 bp, Homo sapiens
ggccctgcgattaggtggcagg

SEQ ID NO: 8495040 - DNA, 22 bp, Homo sapiens
ggccttcacgtgacctggcgtg

SEQ ID NO: 8495041 - DNA, 22 bp, Homo sapiens
ggccttcacgtgacctggcgtg

SEQ ID NO: 8495042 - DNA, 22 bp, Homo sapiens
ggccttccagggaagacagggc

SEQ ID NO: 8495043 - DNA, 22 bp, Homo sapiens
ggccttcctggcggctcagggt

SEQ ID NO: 8495044 - DNA, 22 bp, Homo sapiens
ggccttcctggcggctcagggt

SEQ ID NO: 8495045 - DNA, 22 bp, Homo sapiens
ggccttcctggcggctcagggt

SEQ ID NO: 8495046 - DNA, 22 bp, Homo sapiens
ggccttcctgctgctccgggcc

SEQ ID NO: 8495047 - DNA, 21 bp, Homo sapiens
ggccttcccctgcagtctccg

SEQ ID NO: 8495048 - DNA, 22 bp, Homo sapiens
ggccttcctgctgctccgggcc

SEQ ID NO: 8495049 - DNA, 22 bp, Homo sapiens
ggccttccttcccagcctactg

SEQ ID NO: 8495050 - DNA, 22 bp, Homo sapiens
ggccttcctggcggctcagggt

SEQ ID NO: 8495051 - DNA, 22 bp, Homo sapiens
ggccttggagtcctccactgga

SEQ ID NO: 8495052 - DNA, 22 bp, Homo sapiens
ggccttgatcctccagagcact

SEQ ID NO: 8495053 - DNA, 22 bp, Homo sapiens
gtggaagtagatttgagaaggt

SEQ ID NO: 8495054 - DNA, 22 bp, Homo sapiens
gtggaaggtgctagaacaagga

SEQ ID NO: 8495055 - DNA, 22 bp, Homo sapiens
gtggaaggtgctagaacaagga

SEQ ID NO: 8495056 - DNA, 22 bp, Homo sapiens
gtggaaggtgctagaacaagga

SEQ ID NO: 8495057 - DNA, 22 bp, Homo sapiens
gtggaaggtgaaggagcagcga

SEQ ID NO: 8495058 - DNA, 22 bp, Homo sapiens
gtggaaggtgaaggagcagcga

SEQ ID NO: 8495059 - DNA, 22 bp, Homo sapiens
gtggaaggtgaaggagcagcga

SEQ ID NO: 8495060 - DNA, 22 bp, Homo sapiens
gtggaagggtcacagcccctac

SEQ ID NO: 8495061 - DNA, 22 bp, Homo sapiens
gtggaaggtaatgcagcttact

SEQ ID NO: 8495062 - DNA, 22 bp, Homo sapiens
gtggaaggtaatgcagcttact

SEQ ID NO: 8495063 - DNA, 22 bp, Homo sapiens
gtggaagggactgcctagagga

SEQ ID NO: 8495064 - DNA, 22 bp, Homo sapiens
gtggaaggaattaacagactag

SEQ ID NO: 8495065 - DNA, 22 bp, Homo sapiens
gtggaaggaagagatggcccca

SEQ ID NO: 8495066 - DNA, 22 bp, Homo sapiens
gtggaaggaattaacagactag

SEQ ID NO: 8495067 - DNA, 22 bp, Homo sapiens
gtggaaggaattaacagactag

SEQ ID NO: 8495068 - DNA, 22 bp, Homo sapiens
gtggaaattttaggatcatctt

SEQ ID NO: 8495069 - DNA, 22 bp, Homo sapiens
gtggaaatgcccccaaatagtg

SEQ ID NO: 8495070 - DNA, 22 bp, Homo sapiens
gtggaaatagtttggttataga

SEQ ID NO: 8495071 - DNA, 22 bp, Homo sapiens
gtggaaaactgagaaaattgct

SEQ ID NO: 8495072 - DNA, 22 bp, Homo sapiens
gtggaaaactgagaaaattgct

SEQ ID NO: 8495073 - DNA, 22 bp, Homo sapiens
gtggaagaggcaagatagctct

SEQ ID NO: 8495074 - DNA, 22 bp, Homo sapiens
gtggaacatgtccatatacatt

SEQ ID NO: 8495075 - DNA, 22 bp, Homo sapiens
gtggaacagcctgtgcaaacct

SEQ ID NO: 8495076 - DNA, 22 bp, Homo sapiens
gtggaacagcctgtgcaaacct

SEQ ID NO: 8495077 - DNA, 22 bp, Homo sapiens
gtggaaggaagagatggcccca

SEQ ID NO: 8495078 - DNA, 22 bp, Homo sapiens
gtgcctggcagggtcagctgct

SEQ ID NO: 8495079 - DNA, 22 bp, Homo sapiens
gtgcctggcagggtcagctgct

SEQ ID NO: 8495080 - DNA, 22 bp, Homo sapiens
gtgcctggcatgcgccggtgct

SEQ ID NO: 8495081 - DNA, 22 bp, Homo sapiens
gtgcctgtttcttttgaattca

SEQ ID NO: 8495082 - DNA, 22 bp, Homo sapiens
gtgcctggcatgcgccggtgct

SEQ ID NO: 8495083 - DNA, 22 bp, Homo sapiens
gtgcctggagctaatgtgtata

SEQ ID NO: 8495084 - DNA, 22 bp, Homo sapiens
gtgcctggagctaatgtgtata

SEQ ID NO: 8495085 - DNA, 22 bp, Homo sapiens
gtgcctggcacacagaaggcaa

SEQ ID NO: 8495086 - DNA, 20 bp, Homo sapiens
gtgcctggagaagaggctgt

SEQ ID NO: 8495087 - DNA, 22 bp, Homo sapiens
gtgctacagactgagtacactt

SEQ ID NO: 8495088 - DNA, 22 bp, Homo sapiens
gtgcgtgtgcctatcaataaag

SEQ ID NO: 8495089 - DNA, 22 bp, Homo sapiens
gtgcgtgtgcctatcaataaag

SEQ ID NO: 8495090 - DNA, 22 bp, Homo sapiens
gtgcgtcctgggggctgggtcg

SEQ ID NO: 8495091 - DNA, 22 bp, Homo sapiens
gtgcgtgaggcccctgagcgaa

SEQ ID NO: 8495092 - DNA, 22 bp, Homo sapiens
gtgcgcttcttcctgagccagg

SEQ ID NO: 8495093 - DNA, 22 bp, Homo sapiens
gtgcgggcctgggggtttctct

SEQ ID NO: 8495094 - DNA, 22 bp, Homo sapiens
gtgcggatcggtgtcctccaaa

SEQ ID NO: 8495095 - DNA, 21 bp, Homo sapiens
gtgcggatgccgtcattgtca

SEQ ID NO: 8495096 - DNA, 22 bp, Homo sapiens
gtgcctttgagaagtttctctg

SEQ ID NO: 8495097 - DNA, 22 bp, Homo sapiens
gtgcctttgtgtctaaaacagc

SEQ ID NO: 8495098 - DNA, 22 bp, Homo sapiens
gtgcctttgtgtctaaaacagc

SEQ ID NO: 8495099 - DNA, 22 bp, Homo sapiens
gtgcgccagctcaaggggaggc

SEQ ID NO: 8495100 - DNA, 22 bp, Homo sapiens
gtgccttttcttcatagttact

SEQ ID NO: 8495101 - DNA, 22 bp, Homo sapiens
gtgcctgctacctgacttgttt

SEQ ID NO: 8495102 - DNA, 22 bp, Homo sapiens
gtgcctgcaggtgccggcttca

SEQ ID NO: 8495103 - DNA, 22 bp, Homo sapiens
gtgcctgctacctgacttgttt

SEQ ID NO: 8495104 - DNA, 22 bp, Homo sapiens
gtgcctgccccactcctcagca

SEQ ID NO: 8495105 - DNA, 22 bp, Homo sapiens
gtgcctgctacctgacttgttt

SEQ ID NO: 8495106 - DNA, 22 bp, Homo sapiens
gtgcctgctgcagagtcgctgt

SEQ ID NO: 8495107 - DNA, 22 bp, Homo sapiens
gtgcctgctgcagagtcgctgt

SEQ ID NO: 8495108 - DNA, 22 bp, Homo sapiens
gtgcctgctgcagagtcgctgt

SEQ ID NO: 8495109 - DNA, 22 bp, Homo sapiens
gtgcctgcagcaatccatggca

SEQ ID NO: 8495110 - DNA, 22 bp, Homo sapiens
gtgcctgcagcaatccatggca

SEQ ID NO: 8495111 - DNA, 22 bp, Homo sapiens
gtgcctgccccactcctcagca

SEQ ID NO: 8495112 - DNA, 22 bp, Homo sapiens
gtgcctgcagcaatccatggca

SEQ ID NO: 8495113 - DNA, 22 bp, Homo sapiens
gtgcctgctgcagctgagcagt

SEQ ID NO: 8495114 - DNA, 22 bp, Homo sapiens
gtgcctggaatgcgcctcggcg

SEQ ID NO: 8495115 - DNA, 22 bp, Homo sapiens
gtgcctggaccctctttccgga

SEQ ID NO: 8495116 - DNA, 22 bp, Homo sapiens
gtgcctggaatgcgcctcggcg

SEQ ID NO: 8495117 - DNA, 22 bp, Homo sapiens
gtgacagtcaaagacatgactt

SEQ ID NO: 8495118 - DNA, 22 bp, Homo sapiens
gtgacagtcaaagacatgactt

SEQ ID NO: 8495119 - DNA, 22 bp, Homo sapiens
gtgacagtcaaagacatgactt

SEQ ID NO: 8495120 - DNA, 22 bp, Homo sapiens
gtgacagtggtcacttgtagtt

SEQ ID NO: 8495121 - DNA, 22 bp, Homo sapiens
gtgacagtggtcacttgtagtt

SEQ ID NO: 8495122 - DNA, 22 bp, Homo sapiens
gtgacattgctaggaacagatt

SEQ ID NO: 8495123 - DNA, 22 bp, Homo sapiens
gtgacatgttatggactggcta

SEQ ID NO: 8495124 - DNA, 22 bp, Homo sapiens
gtgacatttattagatgcttac

SEQ ID NO: 8495125 - DNA, 22 bp, Homo sapiens
gtgacatttacgaatcttatcc

SEQ ID NO: 8495126 - DNA, 22 bp, Homo sapiens
gtgaccagcccatagagaggcg

SEQ ID NO: 8495127 - DNA, 22 bp, Homo sapiens
gtgaccagccagtgctgtctgt

SEQ ID NO: 8495128 - DNA, 22 bp, Homo sapiens
gtgaccagagcgggagattggg

SEQ ID NO: 8495129 - DNA, 20 bp, Homo sapiens
gtgaccagaagacagtgggt

SEQ ID NO: 8495130 - DNA, 20 bp, Homo sapiens
gtgaccagaagacagtgggt

SEQ ID NO: 8495131 - DNA, 22 bp, Homo sapiens
gtgacatttcgtgacgtgagaa

SEQ ID NO: 8495132 - DNA, 22 bp, Homo sapiens
gtgacatttttactgatgagag

SEQ ID NO: 8495133 - DNA, 22 bp, Homo sapiens
gtgacaggccactgcggctctg

SEQ ID NO: 8495134 - DNA, 22 bp, Homo sapiens
gtgacaggcccagtgggatgca

SEQ ID NO: 8495135 - DNA, 22 bp, Homo sapiens
gtgacaggcccagtgggatgca

SEQ ID NO: 8495136 - DNA, 22 bp, Homo sapiens
gtgacagagattaatagcttgg

SEQ ID NO: 8495137 - DNA, 22 bp, Homo sapiens
gtgacagagttttagatctcat

SEQ ID NO: 8495138 - DNA, 22 bp, Homo sapiens
gtgacagagtgagaccctgtct

SEQ ID NO: 8495139 - DNA, 22 bp, Homo sapiens
gtgacagatttgctgcgcatgg

SEQ ID NO: 8495140 - DNA, 22 bp, Homo sapiens
gtgacagatttgctgcgcatgg

SEQ ID NO: 8495141 - DNA, 22 bp, Homo sapiens
gtgacaaaaacactgattattt

SEQ ID NO: 8495142 - DNA, 22 bp, Homo sapiens
gtgacaaaggtcaagcttttga

SEQ ID NO: 8495143 - DNA, 22 bp, Homo sapiens
gtgacaaatgcaaattgggctg

SEQ ID NO: 8495144 - DNA, 22 bp, Homo sapiens
gtgacaatattagctcaggggc

SEQ ID NO: 8495145 - DNA, 22 bp, Homo sapiens
gtgacagaaacagggctagaat

SEQ ID NO: 8495146 - DNA, 22 bp, Homo sapiens
gtgaaggattggagggcatctt

SEQ ID NO: 8495147 - DNA, 22 bp, Homo sapiens
gtctggggtactttcatctgat

SEQ ID NO: 8495148 - DNA, 20 bp, Homo sapiens
gtgaagggagtcaggtgtgc

SEQ ID NO: 8495149 - DNA, 22 bp, Homo sapiens
gtgaaggctacaagagatcaag

SEQ ID NO: 8495150 - DNA, 20 bp, Homo sapiens
gtggatgatcagtgtagtgg

SEQ ID NO: 8495151 - DNA, 22 bp, Homo sapiens
gtggatgcttaggcagcctggg

SEQ ID NO: 8495152 - DNA, 22 bp, Homo sapiens
gtggatggacatgggcaagagg

SEQ ID NO: 8495153 - DNA, 22 bp, Homo sapiens
gtggatggacatgggcaagagg

SEQ ID NO: 8495154 - DNA, 22 bp, Homo sapiens
gtggagggtttgcaatgtgcag

SEQ ID NO: 8495155 - DNA, 22 bp, Homo sapiens
gtggaggtcccgggcaggagca

SEQ ID NO: 8495156 - DNA, 22 bp, Homo sapiens
gtggagtggcctggccctgaga

SEQ ID NO: 8495157 - DNA, 22 bp, Homo sapiens
gtggagtgcaacggttggagtt

SEQ ID NO: 8495158 - DNA, 22 bp, Homo sapiens
gtggaggcagtgacacagtagc

SEQ ID NO: 8495159 - DNA, 22 bp, Homo sapiens
gtggagggaatgaatcttctct

SEQ ID NO: 8495160 - DNA, 22 bp, Homo sapiens
gtggagggaatgaatcttctct

SEQ ID NO: 8495161 - DNA, 22 bp, Homo sapiens
gtggaggagaggcgccttgcgg

SEQ ID NO: 8495162 - DNA, 22 bp, Homo sapiens
gtggaggcagtgacacagtagc

SEQ ID NO: 8495163 - DNA, 22 bp, Homo sapiens
gtggaggacaaaagaagccttt

SEQ ID NO: 8495164 - DNA, 18 bp, Homo sapiens
gtggagggttctcagaat

SEQ ID NO: 8495165 - DNA, 18 bp, Homo sapiens
gtggagggttctcagaat

SEQ ID NO: 8495166 - DNA, 18 bp, Homo sapiens
gtggagggttctcagaat

SEQ ID NO: 8495167 - DNA, 22 bp, Homo sapiens
gtggagggtttgcaatgtgcag

SEQ ID NO: 8495168 - DNA, 22 bp, Homo sapiens
gtggagggtgattgccggctgt

SEQ ID NO: 8495169 - DNA, 22 bp, Homo sapiens
gtggagggtgattgccggctgt

SEQ ID NO: 8495170 - DNA, 22 bp, Homo sapiens
gtggagctggacccaggcctct

SEQ ID NO: 8495171 - DNA, 22 bp, Homo sapiens
gtggagccctggtagggacccc

SEQ ID NO: 8495172 - DNA, 22 bp, Homo sapiens
gtggagccctggtagggacccc

SEQ ID NO: 8495173 - DNA, 22 bp, Homo sapiens
gtggaggacaaaagaagccttt

SEQ ID NO: 8495174 - DNA, 22 bp, Homo sapiens
gtggaggacaaaagaagccttt

SEQ ID NO: 8495175 - DNA, 22 bp, Homo sapiens
gtggagaggaacccagctctgt

SEQ ID NO: 8495176 - DNA, 22 bp, Homo sapiens
gtggagaggaacccagctctgt

SEQ ID NO: 8495177 - DNA, 22 bp, Homo sapiens
gtggagaggaacccagctctgt

SEQ ID NO: 8495178 - DNA, 22 bp, Homo sapiens
gtggagagcaaataattggaat

SEQ ID NO: 8495179 - DNA, 22 bp, Homo sapiens
gtggagagcaaataattggaat

SEQ ID NO: 8495180 - DNA, 22 bp, Homo sapiens
gtggagaggaacccagctctgt

SEQ ID NO: 8495181 - DNA, 22 bp, Homo sapiens
gtggagagagataagcctggtc

SEQ ID NO: 8495182 - DNA, 22 bp, Homo sapiens
gtggagagagataagcctggtc

SEQ ID NO: 8495183 - DNA, 22 bp, Homo sapiens
gtggagagagtgacagcatctt

SEQ ID NO: 8495184 - DNA, 23 bp, Homo sapiens
gtggagagattagtaattcaccc

SEQ ID NO: 8495185 - DNA, 23 bp, Homo sapiens
gtggagagattagtaattcaccc

SEQ ID NO: 8495186 - DNA, 22 bp, Homo sapiens
gtggagagagtgacagcatctt

SEQ ID NO: 8495187 - DNA, 22 bp, Homo sapiens
gtggaattgctggataatatca

SEQ ID NO: 8495188 - DNA, 22 bp, Homo sapiens
gtggacacaggagagagaactg

SEQ ID NO: 8495189 - DNA, 22 bp, Homo sapiens
gtggacagcttctaggtgccag

SEQ ID NO: 8495190 - DNA, 22 bp, Homo sapiens
gtggacagcttctaggtgccag

SEQ ID NO: 8495191 - DNA, 22 bp, Homo sapiens
gtggagagagataagcctggtc

SEQ ID NO: 8495192 - DNA, 22 bp, Homo sapiens
gtggagagagataagcctggtc

SEQ ID NO: 8495193 - DNA, 22 bp, Homo sapiens
gtggagacttctactagagacc

SEQ ID NO: 8495194 - DNA, 22 bp, Homo sapiens
gtggacgttaggattgtgtaga

SEQ ID NO: 8495195 - DNA, 22 bp, Homo sapiens
gtggagacctcctaggatgtgt

SEQ ID NO: 8495196 - DNA, 22 bp, Homo sapiens
gtggagacgggacagaagctaa

SEQ ID NO: 8495197 - DNA, 22 bp, Homo sapiens
gtggacatgcatacatatgttt

SEQ ID NO: 8495198 - DNA, 22 bp, Homo sapiens
gtggaccaaggtggaagataaa

SEQ ID NO: 8495199 - DNA, 22 bp, Homo sapiens
gtggcagattgctcaccatggt

SEQ ID NO: 8495200 - DNA, 22 bp, Homo sapiens
gtggcagattgctcaccatggt

SEQ ID NO: 8495201 - DNA, 22 bp, Homo sapiens
gtggcagcaaaatcctgcattc

SEQ ID NO: 8495202 - DNA, 22 bp, Homo sapiens
gtggcagcaaaatcctgcattc

SEQ ID NO: 8495203 - DNA, 22 bp, Homo sapiens
gtggcagagttgctgactagaa

SEQ ID NO: 8495204 - DNA, 22 bp, Homo sapiens
gtggcagagttcaggcgtttgg

SEQ ID NO: 8495205 - DNA, 22 bp, Homo sapiens
gtggcagagtgcggttctgacc

SEQ ID NO: 8495206 - DNA, 22 bp, Homo sapiens
gtggcagagtgcggttctgacc

SEQ ID NO: 8495207 - DNA, 22 bp, Homo sapiens
gtggcagaggttcctcagtgtg

SEQ ID NO: 8495208 - DNA, 22 bp, Homo sapiens
gtggcagaggttcctcagtgtg

SEQ ID NO: 8495209 - DNA, 22 bp, Homo sapiens
gtggcagaggctgtgaggatgc

SEQ ID NO: 8495210 - DNA, 22 bp, Homo sapiens
gtggcagagggtgagctggact

SEQ ID NO: 8495211 - DNA, 22 bp, Homo sapiens
gtggcagagggtgagctggact

SEQ ID NO: 8495212 - DNA, 22 bp, Homo sapiens
gtggcagagggtgagctggact

SEQ ID NO: 8495213 - DNA, 22 bp, Homo sapiens
gtggcagagccttgcggctttg

SEQ ID NO: 8495214 - DNA, 22 bp, Homo sapiens
gtggcagagccgtgcaggtagg

SEQ ID NO: 8495215 - DNA, 22 bp, Homo sapiens
gtggcagcggtgtgcaaggagg

SEQ ID NO: 8495216 - DNA, 22 bp, Homo sapiens
gtggcagctcatgttgttttaa

SEQ ID NO: 8495217 - DNA, 22 bp, Homo sapiens
gtggcagcggcccaggccgtct

SEQ ID NO: 8495218 - DNA, 19 bp, Homo sapiens
gtggcagcagatttggtgt

SEQ ID NO: 8495219 - DNA, 22 bp, Homo sapiens
gtggcagcagaggggtggtatg

SEQ ID NO: 8495220 - DNA, 22 bp, Homo sapiens
gtggatggattgaggcagtggg

SEQ ID NO: 8495221 - DNA, 22 bp, Homo sapiens
gtggatggagctggaagccatt

SEQ ID NO: 8495222 - DNA, 22 bp, Homo sapiens
gtggatggccctgcacacaggt

SEQ ID NO: 8495223 - DNA, 22 bp, Homo sapiens
gtggatggattttgaggaatgg

SEQ ID NO: 8495224 - DNA, 22 bp, Homo sapiens
gtggatggattttgaggaatgg

SEQ ID NO: 8495225 - DNA, 22 bp, Homo sapiens
gtggatggattgaggcagtggg

SEQ ID NO: 8495226 - DNA, 22 bp, Homo sapiens
gtggatggtggtccagtatcat

SEQ ID NO: 8495227 - DNA, 22 bp, Homo sapiens
gtggatggctagttgagaaggg

SEQ ID NO: 8495228 - DNA, 22 bp, Homo sapiens
gtggattacaagacagttgaga

SEQ ID NO: 8495229 - DNA, 22 bp, Homo sapiens
gtggattacaagacagttgaga

SEQ ID NO: 8495230 - DNA, 22 bp, Homo sapiens
gtggcaaggagcatgaaaagtc

SEQ ID NO: 8495231 - DNA, 22 bp, Homo sapiens
gtggcacacaggagagagctca

SEQ ID NO: 8495232 - DNA, 22 bp, Homo sapiens
gtggcacagggttgttggtcat

SEQ ID NO: 8495233 - DNA, 22 bp, Homo sapiens
gtggcacagagatggggcatga

SEQ ID NO: 8495234 - DNA, 22 bp, Homo sapiens
gtggcacagagatggggcatga

SEQ ID NO: 8495235 - DNA, 22 bp, Homo sapiens
gtggcacattggtagggtctgt

SEQ ID NO: 8495236 - DNA, 22 bp, Homo sapiens
gtggcagagccaggctttgaac

SEQ ID NO: 8495237 - DNA, 22 bp, Homo sapiens
gtggcagagccaaggctggagc

SEQ ID NO: 8495238 - DNA, 22 bp, Homo sapiens
gtggcagagccgtgcaggtagg

SEQ ID NO: 8495239 - DNA, 22 bp, Homo sapiens
gtggcagagccgtgcaggtagg

SEQ ID NO: 8495240 - DNA, 22 bp, Homo sapiens
gtggcactcacctgtagtttca

SEQ ID NO: 8495241 - DNA, 22 bp, Homo sapiens
gtggcacattggtagggtctgt

SEQ ID NO: 8495242 - DNA, 22 bp, Homo sapiens
gtggcctgatgccagccctgtg

SEQ ID NO: 8495243 - DNA, 22 bp, Homo sapiens
gtggcctgccagcagatggcgc

SEQ ID NO: 8495244 - DNA, 21 bp, Homo sapiens
gtggcctgattatgaatgggt

SEQ ID NO: 8495245 - DNA, 21 bp, Homo sapiens
gtggcctgattatgaatgggt

SEQ ID NO: 8495246 - DNA, 22 bp, Homo sapiens
gtggcctggaaaggctggtctg

SEQ ID NO: 8495247 - DNA, 22 bp, Homo sapiens
gtggcctggaaaggctggtctg

SEQ ID NO: 8495248 - DNA, 22 bp, Homo sapiens
gtggcctggatagactccatct

SEQ ID NO: 8495249 - DNA, 22 bp, Homo sapiens
gtggcctggagtttgatgtagg

SEQ ID NO: 8495250 - DNA, 22 bp, Homo sapiens
gtggcctggagtttgatgtagg

SEQ ID NO: 8495251 - DNA, 22 bp, Homo sapiens
gtggcctgccgtgtggtatggg

SEQ ID NO: 8495252 - DNA, 22 bp, Homo sapiens
gtggcctgccgtgtggtatggg

SEQ ID NO: 8495253 - DNA, 19 bp, Homo sapiens
gtggcctgcgctgggtgcg

SEQ ID NO: 8495254 - DNA, 19 bp, Homo sapiens
gtggcctgcgctgggtgcg

SEQ ID NO: 8495255 - DNA, 22 bp, Homo sapiens
gtggcctgccgtgtggtatggg

SEQ ID NO: 8495256 - DNA, 22 bp, Homo sapiens
gtggcctctgtgctcctgccta

SEQ ID NO: 8495257 - DNA, 22 bp, Homo sapiens
gtggcctctgtgctcctgccta

SEQ ID NO: 8495258 - DNA, 20 bp, Homo sapiens
gtggcctctcacattctgag

SEQ ID NO: 8495259 - DNA, 22 bp, Homo sapiens
gtggcctctgttggctcctagg

SEQ ID NO: 8495260 - DNA, 22 bp, Homo sapiens
gtggcctctgttggctcctagg

SEQ ID NO: 8495261 - DNA, 22 bp, Homo sapiens
gtggcctctgttggctcctagg

SEQ ID NO: 8495262 - DNA, 22 bp, Homo sapiens
gtggcctctgttggctcctagg

SEQ ID NO: 8495263 - DNA, 23 bp, Homo sapiens
gtggcctccccggaatgcctcgc

SEQ ID NO: 8495264 - DNA, 22 bp, Homo sapiens
gtggcctcctccgtccgcctct

SEQ ID NO: 8495265 - DNA, 19 bp, Homo sapiens
gtggcctcggagcgcgcgg

SEQ ID NO: 8495266 - DNA, 22 bp, Homo sapiens
gtggccctttgttttgatacct

SEQ ID NO: 8495267 - DNA, 22 bp, Homo sapiens
gtggcctcatgtctataaagag

SEQ ID NO: 8495268 - DNA, 23 bp, Homo sapiens
gtggcctccccggaatgcctcgc

SEQ ID NO: 8495269 - DNA, 22 bp, Homo sapiens
gtggcctcatgtctataaagag

SEQ ID NO: 8495270 - DNA, 22 bp, Homo sapiens
gtggccgtgtaacttgagtaca

SEQ ID NO: 8495271 - DNA, 22 bp, Homo sapiens
gtggccctgtgaacagcgcagt

SEQ ID NO: 8495272 - DNA, 20 bp, Homo sapiens
gtggcccttaaagagggaag

SEQ ID NO: 8495273 - DNA, 22 bp, Homo sapiens
gtggcccttggagttgtgacct

SEQ ID NO: 8495274 - DNA, 22 bp, Homo sapiens
gtggcccttgaagcagcttcat

SEQ ID NO: 8495275 - DNA, 20 bp, Homo sapiens
gtggcccttaaagagggaag

SEQ ID NO: 8495276 - DNA, 21 bp, Homo sapiens
gtggccctggtgtggctgcac

SEQ ID NO: 8495277 - DNA, 22 bp, Homo sapiens
gtggccctggagttgtgacact

SEQ ID NO: 8495278 - DNA, 22 bp, Homo sapiens
gtggccctgtcccaggcctcct

SEQ ID NO: 8495279 - DNA, 21 bp, Homo sapiens
gtggccctggtgtggctgcac

SEQ ID NO: 8495280 - DNA, 22 bp, Homo sapiens
gtggccctgtcccaggcctcct

SEQ ID NO: 8495281 - DNA, 22 bp, Homo sapiens
gtggcctggcgagctggcgcgg

SEQ ID NO: 8495282 - DNA, 22 bp, Homo sapiens
gtggcctggctggcaccacctc

SEQ ID NO: 8495283 - DNA, 22 bp, Homo sapiens
gtggctcagcggagctctgcac

SEQ ID NO: 8495284 - DNA, 22 bp, Homo sapiens
gtggcctggggtttgttctgag

SEQ ID NO: 8495285 - DNA, 22 bp, Homo sapiens
gtggcctggcgagctggcgcgg

SEQ ID NO: 8495286 - DNA, 22 bp, Homo sapiens
gtggcctggatgagcttcgaca

SEQ ID NO: 8495287 - DNA, 22 bp, Homo sapiens
gtggcctggatagactccatct

SEQ ID NO: 8495288 - DNA, 22 bp, Homo sapiens
gtggcctggatgagcttcgaca

SEQ ID NO: 8495289 - DNA, 22 bp, Homo sapiens
gtggcctggatgagcttcgaca

SEQ ID NO: 8495290 - DNA, 22 bp, Homo sapiens
gtggcctggggtttgttctgag

SEQ ID NO: 8495291 - DNA, 22 bp, Homo sapiens
gtggctcagttaacttccatgt

SEQ ID NO: 8495292 - DNA, 19 bp, Homo sapiens
gtggctcatgtagtgggcc

SEQ ID NO: 8495293 - DNA, 22 bp, Homo sapiens
gtggctcatctttgggaagtaa

SEQ ID NO: 8495294 - DNA, 22 bp, Homo sapiens
gtggctctaggtgagcatggag

SEQ ID NO: 8495295 - DNA, 22 bp, Homo sapiens
gtggctctaggtgagcatggag

SEQ ID NO: 8495296 - DNA, 21 bp, Homo sapiens
gtggctctgccaggactgaaa

SEQ ID NO: 8495297 - DNA, 21 bp, Homo sapiens
gtggctctgccaggactgaaa

SEQ ID NO: 8495298 - DNA, 22 bp, Homo sapiens
gtggctctcgccagcctgcggg

SEQ ID NO: 8495299 - DNA, 22 bp, Homo sapiens
gtggctctccattgacatggaa

SEQ ID NO: 8495300 - DNA, 22 bp, Homo sapiens
gtgggatgcagtggtgagtggc

SEQ ID NO: 8495301 - DNA, 22 bp, Homo sapiens
gtgggatgcagtggtgagtggc

SEQ ID NO: 8495302 - DNA, 22 bp, Homo sapiens
gtgggatggtaggtaggtaata

SEQ ID NO: 8495303 - DNA, 22 bp, Homo sapiens
gtgggatgcagtggtgagtggc

SEQ ID NO: 8495304 - DNA, 22 bp, Homo sapiens
gtgggagccctcagggaggtgc

SEQ ID NO: 8495305 - DNA, 22 bp, Homo sapiens
gtgggagctgcggaggcctggg

SEQ ID NO: 8495306 - DNA, 22 bp, Homo sapiens
gtgggagctgcggaggcctggg

SEQ ID NO: 8495307 - DNA, 22 bp, Homo sapiens
gtgggagcttcatcaagcagtt

SEQ ID NO: 8495308 - DNA, 22 bp, Homo sapiens
gtgggagctgcggaggcctggg

SEQ ID NO: 8495309 - DNA, 22 bp, Homo sapiens
gtgggagccctcagggaggtgc

SEQ ID NO: 8495310 - DNA, 22 bp, Homo sapiens
gtgggagccctcagggaggtgc

SEQ ID NO: 8495311 - DNA, 22 bp, Homo sapiens
gtgggagcatggtcccagtgcc

SEQ ID NO: 8495312 - DNA, 22 bp, Homo sapiens
gtgggagaagatttggtcatct

SEQ ID NO: 8495313 - DNA, 22 bp, Homo sapiens
gtgggagaagccctgttcgtag

SEQ ID NO: 8495314 - DNA, 22 bp, Homo sapiens
gtgggagaaattagctctagtt

SEQ ID NO: 8495315 - DNA, 22 bp, Homo sapiens
gtgggagaagatttggtcatct

SEQ ID NO: 8495316 - DNA, 22 bp, Homo sapiens
gtggcttccatgtgcatctgac

SEQ ID NO: 8495317 - DNA, 22 bp, Homo sapiens
gtggcttccaagactaagtcac

SEQ ID NO: 8495318 - DNA, 22 bp, Homo sapiens
gtgggagaaattagctctagtt

SEQ ID NO: 8495319 - DNA, 22 bp, Homo sapiens
gtggcttcatgaacactgatga

SEQ ID NO: 8495320 - DNA, 22 bp, Homo sapiens
gtggcttcatcaactgtgctta

SEQ ID NO: 8495321 - DNA, 22 bp, Homo sapiens
gtggctgcagagggcacagcat

SEQ ID NO: 8495322 - DNA, 22 bp, Homo sapiens
gtggctgcagagggcacagcat

SEQ ID NO: 8495323 - DNA, 22 bp, Homo sapiens
gtggctgcagcccagcggcacg

SEQ ID NO: 8495324 - DNA, 22 bp, Homo sapiens
gtggctgcagcggctgtggaga

SEQ ID NO: 8495325 - DNA, 22 bp, Homo sapiens
gtggctgcagcggctgtggaga

SEQ ID NO: 8495326 - DNA, 22 bp, Homo sapiens
gtggctgcagtagtgtagggtc

SEQ ID NO: 8495327 - DNA, 22 bp, Homo sapiens
gtggctgctgtcctctctggtt

SEQ ID NO: 8495328 - DNA, 22 bp, Homo sapiens
gtggctgctggtactctgggaa

SEQ ID NO: 8495329 - DNA, 22 bp, Homo sapiens
gtggctgctggtactctgggaa

SEQ ID NO: 8495330 - DNA, 22 bp, Homo sapiens
gtggctgctcgggctccggccc

SEQ ID NO: 8495331 - DNA, 22 bp, Homo sapiens
gtggctgctacagagctggagg

SEQ ID NO: 8495332 - DNA, 22 bp, Homo sapiens
gtggctgctaagtctccttcct

SEQ ID NO: 8495333 - DNA, 22 bp, Homo sapiens
gtggctgctaagtctccttcct

SEQ ID NO: 8495334 - DNA, 22 bp, Homo sapiens
gtggcttcaccccagttgtctc

SEQ ID NO: 8495335 - DNA, 22 bp, Homo sapiens
gtggcttcacatggcatttggc

SEQ ID NO: 8495336 - DNA, 22 bp, Homo sapiens
gtggcttcaccccagttgtctc

SEQ ID NO: 8495337 - DNA, 22 bp, Homo sapiens
gtggctgttcttgccccatgct

SEQ ID NO: 8495338 - DNA, 22 bp, Homo sapiens
gtggctgtatagccaagtcaga

SEQ ID NO: 8495339 - DNA, 22 bp, Homo sapiens
gtggctggtttcctgcatgcaa

SEQ ID NO: 8495340 - DNA, 22 bp, Homo sapiens
gtggctggtttcctgcatgcaa

SEQ ID NO: 8495341 - DNA, 22 bp, Homo sapiens
gtggctggtttcctgcatgcaa

SEQ ID NO: 8495342 - DNA, 22 bp, Homo sapiens
gtggctggtttcctgcatgcaa

SEQ ID NO: 8495343 - DNA, 22 bp, Homo sapiens
gtggctgggctccgagcggctt

SEQ ID NO: 8495344 - DNA, 22 bp, Homo sapiens
gtggctgggctccgagcggctt

SEQ ID NO: 8495345 - DNA, 22 bp, Homo sapiens
gtggctgggctccgagcggctt

SEQ ID NO: 8495346 - DNA, 22 bp, Homo sapiens
gtggctggagtatgaggaaagg

SEQ ID NO: 8495347 - DNA, 22 bp, Homo sapiens
gtggctgctgtcctctctggtt

SEQ ID NO: 8495348 - DNA, 22 bp, Homo sapiens
gtggcattgacatgtaaacagt

SEQ ID NO: 8495349 - DNA, 22 bp, Homo sapiens
gtggcatgaaagcatctgtgat

SEQ ID NO: 8495350 - DNA, 22 bp, Homo sapiens
gtggccaaggcagagaaagagc

SEQ ID NO: 8495351 - DNA, 22 bp, Homo sapiens
gtggcagtggagacccgagcct

SEQ ID NO: 8495352 - DNA, 22 bp, Homo sapiens
gtggcagtgccgtttggttcag

SEQ ID NO: 8495353 - DNA, 22 bp, Homo sapiens
gtggcagtgggatgctatcagg

SEQ ID NO: 8495354 - DNA, 22 bp, Homo sapiens
gtggcagtggagacccgagcct

SEQ ID NO: 8495355 - DNA, 22 bp, Homo sapiens
gtggcagtgtgaggatcctgct

SEQ ID NO: 8495356 - DNA, 20 bp, Homo sapiens
gtggcagtggtggcagcagt

SEQ ID NO: 8495357 - DNA, 22 bp, Homo sapiens
gtggcagtgccgtttggttcag

SEQ ID NO: 8495358 - DNA, 22 bp, Homo sapiens
gtggcagttctgtgtctcttgt

SEQ ID NO: 8495359 - DNA, 22 bp, Homo sapiens
gtggcagtgtggagggaggagt

SEQ ID NO: 8495360 - DNA, 22 bp, Homo sapiens
gtggcagttgctgtggcaataa

SEQ ID NO: 8495361 - DNA, 22 bp, Homo sapiens
gtggcagttttgacatcacaaa

SEQ ID NO: 8495362 - DNA, 22 bp, Homo sapiens
gtggcaggggtattccagctga

SEQ ID NO: 8495363 - DNA, 22 bp, Homo sapiens
gtggcagctgtgttgcagtttt

SEQ ID NO: 8495364 - DNA, 22 bp, Homo sapiens
gtggcaggagactggaagatgg

SEQ ID NO: 8495365 - DNA, 22 bp, Homo sapiens
gtggcagctggtatgcagacag

SEQ ID NO: 8495366 - DNA, 22 bp, Homo sapiens
gtggcagctggtatgcagacag

SEQ ID NO: 8495367 - DNA, 22 bp, Homo sapiens
gtggcagctgtgggacactggt

SEQ ID NO: 8495368 - DNA, 22 bp, Homo sapiens
gtggcaggagagacacagccat

SEQ ID NO: 8495369 - DNA, 22 bp, Homo sapiens
gtggcaggagactggaagatgg

SEQ ID NO: 8495370 - DNA, 22 bp, Homo sapiens
gtggcaggagagacacagccat

SEQ ID NO: 8495371 - DNA, 20 bp, Homo sapiens
gtggcaggcagtgaaggagc

SEQ ID NO: 8495372 - DNA, 22 bp, Homo sapiens
gtggcaggatcacggctcactg

SEQ ID NO: 8495373 - DNA, 20 bp, Homo sapiens
gtggcaggcagtgaaggagc

SEQ ID NO: 8495374 - DNA, 22 bp, Homo sapiens
gtggcccacttacgtcatgtgt

SEQ ID NO: 8495375 - DNA, 22 bp, Homo sapiens
gtggcccacacagacagcatct

SEQ ID NO: 8495376 - DNA, 22 bp, Homo sapiens
gtggccaggagagggtgggaca

SEQ ID NO: 8495377 - DNA, 22 bp, Homo sapiens
gtggccaggccgactgccaggc

SEQ ID NO: 8495378 - DNA, 22 bp, Homo sapiens
gtggccaggagagggtgggaca

SEQ ID NO: 8495379 - DNA, 22 bp, Homo sapiens
gtggccaggacattgccaggca

SEQ ID NO: 8495380 - DNA, 22 bp, Homo sapiens
gtggccaggacattgccaggca

SEQ ID NO: 8495381 - DNA, 22 bp, Homo sapiens
gtggccagctgtcagcaccctt

SEQ ID NO: 8495382 - DNA, 22 bp, Homo sapiens
gtggccaggagaccttgggcat

SEQ ID NO: 8495383 - DNA, 22 bp, Homo sapiens
gtggccaggacattgccaggca

SEQ ID NO: 8495384 - DNA, 22 bp, Homo sapiens
gtggcccagccctacagaggac

SEQ ID NO: 8495385 - DNA, 22 bp, Homo sapiens
gtggcccaggcttggcgctggc

SEQ ID NO: 8495386 - DNA, 22 bp, Homo sapiens
gtggccctgagccctttgacag

SEQ ID NO: 8495387 - DNA, 22 bp, Homo sapiens
gtggccctctgatagggtcagg

SEQ ID NO: 8495388 - DNA, 21 bp, Homo sapiens
gtggccctgccgcagtgtcca

SEQ ID NO: 8495389 - DNA, 21 bp, Homo sapiens
gtggccctgccgcagtgtcca

SEQ ID NO: 8495390 - DNA, 22 bp, Homo sapiens
gtggccctatttgaggacccca

SEQ ID NO: 8495391 - DNA, 22 bp, Homo sapiens
gtggccctaacaccgtttctca

SEQ ID NO: 8495392 - DNA, 22 bp, Homo sapiens
gtggccctctgatagggtcagg

SEQ ID NO: 8495393 - DNA, 22 bp, Homo sapiens
gtggccctcagcagttgccaag

SEQ ID NO: 8495394 - DNA, 18 bp, Homo sapiens
gtggccagcctggtcttg

SEQ ID NO: 8495395 - DNA, 22 bp, Homo sapiens
gtggccagccccatggacagtt

SEQ ID NO: 8495396 - DNA, 22 bp, Homo sapiens
gtggccagccccatggacagtt

SEQ ID NO: 8495397 - DNA, 22 bp, Homo sapiens
gtggccagccccatggacagtt

SEQ ID NO: 8495398 - DNA, 22 bp, Homo sapiens
gtggccagcaagtgctgcctct

SEQ ID NO: 8495399 - DNA, 22 bp, Homo sapiens
gtggccagcaagtgctgcctct

SEQ ID NO: 8495400 - DNA, 22 bp, Homo sapiens
gtggccagaggtcccatgtgtc

SEQ ID NO: 8495401 - DNA, 22 bp, Homo sapiens
gtggccagagtgtcattttatt

SEQ ID NO: 8495402 - DNA, 22 bp, Homo sapiens
gtggccagccagggtgctgatg

SEQ ID NO: 8495403 - DNA, 22 bp, Homo sapiens
gtggccagcaagtgctgcctct

SEQ ID NO: 8495404 - DNA, 22 bp, Homo sapiens
gtggccagaggatttgttcagt

SEQ ID NO: 8495405 - DNA, 22 bp, Homo sapiens
gtggccagagattaaatagagt

SEQ ID NO: 8495406 - DNA, 22 bp, Homo sapiens
gtggccagaggtcccatgtgtc

SEQ ID NO: 8495407 - DNA, 22 bp, Homo sapiens
gtggccagaatcttgaggcctt

SEQ ID NO: 8495408 - DNA, 22 bp, Homo sapiens
gtggccagaatcttgaggcctt

SEQ ID NO: 8495409 - DNA, 22 bp, Homo sapiens
gtggccagagattaaatagagt

SEQ ID NO: 8495410 - DNA, 22 bp, Homo sapiens
gtggccagagattaaatagagt

SEQ ID NO: 8495411 - DNA, 22 bp, Homo sapiens
gtggccagaaccaggagaatga

SEQ ID NO: 8495412 - DNA, 22 bp, Homo sapiens
gtggccagaaccaggagaatga

SEQ ID NO: 8495413 - DNA, 22 bp, Homo sapiens
gtggccagaaccaggagaatga

SEQ ID NO: 8495414 - DNA, 22 bp, Homo sapiens
gtggccagaaccaggagaatga

SEQ ID NO: 8495415 - DNA, 22 bp, Homo sapiens
gtggccagaagttaagtggtta

SEQ ID NO: 8495416 - DNA, 22 bp, Homo sapiens
gtggccagaagttaagtggtta

SEQ ID NO: 8495417 - DNA, 22 bp, Homo sapiens
gtggccagaagactgcaatgct

SEQ ID NO: 8495418 - DNA, 22 bp, Homo sapiens
gtggccagaagactgcaatgct

SEQ ID NO: 8495419 - DNA, 22 bp, Homo sapiens
gtggccagaagactgcaatgct

SEQ ID NO: 8495420 - DNA, 22 bp, Homo sapiens
gtcccagaaacatattgctggt

SEQ ID NO: 8495421 - DNA, 22 bp, Homo sapiens
gtcccagggaagaaggcagcac

SEQ ID NO: 8495422 - DNA, 22 bp, Homo sapiens
gtcccacaccttgaggggtctt

SEQ ID NO: 8495423 - DNA, 22 bp, Homo sapiens
gtccatctgtaggagggacaca

SEQ ID NO: 8495424 - DNA, 22 bp, Homo sapiens
gtccagggccccgagcaccagg

SEQ ID NO: 8495425 - DNA, 22 bp, Homo sapiens
gtccagggctaaatcaggttcc

SEQ ID NO: 8495426 - DNA, 22 bp, Homo sapiens
gtccagggggcttaagcaaact

SEQ ID NO: 8495427 - DNA, 22 bp, Homo sapiens
gtccttaacaaacggggaaaag

SEQ ID NO: 8495428 - DNA, 22 bp, Homo sapiens
gtccttaaagagagcatcattc

SEQ ID NO: 8495429 - DNA, 22 bp, Homo sapiens
gtccttcaaaggcacgcagtta

SEQ ID NO: 8495430 - DNA, 22 bp, Homo sapiens
gtccttcaagagtcccctactg

SEQ ID NO: 8495431 - DNA, 22 bp, Homo sapiens
gtcctgtgtgagtgcaccacct

SEQ ID NO: 8495432 - DNA, 22 bp, Homo sapiens
gtcctgtgtgttgccggctgaa

SEQ ID NO: 8495433 - DNA, 22 bp, Homo sapiens
gtcctgggtccccgcaggtcag

SEQ ID NO: 8495434 - DNA, 22 bp, Homo sapiens
gtcctgggtccccgcaggtcag

SEQ ID NO: 8495435 - DNA, 22 bp, Homo sapiens
gtcctggtagggctctgtgtct

SEQ ID NO: 8495436 - DNA, 22 bp, Homo sapiens
gtcctggtagctggcttggtca

SEQ ID NO: 8495437 - DNA, 22 bp, Homo sapiens
gtcctgtgtgacttcccaaatg

SEQ ID NO: 8495438 - DNA, 22 bp, Homo sapiens
gtcctgtgtactcctgatactt

SEQ ID NO: 8495439 - DNA, 22 bp, Homo sapiens
gtcccaggtgggctccacctct

SEQ ID NO: 8495440 - DNA, 22 bp, Homo sapiens
gtcccataagtagtgcaacttg

SEQ ID NO: 8495441 - DNA, 22 bp, Homo sapiens
gtcccaggtgcccagtgggcag

SEQ ID NO: 8495442 - DNA, 22 bp, Homo sapiens
gtcccagggatgcagacatgag

SEQ ID NO: 8495443 - DNA, 22 bp, Homo sapiens
gtcccagggaggttcagggctt

SEQ ID NO: 8495444 - DNA, 22 bp, Homo sapiens
gtcccagggaggttcagggctt

SEQ ID NO: 8495445 - DNA, 22 bp, Homo sapiens
gtcccagggatgcagacatgag

SEQ ID NO: 8495446 - DNA, 22 bp, Homo sapiens
gtcaggacaggctctggactga

SEQ ID NO: 8495447 - DNA, 22 bp, Homo sapiens
gtcaggacattttaccatcctg

SEQ ID NO: 8495448 - DNA, 22 bp, Homo sapiens
gtcaggactctgacccgtcccg

SEQ ID NO: 8495449 - DNA, 22 bp, Homo sapiens
gtcaggactctgacccgtcccg

SEQ ID NO: 8495450 - DNA, 22 bp, Homo sapiens
gtcaggaaaacccgggttgact

SEQ ID NO: 8495451 - DNA, 22 bp, Homo sapiens
gtcaggacaaggtggtctccag

SEQ ID NO: 8495452 - DNA, 22 bp, Homo sapiens
gtcaggagagatcaggacagca

SEQ ID NO: 8495453 - DNA, 22 bp, Homo sapiens
gtcaggagagatcaggacagca

SEQ ID NO: 8495454 - DNA, 22 bp, Homo sapiens
gtcaggagagatcaggacagca

SEQ ID NO: 8495455 - DNA, 22 bp, Homo sapiens
gtcaggagatagggcaagcttc

SEQ ID NO: 8495456 - DNA, 22 bp, Homo sapiens
gtcaggcagcctggagattcag

SEQ ID NO: 8495457 - DNA, 22 bp, Homo sapiens
gtcaggcatttaggatgagttc

SEQ ID NO: 8495458 - DNA, 19 bp, Homo sapiens
gtcaggcacgtgagagcat

SEQ ID NO: 8495459 - DNA, 19 bp, Homo sapiens
gtcaggcacgtgagagcat

SEQ ID NO: 8495460 - DNA, 22 bp, Homo sapiens
gtccagggaaatagcgacaggg

SEQ ID NO: 8495461 - DNA, 22 bp, Homo sapiens
gtcaggccctggcagccgtgac

SEQ ID NO: 8495462 - DNA, 22 bp, Homo sapiens
gtattacatttagtaattaggc

SEQ ID NO: 8495463 - DNA, 20 bp, Homo sapiens
gtattacaggcttagaacca

SEQ ID NO: 8495464 - DNA, 22 bp, Homo sapiens
gtcagaggggacaagacacaga

SEQ ID NO: 8495465 - DNA, 18 bp, Homo sapiens
gtcagaggatggggaaat

SEQ ID NO: 8495466 - DNA, 22 bp, Homo sapiens
gtcagaggggacaagacacaga

SEQ ID NO: 8495467 - DNA, 18 bp, Homo sapiens
gtcagaggatggggaaat

SEQ ID NO: 8495468 - DNA, 22 bp, Homo sapiens
gtatgtgttgaattcaggggtc

SEQ ID NO: 8495469 - DNA, 22 bp, Homo sapiens
gtatgtgtgcaaatgtaaatat

SEQ ID NO: 8495470 - DNA, 22 bp, Homo sapiens
gtatgtcaaaatctgcatgata

SEQ ID NO: 8495471 - DNA, 22 bp, Homo sapiens
gtatgtcacctctcctaagcac

SEQ ID NO: 8495472 - DNA, 22 bp, Homo sapiens
gtatgtcatgagccttgtgcgt

SEQ ID NO: 8495473 - DNA, 22 bp, Homo sapiens
gtcagaggggcagctgccaggc

SEQ ID NO: 8495474 - DNA, 22 bp, Homo sapiens
gtcagaggggcagctgccaggc

SEQ ID NO: 8495475 - DNA, 22 bp, Homo sapiens
gtcagaggggcagctgccaggc

SEQ ID NO: 8495476 - DNA, 22 bp, Homo sapiens
gtcagaggggcagctgccaggc

SEQ ID NO: 8495477 - DNA, 22 bp, Homo sapiens
gtcagctagaggatgtgacatt

SEQ ID NO: 8495478 - DNA, 22 bp, Homo sapiens
gtcagctaatagggtgtgtgtc

SEQ ID NO: 8495479 - DNA, 22 bp, Homo sapiens
gtcagctcctagcaccccccaa

SEQ ID NO: 8495480 - DNA, 22 bp, Homo sapiens
gtcagctcatccatcccggtgg

SEQ ID NO: 8495481 - DNA, 22 bp, Homo sapiens
gtcagctatgtctgttgttgag

SEQ ID NO: 8495482 - DNA, 22 bp, Homo sapiens
gtcagctcagcaggtgggagtg

SEQ ID NO: 8495483 - DNA, 22 bp, Homo sapiens
gtcaggaaaacccgggttgact

SEQ ID NO: 8495484 - DNA, 22 bp, Homo sapiens
gtcaggaaaaattgataatttt

SEQ ID NO: 8495485 - DNA, 22 bp, Homo sapiens
gtcagctgtctccccagagtgg

SEQ ID NO: 8495486 - DNA, 22 bp, Homo sapiens
gtcagctgtctccccagagtgg

SEQ ID NO: 8495487 - DNA, 22 bp, Homo sapiens
gtctggcttttgccctgtgttt

SEQ ID NO: 8495488 - DNA, 22 bp, Homo sapiens
gtctgggcacctggcctgggaa

SEQ ID NO: 8495489 - DNA, 22 bp, Homo sapiens
gtctgggcaagggagatggcgc

SEQ ID NO: 8495490 - DNA, 17 bp, Homo sapiens
gtctgggctttagagac

SEQ ID NO: 8495491 - DNA, 17 bp, Homo sapiens
gtctgggctttagagac

SEQ ID NO: 8495492 - DNA, 22 bp, Homo sapiens
gtctgggcttcagagttagaga

SEQ ID NO: 8495493 - DNA, 22 bp, Homo sapiens
gtctggggaagtcagggcatca

SEQ ID NO: 8495494 - DNA, 22 bp, Homo sapiens
gtctgagggttgtgctggagga

SEQ ID NO: 8495495 - DNA, 22 bp, Homo sapiens
gtctgagggttgtgctggagga

SEQ ID NO: 8495496 - DNA, 22 bp, Homo sapiens
gtctgatatcagaaaaagtaaa

SEQ ID NO: 8495497 - DNA, 22 bp, Homo sapiens
gtctgcccagaagacatcccct

SEQ ID NO: 8495498 - DNA, 22 bp, Homo sapiens
gtctggctgttcctgcctgtga

SEQ ID NO: 8495499 - DNA, 22 bp, Homo sapiens
gtctctgagctctgagctggct

SEQ ID NO: 8495500 - DNA, 22 bp, Homo sapiens
gtctctgagctctgagctggct

SEQ ID NO: 8495501 - DNA, 22 bp, Homo sapiens
gtctctgagctctgagctggct

SEQ ID NO: 8495502 - DNA, 22 bp, Homo sapiens
gtctctgagctctgagctggct

SEQ ID NO: 8495503 - DNA, 22 bp, Homo sapiens
gtctgaaaatgccctacgattg

SEQ ID NO: 8495504 - DNA, 22 bp, Homo sapiens
gtctgaaaatatgattttgcct

SEQ ID NO: 8495505 - DNA, 22 bp, Homo sapiens
gtctcttttatggtgagttgat

SEQ ID NO: 8495506 - DNA, 22 bp, Homo sapiens
gtctcttttatggtgagttgat

SEQ ID NO: 8495507 - DNA, 22 bp, Homo sapiens
gtctgagactttttctgtgtgg

SEQ ID NO: 8495508 - DNA, 22 bp, Homo sapiens
gtctgaaatggaggtgggaact

SEQ ID NO: 8495509 - DNA, 22 bp, Homo sapiens
gtctgaaagtagggctgatcta

SEQ ID NO: 8495510 - DNA, 22 bp, Homo sapiens
gtctgaaacgcattgttatcga

SEQ ID NO: 8495511 - DNA, 22 bp, Homo sapiens
gtctgaatgatgagtgggactc

SEQ ID NO: 8495512 - DNA, 22 bp, Homo sapiens
gtctgaatacgtacttgtgaag

SEQ ID NO: 8495513 - DNA, 22 bp, Homo sapiens
gtctgaattctgtgtaactcta

SEQ ID NO: 8495514 - DNA, 22 bp, Homo sapiens
gtctgacacctagagtccagga

SEQ ID NO: 8495515 - DNA, 20 bp, Homo sapiens
gtctgaggagcagtgggaaa

SEQ ID NO: 8495516 - DNA, 20 bp, Homo sapiens
gtctgaggagcagtgggaaa

SEQ ID NO: 8495517 - DNA, 22 bp, Homo sapiens
gtctgaggcctgaggccctggg

SEQ ID NO: 8495518 - DNA, 22 bp, Homo sapiens
gtctgagattagggaagatttt

SEQ ID NO: 8495519 - DNA, 22 bp, Homo sapiens
gtctgagctacttaggatataa

SEQ ID NO: 8495520 - DNA, 22 bp, Homo sapiens
gtctgagcgctggagcttgtgt

SEQ ID NO: 8495521 - DNA, 22 bp, Homo sapiens
gtctgagattagggaagatttt

SEQ ID NO: 8495522 - DNA, 22 bp, Homo sapiens
gtctgagcaccctggcctgtca

SEQ ID NO: 8495523 - DNA, 22 bp, Homo sapiens
gtctgagggacagagtcctggc

SEQ ID NO: 8495524 - DNA, 22 bp, Homo sapiens
gtctgaggcgaggcctgagaac

SEQ ID NO: 8495525 - DNA, 22 bp, Homo sapiens
gtctgaggggtttcccaggaca

SEQ ID NO: 8495526 - DNA, 22 bp, Homo sapiens
gtctgagggacagagtcctggc

SEQ ID NO: 8495527 - DNA, 20 bp, Homo sapiens
gtcgaaaaagataaacaggc

SEQ ID NO: 8495528 - DNA, 22 bp, Homo sapiens
gtcggccacgcaggtgcggtag

SEQ ID NO: 8495529 - DNA, 22 bp, Homo sapiens
gtccttggctgtggctgtaatg

SEQ ID NO: 8495530 - DNA, 22 bp, Homo sapiens
gtccttggcttcttgttgactg

SEQ ID NO: 8495531 - DNA, 22 bp, Homo sapiens
gtccttggaggtgtggaatctg

SEQ ID NO: 8495532 - DNA, 22 bp, Homo sapiens
gtccttggaggtgtggaatctg

SEQ ID NO: 8495533 - DNA, 22 bp, Homo sapiens
gtccttggagctcccctctgta

SEQ ID NO: 8495534 - DNA, 22 bp, Homo sapiens
gtccttggcacccatgtgattc

SEQ ID NO: 8495535 - DNA, 22 bp, Homo sapiens
gtccttggcacccatgtgattc

SEQ ID NO: 8495536 - DNA, 22 bp, Homo sapiens
gtccttcagcacctccctcggc

SEQ ID NO: 8495537 - DNA, 22 bp, Homo sapiens
gtccttcagcacctccctcggc

SEQ ID NO: 8495538 - DNA, 21 bp, Homo sapiens
gtccttcagcaagttagtggc

SEQ ID NO: 8495539 - DNA, 22 bp, Homo sapiens
gtccttcaagtaacctgggacc

SEQ ID NO: 8495540 - DNA, 22 bp, Homo sapiens
gtccttcaagtaacctgggacc

SEQ ID NO: 8495541 - DNA, 22 bp, Homo sapiens
gtccttcaaggtccttggtgtg

SEQ ID NO: 8495542 - DNA, 22 bp, Homo sapiens
gtccttcagctttatctgaaca

SEQ ID NO: 8495543 - DNA, 22 bp, Homo sapiens
gtccttcatctggagcctggtc

SEQ ID NO: 8495544 - DNA, 22 bp, Homo sapiens
gtccttcatatcatggattata

SEQ ID NO: 8495545 - DNA, 22 bp, Homo sapiens
gtccttcagggagtcaaacact

SEQ ID NO: 8495546 - DNA, 22 bp, Homo sapiens
gtccttcatttcctgatctcta

SEQ ID NO: 8495547 - DNA, 22 bp, Homo sapiens
gtccttcatggagttacagcct

SEQ ID NO: 8495548 - DNA, 22 bp, Homo sapiens
gtccttcatggagttacagcct

SEQ ID NO: 8495549 - DNA, 22 bp, Homo sapiens
gtccttcatctggagcctggtc

SEQ ID NO: 8495550 - DNA, 22 bp, Homo sapiens
gtccttgagtaagtcatggtgg

SEQ ID NO: 8495551 - DNA, 22 bp, Homo sapiens
gtccttcttttcatccctggtt

SEQ ID NO: 8495552 - DNA, 22 bp, Homo sapiens
gtccttcatttcctgatctcta

SEQ ID NO: 8495553 - DNA, 21 bp, Homo sapiens
gtccttcattatcaagtcaaa

SEQ ID NO: 8495554 - DNA, 22 bp, Homo sapiens
ggtggttcacgcctataatccc

SEQ ID NO: 8495555 - DNA, 22 bp, Homo sapiens
ggtggttgcataggccagcagc

SEQ ID NO: 8495556 - DNA, 22 bp, Homo sapiens
ggtgtagctctgtgtcccactg

SEQ ID NO: 8495557 - DNA, 22 bp, Homo sapiens
ggtgtagctctgtgtcccactg

SEQ ID NO: 8495558 - DNA, 17 bp, Homo sapiens
ggtgtatggggagggaa

SEQ ID NO: 8495559 - DNA, 17 bp, Homo sapiens
ggtgtatggggagggaa

SEQ ID NO: 8495560 - DNA, 23 bp, Homo sapiens
ggtggtggtgagtcacgggctca

SEQ ID NO: 8495561 - DNA, 22 bp, Homo sapiens
ggtggtggtcccgacttgggag

SEQ ID NO: 8495562 - DNA, 22 bp, Homo sapiens
ggtggttcacgcctataatccc

SEQ ID NO: 8495563 - DNA, 23 bp, Homo sapiens
ggtggtggtgagtcacgggctca

SEQ ID NO: 8495564 - DNA, 22 bp, Homo sapiens
ggtggccattctaccgccttct

SEQ ID NO: 8495565 - DNA, 22 bp, Homo sapiens
ggtggccatggtcaggtagcgg

SEQ ID NO: 8495566 - DNA, 22 bp, Homo sapiens
ggtgtccatcaggctgtgcttc

SEQ ID NO: 8495567 - DNA, 22 bp, Homo sapiens
ggtgtccatcaggctgtgcttc

SEQ ID NO: 8495568 - DNA, 22 bp, Homo sapiens
ggtgtccatcaggctgtgcttc

SEQ ID NO: 8495569 - DNA, 21 bp, Homo sapiens
ggtgtccagaggagtccccag

SEQ ID NO: 8495570 - DNA, 22 bp, Homo sapiens
ggtgtcccaggccagctgtgtg

SEQ ID NO: 8495571 - DNA, 22 bp, Homo sapiens
ggtgtccgcgctgtagaaggtc

SEQ ID NO: 8495572 - DNA, 21 bp, Homo sapiens
ggtgtcagttttggtcattag

SEQ ID NO: 8495573 - DNA, 22 bp, Homo sapiens
ggtggcagcgtctatctgacat

SEQ ID NO: 8495574 - DNA, 23 bp, Homo sapiens
ggtggcaggagtggatgctgagc

SEQ ID NO: 8495575 - DNA, 23 bp, Homo sapiens
ggtggcaggagtggatgctgagc

SEQ ID NO: 8495576 - DNA, 22 bp, Homo sapiens
ggtggcaggccctgagcatccc

SEQ ID NO: 8495577 - DNA, 22 bp, Homo sapiens
ggtggcaggccctgagcatccc

SEQ ID NO: 8495578 - DNA, 22 bp, Homo sapiens
ggtggcaggctggcattggcaa

SEQ ID NO: 8495579 - DNA, 22 bp, Homo sapiens
ggtggcatctcagttcatgggc

SEQ ID NO: 8495580 - DNA, 22 bp, Homo sapiens
ggtggcatctctttccagattt

SEQ ID NO: 8495581 - DNA, 22 bp, Homo sapiens
ggtggccataggaccagcctgg

SEQ ID NO: 8495582 - DNA, 22 bp, Homo sapiens
ggtggccataggaccagcctgg

SEQ ID NO: 8495583 - DNA, 22 bp, Homo sapiens
ggtggccaggccagctctggcc

SEQ ID NO: 8495584 - DNA, 22 bp, Homo sapiens
ggtggccaggccagctctggcc

SEQ ID NO: 8495585 - DNA, 22 bp, Homo sapiens
ggtggccaggccagctctggcc

SEQ ID NO: 8495586 - DNA, 22 bp, Homo sapiens
ggtggccaggccagctctggcc

SEQ ID NO: 8495587 - DNA, 22 bp, Homo sapiens
ggtggcattcagaagagctggc

SEQ ID NO: 8495588 - DNA, 22 bp, Homo sapiens
ggtggcattcagaagagctggc

SEQ ID NO: 8495589 - DNA, 22 bp, Homo sapiens
ggtgaggggagagtgaaagaaa

SEQ ID NO: 8495590 - DNA, 22 bp, Homo sapiens
ggtgaggggagagtgaaagaaa

SEQ ID NO: 8495591 - DNA, 22 bp, Homo sapiens
ggtgaggggagagtgaaagaaa

SEQ ID NO: 8495592 - DNA, 22 bp, Homo sapiens
ggtgaggggcacctctgcccgg

SEQ ID NO: 8495593 - DNA, 22 bp, Homo sapiens
ggtgaggggcgcctctgcccag

SEQ ID NO: 8495594 - DNA, 22 bp, Homo sapiens
ggtgagggtaaatataggcaaa

SEQ ID NO: 8495595 - DNA, 22 bp, Homo sapiens
ggtgagggtaaatataggcaaa

SEQ ID NO: 8495596 - DNA, 22 bp, Homo sapiens
ggtgagggtaaactaaaacatc

SEQ ID NO: 8495597 - DNA, 22 bp, Homo sapiens
ggtgagggtaaatataggcaaa

SEQ ID NO: 8495598 - DNA, 22 bp, Homo sapiens
ggtgaggggctcctctgcccgg

SEQ ID NO: 8495599 - DNA, 22 bp, Homo sapiens
ggtgaggggcgcctctgcccgg

SEQ ID NO: 8495600 - DNA, 22 bp, Homo sapiens
gggtggggcccaggaaatctat

SEQ ID NO: 8495601 - DNA, 22 bp, Homo sapiens
gggtggggcccaggaaatctat

SEQ ID NO: 8495602 - DNA, 22 bp, Homo sapiens
gggtggggccaggcaatttgca

SEQ ID NO: 8495603 - DNA, 22 bp, Homo sapiens
gggtggggtgtatcggatccta

SEQ ID NO: 8495604 - DNA, 22 bp, Homo sapiens
gggtggggtgtatcggatccta

SEQ ID NO: 8495605 - DNA, 22 bp, Homo sapiens
gggtggggtgtatcggatccta

SEQ ID NO: 8495606 - DNA, 22 bp, Homo sapiens
gggtggggtgtatcggatccta

SEQ ID NO: 8495607 - DNA, 22 bp, Homo sapiens
gggtggggttcaggaatcttca

SEQ ID NO: 8495608 - DNA, 22 bp, Homo sapiens
gggtggggttcaggaatcttca

SEQ ID NO: 8495609 - DNA, 22 bp, Homo sapiens
ggtggcagaggtgcatcagccc

SEQ ID NO: 8495610 - DNA, 22 bp, Homo sapiens
ggtggcagagaggaggtagttt

SEQ ID NO: 8495611 - DNA, 22 bp, Homo sapiens
ggtgcaggagcggggtgctcgg

SEQ ID NO: 8495612 - DNA, 22 bp, Homo sapiens
ggtgcaggagcggggtgctcgg

SEQ ID NO: 8495613 - DNA, 22 bp, Homo sapiens
ggtgcaggagcggggtgctcgg

SEQ ID NO: 8495614 - DNA, 22 bp, Homo sapiens
ggtgcaggcggtggggcaagta

SEQ ID NO: 8495615 - DNA, 22 bp, Homo sapiens
ggtgcaggcggtggggcaagta

SEQ ID NO: 8495616 - DNA, 22 bp, Homo sapiens
ggtgcaggcggtggggcaagta

SEQ ID NO: 8495617 - DNA, 22 bp, Homo sapiens
ggtgcaggacgaagtgggggtt

SEQ ID NO: 8495618 - DNA, 22 bp, Homo sapiens
ggtgcaggacgaagtgggggtt

SEQ ID NO: 8495619 - DNA, 22 bp, Homo sapiens
ggtgcaggacgaagtgggggtt

SEQ ID NO: 8495620 - DNA, 22 bp, Homo sapiens
ggtgcaggacgaagtgggggtt

SEQ ID NO: 8495621 - DNA, 22 bp, Homo sapiens
ggtgagtttcatggttgtttac

SEQ ID NO: 8495622 - DNA, 17 bp, Homo sapiens
ggtgagtgtccaggtgg

SEQ ID NO: 8495623 - DNA, 17 bp, Homo sapiens
ggtgagtgtccaggtgg

SEQ ID NO: 8495624 - DNA, 22 bp, Homo sapiens
ggtgagtgtcaatggttagagt

SEQ ID NO: 8495625 - DNA, 22 bp, Homo sapiens
ggtgagtgtcaatggttagagt

SEQ ID NO: 8495626 - DNA, 22 bp, Homo sapiens
ggtgagtgcctggcctggccac

SEQ ID NO: 8495627 - DNA, 22 bp, Homo sapiens
ggtgagggtaaatataggcaaa

SEQ ID NO: 8495628 - DNA, 22 bp, Homo sapiens
gtaaataactggtaattggggt

SEQ ID NO: 8495629 - DNA, 22 bp, Homo sapiens
gtaaataactggtaattggggt

SEQ ID NO: 8495630 - DNA, 22 bp, Homo sapiens
gtaaataactggtaattggggt

SEQ ID NO: 8495631 - DNA, 22 bp, Homo sapiens
gtaaataactggtaattggggt

SEQ ID NO: 8495632 - DNA, 22 bp, Homo sapiens
gtaaataactggtaattggggt

SEQ ID NO: 8495633 - DNA, 22 bp, Homo sapiens
gtaaatataaatgctagctgcc

SEQ ID NO: 8495634 - DNA, 22 bp, Homo sapiens
gtaaatataaatgctagctgcc

SEQ ID NO: 8495635 - DNA, 22 bp, Homo sapiens
gtaaatataaatgctagctgcc

SEQ ID NO: 8495636 - DNA, 22 bp, Homo sapiens
gtaaatataaatgctagctgcc

SEQ ID NO: 8495637 - DNA, 22 bp, Homo sapiens
gtaaatataaatgctagctgcc

SEQ ID NO: 8495638 - DNA, 22 bp, Homo sapiens
gtaaatattaaaggctgctaga

SEQ ID NO: 8495639 - DNA, 22 bp, Homo sapiens
gtacacaaaagaggaaaccgga

SEQ ID NO: 8495640 - DNA, 22 bp, Homo sapiens
gtaaatattccctcggttccta

SEQ ID NO: 8495641 - DNA, 22 bp, Homo sapiens
gtaaatataaatgctagctgcc

SEQ ID NO: 8495642 - DNA, 22 bp, Homo sapiens
gtaaatattaaaggctgctaga

SEQ ID NO: 8495643 - DNA, 22 bp, Homo sapiens
gtaaatattaaaggctgctaga

SEQ ID NO: 8495644 - DNA, 22 bp, Homo sapiens
gtaaatattaaaggctgctaga

SEQ ID NO: 8495645 - DNA, 22 bp, Homo sapiens
gtaaatattaaaggctgctaga

SEQ ID NO: 8495646 - DNA, 22 bp, Homo sapiens
gtacaggcagcaaacaccataa

SEQ ID NO: 8495647 - DNA, 22 bp, Homo sapiens
gtacaggaccgcggccccctgg

SEQ ID NO: 8495648 - DNA, 22 bp, Homo sapiens
gtacaggaaggagggagtttca

SEQ ID NO: 8495649 - DNA, 22 bp, Homo sapiens
gtacaggaaggagggagtttca

SEQ ID NO: 8495650 - DNA, 22 bp, Homo sapiens
gtacagctaagaatttcatctt

SEQ ID NO: 8495651 - DNA, 22 bp, Homo sapiens
gtacagcatttgaaattactgg

SEQ ID NO: 8495652 - DNA, 22 bp, Homo sapiens
gtacagattaataatatactga

SEQ ID NO: 8495653 - DNA, 22 bp, Homo sapiens
gtacagaaagtacccatagaag

SEQ ID NO: 8495654 - DNA, 21 bp, Homo sapiens
gtacacacaggtggatgggct

SEQ ID NO: 8495655 - DNA, 21 bp, Homo sapiens
gtacacacaggtggatgggct

SEQ ID NO: 8495656 - DNA, 22 bp, Homo sapiens
gtacacacaatctctggtcagt

SEQ ID NO: 8495657 - DNA, 22 bp, Homo sapiens
gtacacacaatctctggtcagt

SEQ ID NO: 8495658 - DNA, 22 bp, Homo sapiens
gtacagagaaggttacatatga

SEQ ID NO: 8495659 - DNA, 22 bp, Homo sapiens
gtacagaattatgccatgaggg

SEQ ID NO: 8495660 - DNA, 22 bp, Homo sapiens
gtacagaaggatttctagtagt

SEQ ID NO: 8495661 - DNA, 22 bp, Homo sapiens
gtacagaatgcttggtaaggca

SEQ ID NO: 8495662 - DNA, 22 bp, Homo sapiens
gtacagaatgcttggtaaggca

SEQ ID NO: 8495663 - DNA, 22 bp, Homo sapiens
gtacagaaatggggccccaggt

SEQ ID NO: 8495664 - DNA, 22 bp, Homo sapiens
gtaaacatgctgtgtactcagc

SEQ ID NO: 8495665 - DNA, 22 bp, Homo sapiens
gtaaacatgctgtgtactcagc

SEQ ID NO: 8495666 - DNA, 22 bp, Homo sapiens
gtaaacattactgtgctgtata

SEQ ID NO: 8495667 - DNA, 22 bp, Homo sapiens
gtaaacattactgtgctgtata

SEQ ID NO: 8495668 - DNA, 22 bp, Homo sapiens
gtaaacattactgtgctgtata

SEQ ID NO: 8495669 - DNA, 22 bp, Homo sapiens
gtaaacattttcatctgtgccc

SEQ ID NO: 8495670 - DNA, 22 bp, Homo sapiens
gtaaacattttcatctgtgccc

SEQ ID NO: 8495671 - DNA, 23 bp, Homo sapiens
gtaaaatacgcagtgcagtgtga

SEQ ID NO: 8495672 - DNA, 22 bp, Homo sapiens
ggtgtcctcactatagcaagtc

SEQ ID NO: 8495673 - DNA, 22 bp, Homo sapiens
gtaaagcaaaatgtagagattg

SEQ ID NO: 8495674 - DNA, 22 bp, Homo sapiens
gtaaagaagtttttgaatgcat

SEQ ID NO: 8495675 - DNA, 22 bp, Homo sapiens
gtaaagaaggcaacctggttat

SEQ ID NO: 8495676 - DNA, 22 bp, Homo sapiens
gtaaagaagtttttgaatgcat

SEQ ID NO: 8495677 - DNA, 22 bp, Homo sapiens
gtaaagaaggcaacctggttat

SEQ ID NO: 8495678 - DNA, 20 bp, Homo sapiens
gtaaagcattcttggcatac

SEQ ID NO: 8495679 - DNA, 22 bp, Homo sapiens
gtaaagtaaacccactttgtag

SEQ ID NO: 8495680 - DNA, 22 bp, Homo sapiens
gtaaagttctatttgaatttag

SEQ ID NO: 8495681 - DNA, 22 bp, Homo sapiens
gtaaagttctactagaatcaac

SEQ ID NO: 8495682 - DNA, 19 bp, Homo sapiens
gtacagtggtaagctatga

SEQ ID NO: 8495683 - DNA, 22 bp, Homo sapiens
gtacagtagtaaaagtgaatga

SEQ ID NO: 8495684 - DNA, 22 bp, Homo sapiens
gtacagtaaatgtaaatggatt

SEQ ID NO: 8495685 - DNA, 22 bp, Homo sapiens
gtacagtaaatgtaaatggatt

SEQ ID NO: 8495686 - DNA, 22 bp, Homo sapiens
gtacagtacttcagaaccagcc

SEQ ID NO: 8495687 - DNA, 22 bp, Homo sapiens
gtacagtaatcccgttcttctg

SEQ ID NO: 8495688 - DNA, 22 bp, Homo sapiens
gtacagtagagccaggttcagt

SEQ ID NO: 8495689 - DNA, 22 bp, Homo sapiens
gtacagttttcagtgttcactg

SEQ ID NO: 8495690 - DNA, 22 bp, Homo sapiens
gtacatattacagacaaagctt

SEQ ID NO: 8495691 - DNA, 22 bp, Homo sapiens
gtacatattaaaggtctataaa

SEQ ID NO: 8495692 - DNA, 22 bp, Homo sapiens
gtacatgttggttgtttccagt

SEQ ID NO: 8495693 - DNA, 22 bp, Homo sapiens
gtacatgtcaaaaaatgcataa

SEQ ID NO: 8495694 - DNA, 22 bp, Homo sapiens
gtacatgcagattatagctaat

SEQ ID NO: 8495695 - DNA, 22 bp, Homo sapiens
gtacatttactgatgaaaagta

SEQ ID NO: 8495696 - DNA, 22 bp, Homo sapiens
gtacattggcaactctcttaga

SEQ ID NO: 8495697 - DNA, 22 bp, Homo sapiens
gtacatttactgatgaaaagta

SEQ ID NO: 8495698 - DNA, 22 bp, Homo sapiens
gtacatttaggattcattgaaa

SEQ ID NO: 8495699 - DNA, 22 bp, Homo sapiens
gtacatttaggattcattgaaa

SEQ ID NO: 8495700 - DNA, 22 bp, Homo sapiens
gtatacatgtggtaaaatgcac

SEQ ID NO: 8495701 - DNA, 22 bp, Homo sapiens
gtatataaggtaaagcgattgt

SEQ ID NO: 8495702 - DNA, 22 bp, Homo sapiens
gtatatatcggcactattttaa

SEQ ID NO: 8495703 - DNA, 22 bp, Homo sapiens
gtatataaggtaaagcgattgt

SEQ ID NO: 8495704 - DNA, 20 bp, Homo sapiens
gtatataaccatagtgacta

SEQ ID NO: 8495705 - DNA, 22 bp, Homo sapiens
gtatatatcggcactattttaa

SEQ ID NO: 8495706 - DNA, 22 bp, Homo sapiens
gtatagtttgcgatttgtggtt

SEQ ID NO: 8495707 - DNA, 20 bp, Homo sapiens
gtatataaccatagtgacta

SEQ ID NO: 8495708 - DNA, 22 bp, Homo sapiens
gtataggcattttgattagagt

SEQ ID NO: 8495709 - DNA, 22 bp, Homo sapiens
gtatggaagtataagttttgaa

SEQ ID NO: 8495710 - DNA, 22 bp, Homo sapiens
taacagaatagcagaaacagaa

SEQ ID NO: 8495711 - DNA, 22 bp, Homo sapiens
taacagaatcctgttattgcca

SEQ ID NO: 8495712 - DNA, 22 bp, Homo sapiens
taacagaatcctgttattgcca

SEQ ID NO: 8495713 - DNA, 22 bp, Homo sapiens
taacagaatcctgttattgcca

SEQ ID NO: 8495714 - DNA, 22 bp, Homo sapiens
taacactgtggtgttctttgtc

SEQ ID NO: 8495715 - DNA, 22 bp, Homo sapiens
taacagaagttgttcattgtgg

SEQ ID NO: 8495716 - DNA, 22 bp, Homo sapiens
taacactgtccaaagaattcca

SEQ ID NO: 8495717 - DNA, 22 bp, Homo sapiens
taacactgtaaacctagatgtt

SEQ ID NO: 8495718 - DNA, 22 bp, Homo sapiens
taacactgtccaaagaattcca

SEQ ID NO: 8495719 - DNA, 22 bp, Homo sapiens
taacagcagtcctcttctcatg

SEQ ID NO: 8495720 - DNA, 22 bp, Homo sapiens
taagaaatttagttatagaatg

SEQ ID NO: 8495721 - DNA, 22 bp, Homo sapiens
taagaaatttagttatagaatg

SEQ ID NO: 8495722 - DNA, 20 bp, Homo sapiens
taagaacaagactaggaagc

SEQ ID NO: 8495723 - DNA, 22 bp, Homo sapiens
taacagaatttgctaaactccg

SEQ ID NO: 8495724 - DNA, 22 bp, Homo sapiens
taacagaatttgctaaactccg

SEQ ID NO: 8495725 - DNA, 22 bp, Homo sapiens
taacagaatttgctaaactccg

SEQ ID NO: 8495726 - DNA, 22 bp, Homo sapiens
taacagagatagaaatgtaaag

SEQ ID NO: 8495727 - DNA, 20 bp, Homo sapiens
taagaacaagactaggaagc

SEQ ID NO: 8495728 - DNA, 22 bp, Homo sapiens
taaatccctacatctgtgtttt

SEQ ID NO: 8495729 - DNA, 22 bp, Homo sapiens
taaatcagtttctcttattggt

SEQ ID NO: 8495730 - DNA, 22 bp, Homo sapiens
taaatcagtaaggcatattctc

SEQ ID NO: 8495731 - DNA, 22 bp, Homo sapiens
taaatagaatctaaactgctca

SEQ ID NO: 8495732 - DNA, 22 bp, Homo sapiens
taaatcacccatctcctaatct

SEQ ID NO: 8495733 - DNA, 22 bp, Homo sapiens
taaatcacccatctcctaatct

SEQ ID NO: 8495734 - DNA, 22 bp, Homo sapiens
taaatcactgtactttattcct

SEQ ID NO: 8495735 - DNA, 22 bp, Homo sapiens
taaatcactcttctctcaccac

SEQ ID NO: 8495736 - DNA, 22 bp, Homo sapiens
taaatcactgttcattccacac

SEQ ID NO: 8495737 - DNA, 22 bp, Homo sapiens
taaatcactcctaataatcagt

SEQ ID NO: 8495738 - DNA, 22 bp, Homo sapiens
taaatcactcctaataatcagt

SEQ ID NO: 8495739 - DNA, 22 bp, Homo sapiens
taaatcactcttctctcaccac

SEQ ID NO: 8495740 - DNA, 19 bp, Homo sapiens
taaatctgtattcttcaaa

SEQ ID NO: 8495741 - DNA, 22 bp, Homo sapiens
taaatccttatcttctttgaat

SEQ ID NO: 8495742 - DNA, 22 bp, Homo sapiens
taaatctcactgggtatattgg

SEQ ID NO: 8495743 - DNA, 22 bp, Homo sapiens
taaatcttctacatcatcataa

SEQ ID NO: 8495744 - DNA, 22 bp, Homo sapiens
taaatcttgtggcaatgcttct

SEQ ID NO: 8495745 - DNA, 22 bp, Homo sapiens
taaatcttgtggcaatgcttct

SEQ ID NO: 8495746 - DNA, 22 bp, Homo sapiens
taaatgaagaaatggagattgt

SEQ ID NO: 8495747 - DNA, 22 bp, Homo sapiens
taacactggcttttgctgaggc

SEQ ID NO: 8495748 - DNA, 22 bp, Homo sapiens
taacactggttatccctgtgca

SEQ ID NO: 8495749 - DNA, 22 bp, Homo sapiens
taacactggtatttcatttagt

SEQ ID NO: 8495750 - DNA, 22 bp, Homo sapiens
taacactgatttgttctcaggg

SEQ ID NO: 8495751 - DNA, 22 bp, Homo sapiens
taaatgagggctgacatgattg

SEQ ID NO: 8495752 - DNA, 22 bp, Homo sapiens
taaatgagggctgacatgattg

SEQ ID NO: 8495753 - DNA, 22 bp, Homo sapiens
taaatgataataatgctagtgt

SEQ ID NO: 8495754 - DNA, 22 bp, Homo sapiens
taaatgacattcttaagtcttg

SEQ ID NO: 8495755 - DNA, 22 bp, Homo sapiens
taaatgacattcttaagtcttg

SEQ ID NO: 8495756 - DNA, 22 bp, Homo sapiens
taaatgacccatgctgacctca

SEQ ID NO: 8495757 - DNA, 22 bp, Homo sapiens
taaatgagatgtacataactca

SEQ ID NO: 8495758 - DNA, 22 bp, Homo sapiens
taaatgaagaaatggagattgt

SEQ ID NO: 8495759 - DNA, 22 bp, Homo sapiens
taaatgaagctcatgggccaca

SEQ ID NO: 8495760 - DNA, 22 bp, Homo sapiens
taaatgaagaaatggagattgt

SEQ ID NO: 8495761 - DNA, 22 bp, Homo sapiens
gtttttctgtgagcggtaaagg

SEQ ID NO: 8495762 - DNA, 20 bp, Homo sapiens
gtttttcttgggcgagctat

SEQ ID NO: 8495763 - DNA, 22 bp, Homo sapiens
gtttttctctgaaatagttgac

SEQ ID NO: 8495764 - DNA, 22 bp, Homo sapiens
gtttttctagactgggagtttg

SEQ ID NO: 8495765 - DNA, 22 bp, Homo sapiens
gtttttctaggaccatgtgatt

SEQ ID NO: 8495766 - DNA, 20 bp, Homo sapiens
gtttttctctcttgccacta

SEQ ID NO: 8495767 - DNA, 22 bp, Homo sapiens
gtttttctaggaccatgtgatt

SEQ ID NO: 8495768 - DNA, 22 bp, Homo sapiens
gttttttcatgagtagttatct

SEQ ID NO: 8495769 - DNA, 22 bp, Homo sapiens
gtttttctttgtgtgaagacaa

SEQ ID NO: 8495770 - DNA, 22 bp, Homo sapiens
gtttttctttgtgtgaagacaa

SEQ ID NO: 8495771 - DNA, 22 bp, Homo sapiens
gtttttctttgtgtgaagacaa

SEQ ID NO: 8495772 - DNA, 22 bp, Homo sapiens
gtttttctagaaatctcctcct

SEQ ID NO: 8495773 - DNA, 22 bp, Homo sapiens
gtttttctaagtagcgatattt

SEQ ID NO: 8495774 - DNA, 22 bp, Homo sapiens
gtttttctagaaatctcctcct

SEQ ID NO: 8495775 - DNA, 22 bp, Homo sapiens
gtttaattcccacacctgccct

SEQ ID NO: 8495776 - DNA, 21 bp, Homo sapiens
gtttttcagccctgaggtgag

SEQ ID NO: 8495777 - DNA, 22 bp, Homo sapiens
gtttaataatgttgaattacta

SEQ ID NO: 8495778 - DNA, 22 bp, Homo sapiens
gtttaagtttcagaagctaaga

SEQ ID NO: 8495779 - DNA, 22 bp, Homo sapiens
gtttaactgggagtgtgggaaa

SEQ ID NO: 8495780 - DNA, 22 bp, Homo sapiens
gtttaacattgtaccaacacct

SEQ ID NO: 8495781 - DNA, 22 bp, Homo sapiens
gtttaaccaagagcattgtgca

SEQ ID NO: 8495782 - DNA, 22 bp, Homo sapiens
gtttaagaaaattcatgttgtt

SEQ ID NO: 8495783 - DNA, 22 bp, Homo sapiens
gtttaaccattgcatatccata

SEQ ID NO: 8495784 - DNA, 22 bp, Homo sapiens
gttgtttttgttctctatagct

SEQ ID NO: 8495785 - DNA, 22 bp, Homo sapiens
gtttaaagtagcttccttttgg

SEQ ID NO: 8495786 - DNA, 22 bp, Homo sapiens
gtttaaataattaggggcctgt

SEQ ID NO: 8495787 - DNA, 22 bp, Homo sapiens
gtttaaataattaggggcctgt

SEQ ID NO: 8495788 - DNA, 22 bp, Homo sapiens
gtttaaataattaggggcctgt

SEQ ID NO: 8495789 - DNA, 22 bp, Homo sapiens
gtttaaataattaggggcctgt

SEQ ID NO: 8495790 - DNA, 22 bp, Homo sapiens
gtttaacatctgtgaagctgct

SEQ ID NO: 8495791 - DNA, 22 bp, Homo sapiens
gtttaaataattaggggcctgt

SEQ ID NO: 8495792 - DNA, 22 bp, Homo sapiens
gttgttttgcaggatccttaca

SEQ ID NO: 8495793 - DNA, 22 bp, Homo sapiens
taaaaccataaggctggaagga

SEQ ID NO: 8495794 - DNA, 22 bp, Homo sapiens
taaaaccaggtcttgggattta

SEQ ID NO: 8495795 - DNA, 22 bp, Homo sapiens
taaaaccataaggctggaagga

SEQ ID NO: 8495796 - DNA, 22 bp, Homo sapiens
taaaacagcagggcagagaagt

SEQ ID NO: 8495797 - DNA, 22 bp, Homo sapiens
taaaacagcagggcagagaagt

SEQ ID NO: 8495798 - DNA, 22 bp, Homo sapiens
taaaactagtggttgggactaa

SEQ ID NO: 8495799 - DNA, 22 bp, Homo sapiens
taaaactagtggttgggactaa

SEQ ID NO: 8495800 - DNA, 22 bp, Homo sapiens
taaaactagaccgtgagtctaa

SEQ ID NO: 8495801 - DNA, 22 bp, Homo sapiens
taaaactagaccgtgagtctaa

SEQ ID NO: 8495802 - DNA, 22 bp, Homo sapiens
taaaactagtggttgggactaa

SEQ ID NO: 8495803 - DNA, 22 bp, Homo sapiens
taaaactagtggttgggactaa

SEQ ID NO: 8495804 - DNA, 22 bp, Homo sapiens
taaagcaggcatctctctcctc

SEQ ID NO: 8495805 - DNA, 22 bp, Homo sapiens
taaagcaggccacatatgtgat

SEQ ID NO: 8495806 - DNA, 22 bp, Homo sapiens
taaagcaggccacatatgtgat

SEQ ID NO: 8495807 - DNA, 22 bp, Homo sapiens
taaagcttgtattgcaatattt

SEQ ID NO: 8495808 - DNA, 22 bp, Homo sapiens
taaagctgttcagtgcagaaag

SEQ ID NO: 8495809 - DNA, 22 bp, Homo sapiens
taaaggaacagaggactcattt

SEQ ID NO: 8495810 - DNA, 22 bp, Homo sapiens
taaagctgttcagtgcagaaag

SEQ ID NO: 8495811 - DNA, 22 bp, Homo sapiens
taaagctagaattgttccagca

SEQ ID NO: 8495812 - DNA, 21 bp, Homo sapiens
taaagctagaaccttagcttt

SEQ ID NO: 8495813 - DNA, 22 bp, Homo sapiens
taaagctagaaggtgctgtaca

SEQ ID NO: 8495814 - DNA, 21 bp, Homo sapiens
taaagctagaaccttagcttt

SEQ ID NO: 8495815 - DNA, 22 bp, Homo sapiens
taaaggaggagttaatgagact

SEQ ID NO: 8495816 - DNA, 22 bp, Homo sapiens
taaaggaggagttaatgagact

SEQ ID NO: 8495817 - DNA, 22 bp, Homo sapiens
taaaggaatcagttttagagat

SEQ ID NO: 8495818 - DNA, 18 bp, Homo sapiens
taaaggaagtgggagagg

SEQ ID NO: 8495819 - DNA, 22 bp, Homo sapiens
taaaggattttgtataatataa

SEQ ID NO: 8495820 - DNA, 22 bp, Homo sapiens
taaaggataactttcaagaatt

SEQ ID NO: 8495821 - DNA, 22 bp, Homo sapiens
taaaggcacggagttgttatgg

SEQ ID NO: 8495822 - DNA, 22 bp, Homo sapiens
taaaggcaaatgtgtgtttgtg

SEQ ID NO: 8495823 - DNA, 22 bp, Homo sapiens
taaaggcaattcagcaagccac

SEQ ID NO: 8495824 - DNA, 22 bp, Homo sapiens
taaaggcacggagttgttatgg

SEQ ID NO: 8495825 - DNA, 22 bp, Homo sapiens
taaaggcatgcaggtgaatgta

SEQ ID NO: 8495826 - DNA, 22 bp, Homo sapiens
taaaggccagggcctgagtgct

SEQ ID NO: 8495827 - DNA, 22 bp, Homo sapiens
taaaggcagttctgattaggtc

SEQ ID NO: 8495828 - DNA, 22 bp, Homo sapiens
taaaggcagtaattcctgagtt

SEQ ID NO: 8495829 - DNA, 22 bp, Homo sapiens
taaatactttacaggatgtctc

SEQ ID NO: 8495830 - DNA, 22 bp, Homo sapiens
taaatactttacaggatgtctc

SEQ ID NO: 8495831 - DNA, 22 bp, Homo sapiens
taaatactttacaggatgtctc

SEQ ID NO: 8495832 - DNA, 20 bp, Homo sapiens
gtgggcagcaggcatactgg

SEQ ID NO: 8495833 - DNA, 22 bp, Homo sapiens
gtgggcagcaccagggaagtgt

SEQ ID NO: 8495834 - DNA, 22 bp, Homo sapiens
gtgggcagcaccagggaagtgt

SEQ ID NO: 8495835 - DNA, 22 bp, Homo sapiens
gtgggcagattatagatgatgc

SEQ ID NO: 8495836 - DNA, 22 bp, Homo sapiens
gtgggcagattatagatgatgc

SEQ ID NO: 8495837 - DNA, 22 bp, Homo sapiens
gtgggcagaggagagaacatta

SEQ ID NO: 8495838 - DNA, 20 bp, Homo sapiens
gtgggcagatgtgtgcatgg

SEQ ID NO: 8495839 - DNA, 22 bp, Homo sapiens
gtgggcagagcaagggaactca

SEQ ID NO: 8495840 - DNA, 20 bp, Homo sapiens
gtgggcagagcaccacctgg

SEQ ID NO: 8495841 - DNA, 22 bp, Homo sapiens
gtgggcagaggagagaacatta

SEQ ID NO: 8495842 - DNA, 20 bp, Homo sapiens
gtgggcagagcaccacctgg

SEQ ID NO: 8495843 - DNA, 20 bp, Homo sapiens
gtgggcagagcaccacctgg

SEQ ID NO: 8495844 - DNA, 22 bp, Homo sapiens
gtgggcagacatgatagaagga

SEQ ID NO: 8495845 - DNA, 22 bp, Homo sapiens
gtgggcagacatgatagaagga

SEQ ID NO: 8495846 - DNA, 22 bp, Homo sapiens
gtgggcagacatgatagaagga

SEQ ID NO: 8495847 - DNA, 22 bp, Homo sapiens
gtgggcagaacatttgtaggct

SEQ ID NO: 8495848 - DNA, 22 bp, Homo sapiens
gtgggcaaggtccctgccagct

SEQ ID NO: 8495849 - DNA, 22 bp, Homo sapiens
gtgggcagtggtttgcgcggtc

SEQ ID NO: 8495850 - DNA, 22 bp, Homo sapiens
gtgggcagtgtgtcagtatctt

SEQ ID NO: 8495851 - DNA, 22 bp, Homo sapiens
gtgggcagttcaattctgggag

SEQ ID NO: 8495852 - DNA, 22 bp, Homo sapiens
gtgggcagcctgtccggagacc

SEQ ID NO: 8495853 - DNA, 22 bp, Homo sapiens
gtgggcaggaggccctgccctg

SEQ ID NO: 8495854 - DNA, 22 bp, Homo sapiens
gtgggcagccccttcaaggcca

SEQ ID NO: 8495855 - DNA, 22 bp, Homo sapiens
gtgggcagccccttcaaggcca

SEQ ID NO: 8495856 - DNA, 22 bp, Homo sapiens
gtgggccacatcccagggctct

SEQ ID NO: 8495857 - DNA, 22 bp, Homo sapiens
gtgggccactgggaggcaaggg

SEQ ID NO: 8495858 - DNA, 22 bp, Homo sapiens
gtgggccacatcccagggctct

SEQ ID NO: 8495859 - DNA, 22 bp, Homo sapiens
gtgggccaggcgtctaggccct

SEQ ID NO: 8495860 - DNA, 22 bp, Homo sapiens
gtgggccaggccggagtgcaga

SEQ ID NO: 8495861 - DNA, 19 bp, Homo sapiens
gtgggccaggcagaaggct

SEQ ID NO: 8495862 - DNA, 22 bp, Homo sapiens
gtgggccagcattttgaagagt

SEQ ID NO: 8495863 - DNA, 22 bp, Homo sapiens
gtgggggacccaggtgctgtcc

SEQ ID NO: 8495864 - DNA, 22 bp, Homo sapiens
gtgggggatgctgagttggaaa

SEQ ID NO: 8495865 - DNA, 22 bp, Homo sapiens
gtggggcttcctggggcaagtt

SEQ ID NO: 8495866 - DNA, 22 bp, Homo sapiens
gtggggcttcctggggcaagtt

SEQ ID NO: 8495867 - DNA, 22 bp, Homo sapiens
gtgggggcaggcagtgctagga

SEQ ID NO: 8495868 - DNA, 22 bp, Homo sapiens
gtgggggcaggcagtgctagga

SEQ ID NO: 8495869 - DNA, 22 bp, Homo sapiens
gtgggggcaggcagtgctagga

SEQ ID NO: 8495870 - DNA, 22 bp, Homo sapiens
gtgggggatgctgagttggaaa

SEQ ID NO: 8495871 - DNA, 22 bp, Homo sapiens
gtggggaaaggagtggggctca

SEQ ID NO: 8495872 - DNA, 22 bp, Homo sapiens
gtggggacgggatggctcactg

SEQ ID NO: 8495873 - DNA, 22 bp, Homo sapiens
gtggggagcagccttagcccct

SEQ ID NO: 8495874 - DNA, 22 bp, Homo sapiens
gtggggaggcattcttctccct

SEQ ID NO: 8495875 - DNA, 22 bp, Homo sapiens
gtggggaggcattcttctccct

SEQ ID NO: 8495876 - DNA, 22 bp, Homo sapiens
gtggggaggcctaagcaagttg

SEQ ID NO: 8495877 - DNA, 22 bp, Homo sapiens
gtgggccttgcagggtgcaggg

SEQ ID NO: 8495878 - DNA, 22 bp, Homo sapiens
gtgggcctcttgagggtggcta

SEQ ID NO: 8495879 - DNA, 22 bp, Homo sapiens
gtgggctgaggggacaccaagg

SEQ ID NO: 8495880 - DNA, 22 bp, Homo sapiens
gtgggccttgcagggtgcaggg

SEQ ID NO: 8495881 - DNA, 22 bp, Homo sapiens
gtgggccttgcagggtgcaggg

SEQ ID NO: 8495882 - DNA, 22 bp, Homo sapiens
gtgggcttctgttagggaggct

SEQ ID NO: 8495883 - DNA, 22 bp, Homo sapiens
gtgggctgcccttgaggtcagc

SEQ ID NO: 8495884 - DNA, 22 bp, Homo sapiens
gtgggctggaccctcctgctcc

SEQ ID NO: 8495885 - DNA, 22 bp, Homo sapiens
gtggtctggggtcaggcctgag

SEQ ID NO: 8495886 - DNA, 22 bp, Homo sapiens
gtggtctggggtcaggcctgag

SEQ ID NO: 8495887 - DNA, 22 bp, Homo sapiens
gtggtcctttagaggatgtaat

SEQ ID NO: 8495888 - DNA, 22 bp, Homo sapiens
gtggtctggggtcaggcctgag

SEQ ID NO: 8495889 - DNA, 22 bp, Homo sapiens
gtggtcctggcaaccatggtga

SEQ ID NO: 8495890 - DNA, 22 bp, Homo sapiens
gtggtgagattgctggatcaaa

SEQ ID NO: 8495891 - DNA, 22 bp, Homo sapiens
gtggtcccttctggccctggtc

SEQ ID NO: 8495892 - DNA, 22 bp, Homo sapiens
gtggtcctgccagccaggtcca

SEQ ID NO: 8495893 - DNA, 22 bp, Homo sapiens
gtggtccaaggagtttccagca

SEQ ID NO: 8495894 - DNA, 22 bp, Homo sapiens
gtggtccccagagctgtgtaca

SEQ ID NO: 8495895 - DNA, 22 bp, Homo sapiens
gtggtccatcatgcagagctcc

SEQ ID NO: 8495896 - DNA, 21 bp, Homo sapiens
gtggttattttcattagcatc

SEQ ID NO: 8495897 - DNA, 21 bp, Homo sapiens
gtggttctagagaaacagaat

SEQ ID NO: 8495898 - DNA, 22 bp, Homo sapiens
gtggttgtttaggtcgtggatc

SEQ ID NO: 8495899 - DNA, 22 bp, Homo sapiens
gtggttgtttaggtcgtggatc

SEQ ID NO: 8495900 - DNA, 22 bp, Homo sapiens
gtggtgtaggtcacagttagga

SEQ ID NO: 8495901 - DNA, 22 bp, Homo sapiens
gtggtgcatccttgagtaagct

SEQ ID NO: 8495902 - DNA, 22 bp, Homo sapiens
gtggtgcaggtgtcactgcaga

SEQ ID NO: 8495903 - DNA, 22 bp, Homo sapiens
gtggtgcatgcatgcatatgta

SEQ ID NO: 8495904 - DNA, 22 bp, Homo sapiens
gtggtgcatccttgagtaagct

SEQ ID NO: 8495905 - DNA, 22 bp, Homo sapiens
gtggtgcaggccagcaggggcg

SEQ ID NO: 8495906 - DNA, 22 bp, Homo sapiens
gtggtgcaggaagcatctggct

SEQ ID NO: 8495907 - DNA, 22 bp, Homo sapiens
gtggtgagttcaggctggggtg

SEQ ID NO: 8495908 - DNA, 22 bp, Homo sapiens
gtgtcaataaatagcggtgtgg

SEQ ID NO: 8495909 - DNA, 19 bp, Homo sapiens
gtgtacagctcagtgaatt

SEQ ID NO: 8495910 - DNA, 22 bp, Homo sapiens
gtgtcacaagagcccaggaaac

SEQ ID NO: 8495911 - DNA, 22 bp, Homo sapiens
gtgtcacaggcccagctcttca

SEQ ID NO: 8495912 - DNA, 22 bp, Homo sapiens
gtgtcaatgaggtttatttttg

SEQ ID NO: 8495913 - DNA, 22 bp, Homo sapiens
gtgtcacatggtttactgcagc

SEQ ID NO: 8495914 - DNA, 22 bp, Homo sapiens
gtgtcacaggcccagctcttca

SEQ ID NO: 8495915 - DNA, 22 bp, Homo sapiens
gtgtacaaaatgtctccatgga

SEQ ID NO: 8495916 - DNA, 22 bp, Homo sapiens
gtgtaattgaaattgagaacca

SEQ ID NO: 8495917 - DNA, 22 bp, Homo sapiens
gtgtaagtatctttgtatcttt

SEQ ID NO: 8495918 - DNA, 22 bp, Homo sapiens
gtgtaagtatctttgtatcttt

SEQ ID NO: 8495919 - DNA, 22 bp, Homo sapiens
gtgtaatgttgtcagcatcatc

SEQ ID NO: 8495920 - DNA, 22 bp, Homo sapiens
gtgtaattatataaagatctac

SEQ ID NO: 8495921 - DNA, 22 bp, Homo sapiens
gtgtaattatataaagatctac

SEQ ID NO: 8495922 - DNA, 22 bp, Homo sapiens
gtgtaaaaacatactatttcta

SEQ ID NO: 8495923 - DNA, 22 bp, Homo sapiens
gtgtaaaaacatactatttcta

SEQ ID NO: 8495924 - DNA, 22 bp, Homo sapiens
gtggttttgccattacaagtaa

SEQ ID NO: 8495925 - DNA, 22 bp, Homo sapiens
gtggttttctccaacccagaac

SEQ ID NO: 8495926 - DNA, 21 bp, Homo sapiens
gtgtaaacggactcatgcagt

SEQ ID NO: 8495927 - DNA, 18 bp, Homo sapiens
gtgtaaacagccattgag

SEQ ID NO: 8495928 - DNA, 22 bp, Homo sapiens
gtgtaacttttattcatgctct

SEQ ID NO: 8495929 - DNA, 22 bp, Homo sapiens
gtgtaacttttattcatgctct

SEQ ID NO: 8495930 - DNA, 17 bp, Homo sapiens
gtgtaactatgagccat

SEQ ID NO: 8495931 - DNA, 22 bp, Homo sapiens
gtgtaacttgctggaaaaacta

SEQ ID NO: 8495932 - DNA, 22 bp, Homo sapiens
gtgggtgatgtactggaggcca

SEQ ID NO: 8495933 - DNA, 22 bp, Homo sapiens
gtgggtgcggggagccgaggcg

SEQ ID NO: 8495934 - DNA, 22 bp, Homo sapiens
gtgggtggagactgggtgcaag

SEQ ID NO: 8495935 - DNA, 22 bp, Homo sapiens
gtgggtggagactgggtgcaag

SEQ ID NO: 8495936 - DNA, 22 bp, Homo sapiens
gtgggtggagactgggtgcaag

SEQ ID NO: 8495937 - DNA, 22 bp, Homo sapiens
gtgggtggaggcgtcgagggca

SEQ ID NO: 8495938 - DNA, 22 bp, Homo sapiens
gtgggtggaggcgtcgagggca

SEQ ID NO: 8495939 - DNA, 22 bp, Homo sapiens
gtgggtggagactgggtgcaag

SEQ ID NO: 8495940 - DNA, 22 bp, Homo sapiens
gtggtcaggcagtgggagagaa

SEQ ID NO: 8495941 - DNA, 22 bp, Homo sapiens
gtggtcagccccggtgagccct

SEQ ID NO: 8495942 - DNA, 22 bp, Homo sapiens
gtggtcagcagcagtgggagtg

SEQ ID NO: 8495943 - DNA, 22 bp, Homo sapiens
gtggtcagggagcagagccatg

SEQ ID NO: 8495944 - DNA, 22 bp, Homo sapiens
gtggtcaggcagtgggagagaa

SEQ ID NO: 8495945 - DNA, 22 bp, Homo sapiens
gtggtcaggggctgaggtgccc

SEQ ID NO: 8495946 - DNA, 22 bp, Homo sapiens
gtggtcagggagcagagccatg

SEQ ID NO: 8495947 - DNA, 22 bp, Homo sapiens
gtggtcagtggtacagtttgaa

SEQ ID NO: 8495948 - DNA, 22 bp, Homo sapiens
gtggtcaggggctgtggctatg

SEQ ID NO: 8495949 - DNA, 22 bp, Homo sapiens
gtggtcaggttatcagatcata

SEQ ID NO: 8495950 - DNA, 22 bp, Homo sapiens
gtgggtggaggcgtcgagggca

SEQ ID NO: 8495951 - DNA, 22 bp, Homo sapiens
gtggtcagaaatctcagtggca

SEQ ID NO: 8495952 - DNA, 22 bp, Homo sapiens
gtggtcagaaatctcagtggca

SEQ ID NO: 8495953 - DNA, 22 bp, Homo sapiens
gtggtcagaatggagcccagga

SEQ ID NO: 8495954 - DNA, 22 bp, Homo sapiens
gtggtcagaatggagcccagga

SEQ ID NO: 8495955 - DNA, 22 bp, Homo sapiens
gtggtcagagatgacagtgggt

SEQ ID NO: 8495956 - DNA, 22 bp, Homo sapiens
gtggtcagaatggagcccagga

SEQ ID NO: 8495957 - DNA, 22 bp, Homo sapiens
gtggtcagcagcagtgggagtg

SEQ ID NO: 8495958 - DNA, 22 bp, Homo sapiens
gtggtcagagatgacagtgggt

SEQ ID NO: 8495959 - DNA, 22 bp, Homo sapiens
gtggggtgcagcagtactgtgt

SEQ ID NO: 8495960 - DNA, 22 bp, Homo sapiens
gtggggtgggctgagttaggcc

SEQ ID NO: 8495961 - DNA, 22 bp, Homo sapiens
gtggggtgggctgagttaggcc

SEQ ID NO: 8495962 - DNA, 18 bp, Homo sapiens
gtggggtgttgtgaggat

SEQ ID NO: 8495963 - DNA, 22 bp, Homo sapiens
gtggggtgtccagcagcgagct

SEQ ID NO: 8495964 - DNA, 18 bp, Homo sapiens
gtggggtgttgtgaggat

SEQ ID NO: 8495965 - DNA, 18 bp, Homo sapiens
gtggggtgttgtgaggat

SEQ ID NO: 8495966 - DNA, 22 bp, Homo sapiens
gtggggtgtccagcagcgagct

SEQ ID NO: 8495967 - DNA, 22 bp, Homo sapiens
gtggggggacgttggtcacttt

SEQ ID NO: 8495968 - DNA, 22 bp, Homo sapiens
gtggggggacgttggtcacttt

SEQ ID NO: 8495969 - DNA, 22 bp, Homo sapiens
gtggggggagctgcaagctgga

SEQ ID NO: 8495970 - DNA, 22 bp, Homo sapiens
gtggggggagctgcaagctgga

SEQ ID NO: 8495971 - DNA, 22 bp, Homo sapiens
gtgggggtggaaaggcaagttg

SEQ ID NO: 8495972 - DNA, 22 bp, Homo sapiens
gtgggggtggaaaggcaagttg

SEQ ID NO: 8495973 - DNA, 22 bp, Homo sapiens
gtgggggtggaaaggcaagttg

SEQ ID NO: 8495974 - DNA, 22 bp, Homo sapiens
gtggggtagatctttctcagga

SEQ ID NO: 8495975 - DNA, 22 bp, Homo sapiens
gtggggtagatctttctcagga

SEQ ID NO: 8495976 - DNA, 22 bp, Homo sapiens
gtgggggtttcattaagacaat

SEQ ID NO: 8495977 - DNA, 22 bp, Homo sapiens
gttcaagaccagcctggccaac

SEQ ID NO: 8495978 - DNA, 22 bp, Homo sapiens
gttcaagaccagcctggccaac

SEQ ID NO: 8495979 - DNA, 22 bp, Homo sapiens
gttcaaattttggctgtactgc

SEQ ID NO: 8495980 - DNA, 22 bp, Homo sapiens
gttcaaccccttgatggtacag

SEQ ID NO: 8495981 - DNA, 22 bp, Homo sapiens
gttcaaccatgattaggaactg

SEQ ID NO: 8495982 - DNA, 21 bp, Homo sapiens
gttcaaatgggtagattcaca

SEQ ID NO: 8495983 - DNA, 21 bp, Homo sapiens
gttcaaatgggtagattcaca

SEQ ID NO: 8495984 - DNA, 22 bp, Homo sapiens
gttcaaattgagatggtataaa

SEQ ID NO: 8495985 - DNA, 22 bp, Homo sapiens
gttcaaattctatgaaatatgt

SEQ ID NO: 8495986 - DNA, 22 bp, Homo sapiens
gttcaaatggctgcagttacca

SEQ ID NO: 8495987 - DNA, 22 bp, Homo sapiens
gttcaaatggctgcagttacca

SEQ ID NO: 8495988 - DNA, 22 bp, Homo sapiens
gttcaaatctcaggacttcaga

SEQ ID NO: 8495989 - DNA, 22 bp, Homo sapiens
gttcaaatctcaggacttcaga

SEQ ID NO: 8495990 - DNA, 21 bp, Homo sapiens
gttcaaatcctgacactacac

SEQ ID NO: 8495991 - DNA, 22 bp, Homo sapiens
gttctaatattttaaaagccaa

SEQ ID NO: 8495992 - DNA, 22 bp, Homo sapiens
gttctaatttggggctccttag

SEQ ID NO: 8495993 - DNA, 22 bp, Homo sapiens
gttctactttctgtgtctttga

SEQ ID NO: 8495994 - DNA, 18 bp, Homo sapiens
gttcaaggtcaagagaga

SEQ ID NO: 8495995 - DNA, 22 bp, Homo sapiens
gttctaataggagaaaagacag

SEQ ID NO: 8495996 - DNA, 22 bp, Homo sapiens
gttcgcatcttgatcatggact

SEQ ID NO: 8495997 - DNA, 22 bp, Homo sapiens
gttattttaacttctcagtaat

SEQ ID NO: 8495998 - DNA, 22 bp, Homo sapiens
gttattttaacttctcagtaat

SEQ ID NO: 8495999 - DNA, 22 bp, Homo sapiens
gtgtgtcctcagtagtggcatg

SEQ ID NO: 8496000 - DNA, 22 bp, Homo sapiens
gtgtgtcctcagtagtggcatg

SEQ ID NO: 8496001 - DNA, 21 bp, Homo sapiens
gttattttaagtgagctttgc

SEQ ID NO: 8496002 - DNA, 21 bp, Homo sapiens
gttattttaagtgagctttgc

SEQ ID NO: 8496003 - DNA, 22 bp, Homo sapiens
gttattttaacttctcagtaat

SEQ ID NO: 8496004 - DNA, 22 bp, Homo sapiens
gttattttaacttctcagtaat

SEQ ID NO: 8496005 - DNA, 22 bp, Homo sapiens
gtgtgtcctcagtagtggcatg

SEQ ID NO: 8496006 - DNA, 22 bp, Homo sapiens
gtgtgtccaggcgggagtcaag

SEQ ID NO: 8496007 - DNA, 22 bp, Homo sapiens
gtgtgtcaggtactgtgctagg

SEQ ID NO: 8496008 - DNA, 19 bp, Homo sapiens
gttcaaacactgattcagc

SEQ ID NO: 8496009 - DNA, 19 bp, Homo sapiens
gttcaaacactgattcagc

SEQ ID NO: 8496010 - DNA, 22 bp, Homo sapiens
gttcaaagctcctggtacagta

SEQ ID NO: 8496011 - DNA, 22 bp, Homo sapiens
gttattttcattggctcagact

SEQ ID NO: 8496012 - DNA, 22 bp, Homo sapiens
gttattttcattggctcagact

SEQ ID NO: 8496013 - DNA, 22 bp, Homo sapiens
gttattttcattggctcagact

SEQ ID NO: 8496014 - DNA, 22 bp, Homo sapiens
gttattttcattggctcagact

SEQ ID NO: 8496015 - DNA, 22 bp, Homo sapiens
gttattttcattggctcagact

SEQ ID NO: 8496016 - DNA, 21 bp, Homo sapiens
gttattttaagtgagctttgc

SEQ ID NO: 8496017 - DNA, 21 bp, Homo sapiens
gttattttaagtgagctttgc

SEQ ID NO: 8496018 - DNA, 21 bp, Homo sapiens
gttattttaagtgagctttgc

SEQ ID NO: 8496019 - DNA, 22 bp, Homo sapiens
gttattttatctctgagaggtt

SEQ ID NO: 8496020 - DNA, 22 bp, Homo sapiens
gttattttatctctgagaggtt

SEQ ID NO: 8496021 - DNA, 22 bp, Homo sapiens
gttattttatctctgagaggtt

SEQ ID NO: 8496022 - DNA, 22 bp, Homo sapiens
gttattttatctctgagaggtt

SEQ ID NO: 8496023 - DNA, 22 bp, Homo sapiens
gttattttatctctgagaggtt

SEQ ID NO: 8496024 - DNA, 22 bp, Homo sapiens
gttattttcattggctcagact

SEQ ID NO: 8496025 - DNA, 22 bp, Homo sapiens
gttattttatctctgagaggtt

SEQ ID NO: 8496026 - DNA, 22 bp, Homo sapiens
gttgtgattgtagctaaactag

SEQ ID NO: 8496027 - DNA, 21 bp, Homo sapiens
gttgtggttggggctgcagct

SEQ ID NO: 8496028 - DNA, 22 bp, Homo sapiens
gttgtgaatagtgccgcaataa

SEQ ID NO: 8496029 - DNA, 22 bp, Homo sapiens
gttgtgaatagtgccgcaataa

SEQ ID NO: 8496030 - DNA, 22 bp, Homo sapiens
gttgtcttagtcagaaatatgc

SEQ ID NO: 8496031 - DNA, 22 bp, Homo sapiens
gttgtttgtaatgacaggagac

SEQ ID NO: 8496032 - DNA, 22 bp, Homo sapiens
gttgtattcttcaatatcagag

SEQ ID NO: 8496033 - DNA, 22 bp, Homo sapiens
gttgtatatgtagagaatggtc

SEQ ID NO: 8496034 - DNA, 22 bp, Homo sapiens
gttgtatagagggcatgaatct

SEQ ID NO: 8496035 - DNA, 22 bp, Homo sapiens
gttgtacatatgaggataagtt

SEQ ID NO: 8496036 - DNA, 22 bp, Homo sapiens
gttctgagtcctcctttgaagg

SEQ ID NO: 8496037 - DNA, 22 bp, Homo sapiens
gttctgagtcctcctttgaagg

SEQ ID NO: 8496038 - DNA, 22 bp, Homo sapiens
gttctgagtcctcctttgaagg

SEQ ID NO: 8496039 - DNA, 22 bp, Homo sapiens
gttctgcctgtggcttctgtgg

SEQ ID NO: 8496040 - DNA, 22 bp, Homo sapiens
gttgtacaggcagggaaactga

SEQ ID NO: 8496041 - DNA, 22 bp, Homo sapiens
gttgtacagcattccatatagg

SEQ ID NO: 8496042 - DNA, 22 bp, Homo sapiens
gttctccaggggctgttcatct

SEQ ID NO: 8496043 - DNA, 22 bp, Homo sapiens
gttctccactgcagagtctctc

SEQ ID NO: 8496044 - DNA, 22 bp, Homo sapiens
gttctcatagtggaaaataggt

SEQ ID NO: 8496045 - DNA, 22 bp, Homo sapiens
gttctcagtggggagcagggtt

SEQ ID NO: 8496046 - DNA, 22 bp, Homo sapiens
gttctcagttcaggaaggacat

SEQ ID NO: 8496047 - DNA, 22 bp, Homo sapiens
gttctcagggataacttccccc

SEQ ID NO: 8496048 - DNA, 20 bp, Homo sapiens
gttctcactgatctgcaggg

SEQ ID NO: 8496049 - DNA, 22 bp, Homo sapiens
gttctattccccttatctgtga

SEQ ID NO: 8496050 - DNA, 22 bp, Homo sapiens
gttctattctccagttacatat

SEQ ID NO: 8496051 - DNA, 22 bp, Homo sapiens
gttctattctccagttacatat

SEQ ID NO: 8496052 - DNA, 22 bp, Homo sapiens
gttctctggagtccctgggccc

SEQ ID NO: 8496053 - DNA, 22 bp, Homo sapiens
gttctctctgcttccaagatgg

SEQ ID NO: 8496054 - DNA, 22 bp, Homo sapiens
gttctgagtcctcctttgaagg

SEQ ID NO: 8496055 - DNA, 22 bp, Homo sapiens
gttctctcagcgatagtgatgg

SEQ ID NO: 8496056 - DNA, 22 bp, Homo sapiens
gttctctctcttgcctgggtgg

SEQ ID NO: 8496057 - DNA, 22 bp, Homo sapiens
gttctctcagcgatagtgatgg

SEQ ID NO: 8496058 - DNA, 22 bp, Homo sapiens
gttctctctgcttccaagatgg

SEQ ID NO: 8496059 - DNA, 22 bp, Homo sapiens
gttctctctcttgcctgggtgg

SEQ ID NO: 8496060 - DNA, 22 bp, Homo sapiens
gttctctcaaactttgtgtttg

SEQ ID NO: 8496061 - DNA, 22 bp, Homo sapiens
gttctctcaaactttgtgtttg

SEQ ID NO: 8496062 - DNA, 16 bp, Homo sapiens
gttctctcactgtacc

SEQ ID NO: 8496063 - DNA, 22 bp, Homo sapiens
gttctctcagcctttgttatta

SEQ ID NO: 8496064 - DNA, 22 bp, Homo sapiens
gttctctcagcctttgttatta

SEQ ID NO: 8496065 - DNA, 22 bp, Homo sapiens
gtgtcctgatcaattgagctgg

SEQ ID NO: 8496066 - DNA, 22 bp, Homo sapiens
gtgtcctgagtgaggcctggcc

SEQ ID NO: 8496067 - DNA, 22 bp, Homo sapiens
gtgtcccaggcctctggaatta

SEQ ID NO: 8496068 - DNA, 22 bp, Homo sapiens
gtgtcccagcagcacattggct

SEQ ID NO: 8496069 - DNA, 22 bp, Homo sapiens
gtgtcccagccccacaggcctg

SEQ ID NO: 8496070 - DNA, 22 bp, Homo sapiens
gtgtcccaggagaggagacaat

SEQ ID NO: 8496071 - DNA, 22 bp, Homo sapiens
gtgtcctgggcattaggcttag

SEQ ID NO: 8496072 - DNA, 22 bp, Homo sapiens
gtgtcctgggctggtagagctg

SEQ ID NO: 8496073 - DNA, 18 bp, Homo sapiens
gtgtcctggctgcggcgc

SEQ ID NO: 8496074 - DNA, 22 bp, Homo sapiens
gtgtcctgcattggctctgccc

SEQ ID NO: 8496075 - DNA, 22 bp, Homo sapiens
gtgtcctgggggacttcaggtt

SEQ ID NO: 8496076 - DNA, 22 bp, Homo sapiens
gtgtcctgtttccctgtctata

SEQ ID NO: 8496077 - DNA, 22 bp, Homo sapiens
gtgtcctttccgggcctggagg

SEQ ID NO: 8496078 - DNA, 22 bp, Homo sapiens
gtgtcgtgcttgccatgggtac

SEQ ID NO: 8496079 - DNA, 22 bp, Homo sapiens
gtgtccttttgagggtccacag

SEQ ID NO: 8496080 - DNA, 22 bp, Homo sapiens
gtgtcgtgcttgccatgggtac

SEQ ID NO: 8496081 - DNA, 22 bp, Homo sapiens
gtgtgagcatcaaagcctgtca

SEQ ID NO: 8496082 - DNA, 22 bp, Homo sapiens
gtgtgagccatgatgtgtccag

SEQ ID NO: 8496083 - DNA, 22 bp, Homo sapiens
gtgtgagccatgatgtgtccag

SEQ ID NO: 8496084 - DNA, 19 bp, Homo sapiens
gtgtccatggagcatggag

SEQ ID NO: 8496085 - DNA, 22 bp, Homo sapiens
gtgtcccaaagattagaaatca

SEQ ID NO: 8496086 - DNA, 22 bp, Homo sapiens
gtgtcccaatctacttttccct

SEQ ID NO: 8496087 - DNA, 22 bp, Homo sapiens
gtgtcccaatgttcaggacggc

SEQ ID NO: 8496088 - DNA, 22 bp, Homo sapiens
gtgtcccactctggaggtgaag

SEQ ID NO: 8496089 - DNA, 22 bp, Homo sapiens
gtgtccagagaaactcacagct

SEQ ID NO: 8496090 - DNA, 22 bp, Homo sapiens
gtgtccagagaactgtgggagc

SEQ ID NO: 8496091 - DNA, 22 bp, Homo sapiens
gtgtccagggccgtgttgtctt

SEQ ID NO: 8496092 - DNA, 22 bp, Homo sapiens
gtgtccacggctgagaatgatt

SEQ ID NO: 8496093 - DNA, 22 bp, Homo sapiens
gtgtccagagaaactcacagct

SEQ ID NO: 8496094 - DNA, 22 bp, Homo sapiens
gtgtccacggctgagaatgatt

SEQ ID NO: 8496095 - DNA, 22 bp, Homo sapiens
gtgtcatgcacactcagtgttg

SEQ ID NO: 8496096 - DNA, 22 bp, Homo sapiens
gtgtcatgcacactcagtgttg

SEQ ID NO: 8496097 - DNA, 22 bp, Homo sapiens
gtgtcacatggtttactgcagc

SEQ ID NO: 8496098 - DNA, 22 bp, Homo sapiens
gtgtcagaaacaggaaggggaa

SEQ ID NO: 8496099 - DNA, 22 bp, Homo sapiens
gtgtcagaaacaggaaggggaa

SEQ ID NO: 8496100 - DNA, 22 bp, Homo sapiens
gtgtcagatgtccagggcagca

SEQ ID NO: 8496101 - DNA, 22 bp, Homo sapiens
gtgtggtcgaagttctcccgga

SEQ ID NO: 8496102 - DNA, 22 bp, Homo sapiens
gtgtggggtcttctcttggcct

SEQ ID NO: 8496103 - DNA, 22 bp, Homo sapiens
gtgtggggtcttctcttggcct

SEQ ID NO: 8496104 - DNA, 22 bp, Homo sapiens
gtgtgggtgggacatcatcttt

SEQ ID NO: 8496105 - DNA, 22 bp, Homo sapiens
gtgtgggtgtactgttctagat

SEQ ID NO: 8496106 - DNA, 22 bp, Homo sapiens
gtgtggggtcttctcttggcct

SEQ ID NO: 8496107 - DNA, 22 bp, Homo sapiens
gtgtgggggcagctctgatatg

SEQ ID NO: 8496108 - DNA, 22 bp, Homo sapiens
gtgtgggggcagctctgatatg

SEQ ID NO: 8496109 - DNA, 22 bp, Homo sapiens
gtgtggggctcagtgggaatgt

SEQ ID NO: 8496110 - DNA, 22 bp, Homo sapiens
gtgtggggctcagtgggaatgt

SEQ ID NO: 8496111 - DNA, 22 bp, Homo sapiens
gtgtggggctcagtgggaatgt

SEQ ID NO: 8496112 - DNA, 22 bp, Homo sapiens
gtgtgtcagagctcagagaagt

SEQ ID NO: 8496113 - DNA, 22 bp, Homo sapiens
gtgtgtcaggtactgtgctagg

SEQ ID NO: 8496114 - DNA, 22 bp, Homo sapiens
gtgtgtatgtagaactatgtat

SEQ ID NO: 8496115 - DNA, 22 bp, Homo sapiens
gtgtgtattattgcatacacat

SEQ ID NO: 8496116 - DNA, 22 bp, Homo sapiens
gtgtgtatttaaaggatagttg

SEQ ID NO: 8496117 - DNA, 22 bp, Homo sapiens
gtgtgtcagagctcagagaagt

SEQ ID NO: 8496118 - DNA, 22 bp, Homo sapiens
gtgtgtaatgcttattgtgctt

SEQ ID NO: 8496119 - DNA, 22 bp, Homo sapiens
gtgtggtggccctccttcaggc

SEQ ID NO: 8496120 - DNA, 22 bp, Homo sapiens
gtgtgtatgtagaactatgtat

SEQ ID NO: 8496121 - DNA, 22 bp, Homo sapiens
gtgtgtacaaatttcatgtaaa

SEQ ID NO: 8496122 - DNA, 22 bp, Homo sapiens
gtgtgggacgggtgagtggcca

SEQ ID NO: 8496123 - DNA, 22 bp, Homo sapiens
gtgtgggctatgtgcgtgggca

SEQ ID NO: 8496124 - DNA, 22 bp, Homo sapiens
gtgtgggcagggccgtgctccc

SEQ ID NO: 8496125 - DNA, 22 bp, Homo sapiens
gtgtgggctatgtgcgtgggca

SEQ ID NO: 8496126 - DNA, 22 bp, Homo sapiens
gtgtggggaggagagagccctt

SEQ ID NO: 8496127 - DNA, 22 bp, Homo sapiens
gtgtggggccaggatcagggct

SEQ ID NO: 8496128 - DNA, 22 bp, Homo sapiens
gtgtggggccaggatcagggct

SEQ ID NO: 8496129 - DNA, 22 bp, Homo sapiens
gtgtggggagctgcagccacat

SEQ ID NO: 8496130 - DNA, 22 bp, Homo sapiens
gtgtggggagctgcagccacat

SEQ ID NO: 8496131 - DNA, 22 bp, Homo sapiens
gtgtggggaggagagagccctt

SEQ ID NO: 8496132 - DNA, 22 bp, Homo sapiens
gtgtgataacagggcatgacgg

SEQ ID NO: 8496133 - DNA, 22 bp, Homo sapiens
gtgtgagtgaaagtagtttgat

SEQ ID NO: 8496134 - DNA, 21 bp, Homo sapiens
gtgtgagtagcatgtgtctca

SEQ ID NO: 8496135 - DNA, 22 bp, Homo sapiens
gtgtgagtgaaagtagtttgat

SEQ ID NO: 8496136 - DNA, 21 bp, Homo sapiens
gtgtgagtagcatgtgtctca

SEQ ID NO: 8496137 - DNA, 21 bp, Homo sapiens
gtgtgagtagcatgtgtctca

SEQ ID NO: 8496138 - DNA, 22 bp, Homo sapiens
gtgtgagggacagagaaagggg

SEQ ID NO: 8496139 - DNA, 21 bp, Homo sapiens
gtgtgagtagcatgtgtctca

SEQ ID NO: 8496140 - DNA, 22 bp, Homo sapiens
gtgtgcagaagacacaagacat

SEQ ID NO: 8496141 - DNA, 22 bp, Homo sapiens
gtgtgcagaagacacaagacat

SEQ ID NO: 8496142 - DNA, 22 bp, Homo sapiens
gtgtgcagaagacacaagacat

SEQ ID NO: 8496143 - DNA, 22 bp, Homo sapiens
gtgtgcagaacagggagtgggt

SEQ ID NO: 8496144 - DNA, 22 bp, Homo sapiens
gtgtgcagcagagacaggactc

SEQ ID NO: 8496145 - DNA, 22 bp, Homo sapiens
gtgtgcagcagagacaggactc

SEQ ID NO: 8496146 - DNA, 22 bp, Homo sapiens
gtgtgcagaggcaggaggtgct

SEQ ID NO: 8496147 - DNA, 23 bp, Homo sapiens
gtgtgcaggattatttgcagaca

SEQ ID NO: 8496148 - DNA, 22 bp, Homo sapiens
gtgtgcaggccacaggccaggg

SEQ ID NO: 8496149 - DNA, 22 bp, Homo sapiens
gtgtgcaggcttgaggattagg

SEQ ID NO: 8496150 - DNA, 22 bp, Homo sapiens
gtgtgcaggcttgaggattagg

SEQ ID NO: 8496151 - DNA, 22 bp, Homo sapiens
gtgtgcaggccacaggccaggg

SEQ ID NO: 8496152 - DNA, 22 bp, Homo sapiens
gtgtgcagggctgcctgtgccg

SEQ ID NO: 8496153 - DNA, 22 bp, Homo sapiens
gtgtgcagggatgagtgcaggt

SEQ ID NO: 8496154 - DNA, 22 bp, Homo sapiens
gtgtgcagggggccagcgcagc

SEQ ID NO: 8496155 - DNA, 22 bp, Homo sapiens
gtgtgcagtagagaaagagcag

SEQ ID NO: 8496156 - DNA, 22 bp, Homo sapiens
gtgtgcaggtgtcagtgcagct

SEQ ID NO: 8496157 - DNA, 22 bp, Homo sapiens
gtgtgcagggggccagcgcagc

SEQ ID NO: 8496158 - DNA, 21 bp, Homo sapiens
tctgagaacttctgctgcagc

SEQ ID NO: 8496159 - DNA, 22 bp, Homo sapiens
tctgagaactccgggttagatc

SEQ ID NO: 8496160 - DNA, 22 bp, Homo sapiens
tctgagaactccgggttagatc

SEQ ID NO: 8496161 - DNA, 22 bp, Homo sapiens
tctgagaacatgctttgatcat

SEQ ID NO: 8496162 - DNA, 22 bp, Homo sapiens
tctgagaacatgctttgatcat

SEQ ID NO: 8496163 - DNA, 20 bp, Homo sapiens
tctgagaagcaaacaatgtt

SEQ ID NO: 8496164 - DNA, 17 bp, Homo sapiens
tctgagaacttgaagca

SEQ ID NO: 8496165 - DNA, 22 bp, Homo sapiens
tctgagaaatcagtggtgaata

SEQ ID NO: 8496166 - DNA, 22 bp, Homo sapiens
tctgagaaatcagtggtgaata

SEQ ID NO: 8496167 - DNA, 17 bp, Homo sapiens
tctgagaaaggagaatc

SEQ ID NO: 8496168 - DNA, 22 bp, Homo sapiens
tctgacttggtgctaccagcca

SEQ ID NO: 8496169 - DNA, 22 bp, Homo sapiens
tctgactttggacagtggcgaa

SEQ ID NO: 8496170 - DNA, 22 bp, Homo sapiens
tctgacttttctcactgttgtg

SEQ ID NO: 8496171 - DNA, 22 bp, Homo sapiens
tctgacttttctcactgttgtg

SEQ ID NO: 8496172 - DNA, 22 bp, Homo sapiens
tctgagaagcgggagcctgtga

SEQ ID NO: 8496173 - DNA, 22 bp, Homo sapiens
tctgagaagcgtgtctctgttt

SEQ ID NO: 8496174 - DNA, 22 bp, Homo sapiens
tctgagaagcgtgtctctgttt

SEQ ID NO: 8496175 - DNA, 22 bp, Homo sapiens
tctgagaagctagaggacaaag

SEQ ID NO: 8496176 - DNA, 22 bp, Homo sapiens
tctgagaagctagaggacaaag

SEQ ID NO: 8496177 - DNA, 22 bp, Homo sapiens
tctgagaaggtgcatcagctgc

SEQ ID NO: 8496178 - DNA, 23 bp, Homo sapiens
tctgagaaggtttcagccagact

SEQ ID NO: 8496179 - DNA, 22 bp, Homo sapiens
tctgagaatgagtgttttctta

SEQ ID NO: 8496180 - DNA, 22 bp, Homo sapiens
tctgagaatggagctaaaaatc

SEQ ID NO: 8496181 - DNA, 22 bp, Homo sapiens
tctgagaatggagctaaaaatc

SEQ ID NO: 8496182 - DNA, 22 bp, Homo sapiens
tctgacattagattaattggaa

SEQ ID NO: 8496183 - DNA, 22 bp, Homo sapiens
tctgacagggccaaacatgaca

SEQ ID NO: 8496184 - DNA, 22 bp, Homo sapiens
tctgacaggttgggatatggaa

SEQ ID NO: 8496185 - DNA, 22 bp, Homo sapiens
tctgacagtcacagtggaggat

SEQ ID NO: 8496186 - DNA, 22 bp, Homo sapiens
tctgacaagtcaagtcttgact

SEQ ID NO: 8496187 - DNA, 22 bp, Homo sapiens
tctgacaagtcaagtcttgact

SEQ ID NO: 8496188 - DNA, 22 bp, Homo sapiens
tctgacaataactgagtttaac

SEQ ID NO: 8496189 - DNA, 21 bp, Homo sapiens
tctgacaatctcatttcaaac

SEQ ID NO: 8496190 - DNA, 22 bp, Homo sapiens
tctgacaatgaacaatctatag

SEQ ID NO: 8496191 - DNA, 22 bp, Homo sapiens
tctgacaatgaacaatctatag

SEQ ID NO: 8496192 - DNA, 22 bp, Homo sapiens
tctgacaatgaacaatctatag

SEQ ID NO: 8496193 - DNA, 19 bp, Homo sapiens
tctgacacttacacacccc

SEQ ID NO: 8496194 - DNA, 22 bp, Homo sapiens
tctgacaattagcctagtcctg

SEQ ID NO: 8496195 - DNA, 22 bp, Homo sapiens
tctgacattttgagaatgacat

SEQ ID NO: 8496196 - DNA, 22 bp, Homo sapiens
tctgaccacagacaacctgcta

SEQ ID NO: 8496197 - DNA, 22 bp, Homo sapiens
tctgacctgcaggcacagcaat

SEQ ID NO: 8496198 - DNA, 22 bp, Homo sapiens
tctgacttcctccacatctgtt

SEQ ID NO: 8496199 - DNA, 22 bp, Homo sapiens
tctgacttgcatcttaaaggag

SEQ ID NO: 8496200 - DNA, 22 bp, Homo sapiens
tctgagccagggtctcctccct

SEQ ID NO: 8496201 - DNA, 22 bp, Homo sapiens
tctgagccataagagtacagga

SEQ ID NO: 8496202 - DNA, 22 bp, Homo sapiens
tctgagccagacaagacagcca

SEQ ID NO: 8496203 - DNA, 22 bp, Homo sapiens
tctgagccagacaagacagcca

SEQ ID NO: 8496204 - DNA, 22 bp, Homo sapiens
tctgagccacctgagcccatgg

SEQ ID NO: 8496205 - DNA, 22 bp, Homo sapiens
tctgagcatatgcagcacctgg

SEQ ID NO: 8496206 - DNA, 22 bp, Homo sapiens
tctgagcattgaattttcttcc

SEQ ID NO: 8496207 - DNA, 22 bp, Homo sapiens
tctgagcattgaattttcttcc

SEQ ID NO: 8496208 - DNA, 22 bp, Homo sapiens
tctgagccaatttctgtgtcca

SEQ ID NO: 8496209 - DNA, 22 bp, Homo sapiens
tctgagccaaaataaacagcat

SEQ ID NO: 8496210 - DNA, 22 bp, Homo sapiens
tctgagcacaattacttacatc

SEQ ID NO: 8496211 - DNA, 22 bp, Homo sapiens
tctgagcagagcatcatttcag

SEQ ID NO: 8496212 - DNA, 22 bp, Homo sapiens
tctgagcaccttatattcttga

SEQ ID NO: 8496213 - DNA, 22 bp, Homo sapiens
tctgagcacatcacacagctca

SEQ ID NO: 8496214 - DNA, 22 bp, Homo sapiens
tctgagcagagcatcatttcag

SEQ ID NO: 8496215 - DNA, 22 bp, Homo sapiens
tctgagcagctttgttttgtgt

SEQ ID NO: 8496216 - DNA, 22 bp, Homo sapiens
tctgagaatggtggatgtggtg

SEQ ID NO: 8496217 - DNA, 22 bp, Homo sapiens
tctgagctacgatgcctgtcac

SEQ ID NO: 8496218 - DNA, 22 bp, Homo sapiens
tctgagctacgatgcctgtcac

SEQ ID NO: 8496219 - DNA, 22 bp, Homo sapiens
tctgagctaatcctgttgccga

SEQ ID NO: 8496220 - DNA, 22 bp, Homo sapiens
tctgagccgtatggcttggcta

SEQ ID NO: 8496221 - DNA, 22 bp, Homo sapiens
tctgagccctcttttgcagccc

SEQ ID NO: 8496222 - DNA, 19 bp, Homo sapiens
tctgagctgatatgacatt

SEQ ID NO: 8496223 - DNA, 21 bp, Homo sapiens
tctgagctgagtcctctaggt

SEQ ID NO: 8496224 - DNA, 22 bp, Homo sapiens
tctgagctgcccctttactttg

SEQ ID NO: 8496225 - DNA, 22 bp, Homo sapiens
tctgagctatgtaagacttgga

SEQ ID NO: 8496226 - DNA, 22 bp, Homo sapiens
tctgagctccatgcaggaggct

SEQ ID NO: 8496227 - DNA, 22 bp, Homo sapiens
tctgagctcaagtgacagttag

SEQ ID NO: 8496228 - DNA, 22 bp, Homo sapiens
tctgagctctatctgtgggaat

SEQ ID NO: 8496229 - DNA, 22 bp, Homo sapiens
tctgagctgggggcctggcatg

SEQ ID NO: 8496230 - DNA, 22 bp, Homo sapiens
tctgagctgggtcttgacagct

SEQ ID NO: 8496231 - DNA, 22 bp, Homo sapiens
tctgagctgggcacagaaggcg

SEQ ID NO: 8496232 - DNA, 22 bp, Homo sapiens
tctgagctgggcacagaaggcg

SEQ ID NO: 8496233 - DNA, 22 bp, Homo sapiens
tctgagctgggcacagaaggcg

SEQ ID NO: 8496234 - DNA, 22 bp, Homo sapiens
tctgagctggagcccatcacct

SEQ ID NO: 8496235 - DNA, 22 bp, Homo sapiens
tctgagctggagcccatcacct

SEQ ID NO: 8496236 - DNA, 22 bp, Homo sapiens
tctgagctggagcccatcacct

SEQ ID NO: 8496237 - DNA, 22 bp, Homo sapiens
tctgagctgtggccattcttcc

SEQ ID NO: 8496238 - DNA, 23 bp, Homo sapiens
tctgagctgtcttttcagcagaa

SEQ ID NO: 8496239 - DNA, 23 bp, Homo sapiens
tctgagctgtcttttcagcagaa

SEQ ID NO: 8496240 - DNA, 23 bp, Homo sapiens
tctgagctgtcttttcagcagaa

SEQ ID NO: 8496241 - DNA, 23 bp, Homo sapiens
tctgagctgtcttttcagcagaa

SEQ ID NO: 8496242 - DNA, 22 bp, Homo sapiens
tctgaggtgtagctgggcttca

SEQ ID NO: 8496243 - DNA, 22 bp, Homo sapiens
tctgaggtggggctggagcatt

SEQ ID NO: 8496244 - DNA, 22 bp, Homo sapiens
tctgaggtggacgatggagcct

SEQ ID NO: 8496245 - DNA, 23 bp, Homo sapiens
tctgaggtggctcttgctttgaa

SEQ ID NO: 8496246 - DNA, 17 bp, Homo sapiens
tctgaggtgaggatgca

SEQ ID NO: 8496247 - DNA, 19 bp, Homo sapiens
tctgaggtggaactggggg

SEQ ID NO: 8496248 - DNA, 18 bp, Homo sapiens
tctgaggtggacgaggag

SEQ ID NO: 8496249 - DNA, 22 bp, Homo sapiens
tctgaggtcattccaaggacat

SEQ ID NO: 8496250 - DNA, 22 bp, Homo sapiens
tctgaggtcataaagcaacttt

SEQ ID NO: 8496251 - DNA, 22 bp, Homo sapiens
tctgaggtcagtgctgcagtta

SEQ ID NO: 8496252 - DNA, 22 bp, Homo sapiens
tctgaggtcctactataagtgg

SEQ ID NO: 8496253 - DNA, 23 bp, Homo sapiens
tctgaggtccaccagtttgcaga

SEQ ID NO: 8496254 - DNA, 22 bp, Homo sapiens
tctgaggtctcatgacttgcat

SEQ ID NO: 8496255 - DNA, 22 bp, Homo sapiens
tctgaggtctatgactttgctt

SEQ ID NO: 8496256 - DNA, 22 bp, Homo sapiens
tctgaggtcctgtgatttctct

SEQ ID NO: 8496257 - DNA, 22 bp, Homo sapiens
tctgaggttaatcctgctgcat

SEQ ID NO: 8496258 - DNA, 22 bp, Homo sapiens
tctgaggtgtcacaaggccagg

SEQ ID NO: 8496259 - DNA, 22 bp, Homo sapiens
tctgaggttactgctttgtaga

SEQ ID NO: 8496260 - DNA, 22 bp, Homo sapiens
tctgaggttattgtctgccatt

SEQ ID NO: 8496261 - DNA, 22 bp, Homo sapiens
tctgatgcaatgtaagtcttgg

SEQ ID NO: 8496262 - DNA, 21 bp, Homo sapiens
tctgatggtagatgagatgtg

SEQ ID NO: 8496263 - DNA, 21 bp, Homo sapiens
tctgatggtagatgagatgtg

SEQ ID NO: 8496264 - DNA, 21 bp, Homo sapiens
tctgatggtagatgagatgtg

SEQ ID NO: 8496265 - DNA, 21 bp, Homo sapiens
tctgatggtagatgagatgtg

SEQ ID NO: 8496266 - DNA, 21 bp, Homo sapiens
tctgatggtagatgagatgtg

SEQ ID NO: 8496267 - DNA, 21 bp, Homo sapiens
tctgatggtagatgagatgtg

SEQ ID NO: 8496268 - DNA, 21 bp, Homo sapiens
tctgatggtagatgagatgtg

SEQ ID NO: 8496269 - DNA, 21 bp, Homo sapiens
tctgatggtagatgagatgtg

SEQ ID NO: 8496270 - DNA, 21 bp, Homo sapiens
tctgatggtagatgagatgtg

SEQ ID NO: 8496271 - DNA, 22 bp, Homo sapiens
tctgattagagcattcttgagt

SEQ ID NO: 8496272 - DNA, 22 bp, Homo sapiens
tctgatgttgtgacatcacttc

SEQ ID NO: 8496273 - DNA, 22 bp, Homo sapiens
tctgattcattcatgtgcacca

SEQ ID NO: 8496274 - DNA, 22 bp, Homo sapiens
tctgatgtggcagctgcatcta

SEQ ID NO: 8496275 - DNA, 22 bp, Homo sapiens
tctgatgtctgaaatgctcttg

SEQ ID NO: 8496276 - DNA, 21 bp, Homo sapiens
tctgatgtgtttaatggtggg

SEQ ID NO: 8496277 - DNA, 23 bp, Homo sapiens
tctgatgttctcttatgctgtag

SEQ ID NO: 8496278 - DNA, 23 bp, Homo sapiens
tctgatgttctcttatgctgtag

SEQ ID NO: 8496279 - DNA, 22 bp, Homo sapiens
tctgatgttgatgcttctgcct

SEQ ID NO: 8496280 - DNA, 22 bp, Homo sapiens
tctgcaacattcctctccccac

SEQ ID NO: 8496281 - DNA, 22 bp, Homo sapiens
tctgcaacgcactgcaaaacct

SEQ ID NO: 8496282 - DNA, 22 bp, Homo sapiens
tctgcaacattcctctccccac

SEQ ID NO: 8496283 - DNA, 22 bp, Homo sapiens
tctgcaagcgtcacatgattct

SEQ ID NO: 8496284 - DNA, 22 bp, Homo sapiens
tctgcaaacttaagttgaaata

SEQ ID NO: 8496285 - DNA, 22 bp, Homo sapiens
tctgcaaactggctcttactgc

SEQ ID NO: 8496286 - DNA, 20 bp, Homo sapiens
tctgcaaacaagttttagac

SEQ ID NO: 8496287 - DNA, 22 bp, Homo sapiens
tctgcaaacccccatctatcat

SEQ ID NO: 8496288 - DNA, 22 bp, Homo sapiens
tctgcaacagtgccctgtaaat

SEQ ID NO: 8496289 - DNA, 22 bp, Homo sapiens
tctgcaaatattagcttagaca

SEQ ID NO: 8496290 - DNA, 22 bp, Homo sapiens
tctgaggaattctgcagtgaga

SEQ ID NO: 8496291 - DNA, 18 bp, Homo sapiens
tctgaggaatggaagagc

SEQ ID NO: 8496292 - DNA, 22 bp, Homo sapiens
tctgaggaataagaaggaagtg

SEQ ID NO: 8496293 - DNA, 22 bp, Homo sapiens
tctgaggaatcttgacacattt

SEQ ID NO: 8496294 - DNA, 22 bp, Homo sapiens
tctgaggaattctgcagtgaga

SEQ ID NO: 8496295 - DNA, 22 bp, Homo sapiens
tctgaggccctaccctgagcct

SEQ ID NO: 8496296 - DNA, 22 bp, Homo sapiens
tctgagctttcttgtgctcaag

SEQ ID NO: 8496297 - DNA, 22 bp, Homo sapiens
tctgagcttttattatcaacct

SEQ ID NO: 8496298 - DNA, 22 bp, Homo sapiens
tctgaggaaagagagtgggatg

SEQ ID NO: 8496299 - DNA, 22 bp, Homo sapiens
tctgaggaagcagcaggaagtg

SEQ ID NO: 8496300 - DNA, 22 bp, Homo sapiens
tctgaggaaaagaggaggtagc

SEQ ID NO: 8496301 - DNA, 22 bp, Homo sapiens
tctgaggccttgggacagaagt

SEQ ID NO: 8496302 - DNA, 22 bp, Homo sapiens
tctgaggccttcagcatgaatc

SEQ ID NO: 8496303 - DNA, 22 bp, Homo sapiens
tctgaggctaagagacagaggc

SEQ ID NO: 8496304 - DNA, 22 bp, Homo sapiens
tctgaggctaagagacagaggc

SEQ ID NO: 8496305 - DNA, 22 bp, Homo sapiens
tctgaggccctgcaggcagtgt

SEQ ID NO: 8496306 - DNA, 22 bp, Homo sapiens
tctgaggcctgaagcagcagag

SEQ ID NO: 8496307 - DNA, 19 bp, Homo sapiens
tctgagggtccagatgcat

SEQ ID NO: 8496308 - DNA, 22 bp, Homo sapiens
tctgagggcttgaggggaagta

SEQ ID NO: 8496309 - DNA, 22 bp, Homo sapiens
tctgagggttgtagagagggac

SEQ ID NO: 8496310 - DNA, 22 bp, Homo sapiens
tctgaggtaccagctggtttat

SEQ ID NO: 8496311 - DNA, 20 bp, Homo sapiens
tctgaggtatgatagggtct

SEQ ID NO: 8496312 - DNA, 22 bp, Homo sapiens
tctgaggtcacagatttcaaga

SEQ ID NO: 8496313 - DNA, 23 bp, Homo sapiens
tctgagggagtgggcagtggcac

SEQ ID NO: 8496314 - DNA, 22 bp, Homo sapiens
tctgagggaatagctattgtag

SEQ ID NO: 8496315 - DNA, 19 bp, Homo sapiens
tctgaggcttctccccttg

SEQ ID NO: 8496316 - DNA, 22 bp, Homo sapiens
tctgaggctgcatctatgtgac

SEQ ID NO: 8496317 - DNA, 22 bp, Homo sapiens
tctgaggcttcagactgtactg

SEQ ID NO: 8496318 - DNA, 22 bp, Homo sapiens
tctgaggcttcagactgtactg

SEQ ID NO: 8496319 - DNA, 22 bp, Homo sapiens
tctgaggctgtctctgggctcc

SEQ ID NO: 8496320 - DNA, 22 bp, Homo sapiens
tctgaggctatgttcaggctaa

SEQ ID NO: 8496321 - DNA, 20 bp, Homo sapiens
tctgaggctgagctctactt

SEQ ID NO: 8496322 - DNA, 22 bp, Homo sapiens
tctgaggctgcatctatgtgac

SEQ ID NO: 8496323 - DNA, 22 bp, Homo sapiens
tctgccatgctaacttcagtat

SEQ ID NO: 8496324 - DNA, 22 bp, Homo sapiens
tctgccatcttaattctctttt

SEQ ID NO: 8496325 - DNA, 22 bp, Homo sapiens
tctgccagtttatagacaagcc

SEQ ID NO: 8496326 - DNA, 22 bp, Homo sapiens
tctgccagtttatagacaagcc

SEQ ID NO: 8496327 - DNA, 22 bp, Homo sapiens
tctgccatcaagatgctctggc

SEQ ID NO: 8496328 - DNA, 23 bp, Homo sapiens
tctgccagtgtgtgccaggagcc

SEQ ID NO: 8496329 - DNA, 23 bp, Homo sapiens
tctgccagtgtgtgccaggagcc

SEQ ID NO: 8496330 - DNA, 23 bp, Homo sapiens
tctgccagtgtgtgccaggagcc

SEQ ID NO: 8496331 - DNA, 22 bp, Homo sapiens
tctgccaggtggggagaggcca

SEQ ID NO: 8496332 - DNA, 22 bp, Homo sapiens
tctgccaggtggggagaggcca

SEQ ID NO: 8496333 - DNA, 22 bp, Homo sapiens
tctgccaggcctgcttccgggg

SEQ ID NO: 8496334 - DNA, 22 bp, Homo sapiens
tctgccacatgagggcacagca

SEQ ID NO: 8496335 - DNA, 22 bp, Homo sapiens
tctgcaggtcacgctccagcct

SEQ ID NO: 8496336 - DNA, 22 bp, Homo sapiens
tctgcaggtgggcccctagaat

SEQ ID NO: 8496337 - DNA, 22 bp, Homo sapiens
tctgcatgatgaacaaatgagc

SEQ ID NO: 8496338 - DNA, 22 bp, Homo sapiens
tctgcatatttatcatgagtct

SEQ ID NO: 8496339 - DNA, 22 bp, Homo sapiens
tctgcatcatttttcagagccg

SEQ ID NO: 8496340 - DNA, 22 bp, Homo sapiens
tctgcatggagaggagatgcta

SEQ ID NO: 8496341 - DNA, 22 bp, Homo sapiens
tctgcatttttaacaagatccc

SEQ ID NO: 8496342 - DNA, 21 bp, Homo sapiens
tctgcattttagcaagatctc

SEQ ID NO: 8496343 - DNA, 22 bp, Homo sapiens
tctgcatttggatcttgagctg

SEQ ID NO: 8496344 - DNA, 22 bp, Homo sapiens
tctgcacatgtagtaaatatta

SEQ ID NO: 8496345 - DNA, 22 bp, Homo sapiens
tctgcacatggcgctggtcctg

SEQ ID NO: 8496346 - DNA, 22 bp, Homo sapiens
tctgcacataggtaggctggaa

SEQ ID NO: 8496347 - DNA, 22 bp, Homo sapiens
tctgcacacaatttatctttct

SEQ ID NO: 8496348 - DNA, 22 bp, Homo sapiens
tctgcaagggcacagccaaccc

SEQ ID NO: 8496349 - DNA, 22 bp, Homo sapiens
tctgcagaaactgtgactatgt

SEQ ID NO: 8496350 - DNA, 22 bp, Homo sapiens
tctgcagaaagtggctcagtgg

SEQ ID NO: 8496351 - DNA, 22 bp, Homo sapiens
tctgcagaagaattaaggacag

SEQ ID NO: 8496352 - DNA, 22 bp, Homo sapiens
tctgcagaactttatgagcaaa

SEQ ID NO: 8496353 - DNA, 22 bp, Homo sapiens
tctgcagcaacctttcacctcc

SEQ ID NO: 8496354 - DNA, 22 bp, Homo sapiens
tctgcaggactgaggcctgttt

SEQ ID NO: 8496355 - DNA, 22 bp, Homo sapiens
tctgcaggaaaaaagtgcctgg

SEQ ID NO: 8496356 - DNA, 22 bp, Homo sapiens
tctgcagctttttggtggggtg

SEQ ID NO: 8496357 - DNA, 22 bp, Homo sapiens
tctgcagcttgcacaggcaggc

SEQ ID NO: 8496358 - DNA, 22 bp, Homo sapiens
tctgcagcgtgcaggctggtgc

SEQ ID NO: 8496359 - DNA, 22 bp, Homo sapiens
tctgcagcttcttgccagagag

SEQ ID NO: 8496360 - DNA, 22 bp, Homo sapiens
tctgcagcttcttgccagagag

SEQ ID NO: 8496361 - DNA, 22 bp, Homo sapiens
tctgcaggcctcgacaaggcca

SEQ ID NO: 8496362 - DNA, 22 bp, Homo sapiens
tctgcaggagagtgccctagag

SEQ ID NO: 8496363 - DNA, 22 bp, Homo sapiens
tctgcaggatcagagccagagg

SEQ ID NO: 8496364 - DNA, 22 bp, Homo sapiens
tctgcaggaggctggctgcagg

SEQ ID NO: 8496365 - DNA, 22 bp, Homo sapiens
tctgcctgcggctgcaggtggc

SEQ ID NO: 8496366 - DNA, 22 bp, Homo sapiens
tctgcctgcggctgcaggtggc

SEQ ID NO: 8496367 - DNA, 22 bp, Homo sapiens
tctgcctgcggctgcaggtggc

SEQ ID NO: 8496368 - DNA, 22 bp, Homo sapiens
tctgcctgcggctgcaggtggc

SEQ ID NO: 8496369 - DNA, 22 bp, Homo sapiens
tctgcctgcgctcacggggccg

SEQ ID NO: 8496370 - DNA, 22 bp, Homo sapiens
tctgcctgctaactcctgcacc

SEQ ID NO: 8496371 - DNA, 22 bp, Homo sapiens
tctgcctgctaactcctgcacc

SEQ ID NO: 8496372 - DNA, 22 bp, Homo sapiens
tctgcctgctaactcctgcacc

SEQ ID NO: 8496373 - DNA, 22 bp, Homo sapiens
tctgcctggagagttcttctct

SEQ ID NO: 8496374 - DNA, 22 bp, Homo sapiens
tctgcctggatgatggcagggc

SEQ ID NO: 8496375 - DNA, 22 bp, Homo sapiens
tctgcctggatgatggcagggc

SEQ ID NO: 8496376 - DNA, 22 bp, Homo sapiens
tctgcctgcttcttcatagtct

SEQ ID NO: 8496377 - DNA, 22 bp, Homo sapiens
tctgcctggattccattctcca

SEQ ID NO: 8496378 - DNA, 22 bp, Homo sapiens
tctgcctggattccattctcca

SEQ ID NO: 8496379 - DNA, 22 bp, Homo sapiens
tctgcctggattccattctcca

SEQ ID NO: 8496380 - DNA, 22 bp, Homo sapiens
tctgcctggatgatggcagggc

SEQ ID NO: 8496381 - DNA, 22 bp, Homo sapiens
tctgcctggcctggagggcaca

SEQ ID NO: 8496382 - DNA, 22 bp, Homo sapiens
tctgcctggcctggagggcaca

SEQ ID NO: 8496383 - DNA, 22 bp, Homo sapiens
tctgcctggcctggagggcaca

SEQ ID NO: 8496384 - DNA, 22 bp, Homo sapiens
tctgcctggattttggaaagct

SEQ ID NO: 8496385 - DNA, 22 bp, Homo sapiens
tctgcctggattttggaaagct

SEQ ID NO: 8496386 - DNA, 22 bp, Homo sapiens
tctgcctgggtgtggagcagag

SEQ ID NO: 8496387 - DNA, 22 bp, Homo sapiens
tctgcctgggtgtggagcagag

SEQ ID NO: 8496388 - DNA, 22 bp, Homo sapiens
tctgcctgtacctcttttttgc

SEQ ID NO: 8496389 - DNA, 22 bp, Homo sapiens
tctgcctggctcatggcagtga

SEQ ID NO: 8496390 - DNA, 22 bp, Homo sapiens
tctgcctggctcatggcagtga

SEQ ID NO: 8496391 - DNA, 22 bp, Homo sapiens
tctgcctggctcatggcagtga

SEQ ID NO: 8496392 - DNA, 22 bp, Homo sapiens
tctgcctggctcatggcagtga

SEQ ID NO: 8496393 - DNA, 22 bp, Homo sapiens
tctgcctgtggatacatgctct

SEQ ID NO: 8496394 - DNA, 22 bp, Homo sapiens
tctgcctgtggatacatgctct

SEQ ID NO: 8496395 - DNA, 22 bp, Homo sapiens
tctgcctgtggtggaggaagtt

SEQ ID NO: 8496396 - DNA, 22 bp, Homo sapiens
tctgcctgtgctgtgttttcat

SEQ ID NO: 8496397 - DNA, 22 bp, Homo sapiens
tctgcctgtggtggaggaagtt

SEQ ID NO: 8496398 - DNA, 22 bp, Homo sapiens
tctgcctgttcaagtcttctag

SEQ ID NO: 8496399 - DNA, 22 bp, Homo sapiens
tctgcctgttcaagtcttctag

SEQ ID NO: 8496400 - DNA, 22 bp, Homo sapiens
tctgcctgttcaagtcttctag

SEQ ID NO: 8496401 - DNA, 22 bp, Homo sapiens
tctgcctgttcaagtcttctag

SEQ ID NO: 8496402 - DNA, 22 bp, Homo sapiens
tctgcctgttgctagaatgtca

SEQ ID NO: 8496403 - DNA, 22 bp, Homo sapiens
tctgcctgttgctagaatgtca

SEQ ID NO: 8496404 - DNA, 22 bp, Homo sapiens
tctgcctgttgagcctaaggcc

SEQ ID NO: 8496405 - DNA, 22 bp, Homo sapiens
tctgcctgttcccgattccatg

SEQ ID NO: 8496406 - DNA, 22 bp, Homo sapiens
tctgcctgttgagcctaaggcc

SEQ ID NO: 8496407 - DNA, 22 bp, Homo sapiens
tctgcctgttgagcctaaggcc

SEQ ID NO: 8496408 - DNA, 22 bp, Homo sapiens
tctgctcaggttacctagctag

SEQ ID NO: 8496409 - DNA, 22 bp, Homo sapiens
tctgctcagtgcttatctctaa

SEQ ID NO: 8496410 - DNA, 22 bp, Homo sapiens
tctgctcaggttacctagctag

SEQ ID NO: 8496411 - DNA, 20 bp, Homo sapiens
tctgctcagccctcagtggc

SEQ ID NO: 8496412 - DNA, 22 bp, Homo sapiens
tctgctcagccgatctgctccg

SEQ ID NO: 8496413 - DNA, 22 bp, Homo sapiens
tctgcctgcagtgtggcagggc

SEQ ID NO: 8496414 - DNA, 22 bp, Homo sapiens
tctgcctgcagtgtggcagggc

SEQ ID NO: 8496415 - DNA, 22 bp, Homo sapiens
tctgcctgcagtgtggcagggc

SEQ ID NO: 8496416 - DNA, 22 bp, Homo sapiens
tctgcctgccagtctggtcctc

SEQ ID NO: 8496417 - DNA, 22 bp, Homo sapiens
tctgcctgccagtctggtcctc

SEQ ID NO: 8496418 - DNA, 22 bp, Homo sapiens
tctgcctgccagtctggtcctc

SEQ ID NO: 8496419 - DNA, 22 bp, Homo sapiens
tctgcctgccgagaacacctac

SEQ ID NO: 8496420 - DNA, 22 bp, Homo sapiens
tctgcctgagggagctgaggaa

SEQ ID NO: 8496421 - DNA, 18 bp, Homo sapiens
tctgcctgcagggcatct

SEQ ID NO: 8496422 - DNA, 18 bp, Homo sapiens
tctgcctgcagggcatct

SEQ ID NO: 8496423 - DNA, 22 bp, Homo sapiens
tctgcctgagggagctgaggaa

SEQ ID NO: 8496424 - DNA, 22 bp, Homo sapiens
tctgcctgagggagctgaggaa

SEQ ID NO: 8496425 - DNA, 22 bp, Homo sapiens
tctgcctgagggagctgaggaa

SEQ ID NO: 8496426 - DNA, 22 bp, Homo sapiens
tctgcctgagggagctgaggaa

SEQ ID NO: 8496427 - DNA, 22 bp, Homo sapiens
tctgcctgaggactgacaccag

SEQ ID NO: 8496428 - DNA, 22 bp, Homo sapiens
tctgcccttggctctcttgttg

SEQ ID NO: 8496429 - DNA, 22 bp, Homo sapiens
tctgcctgagcagagggaggcc

SEQ ID NO: 8496430 - DNA, 22 bp, Homo sapiens
tctgcctgagcagagggaggcc

SEQ ID NO: 8496431 - DNA, 22 bp, Homo sapiens
tctgcctgagcagagggaggcc

SEQ ID NO: 8496432 - DNA, 22 bp, Homo sapiens
tctgcctgagaagtggggtgcc

SEQ ID NO: 8496433 - DNA, 21 bp, Homo sapiens
tctgcctgagactttgctggt

SEQ ID NO: 8496434 - DNA, 22 bp, Homo sapiens
tctgccctgccattcactggaa

SEQ ID NO: 8496435 - DNA, 22 bp, Homo sapiens
tctgccctgcagggagcagtaa

SEQ ID NO: 8496436 - DNA, 22 bp, Homo sapiens
tctgccctggggtcagcctcca

SEQ ID NO: 8496437 - DNA, 22 bp, Homo sapiens
tctgccctggggtcagcctcca

SEQ ID NO: 8496438 - DNA, 22 bp, Homo sapiens
tctgccctggggtcagcctcca

SEQ ID NO: 8496439 - DNA, 22 bp, Homo sapiens
tctgcccacagtccaatagttg

SEQ ID NO: 8496440 - DNA, 22 bp, Homo sapiens
tctgcccactgctctgctgccc

SEQ ID NO: 8496441 - DNA, 22 bp, Homo sapiens
tctgccctcagggtaatgatca

SEQ ID NO: 8496442 - DNA, 22 bp, Homo sapiens
tctgcccctgctgggcacagag

SEQ ID NO: 8496443 - DNA, 22 bp, Homo sapiens
tctgcccattcttagagtctag

SEQ ID NO: 8496444 - DNA, 18 bp, Homo sapiens
tctgccccagccgcactg

SEQ ID NO: 8496445 - DNA, 18 bp, Homo sapiens
tctgccccagccgcactg

SEQ ID NO: 8496446 - DNA, 21 bp, Homo sapiens
tctgccctccaggagctcata

SEQ ID NO: 8496447 - DNA, 21 bp, Homo sapiens
tctgccctccaggagctcata

SEQ ID NO: 8496448 - DNA, 21 bp, Homo sapiens
tctgccctccaggagctcata

SEQ ID NO: 8496449 - DNA, 22 bp, Homo sapiens
tctgccctcattgctgcctgga

SEQ ID NO: 8496450 - DNA, 22 bp, Homo sapiens
tctgccctcattgctgcctgga

SEQ ID NO: 8496451 - DNA, 22 bp, Homo sapiens
tctggctgacatcctgtatgag

SEQ ID NO: 8496452 - DNA, 22 bp, Homo sapiens
tctggctgacatcctgtatgag

SEQ ID NO: 8496453 - DNA, 22 bp, Homo sapiens
tctggctgacatcctgtatgag

SEQ ID NO: 8496454 - DNA, 22 bp, Homo sapiens
tctggctgctgcgtgagtgctt

SEQ ID NO: 8496455 - DNA, 22 bp, Homo sapiens
tctggctgctgcgtgagtgctt

SEQ ID NO: 8496456 - DNA, 22 bp, Homo sapiens
tctggctggcagtgatggtgtg

SEQ ID NO: 8496457 - DNA, 22 bp, Homo sapiens
tctggctgtgtaaggtagcacc

SEQ ID NO: 8496458 - DNA, 22 bp, Homo sapiens
tctggctgtgtaatatgtgtag

SEQ ID NO: 8496459 - DNA, 21 bp, Homo sapiens
tctggctttcattccccttct

SEQ ID NO: 8496460 - DNA, 22 bp, Homo sapiens
tctggctttctcagcatggcat

SEQ ID NO: 8496461 - DNA, 22 bp, Homo sapiens
tctggctttcctggagcaagaa

SEQ ID NO: 8496462 - DNA, 22 bp, Homo sapiens
tctggctttcctggagcaagaa

SEQ ID NO: 8496463 - DNA, 22 bp, Homo sapiens
tctggctttcatttgtttaaag

SEQ ID NO: 8496464 - DNA, 22 bp, Homo sapiens
tctggctttcatttgtttaaag

SEQ ID NO: 8496465 - DNA, 22 bp, Homo sapiens
tctgggaagcaaatatgtaaga

SEQ ID NO: 8496466 - DNA, 22 bp, Homo sapiens
tctgggaaggctctgcagatat

SEQ ID NO: 8496467 - DNA, 22 bp, Homo sapiens
tctgggaacgaaggctaatatg

SEQ ID NO: 8496468 - DNA, 22 bp, Homo sapiens
tctgggaactatatctggtggt

SEQ ID NO: 8496469 - DNA, 22 bp, Homo sapiens
tctgggaaagtaaatgtaaagg

SEQ ID NO: 8496470 - DNA, 22 bp, Homo sapiens
tctggcttttattcagttggca

SEQ ID NO: 8496471 - DNA, 22 bp, Homo sapiens
tctggcttttattcagttggca

SEQ ID NO: 8496472 - DNA, 23 bp, Homo sapiens
tctggctttgctggaagttttga

SEQ ID NO: 8496473 - DNA, 22 bp, Homo sapiens
tctgggaacatggcttggaatc

SEQ ID NO: 8496474 - DNA, 22 bp, Homo sapiens
tctgggaacagcctggctgtgt

SEQ ID NO: 8496475 - DNA, 22 bp, Homo sapiens
tctgggaacactttgtgagctc

SEQ ID NO: 8496476 - DNA, 22 bp, Homo sapiens
tctgggaacacacgtcacttca

SEQ ID NO: 8496477 - DNA, 21 bp, Homo sapiens
tctgggaaattgggaaagaag

SEQ ID NO: 8496478 - DNA, 22 bp, Homo sapiens
tctgggaaatggctacttgtca

SEQ ID NO: 8496479 - DNA, 22 bp, Homo sapiens
tctggctctaactaggcatcag

SEQ ID NO: 8496480 - DNA, 22 bp, Homo sapiens
tctggctcggatttgtctagca

SEQ ID NO: 8496481 - DNA, 22 bp, Homo sapiens
tctggctcctggctccactgcc

SEQ ID NO: 8496482 - DNA, 19 bp, Homo sapiens
tctggctcctgccaggctg

SEQ ID NO: 8496483 - DNA, 22 bp, Homo sapiens
tctggctcctgagtccatgctc

SEQ ID NO: 8496484 - DNA, 22 bp, Homo sapiens
tctggctctcaacaaatattta

SEQ ID NO: 8496485 - DNA, 22 bp, Homo sapiens
tctggctctccagtgctcttag

SEQ ID NO: 8496486 - DNA, 22 bp, Homo sapiens
tctggctctcatactcgccagt

SEQ ID NO: 8496487 - DNA, 22 bp, Homo sapiens
tctggctctcatactcgccagt

SEQ ID NO: 8496488 - DNA, 22 bp, Homo sapiens
tctggctctataactcctagct

SEQ ID NO: 8496489 - DNA, 23 bp, Homo sapiens
tctggctctatgtgacagctctc

SEQ ID NO: 8496490 - DNA, 22 bp, Homo sapiens
tctggctctataactcctagct

SEQ ID NO: 8496491 - DNA, 22 bp, Homo sapiens
tctggctctataactcctagct

SEQ ID NO: 8496492 - DNA, 22 bp, Homo sapiens
tctggctgaagcttttgcagct

SEQ ID NO: 8496493 - DNA, 22 bp, Homo sapiens
tctggctgaaaggggctgtgcc

SEQ ID NO: 8496494 - DNA, 20 bp, Homo sapiens
tctggctctttgctcctccc

SEQ ID NO: 8496495 - DNA, 22 bp, Homo sapiens
tctggctctgacactactgtta

SEQ ID NO: 8496496 - DNA, 22 bp, Homo sapiens
tctggctctgaattcacttctg

SEQ ID NO: 8496497 - DNA, 22 bp, Homo sapiens
tctggctctccagtgctcttag

SEQ ID NO: 8496498 - DNA, 22 bp, Homo sapiens
tctggctctctcatcacccaat

SEQ ID NO: 8496499 - DNA, 20 bp, Homo sapiens
tctggctctttgctcctccc

SEQ ID NO: 8496500 - DNA, 22 bp, Homo sapiens
tctggctctgtgtcctcaccca

SEQ ID NO: 8496501 - DNA, 22 bp, Homo sapiens
tctggctctgtgtcctcaccca

SEQ ID NO: 8496502 - DNA, 22 bp, Homo sapiens
tctggctctggagtccacctgc

SEQ ID NO: 8496503 - DNA, 22 bp, Homo sapiens
tctggctccactttcttcattt

SEQ ID NO: 8496504 - DNA, 22 bp, Homo sapiens
tctggctccacacctcactgca

SEQ ID NO: 8496505 - DNA, 21 bp, Homo sapiens
tctggccctcacagtcacacc

SEQ ID NO: 8496506 - DNA, 22 bp, Homo sapiens
tctggctccacacctcactgca

SEQ ID NO: 8496507 - DNA, 22 bp, Homo sapiens
tctggctccacacctcactgca

SEQ ID NO: 8496508 - DNA, 21 bp, Homo sapiens
tctggccctcacagtcacacc

SEQ ID NO: 8496509 - DNA, 22 bp, Homo sapiens
tctggccctatggcatgtacct

SEQ ID NO: 8496510 - DNA, 22 bp, Homo sapiens
tctggctccgtgtccgctccca

SEQ ID NO: 8496511 - DNA, 22 bp, Homo sapiens
tctggctccgtgtccgctccca

SEQ ID NO: 8496512 - DNA, 19 bp, Homo sapiens
tctggctccgcctcttagt

SEQ ID NO: 8496513 - DNA, 22 bp, Homo sapiens
tctggctcctgagtccatgctc

SEQ ID NO: 8496514 - DNA, 22 bp, Homo sapiens
tctggctcctgagtccatgctc

SEQ ID NO: 8496515 - DNA, 22 bp, Homo sapiens
tctggctcccagcctgctctca

SEQ ID NO: 8496516 - DNA, 22 bp, Homo sapiens
tctggctcccagcctgctctca

SEQ ID NO: 8496517 - DNA, 22 bp, Homo sapiens
tctggctccctggagctccaca

SEQ ID NO: 8496518 - DNA, 22 bp, Homo sapiens
tctggccccggtcttcacagct

SEQ ID NO: 8496519 - DNA, 22 bp, Homo sapiens
tctggccccggtcttcacagct

SEQ ID NO: 8496520 - DNA, 22 bp, Homo sapiens
tctggcccatgatcctgctaac

SEQ ID NO: 8496521 - DNA, 22 bp, Homo sapiens
tctggcccatgatcctgctaac

SEQ ID NO: 8496522 - DNA, 22 bp, Homo sapiens
tctggcccatgatcctgctaac

SEQ ID NO: 8496523 - DNA, 22 bp, Homo sapiens
tctggccctatggcatgtacct

SEQ ID NO: 8496524 - DNA, 20 bp, Homo sapiens
tctggccccttcctgtcctg

SEQ ID NO: 8496525 - DNA, 22 bp, Homo sapiens
tctggcccctggtctctggtgt

SEQ ID NO: 8496526 - DNA, 22 bp, Homo sapiens
tctggcccctggcagtcctgga

SEQ ID NO: 8496527 - DNA, 22 bp, Homo sapiens
tctggcccctggcagtcctgga

SEQ ID NO: 8496528 - DNA, 22 bp, Homo sapiens
tctgggcagtacccctctccta

SEQ ID NO: 8496529 - DNA, 22 bp, Homo sapiens
tctgggcagttcggatcctctg

SEQ ID NO: 8496530 - DNA, 23 bp, Homo sapiens
tctgggcatatctagtcacatcg

SEQ ID NO: 8496531 - DNA, 22 bp, Homo sapiens
tctgggcagcctcaggccaggg

SEQ ID NO: 8496532 - DNA, 20 bp, Homo sapiens
tctgggcagggcacatggaa

SEQ ID NO: 8496533 - DNA, 22 bp, Homo sapiens
tctgggcagcagcagctagtag

SEQ ID NO: 8496534 - DNA, 21 bp, Homo sapiens
tctgggcagcccagtcctgag

SEQ ID NO: 8496535 - DNA, 22 bp, Homo sapiens
tctgggcagccatgtgcctggc

SEQ ID NO: 8496536 - DNA, 22 bp, Homo sapiens
tctgggcagccatgtgcctggc

SEQ ID NO: 8496537 - DNA, 22 bp, Homo sapiens
tctgggcagcagcagctagtag

SEQ ID NO: 8496538 - DNA, 22 bp, Homo sapiens
tctgggcagaagcagtgcaaag

SEQ ID NO: 8496539 - DNA, 22 bp, Homo sapiens
tctgggcactgctgagcctgta

SEQ ID NO: 8496540 - DNA, 22 bp, Homo sapiens
tctgggcactgctgagcctgta

SEQ ID NO: 8496541 - DNA, 23 bp, Homo sapiens
tctgggcaccttgttgacatgat

SEQ ID NO: 8496542 - DNA, 22 bp, Homo sapiens
tctgggatgagatcagagacac

SEQ ID NO: 8496543 - DNA, 22 bp, Homo sapiens
tctgggatgcaaacagaatctg

SEQ ID NO: 8496544 - DNA, 22 bp, Homo sapiens
tctgggatgaagccagaaactt

SEQ ID NO: 8496545 - DNA, 22 bp, Homo sapiens
tctgggatagggccagaacatg

SEQ ID NO: 8496546 - DNA, 22 bp, Homo sapiens
tctgggataagaccacagattt

SEQ ID NO: 8496547 - DNA, 23 bp, Homo sapiens
tctgggctgagctcgagtgtaga

SEQ ID NO: 8496548 - DNA, 22 bp, Homo sapiens
tctgggctgctatgaggcagag

SEQ ID NO: 8496549 - DNA, 22 bp, Homo sapiens
tctgggccctaaaccagctcta

SEQ ID NO: 8496550 - DNA, 22 bp, Homo sapiens
tctgggccctaaaccagctcta

SEQ ID NO: 8496551 - DNA, 22 bp, Homo sapiens
tctgggccctaaaccagctcta

SEQ ID NO: 8496552 - DNA, 21 bp, Homo sapiens
tctgggcccatgctgcctcac

SEQ ID NO: 8496553 - DNA, 22 bp, Homo sapiens
tctgggctcttagtgtaccctc

SEQ ID NO: 8496554 - DNA, 22 bp, Homo sapiens
tctgggctcttagtgtaccctc

SEQ ID NO: 8496555 - DNA, 21 bp, Homo sapiens
tctgggcccatgctgcctcac

SEQ ID NO: 8496556 - DNA, 22 bp, Homo sapiens
tctgggcccactcaacttcact

SEQ ID NO: 8496557 - DNA, 21 bp, Homo sapiens
tctgggcccatgctgcctcac

SEQ ID NO: 8496558 - DNA, 22 bp, Homo sapiens
tctgggccagatctagggatct

SEQ ID NO: 8496559 - DNA, 23 bp, Homo sapiens
tctgggccacttgtctgcacttc

SEQ ID NO: 8496560 - DNA, 22 bp, Homo sapiens
tctgggccagtgatttttccag

SEQ ID NO: 8496561 - DNA, 22 bp, Homo sapiens
tctgggcccactcaacttcact

SEQ ID NO: 8496562 - DNA, 22 bp, Homo sapiens
tctgggccagtgatttttccag

SEQ ID NO: 8496563 - DNA, 22 bp, Homo sapiens
tctgggccagatctagggatct

SEQ ID NO: 8496564 - DNA, 22 bp, Homo sapiens
tctgggccaacccttccatggg

SEQ ID NO: 8496565 - DNA, 23 bp, Homo sapiens
tctgggccacttgtctgcacttc

SEQ ID NO: 8496566 - DNA, 22 bp, Homo sapiens
tctgggccaacccttccatggg

SEQ ID NO: 8496567 - DNA, 22 bp, Homo sapiens
tctgggaatgaggcttgggcaa

SEQ ID NO: 8496568 - DNA, 23 bp, Homo sapiens
tctgggaattggctgtccacagg

SEQ ID NO: 8496569 - DNA, 22 bp, Homo sapiens
tctgggaatttattggcacttt

SEQ ID NO: 8496570 - DNA, 22 bp, Homo sapiens
tctgggaagtgagatgctgtgt

SEQ ID NO: 8496571 - DNA, 22 bp, Homo sapiens
tctgggaagtcctctgtcatgc

SEQ ID NO: 8496572 - DNA, 22 bp, Homo sapiens
tctgggagaagctgatgtgaag

SEQ ID NO: 8496573 - DNA, 22 bp, Homo sapiens
tctgggagacgtgtgttgtcag

SEQ ID NO: 8496574 - DNA, 22 bp, Homo sapiens
tctgggagagcacgtggctgac

SEQ ID NO: 8496575 - DNA, 22 bp, Homo sapiens
tctgggagagggaaagaagact

SEQ ID NO: 8496576 - DNA, 22 bp, Homo sapiens
tctgggagagctgctgtcagag

SEQ ID NO: 8496577 - DNA, 22 bp, Homo sapiens
tctgggagagctgctgtcagag

SEQ ID NO: 8496578 - DNA, 22 bp, Homo sapiens
tctgggagagctgctgtcagag

SEQ ID NO: 8496579 - DNA, 22 bp, Homo sapiens
tctgggagagctgctgtcagag

SEQ ID NO: 8496580 - DNA, 22 bp, Homo sapiens
tctgggagagcacgtggctgac

SEQ ID NO: 8496581 - DNA, 22 bp, Homo sapiens
tctgggagagggaaagaagact

SEQ ID NO: 8496582 - DNA, 22 bp, Homo sapiens
tctgggagagtcacaggcattg

SEQ ID NO: 8496583 - DNA, 22 bp, Homo sapiens
tctgggaggggctgccattgct

SEQ ID NO: 8496584 - DNA, 22 bp, Homo sapiens
tctgggaggggctgccattgct

SEQ ID NO: 8496585 - DNA, 22 bp, Homo sapiens
tctgggaggggctgccattgct

SEQ ID NO: 8496586 - DNA, 22 bp, Homo sapiens
tctgggaggtaaccatgctgat

SEQ ID NO: 8496587 - DNA, 22 bp, Homo sapiens
tctgggaggtaaccatgctgat

SEQ ID NO: 8496588 - DNA, 22 bp, Homo sapiens
tctgggaggtaaccatgctgat

SEQ ID NO: 8496589 - DNA, 22 bp, Homo sapiens
tctgggaggtaaccatgctgat

SEQ ID NO: 8496590 - DNA, 22 bp, Homo sapiens
tctgggaggtcacattggtctt

SEQ ID NO: 8496591 - DNA, 22 bp, Homo sapiens
tctgggaggtactgggaggtgt

SEQ ID NO: 8496592 - DNA, 22 bp, Homo sapiens
tctgggaggtggcagggtgcat

SEQ ID NO: 8496593 - DNA, 22 bp, Homo sapiens
tctgggaggtgttttgagaact

SEQ ID NO: 8496594 - DNA, 22 bp, Homo sapiens
tctgggaggtgttttgagaact

SEQ ID NO: 8496595 - DNA, 22 bp, Homo sapiens
tctgggagttagaatacatggg

SEQ ID NO: 8496596 - DNA, 22 bp, Homo sapiens
tctggcagggtgtgtatttaca

SEQ ID NO: 8496597 - DNA, 22 bp, Homo sapiens
tctggcaggtcaatcattcttt

SEQ ID NO: 8496598 - DNA, 22 bp, Homo sapiens
tctggcagagtgataggataag

SEQ ID NO: 8496599 - DNA, 22 bp, Homo sapiens
tctggcagtgagcaacttgaca

SEQ ID NO: 8496600 - DNA, 22 bp, Homo sapiens
tctggcagtgaagtcatgaggt

SEQ ID NO: 8496601 - DNA, 20 bp, Homo sapiens
tctggcaggtgaacgagctg

SEQ ID NO: 8496602 - DNA, 20 bp, Homo sapiens
tctggcaggtgaacgagctg

SEQ ID NO: 8496603 - DNA, 22 bp, Homo sapiens
tctggcagagtcagtgcacaca

SEQ ID NO: 8496604 - DNA, 22 bp, Homo sapiens
tctggcagagtcagtgcacaca

SEQ ID NO: 8496605 - DNA, 20 bp, Homo sapiens
tctggcacactgagaagctc

SEQ ID NO: 8496606 - DNA, 22 bp, Homo sapiens
tctggcagttccttgttgatat

SEQ ID NO: 8496607 - DNA, 22 bp, Homo sapiens
tctggcagtgatttctgtgatc

SEQ ID NO: 8496608 - DNA, 22 bp, Homo sapiens
tctggcatctgttttcatattt

SEQ ID NO: 8496609 - DNA, 22 bp, Homo sapiens
tctggcatttcaggcatctata

SEQ ID NO: 8496610 - DNA, 22 bp, Homo sapiens
tctggccaacaaaaactaagtc

SEQ ID NO: 8496611 - DNA, 22 bp, Homo sapiens
tctggccacccgaggcccctgc

SEQ ID NO: 8496612 - DNA, 22 bp, Homo sapiens
tctggccacccgaggcccctgc

SEQ ID NO: 8496613 - DNA, 22 bp, Homo sapiens
tctggccagtgaaatgcagaat

SEQ ID NO: 8496614 - DNA, 22 bp, Homo sapiens
tctggccaggatggcaagacca

SEQ ID NO: 8496615 - DNA, 22 bp, Homo sapiens
tctggcccagcccctgatccca

SEQ ID NO: 8496616 - DNA, 22 bp, Homo sapiens
tctggcccagcccctgaggtca

SEQ ID NO: 8496617 - DNA, 22 bp, Homo sapiens
tctggcccagcccctgaggtca

SEQ ID NO: 8496618 - DNA, 22 bp, Homo sapiens
tctggcccagcccctgaggtca

SEQ ID NO: 8496619 - DNA, 22 bp, Homo sapiens
tctggccatggcaagccgagtg

SEQ ID NO: 8496620 - DNA, 22 bp, Homo sapiens
tctggcccaagttttcggtgag

SEQ ID NO: 8496621 - DNA, 17 bp, Homo sapiens
tctggatgtcatggaag

SEQ ID NO: 8496622 - DNA, 22 bp, Homo sapiens
tctggatggtcagctcttcctg

SEQ ID NO: 8496623 - DNA, 22 bp, Homo sapiens
tctggagtgtttctaattactg

SEQ ID NO: 8496624 - DNA, 22 bp, Homo sapiens
tctggagtggcagtcatctgaa

SEQ ID NO: 8496625 - DNA, 22 bp, Homo sapiens
tctggagcaacagagcaggaca

SEQ ID NO: 8496626 - DNA, 22 bp, Homo sapiens
tctggagatcatgtggggtgga

SEQ ID NO: 8496627 - DNA, 22 bp, Homo sapiens
tctggagccacaaacctcagct

SEQ ID NO: 8496628 - DNA, 22 bp, Homo sapiens
tctggagccacaaacctcagct

SEQ ID NO: 8496629 - DNA, 21 bp, Homo sapiens
tctggagccctaagctgagaa

SEQ ID NO: 8496630 - DNA, 22 bp, Homo sapiens
tctggaggggtttagagggaca

SEQ ID NO: 8496631 - DNA, 22 bp, Homo sapiens
tctggagtctaaagaaccaaaa

SEQ ID NO: 8496632 - DNA, 22 bp, Homo sapiens
tctggagtccagatccatttgg

SEQ ID NO: 8496633 - DNA, 22 bp, Homo sapiens
tctggagtggagctgatcattt

SEQ ID NO: 8496634 - DNA, 22 bp, Homo sapiens
tctggagtggacccagagcact

SEQ ID NO: 8496635 - DNA, 17 bp, Homo sapiens
tctgctctgccaatcca

SEQ ID NO: 8496636 - DNA, 22 bp, Homo sapiens
tctgctctgtactgcactggcc

SEQ ID NO: 8496637 - DNA, 22 bp, Homo sapiens
tctgctctgtggcttcagctaa

SEQ ID NO: 8496638 - DNA, 22 bp, Homo sapiens
tctgctctgtggcttcagctaa

SEQ ID NO: 8496639 - DNA, 22 bp, Homo sapiens
tctgctctgtggcttcagctaa

SEQ ID NO: 8496640 - DNA, 22 bp, Homo sapiens
tctgctctgggccagctattaa

SEQ ID NO: 8496641 - DNA, 22 bp, Homo sapiens
tctgctctagttgcttcctgcc

SEQ ID NO: 8496642 - DNA, 22 bp, Homo sapiens
tctgctctagttgcttcctgcc

SEQ ID NO: 8496643 - DNA, 22 bp, Homo sapiens
tctgctctagttgcttcctgcc

SEQ ID NO: 8496644 - DNA, 22 bp, Homo sapiens
tctgctctagttgcttcctgcc

SEQ ID NO: 8496645 - DNA, 22 bp, Homo sapiens
tctgctctagttgcttcctgcc

SEQ ID NO: 8496646 - DNA, 22 bp, Homo sapiens
tctgctctccatacttccgcac

SEQ ID NO: 8496647 - DNA, 22 bp, Homo sapiens
tctgctctccatacttccgcac

SEQ ID NO: 8496648 - DNA, 22 bp, Homo sapiens
tctgctctccatacttccgcac

SEQ ID NO: 8496649 - DNA, 22 bp, Homo sapiens
tctgctctccatacttccgcac

SEQ ID NO: 8496650 - DNA, 23 bp, Homo sapiens
tctgctctgaagttcggctgagc

SEQ ID NO: 8496651 - DNA, 23 bp, Homo sapiens
tctgctctgaagttcggctgagc

SEQ ID NO: 8496652 - DNA, 22 bp, Homo sapiens
tctgctgcacaaattcatctct

SEQ ID NO: 8496653 - DNA, 22 bp, Homo sapiens
tctgctgcagagctgcgggtgc

SEQ ID NO: 8496654 - DNA, 22 bp, Homo sapiens
tctgctgcagcaggattctctg

SEQ ID NO: 8496655 - DNA, 22 bp, Homo sapiens
tctgctgccaccttgtggtgag

SEQ ID NO: 8496656 - DNA, 22 bp, Homo sapiens
tctgctgcagggaaagactttc

SEQ ID NO: 8496657 - DNA, 22 bp, Homo sapiens
tctgctgcctgcagggcagaga

SEQ ID NO: 8496658 - DNA, 22 bp, Homo sapiens
tctgctgcctcggtgtgggtac

SEQ ID NO: 8496659 - DNA, 22 bp, Homo sapiens
tctgctgccatgcagagcagta

SEQ ID NO: 8496660 - DNA, 22 bp, Homo sapiens
tctgctgctacagactctctag

SEQ ID NO: 8496661 - DNA, 22 bp, Homo sapiens
tctgctgctacagactctctag

SEQ ID NO: 8496662 - DNA, 22 bp, Homo sapiens
tctgctgctacagactctctag

SEQ ID NO: 8496663 - DNA, 22 bp, Homo sapiens
tctgctgaacttgctgcccaga

SEQ ID NO: 8496664 - DNA, 22 bp, Homo sapiens
tctgctgaacttgctgcccaga

SEQ ID NO: 8496665 - DNA, 22 bp, Homo sapiens
tctgctctgtggcttcagctaa

SEQ ID NO: 8496666 - DNA, 22 bp, Homo sapiens
tctgctgaatcagatagctaag

SEQ ID NO: 8496667 - DNA, 22 bp, Homo sapiens
tctgctgacctttctctgacac

SEQ ID NO: 8496668 - DNA, 22 bp, Homo sapiens
tctgctgacatttatgaataga

SEQ ID NO: 8496669 - DNA, 22 bp, Homo sapiens
tctgctgaatggagccaacctc

SEQ ID NO: 8496670 - DNA, 22 bp, Homo sapiens
tctgctgcacaaattcatctct

SEQ ID NO: 8496671 - DNA, 22 bp, Homo sapiens
tctgctgagtcagacctctggg

SEQ ID NO: 8496672 - DNA, 22 bp, Homo sapiens
tctgctgagatgcccatggtta

SEQ ID NO: 8496673 - DNA, 22 bp, Homo sapiens
tctgctgaggccttcccactcc

SEQ ID NO: 8496674 - DNA, 22 bp, Homo sapiens
tctgctgaggtggttttagaga

SEQ ID NO: 8496675 - DNA, 22 bp, Homo sapiens
tctgctggtcaaggctgggtcc

SEQ ID NO: 8496676 - DNA, 22 bp, Homo sapiens
tctgctggtgatgacctcataa

SEQ ID NO: 8496677 - DNA, 22 bp, Homo sapiens
tctgctggttccgaattaggcc

SEQ ID NO: 8496678 - DNA, 22 bp, Homo sapiens
tctgctgtaaagaatttctgcc

SEQ ID NO: 8496679 - DNA, 22 bp, Homo sapiens
tctgctgtaaagaatttctgcc

SEQ ID NO: 8496680 - DNA, 22 bp, Homo sapiens
tctgctgctgcagctacactat

SEQ ID NO: 8496681 - DNA, 22 bp, Homo sapiens
tctgctgctgcagctacactat

SEQ ID NO: 8496682 - DNA, 22 bp, Homo sapiens
tctgctgctgaccaacactgtg

SEQ ID NO: 8496683 - DNA, 22 bp, Homo sapiens
tctgctgctgagcacactccta

SEQ ID NO: 8496684 - DNA, 22 bp, Homo sapiens
tctgctgctgaccaacactgtg

SEQ ID NO: 8496685 - DNA, 22 bp, Homo sapiens
tctgctgctgagcacactccta

SEQ ID NO: 8496686 - DNA, 22 bp, Homo sapiens
tctgctggaaaaccagggaatt

SEQ ID NO: 8496687 - DNA, 18 bp, Homo sapiens
tctgctgctgcgtcctgc

SEQ ID NO: 8496688 - DNA, 22 bp, Homo sapiens
tctgctgttctcatgctgattt

SEQ ID NO: 8496689 - DNA, 22 bp, Homo sapiens
tctgctgtgtccctggtctcct

SEQ ID NO: 8496690 - DNA, 22 bp, Homo sapiens
tctgctgttcattcttttagct

SEQ ID NO: 8496691 - DNA, 22 bp, Homo sapiens
tctgctgttcattcttttagct

SEQ ID NO: 8496692 - DNA, 22 bp, Homo sapiens
tctgctgtgtcccctgtgcggg

SEQ ID NO: 8496693 - DNA, 22 bp, Homo sapiens
tctgctgtgtcccctgtgcggg

SEQ ID NO: 8496694 - DNA, 22 bp, Homo sapiens
tctgctgtgtccctggtctcct

SEQ ID NO: 8496695 - DNA, 22 bp, Homo sapiens
tctgctgtcactcatttgcttc

SEQ ID NO: 8496696 - DNA, 22 bp, Homo sapiens
tctgctgtacttttggtctgtt

SEQ ID NO: 8496697 - DNA, 22 bp, Homo sapiens
tctgctgtattaggttgaactg

SEQ ID NO: 8496698 - DNA, 22 bp, Homo sapiens
tctgctgtctatgcaagtcctt

SEQ ID NO: 8496699 - DNA, 22 bp, Homo sapiens
tctgctgtcttttctgggtgag

SEQ ID NO: 8496700 - DNA, 22 bp, Homo sapiens
tctgctgtgatttgctacctgt

SEQ ID NO: 8496701 - DNA, 22 bp, Homo sapiens
tctgctgtgggtctatatttta

SEQ ID NO: 8496702 - DNA, 22 bp, Homo sapiens
tctgctgtgattctactagtgt

SEQ ID NO: 8496703 - DNA, 22 bp, Homo sapiens
tctgctgtgaaaggtgaatatt

SEQ ID NO: 8496704 - DNA, 22 bp, Homo sapiens
tctggaattctcaagtcctgga

SEQ ID NO: 8496705 - DNA, 22 bp, Homo sapiens
tctggaattgctgtgtgagttc

SEQ ID NO: 8496706 - DNA, 22 bp, Homo sapiens
tctggaattttattgatcaaaa

SEQ ID NO: 8496707 - DNA, 22 bp, Homo sapiens
tctggactaacagcagcctcag

SEQ ID NO: 8496708 - DNA, 22 bp, Homo sapiens
tctggactataggctgccaagt

SEQ ID NO: 8496709 - DNA, 22 bp, Homo sapiens
tctggactccatgctgcctgga

SEQ ID NO: 8496710 - DNA, 20 bp, Homo sapiens
tctggactctaaggtatatt

SEQ ID NO: 8496711 - DNA, 22 bp, Homo sapiens
tctggactaacagcagcctcag

SEQ ID NO: 8496712 - DNA, 23 bp, Homo sapiens
tctggaatcctcccccttggttc

SEQ ID NO: 8496713 - DNA, 22 bp, Homo sapiens
tctggaatcagtggcttaccct

SEQ ID NO: 8496714 - DNA, 22 bp, Homo sapiens
tctggaatgatttccttcccct

SEQ ID NO: 8496715 - DNA, 22 bp, Homo sapiens
tctggaatgaatgaggttctgt

SEQ ID NO: 8496716 - DNA, 22 bp, Homo sapiens
tctggaataggtcctgagtatt

SEQ ID NO: 8496717 - DNA, 22 bp, Homo sapiens
tctggaataggtcctgagtatt

SEQ ID NO: 8496718 - DNA, 22 bp, Homo sapiens
tctggaatcagacctaatccca

SEQ ID NO: 8496719 - DNA, 22 bp, Homo sapiens
tctggaagttagaggaggaaag

SEQ ID NO: 8496720 - DNA, 22 bp, Homo sapiens
tctggaagttagaggaggaaag

SEQ ID NO: 8496721 - DNA, 22 bp, Homo sapiens
tctggaataaccctgcttccaa

SEQ ID NO: 8496722 - DNA, 22 bp, Homo sapiens
tctggagagcagatgcctctgg

SEQ ID NO: 8496723 - DNA, 22 bp, Homo sapiens
tctggagagatcttccacaaca

SEQ ID NO: 8496724 - DNA, 22 bp, Homo sapiens
tctggagacctagccctgttgt

SEQ ID NO: 8496725 - DNA, 22 bp, Homo sapiens
tctggagacctgcatttatatt

SEQ ID NO: 8496726 - DNA, 22 bp, Homo sapiens
tctggagaggggcctagaattt

SEQ ID NO: 8496727 - DNA, 22 bp, Homo sapiens
tctggagaggggcctagaattt

SEQ ID NO: 8496728 - DNA, 22 bp, Homo sapiens
tctggagaggaggatgtggaca

SEQ ID NO: 8496729 - DNA, 22 bp, Homo sapiens
tctggagataagacagacagat

SEQ ID NO: 8496730 - DNA, 22 bp, Homo sapiens
tctggagataagcagcaatgaa

SEQ ID NO: 8496731 - DNA, 22 bp, Homo sapiens
tctggagataagacagacagat

SEQ ID NO: 8496732 - DNA, 22 bp, Homo sapiens
tctggagataagacagacagat

SEQ ID NO: 8496733 - DNA, 22 bp, Homo sapiens
tctggagagtcacagtgccaga

SEQ ID NO: 8496734 - DNA, 22 bp, Homo sapiens
tctggagaggggcctagaattt

SEQ ID NO: 8496735 - DNA, 22 bp, Homo sapiens
tctggagagtcctgctcacgtc

SEQ ID NO: 8496736 - DNA, 22 bp, Homo sapiens
tctggagagtcacagtgccaga

SEQ ID NO: 8496737 - DNA, 22 bp, Homo sapiens
tctggagaagcagtgagagtca

SEQ ID NO: 8496738 - DNA, 22 bp, Homo sapiens
tctggagaagcagtgagagtca

SEQ ID NO: 8496739 - DNA, 22 bp, Homo sapiens
tctggagaagcccagggagctg

SEQ ID NO: 8496740 - DNA, 22 bp, Homo sapiens
tctggagaagcccagggagctg

SEQ ID NO: 8496741 - DNA, 22 bp, Homo sapiens
tctggagaatctgtcagtgtgg

SEQ ID NO: 8496742 - DNA, 22 bp, Homo sapiens
tctggagaatctgtcagtgtgg

SEQ ID NO: 8496743 - DNA, 22 bp, Homo sapiens
tctggagaaggaagagtctttg

SEQ ID NO: 8496744 - DNA, 20 bp, Homo sapiens
tctggactgtcagacaggga

SEQ ID NO: 8496745 - DNA, 20 bp, Homo sapiens
tctggactctaaggtatatt

SEQ ID NO: 8496746 - DNA, 22 bp, Homo sapiens
tctggactttcggtgcaagagt

SEQ ID NO: 8496747 - DNA, 22 bp, Homo sapiens
tctggagaaagttgagtttgtg

SEQ ID NO: 8496748 - DNA, 22 bp, Homo sapiens
tctggagaaagttgagtttgtg

SEQ ID NO: 8496749 - DNA, 22 bp, Homo sapiens
tctggagaagaaacttgctctg

SEQ ID NO: 8496750 - DNA, 22 bp, Homo sapiens
tctggagaagaaacttgctctg

SEQ ID NO: 8496751 - DNA, 22 bp, Homo sapiens
tctggagaacttgcaagaggat

SEQ ID NO: 8496752 - DNA, 22 bp, Homo sapiens
tctggagaacttgcaagaggat

SEQ ID NO: 8496753 - DNA, 22 bp, Homo sapiens
tcttattattgttgtaaaagca

SEQ ID NO: 8496754 - DNA, 22 bp, Homo sapiens
tcttattattgttgtaaaagca

SEQ ID NO: 8496755 - DNA, 22 bp, Homo sapiens
tcttatgcatattcataacaca

SEQ ID NO: 8496756 - DNA, 22 bp, Homo sapiens
tcttattggataaaaggaaacc

SEQ ID NO: 8496757 - DNA, 22 bp, Homo sapiens
tcttatttgcaactggctcaga

SEQ ID NO: 8496758 - DNA, 22 bp, Homo sapiens
tcttatttagagaggactagag

SEQ ID NO: 8496759 - DNA, 22 bp, Homo sapiens
tcttattttttaatgacagaga

SEQ ID NO: 8496760 - DNA, 22 bp, Homo sapiens
tcttattttgttagatgctgta

SEQ ID NO: 8496761 - DNA, 22 bp, Homo sapiens
tcttatttgcaactggctcaga

SEQ ID NO: 8496762 - DNA, 22 bp, Homo sapiens
tcttcaaaaatacaggttttca

SEQ ID NO: 8496763 - DNA, 22 bp, Homo sapiens
tcttcaaaaatacaggttttca

SEQ ID NO: 8496764 - DNA, 22 bp, Homo sapiens
tcttcaaaaactgcaccttgct

SEQ ID NO: 8496765 - DNA, 22 bp, Homo sapiens
tcttcaaaaaatatccatcagt

SEQ ID NO: 8496766 - DNA, 22 bp, Homo sapiens
tcttattttttaatgacagaga

SEQ ID NO: 8496767 - DNA, 22 bp, Homo sapiens
tcttattttttaatgacagaga

SEQ ID NO: 8496768 - DNA, 22 bp, Homo sapiens
tcttcaaagaattttagtaatt

SEQ ID NO: 8496769 - DNA, 22 bp, Homo sapiens
tcttcaaagaattttagtaatt

SEQ ID NO: 8496770 - DNA, 22 bp, Homo sapiens
tcttcaaagcatatgcaggcat

SEQ ID NO: 8496771 - DNA, 22 bp, Homo sapiens
tcttcaaagaagccttggatta

SEQ ID NO: 8496772 - DNA, 22 bp, Homo sapiens
tcttcacagatgcatatacttc

SEQ ID NO: 8496773 - DNA, 22 bp, Homo sapiens
tcttcacaggagcctgcctgcc

SEQ ID NO: 8496774 - DNA, 22 bp, Homo sapiens
tcttcacaggagcctgcctgcc

SEQ ID NO: 8496775 - DNA, 22 bp, Homo sapiens
tcttcacaggagcctgcctgcc

SEQ ID NO: 8496776 - DNA, 22 bp, Homo sapiens
tcttcacatcatgttttttaat

SEQ ID NO: 8496777 - DNA, 22 bp, Homo sapiens
tcttcacatcatgttttttaat

SEQ ID NO: 8496778 - DNA, 22 bp, Homo sapiens
tcttcacagtcctggtcagtgg

SEQ ID NO: 8496779 - DNA, 22 bp, Homo sapiens
tcttcagattgcactgagcaag

SEQ ID NO: 8496780 - DNA, 22 bp, Homo sapiens
tcttcagcaactccccaatctg

SEQ ID NO: 8496781 - DNA, 22 bp, Homo sapiens
tcttcagatggccagttgtccc

SEQ ID NO: 8496782 - DNA, 22 bp, Homo sapiens
tcttcacatgaccttcatgtct

SEQ ID NO: 8496783 - DNA, 22 bp, Homo sapiens
tcttcaaatacagtcatattga

SEQ ID NO: 8496784 - DNA, 22 bp, Homo sapiens
tcttcaaatacagtcatattga

SEQ ID NO: 8496785 - DNA, 22 bp, Homo sapiens
tcttcaaatacagtcatattga

SEQ ID NO: 8496786 - DNA, 22 bp, Homo sapiens
tcttcaaatcctacagtgtctg

SEQ ID NO: 8496787 - DNA, 22 bp, Homo sapiens
tcttcaatttagaatggattta

SEQ ID NO: 8496788 - DNA, 22 bp, Homo sapiens
tcttcaattagatttaccaatt

SEQ ID NO: 8496789 - DNA, 22 bp, Homo sapiens
tcttcacaccgggcagcaggaa

SEQ ID NO: 8496790 - DNA, 22 bp, Homo sapiens
tcttcacaaagctgttgttaaa

SEQ ID NO: 8496791 - DNA, 22 bp, Homo sapiens
tcttcagtatttggataacatt

SEQ ID NO: 8496792 - DNA, 22 bp, Homo sapiens
tcttcagtatttggataacatt

SEQ ID NO: 8496793 - DNA, 22 bp, Homo sapiens
tcttcagtcaatccagatgttt

SEQ ID NO: 8496794 - DNA, 22 bp, Homo sapiens
tcttcagtgcacctgatgtctt

SEQ ID NO: 8496795 - DNA, 22 bp, Homo sapiens
tcttcagttgtaaaagtgttgg

SEQ ID NO: 8496796 - DNA, 22 bp, Homo sapiens
tcttcaggaagggaaatcatcc

SEQ ID NO: 8496797 - DNA, 22 bp, Homo sapiens
tcttcagctgtagtcattgttc

SEQ ID NO: 8496798 - DNA, 22 bp, Homo sapiens
tcttcagctctgaggctctggc

SEQ ID NO: 8496799 - DNA, 22 bp, Homo sapiens
tcttcagcagagaattatgatg

SEQ ID NO: 8496800 - DNA, 22 bp, Homo sapiens
tcttcagcaactccccaatctg

SEQ ID NO: 8496801 - DNA, 20 bp, Homo sapiens
tcttcagcactccttaggta

SEQ ID NO: 8496802 - DNA, 22 bp, Homo sapiens
tcttcagcagagaattatgatg

SEQ ID NO: 8496803 - DNA, 22 bp, Homo sapiens
tcttcatgtatactcatggtac

SEQ ID NO: 8496804 - DNA, 22 bp, Homo sapiens
tcttcatgtatttgacaaccat

SEQ ID NO: 8496805 - DNA, 22 bp, Homo sapiens
tcttcatgtctctgcttgagtc

SEQ ID NO: 8496806 - DNA, 22 bp, Homo sapiens
tcttcatgtcatggtatattga

SEQ ID NO: 8496807 - DNA, 22 bp, Homo sapiens
tcttcatgttgctgtagggaga

SEQ ID NO: 8496808 - DNA, 22 bp, Homo sapiens
tcttcatgtcttgcctgatata

SEQ ID NO: 8496809 - DNA, 22 bp, Homo sapiens
tcttcatgttagttgggttttc

SEQ ID NO: 8496810 - DNA, 22 bp, Homo sapiens
tcttcatgttgctgtagggaga

SEQ ID NO: 8496811 - DNA, 22 bp, Homo sapiens
tcttcatgttgcttattctggg

SEQ ID NO: 8496812 - DNA, 22 bp, Homo sapiens
tcttcatgttgcttattctggg

SEQ ID NO: 8496813 - DNA, 22 bp, Homo sapiens
tcttcatgccaaatgagttttg

SEQ ID NO: 8496814 - DNA, 22 bp, Homo sapiens
tcttcatgccaaatgagttttg

SEQ ID NO: 8496815 - DNA, 22 bp, Homo sapiens
tcttcatgccaaatgagttttg

SEQ ID NO: 8496816 - DNA, 22 bp, Homo sapiens
tcttcatgccaaatgagttttg

SEQ ID NO: 8496817 - DNA, 22 bp, Homo sapiens
tcttcatgcacctcacagctag

SEQ ID NO: 8496818 - DNA, 23 bp, Homo sapiens
tcttcatgcccaggccttggtgc

SEQ ID NO: 8496819 - DNA, 23 bp, Homo sapiens
tcttcatgcccaggccttggtgc

SEQ ID NO: 8496820 - DNA, 22 bp, Homo sapiens
tcttcatggtctggttctccag

SEQ ID NO: 8496821 - DNA, 22 bp, Homo sapiens
tcttcatggtctggttctccag

SEQ ID NO: 8496822 - DNA, 23 bp, Homo sapiens
tcttcatggccatctggttcttc

SEQ ID NO: 8496823 - DNA, 22 bp, Homo sapiens
tcttcatgaaattgattgctta

SEQ ID NO: 8496824 - DNA, 22 bp, Homo sapiens
tcttcatctcagattaacagga

SEQ ID NO: 8496825 - DNA, 22 bp, Homo sapiens
tcttcatgaatgaatctttgac

SEQ ID NO: 8496826 - DNA, 22 bp, Homo sapiens
tcttcatgaatgaatctttgac

SEQ ID NO: 8496827 - DNA, 22 bp, Homo sapiens
tcttcatgataccctaagccac

SEQ ID NO: 8496828 - DNA, 22 bp, Homo sapiens
tcttcatgacctctgtgtttta

SEQ ID NO: 8496829 - DNA, 22 bp, Homo sapiens
tcttcatctcagattaacagga

SEQ ID NO: 8496830 - DNA, 22 bp, Homo sapiens
tcttccagaatgcattctcttt

SEQ ID NO: 8496831 - DNA, 22 bp, Homo sapiens
tcttccagatacttcctgactt

SEQ ID NO: 8496832 - DNA, 22 bp, Homo sapiens
tcttccagagcctccatcccta

SEQ ID NO: 8496833 - DNA, 22 bp, Homo sapiens
tcttccagatgcagatgcttct

SEQ ID NO: 8496834 - DNA, 22 bp, Homo sapiens
tcttccagcaatgtgaaatcac

SEQ ID NO: 8496835 - DNA, 19 bp, Homo sapiens
tcttccagcatctgggggc

SEQ ID NO: 8496836 - DNA, 22 bp, Homo sapiens
tcttcattttatagcatctgtg

SEQ ID NO: 8496837 - DNA, 22 bp, Homo sapiens
tcttcattttgaagaggcagaa

SEQ ID NO: 8496838 - DNA, 22 bp, Homo sapiens
tcttcattttgaagaggcagaa

SEQ ID NO: 8496839 - DNA, 22 bp, Homo sapiens
tcttcattttatagcatctgtg

SEQ ID NO: 8496840 - DNA, 22 bp, Homo sapiens
tcttcatgttgcttattctggg

SEQ ID NO: 8496841 - DNA, 22 bp, Homo sapiens
tcttcatgttgcttattctggg

SEQ ID NO: 8496842 - DNA, 22 bp, Homo sapiens
tcttcattccgtagatatttat

SEQ ID NO: 8496843 - DNA, 22 bp, Homo sapiens
tcttcattccgtagatatttat

SEQ ID NO: 8496844 - DNA, 22 bp, Homo sapiens
tcttcattctcgcctttgtcgt

SEQ ID NO: 8496845 - DNA, 22 bp, Homo sapiens
tcttcattttacaggcagacct

SEQ ID NO: 8496846 - DNA, 22 bp, Homo sapiens
tcttcattttacaggcagacct

SEQ ID NO: 8496847 - DNA, 22 bp, Homo sapiens
tcttcttttatttcaagggtgt

SEQ ID NO: 8496848 - DNA, 22 bp, Homo sapiens
tcttctttgaatcatagtgacc

SEQ ID NO: 8496849 - DNA, 22 bp, Homo sapiens
tcttctttggatgaaagaatat

SEQ ID NO: 8496850 - DNA, 22 bp, Homo sapiens
tcttctttggatgaaagaatat

SEQ ID NO: 8496851 - DNA, 22 bp, Homo sapiens
tcttctttggatgaaagaatat

SEQ ID NO: 8496852 - DNA, 22 bp, Homo sapiens
tcttgaaaattgaggttgaagg

SEQ ID NO: 8496853 - DNA, 23 bp, Homo sapiens
tcttgaaaagcctacagcagttc

SEQ ID NO: 8496854 - DNA, 22 bp, Homo sapiens
tcttgaaacatatgagtaagtg

SEQ ID NO: 8496855 - DNA, 22 bp, Homo sapiens
tcttgaaagcatgagatggaca

SEQ ID NO: 8496856 - DNA, 22 bp, Homo sapiens
tcttgaaagcatgagatggaca

SEQ ID NO: 8496857 - DNA, 22 bp, Homo sapiens
tcttcttcctcatttatacata

SEQ ID NO: 8496858 - DNA, 22 bp, Homo sapiens
tcttcttatgtgccattatctc

SEQ ID NO: 8496859 - DNA, 22 bp, Homo sapiens
tcttcttcccatccctcaaatg

SEQ ID NO: 8496860 - DNA, 22 bp, Homo sapiens
tcttcttcctccacagggccca

SEQ ID NO: 8496861 - DNA, 22 bp, Homo sapiens
tcttctttgaatcatagtgacc

SEQ ID NO: 8496862 - DNA, 22 bp, Homo sapiens
tcttctttatgtcatatgccag

SEQ ID NO: 8496863 - DNA, 22 bp, Homo sapiens
tcttctttatgtcatatgccag

SEQ ID NO: 8496864 - DNA, 22 bp, Homo sapiens
tcttctgttttagattgcatac

SEQ ID NO: 8496865 - DNA, 22 bp, Homo sapiens
tcttctgttttagattgcatac

SEQ ID NO: 8496866 - DNA, 22 bp, Homo sapiens
tcttctgttttagattgcatac

SEQ ID NO: 8496867 - DNA, 22 bp, Homo sapiens
tcttcttatgtgccattatctc

SEQ ID NO: 8496868 - DNA, 22 bp, Homo sapiens
tcttcttaaagtatgttctctt

SEQ ID NO: 8496869 - DNA, 22 bp, Homo sapiens
tcttctgttttagattgcatac

SEQ ID NO: 8496870 - DNA, 20 bp, Homo sapiens
tcttctgttgccttgttctg

SEQ ID NO: 8496871 - DNA, 20 bp, Homo sapiens
tcttctgttgccttgttctg

SEQ ID NO: 8496872 - DNA, 22 bp, Homo sapiens
tcttctgttaccacagcgatga

SEQ ID NO: 8496873 - DNA, 20 bp, Homo sapiens
tcttctgttgccttgttctg

SEQ ID NO: 8496874 - DNA, 20 bp, Homo sapiens
tcttctgttgccttgttctg

SEQ ID NO: 8496875 - DNA, 22 bp, Homo sapiens
tcttctgttaccacagcgatga

SEQ ID NO: 8496876 - DNA, 22 bp, Homo sapiens
tcttctgtggctctcaccaccc

SEQ ID NO: 8496877 - DNA, 22 bp, Homo sapiens
tcttctgtggctctcaccaccc

SEQ ID NO: 8496878 - DNA, 22 bp, Homo sapiens
tcttctgtgatctatgtgtttt

SEQ ID NO: 8496879 - DNA, 22 bp, Homo sapiens
tcttctgtgatctatgtgtttt

SEQ ID NO: 8496880 - DNA, 22 bp, Homo sapiens
tcttctgtgatctatgtgtttt

SEQ ID NO: 8496881 - DNA, 22 bp, Homo sapiens
tcttctgtgagaattcaagcaa

SEQ ID NO: 8496882 - DNA, 22 bp, Homo sapiens
tcttctgtcctaagtcaaagca

SEQ ID NO: 8496883 - DNA, 22 bp, Homo sapiens
tcttctgtgagaattcaagcaa

SEQ ID NO: 8496884 - DNA, 22 bp, Homo sapiens
tcttctgtattgttaactcagg

SEQ ID NO: 8496885 - DNA, 22 bp, Homo sapiens
tcttctgtcctaagtcaaagca

SEQ ID NO: 8496886 - DNA, 22 bp, Homo sapiens
tcttctgtattgttaactcagg

SEQ ID NO: 8496887 - DNA, 22 bp, Homo sapiens
tcttctgtattgttaactcagg

SEQ ID NO: 8496888 - DNA, 22 bp, Homo sapiens
tcttctggatgagagcggaggc

SEQ ID NO: 8496889 - DNA, 22 bp, Homo sapiens
tcttctctacaccagcagcccc

SEQ ID NO: 8496890 - DNA, 22 bp, Homo sapiens
tcttctctacaccagcagcccc

SEQ ID NO: 8496891 - DNA, 22 bp, Homo sapiens
tcttctcctttgccatgtgttt

SEQ ID NO: 8496892 - DNA, 22 bp, Homo sapiens
tcttctcctttgccatgtgttt

SEQ ID NO: 8496893 - DNA, 22 bp, Homo sapiens
tcttctcccatctccaggcagg

SEQ ID NO: 8496894 - DNA, 22 bp, Homo sapiens
tcttctcccatcggccgcaggg

SEQ ID NO: 8496895 - DNA, 22 bp, Homo sapiens
tcttctcccagggtcgcccaag

SEQ ID NO: 8496896 - DNA, 22 bp, Homo sapiens
tcttctccataatcaacactct

SEQ ID NO: 8496897 - DNA, 22 bp, Homo sapiens
tcttctccagtgcttctgcaca

SEQ ID NO: 8496898 - DNA, 22 bp, Homo sapiens
tcttctccagttcatcctacca

SEQ ID NO: 8496899 - DNA, 22 bp, Homo sapiens
tcttctccagttcatcctacca

SEQ ID NO: 8496900 - DNA, 22 bp, Homo sapiens
tcttctccagtgcttctgcaca

SEQ ID NO: 8496901 - DNA, 22 bp, Homo sapiens
tcttccagctgtaggacctagg

SEQ ID NO: 8496902 - DNA, 20 bp, Homo sapiens
tcttccagcttctggtagaa

SEQ ID NO: 8496903 - DNA, 18 bp, Homo sapiens
tcttccagcttctggagg

SEQ ID NO: 8496904 - DNA, 22 bp, Homo sapiens
tcttccaggagggcatttcttt

SEQ ID NO: 8496905 - DNA, 22 bp, Homo sapiens
tcttccaggccctgccacagct

SEQ ID NO: 8496906 - DNA, 22 bp, Homo sapiens
tcttcctccctacagagctcag

SEQ ID NO: 8496907 - DNA, 22 bp, Homo sapiens
tcttcctccctacagagctcag

SEQ ID NO: 8496908 - DNA, 21 bp, Homo sapiens
tcttcctccacagcgtgccac

SEQ ID NO: 8496909 - DNA, 21 bp, Homo sapiens
tcttcctccacagcgtgccac

SEQ ID NO: 8496910 - DNA, 20 bp, Homo sapiens
tcttccaggtacagtctgca

SEQ ID NO: 8496911 - DNA, 22 bp, Homo sapiens
tcttcctccctacagagctcag

SEQ ID NO: 8496912 - DNA, 22 bp, Homo sapiens
tcttcctctagatctgaggccc

SEQ ID NO: 8496913 - DNA, 22 bp, Homo sapiens
tcttcctctagatctgaggccc

SEQ ID NO: 8496914 - DNA, 22 bp, Homo sapiens
tcttcctctagatctgaggccc

SEQ ID NO: 8496915 - DNA, 22 bp, Homo sapiens
tcttcctctctaattgatcaga

SEQ ID NO: 8496916 - DNA, 22 bp, Homo sapiens
tcttcctctctaattgatcaga

SEQ ID NO: 8496917 - DNA, 22 bp, Homo sapiens
tcttcctctctaattgatcaga

SEQ ID NO: 8496918 - DNA, 22 bp, Homo sapiens
tcttcctcttctgctgagaagt

SEQ ID NO: 8496919 - DNA, 22 bp, Homo sapiens
tcttcctcttctgctgagaagt

SEQ ID NO: 8496920 - DNA, 23 bp, Homo sapiens
tcttcctgaactatcaggcacat

SEQ ID NO: 8496921 - DNA, 23 bp, Homo sapiens
tcttcctgaactatcaggcacat

SEQ ID NO: 8496922 - DNA, 21 bp, Homo sapiens
tcttcctgctccacactcccc

SEQ ID NO: 8496923 - DNA, 21 bp, Homo sapiens
tcttcctgacatatgcaaggc

SEQ ID NO: 8496924 - DNA, 21 bp, Homo sapiens
tcttcctgacatatgcaaggc

SEQ ID NO: 8496925 - DNA, 22 bp, Homo sapiens
tcttcctgaaaccctgttccag

SEQ ID NO: 8496926 - DNA, 22 bp, Homo sapiens
tcttcctgaaaccctgttccag

SEQ ID NO: 8496927 - DNA, 23 bp, Homo sapiens
tcttcctgaactatcaggcacat

SEQ ID NO: 8496928 - DNA, 23 bp, Homo sapiens
tcttcctgaactatcaggcacat

SEQ ID NO: 8496929 - DNA, 22 bp, Homo sapiens
tcttccttctttgatgacaagg

SEQ ID NO: 8496930 - DNA, 22 bp, Homo sapiens
tcttcctgtcaatgagaattaa

SEQ ID NO: 8496931 - DNA, 22 bp, Homo sapiens
tcttcctgtcaatgagaattaa

SEQ ID NO: 8496932 - DNA, 22 bp, Homo sapiens
tcttcctgtcaatgagaattaa

SEQ ID NO: 8496933 - DNA, 22 bp, Homo sapiens
tcttcctggatgggggttgatg

SEQ ID NO: 8496934 - DNA, 22 bp, Homo sapiens
tcttcctgctttggtgaggctt

SEQ ID NO: 8496935 - DNA, 22 bp, Homo sapiens
tcttcctggcattgatgctgca

SEQ ID NO: 8496936 - DNA, 22 bp, Homo sapiens
tcttcctggcattgatgctgca

SEQ ID NO: 8496937 - DNA, 22 bp, Homo sapiens
tcttcctgcttggtgtgtctgg

SEQ ID NO: 8496938 - DNA, 22 bp, Homo sapiens
tcttcctgctttggtgaggctt

SEQ ID NO: 8496939 - DNA, 21 bp, Homo sapiens
tcttcctgctccacactcccc

SEQ ID NO: 8496940 - DNA, 21 bp, Homo sapiens
tcttcctgctccacactcccc

SEQ ID NO: 8496941 - DNA, 21 bp, Homo sapiens
tcttcctgctccacactcccc

SEQ ID NO: 8496942 - DNA, 22 bp, Homo sapiens
tcttctatcctcagcccctgcc

SEQ ID NO: 8496943 - DNA, 22 bp, Homo sapiens
tcttctactataataattttct

SEQ ID NO: 8496944 - DNA, 22 bp, Homo sapiens
tcttccttttgtaccttctgaa

SEQ ID NO: 8496945 - DNA, 22 bp, Homo sapiens
tcttccttttgtaccttctgaa

SEQ ID NO: 8496946 - DNA, 16 bp, Homo sapiens
tcttccttttgatttt

SEQ ID NO: 8496947 - DNA, 16 bp, Homo sapiens
tcttccttttgatttt

SEQ ID NO: 8496948 - DNA, 22 bp, Homo sapiens
tcttcctttcattcatgtgtta

SEQ ID NO: 8496949 - DNA, 22 bp, Homo sapiens
tcttccttgtaagggctttaga

SEQ ID NO: 8496950 - DNA, 22 bp, Homo sapiens
tcttccttgccttgcttcatca

SEQ ID NO: 8496951 - DNA, 22 bp, Homo sapiens
tcttccttgccttgcttcatca

SEQ ID NO: 8496952 - DNA, 22 bp, Homo sapiens
tcttccttgctccttgtcactt

SEQ ID NO: 8496953 - DNA, 22 bp, Homo sapiens
tctttctacatcatttgcttct

SEQ ID NO: 8496954 - DNA, 22 bp, Homo sapiens
tctttctacattttatatgctt

SEQ ID NO: 8496955 - DNA, 22 bp, Homo sapiens
tctttccttagaataattcttt

SEQ ID NO: 8496956 - DNA, 22 bp, Homo sapiens
tctttcctgtaactgctgttca

SEQ ID NO: 8496957 - DNA, 22 bp, Homo sapiens
tctttcctgtaactgctgttca

SEQ ID NO: 8496958 - DNA, 17 bp, Homo sapiens
tctttcctgccatgctc

SEQ ID NO: 8496959 - DNA, 17 bp, Homo sapiens
tctttcctgccatgctc

SEQ ID NO: 8496960 - DNA, 21 bp, Homo sapiens
tctttcctgcccagttgccct

SEQ ID NO: 8496961 - DNA, 21 bp, Homo sapiens
tctttcctgcccagttgccct

SEQ ID NO: 8496962 - DNA, 23 bp, Homo sapiens
tctttcctcagcacacaccaaga

SEQ ID NO: 8496963 - DNA, 23 bp, Homo sapiens
tctttcctcagcacacaccaaga

SEQ ID NO: 8496964 - DNA, 22 bp, Homo sapiens
tctttcctctgagctcctgtag

SEQ ID NO: 8496965 - DNA, 22 bp, Homo sapiens
tctttcctctgagctcctgtag

SEQ ID NO: 8496966 - DNA, 22 bp, Homo sapiens
tctttcctctgagctcctgtag

SEQ ID NO: 8496967 - DNA, 22 bp, Homo sapiens
tctttcctagaggctgatgagt

SEQ ID NO: 8496968 - DNA, 22 bp, Homo sapiens
tctttcctactttattgtgaac

SEQ ID NO: 8496969 - DNA, 22 bp, Homo sapiens
tctttcctaggtgatatgcaat

SEQ ID NO: 8496970 - DNA, 22 bp, Homo sapiens
tctttcctaggtgatatgcaat

SEQ ID NO: 8496971 - DNA, 22 bp, Homo sapiens
tctttcctaggtgatatgcaat

SEQ ID NO: 8496972 - DNA, 23 bp, Homo sapiens
tctttcctaatgaaacagtgaaa

SEQ ID NO: 8496973 - DNA, 22 bp, Homo sapiens
tctttcctactttattgtgaac

SEQ ID NO: 8496974 - DNA, 22 bp, Homo sapiens
tctttcctactttattgtgaac

SEQ ID NO: 8496975 - DNA, 22 bp, Homo sapiens
tctttgatggagagatagatat

SEQ ID NO: 8496976 - DNA, 22 bp, Homo sapiens
tctttgatcagcctttcactga

SEQ ID NO: 8496977 - DNA, 22 bp, Homo sapiens
tctttgaatttctgactgtctt

SEQ ID NO: 8496978 - DNA, 22 bp, Homo sapiens
tctttgaccaaattatcctgtt

SEQ ID NO: 8496979 - DNA, 22 bp, Homo sapiens
tctttgaatacaggaagcatga

SEQ ID NO: 8496980 - DNA, 22 bp, Homo sapiens
tctttgaatcctttacatctga

SEQ ID NO: 8496981 - DNA, 22 bp, Homo sapiens
tctttgaatcctttacatctga

SEQ ID NO: 8496982 - DNA, 22 bp, Homo sapiens
tctttgaatcctttacatctga

SEQ ID NO: 8496983 - DNA, 22 bp, Homo sapiens
tctttgaattcaaactgttcaa

SEQ ID NO: 8496984 - DNA, 22 bp, Homo sapiens
tctttgaattcaaactgttcaa

SEQ ID NO: 8496985 - DNA, 22 bp, Homo sapiens
tctttctggttatgtatagaga

SEQ ID NO: 8496986 - DNA, 22 bp, Homo sapiens
tctttctgtaagctccatggaa

SEQ ID NO: 8496987 - DNA, 22 bp, Homo sapiens
tctttctgtaagctccatggaa

SEQ ID NO: 8496988 - DNA, 22 bp, Homo sapiens
tctttcttaaataggtggattg

SEQ ID NO: 8496989 - DNA, 22 bp, Homo sapiens
tctttcttaaataggtggattg

SEQ ID NO: 8496990 - DNA, 22 bp, Homo sapiens
tctttgaactctgtgtattaac

SEQ ID NO: 8496991 - DNA, 22 bp, Homo sapiens
tctttcttattagccattgttc

SEQ ID NO: 8496992 - DNA, 22 bp, Homo sapiens
tctttgaaagctgttctagagt

SEQ ID NO: 8496993 - DNA, 22 bp, Homo sapiens
tctttgaacttggctgatctct

SEQ ID NO: 8496994 - DNA, 22 bp, Homo sapiens
tctttgaacttggctgatctct

SEQ ID NO: 8496995 - DNA, 22 bp, Homo sapiens
tctttgaacttggctgatctct

SEQ ID NO: 8496996 - DNA, 22 bp, Homo sapiens
tctttctggtctcgccttattc

SEQ ID NO: 8496997 - DNA, 22 bp, Homo sapiens
tctttctggttatgtatagaga

SEQ ID NO: 8496998 - DNA, 22 bp, Homo sapiens
tctttctgcagcacaggggcag

SEQ ID NO: 8496999 - DNA, 22 bp, Homo sapiens
tctttctgcacttagtggggct

SEQ ID NO: 8497000 - DNA, 22 bp, Homo sapiens
tctttctgatgggaagggtcaa

SEQ ID NO: 8497001 - DNA, 22 bp, Homo sapiens
tctttctgaatatttgacctca

SEQ ID NO: 8497002 - DNA, 21 bp, Homo sapiens
tctttctgaaatctcagtctg

SEQ ID NO: 8497003 - DNA, 22 bp, Homo sapiens
tctttctctctaatcaagcaca

SEQ ID NO: 8497004 - DNA, 22 bp, Homo sapiens
tctttatcaagtctgttctttg

SEQ ID NO: 8497005 - DNA, 22 bp, Homo sapiens
tctttatcaagtctgttctttg

SEQ ID NO: 8497006 - DNA, 22 bp, Homo sapiens
tctttatcaagtctgttctttg

SEQ ID NO: 8497007 - DNA, 22 bp, Homo sapiens
tctttatctggctcagagacac

SEQ ID NO: 8497008 - DNA, 22 bp, Homo sapiens
tctttataaaagtcattatgtc

SEQ ID NO: 8497009 - DNA, 22 bp, Homo sapiens
tctttagagttaacaataatga

SEQ ID NO: 8497010 - DNA, 22 bp, Homo sapiens
tctttagtgaccatctcattct

SEQ ID NO: 8497011 - DNA, 20 bp, Homo sapiens
tctttagttcctggcccttt

SEQ ID NO: 8497012 - DNA, 22 bp, Homo sapiens
tctttagccagtatcataatga

SEQ ID NO: 8497013 - DNA, 22 bp, Homo sapiens
tctttagctagaaatactctaa

SEQ ID NO: 8497014 - DNA, 22 bp, Homo sapiens
tctttagctagaaatactctaa

SEQ ID NO: 8497015 - DNA, 20 bp, Homo sapiens
tctttagatttatcttatgt

SEQ ID NO: 8497016 - DNA, 22 bp, Homo sapiens
tctttccatggccacacagtct

SEQ ID NO: 8497017 - DNA, 22 bp, Homo sapiens
tctttcccgccagagcatgagt

SEQ ID NO: 8497018 - DNA, 22 bp, Homo sapiens
tctttccagaggaatttttaga

SEQ ID NO: 8497019 - DNA, 22 bp, Homo sapiens
tctttccagaggaatttttaga

SEQ ID NO: 8497020 - DNA, 22 bp, Homo sapiens
tctttccacattctctgtttag

SEQ ID NO: 8497021 - DNA, 21 bp, Homo sapiens
tctttccaatattcatgtctc

SEQ ID NO: 8497022 - DNA, 22 bp, Homo sapiens
tctttccaaggactctgtagca

SEQ ID NO: 8497023 - DNA, 22 bp, Homo sapiens
tctttccaagtaatacttccca

SEQ ID NO: 8497024 - DNA, 21 bp, Homo sapiens
tctttccaatattcatgtctc

SEQ ID NO: 8497025 - DNA, 22 bp, Homo sapiens
tctttcaatgtgaaaccatgta

SEQ ID NO: 8497026 - DNA, 22 bp, Homo sapiens
tctttcagaaactttgtctgcg

SEQ ID NO: 8497027 - DNA, 22 bp, Homo sapiens
tctttcagctcttcaggaccca

SEQ ID NO: 8497028 - DNA, 22 bp, Homo sapiens
tctttcagccacttacctgtct

SEQ ID NO: 8497029 - DNA, 22 bp, Homo sapiens
tctttcagccacttacctgtct

SEQ ID NO: 8497030 - DNA, 19 bp, Homo sapiens
tctttcatttctagctctg

SEQ ID NO: 8497031 - DNA, 22 bp, Homo sapiens
tctttcatgtatatgcaaccta

SEQ ID NO: 8497032 - DNA, 19 bp, Homo sapiens
tctttcatttctagctctg

SEQ ID NO: 8497033 - DNA, 22 bp, Homo sapiens
tctttattgctactggtttgtc

SEQ ID NO: 8497034 - DNA, 22 bp, Homo sapiens
tcttggagactcttgtatattt

SEQ ID NO: 8497035 - DNA, 22 bp, Homo sapiens
tcttggagactcttgtatattt

SEQ ID NO: 8497036 - DNA, 22 bp, Homo sapiens
tcttggagaatggcagagaagc

SEQ ID NO: 8497037 - DNA, 20 bp, Homo sapiens
tcttggagagggtggactta

SEQ ID NO: 8497038 - DNA, 18 bp, Homo sapiens
tcttggagtaatgatcaa

SEQ ID NO: 8497039 - DNA, 22 bp, Homo sapiens
tcttggattttaatggatcaaa

SEQ ID NO: 8497040 - DNA, 22 bp, Homo sapiens
tcttggagtattgggcctcagg

SEQ ID NO: 8497041 - DNA, 22 bp, Homo sapiens
tcttggaataccccgaaggtca

SEQ ID NO: 8497042 - DNA, 22 bp, Homo sapiens
tcttggaatctccatagagtga

SEQ ID NO: 8497043 - DNA, 22 bp, Homo sapiens
tcttggaatctccatagagtga

SEQ ID NO: 8497044 - DNA, 22 bp, Homo sapiens
tcttggaaccctatgtgatttc

SEQ ID NO: 8497045 - DNA, 22 bp, Homo sapiens
tcttggaacttattattgtaga

SEQ ID NO: 8497046 - DNA, 22 bp, Homo sapiens
tcttggaacttattattgtaga

SEQ ID NO: 8497047 - DNA, 22 bp, Homo sapiens
tcttggaagcctcaagatactc

SEQ ID NO: 8497048 - DNA, 22 bp, Homo sapiens
tcttggaacttattattgtaga

SEQ ID NO: 8497049 - DNA, 22 bp, Homo sapiens
tcttggaagtagaacacagtct

SEQ ID NO: 8497050 - DNA, 22 bp, Homo sapiens
tcttggaagtagaacacagtct

SEQ ID NO: 8497051 - DNA, 22 bp, Homo sapiens
tcttggaagtagaacacagtct

SEQ ID NO: 8497052 - DNA, 22 bp, Homo sapiens
tcttggaagtagaacacagtct

SEQ ID NO: 8497053 - DNA, 22 bp, Homo sapiens
tcttggctactttcctgtctgc

SEQ ID NO: 8497054 - DNA, 22 bp, Homo sapiens
tcttggctactttcctgtctgc

SEQ ID NO: 8497055 - DNA, 22 bp, Homo sapiens
tcttggctatccaagttatcca

SEQ ID NO: 8497056 - DNA, 22 bp, Homo sapiens
tcttggctatccaagttatcca

SEQ ID NO: 8497057 - DNA, 22 bp, Homo sapiens
tcttggctagtaccttcctgcc

SEQ ID NO: 8497058 - DNA, 22 bp, Homo sapiens
tcttggctagtaccttcctgcc

SEQ ID NO: 8497059 - DNA, 22 bp, Homo sapiens
tcttggccaggtgtggtgcctc

SEQ ID NO: 8497060 - DNA, 22 bp, Homo sapiens
tcttggccagatgcacttcctc

SEQ ID NO: 8497061 - DNA, 21 bp, Homo sapiens
tcttggcctaagttcactgaa

SEQ ID NO: 8497062 - DNA, 22 bp, Homo sapiens
tcttggccccacctgtgccagc

SEQ ID NO: 8497063 - DNA, 22 bp, Homo sapiens
tcttggccccaaccctctattt

SEQ ID NO: 8497064 - DNA, 22 bp, Homo sapiens
tcttggattttaatggatcaaa

SEQ ID NO: 8497065 - DNA, 22 bp, Homo sapiens
tcttggccactaccacctggag

SEQ ID NO: 8497066 - DNA, 22 bp, Homo sapiens
tcttggccactaccacctggag

SEQ ID NO: 8497067 - DNA, 22 bp, Homo sapiens
tcttgaaagtatcttattttgt

SEQ ID NO: 8497068 - DNA, 22 bp, Homo sapiens
tcttgaaagtatcttattttgt

SEQ ID NO: 8497069 - DNA, 22 bp, Homo sapiens
tcttgaagtccttacatttgat

SEQ ID NO: 8497070 - DNA, 22 bp, Homo sapiens
tcttgaagtcttatggtttaaa

SEQ ID NO: 8497071 - DNA, 22 bp, Homo sapiens
tcttgaagtcttatggtttaaa

SEQ ID NO: 8497072 - DNA, 22 bp, Homo sapiens
tcttgaaggggggcagtgttga

SEQ ID NO: 8497073 - DNA, 20 bp, Homo sapiens
tcttgagaacaatttctggc

SEQ ID NO: 8497074 - DNA, 22 bp, Homo sapiens
tcttgagaaataattaaacatg

SEQ ID NO: 8497075 - DNA, 22 bp, Homo sapiens
tcttgacattgcaatcttcaga

SEQ ID NO: 8497076 - DNA, 22 bp, Homo sapiens
tcttgacattcaatcatgtata

SEQ ID NO: 8497077 - DNA, 22 bp, Homo sapiens
tcttgaataagtttcatgagct

SEQ ID NO: 8497078 - DNA, 22 bp, Homo sapiens
tcttgacaactatactacttac

SEQ ID NO: 8497079 - DNA, 22 bp, Homo sapiens
tcttgaattgtactcccataag

SEQ ID NO: 8497080 - DNA, 22 bp, Homo sapiens
tcttgagtctaatctgaacttt

SEQ ID NO: 8497081 - DNA, 22 bp, Homo sapiens
tcttgaggtcatcatctgaaac

SEQ ID NO: 8497082 - DNA, 19 bp, Homo sapiens
tcttgatgaggtttctcca

SEQ ID NO: 8497083 - DNA, 22 bp, Homo sapiens
tcttggaaccctatgtgatttc

SEQ ID NO: 8497084 - DNA, 20 bp, Homo sapiens
tcttggaaaaagttcagaat

SEQ ID NO: 8497085 - DNA, 22 bp, Homo sapiens
tcttgcttctgctcaaggggag

SEQ ID NO: 8497086 - DNA, 22 bp, Homo sapiens
tcttgctaaagaccaacacatt

SEQ ID NO: 8497087 - DNA, 22 bp, Homo sapiens
tcttggctctgccactaattag

SEQ ID NO: 8497088 - DNA, 22 bp, Homo sapiens
tcttggctgcgtcctggctgtg

SEQ ID NO: 8497089 - DNA, 22 bp, Homo sapiens
tcttggctgcgtcctggctgtg

SEQ ID NO: 8497090 - DNA, 22 bp, Homo sapiens
tcttggctgctgccaatttact

SEQ ID NO: 8497091 - DNA, 21 bp, Homo sapiens
tcttggctctgccacttatta

SEQ ID NO: 8497092 - DNA, 22 bp, Homo sapiens
tcttggcttctgtatttcctgt

SEQ ID NO: 8497093 - DNA, 22 bp, Homo sapiens
tcttggcttctgtatttcctgt

SEQ ID NO: 8497094 - DNA, 22 bp, Homo sapiens
tcttggctgtctttgaagttag

SEQ ID NO: 8497095 - DNA, 22 bp, Homo sapiens
tcttggctgtgcatgcatcttc

SEQ ID NO: 8497096 - DNA, 23 bp, Homo sapiens
tcttggctggacaagtcactcac

SEQ ID NO: 8497097 - DNA, 22 bp, Homo sapiens
tcttggctgtaccattgactag

SEQ ID NO: 8497098 - DNA, 22 bp, Homo sapiens
tcttgggattgccctgcagttc

SEQ ID NO: 8497099 - DNA, 22 bp, Homo sapiens
tcttgggcatgtgtttgatttc

SEQ ID NO: 8497100 - DNA, 22 bp, Homo sapiens
tcttgggcatgtgtttgatttc

SEQ ID NO: 8497101 - DNA, 22 bp, Homo sapiens
tcttgggcatgtgtttgatttc

SEQ ID NO: 8497102 - DNA, 22 bp, Homo sapiens
tcttgggagtcccaggacatag

SEQ ID NO: 8497103 - DNA, 19 bp, Homo sapiens
tcttggctttgtctactgt

SEQ ID NO: 8497104 - DNA, 19 bp, Homo sapiens
tcttggctttgtctactgt

SEQ ID NO: 8497105 - DNA, 22 bp, Homo sapiens
tctttacatcacaattgtatgg

SEQ ID NO: 8497106 - DNA, 22 bp, Homo sapiens
tctttacatcacaattgtatgg

SEQ ID NO: 8497107 - DNA, 22 bp, Homo sapiens
tctttacatcacaattgtatgg

SEQ ID NO: 8497108 - DNA, 22 bp, Homo sapiens
tctttacttgtgtattgtatat

SEQ ID NO: 8497109 - DNA, 21 bp, Homo sapiens
tctttacatttgcctcttgca

SEQ ID NO: 8497110 - DNA, 22 bp, Homo sapiens
tctttactggaatggaactttc

SEQ ID NO: 8497111 - DNA, 23 bp, Homo sapiens
tctttagaagaacatcagaaatg

SEQ ID NO: 8497112 - DNA, 22 bp, Homo sapiens
tctttagacatccagtttctct

SEQ ID NO: 8497113 - DNA, 22 bp, Homo sapiens
tctttagaaacttttcttcatg

SEQ ID NO: 8497114 - DNA, 22 bp, Homo sapiens
tctttacacaagacaagaataa

SEQ ID NO: 8497115 - DNA, 22 bp, Homo sapiens
tctttacagtcctctgtcaatc

SEQ ID NO: 8497116 - DNA, 23 bp, Homo sapiens
tctttacagcagcaggatttgga

SEQ ID NO: 8497117 - DNA, 22 bp, Homo sapiens
tctttacatagtgtggactact

SEQ ID NO: 8497118 - DNA, 22 bp, Homo sapiens
tctttacatcacaattgtatgg

SEQ ID NO: 8497119 - DNA, 23 bp, Homo sapiens
tctttacatactgatgagttctc

SEQ ID NO: 8497120 - DNA, 23 bp, Homo sapiens
tctttacatactgatgagttctc

SEQ ID NO: 8497121 - DNA, 22 bp, Homo sapiens
tctttaatgtactttctttcac

SEQ ID NO: 8497122 - DNA, 22 bp, Homo sapiens
tctttaatatctgccccagagc

SEQ ID NO: 8497123 - DNA, 22 bp, Homo sapiens
tctttacaatctaagcatagtt

SEQ ID NO: 8497124 - DNA, 22 bp, Homo sapiens
tctttacaatctaagcatagtt

SEQ ID NO: 8497125 - DNA, 22 bp, Homo sapiens
tctttacaatctaagcatagtt

SEQ ID NO: 8497126 - DNA, 22 bp, Homo sapiens
tctttacaagtcacattttctg

SEQ ID NO: 8497127 - DNA, 22 bp, Homo sapiens
tctgtttgctggtgcatgggtt

SEQ ID NO: 8497128 - DNA, 22 bp, Homo sapiens
tctgttttagataagaaaggct

SEQ ID NO: 8497129 - DNA, 22 bp, Homo sapiens
tctgttttctctgtattttgac

SEQ ID NO: 8497130 - DNA, 22 bp, Homo sapiens
tctgttttcatttgtcttgaga

SEQ ID NO: 8497131 - DNA, 22 bp, Homo sapiens
tctgttttcatttgtcttgaga

SEQ ID NO: 8497132 - DNA, 22 bp, Homo sapiens
tctgttttgcataatgttcttt

SEQ ID NO: 8497133 - DNA, 22 bp, Homo sapiens
tctgtttcttcttctgttatat

SEQ ID NO: 8497134 - DNA, 22 bp, Homo sapiens
tctgtttcttcctagccatgct

SEQ ID NO: 8497135 - DNA, 22 bp, Homo sapiens
tctgtttctccaacattgtgag

SEQ ID NO: 8497136 - DNA, 22 bp, Homo sapiens
tctgtttctataaagacaagag

SEQ ID NO: 8497137 - DNA, 22 bp, Homo sapiens
tctgtttcctcttgtgtaaagt

SEQ ID NO: 8497138 - DNA, 22 bp, Homo sapiens
tctgtttcctcttgtgtaaagt

SEQ ID NO: 8497139 - DNA, 22 bp, Homo sapiens
tctgttttgtgtctctctggtg

SEQ ID NO: 8497140 - DNA, 22 bp, Homo sapiens
tctgttttggtcacctttatat

SEQ ID NO: 8497141 - DNA, 22 bp, Homo sapiens
tcttaaaagtatgccaattgga

SEQ ID NO: 8497142 - DNA, 22 bp, Homo sapiens
tcttaaaagtatgccaattgga

SEQ ID NO: 8497143 - DNA, 22 bp, Homo sapiens
tcttaaaagtatgccaattgga

SEQ ID NO: 8497144 - DNA, 22 bp, Homo sapiens
tcttaaaagtatgccaattgga

SEQ ID NO: 8497145 - DNA, 22 bp, Homo sapiens
tcttaaaggcacatagtgtcta

SEQ ID NO: 8497146 - DNA, 22 bp, Homo sapiens
tcttaaagccaagcataaacca

SEQ ID NO: 8497147 - DNA, 22 bp, Homo sapiens
tcttaaatgactgataagagga

SEQ ID NO: 8497148 - DNA, 22 bp, Homo sapiens
tcttaacaagctcctcagtgct

SEQ ID NO: 8497149 - DNA, 22 bp, Homo sapiens
tcttaacaagctcctcagtgct

SEQ ID NO: 8497150 - DNA, 22 bp, Homo sapiens
tcttaacagtgctacagagcag

SEQ ID NO: 8497151 - DNA, 22 bp, Homo sapiens
tcttaacatattattttagcac

SEQ ID NO: 8497152 - DNA, 22 bp, Homo sapiens
tcttaacatattattttagcac

SEQ ID NO: 8497153 - DNA, 22 bp, Homo sapiens
tcttaactatcatttgaacacc

SEQ ID NO: 8497154 - DNA, 20 bp, Homo sapiens
tcttaaatccccagggccat

SEQ ID NO: 8497155 - DNA, 22 bp, Homo sapiens
tcttaaatgactgataagagga

SEQ ID NO: 8497156 - DNA, 22 bp, Homo sapiens
tcttaaatgactgataagagga

SEQ ID NO: 8497157 - DNA, 22 bp, Homo sapiens
tcttaaatgactgataagagga

SEQ ID NO: 8497158 - DNA, 22 bp, Homo sapiens
tcttaactgacagtttaatggg

SEQ ID NO: 8497159 - DNA, 22 bp, Homo sapiens
tcttaactgacagtttaatggg

SEQ ID NO: 8497160 - DNA, 22 bp, Homo sapiens
tcttaagcagagaagaagttga

SEQ ID NO: 8497161 - DNA, 22 bp, Homo sapiens
tcttaatgaaagtgaaatatca

SEQ ID NO: 8497162 - DNA, 22 bp, Homo sapiens
tcttagatgaataaaaagttat

SEQ ID NO: 8497163 - DNA, 22 bp, Homo sapiens
tcttatgaaaagcacttagaac

SEQ ID NO: 8497164 - DNA, 22 bp, Homo sapiens
tcttatacagaagatgtttaat

SEQ ID NO: 8497165 - DNA, 22 bp, Homo sapiens
tcttataaaaggactcccattt

SEQ ID NO: 8497166 - DNA, 22 bp, Homo sapiens
tcttagcaaattttctttgcct

SEQ ID NO: 8497167 - DNA, 22 bp, Homo sapiens
tcttagcatgcatgtataaata

SEQ ID NO: 8497168 - DNA, 22 bp, Homo sapiens
tcttagcacagctatataagtt

SEQ ID NO: 8497169 - DNA, 22 bp, Homo sapiens
tcttagcacagctatataagtt

SEQ ID NO: 8497170 - DNA, 22 bp, Homo sapiens
tctgttgcaatgtgcatggtga

SEQ ID NO: 8497171 - DNA, 22 bp, Homo sapiens
tctgttgcatatgctgctgggt

SEQ ID NO: 8497172 - DNA, 22 bp, Homo sapiens
tctgttggagcctaggatgaca

SEQ ID NO: 8497173 - DNA, 21 bp, Homo sapiens
tctgttggaggcctctcttcc

SEQ ID NO: 8497174 - DNA, 22 bp, Homo sapiens
tctgttggctttttaaagttgt

SEQ ID NO: 8497175 - DNA, 22 bp, Homo sapiens
tctgttggttctgtttctctga

SEQ ID NO: 8497176 - DNA, 22 bp, Homo sapiens
tctgttggcttgagatttaatt

SEQ ID NO: 8497177 - DNA, 22 bp, Homo sapiens
tctgtttaatgggaatgatact

SEQ ID NO: 8497178 - DNA, 22 bp, Homo sapiens
tctgtttatgtgtctaaataaa

SEQ ID NO: 8497179 - DNA, 22 bp, Homo sapiens
tctgtttatgcatatttaaaac

SEQ ID NO: 8497180 - DNA, 22 bp, Homo sapiens
tctgtttatatttcaaaccttc

SEQ ID NO: 8497181 - DNA, 22 bp, Homo sapiens
tctgtttaggcaaaatagctac

SEQ ID NO: 8497182 - DNA, 22 bp, Homo sapiens
tctgtttagactcagttgaaac

SEQ ID NO: 8497183 - DNA, 22 bp, Homo sapiens
tctgtttaggcaaaatagctac

SEQ ID NO: 8497184 - DNA, 22 bp, Homo sapiens
tctgtttagatgctttatctgt

SEQ ID NO: 8497185 - DNA, 22 bp, Homo sapiens
tctgttatctcaagtcacaaga

SEQ ID NO: 8497186 - DNA, 22 bp, Homo sapiens
tctgttatgcataagcatcagt

SEQ ID NO: 8497187 - DNA, 22 bp, Homo sapiens
tctgttatgcataagcatcagt

SEQ ID NO: 8497188 - DNA, 22 bp, Homo sapiens
tctgttatgcataagcatcagt

SEQ ID NO: 8497189 - DNA, 22 bp, Homo sapiens
tctgttattctgctcagtatag

SEQ ID NO: 8497190 - DNA, 20 bp, Homo sapiens
tctgttattattacattgcc

SEQ ID NO: 8497191 - DNA, 22 bp, Homo sapiens
tctgttattctgtctattgcca

SEQ ID NO: 8497192 - DNA, 22 bp, Homo sapiens
tctgttattctgtctattgcca

SEQ ID NO: 8497193 - DNA, 22 bp, Homo sapiens
tctgttcttggtgcagctggga

SEQ ID NO: 8497194 - DNA, 22 bp, Homo sapiens
tctgttctttagcctgcttgag

SEQ ID NO: 8497195 - DNA, 22 bp, Homo sapiens
tctgttcttgtccccacttcag

SEQ ID NO: 8497196 - DNA, 22 bp, Homo sapiens
tctgttgcaatgtgcatggtga

SEQ ID NO: 8497197 - DNA, 22 bp, Homo sapiens
tctgttgactcctagcagccat

SEQ ID NO: 8497198 - DNA, 22 bp, Homo sapiens
tctgttgactcctagcagccat

SEQ ID NO: 8497199 - DNA, 22 bp, Homo sapiens
tctgttgactcctagcagccat

SEQ ID NO: 8497200 - DNA, 23 bp, Homo sapiens
tctgttcttttagctgatcattt

SEQ ID NO: 8497201 - DNA, 22 bp, Homo sapiens
tctgttctttagcctgcttgag

SEQ ID NO: 8497202 - DNA, 22 bp, Homo sapiens
tctgtgttttaaacagtagaaa

SEQ ID NO: 8497203 - DNA, 22 bp, Homo sapiens
tctgtgtttaaaagatatgtcc

SEQ ID NO: 8497204 - DNA, 22 bp, Homo sapiens
tctgtgtttgccatccttgctc

SEQ ID NO: 8497205 - DNA, 20 bp, Homo sapiens
tctgtgtttcagctgcttga

SEQ ID NO: 8497206 - DNA, 18 bp, Homo sapiens
tctgtgttctgtcattgc

SEQ ID NO: 8497207 - DNA, 22 bp, Homo sapiens
tctgtgttgagaaggatcatga

SEQ ID NO: 8497208 - DNA, 22 bp, Homo sapiens
tctgtgttgataattttggaga

SEQ ID NO: 8497209 - DNA, 22 bp, Homo sapiens
tctgtgtttaaaagatatgtcc

SEQ ID NO: 8497210 - DNA, 22 bp, Homo sapiens
tctgtgtgttgtcaggaggatt

SEQ ID NO: 8497211 - DNA, 22 bp, Homo sapiens
tctgtgtgttgtcaggaggatt

SEQ ID NO: 8497212 - DNA, 22 bp, Homo sapiens
tctgtgtgttgtcaggaggatt

SEQ ID NO: 8497213 - DNA, 22 bp, Homo sapiens
tctgtgtgttgtcaggaggatt

SEQ ID NO: 8497214 - DNA, 22 bp, Homo sapiens
tctgttatctcaagtcacaaga

SEQ ID NO: 8497215 - DNA, 22 bp, Homo sapiens
tctgttatctcaagtcacaaga

SEQ ID NO: 8497216 - DNA, 22 bp, Homo sapiens
tctgttatacaacaagtaacag

SEQ ID NO: 8497217 - DNA, 22 bp, Homo sapiens
tctgttatatagataatgtgtg

SEQ ID NO: 8497218 - DNA, 22 bp, Homo sapiens
tctgttatacagtctgtggcac

SEQ ID NO: 8497219 - DNA, 22 bp, Homo sapiens
tctgttatacagtctgtggcac

SEQ ID NO: 8497220 - DNA, 22 bp, Homo sapiens
tctgttagagaggtagttcttg

SEQ ID NO: 8497221 - DNA, 22 bp, Homo sapiens
tctgttaacaggagagaatgat

SEQ ID NO: 8497222 - DNA, 22 bp, Homo sapiens
tctgttaacctggtcttggctt

SEQ ID NO: 8497223 - DNA, 22 bp, Homo sapiens
tctgttagctgtcaaagtgttt

SEQ ID NO: 8497224 - DNA, 22 bp, Homo sapiens
tctgttataaatcacactgcat

SEQ ID NO: 8497225 - DNA, 22 bp, Homo sapiens
tctgtgtgaccataagccagct

SEQ ID NO: 8497226 - DNA, 22 bp, Homo sapiens
tctgtgtgaccataagccagct

SEQ ID NO: 8497227 - DNA, 22 bp, Homo sapiens
tctgtgtgaccataagccagct

SEQ ID NO: 8497228 - DNA, 22 bp, Homo sapiens
tctgtgtgaccataagccagct

SEQ ID NO: 8497229 - DNA, 22 bp, Homo sapiens
tctgtgtgatttcagggaagtc

SEQ ID NO: 8497230 - DNA, 22 bp, Homo sapiens
tctgtgtgatttcagggaagtc

SEQ ID NO: 8497231 - DNA, 22 bp, Homo sapiens
tctgtgtgatttcagggaagtc

SEQ ID NO: 8497232 - DNA, 20 bp, Homo sapiens
tctgtgtgccatcacctaac

SEQ ID NO: 8497233 - DNA, 22 bp, Homo sapiens
tctgtgtgcccacctgacacct

SEQ ID NO: 8497234 - DNA, 22 bp, Homo sapiens
tctgtgtgcccacctgacacct

SEQ ID NO: 8497235 - DNA, 22 bp, Homo sapiens
tctgtgtgcccacctgacacct

SEQ ID NO: 8497236 - DNA, 22 bp, Homo sapiens
tctgtgtgcccacctgacacct

SEQ ID NO: 8497237 - DNA, 20 bp, Homo sapiens
tctgtgtgccatcacctaac

SEQ ID NO: 8497238 - DNA, 22 bp, Homo sapiens
tctgtgtgccctaaagcctgct

SEQ ID NO: 8497239 - DNA, 22 bp, Homo sapiens
tctgtgtgccctaaagcctgct

SEQ ID NO: 8497240 - DNA, 22 bp, Homo sapiens
tctgtgtgggatagtttgagga

SEQ ID NO: 8497241 - DNA, 22 bp, Homo sapiens
tctgtgtgccctaaagcctgct

SEQ ID NO: 8497242 - DNA, 22 bp, Homo sapiens
tctgtgtgccctaaagcctgct

SEQ ID NO: 8497243 - DNA, 22 bp, Homo sapiens
tctgtgtgggatagtttgagga

SEQ ID NO: 8497244 - DNA, 22 bp, Homo sapiens
tctgtgtgggatagtttgagga

SEQ ID NO: 8497245 - DNA, 22 bp, Homo sapiens
tctgtgtgggatagtttgagga

SEQ ID NO: 8497246 - DNA, 22 bp, Homo sapiens
tctgtgtgggatagtttgagga

SEQ ID NO: 8497247 - DNA, 22 bp, Homo sapiens
tctgtgtgtgcctgttaatatt

SEQ ID NO: 8497248 - DNA, 22 bp, Homo sapiens
tctgtgtggtagtttcagtgaa

SEQ ID NO: 8497249 - DNA, 22 bp, Homo sapiens
tctgtgtgtgcctgttaatatt

SEQ ID NO: 8497250 - DNA, 22 bp, Homo sapiens
tctgtgtgtgcctgttaatatt

SEQ ID NO: 8497251 - DNA, 22 bp, Homo sapiens
tctgtgtggtagtttcagtgaa

SEQ ID NO: 8497252 - DNA, 22 bp, Homo sapiens
tctgtgtggtagtttcagtgaa

SEQ ID NO: 8497253 - DNA, 22 bp, Homo sapiens
tctgtgtggtagtttcagtgaa

SEQ ID NO: 8497254 - DNA, 22 bp, Homo sapiens
tctgtgcctcatctggttcagg

SEQ ID NO: 8497255 - DNA, 21 bp, Homo sapiens
tctgtgcctcaaccctcatct

SEQ ID NO: 8497256 - DNA, 22 bp, Homo sapiens
tctgtgccttctcccagactta

SEQ ID NO: 8497257 - DNA, 21 bp, Homo sapiens
tctgtgcctcaaccctcatct

SEQ ID NO: 8497258 - DNA, 22 bp, Homo sapiens
tctgtgcggtctgtgttatgaa

SEQ ID NO: 8497259 - DNA, 22 bp, Homo sapiens
tctgtgcggtctgtgttatgaa

SEQ ID NO: 8497260 - DNA, 22 bp, Homo sapiens
tctgtgcctttaagaagctcat

SEQ ID NO: 8497261 - DNA, 22 bp, Homo sapiens
tctgtgctaatgcttcacaata

SEQ ID NO: 8497262 - DNA, 22 bp, Homo sapiens
tctgtgctaatttatccttcct

SEQ ID NO: 8497263 - DNA, 23 bp, Homo sapiens
tctgtgctacaaatcgcgtctgt

SEQ ID NO: 8497264 - DNA, 22 bp, Homo sapiens
tctgtgctaatgcttcacaata

SEQ ID NO: 8497265 - DNA, 23 bp, Homo sapiens
tctgtgccagtttccatgtctgt

SEQ ID NO: 8497266 - DNA, 23 bp, Homo sapiens
tctgtgccagtttccatgtctgt

SEQ ID NO: 8497267 - DNA, 22 bp, Homo sapiens
tctgtgccagcagcctcctgga

SEQ ID NO: 8497268 - DNA, 22 bp, Homo sapiens
tctgtgccacctctccagtgtc

SEQ ID NO: 8497269 - DNA, 22 bp, Homo sapiens
tctgtgccctcggtgctgggcc

SEQ ID NO: 8497270 - DNA, 22 bp, Homo sapiens
tctgtgccatcagtctccagag

SEQ ID NO: 8497271 - DNA, 22 bp, Homo sapiens
tctgtgccaagcttatatctgt

SEQ ID NO: 8497272 - DNA, 20 bp, Homo sapiens
tctgtgcattgcctgctggt

SEQ ID NO: 8497273 - DNA, 22 bp, Homo sapiens
tctgtgcagtcagggctcagtc

SEQ ID NO: 8497274 - DNA, 22 bp, Homo sapiens
tctgtctttgagatctcagcct

SEQ ID NO: 8497275 - DNA, 22 bp, Homo sapiens
tctgtctttgagatctcagcct

SEQ ID NO: 8497276 - DNA, 22 bp, Homo sapiens
tctgtgaaacagctctggcatg

SEQ ID NO: 8497277 - DNA, 22 bp, Homo sapiens
tctgtctttgtcaggaccagag

SEQ ID NO: 8497278 - DNA, 22 bp, Homo sapiens
tctgtctttgtcaggaccagag

SEQ ID NO: 8497279 - DNA, 22 bp, Homo sapiens
tctgtctttgtcaggaccagag

SEQ ID NO: 8497280 - DNA, 22 bp, Homo sapiens
tctgtctttagaggcctgtgct

SEQ ID NO: 8497281 - DNA, 22 bp, Homo sapiens
tctgtctttagaggcctgtgct

SEQ ID NO: 8497282 - DNA, 22 bp, Homo sapiens
tctgtctgcttcacttgcattt

SEQ ID NO: 8497283 - DNA, 22 bp, Homo sapiens
tctgtctgcgcttgccctggtg

SEQ ID NO: 8497284 - DNA, 22 bp, Homo sapiens
tctgtctgctcatttacctcag

SEQ ID NO: 8497285 - DNA, 22 bp, Homo sapiens
tctgtctgccttgtgagggcac

SEQ ID NO: 8497286 - DNA, 22 bp, Homo sapiens
tctgtctgagggagtgacattt

SEQ ID NO: 8497287 - DNA, 22 bp, Homo sapiens
tctgtctgagggagtgacattt

SEQ ID NO: 8497288 - DNA, 22 bp, Homo sapiens
tctgtctgcacctaagcacagt

SEQ ID NO: 8497289 - DNA, 22 bp, Homo sapiens
tctgtgaacatcacattgacag

SEQ ID NO: 8497290 - DNA, 22 bp, Homo sapiens
tctgtgaacatcacattgacag

SEQ ID NO: 8497291 - DNA, 22 bp, Homo sapiens
tctgtgaaatcacccaggttta

SEQ ID NO: 8497292 - DNA, 22 bp, Homo sapiens
tctgtgactcatatctgtagat

SEQ ID NO: 8497293 - DNA, 22 bp, Homo sapiens
tctgtgacttgcgggaggagaa

SEQ ID NO: 8497294 - DNA, 17 bp, Homo sapiens
tctgtgatagtgtagat

SEQ ID NO: 8497295 - DNA, 22 bp, Homo sapiens
tctgtgataggtggcatagtga

SEQ ID NO: 8497296 - DNA, 22 bp, Homo sapiens
tctgtgagaaccagtgccaggg

SEQ ID NO: 8497297 - DNA, 22 bp, Homo sapiens
tctgtgtctgttacttcactgc

SEQ ID NO: 8497298 - DNA, 22 bp, Homo sapiens
tctgtgtcgttctgtgctctgg

SEQ ID NO: 8497299 - DNA, 22 bp, Homo sapiens
tctgtgtatttgtgacctgtat

SEQ ID NO: 8497300 - DNA, 22 bp, Homo sapiens
tctgtgtatagggttgtgcgct

SEQ ID NO: 8497301 - DNA, 22 bp, Homo sapiens
tctgtgtcactgaggcctgtgt

SEQ ID NO: 8497302 - DNA, 22 bp, Homo sapiens
tctgtgtcagcagcactcagcc

SEQ ID NO: 8497303 - DNA, 22 bp, Homo sapiens
tctgtgtcctgctagctgtctt

SEQ ID NO: 8497304 - DNA, 22 bp, Homo sapiens
tctgtgtcctgctagctgtctt

SEQ ID NO: 8497305 - DNA, 22 bp, Homo sapiens
tctgtggctttcttatgttgta

SEQ ID NO: 8497306 - DNA, 22 bp, Homo sapiens
tctgtgtaagaccagtgctggg

SEQ ID NO: 8497307 - DNA, 22 bp, Homo sapiens
tctgtggtggagtgggcatgag

SEQ ID NO: 8497308 - DNA, 22 bp, Homo sapiens
tctgtgtaagaccagtgctggg

SEQ ID NO: 8497309 - DNA, 22 bp, Homo sapiens
tctgtgtacgcaggcgtgcgcg

SEQ ID NO: 8497310 - DNA, 18 bp, Homo sapiens
tctgtggagagggcagtt

SEQ ID NO: 8497311 - DNA, 19 bp, Homo sapiens
tctgtggagctcagagtag

SEQ ID NO: 8497312 - DNA, 22 bp, Homo sapiens
tctgtggagtgacctgggcttt

SEQ ID NO: 8497313 - DNA, 22 bp, Homo sapiens
tctgtgctttccctgccttctt

SEQ ID NO: 8497314 - DNA, 22 bp, Homo sapiens
tctgtgcttaactactcacccc

SEQ ID NO: 8497315 - DNA, 22 bp, Homo sapiens
tctgtgctttccctgccttctt

SEQ ID NO: 8497316 - DNA, 21 bp, Homo sapiens
tctgtgcttttttggctccta

SEQ ID NO: 8497317 - DNA, 22 bp, Homo sapiens
tctgtggaaatttcctgaggca

SEQ ID NO: 8497318 - DNA, 22 bp, Homo sapiens
tctgtggagtgacctgggcttt

SEQ ID NO: 8497319 - DNA, 22 bp, Homo sapiens
tctgtggagttgaggaaggttg

SEQ ID NO: 8497320 - DNA, 23 bp, Homo sapiens
tctgtggctccttcaggctgctg

SEQ ID NO: 8497321 - DNA, 22 bp, Homo sapiens
tctgtggctgtctttccagagg

SEQ ID NO: 8497322 - DNA, 22 bp, Homo sapiens
tctgtgctgccatcctgtggcc

SEQ ID NO: 8497323 - DNA, 22 bp, Homo sapiens
tctgtgctgcccaacttctcaa

SEQ ID NO: 8497324 - DNA, 22 bp, Homo sapiens
tctgtgctgagctctgagatgt

SEQ ID NO: 8497325 - DNA, 22 bp, Homo sapiens
tctgtgctcttctcagtatcac

SEQ ID NO: 8497326 - DNA, 19 bp, Homo sapiens
tctgtgctgggaggcagca

SEQ ID NO: 8497327 - DNA, 19 bp, Homo sapiens
tctgtgctgggaggcagca

SEQ ID NO: 8497328 - DNA, 21 bp, Homo sapiens
tctgtgctgccgtcaacatcc

SEQ ID NO: 8497329 - DNA, 22 bp, Homo sapiens
tctgtgctggactgatttcata

SEQ ID NO: 8497330 - DNA, 22 bp, Homo sapiens
tctgtgctagaggagttggcca

SEQ ID NO: 8497331 - DNA, 22 bp, Homo sapiens
tctgtgctaggcagcctggccc

SEQ ID NO: 8497332 - DNA, 20 bp, Homo sapiens
tctgtgctacactccagatt

SEQ ID NO: 8497333 - DNA, 22 bp, Homo sapiens
tctgtgctcaagttctgcctct

SEQ ID NO: 8497334 - DNA, 22 bp, Homo sapiens
tctgtgctcattcagtcattca

SEQ ID NO: 8497335 - DNA, 23 bp, Homo sapiens
tctgtgctcgggggagctctctg

SEQ ID NO: 8497336 - DNA, 22 bp, Homo sapiens
tctgtgctcattcagtcattca

SEQ ID NO: 8497337 - DNA, 22 bp, Homo sapiens
tctgtaatcaagatatttgaga

SEQ ID NO: 8497338 - DNA, 22 bp, Homo sapiens
tctgtaatcaagatatttgaga

SEQ ID NO: 8497339 - DNA, 19 bp, Homo sapiens
tctgtaacactctagcctt

SEQ ID NO: 8497340 - DNA, 22 bp, Homo sapiens
tctgtacaaaggctatttggag

SEQ ID NO: 8497341 - DNA, 22 bp, Homo sapiens
tctgtacaaaggctatttggag

SEQ ID NO: 8497342 - DNA, 22 bp, Homo sapiens
tctgtacaacaaagggatgaga

SEQ ID NO: 8497343 - DNA, 22 bp, Homo sapiens
tctgtaatcttccccagctcag

SEQ ID NO: 8497344 - DNA, 22 bp, Homo sapiens
tctgtaaagatgtttatacctt

SEQ ID NO: 8497345 - DNA, 23 bp, Homo sapiens
tctgtacaattgagaagagaaca

SEQ ID NO: 8497346 - DNA, 22 bp, Homo sapiens
tctgtacaacaaagggatgaga

SEQ ID NO: 8497347 - DNA, 23 bp, Homo sapiens
tctgtacacatcagcatctccca

SEQ ID NO: 8497348 - DNA, 23 bp, Homo sapiens
tctgtacacatcagcatctccca

SEQ ID NO: 8497349 - DNA, 23 bp, Homo sapiens
tctgtacacatcagcatctccca

SEQ ID NO: 8497350 - DNA, 23 bp, Homo sapiens
tctgtacacatcagcatctccca

SEQ ID NO: 8497351 - DNA, 22 bp, Homo sapiens
tctgtacacttcagcatgcatc

SEQ ID NO: 8497352 - DNA, 20 bp, Homo sapiens
tctgtacactcatcttctgc

SEQ ID NO: 8497353 - DNA, 20 bp, Homo sapiens
tctgtacactcatcttctgc

SEQ ID NO: 8497354 - DNA, 20 bp, Homo sapiens
tctgtacactcatcttctgc

SEQ ID NO: 8497355 - DNA, 22 bp, Homo sapiens
tctgtacaccaggggccattct

SEQ ID NO: 8497356 - DNA, 20 bp, Homo sapiens
tctgtacactcatcttctgc

SEQ ID NO: 8497357 - DNA, 20 bp, Homo sapiens
tctgtacactcatcttctgc

SEQ ID NO: 8497358 - DNA, 21 bp, Homo sapiens
tctgtacatcattgagtcccc

SEQ ID NO: 8497359 - DNA, 21 bp, Homo sapiens
tctgtacatcattgagtcccc

SEQ ID NO: 8497360 - DNA, 22 bp, Homo sapiens
tctgtacagtaccagatagtaa

SEQ ID NO: 8497361 - DNA, 22 bp, Homo sapiens
tctgtacagtaccagatagtaa

SEQ ID NO: 8497362 - DNA, 22 bp, Homo sapiens
tctgtacatgagttgagaatca

SEQ ID NO: 8497363 - DNA, 21 bp, Homo sapiens
tctgtacatcattgagtcccc

SEQ ID NO: 8497364 - DNA, 22 bp, Homo sapiens
tctgtacagtaccagatagtaa

SEQ ID NO: 8497365 - DNA, 22 bp, Homo sapiens
tctgtacagtaccagatagtaa

SEQ ID NO: 8497366 - DNA, 22 bp, Homo sapiens
tctgtacagtaccagatagtaa

SEQ ID NO: 8497367 - DNA, 22 bp, Homo sapiens
tctgtacagtaccagatagtaa

SEQ ID NO: 8497368 - DNA, 22 bp, Homo sapiens
tctgtacacttcagcatgcatc

SEQ ID NO: 8497369 - DNA, 22 bp, Homo sapiens
tctgtacagtaccagatagtaa

SEQ ID NO: 8497370 - DNA, 22 bp, Homo sapiens
tctgtacatttggggaccccag

SEQ ID NO: 8497371 - DNA, 22 bp, Homo sapiens
tctgtacatttggggaccccag

SEQ ID NO: 8497372 - DNA, 22 bp, Homo sapiens
tctgtacatttgtgttgtgaat

SEQ ID NO: 8497373 - DNA, 22 bp, Homo sapiens
tctgtacatttgtgttgtgaat

SEQ ID NO: 8497374 - DNA, 22 bp, Homo sapiens
tctgtacatttgtgttgtgaat

SEQ ID NO: 8497375 - DNA, 22 bp, Homo sapiens
tctgtagcaagtgagaggcatt

SEQ ID NO: 8497376 - DNA, 22 bp, Homo sapiens
tctgtagagacgaatgtgttat

SEQ ID NO: 8497377 - DNA, 22 bp, Homo sapiens
tctgtagtaggttgtagttctt

SEQ ID NO: 8497378 - DNA, 22 bp, Homo sapiens
tctgtagtaggttgtagttctt

SEQ ID NO: 8497379 - DNA, 22 bp, Homo sapiens
tctgtaggttaaaagtagacaa

SEQ ID NO: 8497380 - DNA, 22 bp, Homo sapiens
tctgtagcaagtgagaggcatt

SEQ ID NO: 8497381 - DNA, 22 bp, Homo sapiens
tctgtagcattcaccagccctg

SEQ ID NO: 8497382 - DNA, 22 bp, Homo sapiens
tctgtagcttcttgagaggcca

SEQ ID NO: 8497383 - DNA, 20 bp, Homo sapiens
tctgtaggcaagttagcagg

SEQ ID NO: 8497384 - DNA, 20 bp, Homo sapiens
tctgtagtctatgaggctta

SEQ ID NO: 8497385 - DNA, 20 bp, Homo sapiens
tctgtagtctgtggcaagac

SEQ ID NO: 8497386 - DNA, 22 bp, Homo sapiens
tctgtatctaattttacagtag

SEQ ID NO: 8497387 - DNA, 22 bp, Homo sapiens
tctgtattgagaaagccggaca

SEQ ID NO: 8497388 - DNA, 22 bp, Homo sapiens
tctgtatatattaatgaaattc

SEQ ID NO: 8497389 - DNA, 22 bp, Homo sapiens
tctgtatcacccgttcccagaa

SEQ ID NO: 8497390 - DNA, 22 bp, Homo sapiens
tctgtatcacccgttcccagaa

SEQ ID NO: 8497391 - DNA, 22 bp, Homo sapiens
tctgtattttaagatgctgttt

SEQ ID NO: 8497392 - DNA, 22 bp, Homo sapiens
tctgtattgattctgttaggca

SEQ ID NO: 8497393 - DNA, 22 bp, Homo sapiens
tctgtcacaatttgcttactct

SEQ ID NO: 8497394 - DNA, 22 bp, Homo sapiens
tctgtcaccattcagcttgaat

SEQ ID NO: 8497395 - DNA, 22 bp, Homo sapiens
tctgtcacccagagtgcagtgg

SEQ ID NO: 8497396 - DNA, 22 bp, Homo sapiens
tctgtcacccaggctggagtgc

SEQ ID NO: 8497397 - DNA, 22 bp, Homo sapiens
tctgtcacccaggctggagtgc

SEQ ID NO: 8497398 - DNA, 22 bp, Homo sapiens
tctgtccattcagccatccatc

SEQ ID NO: 8497399 - DNA, 22 bp, Homo sapiens
tctgtccagtggctctcaggga

SEQ ID NO: 8497400 - DNA, 17 bp, Homo sapiens
tctgtccagggagtgtg

SEQ ID NO: 8497401 - DNA, 22 bp, Homo sapiens
tctgtccaggcttactatatat

SEQ ID NO: 8497402 - DNA, 22 bp, Homo sapiens
tctgtcctccacactgtaagtt

SEQ ID NO: 8497403 - DNA, 22 bp, Homo sapiens
tctgtccattttccattttggc

SEQ ID NO: 8497404 - DNA, 22 bp, Homo sapiens
tctgtccagaacgtacatcttg

SEQ ID NO: 8497405 - DNA, 22 bp, Homo sapiens
tctgtcattagccttgactgta

SEQ ID NO: 8497406 - DNA, 22 bp, Homo sapiens
tctgtcatttcaatatggttaa

SEQ ID NO: 8497407 - DNA, 22 bp, Homo sapiens
tctgtcatttcaatatggttaa

SEQ ID NO: 8497408 - DNA, 22 bp, Homo sapiens
tctgtcatctgttcagtgctca

SEQ ID NO: 8497409 - DNA, 22 bp, Homo sapiens
tctgtcacccaggctggagtgc

SEQ ID NO: 8497410 - DNA, 22 bp, Homo sapiens
tctgtcatctctaaaatagaaa

SEQ ID NO: 8497411 - DNA, 22 bp, Homo sapiens
tctgtcctgtttcctcctgaca

SEQ ID NO: 8497412 - DNA, 22 bp, Homo sapiens
tctgtctcaagttcttgcactc

SEQ ID NO: 8497413 - DNA, 22 bp, Homo sapiens
tctgtctcaagttcttgcactc

SEQ ID NO: 8497414 - DNA, 22 bp, Homo sapiens
tctgtctcaagttcttgcactc

SEQ ID NO: 8497415 - DNA, 22 bp, Homo sapiens
tctgtctcctctgaggtgccag

SEQ ID NO: 8497416 - DNA, 22 bp, Homo sapiens
tctgtctcctctgaggtgccag

SEQ ID NO: 8497417 - DNA, 22 bp, Homo sapiens
tctgtctcctctgaggtgccag

SEQ ID NO: 8497418 - DNA, 22 bp, Homo sapiens
tctgtctcctcagatgactcca

SEQ ID NO: 8497419 - DNA, 22 bp, Homo sapiens
tctgtctcaagttcttgcactc

SEQ ID NO: 8497420 - DNA, 22 bp, Homo sapiens
tctgtctgacagggtatgaact

SEQ ID NO: 8497421 - DNA, 22 bp, Homo sapiens
tctgtctctttgttctgtgagt

SEQ ID NO: 8497422 - DNA, 20 bp, Homo sapiens
tctgtctctgagctagactt

SEQ ID NO: 8497423 - DNA, 18 bp, Homo sapiens
tctgtctctgtccttgct

SEQ ID NO: 8497424 - DNA, 18 bp, Homo sapiens
tctgtctctgtccttgct

SEQ ID NO: 8497425 - DNA, 18 bp, Homo sapiens
tctgtctctgtccttgct

SEQ ID NO: 8497426 - DNA, 22 bp, Homo sapiens
tctgtctcctgccagtgcctct

SEQ ID NO: 8497427 - DNA, 22 bp, Homo sapiens
tctgtctcctgccagtgcctct

SEQ ID NO: 8497428 - DNA, 22 bp, Homo sapiens
tctgtctcctctgaggtgccag

SEQ ID NO: 8497429 - DNA, 22 bp, Homo sapiens
tctgtctcctctgaggtgccag

SEQ ID NO: 8497430 - DNA, 22 bp, Homo sapiens
tctgtctcctgccagtgcctct

SEQ ID NO: 8497431 - DNA, 22 bp, Homo sapiens
tctgtctcctgccagtgcctct

SEQ ID NO: 8497432 - DNA, 21 bp, Homo sapiens
tctgtctctccactgccctgc

SEQ ID NO: 8497433 - DNA, 21 bp, Homo sapiens
tctgtctctccactgccctgc

SEQ ID NO: 8497434 - DNA, 21 bp, Homo sapiens
tctgtctctccactgccctgc

SEQ ID NO: 8497435 - DNA, 22 bp, Homo sapiens
tctgtctctcaagggccgtcct

SEQ ID NO: 8497436 - DNA, 22 bp, Homo sapiens
tctgtctctcaagggccgtcct

SEQ ID NO: 8497437 - DNA, 22 bp, Homo sapiens
tctgggctggtgctcatgaatt

SEQ ID NO: 8497438 - DNA, 22 bp, Homo sapiens
tctgggctggtgctcatgaatt

SEQ ID NO: 8497439 - DNA, 22 bp, Homo sapiens
tctgggctgtctacaggttggc

SEQ ID NO: 8497440 - DNA, 22 bp, Homo sapiens
tctgggctgggagcgtgtggac

SEQ ID NO: 8497441 - DNA, 22 bp, Homo sapiens
tctgggctgcttcagccttcgc

SEQ ID NO: 8497442 - DNA, 18 bp, Homo sapiens
tctgggcttcccgaggct

SEQ ID NO: 8497443 - DNA, 22 bp, Homo sapiens
tctgggctgtggttccactccg

SEQ ID NO: 8497444 - DNA, 22 bp, Homo sapiens
tctgggctgtggttccactccg

SEQ ID NO: 8497445 - DNA, 17 bp, Homo sapiens
tctgggcttcagtggtc

SEQ ID NO: 8497446 - DNA, 21 bp, Homo sapiens
tctgggggtgagcctagaaat

SEQ ID NO: 8497447 - DNA, 22 bp, Homo sapiens
tctgggggaggaggcatggccc

SEQ ID NO: 8497448 - DNA, 22 bp, Homo sapiens
tctgggggcgaccagggactgc

SEQ ID NO: 8497449 - DNA, 22 bp, Homo sapiens
tctgggggaggaggcatggccc

SEQ ID NO: 8497450 - DNA, 22 bp, Homo sapiens
tctggggatgagtgatgtcgta

SEQ ID NO: 8497451 - DNA, 22 bp, Homo sapiens
tctgggctttacactgtgctta

SEQ ID NO: 8497452 - DNA, 22 bp, Homo sapiens
tctgggctttgtaatgggaggt

SEQ ID NO: 8497453 - DNA, 22 bp, Homo sapiens
tctgggcttggttagggctgtt

SEQ ID NO: 8497454 - DNA, 22 bp, Homo sapiens
tctgggtgccctttgctctgtt

SEQ ID NO: 8497455 - DNA, 22 bp, Homo sapiens
tctgggtgccctttgctctgtt

SEQ ID NO: 8497456 - DNA, 22 bp, Homo sapiens
tctgggtgccctttgctctgtt

SEQ ID NO: 8497457 - DNA, 22 bp, Homo sapiens
tctgggtgccactgtctgtaca

SEQ ID NO: 8497458 - DNA, 22 bp, Homo sapiens
tctgggtgccactgtctgtaca

SEQ ID NO: 8497459 - DNA, 22 bp, Homo sapiens
tctgggtgccactgtctgtaca

SEQ ID NO: 8497460 - DNA, 22 bp, Homo sapiens
tctgggtgatgaaatgcactgt

SEQ ID NO: 8497461 - DNA, 22 bp, Homo sapiens
tctgggtgatgaaatgcactgt

SEQ ID NO: 8497462 - DNA, 22 bp, Homo sapiens
tctgggtggcttcagaggccac

SEQ ID NO: 8497463 - DNA, 22 bp, Homo sapiens
tctgggtggctgccaatctgcc

SEQ ID NO: 8497464 - DNA, 21 bp, Homo sapiens
tctgggtgctagtgtttgctt

SEQ ID NO: 8497465 - DNA, 22 bp, Homo sapiens
tctgggtgctacaaacagtatt

SEQ ID NO: 8497466 - DNA, 21 bp, Homo sapiens
tctgggtgctagtgtttgctt

SEQ ID NO: 8497467 - DNA, 22 bp, Homo sapiens
tctgtaaaattagtataattgt

SEQ ID NO: 8497468 - DNA, 22 bp, Homo sapiens
tctgtaaacaccatgttagagt

SEQ ID NO: 8497469 - DNA, 22 bp, Homo sapiens
tctgtaaaacttctttgtaaat

SEQ ID NO: 8497470 - DNA, 22 bp, Homo sapiens
tctgggttgggttcctggaatt

SEQ ID NO: 8497471 - DNA, 17 bp, Homo sapiens
tctgggtttaaatccca

SEQ ID NO: 8497472 - DNA, 22 bp, Homo sapiens
tctggtttcccagttcctccgt

SEQ ID NO: 8497473 - DNA, 22 bp, Homo sapiens
tctgtaaaacttctttgtaaat

SEQ ID NO: 8497474 - DNA, 22 bp, Homo sapiens
tctgggtgtcactcctgcctgc

SEQ ID NO: 8497475 - DNA, 22 bp, Homo sapiens
tctgggtgtagggcctggcaac

SEQ ID NO: 8497476 - DNA, 20 bp, Homo sapiens
tctgggttgaaatcaagatc

SEQ ID NO: 8497477 - DNA, 22 bp, Homo sapiens
tctgggttcttgatgctacctt

SEQ ID NO: 8497478 - DNA, 19 bp, Homo sapiens
tctggggtgtggcctggca

SEQ ID NO: 8497479 - DNA, 19 bp, Homo sapiens
tctggggtgtggcctggca

SEQ ID NO: 8497480 - DNA, 22 bp, Homo sapiens
tctgggtctcagagtgaccatg

SEQ ID NO: 8497481 - DNA, 22 bp, Homo sapiens
tctgggtcttagttttcttgat

SEQ ID NO: 8497482 - DNA, 22 bp, Homo sapiens
tctgggtctatgatctcacttc

SEQ ID NO: 8497483 - DNA, 22 bp, Homo sapiens
tctgggtctatcccatgccttt

SEQ ID NO: 8497484 - DNA, 19 bp, Homo sapiens
tctgggtatttggaagatg

SEQ ID NO: 8497485 - DNA, 22 bp, Homo sapiens
tctgggtaatcagggctgggag

SEQ ID NO: 8497486 - DNA, 22 bp, Homo sapiens
tctatttcgcatataagttttg

SEQ ID NO: 8497487 - DNA, 20 bp, Homo sapiens
tctatttgtaaagggctgtg

SEQ ID NO: 8497488 - DNA, 22 bp, Homo sapiens
tctatttgctggttgcttctgt

SEQ ID NO: 8497489 - DNA, 22 bp, Homo sapiens
tctatttgttctcaggatcatc

SEQ ID NO: 8497490 - DNA, 22 bp, Homo sapiens
tctattttatactcaaatcttc

SEQ ID NO: 8497491 - DNA, 22 bp, Homo sapiens
tctattgtaggcatgtagcttg

SEQ ID NO: 8497492 - DNA, 22 bp, Homo sapiens
tctatttaccaaatgtagttcc

SEQ ID NO: 8497493 - DNA, 22 bp, Homo sapiens
tctattcaggcagagtgcagca

SEQ ID NO: 8497494 - DNA, 22 bp, Homo sapiens
tctattcattcaatttagctct

SEQ ID NO: 8497495 - DNA, 22 bp, Homo sapiens
tctattgattggcttcctggat

SEQ ID NO: 8497496 - DNA, 22 bp, Homo sapiens
tctcaaagtagctcccacagat

SEQ ID NO: 8497497 - DNA, 22 bp, Homo sapiens
tctcaaactaacaatgattata

SEQ ID NO: 8497498 - DNA, 18 bp, Homo sapiens
tctcaaaaataatggctt

SEQ ID NO: 8497499 - DNA, 22 bp, Homo sapiens
tctcaaatatttggagagagga

SEQ ID NO: 8497500 - DNA, 23 bp, Homo sapiens
tctcaaatatgatctgggtcatc

SEQ ID NO: 8497501 - DNA, 18 bp, Homo sapiens
tctcaaaaataatggctt

SEQ ID NO: 8497502 - DNA, 22 bp, Homo sapiens
tctatttttatagttgaagtgc

SEQ ID NO: 8497503 - DNA, 22 bp, Homo sapiens
tctatttttatagttgaagtgc

SEQ ID NO: 8497504 - DNA, 22 bp, Homo sapiens
tctatttttatagttgaagtgc

SEQ ID NO: 8497505 - DNA, 22 bp, Homo sapiens
tctattttgtttccagctctac

SEQ ID NO: 8497506 - DNA, 22 bp, Homo sapiens
tctcacagcatcattgctcatg

SEQ ID NO: 8497507 - DNA, 22 bp, Homo sapiens
tctcacagggctaggccctgcc

SEQ ID NO: 8497508 - DNA, 22 bp, Homo sapiens
tctcacagggctaggccctgcc

SEQ ID NO: 8497509 - DNA, 22 bp, Homo sapiens
tctcacactatttcaggtgact

SEQ ID NO: 8497510 - DNA, 22 bp, Homo sapiens
tctcacactatttattctgctt

SEQ ID NO: 8497511 - DNA, 22 bp, Homo sapiens
tctcacactatttattctgctt

SEQ ID NO: 8497512 - DNA, 22 bp, Homo sapiens
tctcacactatttattctgctt

SEQ ID NO: 8497513 - DNA, 22 bp, Homo sapiens
tctcacactaatgctctatcag

SEQ ID NO: 8497514 - DNA, 22 bp, Homo sapiens
tctcacaccgtccctaaaccat

SEQ ID NO: 8497515 - DNA, 22 bp, Homo sapiens
tctcacacttctgtgttgcaca

SEQ ID NO: 8497516 - DNA, 22 bp, Homo sapiens
tctcacacttctgtgttgcaca

SEQ ID NO: 8497517 - DNA, 22 bp, Homo sapiens
tctcacagcaggggccaggtct

SEQ ID NO: 8497518 - DNA, 19 bp, Homo sapiens
tctcacaagcaacattgtt

SEQ ID NO: 8497519 - DNA, 22 bp, Homo sapiens
tctcacacaacatgttactttg

SEQ ID NO: 8497520 - DNA, 21 bp, Homo sapiens
tctcacaatatgatgccagat

SEQ ID NO: 8497521 - DNA, 19 bp, Homo sapiens
tctcacaagcaacattgtt

SEQ ID NO: 8497522 - DNA, 22 bp, Homo sapiens
tctcaaatggacaatattgtgg

SEQ ID NO: 8497523 - DNA, 22 bp, Homo sapiens
tctcaaatgtaaagcatgattt

SEQ ID NO: 8497524 - DNA, 21 bp, Homo sapiens
tctatgcaagaccctagtcct

SEQ ID NO: 8497525 - DNA, 22 bp, Homo sapiens
tctatcctgcttagaagtatgt

SEQ ID NO: 8497526 - DNA, 22 bp, Homo sapiens
tctataaagggccagatagtag

SEQ ID NO: 8497527 - DNA, 22 bp, Homo sapiens
tctataaagggccagatagtag

SEQ ID NO: 8497528 - DNA, 22 bp, Homo sapiens
tctataaatgcagatatgtgtg

SEQ ID NO: 8497529 - DNA, 23 bp, Homo sapiens
tctattacttattgtactctgga

SEQ ID NO: 8497530 - DNA, 23 bp, Homo sapiens
tctattacttattgtactctgga

SEQ ID NO: 8497531 - DNA, 22 bp, Homo sapiens
tctattagattattctcaagga

SEQ ID NO: 8497532 - DNA, 22 bp, Homo sapiens
tctattacttaccactaattca

SEQ ID NO: 8497533 - DNA, 22 bp, Homo sapiens
tctattacttaccactaattca

SEQ ID NO: 8497534 - DNA, 19 bp, Homo sapiens
tctatgtggcagtgatggc

SEQ ID NO: 8497535 - DNA, 22 bp, Homo sapiens
tctattaatgattcaatagtgt

SEQ ID NO: 8497536 - DNA, 22 bp, Homo sapiens
tctatgtagtgccagctagtat

SEQ ID NO: 8497537 - DNA, 22 bp, Homo sapiens
tctatgcttgagacagatgggg

SEQ ID NO: 8497538 - DNA, 22 bp, Homo sapiens
tctatgtctccaccttcgcaga

SEQ ID NO: 8497539 - DNA, 22 bp, Homo sapiens
tctatgtgccctttgtgtgatg

SEQ ID NO: 8497540 - DNA, 22 bp, Homo sapiens
tctatgtcagcatctttctacc

SEQ ID NO: 8497541 - DNA, 22 bp, Homo sapiens
tctatgtcctttctcccattcc

SEQ ID NO: 8497542 - DNA, 22 bp, Homo sapiens
tctagggagctctagcagtggt

SEQ ID NO: 8497543 - DNA, 22 bp, Homo sapiens
tctaggccgtaggatacagagc

SEQ ID NO: 8497544 - DNA, 22 bp, Homo sapiens
tctaggttagaacccagaaaag

SEQ ID NO: 8497545 - DNA, 22 bp, Homo sapiens
tctaggttagaacccagaaaag

SEQ ID NO: 8497546 - DNA, 22 bp, Homo sapiens
tctaggttcatgggattcagtg

SEQ ID NO: 8497547 - DNA, 22 bp, Homo sapiens
tctagtcatattttttcagtat

SEQ ID NO: 8497548 - DNA, 22 bp, Homo sapiens
tctagggttgaggccacaggga

SEQ ID NO: 8497549 - DNA, 22 bp, Homo sapiens
tctataaaactcaagagcaatt

SEQ ID NO: 8497550 - DNA, 22 bp, Homo sapiens
tctataaaactcaagagcaatt

SEQ ID NO: 8497551 - DNA, 22 bp, Homo sapiens
tctataaaactcaagagcaatt

SEQ ID NO: 8497552 - DNA, 22 bp, Homo sapiens
tctataaagggccagatagtag

SEQ ID NO: 8497553 - DNA, 22 bp, Homo sapiens
tctataaagggccagatagtag

SEQ ID NO: 8497554 - DNA, 22 bp, Homo sapiens
tctataaagggccagatagtag

SEQ ID NO: 8497555 - DNA, 22 bp, Homo sapiens
tctataaaactcaagagcaatt

SEQ ID NO: 8497556 - DNA, 22 bp, Homo sapiens
tctataaagggccagatagtag

SEQ ID NO: 8497557 - DNA, 22 bp, Homo sapiens
tctagttctagatccctgagga

SEQ ID NO: 8497558 - DNA, 22 bp, Homo sapiens
tctagttctagatccctgagga

SEQ ID NO: 8497559 - DNA, 22 bp, Homo sapiens
tctagttaattcctttggtgtt

SEQ ID NO: 8497560 - DNA, 22 bp, Homo sapiens
tctagtgttttggaacatggaa

SEQ ID NO: 8497561 - DNA, 22 bp, Homo sapiens
tctaccactaagtgtgctttga

SEQ ID NO: 8497562 - DNA, 22 bp, Homo sapiens
tctaccacttattagctctgtg

SEQ ID NO: 8497563 - DNA, 22 bp, Homo sapiens
tctaccactcatgctacttact

SEQ ID NO: 8497564 - DNA, 22 bp, Homo sapiens
tctaccactttgacctctctgt

SEQ ID NO: 8497565 - DNA, 22 bp, Homo sapiens
tctaccagggtcacagaggccc

SEQ ID NO: 8497566 - DNA, 23 bp, Homo sapiens
tctacccacactgctctagaagg

SEQ ID NO: 8497567 - DNA, 22 bp, Homo sapiens
tctaccctgcggtcttggggca

SEQ ID NO: 8497568 - DNA, 17 bp, Homo sapiens
tctactcctgaaggaag

SEQ ID NO: 8497569 - DNA, 22 bp, Homo sapiens
tctactgcactggtgtctcatc

SEQ ID NO: 8497570 - DNA, 22 bp, Homo sapiens
tctactgtagtgatgctgcagt

SEQ ID NO: 8497571 - DNA, 22 bp, Homo sapiens
tctactgtggtccttgtaacca

SEQ ID NO: 8497572 - DNA, 22 bp, Homo sapiens
tctactttataagtatataagt

SEQ ID NO: 8497573 - DNA, 22 bp, Homo sapiens
tctacttttccctatacagttt

SEQ ID NO: 8497574 - DNA, 22 bp, Homo sapiens
tctactttcactcatacttatt

SEQ ID NO: 8497575 - DNA, 22 bp, Homo sapiens
tctagaaaaaaactgctgtgga

SEQ ID NO: 8497576 - DNA, 22 bp, Homo sapiens
tctacttttccctatacagttt

SEQ ID NO: 8497577 - DNA, 22 bp, Homo sapiens
tctagacaatgcactgtaagga

SEQ ID NO: 8497578 - DNA, 19 bp, Homo sapiens
tctagacaccaaagttgtc

SEQ ID NO: 8497579 - DNA, 22 bp, Homo sapiens
tctagaaacaggtttctagaaa

SEQ ID NO: 8497580 - DNA, 22 bp, Homo sapiens
tctagaaaaccaatattacatg

SEQ ID NO: 8497581 - DNA, 22 bp, Homo sapiens
tctagaaaaccaatattacatg

SEQ ID NO: 8497582 - DNA, 22 bp, Homo sapiens
tctagaaaaccaatattacatg

SEQ ID NO: 8497583 - DNA, 22 bp, Homo sapiens
tctaggagaaccatcagggagg

SEQ ID NO: 8497584 - DNA, 22 bp, Homo sapiens
tctaggagcatgaagggaaggc

SEQ ID NO: 8497585 - DNA, 22 bp, Homo sapiens
tctaggaggcggagattgcagt

SEQ ID NO: 8497586 - DNA, 20 bp, Homo sapiens
tctaggcaggcaggctcgtg

SEQ ID NO: 8497587 - DNA, 22 bp, Homo sapiens
tctagctgtggtcgagtgagga

SEQ ID NO: 8497588 - DNA, 22 bp, Homo sapiens
tctagctgccccgaggcagggt

SEQ ID NO: 8497589 - DNA, 22 bp, Homo sapiens
tctagcttggcgtttgccttct

SEQ ID NO: 8497590 - DNA, 20 bp, Homo sapiens
tctagcttagtgcctgcctc

SEQ ID NO: 8497591 - DNA, 22 bp, Homo sapiens
tctagctctgcttatcatggct

SEQ ID NO: 8497592 - DNA, 22 bp, Homo sapiens
tctagcatttctttcctgagga

SEQ ID NO: 8497593 - DNA, 22 bp, Homo sapiens
tctagctctgcttatcatggct

SEQ ID NO: 8497594 - DNA, 22 bp, Homo sapiens
tctagctgagggtaggagacct

SEQ ID NO: 8497595 - DNA, 22 bp, Homo sapiens
tctagagactataatgtgtcct

SEQ ID NO: 8497596 - DNA, 22 bp, Homo sapiens
tctagagactataatgtgtcct

SEQ ID NO: 8497597 - DNA, 22 bp, Homo sapiens
tctagagatacattggtcattt

SEQ ID NO: 8497598 - DNA, 22 bp, Homo sapiens
tctagacctggcactgccctgt

SEQ ID NO: 8497599 - DNA, 22 bp, Homo sapiens
tctagacatcttggctgcaatt

SEQ ID NO: 8497600 - DNA, 22 bp, Homo sapiens
tctagatttggggcatgaagtt

SEQ ID NO: 8497601 - DNA, 22 bp, Homo sapiens
tctagatttggggcatgaagtt

SEQ ID NO: 8497602 - DNA, 22 bp, Homo sapiens
tctagcaagctcgtgctcaagg

SEQ ID NO: 8497603 - DNA, 22 bp, Homo sapiens
tctagcaccacattaaatagca

SEQ ID NO: 8497604 - DNA, 22 bp, Homo sapiens
tctagcaagctcgtgctcaagg

SEQ ID NO: 8497605 - DNA, 22 bp, Homo sapiens
tctagcagggaaagcagagaat

SEQ ID NO: 8497606 - DNA, 22 bp, Homo sapiens
tctagcatctaattatggaatc

SEQ ID NO: 8497607 - DNA, 19 bp, Homo sapiens
tctaacagaagtgtcgtcc

SEQ ID NO: 8497608 - DNA, 22 bp, Homo sapiens
tctaacagaaattctgacaaaa

SEQ ID NO: 8497609 - DNA, 22 bp, Homo sapiens
tctaacttagggaatactttag

SEQ ID NO: 8497610 - DNA, 22 bp, Homo sapiens
tctaacttgaactcatgactgt

SEQ ID NO: 8497611 - DNA, 22 bp, Homo sapiens
tctaactctgccaggacacaga

SEQ ID NO: 8497612 - DNA, 22 bp, Homo sapiens
tctaactatacaaagaaaacat

SEQ ID NO: 8497613 - DNA, 22 bp, Homo sapiens
tctaactaactacagtaagagg

SEQ ID NO: 8497614 - DNA, 22 bp, Homo sapiens
tctaactatacaaagaaaacat

SEQ ID NO: 8497615 - DNA, 22 bp, Homo sapiens
tctaacattgtttttcacagat

SEQ ID NO: 8497616 - DNA, 19 bp, Homo sapiens
tctaacagctttcattcta

SEQ ID NO: 8497617 - DNA, 22 bp, Homo sapiens
tctaacctttgaaactgctttc

SEQ ID NO: 8497618 - DNA, 22 bp, Homo sapiens
tctaactaactacagtaagagg

SEQ ID NO: 8497619 - DNA, 22 bp, Homo sapiens
tctaaccttgtggtctgctggt

SEQ ID NO: 8497620 - DNA, 22 bp, Homo sapiens
tctaacttgtatgtatagtttt

SEQ ID NO: 8497621 - DNA, 22 bp, Homo sapiens
tctaacttgtgagtatagatga

SEQ ID NO: 8497622 - DNA, 22 bp, Homo sapiens
tctaattgaatctaagcatgtt

SEQ ID NO: 8497623 - DNA, 22 bp, Homo sapiens
tctaattgcaattctcagagat

SEQ ID NO: 8497624 - DNA, 22 bp, Homo sapiens
tctacaaagaagaattaatgtc

SEQ ID NO: 8497625 - DNA, 22 bp, Homo sapiens
tctacagggtcagagtttcatg

SEQ ID NO: 8497626 - DNA, 22 bp, Homo sapiens
tctacaggtggggcctggcaat

SEQ ID NO: 8497627 - DNA, 22 bp, Homo sapiens
tctacagggtaaggggcttgcc

SEQ ID NO: 8497628 - DNA, 22 bp, Homo sapiens
tctacagccattttgagcagtg

SEQ ID NO: 8497629 - DNA, 22 bp, Homo sapiens
tctacagtcaagttatattgct

SEQ ID NO: 8497630 - DNA, 22 bp, Homo sapiens
tctacagtgtcaatgtgtcttg

SEQ ID NO: 8497631 - DNA, 22 bp, Homo sapiens
tctacaggtggggcctggcaat

SEQ ID NO: 8497632 - DNA, 22 bp, Homo sapiens
tctacagtagaaagatcccagt

SEQ ID NO: 8497633 - DNA, 22 bp, Homo sapiens
tctacattttctttatgtacat

SEQ ID NO: 8497634 - DNA, 22 bp, Homo sapiens
tctacattttaacaagatgccc

SEQ ID NO: 8497635 - DNA, 22 bp, Homo sapiens
tctacattttcacaaggtctcc

SEQ ID NO: 8497636 - DNA, 22 bp, Homo sapiens
tctacatgatgtaccatctaag

SEQ ID NO: 8497637 - DNA, 22 bp, Homo sapiens
tctacaatgagaaatgatcagt

SEQ ID NO: 8497638 - DNA, 22 bp, Homo sapiens
tctacaaataaattactatgta

SEQ ID NO: 8497639 - DNA, 22 bp, Homo sapiens
tctacaaataaattactatgta

SEQ ID NO: 8497640 - DNA, 22 bp, Homo sapiens
tctacaaataaattactatgta

SEQ ID NO: 8497641 - DNA, 19 bp, Homo sapiens
tctacaaagtggcatcagg

SEQ ID NO: 8497642 - DNA, 19 bp, Homo sapiens
tctacaaagtggcatcagg

SEQ ID NO: 8497643 - DNA, 22 bp, Homo sapiens
tctacaaaggttgaggtgccct

SEQ ID NO: 8497644 - DNA, 22 bp, Homo sapiens
tctacagagagtcatagactca

SEQ ID NO: 8497645 - DNA, 22 bp, Homo sapiens
tctacagacagagcaggtggga

SEQ ID NO: 8497646 - DNA, 22 bp, Homo sapiens
tctacacatttgtaaaggcatt

SEQ ID NO: 8497647 - DNA, 22 bp, Homo sapiens
tctacacatttgtaaaggcatt

SEQ ID NO: 8497648 - DNA, 22 bp, Homo sapiens
tctacactgtagaattataagg

SEQ ID NO: 8497649 - DNA, 22 bp, Homo sapiens
tctacactgggggctttgagca

SEQ ID NO: 8497650 - DNA, 22 bp, Homo sapiens
tcctttgacttcttgcagtcca

SEQ ID NO: 8497651 - DNA, 22 bp, Homo sapiens
tcctttgcttctgtcattctcc

SEQ ID NO: 8497652 - DNA, 22 bp, Homo sapiens
tcctttgcttctgtcattctcc

SEQ ID NO: 8497653 - DNA, 22 bp, Homo sapiens
tcctttgcttctgtcattctcc

SEQ ID NO: 8497654 - DNA, 22 bp, Homo sapiens
tcctttgcttctgtcattctcc

SEQ ID NO: 8497655 - DNA, 22 bp, Homo sapiens
tcctttgcttctgtcattctcc

SEQ ID NO: 8497656 - DNA, 22 bp, Homo sapiens
tcctttggttgtagacaggaat

SEQ ID NO: 8497657 - DNA, 22 bp, Homo sapiens
tccttttgctgggatcatcagg

SEQ ID NO: 8497658 - DNA, 22 bp, Homo sapiens
tcgaactcatagtcgtagctgt

SEQ ID NO: 8497659 - DNA, 22 bp, Homo sapiens
tcctttttggtccaaggtgacc

SEQ ID NO: 8497660 - DNA, 22 bp, Homo sapiens
tcctttttatagttagagaaac

SEQ ID NO: 8497661 - DNA, 22 bp, Homo sapiens
tcctttttaagtcgttgtggta

SEQ ID NO: 8497662 - DNA, 22 bp, Homo sapiens
tcgagctctggagccaaggatg

SEQ ID NO: 8497663 - DNA, 22 bp, Homo sapiens
tcgaatggcaaggaaagaggct

SEQ ID NO: 8497664 - DNA, 22 bp, Homo sapiens
tcgaaggttattgtctttacgt

SEQ ID NO: 8497665 - DNA, 22 bp, Homo sapiens
tcgagctctggagccaaggatg

SEQ ID NO: 8497666 - DNA, 19 bp, Homo sapiens
tcgagtcaagacactaggc

SEQ ID NO: 8497667 - DNA, 22 bp, Homo sapiens
tcgataatatcttacatgtgct

SEQ ID NO: 8497668 - DNA, 19 bp, Homo sapiens
tcctttctgttcctgagat

SEQ ID NO: 8497669 - DNA, 19 bp, Homo sapiens
tcctttgaatatcagttga

SEQ ID NO: 8497670 - DNA, 22 bp, Homo sapiens
tcctttcttcttctgcccatgg

SEQ ID NO: 8497671 - DNA, 18 bp, Homo sapiens
tcctttctccctcatctt

SEQ ID NO: 8497672 - DNA, 22 bp, Homo sapiens
tccttggctttctggagcttct

SEQ ID NO: 8497673 - DNA, 23 bp, Homo sapiens
tccttgggcctgcccagagtggt

SEQ ID NO: 8497674 - DNA, 22 bp, Homo sapiens
tcctttccatgcttctagaggc

SEQ ID NO: 8497675 - DNA, 22 bp, Homo sapiens
tcctttccctttccatcctggc

SEQ ID NO: 8497676 - DNA, 22 bp, Homo sapiens
tcctttccatgcttctagaggc

SEQ ID NO: 8497677 - DNA, 22 bp, Homo sapiens
tctaaacacgtctctttgaata

SEQ ID NO: 8497678 - DNA, 20 bp, Homo sapiens
tctaaacagttggcatgggg

SEQ ID NO: 8497679 - DNA, 22 bp, Homo sapiens
tctaaacattatgatagtagag

SEQ ID NO: 8497680 - DNA, 22 bp, Homo sapiens
tctaaaaaagtctgttcacttg

SEQ ID NO: 8497681 - DNA, 22 bp, Homo sapiens
tctaaaaaagtctgttcacttg

SEQ ID NO: 8497682 - DNA, 23 bp, Homo sapiens
tctaaaattcatcatttacgttc

SEQ ID NO: 8497683 - DNA, 22 bp, Homo sapiens
tctaaaatgcagatctactggt

SEQ ID NO: 8497684 - DNA, 22 bp, Homo sapiens
tctaaacacgtctctttgaata

SEQ ID NO: 8497685 - DNA, 22 bp, Homo sapiens
tctaaactacgtcaaaactagt

SEQ ID NO: 8497686 - DNA, 22 bp, Homo sapiens
tctaaacttgtaaacaagcata

SEQ ID NO: 8497687 - DNA, 22 bp, Homo sapiens
tctaaagatttggattcatttg

SEQ ID NO: 8497688 - DNA, 22 bp, Homo sapiens
tctaaagccttccatataacgc

SEQ ID NO: 8497689 - DNA, 22 bp, Homo sapiens
tctaaagtatgctaatatgtga

SEQ ID NO: 8497690 - DNA, 22 bp, Homo sapiens
tctaaagagaaccttttctcat

SEQ ID NO: 8497691 - DNA, 22 bp, Homo sapiens
tctaaagagagtgggtacatgt

SEQ ID NO: 8497692 - DNA, 22 bp, Homo sapiens
tctaaagatgtttattgacata

SEQ ID NO: 8497693 - DNA, 22 bp, Homo sapiens
tcgtatgctctctgtgtcctgt

SEQ ID NO: 8497694 - DNA, 22 bp, Homo sapiens
tcgtctgtgaaattgggataag

SEQ ID NO: 8497695 - DNA, 22 bp, Homo sapiens
tcgtctgtgaaattgggataag

SEQ ID NO: 8497696 - DNA, 22 bp, Homo sapiens
tcgcccaggctggaagtgcagt

SEQ ID NO: 8497697 - DNA, 22 bp, Homo sapiens
tcgcccaggctggaagtgcagt

SEQ ID NO: 8497698 - DNA, 22 bp, Homo sapiens
tcgcaccattgcactccagcca

SEQ ID NO: 8497699 - DNA, 22 bp, Homo sapiens
tcgcaccattgcactccagcca

SEQ ID NO: 8497700 - DNA, 22 bp, Homo sapiens
tcgcaccattgcactccagcca

SEQ ID NO: 8497701 - DNA, 22 bp, Homo sapiens
tcgcagaggcacgagtgcagaa

SEQ ID NO: 8497702 - DNA, 22 bp, Homo sapiens
tcgcccaggctggaagtgcagt

SEQ ID NO: 8497703 - DNA, 22 bp, Homo sapiens
tcgtgatctgtccacctcggcc

SEQ ID NO: 8497704 - DNA, 22 bp, Homo sapiens
tcgtgatctgtccacctcggcc

SEQ ID NO: 8497705 - DNA, 22 bp, Homo sapiens
tcgtgcaaacctgacacagcca

SEQ ID NO: 8497706 - DNA, 22 bp, Homo sapiens
tcgtgaggctctgcatcgcaca

SEQ ID NO: 8497707 - DNA, 21 bp, Homo sapiens
tcgtgcagcagctgaggcttg

SEQ ID NO: 8497708 - DNA, 22 bp, Homo sapiens
tcgtggagaggccatgtggagg

SEQ ID NO: 8497709 - DNA, 22 bp, Homo sapiens
tcgttttaggtggacattgtgt

SEQ ID NO: 8497710 - DNA, 19 bp, Homo sapiens
tcgtggggaggtgggcagc

SEQ ID NO: 8497711 - DNA, 22 bp, Homo sapiens
tcgtgtgtattccctctccttc

SEQ ID NO: 8497712 - DNA, 22 bp, Homo sapiens
tccttcctggggtctctgctgc

SEQ ID NO: 8497713 - DNA, 21 bp, Homo sapiens
tccttccttgaggtcctttcc

SEQ ID NO: 8497714 - DNA, 22 bp, Homo sapiens
tccttctacactgcctctgaga

SEQ ID NO: 8497715 - DNA, 19 bp, Homo sapiens
tccttcagtcagatctggg

SEQ ID NO: 8497716 - DNA, 19 bp, Homo sapiens
tccttcagtcagatctggg

SEQ ID NO: 8497717 - DNA, 19 bp, Homo sapiens
tccttcagtcagatctggg

SEQ ID NO: 8497718 - DNA, 19 bp, Homo sapiens
tccttcagtcagatctggg

SEQ ID NO: 8497719 - DNA, 22 bp, Homo sapiens
tccttcagggttgaggccgact

SEQ ID NO: 8497720 - DNA, 22 bp, Homo sapiens
tccttcagggttgaggccgact

SEQ ID NO: 8497721 - DNA, 22 bp, Homo sapiens
tccttcagggttgaggccgact

SEQ ID NO: 8497722 - DNA, 22 bp, Homo sapiens
tccttcagggggccgcctgcac

SEQ ID NO: 8497723 - DNA, 22 bp, Homo sapiens
tccttcagggggccgcctgcac

SEQ ID NO: 8497724 - DNA, 22 bp, Homo sapiens
tccttcctgctctaacattcag

SEQ ID NO: 8497725 - DNA, 22 bp, Homo sapiens
tccttcctggggtctctgctgc

SEQ ID NO: 8497726 - DNA, 22 bp, Homo sapiens
tccttcctggggtctctgctgc

SEQ ID NO: 8497727 - DNA, 22 bp, Homo sapiens
tccttcctggggtctctgctgc

SEQ ID NO: 8497728 - DNA, 19 bp, Homo sapiens
tccttctccggccaccccg

SEQ ID NO: 8497729 - DNA, 22 bp, Homo sapiens
tccttctcctccttgagtgaca

SEQ ID NO: 8497730 - DNA, 22 bp, Homo sapiens
tccttctctacaaatccaggca

SEQ ID NO: 8497731 - DNA, 20 bp, Homo sapiens
tccttctgaggtgaggagga

SEQ ID NO: 8497732 - DNA, 22 bp, Homo sapiens
tccttctgtagtccctgtccct

SEQ ID NO: 8497733 - DNA, 22 bp, Homo sapiens
tccttctgtagtccctgtccct

SEQ ID NO: 8497734 - DNA, 22 bp, Homo sapiens
tccttctgtagtccctgtccct

SEQ ID NO: 8497735 - DNA, 22 bp, Homo sapiens
tccttctggaggctctaagggg

SEQ ID NO: 8497736 - DNA, 22 bp, Homo sapiens
tccttctggaggctgtaaagga

SEQ ID NO: 8497737 - DNA, 22 bp, Homo sapiens
tccttggcagcagggagcatga

SEQ ID NO: 8497738 - DNA, 17 bp, Homo sapiens
tccttggcaaccagttc

SEQ ID NO: 8497739 - DNA, 22 bp, Homo sapiens
tccttggagtcatgatggaggt

SEQ ID NO: 8497740 - DNA, 22 bp, Homo sapiens
tccttggaggtgttcatctgcc

SEQ ID NO: 8497741 - DNA, 22 bp, Homo sapiens
tccttggaggtcaacgggacgg

SEQ ID NO: 8497742 - DNA, 21 bp, Homo sapiens
tccttgctattttcctcagct

SEQ ID NO: 8497743 - DNA, 22 bp, Homo sapiens
tccttggagcccaggagtagca

SEQ ID NO: 8497744 - DNA, 22 bp, Homo sapiens
tccttctttcacctcatagtca

SEQ ID NO: 8497745 - DNA, 22 bp, Homo sapiens
tccttctttccccctagtcatt

SEQ ID NO: 8497746 - DNA, 22 bp, Homo sapiens
tccttctttcacctcatagtca

SEQ ID NO: 8497747 - DNA, 22 bp, Homo sapiens
tccttcttcatgaagatatatg

SEQ ID NO: 8497748 - DNA, 22 bp, Homo sapiens
tccttctttgacaagtggcaga

SEQ ID NO: 8497749 - DNA, 22 bp, Homo sapiens
tccttgaaaagaatgtctccat

SEQ ID NO: 8497750 - DNA, 22 bp, Homo sapiens
tccttctttgacaagtggcaga

SEQ ID NO: 8497751 - DNA, 22 bp, Homo sapiens
tccttgagaggacagagccata

SEQ ID NO: 8497752 - DNA, 22 bp, Homo sapiens
tccttgagaggacagagccata

SEQ ID NO: 8497753 - DNA, 22 bp, Homo sapiens
tccttgagccgtggccagggcc

SEQ ID NO: 8497754 - DNA, 22 bp, Homo sapiens
tccttgaggaggtgacactgga

SEQ ID NO: 8497755 - DNA, 22 bp, Homo sapiens
tccttgagagccactgtcttgg

SEQ ID NO: 8497756 - DNA, 22 bp, Homo sapiens
tccttgactgtgaggaactagc

SEQ ID NO: 8497757 - DNA, 22 bp, Homo sapiens
tccttgaatgaatgttctctcc

SEQ ID NO: 8497758 - DNA, 22 bp, Homo sapiens
tccttgaagcttgtatctaata

SEQ ID NO: 8497759 - DNA, 22 bp, Homo sapiens
tccttcagggctgaccacaggc

SEQ ID NO: 8497760 - DNA, 22 bp, Homo sapiens
tccttcagggggccgcctgcac

SEQ ID NO: 8497761 - DNA, 22 bp, Homo sapiens
tccttcagggctgaccacaggc

SEQ ID NO: 8497762 - DNA, 22 bp, Homo sapiens
tccttcagggggccgcctgcac

SEQ ID NO: 8497763 - DNA, 22 bp, Homo sapiens
tccttcagggctgaccacaggc

SEQ ID NO: 8497764 - DNA, 17 bp, Homo sapiens
tccttcagggcctcaca

SEQ ID NO: 8497765 - DNA, 17 bp, Homo sapiens
tccttcagggcctcaca

SEQ ID NO: 8497766 - DNA, 17 bp, Homo sapiens
tccttcagggcctcaca

SEQ ID NO: 8497767 - DNA, 17 bp, Homo sapiens
tccttcagggcctcaca

SEQ ID NO: 8497768 - DNA, 20 bp, Homo sapiens
tccttcaggcagggcctagt

SEQ ID NO: 8497769 - DNA, 20 bp, Homo sapiens
tccttcaggcagggcctagt

SEQ ID NO: 8497770 - DNA, 22 bp, Homo sapiens
tccttcaggcctcattctcata

SEQ ID NO: 8497771 - DNA, 22 bp, Homo sapiens
tccttcaggcctcattctcata

SEQ ID NO: 8497772 - DNA, 23 bp, Homo sapiens
tccttcaggctcttcccctggac

SEQ ID NO: 8497773 - DNA, 22 bp, Homo sapiens
tccttcaggcctcattctcata

SEQ ID NO: 8497774 - DNA, 22 bp, Homo sapiens
tccttcagcttatttcttagga

SEQ ID NO: 8497775 - DNA, 22 bp, Homo sapiens
tccttcagctgctaggaaatga

SEQ ID NO: 8497776 - DNA, 22 bp, Homo sapiens
tccttcagctctctatttagat

SEQ ID NO: 8497777 - DNA, 22 bp, Homo sapiens
tccttcagctctctatttagat

SEQ ID NO: 8497778 - DNA, 22 bp, Homo sapiens
tccttcagcttatttcttagga

SEQ ID NO: 8497779 - DNA, 22 bp, Homo sapiens
tccttcagcttgttagagtgac

SEQ ID NO: 8497780 - DNA, 22 bp, Homo sapiens
tccttcagcttgttagagtgac

SEQ ID NO: 8497781 - DNA, 22 bp, Homo sapiens
tccttcagcttgttagagtgac

SEQ ID NO: 8497782 - DNA, 22 bp, Homo sapiens
tccttcagctctctatttagat

SEQ ID NO: 8497783 - DNA, 22 bp, Homo sapiens
tccttcagctactcagtttcca

SEQ ID NO: 8497784 - DNA, 22 bp, Homo sapiens
tccttcagctactcagtttcca

SEQ ID NO: 8497785 - DNA, 22 bp, Homo sapiens
tccttcagctactcagtttcca

SEQ ID NO: 8497786 - DNA, 22 bp, Homo sapiens
tccttcagcctcccagctcaaa

SEQ ID NO: 8497787 - DNA, 22 bp, Homo sapiens
tccttcagcctcccagctcaaa

SEQ ID NO: 8497788 - DNA, 22 bp, Homo sapiens
tccttcagcctcccagctcaaa

SEQ ID NO: 8497789 - DNA, 22 bp, Homo sapiens
tccttcagccatgggctctcca

SEQ ID NO: 8497790 - DNA, 22 bp, Homo sapiens
tccttcagccatgggctctcca

SEQ ID NO: 8497791 - DNA, 22 bp, Homo sapiens
tccttcagaaaacctcagtctt

SEQ ID NO: 8497792 - DNA, 22 bp, Homo sapiens
tccttcagaaaacctcagtctt

SEQ ID NO: 8497793 - DNA, 22 bp, Homo sapiens
tccttcagaaaacctcagtctt

SEQ ID NO: 8497794 - DNA, 22 bp, Homo sapiens
tccttcaccttagccctcctag

SEQ ID NO: 8497795 - DNA, 22 bp, Homo sapiens
tccttcaccttagccctcctag

SEQ ID NO: 8497796 - DNA, 23 bp, Homo sapiens
tccttcaagttaggaagtgaaca

SEQ ID NO: 8497797 - DNA, 18 bp, Homo sapiens
tccttcacagcaggaagg

SEQ ID NO: 8497798 - DNA, 18 bp, Homo sapiens
tccttcacagcaggaagg

SEQ ID NO: 8497799 - DNA, 22 bp, Homo sapiens
tccttcaagtgcagtacctgag

SEQ ID NO: 8497800 - DNA, 22 bp, Homo sapiens
tccttcagaggacggcagccag

SEQ ID NO: 8497801 - DNA, 23 bp, Homo sapiens
tccttcagagcctccctccaagc

SEQ ID NO: 8497802 - DNA, 23 bp, Homo sapiens
tccttcagagcctccctccaagc

SEQ ID NO: 8497803 - DNA, 23 bp, Homo sapiens
tccttcagagcctccctccaagc

SEQ ID NO: 8497804 - DNA, 20 bp, Homo sapiens
tccttcagactttggagttg

SEQ ID NO: 8497805 - DNA, 22 bp, Homo sapiens
tccttcagaacctgtgatggaa

SEQ ID NO: 8497806 - DNA, 22 bp, Homo sapiens
tccttcagaacctgtgatggaa

SEQ ID NO: 8497807 - DNA, 22 bp, Homo sapiens
tccttcagaaaacctcagtctt

SEQ ID NO: 8497808 - DNA, 20 bp, Homo sapiens
tccttcagacgacaagcaag

SEQ ID NO: 8497809 - DNA, 20 bp, Homo sapiens
tccttcagacgacaagcaag

SEQ ID NO: 8497810 - DNA, 22 bp, Homo sapiens
tccttcagattcctgcttctgg

SEQ ID NO: 8497811 - DNA, 22 bp, Homo sapiens
tccttcagattcctgcttctgg

SEQ ID NO: 8497812 - DNA, 22 bp, Homo sapiens
tccttcagccatgggctctcca

SEQ ID NO: 8497813 - DNA, 22 bp, Homo sapiens
tccttcagattcctgcttctgg

SEQ ID NO: 8497814 - DNA, 22 bp, Homo sapiens
tccttcagccatgggctctcca

SEQ ID NO: 8497815 - DNA, 22 bp, Homo sapiens
tccttcagaggacggcagccag

SEQ ID NO: 8497816 - DNA, 22 bp, Homo sapiens
tccttcagaggacggcagccag

SEQ ID NO: 8497817 - DNA, 22 bp, Homo sapiens
tccttcagaggataaggaagaa

SEQ ID NO: 8497818 - DNA, 22 bp, Homo sapiens
tccttcagaggataaggaagaa

SEQ ID NO: 8497819 - DNA, 22 bp, Homo sapiens
tccttcagaggataaggaagaa

SEQ ID NO: 8497820 - DNA, 22 bp, Homo sapiens
tccttcaaaagttgagagagcc

SEQ ID NO: 8497821 - DNA, 22 bp, Homo sapiens
tccttcaaagctcctagtgagc

SEQ ID NO: 8497822 - DNA, 22 bp, Homo sapiens
tccttcaagatgccacagcttt

SEQ ID NO: 8497823 - DNA, 22 bp, Homo sapiens
tccttcaagatgccacagcttt

SEQ ID NO: 8497824 - DNA, 22 bp, Homo sapiens
tccttcaactttttacttgccc

SEQ ID NO: 8497825 - DNA, 22 bp, Homo sapiens
tccttcaactttttacttgccc

SEQ ID NO: 8497826 - DNA, 22 bp, Homo sapiens
tccttaggaaaatgatgagggg

SEQ ID NO: 8497827 - DNA, 22 bp, Homo sapiens
tccttaggcaatttgggagagt

SEQ ID NO: 8497828 - DNA, 22 bp, Homo sapiens
tccttaggcaatttgggagagt

SEQ ID NO: 8497829 - DNA, 22 bp, Homo sapiens
tccttaggtatttagcatgaat

SEQ ID NO: 8497830 - DNA, 22 bp, Homo sapiens
tccttagggatttttccagtca

SEQ ID NO: 8497831 - DNA, 22 bp, Homo sapiens
tccttaggtatttagcatgaat

SEQ ID NO: 8497832 - DNA, 22 bp, Homo sapiens
tccttagagatactgtcttgaa

SEQ ID NO: 8497833 - DNA, 22 bp, Homo sapiens
tccttagagacaagaccagttt

SEQ ID NO: 8497834 - DNA, 22 bp, Homo sapiens
tccttagacaaagagtgggctt

SEQ ID NO: 8497835 - DNA, 22 bp, Homo sapiens
tccttacatgcttccttataca

SEQ ID NO: 8497836 - DNA, 22 bp, Homo sapiens
tccttaatatggaagagttctc

SEQ ID NO: 8497837 - DNA, 22 bp, Homo sapiens
tccttaattctgtgcaatatgt

SEQ ID NO: 8497838 - DNA, 22 bp, Homo sapiens
tccttaataagtacttcattgt

SEQ ID NO: 8497839 - DNA, 22 bp, Homo sapiens
tccttacaacttgttatttttc

SEQ ID NO: 8497840 - DNA, 22 bp, Homo sapiens
tccttacaacttgttatttttc

SEQ ID NO: 8497841 - DNA, 22 bp, Homo sapiens
tccttacaggttacagaaagca

SEQ ID NO: 8497842 - DNA, 22 bp, Homo sapiens
tccttacaggttacagaaagca

SEQ ID NO: 8497843 - DNA, 22 bp, Homo sapiens
tccttaaatgaactctgcatga

SEQ ID NO: 8497844 - DNA, 22 bp, Homo sapiens
tccttaaatgtgatctagattt

SEQ ID NO: 8497845 - DNA, 22 bp, Homo sapiens
tccttaacaagatggcatttgt

SEQ ID NO: 8497846 - DNA, 22 bp, Homo sapiens
tccttaaatgtgatctagattt

SEQ ID NO: 8497847 - DNA, 21 bp, Homo sapiens
tcctgtaagcttgggtggctc

SEQ ID NO: 8497848 - DNA, 22 bp, Homo sapiens
tcctgtagttgctaagtttgtt

SEQ ID NO: 8497849 - DNA, 21 bp, Homo sapiens
tcctgtaagcttgggtggctc

SEQ ID NO: 8497850 - DNA, 22 bp, Homo sapiens
tcctgtcagtgaggcagatgaa

SEQ ID NO: 8497851 - DNA, 22 bp, Homo sapiens
tcctgtcagtgaggcagatgaa

SEQ ID NO: 8497852 - DNA, 18 bp, Homo sapiens
tcctggttctgtggccac

SEQ ID NO: 8497853 - DNA, 22 bp, Homo sapiens
tcctggtttatagactgatggc

SEQ ID NO: 8497854 - DNA, 22 bp, Homo sapiens
tcctggtttatagactgatggc

SEQ ID NO: 8497855 - DNA, 22 bp, Homo sapiens
tcctgtcagtgaggcagatgaa

SEQ ID NO: 8497856 - DNA, 22 bp, Homo sapiens
tcctgtcctgaggctccaggcc

SEQ ID NO: 8497857 - DNA, 22 bp, Homo sapiens
tcctgtctaaagacctgcaggc

SEQ ID NO: 8497858 - DNA, 22 bp, Homo sapiens
tcctgtctaaagacctgcaggc

SEQ ID NO: 8497859 - DNA, 22 bp, Homo sapiens
tcctggtggtctgtgcttcttc

SEQ ID NO: 8497860 - DNA, 22 bp, Homo sapiens
tcctggtgggacagaaaacctc

SEQ ID NO: 8497861 - DNA, 22 bp, Homo sapiens
tcctggttagagctctctgggg

SEQ ID NO: 8497862 - DNA, 22 bp, Homo sapiens
tcctggtgtaatggtaagcatg

SEQ ID NO: 8497863 - DNA, 17 bp, Homo sapiens
tcctgtgggtgcagcag

SEQ ID NO: 8497864 - DNA, 22 bp, Homo sapiens
tcctgtgggctctcggcctcca

SEQ ID NO: 8497865 - DNA, 22 bp, Homo sapiens
tcctgtggggaaaagcctatct

SEQ ID NO: 8497866 - DNA, 22 bp, Homo sapiens
tcctgtggcttccacgacctaa

SEQ ID NO: 8497867 - DNA, 21 bp, Homo sapiens
tcctgtgaggacctgtcagtg

SEQ ID NO: 8497868 - DNA, 22 bp, Homo sapiens
tcctgtgacggagcgccagagg

SEQ ID NO: 8497869 - DNA, 22 bp, Homo sapiens
tcctgtctaaagacctgcaggc

SEQ ID NO: 8497870 - DNA, 22 bp, Homo sapiens
tcctgtctgctcacagagctgg

SEQ ID NO: 8497871 - DNA, 22 bp, Homo sapiens
tcctgtctgtctttggtccctt

SEQ ID NO: 8497872 - DNA, 22 bp, Homo sapiens
tcctgtcttaatgatctcgtgc

SEQ ID NO: 8497873 - DNA, 22 bp, Homo sapiens
tcctgtctgtctttggtccctt

SEQ ID NO: 8497874 - DNA, 22 bp, Homo sapiens
tcctgtctgctcacagagctgg

SEQ ID NO: 8497875 - DNA, 22 bp, Homo sapiens
tcctgtctgtctttggtccctt

SEQ ID NO: 8497876 - DNA, 22 bp, Homo sapiens
tcctgtctgctcacagagctgg

SEQ ID NO: 8497877 - DNA, 22 bp, Homo sapiens
tcctggggtcctgactgcttcc

SEQ ID NO: 8497878 - DNA, 20 bp, Homo sapiens
tcctggggtaagccatggtc

SEQ ID NO: 8497879 - DNA, 22 bp, Homo sapiens
tcctggggtcctgactgcttcc

SEQ ID NO: 8497880 - DNA, 22 bp, Homo sapiens
tcctggggtttagagggaagtg

SEQ ID NO: 8497881 - DNA, 22 bp, Homo sapiens
tcctggggtgtgttttgctgct

SEQ ID NO: 8497882 - DNA, 22 bp, Homo sapiens
tcctggggttttggccgcagct

SEQ ID NO: 8497883 - DNA, 22 bp, Homo sapiens
tcctgggtagagacctgatgaa

SEQ ID NO: 8497884 - DNA, 22 bp, Homo sapiens
tcctgggtagagacctgatgaa

SEQ ID NO: 8497885 - DNA, 22 bp, Homo sapiens
tcctgggtctgggtgtctgagg

SEQ ID NO: 8497886 - DNA, 22 bp, Homo sapiens
tcctgggtctgggtgtctgagg

SEQ ID NO: 8497887 - DNA, 22 bp, Homo sapiens
tcctgggtcccgcacatctgtc

SEQ ID NO: 8497888 - DNA, 22 bp, Homo sapiens
tcctgggtctcttccttagttc

SEQ ID NO: 8497889 - DNA, 22 bp, Homo sapiens
tcctgggtccatggcagccgaa

SEQ ID NO: 8497890 - DNA, 22 bp, Homo sapiens
tcctggtggctctttgggaagg

SEQ ID NO: 8497891 - DNA, 18 bp, Homo sapiens
tcctggtattgcaagcac

SEQ ID NO: 8497892 - DNA, 22 bp, Homo sapiens
tcctggtcagctttgaggttgt

SEQ ID NO: 8497893 - DNA, 22 bp, Homo sapiens
tcctggtcagctttgaggttgt

SEQ ID NO: 8497894 - DNA, 22 bp, Homo sapiens
tcctgggttaattatgattcac

SEQ ID NO: 8497895 - DNA, 22 bp, Homo sapiens
tcctgggttcatgtcctggtgc

SEQ ID NO: 8497896 - DNA, 20 bp, Homo sapiens
tcctggggtaagccatggtc

SEQ ID NO: 8497897 - DNA, 20 bp, Homo sapiens
tcctggggtaagccatggtc

SEQ ID NO: 8497898 - DNA, 22 bp, Homo sapiens
tcctggggctgcaaggcctgtc

SEQ ID NO: 8497899 - DNA, 22 bp, Homo sapiens
tcctggggctgcaaggcctgtc

SEQ ID NO: 8497900 - DNA, 21 bp, Homo sapiens
tcctggggggtaggtgagttt

SEQ ID NO: 8497901 - DNA, 22 bp, Homo sapiens
tcctggggctgcaaggcctgtc

SEQ ID NO: 8497902 - DNA, 22 bp, Homo sapiens
tcctggggctctgagcgagaca

SEQ ID NO: 8497903 - DNA, 22 bp, Homo sapiens
tcctggggctctgagcgagaca

SEQ ID NO: 8497904 - DNA, 22 bp, Homo sapiens
tcctggggctctttgatgtgat

SEQ ID NO: 8497905 - DNA, 19 bp, Homo sapiens
tcctggggatgtggtcacc

SEQ ID NO: 8497906 - DNA, 19 bp, Homo sapiens
tcctggggatgtggtcacc

SEQ ID NO: 8497907 - DNA, 22 bp, Homo sapiens
tcctggggaggtcgaggctgag

SEQ ID NO: 8497908 - DNA, 16 bp, Homo sapiens
tcctggggatactgga

SEQ ID NO: 8497909 - DNA, 22 bp, Homo sapiens
tcctggggctcatgggatttgt

SEQ ID NO: 8497910 - DNA, 22 bp, Homo sapiens
tcctggggccaggcacctctgg

SEQ ID NO: 8497911 - DNA, 22 bp, Homo sapiens
tcctggggccagcactggtgga

SEQ ID NO: 8497912 - DNA, 22 bp, Homo sapiens
tcctggggccagcactggtgga

SEQ ID NO: 8497913 - DNA, 22 bp, Homo sapiens
tcctgggagtaattgagtcatg

SEQ ID NO: 8497914 - DNA, 22 bp, Homo sapiens
tcctgggagtaattgagtcatg

SEQ ID NO: 8497915 - DNA, 22 bp, Homo sapiens
tcctgggagtaattgagtcatg

SEQ ID NO: 8497916 - DNA, 21 bp, Homo sapiens
tcctgggagtctgagatcctg

SEQ ID NO: 8497917 - DNA, 21 bp, Homo sapiens
tcctgggagtctgagatcctg

SEQ ID NO: 8497918 - DNA, 22 bp, Homo sapiens
tcctgggagtggccatgtaatg

SEQ ID NO: 8497919 - DNA, 21 bp, Homo sapiens
tcctgggagtctgagatcctg

SEQ ID NO: 8497920 - DNA, 22 bp, Homo sapiens
tcctgggagtaattgagtcatg

SEQ ID NO: 8497921 - DNA, 22 bp, Homo sapiens
tcctgggatcaagtgatcctcc

SEQ ID NO: 8497922 - DNA, 22 bp, Homo sapiens
tcctgggatcaagtgatcctcc

SEQ ID NO: 8497923 - DNA, 22 bp, Homo sapiens
tcctgggagtggccatgtaatg

SEQ ID NO: 8497924 - DNA, 22 bp, Homo sapiens
tcctgggagtggccatgtaatg

SEQ ID NO: 8497925 - DNA, 22 bp, Homo sapiens
tcctgggagtggccatgtaatg

SEQ ID NO: 8497926 - DNA, 22 bp, Homo sapiens
tcctgggatgacttttgaaatg

SEQ ID NO: 8497927 - DNA, 22 bp, Homo sapiens
tcctgggatcaagtgatcctcc

SEQ ID NO: 8497928 - DNA, 22 bp, Homo sapiens
tcctgggcagaatgggatggct

SEQ ID NO: 8497929 - DNA, 22 bp, Homo sapiens
tcctgggcagcgggacgctcag

SEQ ID NO: 8497930 - DNA, 22 bp, Homo sapiens
tcctgggcagcctctctggaag

SEQ ID NO: 8497931 - DNA, 22 bp, Homo sapiens
tcctgggatttgcccttttctc

SEQ ID NO: 8497932 - DNA, 22 bp, Homo sapiens
tcctgggattctgcatttctaa

SEQ ID NO: 8497933 - DNA, 22 bp, Homo sapiens
tcctgggattaaggtggtgatt

SEQ ID NO: 8497934 - DNA, 22 bp, Homo sapiens
tcctgggattctgcatttctaa

SEQ ID NO: 8497935 - DNA, 22 bp, Homo sapiens
tcctgggattctgcatttctaa

SEQ ID NO: 8497936 - DNA, 22 bp, Homo sapiens
tcctgggattaaggtggtgatt

SEQ ID NO: 8497937 - DNA, 22 bp, Homo sapiens
tcctgggattaaggtggtgatt

SEQ ID NO: 8497938 - DNA, 22 bp, Homo sapiens
tcctgggattaaggtggtgatt

SEQ ID NO: 8497939 - DNA, 22 bp, Homo sapiens
tcctgggcccaggctgccaggg

SEQ ID NO: 8497940 - DNA, 22 bp, Homo sapiens
tcctgggcccaggctgccaggg

SEQ ID NO: 8497941 - DNA, 22 bp, Homo sapiens
tcctgggcccaggctgccaggg

SEQ ID NO: 8497942 - DNA, 22 bp, Homo sapiens
tcctgggcccaggctgccaggg

SEQ ID NO: 8497943 - DNA, 22 bp, Homo sapiens
tcctgggcccaggctgccaggg

SEQ ID NO: 8497944 - DNA, 22 bp, Homo sapiens
tcctgggccaagggctgtgagg

SEQ ID NO: 8497945 - DNA, 22 bp, Homo sapiens
tcctgggcagcgggacgctcag

SEQ ID NO: 8497946 - DNA, 22 bp, Homo sapiens
tcctgggcctgtactccatccg

SEQ ID NO: 8497947 - DNA, 22 bp, Homo sapiens
tcctgggcctgtactccatccg

SEQ ID NO: 8497948 - DNA, 19 bp, Homo sapiens
tcctgggctgcgtcttgcc

SEQ ID NO: 8497949 - DNA, 22 bp, Homo sapiens
tcctgggctgcagggaagagca

SEQ ID NO: 8497950 - DNA, 19 bp, Homo sapiens
tcctgggcgttgactttgg

SEQ ID NO: 8497951 - DNA, 22 bp, Homo sapiens
tcctgggcgattttctgaatat

SEQ ID NO: 8497952 - DNA, 22 bp, Homo sapiens
tcctgggctgtgtgccactctg

SEQ ID NO: 8497953 - DNA, 22 bp, Homo sapiens
tcctgggctgtggccccgggca

SEQ ID NO: 8497954 - DNA, 22 bp, Homo sapiens
tcctgggctgtgtgccactctg

SEQ ID NO: 8497955 - DNA, 19 bp, Homo sapiens
tcctgggctgggccaggtc

SEQ ID NO: 8497956 - DNA, 22 bp, Homo sapiens
tcctggggagggttctggctcc

SEQ ID NO: 8497957 - DNA, 22 bp, Homo sapiens
tcctggctgtcactcgggttga

SEQ ID NO: 8497958 - DNA, 22 bp, Homo sapiens
tcctggctgcaccagtgaccct

SEQ ID NO: 8497959 - DNA, 18 bp, Homo sapiens
tcctgggaaaggcataca

SEQ ID NO: 8497960 - DNA, 21 bp, Homo sapiens
tcctggctttatgctacctct

SEQ ID NO: 8497961 - DNA, 18 bp, Homo sapiens
tcctgggaacttgctagc

SEQ ID NO: 8497962 - DNA, 22 bp, Homo sapiens
tcctgggaactcggaaagctct

SEQ ID NO: 8497963 - DNA, 22 bp, Homo sapiens
tcctgggaactcggaaagctct

SEQ ID NO: 8497964 - DNA, 18 bp, Homo sapiens
tcctgggaaaggcataca

SEQ ID NO: 8497965 - DNA, 18 bp, Homo sapiens
tcctgggaacttgctagc

SEQ ID NO: 8497966 - DNA, 18 bp, Homo sapiens
tcctgggaacttgctagc

SEQ ID NO: 8497967 - DNA, 22 bp, Homo sapiens
tcctgggaagagacctgagcat

SEQ ID NO: 8497968 - DNA, 22 bp, Homo sapiens
tcctgggaccaggcacctactg

SEQ ID NO: 8497969 - DNA, 22 bp, Homo sapiens
tcctgggaagttgcatcaccgt

SEQ ID NO: 8497970 - DNA, 22 bp, Homo sapiens
tcctgggaagttgcatcaccgt

SEQ ID NO: 8497971 - DNA, 22 bp, Homo sapiens
tcctgggaagttgcatcaccgt

SEQ ID NO: 8497972 - DNA, 22 bp, Homo sapiens
tcctgggaagtggctggctgag

SEQ ID NO: 8497973 - DNA, 22 bp, Homo sapiens
tcctgggaagtggctggctgag

SEQ ID NO: 8497974 - DNA, 21 bp, Homo sapiens
tcctgggaagcactggggtgg

SEQ ID NO: 8497975 - DNA, 22 bp, Homo sapiens
tcctgggaagagacctgagcat

SEQ ID NO: 8497976 - DNA, 22 bp, Homo sapiens
tcctgggaagagacctgagcat

SEQ ID NO: 8497977 - DNA, 22 bp, Homo sapiens
tcctgggaagagacctgagcat

SEQ ID NO: 8497978 - DNA, 22 bp, Homo sapiens
tcctgggaagagacctgagcat

SEQ ID NO: 8497979 - DNA, 22 bp, Homo sapiens
tcctgggaagtggctggctgag

SEQ ID NO: 8497980 - DNA, 22 bp, Homo sapiens
tcctgggaagcgccggcctgcg

SEQ ID NO: 8497981 - DNA, 22 bp, Homo sapiens
tcctgggaggctgtgcctggct

SEQ ID NO: 8497982 - DNA, 22 bp, Homo sapiens
tcctgggaggctgtgcctggct

SEQ ID NO: 8497983 - DNA, 22 bp, Homo sapiens
tcctgggaggctgtgcctggct

SEQ ID NO: 8497984 - DNA, 22 bp, Homo sapiens
tcctgggaggcaggaccccttt

SEQ ID NO: 8497985 - DNA, 22 bp, Homo sapiens
tcctgggaggaacatttaccta

SEQ ID NO: 8497986 - DNA, 22 bp, Homo sapiens
tcctgggaggaacatttaccta

SEQ ID NO: 8497987 - DNA, 22 bp, Homo sapiens
tcctgggaggcaggaccccttt

SEQ ID NO: 8497988 - DNA, 22 bp, Homo sapiens
tcctgggactcaacttagaagg

SEQ ID NO: 8497989 - DNA, 22 bp, Homo sapiens
tcctgggactcaacttagaagg

SEQ ID NO: 8497990 - DNA, 22 bp, Homo sapiens
tcctgggactctgcctcaggct

SEQ ID NO: 8497991 - DNA, 22 bp, Homo sapiens
tcctgggactctgcctcaggct

SEQ ID NO: 8497992 - DNA, 22 bp, Homo sapiens
tcctgggaccctgggtgcagag

SEQ ID NO: 8497993 - DNA, 22 bp, Homo sapiens
tcctgggaccctgggtgcagag

SEQ ID NO: 8497994 - DNA, 22 bp, Homo sapiens
tcctggagttgtgcagtgcaca

SEQ ID NO: 8497995 - DNA, 22 bp, Homo sapiens
tcctggagttgtgcagtgcaca

SEQ ID NO: 8497996 - DNA, 22 bp, Homo sapiens
tcctggagttgtgcagtgcaca

SEQ ID NO: 8497997 - DNA, 22 bp, Homo sapiens
tcctggagtttgtaaggtgagc

SEQ ID NO: 8497998 - DNA, 22 bp, Homo sapiens
tcctggagtttgtaaggtgagc

SEQ ID NO: 8497999 - DNA, 22 bp, Homo sapiens
tcctggagtttgtggtgatatg

SEQ ID NO: 8498000 - DNA, 22 bp, Homo sapiens
tcctggagtttgtggtgatatg

SEQ ID NO: 8498001 - DNA, 22 bp, Homo sapiens
tcctggagtgtcttccccaagg

SEQ ID NO: 8498002 - DNA, 22 bp, Homo sapiens
tcctggagtgtcttccccaagg

SEQ ID NO: 8498003 - DNA, 22 bp, Homo sapiens
tcctggagttgtctgtactcat

SEQ ID NO: 8498004 - DNA, 22 bp, Homo sapiens
tcctggagtggagtctgttgtt

SEQ ID NO: 8498005 - DNA, 22 bp, Homo sapiens
tcctggagttgtctgtactcat

SEQ ID NO: 8498006 - DNA, 22 bp, Homo sapiens
tcctggagttgtctgtactcat

SEQ ID NO: 8498007 - DNA, 22 bp, Homo sapiens
tcctggagttgtctgtactcat

SEQ ID NO: 8498008 - DNA, 20 bp, Homo sapiens
tcctggagtctggtttggct

SEQ ID NO: 8498009 - DNA, 20 bp, Homo sapiens
tcctggagtctggtttggct

SEQ ID NO: 8498010 - DNA, 20 bp, Homo sapiens
tcctggagtctggtttggct

SEQ ID NO: 8498011 - DNA, 22 bp, Homo sapiens
tcctggagtggagtctgttgtt

SEQ ID NO: 8498012 - DNA, 22 bp, Homo sapiens
tcctggagtggagtctgttgtt

SEQ ID NO: 8498013 - DNA, 22 bp, Homo sapiens
tcctggagtatttctgtggtgt

SEQ ID NO: 8498014 - DNA, 22 bp, Homo sapiens
tcctggagtatttctgtggtgt

SEQ ID NO: 8498015 - DNA, 22 bp, Homo sapiens
tcctggagtatttctgtggtgt

SEQ ID NO: 8498016 - DNA, 22 bp, Homo sapiens
tcctggagtttgtggtgatatg

SEQ ID NO: 8498017 - DNA, 17 bp, Homo sapiens
tcctggatccatggtgg

SEQ ID NO: 8498018 - DNA, 22 bp, Homo sapiens
tcctggatggagctgccctcgc

SEQ ID NO: 8498019 - DNA, 22 bp, Homo sapiens
tcctggattaatagggagctgt

SEQ ID NO: 8498020 - DNA, 22 bp, Homo sapiens
tcctggattctgccctgaaggc

SEQ ID NO: 8498021 - DNA, 22 bp, Homo sapiens
tcctggattctgccctgaaggc

SEQ ID NO: 8498022 - DNA, 22 bp, Homo sapiens
tcctggatttagaagagcctcc

SEQ ID NO: 8498023 - DNA, 22 bp, Homo sapiens
tcctggatttaaccctggctct

SEQ ID NO: 8498024 - DNA, 19 bp, Homo sapiens
tcctggcacagtggaacca

SEQ ID NO: 8498025 - DNA, 18 bp, Homo sapiens
tcctggccacactacctt

SEQ ID NO: 8498026 - DNA, 22 bp, Homo sapiens
tcctggccaggatgacctaaca

SEQ ID NO: 8498027 - DNA, 22 bp, Homo sapiens
tcctggcccaatctgcccatga

SEQ ID NO: 8498028 - DNA, 21 bp, Homo sapiens
tcctggccagggcactaggca

SEQ ID NO: 8498029 - DNA, 21 bp, Homo sapiens
tcctggccagggcactaggca

SEQ ID NO: 8498030 - DNA, 17 bp, Homo sapiens
tcctggcagtcccctgg

SEQ ID NO: 8498031 - DNA, 22 bp, Homo sapiens
tcctggccaagttactctctgc

SEQ ID NO: 8498032 - DNA, 22 bp, Homo sapiens
tcctggcattgtgcagggtgtg

SEQ ID NO: 8498033 - DNA, 22 bp, Homo sapiens
tcctggccaagtagatgtggcg

SEQ ID NO: 8498034 - DNA, 22 bp, Homo sapiens
tcctggcctccgttctctgcat

SEQ ID NO: 8498035 - DNA, 20 bp, Homo sapiens
tcctggcctccctggggctc

SEQ ID NO: 8498036 - DNA, 22 bp, Homo sapiens
tcctggcctcacagtcctgggt

SEQ ID NO: 8498037 - DNA, 20 bp, Homo sapiens
tcctggcctccctggggctc

SEQ ID NO: 8498038 - DNA, 20 bp, Homo sapiens
tcctggcctccctggggctc

SEQ ID NO: 8498039 - DNA, 22 bp, Homo sapiens
tcctggcctcgctgtccacctt

SEQ ID NO: 8498040 - DNA, 22 bp, Homo sapiens
tcctggcctctgagtcaagaac

SEQ ID NO: 8498041 - DNA, 22 bp, Homo sapiens
tcctggctctgctgcctcctag

SEQ ID NO: 8498042 - DNA, 17 bp, Homo sapiens
tcctggctctgccactg

SEQ ID NO: 8498043 - DNA, 22 bp, Homo sapiens
tcctggctctaagtcctgagtg

SEQ ID NO: 8498044 - DNA, 22 bp, Homo sapiens
tcctggctctaagtcctgagtg

SEQ ID NO: 8498045 - DNA, 22 bp, Homo sapiens
tcctggctcggcttggggactt

SEQ ID NO: 8498046 - DNA, 22 bp, Homo sapiens
tcctggctcctggagacctgct

SEQ ID NO: 8498047 - DNA, 22 bp, Homo sapiens
tcctggcccgatccctgtgaag

SEQ ID NO: 8498048 - DNA, 16 bp, Homo sapiens
tcctggcccctatgga

SEQ ID NO: 8498049 - DNA, 22 bp, Homo sapiens
tcctggcccggccgggcctgct

SEQ ID NO: 8498050 - DNA, 22 bp, Homo sapiens
tcctggcccggccgggcctgct

SEQ ID NO: 8498051 - DNA, 22 bp, Homo sapiens
tcctggcccactatgccagcat

SEQ ID NO: 8498052 - DNA, 22 bp, Homo sapiens
tcctggcctagctcaccctgga

SEQ ID NO: 8498053 - DNA, 22 bp, Homo sapiens
tcctggccgctggcccctgaga

SEQ ID NO: 8498054 - DNA, 22 bp, Homo sapiens
tcctggccgccgcgtggggccg

SEQ ID NO: 8498055 - DNA, 22 bp, Homo sapiens
tcctggccctgtggcctgcagt

SEQ ID NO: 8498056 - DNA, 22 bp, Homo sapiens
tcctggccgccgcgtggggccg

SEQ ID NO: 8498057 - DNA, 22 bp, Homo sapiens
tcctggccctgtggcctgcagt

SEQ ID NO: 8498058 - DNA, 22 bp, Homo sapiens
tcctggccctgtggcctgcagt

SEQ ID NO: 8498059 - DNA, 22 bp, Homo sapiens
tcctggagagtgggcgagcaca

SEQ ID NO: 8498060 - DNA, 22 bp, Homo sapiens
tcctggagagtgggcgagcaca

SEQ ID NO: 8498061 - DNA, 22 bp, Homo sapiens
tcctggagagtgggcgagcaca

SEQ ID NO: 8498062 - DNA, 22 bp, Homo sapiens
tcctggagataattgcagtgaa

SEQ ID NO: 8498063 - DNA, 22 bp, Homo sapiens
tcctggagataattgcagtgaa

SEQ ID NO: 8498064 - DNA, 22 bp, Homo sapiens
tcctggagataattgcagtgaa

SEQ ID NO: 8498065 - DNA, 22 bp, Homo sapiens
tcctggagataattgcagtgaa

SEQ ID NO: 8498066 - DNA, 22 bp, Homo sapiens
tcctggagataattgcagtgaa

SEQ ID NO: 8498067 - DNA, 22 bp, Homo sapiens
tcctggagccaatgtgctgctg

SEQ ID NO: 8498068 - DNA, 22 bp, Homo sapiens
tcctggagccaatgtgctgctg

SEQ ID NO: 8498069 - DNA, 22 bp, Homo sapiens
tcctggagaatcctgccacctg

SEQ ID NO: 8498070 - DNA, 22 bp, Homo sapiens
tcctggagaatcctgccacctg

SEQ ID NO: 8498071 - DNA, 22 bp, Homo sapiens
tcctggagaatcctgccacctg

SEQ ID NO: 8498072 - DNA, 22 bp, Homo sapiens
tcctggagaagaggggcttgga

SEQ ID NO: 8498073 - DNA, 22 bp, Homo sapiens
tcctggagaatggacaatgcac

SEQ ID NO: 8498074 - DNA, 22 bp, Homo sapiens
tcctggagaatcctgccacctg

SEQ ID NO: 8498075 - DNA, 22 bp, Homo sapiens
tcctggagaatggacaatgcac

SEQ ID NO: 8498076 - DNA, 22 bp, Homo sapiens
tcctggagagaggcctggaaga

SEQ ID NO: 8498077 - DNA, 22 bp, Homo sapiens
tcctggagagaggcctggaaga

SEQ ID NO: 8498078 - DNA, 22 bp, Homo sapiens
tcctggagaatggacaatgcac

SEQ ID NO: 8498079 - DNA, 22 bp, Homo sapiens
tcctggagagaggcctggaaga

SEQ ID NO: 8498080 - DNA, 22 bp, Homo sapiens
tcctggagagaggcctggaaga

SEQ ID NO: 8498081 - DNA, 22 bp, Homo sapiens
tcctggagagtgggcgagcaca

SEQ ID NO: 8498082 - DNA, 22 bp, Homo sapiens
tcctggacagatccccatcatc

SEQ ID NO: 8498083 - DNA, 22 bp, Homo sapiens
tcctggactcaggaccacagga

SEQ ID NO: 8498084 - DNA, 22 bp, Homo sapiens
tcctggactggctcagcaccct

SEQ ID NO: 8498085 - DNA, 22 bp, Homo sapiens
tcctggaagtgcttggtgaggg

SEQ ID NO: 8498086 - DNA, 22 bp, Homo sapiens
tcctggacaagcccttcaccct

SEQ ID NO: 8498087 - DNA, 22 bp, Homo sapiens
tcctggaagatctctgtgagat

SEQ ID NO: 8498088 - DNA, 22 bp, Homo sapiens
tcctggaacatggataaagaat

SEQ ID NO: 8498089 - DNA, 22 bp, Homo sapiens
tcctggagaaactcagagatct

SEQ ID NO: 8498090 - DNA, 22 bp, Homo sapiens
tcctggagaaactcagagatct

SEQ ID NO: 8498091 - DNA, 23 bp, Homo sapiens
tcctggagaaaagaaacatttct

SEQ ID NO: 8498092 - DNA, 23 bp, Homo sapiens
tcctggagaaaagaaacatttct

SEQ ID NO: 8498093 - DNA, 22 bp, Homo sapiens
tcctggagaagaggggcttgga

SEQ ID NO: 8498094 - DNA, 22 bp, Homo sapiens
tcctggagaagaggggcttgga

SEQ ID NO: 8498095 - DNA, 22 bp, Homo sapiens
tcctggagaactgattcgcggg

SEQ ID NO: 8498096 - DNA, 22 bp, Homo sapiens
tcctggagaactgattcgcggg

SEQ ID NO: 8498097 - DNA, 20 bp, Homo sapiens
tcctggaggcttcatccata

SEQ ID NO: 8498098 - DNA, 20 bp, Homo sapiens
tcctggaggcttcatccata

SEQ ID NO: 8498099 - DNA, 22 bp, Homo sapiens
tcctggagggaggcggtgctac

SEQ ID NO: 8498100 - DNA, 22 bp, Homo sapiens
tcctggagggaggcggtgctac

SEQ ID NO: 8498101 - DNA, 22 bp, Homo sapiens
tcctggagggaggcggtgctac

SEQ ID NO: 8498102 - DNA, 22 bp, Homo sapiens
tcctggaggcactcgctggggc

SEQ ID NO: 8498103 - DNA, 22 bp, Homo sapiens
tcctggaggcactcgctggggc

SEQ ID NO: 8498104 - DNA, 22 bp, Homo sapiens
tcctggaggcactcgctggggc

SEQ ID NO: 8498105 - DNA, 22 bp, Homo sapiens
tcctggaggcaaatgagcacat

SEQ ID NO: 8498106 - DNA, 22 bp, Homo sapiens
tcctggagccaatgtgctgctg

SEQ ID NO: 8498107 - DNA, 22 bp, Homo sapiens
tcctggagccaatgtgctgctg

SEQ ID NO: 8498108 - DNA, 22 bp, Homo sapiens
tcctggagccaatgtgctgctg

SEQ ID NO: 8498109 - DNA, 22 bp, Homo sapiens
tcctggaggcaaatgaagactc

SEQ ID NO: 8498110 - DNA, 22 bp, Homo sapiens
tcctggaggagatccaatctga

SEQ ID NO: 8498111 - DNA, 22 bp, Homo sapiens
tcctggagccaatgtgctgctg

SEQ ID NO: 8498112 - DNA, 22 bp, Homo sapiens
tcctggaggcaaatgagcacat

SEQ ID NO: 8498113 - DNA, 22 bp, Homo sapiens
tcctggaggcaaatgagcacat

SEQ ID NO: 8498114 - DNA, 22 bp, Homo sapiens
tcctggaggcaaatgagcacat

SEQ ID NO: 8498115 - DNA, 22 bp, Homo sapiens
tcctggaggcaaatgagcacat

SEQ ID NO: 8498116 - DNA, 22 bp, Homo sapiens
tcctggaggcaaatgaagactc

SEQ ID NO: 8498117 - DNA, 22 bp, Homo sapiens
tcctggaggcaaatgaagactc

SEQ ID NO: 8498118 - DNA, 22 bp, Homo sapiens
tcctggaggcaaatgaagactc

SEQ ID NO: 8498119 - DNA, 22 bp, Homo sapiens
tcctggaggggacagcatgggc

SEQ ID NO: 8498120 - DNA, 22 bp, Homo sapiens
tcctggaggggacagcatgggc

SEQ ID NO: 8498121 - DNA, 22 bp, Homo sapiens
tcctggaggggacagcatgggc

SEQ ID NO: 8498122 - DNA, 22 bp, Homo sapiens
tcctggagggctcacaggcggc

SEQ ID NO: 8498123 - DNA, 22 bp, Homo sapiens
tcctggaggggacagcatgggc

SEQ ID NO: 8498124 - DNA, 22 bp, Homo sapiens
tcctggagggctcacaggcggc

SEQ ID NO: 8498125 - DNA, 22 bp, Homo sapiens
tcctggagggctcacaggcggc

SEQ ID NO: 8498126 - DNA, 22 bp, Homo sapiens
tcctggagggctcacaggcggc

SEQ ID NO: 8498127 - DNA, 22 bp, Homo sapiens
tcctggagggaggcggtgctac

SEQ ID NO: 8498128 - DNA, 22 bp, Homo sapiens
tcctggagggaggcggtgctac

SEQ ID NO: 8498129 - DNA, 22 bp, Homo sapiens
tcctggaggggacagcatgggc

SEQ ID NO: 8498130 - DNA, 22 bp, Homo sapiens
tcctggaggggacagcatgggc

SEQ ID NO: 8498131 - DNA, 22 bp, Homo sapiens
tcctggagtaggccttagccat

SEQ ID NO: 8498132 - DNA, 22 bp, Homo sapiens
tcctggagtaggccttagccat

SEQ ID NO: 8498133 - DNA, 22 bp, Homo sapiens
tcctggagtaggccttagccat

SEQ ID NO: 8498134 - DNA, 22 bp, Homo sapiens
tcctggagtatttctgtggtgt

SEQ ID NO: 8498135 - DNA, 22 bp, Homo sapiens
tcctggagtatttctgtggtgt

SEQ ID NO: 8498136 - DNA, 22 bp, Homo sapiens
tcctggagtatttctgtggtgt

SEQ ID NO: 8498137 - DNA, 22 bp, Homo sapiens
tcctggagtatttctgtggtgt

SEQ ID NO: 8498138 - DNA, 20 bp, Homo sapiens
tcctggagtattccatgctt

SEQ ID NO: 8498139 - DNA, 20 bp, Homo sapiens
tcctggagtattccatgctt

SEQ ID NO: 8498140 - DNA, 22 bp, Homo sapiens
taagaacattttcggaaagata

SEQ ID NO: 8498141 - DNA, 22 bp, Homo sapiens
taagaacattttcggaaagata

SEQ ID NO: 8498142 - DNA, 21 bp, Homo sapiens
taagaacattatcttcttcct

SEQ ID NO: 8498143 - DNA, 22 bp, Homo sapiens
taagaacttggcagcaagaaat

SEQ ID NO: 8498144 - DNA, 22 bp, Homo sapiens
taagaacttggcagcaagaaat

SEQ ID NO: 8498145 - DNA, 22 bp, Homo sapiens
taagaatagtccctagatgtgt

SEQ ID NO: 8498146 - DNA, 22 bp, Homo sapiens
taagaacagtgtctgtctcaca

SEQ ID NO: 8498147 - DNA, 22 bp, Homo sapiens
taagaacagtgtctgtctcaca

SEQ ID NO: 8498148 - DNA, 22 bp, Homo sapiens
taagaacagtgtttcatctcta

SEQ ID NO: 8498149 - DNA, 22 bp, Homo sapiens
taagaacataaattcatacggg

SEQ ID NO: 8498150 - DNA, 22 bp, Homo sapiens
taagaacataaattcatacggg

SEQ ID NO: 8498151 - DNA, 22 bp, Homo sapiens
taagaacatctgtccccagatt

SEQ ID NO: 8498152 - DNA, 22 bp, Homo sapiens
taagaacatctgtccccagatt

SEQ ID NO: 8498153 - DNA, 22 bp, Homo sapiens
taagaacagtgtctgtctcaca

SEQ ID NO: 8498154 - DNA, 22 bp, Homo sapiens
taagaacagtgacagccaacat

SEQ ID NO: 8498155 - DNA, 22 bp, Homo sapiens
taagaacagtgtctgtctcaca

SEQ ID NO: 8498156 - DNA, 23 bp, Homo sapiens
taagaacagacaagcatttacat

SEQ ID NO: 8498157 - DNA, 22 bp, Homo sapiens
taagaacaagatgttcctgttt

SEQ ID NO: 8498158 - DNA, 22 bp, Homo sapiens
taagaacaagctgggggttcca

SEQ ID NO: 8498159 - DNA, 23 bp, Homo sapiens
taagaacagacaagcatttacat

SEQ ID NO: 8498160 - DNA, 23 bp, Homo sapiens
taagaacagacaagcatttacat

SEQ ID NO: 8498161 - DNA, 22 bp, Homo sapiens
taagaacagtagaacagtaggt

SEQ ID NO: 8498162 - DNA, 22 bp, Homo sapiens
taagaacagataaagtttcccc

SEQ ID NO: 8498163 - DNA, 22 bp, Homo sapiens
taagaacagtagaacagtaggt

SEQ ID NO: 8498164 - DNA, 22 bp, Homo sapiens
taagaacagtagaacagtaggt

SEQ ID NO: 8498165 - DNA, 22 bp, Homo sapiens
taagaacagtagaacagtaggt

SEQ ID NO: 8498166 - DNA, 19 bp, Homo sapiens
tcctgctgtgtgaagggga

SEQ ID NO: 8498167 - DNA, 22 bp, Homo sapiens
tcctgctgtttacctacaatgg

SEQ ID NO: 8498168 - DNA, 22 bp, Homo sapiens
tcctgcttccttgtctttagac

SEQ ID NO: 8498169 - DNA, 22 bp, Homo sapiens
tcctgcttgaaactctgccttc

SEQ ID NO: 8498170 - DNA, 22 bp, Homo sapiens
taagaatcagtagatatagatt

SEQ ID NO: 8498171 - DNA, 22 bp, Homo sapiens
taagaatattgggaatggatgg

SEQ ID NO: 8498172 - DNA, 22 bp, Homo sapiens
taagaatgacaaccataccatt

SEQ ID NO: 8498173 - DNA, 22 bp, Homo sapiens
taagaattgtgttgaatagagt

SEQ ID NO: 8498174 - DNA, 22 bp, Homo sapiens
taagaattccatcgcagagtat

SEQ ID NO: 8498175 - DNA, 22 bp, Homo sapiens
tctctgagggagatggcctgcc

SEQ ID NO: 8498176 - DNA, 22 bp, Homo sapiens
tctctgagtatcctgaactgcc

SEQ ID NO: 8498177 - DNA, 22 bp, Homo sapiens
tctctgagtatcctgaactgcc

SEQ ID NO: 8498178 - DNA, 22 bp, Homo sapiens
tctctgagtaagtgacagttca

SEQ ID NO: 8498179 - DNA, 22 bp, Homo sapiens
tctctgagctcaggagctgcag

SEQ ID NO: 8498180 - DNA, 22 bp, Homo sapiens
tctctgagctggatttgttctt

SEQ ID NO: 8498181 - DNA, 22 bp, Homo sapiens
tctctgagctgcttcttgcata

SEQ ID NO: 8498182 - DNA, 20 bp, Homo sapiens
tctctgagcttctcttgggg

SEQ ID NO: 8498183 - DNA, 21 bp, Homo sapiens
tctctgagaggtctgcttaga

SEQ ID NO: 8498184 - DNA, 22 bp, Homo sapiens
tctctgagatcagccactgact

SEQ ID NO: 8498185 - DNA, 21 bp, Homo sapiens
tctctgagacactctggagcc

SEQ ID NO: 8498186 - DNA, 22 bp, Homo sapiens
tctctgagcgcattcctccggc

SEQ ID NO: 8498187 - DNA, 22 bp, Homo sapiens
tctctgagcccaatgtagcaat

SEQ ID NO: 8498188 - DNA, 22 bp, Homo sapiens
tctctctgccaactcacagcca

SEQ ID NO: 8498189 - DNA, 22 bp, Homo sapiens
tctctctggagctggggcatga

SEQ ID NO: 8498190 - DNA, 22 bp, Homo sapiens
tctctctgccaactcacagcca

SEQ ID NO: 8498191 - DNA, 23 bp, Homo sapiens
tctctctggcaaatttcacatat

SEQ ID NO: 8498192 - DNA, 22 bp, Homo sapiens
tctctctttttaatcatgtaat

SEQ ID NO: 8498193 - DNA, 22 bp, Homo sapiens
tctctcttttttgaacccgctc

SEQ ID NO: 8498194 - DNA, 22 bp, Homo sapiens
tctctcttttttgaacccgctc

SEQ ID NO: 8498195 - DNA, 22 bp, Homo sapiens
tctctctttttaatcatgtaat

SEQ ID NO: 8498196 - DNA, 22 bp, Homo sapiens
tctctctttttaatcatgtaat

SEQ ID NO: 8498197 - DNA, 22 bp, Homo sapiens
tctctctttttaatcatgtaat

SEQ ID NO: 8498198 - DNA, 22 bp, Homo sapiens
tctctgaagagtcagacataac

SEQ ID NO: 8498199 - DNA, 22 bp, Homo sapiens
tctctgaagatatttattatta

SEQ ID NO: 8498200 - DNA, 22 bp, Homo sapiens
tctctgaagaatcgatgattct

SEQ ID NO: 8498201 - DNA, 22 bp, Homo sapiens
tctctgaattctgatgcaagtg

SEQ ID NO: 8498202 - DNA, 18 bp, Homo sapiens
tctctgaatattttatgt

SEQ ID NO: 8498203 - DNA, 22 bp, Homo sapiens
tctctgaattgtttaagttatt

SEQ ID NO: 8498204 - DNA, 22 bp, Homo sapiens
tctctgaattgtttaagttatt

SEQ ID NO: 8498205 - DNA, 18 bp, Homo sapiens
tctctgaatattttatgt

SEQ ID NO: 8498206 - DNA, 22 bp, Homo sapiens
tctctgaaggctgtgttgatgg

SEQ ID NO: 8498207 - DNA, 22 bp, Homo sapiens
tctctgaagatatttattatta

SEQ ID NO: 8498208 - DNA, 22 bp, Homo sapiens
tctctcagactccccatggttt

SEQ ID NO: 8498209 - DNA, 22 bp, Homo sapiens
tctctcagaggaagaggcagtg

SEQ ID NO: 8498210 - DNA, 22 bp, Homo sapiens
tctctcagaggaagaggcagtg

SEQ ID NO: 8498211 - DNA, 22 bp, Homo sapiens
tctctcagaactgcagctgcag

SEQ ID NO: 8498212 - DNA, 22 bp, Homo sapiens
tctctcagaaagcccatgtctg

SEQ ID NO: 8498213 - DNA, 22 bp, Homo sapiens
tctctcagaaagcccatgtctg

SEQ ID NO: 8498214 - DNA, 22 bp, Homo sapiens
tctctcagaaagcccatgtctg

SEQ ID NO: 8498215 - DNA, 22 bp, Homo sapiens
tctctcactggtgcctctgttg

SEQ ID NO: 8498216 - DNA, 20 bp, Homo sapiens
tctctattcccacgaggaaa

SEQ ID NO: 8498217 - DNA, 20 bp, Homo sapiens
tctctattcccacgaggaaa

SEQ ID NO: 8498218 - DNA, 22 bp, Homo sapiens
tctctcactggtgcctctgttg

SEQ ID NO: 8498219 - DNA, 22 bp, Homo sapiens
tctctattaattgacaatggct

SEQ ID NO: 8498220 - DNA, 22 bp, Homo sapiens
tctctcatagagaaaaatatat

SEQ ID NO: 8498221 - DNA, 22 bp, Homo sapiens
tctctcataagatgagtactta

SEQ ID NO: 8498222 - DNA, 22 bp, Homo sapiens
tctctccaacatggtggtgctg

SEQ ID NO: 8498223 - DNA, 22 bp, Homo sapiens
tctctcataagatgagtactta

SEQ ID NO: 8498224 - DNA, 22 bp, Homo sapiens
tctctcatagagaaaaatatat

SEQ ID NO: 8498225 - DNA, 18 bp, Homo sapiens
tctctcagggaaacagaa

SEQ ID NO: 8498226 - DNA, 22 bp, Homo sapiens
tctctcaggctggagtgcagtg

SEQ ID NO: 8498227 - DNA, 22 bp, Homo sapiens
tctctcagggggaaggctgaag

SEQ ID NO: 8498228 - DNA, 22 bp, Homo sapiens
tctctcagggggaaggctgaag

SEQ ID NO: 8498229 - DNA, 22 bp, Homo sapiens
tctctcagaggccagggtcctg

SEQ ID NO: 8498230 - DNA, 22 bp, Homo sapiens
tctctcagatggggcactagta

SEQ ID NO: 8498231 - DNA, 22 bp, Homo sapiens
tctctcagctttgagacctgct

SEQ ID NO: 8498232 - DNA, 22 bp, Homo sapiens
tctctcaggaggcaggttccta

SEQ ID NO: 8498233 - DNA, 22 bp, Homo sapiens
tctctcagctttgagacctgct

SEQ ID NO: 8498234 - DNA, 22 bp, Homo sapiens
tctctcagctttgagacctgct

SEQ ID NO: 8498235 - DNA, 22 bp, Homo sapiens
tctctcaggctggagtgcagtg

SEQ ID NO: 8498236 - DNA, 22 bp, Homo sapiens
tctctcaggctggagtgcagtg

SEQ ID NO: 8498237 - DNA, 22 bp, Homo sapiens
tctctctgagccctgctttttc

SEQ ID NO: 8498238 - DNA, 22 bp, Homo sapiens
tctctctgagccctgctttttc

SEQ ID NO: 8498239 - DNA, 18 bp, Homo sapiens
tctctctgataacatttt

SEQ ID NO: 8498240 - DNA, 22 bp, Homo sapiens
tctctctgagttgagcaggagt

SEQ ID NO: 8498241 - DNA, 18 bp, Homo sapiens
tctctctgaagagttccc

SEQ ID NO: 8498242 - DNA, 18 bp, Homo sapiens
tctctctgaagagttccc

SEQ ID NO: 8498243 - DNA, 22 bp, Homo sapiens
tctctctcctagtttttagtgg

SEQ ID NO: 8498244 - DNA, 22 bp, Homo sapiens
tctctctcctagtttttagtgg

SEQ ID NO: 8498245 - DNA, 22 bp, Homo sapiens
tctctctcagccattacagaac

SEQ ID NO: 8498246 - DNA, 22 bp, Homo sapiens
tctctctaggcatctattttca

SEQ ID NO: 8498247 - DNA, 22 bp, Homo sapiens
tctctccttatcattgtgttta

SEQ ID NO: 8498248 - DNA, 22 bp, Homo sapiens
tctctcctgtgttctgatgttt

SEQ ID NO: 8498249 - DNA, 22 bp, Homo sapiens
tctctcctgtgttctgatgttt

SEQ ID NO: 8498250 - DNA, 22 bp, Homo sapiens
tctctcctgcactgaattatgt

SEQ ID NO: 8498251 - DNA, 18 bp, Homo sapiens
tctctccatctatttgtt

SEQ ID NO: 8498252 - DNA, 22 bp, Homo sapiens
tctctccctttccttatcagtt

SEQ ID NO: 8498253 - DNA, 22 bp, Homo sapiens
tctctcctaatttcaggtgctt

SEQ ID NO: 8498254 - DNA, 22 bp, Homo sapiens
tctctgggggtagaactcaggc

SEQ ID NO: 8498255 - DNA, 22 bp, Homo sapiens
tctctgggggtagaactcaggc

SEQ ID NO: 8498256 - DNA, 22 bp, Homo sapiens
tctctggggatggacctgggag

SEQ ID NO: 8498257 - DNA, 22 bp, Homo sapiens
tctctggggatgcttattcttg

SEQ ID NO: 8498258 - DNA, 22 bp, Homo sapiens
tctctggggcctttctacatca

SEQ ID NO: 8498259 - DNA, 22 bp, Homo sapiens
tctctggggatggacctgggag

SEQ ID NO: 8498260 - DNA, 22 bp, Homo sapiens
tctctgggtattcactgccttc

SEQ ID NO: 8498261 - DNA, 22 bp, Homo sapiens
tctctgggtattcactgccttc

SEQ ID NO: 8498262 - DNA, 22 bp, Homo sapiens
tctctgggtaaagttctctcat

SEQ ID NO: 8498263 - DNA, 22 bp, Homo sapiens
tctctgggtaaagttctctcat

SEQ ID NO: 8498264 - DNA, 22 bp, Homo sapiens
tctctgggttctcactcagcac

SEQ ID NO: 8498265 - DNA, 20 bp, Homo sapiens
tctctgggttctcactcagc

SEQ ID NO: 8498266 - DNA, 22 bp, Homo sapiens
tctctgggtcctggcaagctca

SEQ ID NO: 8498267 - DNA, 22 bp, Homo sapiens
tctctgggtgatggcagggcac

SEQ ID NO: 8498268 - DNA, 22 bp, Homo sapiens
tctctgggtgatggcagggcac

SEQ ID NO: 8498269 - DNA, 22 bp, Homo sapiens
tctctggggatgcttattcttg

SEQ ID NO: 8498270 - DNA, 19 bp, Homo sapiens
tctctggggacactttcac

SEQ ID NO: 8498271 - DNA, 19 bp, Homo sapiens
tctctggggacactttcac

SEQ ID NO: 8498272 - DNA, 19 bp, Homo sapiens
tctctggggacactttcac

SEQ ID NO: 8498273 - DNA, 22 bp, Homo sapiens
tctctgggctcaggagcccggc

SEQ ID NO: 8498274 - DNA, 22 bp, Homo sapiens
tctctgggcctgttttctcatc

SEQ ID NO: 8498275 - DNA, 22 bp, Homo sapiens
tctctgggcctccctttccaag

SEQ ID NO: 8498276 - DNA, 22 bp, Homo sapiens
tctctgggcctgttttctcatc

SEQ ID NO: 8498277 - DNA, 22 bp, Homo sapiens
tctctgggcctcagttttctca

SEQ ID NO: 8498278 - DNA, 21 bp, Homo sapiens
tctctgggccctcctgtgggg

SEQ ID NO: 8498279 - DNA, 21 bp, Homo sapiens
tctctgggccctcctgtgggg

SEQ ID NO: 8498280 - DNA, 21 bp, Homo sapiens
tctctgggccctcctgtgggg

SEQ ID NO: 8498281 - DNA, 22 bp, Homo sapiens
tctctgggcccagaccttcctt

SEQ ID NO: 8498282 - DNA, 22 bp, Homo sapiens
tctctgggatcgttttgggctc

SEQ ID NO: 8498283 - DNA, 22 bp, Homo sapiens
tctctgggcccagaccttcctt

SEQ ID NO: 8498284 - DNA, 22 bp, Homo sapiens
tctctgggcccagaccttcctt

SEQ ID NO: 8498285 - DNA, 22 bp, Homo sapiens
tctctggctggcaccccaggga

SEQ ID NO: 8498286 - DNA, 22 bp, Homo sapiens
tctctggctggcaccccaggga

SEQ ID NO: 8498287 - DNA, 22 bp, Homo sapiens
tctctgggatcaggtggcccag

SEQ ID NO: 8498288 - DNA, 19 bp, Homo sapiens
tctctggcttgtctgcctg

SEQ ID NO: 8498289 - DNA, 19 bp, Homo sapiens
tctctgccgatcagggccc

SEQ ID NO: 8498290 - DNA, 19 bp, Homo sapiens
tctctgccgatcagggccc

SEQ ID NO: 8498291 - DNA, 22 bp, Homo sapiens
tctctgctcaggcaccagccct

SEQ ID NO: 8498292 - DNA, 22 bp, Homo sapiens
tctctgctaagattgtgtctag

SEQ ID NO: 8498293 - DNA, 22 bp, Homo sapiens
tctctgctaagattgtgtctag

SEQ ID NO: 8498294 - DNA, 22 bp, Homo sapiens
tctctgctaagattgtgtctag

SEQ ID NO: 8498295 - DNA, 22 bp, Homo sapiens
tctctgctctgtgcctcagttt

SEQ ID NO: 8498296 - DNA, 22 bp, Homo sapiens
tctctgctctgtgcctcagttt

SEQ ID NO: 8498297 - DNA, 22 bp, Homo sapiens
tctctgctctgtgcctcagttt

SEQ ID NO: 8498298 - DNA, 22 bp, Homo sapiens
tctctgctctgtgcctcagttt

SEQ ID NO: 8498299 - DNA, 22 bp, Homo sapiens
tctctgctctgtgcctcagttt

SEQ ID NO: 8498300 - DNA, 22 bp, Homo sapiens
tctctgctctgtgcctcagttt

SEQ ID NO: 8498301 - DNA, 19 bp, Homo sapiens
tctctgcttctcttggcat

SEQ ID NO: 8498302 - DNA, 16 bp, Homo sapiens
tctctgcttcataggt

SEQ ID NO: 8498303 - DNA, 20 bp, Homo sapiens
tctctgctgtccacatttgc

SEQ ID NO: 8498304 - DNA, 20 bp, Homo sapiens
tctctgctgtccacatttgc

SEQ ID NO: 8498305 - DNA, 22 bp, Homo sapiens
tctctgctgagaagggctggca

SEQ ID NO: 8498306 - DNA, 22 bp, Homo sapiens
tctctgctgagaagggctggca

SEQ ID NO: 8498307 - DNA, 21 bp, Homo sapiens
tctctggaattagaccatgtt

SEQ ID NO: 8498308 - DNA, 21 bp, Homo sapiens
tctctggaattagaccatgtt

SEQ ID NO: 8498309 - DNA, 22 bp, Homo sapiens
tctctggaagcgcagatctgtt

SEQ ID NO: 8498310 - DNA, 22 bp, Homo sapiens
tctctggaattggctgaggcaa

SEQ ID NO: 8498311 - DNA, 22 bp, Homo sapiens
tctctggaagcgcagatctgtt

SEQ ID NO: 8498312 - DNA, 22 bp, Homo sapiens
tctctgcttggtgtatgtgagt

SEQ ID NO: 8498313 - DNA, 19 bp, Homo sapiens
tctctgcttctcttggcat

SEQ ID NO: 8498314 - DNA, 19 bp, Homo sapiens
tctctgcttctcttggcat

SEQ ID NO: 8498315 - DNA, 19 bp, Homo sapiens
tctctgcttctcttggcat

SEQ ID NO: 8498316 - DNA, 22 bp, Homo sapiens
tctctgcttggtgtatgtgagt

SEQ ID NO: 8498317 - DNA, 19 bp, Homo sapiens
tctctgcttctcttggcat

SEQ ID NO: 8498318 - DNA, 22 bp, Homo sapiens
tctctggagctgcagatccagg

SEQ ID NO: 8498319 - DNA, 22 bp, Homo sapiens
tctctggaattttgagagtgac

SEQ ID NO: 8498320 - DNA, 22 bp, Homo sapiens
tctctggaattttgagagtgac

SEQ ID NO: 8498321 - DNA, 22 bp, Homo sapiens
tctctggagggctccaggcggg

SEQ ID NO: 8498322 - DNA, 22 bp, Homo sapiens
tctctggagtataaccagggat

SEQ ID NO: 8498323 - DNA, 22 bp, Homo sapiens
tctctggagtataaccagggat

SEQ ID NO: 8498324 - DNA, 21 bp, Homo sapiens
tctctggagttagcagagaga

SEQ ID NO: 8498325 - DNA, 22 bp, Homo sapiens
tctctggagtataaccagggat

SEQ ID NO: 8498326 - DNA, 19 bp, Homo sapiens
tctctggcatagactcaat

SEQ ID NO: 8498327 - DNA, 22 bp, Homo sapiens
tctctggccccatggctgagct

SEQ ID NO: 8498328 - DNA, 22 bp, Homo sapiens
tctctggctgatattcctctgc

SEQ ID NO: 8498329 - DNA, 22 bp, Homo sapiens
tctctggcagacacctccctga

SEQ ID NO: 8498330 - DNA, 21 bp, Homo sapiens
tctctggagttagcagagaga

SEQ ID NO: 8498331 - DNA, 22 bp, Homo sapiens
tctctggcagggatatctggct

SEQ ID NO: 8498332 - DNA, 22 bp, Homo sapiens
tctgaaaatgttgactttgttt

SEQ ID NO: 8498333 - DNA, 22 bp, Homo sapiens
tctgaaaatgttgactttgttt

SEQ ID NO: 8498334 - DNA, 22 bp, Homo sapiens
tctgaaaactccatgagctcgt

SEQ ID NO: 8498335 - DNA, 22 bp, Homo sapiens
tctgaaagaaagattttgtttc

SEQ ID NO: 8498336 - DNA, 22 bp, Homo sapiens
tctgaaagagagtacatacagt

SEQ ID NO: 8498337 - DNA, 22 bp, Homo sapiens
tctgaaagagagtacatacagt

SEQ ID NO: 8498338 - DNA, 22 bp, Homo sapiens
tctgaaagaagggcagtctttt

SEQ ID NO: 8498339 - DNA, 21 bp, Homo sapiens
tctctttgggaacattaatca

SEQ ID NO: 8498340 - DNA, 20 bp, Homo sapiens
tctcttttagcttacagctg

SEQ ID NO: 8498341 - DNA, 22 bp, Homo sapiens
tctgaaataaatgcactgttag

SEQ ID NO: 8498342 - DNA, 22 bp, Homo sapiens
tctgaaataaatgcactgttag

SEQ ID NO: 8498343 - DNA, 22 bp, Homo sapiens
tctgaaataactgatgccagat

SEQ ID NO: 8498344 - DNA, 22 bp, Homo sapiens
tctgaaataagggagaagggaa

SEQ ID NO: 8498345 - DNA, 22 bp, Homo sapiens
tctgaaataactgatgccagat

SEQ ID NO: 8498346 - DNA, 22 bp, Homo sapiens
tctgaaataactgatgccagat

SEQ ID NO: 8498347 - DNA, 22 bp, Homo sapiens
tctgaaatactgcaggttctct

SEQ ID NO: 8498348 - DNA, 22 bp, Homo sapiens
tctgaaatactgcaggttctct

SEQ ID NO: 8498349 - DNA, 22 bp, Homo sapiens
tctgaaatagaagtgtctttct

SEQ ID NO: 8498350 - DNA, 22 bp, Homo sapiens
tctgaaatagaagtgtctttct

SEQ ID NO: 8498351 - DNA, 22 bp, Homo sapiens
tctgaaataagggagaagggaa

SEQ ID NO: 8498352 - DNA, 22 bp, Homo sapiens
tctgaaatactgcaggttctct

SEQ ID NO: 8498353 - DNA, 22 bp, Homo sapiens
tctgaaatactgcaggttctct

SEQ ID NO: 8498354 - DNA, 22 bp, Homo sapiens
tctgaaagggctaaataatttg

SEQ ID NO: 8498355 - DNA, 22 bp, Homo sapiens
tctgaaagctagaaaatgctct

SEQ ID NO: 8498356 - DNA, 22 bp, Homo sapiens
tctgaaagtatctggatctttt

SEQ ID NO: 8498357 - DNA, 22 bp, Homo sapiens
tctgaaagtatctggatctttt

SEQ ID NO: 8498358 - DNA, 22 bp, Homo sapiens
tctgaaagtctgaaacagtgtc

SEQ ID NO: 8498359 - DNA, 22 bp, Homo sapiens
tctgaaataaatgcactgttag

SEQ ID NO: 8498360 - DNA, 18 bp, Homo sapiens
tctgaaagcccttttcca

SEQ ID NO: 8498361 - DNA, 22 bp, Homo sapiens
tctgaaagccctagtttgtaat

SEQ ID NO: 8498362 - DNA, 22 bp, Homo sapiens
tctgaaagccctagtttgtaat

SEQ ID NO: 8498363 - DNA, 22 bp, Homo sapiens
tctgaaagcattacagtttatt

SEQ ID NO: 8498364 - DNA, 22 bp, Homo sapiens
tctgaaagccctagtttgtaat

SEQ ID NO: 8498365 - DNA, 22 bp, Homo sapiens
tctctttctttgtatgtctatt

SEQ ID NO: 8498366 - DNA, 21 bp, Homo sapiens
tctctttctggaagcttccct

SEQ ID NO: 8498367 - DNA, 22 bp, Homo sapiens
tctctttctttgtatgtctatt

SEQ ID NO: 8498368 - DNA, 18 bp, Homo sapiens
tctctttcctcagtggag

SEQ ID NO: 8498369 - DNA, 22 bp, Homo sapiens
tctctttctattgcaccatgct

SEQ ID NO: 8498370 - DNA, 17 bp, Homo sapiens
tctctttccctttctgc

SEQ ID NO: 8498371 - DNA, 17 bp, Homo sapiens
tctctttccctttctgc

SEQ ID NO: 8498372 - DNA, 17 bp, Homo sapiens
tctctttccctttctgc

SEQ ID NO: 8498373 - DNA, 22 bp, Homo sapiens
tctctttaaagactcagagatt

SEQ ID NO: 8498374 - DNA, 22 bp, Homo sapiens
tctctttagtgcttagacgtct

SEQ ID NO: 8498375 - DNA, 22 bp, Homo sapiens
tctctttaaaaatagtgaaata

SEQ ID NO: 8498376 - DNA, 22 bp, Homo sapiens
tctctttaaaaatagtgaaata

SEQ ID NO: 8498377 - DNA, 22 bp, Homo sapiens
tctctttaaaaatagtgaaata

SEQ ID NO: 8498378 - DNA, 22 bp, Homo sapiens
tctcttcttgtgttttcctgcc

SEQ ID NO: 8498379 - DNA, 22 bp, Homo sapiens
tctcttcttgtgttttcctgcc

SEQ ID NO: 8498380 - DNA, 17 bp, Homo sapiens
tctcttgttcactgctg

SEQ ID NO: 8498381 - DNA, 22 bp, Homo sapiens
tctcttctttggggtgggctca

SEQ ID NO: 8498382 - DNA, 22 bp, Homo sapiens
tctgaaatgttctcttgttttg

SEQ ID NO: 8498383 - DNA, 22 bp, Homo sapiens
tctgaaattcacagttgagtca

SEQ ID NO: 8498384 - DNA, 22 bp, Homo sapiens
tctgaaatgttctcttgttttg

SEQ ID NO: 8498385 - DNA, 22 bp, Homo sapiens
tctgaaattcacagttgagtca

SEQ ID NO: 8498386 - DNA, 22 bp, Homo sapiens
tctgaaattcacagttgagtca

SEQ ID NO: 8498387 - DNA, 22 bp, Homo sapiens
tctgaaatggcgatggccgttg

SEQ ID NO: 8498388 - DNA, 22 bp, Homo sapiens
tctgaaatgttctcttgttttg

SEQ ID NO: 8498389 - DNA, 22 bp, Homo sapiens
tctgaaatgttctcttgttttg

SEQ ID NO: 8498390 - DNA, 22 bp, Homo sapiens
tctgaaattttagttatagaaa

SEQ ID NO: 8498391 - DNA, 22 bp, Homo sapiens
tctgaaattttagttatagaaa

SEQ ID NO: 8498392 - DNA, 22 bp, Homo sapiens
tctgaaattgttagtaaaaatg

SEQ ID NO: 8498393 - DNA, 22 bp, Homo sapiens
tctgaaattgttagtaaaaatg

SEQ ID NO: 8498394 - DNA, 22 bp, Homo sapiens
tctgaaattccttccagacttt

SEQ ID NO: 8498395 - DNA, 22 bp, Homo sapiens
tctgaaattccttccagacttt

SEQ ID NO: 8498396 - DNA, 22 bp, Homo sapiens
tctgaaattccttccagacttt

SEQ ID NO: 8498397 - DNA, 22 bp, Homo sapiens
tctgaaatgcaggcaatttgct

SEQ ID NO: 8498398 - DNA, 22 bp, Homo sapiens
tctgaaatggcagcgggaatga

SEQ ID NO: 8498399 - DNA, 22 bp, Homo sapiens
tctgaaatggcagcgggaatga

SEQ ID NO: 8498400 - DNA, 22 bp, Homo sapiens
tctgaaatgcaggcaatttgct

SEQ ID NO: 8498401 - DNA, 22 bp, Homo sapiens
tctgaaatggcgatggccgttg

SEQ ID NO: 8498402 - DNA, 22 bp, Homo sapiens
tctgaaatggcgatggccgttg

SEQ ID NO: 8498403 - DNA, 22 bp, Homo sapiens
tctgaaatggggctgaagcact

SEQ ID NO: 8498404 - DNA, 22 bp, Homo sapiens
tctgaaatggggctgaagcact

SEQ ID NO: 8498405 - DNA, 22 bp, Homo sapiens
tctgaaatgcaaatttgactga

SEQ ID NO: 8498406 - DNA, 22 bp, Homo sapiens
tctgaaatgcaggcaatttgct

SEQ ID NO: 8498407 - DNA, 22 bp, Homo sapiens
tctgaaatgcaaatttgactga

SEQ ID NO: 8498408 - DNA, 22 bp, Homo sapiens
tctgaaatgcaaatttgactga

SEQ ID NO: 8498409 - DNA, 22 bp, Homo sapiens
tctgaaatgcaaatttgactga

SEQ ID NO: 8498410 - DNA, 22 bp, Homo sapiens
tctgaaataggaaagcaaatgg

SEQ ID NO: 8498411 - DNA, 22 bp, Homo sapiens
tctgaagaactgtctagagaac

SEQ ID NO: 8498412 - DNA, 22 bp, Homo sapiens
tctgaagaactgtctagagaac

SEQ ID NO: 8498413 - DNA, 22 bp, Homo sapiens
tctgaagaactgagtaaacatg

SEQ ID NO: 8498414 - DNA, 20 bp, Homo sapiens
tctgaagaaagacagggact

SEQ ID NO: 8498415 - DNA, 22 bp, Homo sapiens
tctgaacatgatgtcatctgga

SEQ ID NO: 8498416 - DNA, 22 bp, Homo sapiens
tctgaactccagccctgctctc

SEQ ID NO: 8498417 - DNA, 22 bp, Homo sapiens
tctgaacagaaaagatgcacaa

SEQ ID NO: 8498418 - DNA, 22 bp, Homo sapiens
tctgaacatccagcaatgcaca

SEQ ID NO: 8498419 - DNA, 22 bp, Homo sapiens
tctgaacagcatggaatcattt

SEQ ID NO: 8498420 - DNA, 22 bp, Homo sapiens
tctgaacagcatggaatcattt

SEQ ID NO: 8498421 - DNA, 22 bp, Homo sapiens
tctgaacatgatgtcatctgga

SEQ ID NO: 8498422 - DNA, 22 bp, Homo sapiens
tctgaacattttttgcagccta

SEQ ID NO: 8498423 - DNA, 22 bp, Homo sapiens
tctgaacatggcttcctcttca

SEQ ID NO: 8498424 - DNA, 20 bp, Homo sapiens
tctgaacaaaatgtaatgtc

SEQ ID NO: 8498425 - DNA, 20 bp, Homo sapiens
tctgaacaaaatgtaatgtc

SEQ ID NO: 8498426 - DNA, 22 bp, Homo sapiens
tctgaaattttagttatagaaa

SEQ ID NO: 8498427 - DNA, 21 bp, Homo sapiens
tctgaacaacatacgaatctt

SEQ ID NO: 8498428 - DNA, 21 bp, Homo sapiens
tctgaacaacatacgaatctt

SEQ ID NO: 8498429 - DNA, 20 bp, Homo sapiens
tctgaacacaatatatcccc

SEQ ID NO: 8498430 - DNA, 22 bp, Homo sapiens
tctgaaggtgctagagaaagct

SEQ ID NO: 8498431 - DNA, 17 bp, Homo sapiens
tctgaagccagtctgct

SEQ ID NO: 8498432 - DNA, 22 bp, Homo sapiens
tctgaagacatatgatatggtg

SEQ ID NO: 8498433 - DNA, 19 bp, Homo sapiens
tctgaagaattagagagca

SEQ ID NO: 8498434 - DNA, 19 bp, Homo sapiens
tctgaagaattagagagca

SEQ ID NO: 8498435 - DNA, 22 bp, Homo sapiens
tctgaagaggctcttgataaga

SEQ ID NO: 8498436 - DNA, 22 bp, Homo sapiens
tctgaagagtcatctttgggtg

SEQ ID NO: 8498437 - DNA, 22 bp, Homo sapiens
tctgaagattaccagctaaatg

SEQ ID NO: 8498438 - DNA, 23 bp, Homo sapiens
tctgaagatgctgtttccagtga

SEQ ID NO: 8498439 - DNA, 22 bp, Homo sapiens
tctgaagatatgagctttatga

SEQ ID NO: 8498440 - DNA, 23 bp, Homo sapiens
tctgaagatgctgtttccagtga

SEQ ID NO: 8498441 - DNA, 22 bp, Homo sapiens
tctgaagagtcttgcaagaaag

SEQ ID NO: 8498442 - DNA, 22 bp, Homo sapiens
tctgaagagtcttgcaagaaag

SEQ ID NO: 8498443 - DNA, 22 bp, Homo sapiens
tctcttctgaaacctgtcttta

SEQ ID NO: 8498444 - DNA, 22 bp, Homo sapiens
tctcttctctagtgagcaactg

SEQ ID NO: 8498445 - DNA, 22 bp, Homo sapiens
tctcttctgaaacctgtcttta

SEQ ID NO: 8498446 - DNA, 22 bp, Homo sapiens
tctcttctgaaacctgtcttta

SEQ ID NO: 8498447 - DNA, 22 bp, Homo sapiens
tctcttctgaaacctgtcttta

SEQ ID NO: 8498448 - DNA, 20 bp, Homo sapiens
tctcttctggggagataaaa

SEQ ID NO: 8498449 - DNA, 20 bp, Homo sapiens
tctcttctggggagataaaa

SEQ ID NO: 8498450 - DNA, 22 bp, Homo sapiens
tctcttctgacctagccttgga

SEQ ID NO: 8498451 - DNA, 22 bp, Homo sapiens
tctcttctgacctagccttgga

SEQ ID NO: 8498452 - DNA, 22 bp, Homo sapiens
tctcttcttgattttcactgga

SEQ ID NO: 8498453 - DNA, 18 bp, Homo sapiens
tctcttcttggcagtcaa

SEQ ID NO: 8498454 - DNA, 22 bp, Homo sapiens
tctcttcttgattttcactgga

SEQ ID NO: 8498455 - DNA, 22 bp, Homo sapiens
tctcttcttgattttcactgga

SEQ ID NO: 8498456 - DNA, 22 bp, Homo sapiens
tctcttcttgattttcactgga

SEQ ID NO: 8498457 - DNA, 20 bp, Homo sapiens
tctcttctggggagataaaa

SEQ ID NO: 8498458 - DNA, 18 bp, Homo sapiens
tctcttcttggcagtcaa

SEQ ID NO: 8498459 - DNA, 18 bp, Homo sapiens
tctcttcttggcagtcaa

SEQ ID NO: 8498460 - DNA, 18 bp, Homo sapiens
tctcttcttggcagtcaa

SEQ ID NO: 8498461 - DNA, 22 bp, Homo sapiens
tctcttcttgtgttttcctgcc

SEQ ID NO: 8498462 - DNA, 22 bp, Homo sapiens
tctcttctatttgagactattt

SEQ ID NO: 8498463 - DNA, 22 bp, Homo sapiens
tctcttctatttgagactattt

SEQ ID NO: 8498464 - DNA, 22 bp, Homo sapiens
tctcttctatttgagactattt

SEQ ID NO: 8498465 - DNA, 22 bp, Homo sapiens
tctcttctatttgagactattt

SEQ ID NO: 8498466 - DNA, 19 bp, Homo sapiens
tctcttctccctggtttta

SEQ ID NO: 8498467 - DNA, 19 bp, Homo sapiens
tctcttctccctggtttta

SEQ ID NO: 8498468 - DNA, 22 bp, Homo sapiens
tctcttctctagtgagcaactg

SEQ ID NO: 8498469 - DNA, 22 bp, Homo sapiens
tctcttctctagtgagcaactg

SEQ ID NO: 8498470 - DNA, 22 bp, Homo sapiens
tctcttctaattttcccgagta

SEQ ID NO: 8498471 - DNA, 22 bp, Homo sapiens
tctcttctaattttcccgagta

SEQ ID NO: 8498472 - DNA, 22 bp, Homo sapiens
tctcttctaattagggtccatg

SEQ ID NO: 8498473 - DNA, 22 bp, Homo sapiens
tctcttctaattagggtccatg

SEQ ID NO: 8498474 - DNA, 22 bp, Homo sapiens
tctcttctaattagggtccatg

SEQ ID NO: 8498475 - DNA, 22 bp, Homo sapiens
tctcttctagcttcttgtggtt

SEQ ID NO: 8498476 - DNA, 22 bp, Homo sapiens
tctcttctagcttcttgtggtt

SEQ ID NO: 8498477 - DNA, 22 bp, Homo sapiens
tctcttctagcttcttgtggtt

SEQ ID NO: 8498478 - DNA, 22 bp, Homo sapiens
tctcttctagcttcttgtggtt

SEQ ID NO: 8498479 - DNA, 22 bp, Homo sapiens
tctcttctagcttcttgtggtt

SEQ ID NO: 8498480 - DNA, 22 bp, Homo sapiens
tctcttccttgacctattgtaa

SEQ ID NO: 8498481 - DNA, 21 bp, Homo sapiens
tctcttcctccgcgccgccgc

SEQ ID NO: 8498482 - DNA, 22 bp, Homo sapiens
tctcttccctttatggtatgtg

SEQ ID NO: 8498483 - DNA, 22 bp, Homo sapiens
tctcttctaacactagaaattc

SEQ ID NO: 8498484 - DNA, 22 bp, Homo sapiens
tctcttctaacactagaaattc

SEQ ID NO: 8498485 - DNA, 22 bp, Homo sapiens
tctcttctaacactagaaattc

SEQ ID NO: 8498486 - DNA, 22 bp, Homo sapiens
tctcttctaacactagaaattc

SEQ ID NO: 8498487 - DNA, 22 bp, Homo sapiens
tctcttctaacactagaaattc

SEQ ID NO: 8498488 - DNA, 22 bp, Homo sapiens
tctcttccatgtttcagcccca

SEQ ID NO: 8498489 - DNA, 21 bp, Homo sapiens
tctcttcccatcaggacacta

SEQ ID NO: 8498490 - DNA, 22 bp, Homo sapiens
tctcttcccggataaagtaagt

SEQ ID NO: 8498491 - DNA, 22 bp, Homo sapiens
tctcttcacattcctggcaaac

SEQ ID NO: 8498492 - DNA, 22 bp, Homo sapiens
tctcttcacatgcttgctccaa

SEQ ID NO: 8498493 - DNA, 22 bp, Homo sapiens
tctcttcacatgcttgctccaa

SEQ ID NO: 8498494 - DNA, 23 bp, Homo sapiens
tctcttatcacaattcattttgc

SEQ ID NO: 8498495 - DNA, 20 bp, Homo sapiens
tctcttcaggaggtccatgt

SEQ ID NO: 8498496 - DNA, 22 bp, Homo sapiens
tctcttccagtaagagtcttta

SEQ ID NO: 8498497 - DNA, 22 bp, Homo sapiens
tctcttaggagaaattcataaa

SEQ ID NO: 8498498 - DNA, 23 bp, Homo sapiens
tctcttacctgagacatttccta

SEQ ID NO: 8498499 - DNA, 22 bp, Homo sapiens
tctcttaattttggaatagtgt

SEQ ID NO: 8498500 - DNA, 22 bp, Homo sapiens
tctcttaatccggtgctttctg

SEQ ID NO: 8498501 - DNA, 23 bp, Homo sapiens
tctctgtgtgcctcagtttcttc

SEQ ID NO: 8498502 - DNA, 21 bp, Homo sapiens
tctctgtgtctttaagctgga

SEQ ID NO: 8498503 - DNA, 21 bp, Homo sapiens
tctctgtgtctttaagctgga

SEQ ID NO: 8498504 - DNA, 21 bp, Homo sapiens
tctctgtgtctttaagctgga

SEQ ID NO: 8498505 - DNA, 22 bp, Homo sapiens
tctctgtggtatgtcatagcaa

SEQ ID NO: 8498506 - DNA, 22 bp, Homo sapiens
tctctgtggtatgtcatagcaa

SEQ ID NO: 8498507 - DNA, 22 bp, Homo sapiens
tctctgtggtgggaggctgagt

SEQ ID NO: 8498508 - DNA, 22 bp, Homo sapiens
tctctgtggtgggaggctgagt

SEQ ID NO: 8498509 - DNA, 22 bp, Homo sapiens
tctctgtggtgggaggctgagt

SEQ ID NO: 8498510 - DNA, 22 bp, Homo sapiens
tctctgtggtactgagagtcta

SEQ ID NO: 8498511 - DNA, 22 bp, Homo sapiens
tctctgtgggtttcaccagcgc

SEQ ID NO: 8498512 - DNA, 22 bp, Homo sapiens
tctctgtgggctttggacttga

SEQ ID NO: 8498513 - DNA, 22 bp, Homo sapiens
tctctgtgggtttcaccagcgc

SEQ ID NO: 8498514 - DNA, 22 bp, Homo sapiens
tctctgtgtcttagtgaaggga

SEQ ID NO: 8498515 - DNA, 22 bp, Homo sapiens
tctctgtgtcttagtgaaggga

SEQ ID NO: 8498516 - DNA, 19 bp, Homo sapiens
tctctgtgtctctgtttat

SEQ ID NO: 8498517 - DNA, 22 bp, Homo sapiens
tctctgtgtctcatgttcctat

SEQ ID NO: 8498518 - DNA, 22 bp, Homo sapiens
tctctgtgtctcatgttcctat

SEQ ID NO: 8498519 - DNA, 22 bp, Homo sapiens
tctctgtggtgggaggctgagt

SEQ ID NO: 8498520 - DNA, 21 bp, Homo sapiens
tctctgtgtacagtctcaccc

SEQ ID NO: 8498521 - DNA, 22 bp, Homo sapiens
tctctgtggagcagtgtgttca

SEQ ID NO: 8498522 - DNA, 22 bp, Homo sapiens
tctctgtgcccagtagttctct

SEQ ID NO: 8498523 - DNA, 22 bp, Homo sapiens
tctctgtggagcagtgtgttca

SEQ ID NO: 8498524 - DNA, 22 bp, Homo sapiens
tctctgtggagcagtgtgttca

SEQ ID NO: 8498525 - DNA, 22 bp, Homo sapiens
tctctgtggagcagtgtgttca

SEQ ID NO: 8498526 - DNA, 22 bp, Homo sapiens
tctctgtggcaactacttagct

SEQ ID NO: 8498527 - DNA, 21 bp, Homo sapiens
tctctgtggcctaccctctac

SEQ ID NO: 8498528 - DNA, 22 bp, Homo sapiens
tctctgtggcaagcatgctgct

SEQ ID NO: 8498529 - DNA, 22 bp, Homo sapiens
tctctgtggcaagcatgctgct

SEQ ID NO: 8498530 - DNA, 22 bp, Homo sapiens
tctctgtctgagcctggcagac

SEQ ID NO: 8498531 - DNA, 22 bp, Homo sapiens
tctctgtctgagcctggcagac

SEQ ID NO: 8498532 - DNA, 22 bp, Homo sapiens
tctctgtctgagcctggcagac

SEQ ID NO: 8498533 - DNA, 22 bp, Homo sapiens
tctctgtctgagcctggcagac

SEQ ID NO: 8498534 - DNA, 22 bp, Homo sapiens
tctctgtctgcacccaatcaat

SEQ ID NO: 8498535 - DNA, 22 bp, Homo sapiens
tctctgtctttgttgtcttcac

SEQ ID NO: 8498536 - DNA, 22 bp, Homo sapiens
tctctgtctttgttgtcttcac

SEQ ID NO: 8498537 - DNA, 22 bp, Homo sapiens
tctctgtctcccgtgtgtccgg

SEQ ID NO: 8498538 - DNA, 22 bp, Homo sapiens
tctctgtccctaggagccttgc

SEQ ID NO: 8498539 - DNA, 22 bp, Homo sapiens
tctctgtccctaggagccttgc

SEQ ID NO: 8498540 - DNA, 22 bp, Homo sapiens
tctctgtccctaggagccttgc

SEQ ID NO: 8498541 - DNA, 22 bp, Homo sapiens
tctctgtcccctcagctggggt

SEQ ID NO: 8498542 - DNA, 22 bp, Homo sapiens
tctctggttattaactaactcc

SEQ ID NO: 8498543 - DNA, 22 bp, Homo sapiens
tctctgtcacacaatctacaca

SEQ ID NO: 8498544 - DNA, 21 bp, Homo sapiens
tctctggttggagttgtgcca

SEQ ID NO: 8498545 - DNA, 23 bp, Homo sapiens
tctctggttaggggagattggtg

SEQ ID NO: 8498546 - DNA, 22 bp, Homo sapiens
tctctggtggctccatcagtag

SEQ ID NO: 8498547 - DNA, 22 bp, Homo sapiens
tctctgggtttttgtcctgtac

SEQ ID NO: 8498548 - DNA, 22 bp, Homo sapiens
tctctgggtttttgtcctgtac

SEQ ID NO: 8498549 - DNA, 22 bp, Homo sapiens
tctctgtgacatttctgagcct

SEQ ID NO: 8498550 - DNA, 22 bp, Homo sapiens
tctctgtgacatttctgagcct

SEQ ID NO: 8498551 - DNA, 22 bp, Homo sapiens
tctctgtgacatttctgagcct

SEQ ID NO: 8498552 - DNA, 22 bp, Homo sapiens
tctctgtgacatttctgagcct

SEQ ID NO: 8498553 - DNA, 22 bp, Homo sapiens
tctctgtgagatgccttcctga

SEQ ID NO: 8498554 - DNA, 22 bp, Homo sapiens
tctctgtgactgcagctttgca

SEQ ID NO: 8498555 - DNA, 22 bp, Homo sapiens
tctctgtgaatggcgtcacctg

SEQ ID NO: 8498556 - DNA, 22 bp, Homo sapiens
tctctgtgacagctgggtatgt

SEQ ID NO: 8498557 - DNA, 22 bp, Homo sapiens
tctctgtgaagctcccgttagg

SEQ ID NO: 8498558 - DNA, 22 bp, Homo sapiens
tctctgtgaatggcgtcacctg

SEQ ID NO: 8498559 - DNA, 22 bp, Homo sapiens
tctctgtgcaggatgctgagtt

SEQ ID NO: 8498560 - DNA, 22 bp, Homo sapiens
tctctgtgcaggatgctgagtt

SEQ ID NO: 8498561 - DNA, 22 bp, Homo sapiens
tctctgtgcaggatgctgagtt

SEQ ID NO: 8498562 - DNA, 22 bp, Homo sapiens
tctctgtgcaggatgctgagtt

SEQ ID NO: 8498563 - DNA, 22 bp, Homo sapiens
tctctgtgagtggaaggcaccc

SEQ ID NO: 8498564 - DNA, 22 bp, Homo sapiens
tctctgtgagatttgtattaag

SEQ ID NO: 8498565 - DNA, 22 bp, Homo sapiens
tctctgtgagatttgtattaag

SEQ ID NO: 8498566 - DNA, 22 bp, Homo sapiens
tctctgtgagccaggtcctagt

SEQ ID NO: 8498567 - DNA, 22 bp, Homo sapiens
tctctgtgagccaggtcctagt

SEQ ID NO: 8498568 - DNA, 22 bp, Homo sapiens
tctcccaggcaggagtgcagtg

SEQ ID NO: 8498569 - DNA, 22 bp, Homo sapiens
tctcccaggcaggagtgcagtg

SEQ ID NO: 8498570 - DNA, 22 bp, Homo sapiens
tctcccaggctgccctgtggac

SEQ ID NO: 8498571 - DNA, 22 bp, Homo sapiens
tctcccaggctgccctgtggac

SEQ ID NO: 8498572 - DNA, 20 bp, Homo sapiens
tctcccaggctcagggaaga

SEQ ID NO: 8498573 - DNA, 20 bp, Homo sapiens
tctcccaggctcagggaaga

SEQ ID NO: 8498574 - DNA, 20 bp, Homo sapiens
tctcccaggctcagggaaga

SEQ ID NO: 8498575 - DNA, 22 bp, Homo sapiens
tctcccaggtcatacacagaga

SEQ ID NO: 8498576 - DNA, 22 bp, Homo sapiens
tctcccaggtgggtgcctggag

SEQ ID NO: 8498577 - DNA, 22 bp, Homo sapiens
tctcccaggctggagtgcagtg

SEQ ID NO: 8498578 - DNA, 22 bp, Homo sapiens
tctcccaggctggagtgcagtg

SEQ ID NO: 8498579 - DNA, 22 bp, Homo sapiens
tctcccagtggtgcagaaagca

SEQ ID NO: 8498580 - DNA, 22 bp, Homo sapiens
tctcccagtggtgcagaaagca

SEQ ID NO: 8498581 - DNA, 22 bp, Homo sapiens
tctcccagtggtgcagaaagca

SEQ ID NO: 8498582 - DNA, 22 bp, Homo sapiens
tctcccaggtgggtgcctggag

SEQ ID NO: 8498583 - DNA, 22 bp, Homo sapiens
tctcccaggtgggtgcctggag

SEQ ID NO: 8498584 - DNA, 22 bp, Homo sapiens
tctcccaggtgggtgcctggag

SEQ ID NO: 8498585 - DNA, 22 bp, Homo sapiens
tctccccaggggtatgggtatt

SEQ ID NO: 8498586 - DNA, 22 bp, Homo sapiens
tctccccaggggtatgggtatt

SEQ ID NO: 8498587 - DNA, 23 bp, Homo sapiens
tctccctcatgcctaggcctggg

SEQ ID NO: 8498588 - DNA, 23 bp, Homo sapiens
tctccctcatgcctaggcctggg

SEQ ID NO: 8498589 - DNA, 23 bp, Homo sapiens
tctccctcatgcctaggcctggg

SEQ ID NO: 8498590 - DNA, 22 bp, Homo sapiens
tctccctcattcctgcttccat

SEQ ID NO: 8498591 - DNA, 22 bp, Homo sapiens
tctccctcattcctgcttccat

SEQ ID NO: 8498592 - DNA, 22 bp, Homo sapiens
tctccccaaccatggcactcac

SEQ ID NO: 8498593 - DNA, 22 bp, Homo sapiens
tctccccaaaggactcactctc

SEQ ID NO: 8498594 - DNA, 22 bp, Homo sapiens
tctcccattcagcttgcagtca

SEQ ID NO: 8498595 - DNA, 22 bp, Homo sapiens
tctcccagtgtctggcagtcag

SEQ ID NO: 8498596 - DNA, 22 bp, Homo sapiens
tctccaggtagatatgtcagga

SEQ ID NO: 8498597 - DNA, 22 bp, Homo sapiens
tctccaggtgaaacttgcaggg

SEQ ID NO: 8498598 - DNA, 22 bp, Homo sapiens
tctccaggtgactctgatgtat

SEQ ID NO: 8498599 - DNA, 19 bp, Homo sapiens
tctccaggtgccccaaaca

SEQ ID NO: 8498600 - DNA, 19 bp, Homo sapiens
tctccaggtgccccaaaca

SEQ ID NO: 8498601 - DNA, 22 bp, Homo sapiens
tctccaggtgagggtggttaga

SEQ ID NO: 8498602 - DNA, 22 bp, Homo sapiens
tctccaggtgactctgatgtat

SEQ ID NO: 8498603 - DNA, 22 bp, Homo sapiens
tctccaggtgctaagtgtgcct

SEQ ID NO: 8498604 - DNA, 22 bp, Homo sapiens
tctccaggtgctaagtgtgcct

SEQ ID NO: 8498605 - DNA, 22 bp, Homo sapiens
tctccaggtggcttgggcttct

SEQ ID NO: 8498606 - DNA, 21 bp, Homo sapiens
tctccagtatccttctctgag

SEQ ID NO: 8498607 - DNA, 22 bp, Homo sapiens
tctccaggttcagtcgatggaa

SEQ ID NO: 8498608 - DNA, 22 bp, Homo sapiens
tctcccactgcaagcccaggct

SEQ ID NO: 8498609 - DNA, 22 bp, Homo sapiens
tctcccactgcaagcccaggct

SEQ ID NO: 8498610 - DNA, 22 bp, Homo sapiens
tctcccactgcaagcccaggct

SEQ ID NO: 8498611 - DNA, 22 bp, Homo sapiens
tctcccactgcaagcccaggct

SEQ ID NO: 8498612 - DNA, 22 bp, Homo sapiens
tctccaggtggcttgggcttct

SEQ ID NO: 8498613 - DNA, 22 bp, Homo sapiens
tctccaggtggggtcacctttt

SEQ ID NO: 8498614 - DNA, 22 bp, Homo sapiens
tctccaggtggggtcacctttt

SEQ ID NO: 8498615 - DNA, 22 bp, Homo sapiens
tctcccagaggatcccagtgga

SEQ ID NO: 8498616 - DNA, 22 bp, Homo sapiens
tctcccagaggatcccagtgga

SEQ ID NO: 8498617 - DNA, 22 bp, Homo sapiens
tctcccagaggatcccagtgga

SEQ ID NO: 8498618 - DNA, 22 bp, Homo sapiens
tctcccagaagtcctcagtaca

SEQ ID NO: 8498619 - DNA, 22 bp, Homo sapiens
tctcccagaagtcctcagtaca

SEQ ID NO: 8498620 - DNA, 22 bp, Homo sapiens
tctcccactgcaagcccaggct

SEQ ID NO: 8498621 - DNA, 22 bp, Homo sapiens
tctcccactggccttgtatgat

SEQ ID NO: 8498622 - DNA, 22 bp, Homo sapiens
tctcccactggccttgtatgat

SEQ ID NO: 8498623 - DNA, 22 bp, Homo sapiens
tctccagggcccccgagcgttg

SEQ ID NO: 8498624 - DNA, 22 bp, Homo sapiens
tctccaggggcagggtctggag

SEQ ID NO: 8498625 - DNA, 22 bp, Homo sapiens
tctccagggcagagaatagcaa

SEQ ID NO: 8498626 - DNA, 22 bp, Homo sapiens
tctccagggcagagaatagcaa

SEQ ID NO: 8498627 - DNA, 22 bp, Homo sapiens
tctccagggaggtagcccagtg

SEQ ID NO: 8498628 - DNA, 22 bp, Homo sapiens
tctccagggaggtagcccagtg

SEQ ID NO: 8498629 - DNA, 22 bp, Homo sapiens
tctccagggtgagctaggccag

SEQ ID NO: 8498630 - DNA, 22 bp, Homo sapiens
tctccaggggctgctgtgccac

SEQ ID NO: 8498631 - DNA, 22 bp, Homo sapiens
tctccaggggctgctgtgccac

SEQ ID NO: 8498632 - DNA, 22 bp, Homo sapiens
tctccaggtaaatggcatcctg

SEQ ID NO: 8498633 - DNA, 22 bp, Homo sapiens
tctccaggtaaatggcatcctg

SEQ ID NO: 8498634 - DNA, 22 bp, Homo sapiens
tctccagggtgagctaggccag

SEQ ID NO: 8498635 - DNA, 22 bp, Homo sapiens
tctccaggcctttcccatctta

SEQ ID NO: 8498636 - DNA, 22 bp, Homo sapiens
tctccaggcctttcccatctta

SEQ ID NO: 8498637 - DNA, 22 bp, Homo sapiens
tctccaggcctttcccatctta

SEQ ID NO: 8498638 - DNA, 23 bp, Homo sapiens
tctccaggccttactccaggcct

SEQ ID NO: 8498639 - DNA, 22 bp, Homo sapiens
tctccaggcttaatctcagctt

SEQ ID NO: 8498640 - DNA, 22 bp, Homo sapiens
tctccaggcttaatctcagctt

SEQ ID NO: 8498641 - DNA, 22 bp, Homo sapiens
tctccagggacatgtttctgga

SEQ ID NO: 8498642 - DNA, 22 bp, Homo sapiens
tctccaggctttttgtgaattg

SEQ ID NO: 8498643 - DNA, 22 bp, Homo sapiens
tctccaggctttttgtgaattg

SEQ ID NO: 8498644 - DNA, 22 bp, Homo sapiens
tctccaggctttttgtgaattg

SEQ ID NO: 8498645 - DNA, 22 bp, Homo sapiens
tctccagggactgaggctggag

SEQ ID NO: 8498646 - DNA, 22 bp, Homo sapiens
tctccagggactgaggctggag

SEQ ID NO: 8498647 - DNA, 23 bp, Homo sapiens
tctcctcctagatacagtcatgg

SEQ ID NO: 8498648 - DNA, 21 bp, Homo sapiens
tctcctcccggggagaggccg

SEQ ID NO: 8498649 - DNA, 22 bp, Homo sapiens
tctcctccttttttcaacatag

SEQ ID NO: 8498650 - DNA, 22 bp, Homo sapiens
tctcctccttttttcaacatag

SEQ ID NO: 8498651 - DNA, 23 bp, Homo sapiens
tctcctcctagatacagtcatgg

SEQ ID NO: 8498652 - DNA, 23 bp, Homo sapiens
tctcctcctagatacagtcatgg

SEQ ID NO: 8498653 - DNA, 22 bp, Homo sapiens
tctcctctactgggtctgcaga

SEQ ID NO: 8498654 - DNA, 22 bp, Homo sapiens
tctcctaggctggagtgcagtg

SEQ ID NO: 8498655 - DNA, 22 bp, Homo sapiens
tctcctactcactcaaggcttg

SEQ ID NO: 8498656 - DNA, 22 bp, Homo sapiens
tctcctactcactcaaggcttg

SEQ ID NO: 8498657 - DNA, 22 bp, Homo sapiens
tctcctcaccaccagcagcaga

SEQ ID NO: 8498658 - DNA, 22 bp, Homo sapiens
tctcctcaccaccagcagcaga

SEQ ID NO: 8498659 - DNA, 22 bp, Homo sapiens
tctcctcccaggctcttccagg

SEQ ID NO: 8498660 - DNA, 22 bp, Homo sapiens
tctcctgatatctgcagaccta

SEQ ID NO: 8498661 - DNA, 22 bp, Homo sapiens
tctcctgacatgtctggaggaa

SEQ ID NO: 8498662 - DNA, 22 bp, Homo sapiens
tctcctgatgatggtactggca

SEQ ID NO: 8498663 - DNA, 22 bp, Homo sapiens
tctcctctgtgccacagcttgg

SEQ ID NO: 8498664 - DNA, 22 bp, Homo sapiens
tctcctctcttacctggtacaa

SEQ ID NO: 8498665 - DNA, 22 bp, Homo sapiens
tctcctctcttacctggtacaa

SEQ ID NO: 8498666 - DNA, 22 bp, Homo sapiens
tctcctctcttacctggtacaa

SEQ ID NO: 8498667 - DNA, 22 bp, Homo sapiens
tctcctctcctttcatgttgtt

SEQ ID NO: 8498668 - DNA, 22 bp, Homo sapiens
tctcctctatttctgtatgtat

SEQ ID NO: 8498669 - DNA, 22 bp, Homo sapiens
tctcctctatttctgtatgtat

SEQ ID NO: 8498670 - DNA, 22 bp, Homo sapiens
tctcctctatttctgtatgtat

SEQ ID NO: 8498671 - DNA, 22 bp, Homo sapiens
tctcctctatttctgtatgtat

SEQ ID NO: 8498672 - DNA, 22 bp, Homo sapiens
tctcctgctcagaacagcctca

SEQ ID NO: 8498673 - DNA, 22 bp, Homo sapiens
tctcctgctcagaacagcctca

SEQ ID NO: 8498674 - DNA, 22 bp, Homo sapiens
tctcctgctcagaacagcctca

SEQ ID NO: 8498675 - DNA, 22 bp, Homo sapiens
tctcctgctcagaacagcctca

SEQ ID NO: 8498676 - DNA, 22 bp, Homo sapiens
tctcctgcttcaactgatggac

SEQ ID NO: 8498677 - DNA, 22 bp, Homo sapiens
tctcctgcttcaactgatggac

SEQ ID NO: 8498678 - DNA, 22 bp, Homo sapiens
tctcctgctcccaactgctgca

SEQ ID NO: 8498679 - DNA, 22 bp, Homo sapiens
tctcctgctcccaactgctgca

SEQ ID NO: 8498680 - DNA, 22 bp, Homo sapiens
tctcctggagcccagatgctgg

SEQ ID NO: 8498681 - DNA, 22 bp, Homo sapiens
tctcctggtacccttcctagca

SEQ ID NO: 8498682 - DNA, 20 bp, Homo sapiens
tctcctggtgacagtaccca

SEQ ID NO: 8498683 - DNA, 20 bp, Homo sapiens
tctcctggtgacagtaccca

SEQ ID NO: 8498684 - DNA, 22 bp, Homo sapiens
tctcctggtcacctcagaagtc

SEQ ID NO: 8498685 - DNA, 22 bp, Homo sapiens
tctcctgtatgggactggcgag

SEQ ID NO: 8498686 - DNA, 22 bp, Homo sapiens
tctcctgtgcaccctccctgtg

SEQ ID NO: 8498687 - DNA, 22 bp, Homo sapiens
tctctagtctcctttaacctga

SEQ ID NO: 8498688 - DNA, 22 bp, Homo sapiens
tctctagtctcctttaacctga

SEQ ID NO: 8498689 - DNA, 22 bp, Homo sapiens
tctctagtctcctttaacctga

SEQ ID NO: 8498690 - DNA, 21 bp, Homo sapiens
tctcgttgtatggtcttgggg

SEQ ID NO: 8498691 - DNA, 22 bp, Homo sapiens
tctcgctctgtcgcccaggctg

SEQ ID NO: 8498692 - DNA, 22 bp, Homo sapiens
tctcgctctgtcgcccaggctg

SEQ ID NO: 8498693 - DNA, 22 bp, Homo sapiens
tctcgctctgtcgcccaggctg

SEQ ID NO: 8498694 - DNA, 22 bp, Homo sapiens
tctcgctctgtcgcccaggctg

SEQ ID NO: 8498695 - DNA, 22 bp, Homo sapiens
tctcgctctgtcgcccaggctg

SEQ ID NO: 8498696 - DNA, 22 bp, Homo sapiens
tctcgctctgtcgcccaggctg

SEQ ID NO: 8498697 - DNA, 22 bp, Homo sapiens
tctcgctctgtcgcccaggctg

SEQ ID NO: 8498698 - DNA, 22 bp, Homo sapiens
tctcgctctgtcgcccaggctg

SEQ ID NO: 8498699 - DNA, 22 bp, Homo sapiens
tctcgctctgtcgcccaggctg

SEQ ID NO: 8498700 - DNA, 22 bp, Homo sapiens
tctccttgctacccagtatgtc

SEQ ID NO: 8498701 - DNA, 22 bp, Homo sapiens
tctccttcgaggcccagctccc

SEQ ID NO: 8498702 - DNA, 22 bp, Homo sapiens
tctcctttgaaagttaggactg

SEQ ID NO: 8498703 - DNA, 22 bp, Homo sapiens
tctcctttcttttaaaatgtca

SEQ ID NO: 8498704 - DNA, 22 bp, Homo sapiens
tctcctttctggagcctgctca

SEQ ID NO: 8498705 - DNA, 20 bp, Homo sapiens
tctcgcactcggagcagccg

SEQ ID NO: 8498706 - DNA, 22 bp, Homo sapiens
tctcgctctgtcgcccaggctg

SEQ ID NO: 8498707 - DNA, 22 bp, Homo sapiens
tctccaggaagccctccctgac

SEQ ID NO: 8498708 - DNA, 17 bp, Homo sapiens
tctccaggacgagctca

SEQ ID NO: 8498709 - DNA, 22 bp, Homo sapiens
tctccaggactgagctccagcc

SEQ ID NO: 8498710 - DNA, 22 bp, Homo sapiens
tctccaggactgagctccagcc

SEQ ID NO: 8498711 - DNA, 22 bp, Homo sapiens
tctccaggagaaatatgaagga

SEQ ID NO: 8498712 - DNA, 22 bp, Homo sapiens
tctccaggactgagctccagcc

SEQ ID NO: 8498713 - DNA, 22 bp, Homo sapiens
tctccaagaaaagatctcagct

SEQ ID NO: 8498714 - DNA, 22 bp, Homo sapiens
tctccaaatcaatcaatatgaa

SEQ ID NO: 8498715 - DNA, 22 bp, Homo sapiens
tctccaagcagggctgcaaggc

SEQ ID NO: 8498716 - DNA, 22 bp, Homo sapiens
tctccaggaagccctccctgac

SEQ ID NO: 8498717 - DNA, 22 bp, Homo sapiens
tctccaaggccctactctattt

SEQ ID NO: 8498718 - DNA, 22 bp, Homo sapiens
tctccaaggagctcctgtgccg

SEQ ID NO: 8498719 - DNA, 22 bp, Homo sapiens
tctccaggagaaatatgaagga

SEQ ID NO: 8498720 - DNA, 22 bp, Homo sapiens
tctccaggagcaagtcacccag

SEQ ID NO: 8498721 - DNA, 22 bp, Homo sapiens
tctccaggagcaagtcacccag

SEQ ID NO: 8498722 - DNA, 22 bp, Homo sapiens
tctccaggagcaagtcacccag

SEQ ID NO: 8498723 - DNA, 22 bp, Homo sapiens
tctccaggcactacctgggtaa

SEQ ID NO: 8498724 - DNA, 22 bp, Homo sapiens
tctccaggcactacctgggtaa

SEQ ID NO: 8498725 - DNA, 22 bp, Homo sapiens
tctccaggcactacctgggtaa

SEQ ID NO: 8498726 - DNA, 22 bp, Homo sapiens
tctccaggcacttggctgctac

SEQ ID NO: 8498727 - DNA, 22 bp, Homo sapiens
tctccaggcccactgatttata

SEQ ID NO: 8498728 - DNA, 23 bp, Homo sapiens
tctccaggccttactccaggcct

SEQ ID NO: 8498729 - DNA, 19 bp, Homo sapiens
tctccaggcaggtgagcga

SEQ ID NO: 8498730 - DNA, 22 bp, Homo sapiens
tctcatgttttacctgtcctca

SEQ ID NO: 8498731 - DNA, 22 bp, Homo sapiens
tctcatgtattgccctggtgtg

SEQ ID NO: 8498732 - DNA, 22 bp, Homo sapiens
tctcatggtttgtgattcaaat

SEQ ID NO: 8498733 - DNA, 22 bp, Homo sapiens
tctcatggcttgtaggaggtga

SEQ ID NO: 8498734 - DNA, 22 bp, Homo sapiens
tctcatgttttacctgtcctca

SEQ ID NO: 8498735 - DNA, 22 bp, Homo sapiens
tctcattatccatcactgcact

SEQ ID NO: 8498736 - DNA, 20 bp, Homo sapiens
tctcattatatccaagaggc

SEQ ID NO: 8498737 - DNA, 22 bp, Homo sapiens
tctcattcataccctacatgct

SEQ ID NO: 8498738 - DNA, 22 bp, Homo sapiens
tctcattggtatatacatgtgt

SEQ ID NO: 8498739 - DNA, 23 bp, Homo sapiens
tctcatttcccttgatctatctt

SEQ ID NO: 8498740 - DNA, 22 bp, Homo sapiens
tctcattcatccaaggatttat

SEQ ID NO: 8498741 - DNA, 22 bp, Homo sapiens
tctcattcataccctacatgct

SEQ ID NO: 8498742 - DNA, 22 bp, Homo sapiens
tctcatttgcctcatctataaa

SEQ ID NO: 8498743 - DNA, 22 bp, Homo sapiens
tctcatttgcctcatctataaa

SEQ ID NO: 8498744 - DNA, 22 bp, Homo sapiens
tctcatttgcctcatctataaa

SEQ ID NO: 8498745 - DNA, 22 bp, Homo sapiens
tctcatttgcctcatctataaa

SEQ ID NO: 8498746 - DNA, 22 bp, Homo sapiens
tctcatttggctttgttttaaa

SEQ ID NO: 8498747 - DNA, 22 bp, Homo sapiens
tctccaaatagttatatttaga

SEQ ID NO: 8498748 - DNA, 22 bp, Homo sapiens
tctcatttgtgtgcaattcaga

SEQ ID NO: 8498749 - DNA, 22 bp, Homo sapiens
tctcatttgtgtgcaattcaga

SEQ ID NO: 8498750 - DNA, 22 bp, Homo sapiens
tctcattttgagtcagacacta

SEQ ID NO: 8498751 - DNA, 22 bp, Homo sapiens
tctcagtggacgtgtctgtctt

SEQ ID NO: 8498752 - DNA, 22 bp, Homo sapiens
tctcataattaggtaagtcaga

SEQ ID NO: 8498753 - DNA, 22 bp, Homo sapiens
tctcatctagactctgcccttg

SEQ ID NO: 8498754 - DNA, 22 bp, Homo sapiens
tctcatctcaaattgtaatccc

SEQ ID NO: 8498755 - DNA, 22 bp, Homo sapiens
tctcatctccattatagcatca

SEQ ID NO: 8498756 - DNA, 22 bp, Homo sapiens
tctcatctccattatagcatca

SEQ ID NO: 8498757 - DNA, 22 bp, Homo sapiens
tctcatcttcatatctgaaaga

SEQ ID NO: 8498758 - DNA, 22 bp, Homo sapiens
tctcatcttcatatctgaaaga

SEQ ID NO: 8498759 - DNA, 22 bp, Homo sapiens
tctcatctgcgagctctgccag

SEQ ID NO: 8498760 - DNA, 22 bp, Homo sapiens
tctcatctcggatcagaagtga

SEQ ID NO: 8498761 - DNA, 22 bp, Homo sapiens
tctcatctcggatcagaagtga

SEQ ID NO: 8498762 - DNA, 22 bp, Homo sapiens
tctcatctgccatttgcaggag

SEQ ID NO: 8498763 - DNA, 22 bp, Homo sapiens
tctcatctgcgagctctgccag

SEQ ID NO: 8498764 - DNA, 22 bp, Homo sapiens
tctcatctgccatttgcaggag

SEQ ID NO: 8498765 - DNA, 21 bp, Homo sapiens
tctcatctcctgacctgtgcc

SEQ ID NO: 8498766 - DNA, 22 bp, Homo sapiens
tctcatctccattatagcatca

SEQ ID NO: 8498767 - DNA, 22 bp, Homo sapiens
tctcatggagtcaggagcagaa

SEQ ID NO: 8498768 - DNA, 22 bp, Homo sapiens
tctcatgcctggaattatcatt

SEQ ID NO: 8498769 - DNA, 22 bp, Homo sapiens
tctcatgctgtagtgcactaac

SEQ ID NO: 8498770 - DNA, 22 bp, Homo sapiens
tctcatcttgttcatctaccct

SEQ ID NO: 8498771 - DNA, 22 bp, Homo sapiens
tctcatcttcattgtctcccat

SEQ ID NO: 8498772 - DNA, 22 bp, Homo sapiens
tctcatctttaaatgaaaattt

SEQ ID NO: 8498773 - DNA, 22 bp, Homo sapiens
tctcatgaaaggtctctcctgg

SEQ ID NO: 8498774 - DNA, 22 bp, Homo sapiens
tctcatgcatgcataagtctag

SEQ ID NO: 8498775 - DNA, 23 bp, Homo sapiens
tctcagtgaatctcagaattcgc

SEQ ID NO: 8498776 - DNA, 17 bp, Homo sapiens
tctcagtgactgatagc

SEQ ID NO: 8498777 - DNA, 22 bp, Homo sapiens
tctcagtctttgcaaggatgct

SEQ ID NO: 8498778 - DNA, 23 bp, Homo sapiens
tctcagtgaatctcagaattcgc

SEQ ID NO: 8498779 - DNA, 22 bp, Homo sapiens
tctcagtcagccttgatgtccc

SEQ ID NO: 8498780 - DNA, 22 bp, Homo sapiens
tctcagtcagccttgatgtccc

SEQ ID NO: 8498781 - DNA, 22 bp, Homo sapiens
tctcagtgactgctgggtcccc

SEQ ID NO: 8498782 - DNA, 22 bp, Homo sapiens
tctcagtgatggcccatttgga

SEQ ID NO: 8498783 - DNA, 22 bp, Homo sapiens
tctcagtgcagcaaggaattta

SEQ ID NO: 8498784 - DNA, 22 bp, Homo sapiens
tctcagtgcagcttgacagaga

SEQ ID NO: 8498785 - DNA, 22 bp, Homo sapiens
tctcagtgcagcttgacagaga

SEQ ID NO: 8498786 - DNA, 22 bp, Homo sapiens
tctcagggctcagagctcaggc

SEQ ID NO: 8498787 - DNA, 22 bp, Homo sapiens
tctcagggcctccctctgtttc

SEQ ID NO: 8498788 - DNA, 22 bp, Homo sapiens
tctcagggcgcagtgaggcagt

SEQ ID NO: 8498789 - DNA, 22 bp, Homo sapiens
tctcaggggcctggagtcctgg

SEQ ID NO: 8498790 - DNA, 22 bp, Homo sapiens
tctcaggggattcactggcacc

SEQ ID NO: 8498791 - DNA, 22 bp, Homo sapiens
tctcaggtggcccccatgagtg

SEQ ID NO: 8498792 - DNA, 22 bp, Homo sapiens
tctcaggtctcatgccaggcct

SEQ ID NO: 8498793 - DNA, 22 bp, Homo sapiens
tctcagggtttgtacaagtgta

SEQ ID NO: 8498794 - DNA, 22 bp, Homo sapiens
tctcagggtgaggaaagaattt

SEQ ID NO: 8498795 - DNA, 20 bp, Homo sapiens
tctcagggttcagcaaagta

SEQ ID NO: 8498796 - DNA, 22 bp, Homo sapiens
tctcagggtttcctgggggctg

SEQ ID NO: 8498797 - DNA, 19 bp, Homo sapiens
tctcacatcagctcctagc

SEQ ID NO: 8498798 - DNA, 22 bp, Homo sapiens
tctcacaggtgcacgtggctgt

SEQ ID NO: 8498799 - DNA, 22 bp, Homo sapiens
tctcacagtatgaattgttcac

SEQ ID NO: 8498800 - DNA, 22 bp, Homo sapiens
tctcacagtgagcctgaggtcg

SEQ ID NO: 8498801 - DNA, 22 bp, Homo sapiens
tctcacagtgagcctgaggtcg

SEQ ID NO: 8498802 - DNA, 19 bp, Homo sapiens
tctcacagtttccttgcct

SEQ ID NO: 8498803 - DNA, 22 bp, Homo sapiens
tctcactgcaaatattatgtat

SEQ ID NO: 8498804 - DNA, 22 bp, Homo sapiens
tctcactgatttgagaccaagg

SEQ ID NO: 8498805 - DNA, 22 bp, Homo sapiens
tctcactgatttgagaccaagg

SEQ ID NO: 8498806 - DNA, 22 bp, Homo sapiens
tctcactgatttgagaccaagg

SEQ ID NO: 8498807 - DNA, 22 bp, Homo sapiens
tctcactcatttcctaggtctt

SEQ ID NO: 8498808 - DNA, 22 bp, Homo sapiens
tctcactgggtataaatgagta

SEQ ID NO: 8498809 - DNA, 22 bp, Homo sapiens
tctcactgggtataaatgagta

SEQ ID NO: 8498810 - DNA, 22 bp, Homo sapiens
tctcactgcaaatattatgtat

SEQ ID NO: 8498811 - DNA, 22 bp, Homo sapiens
tctcactgcaaatattatgtat

SEQ ID NO: 8498812 - DNA, 22 bp, Homo sapiens
tctcactgggtataaatgagta

SEQ ID NO: 8498813 - DNA, 22 bp, Homo sapiens
tctcactgggtataaatgagta

SEQ ID NO: 8498814 - DNA, 22 bp, Homo sapiens
tctcactgggtcacagcagagg

SEQ ID NO: 8498815 - DNA, 22 bp, Homo sapiens
tctcagaaaagagcttcagaaa

SEQ ID NO: 8498816 - DNA, 22 bp, Homo sapiens
tctcagaaaagagcttcagaaa

SEQ ID NO: 8498817 - DNA, 22 bp, Homo sapiens
tctcagaaaaaggagaaactgg

SEQ ID NO: 8498818 - DNA, 22 bp, Homo sapiens
tctcagaaaaactttgagggta

SEQ ID NO: 8498819 - DNA, 22 bp, Homo sapiens
tctcactgggtcacagcagagg

SEQ ID NO: 8498820 - DNA, 22 bp, Homo sapiens
tctcactgggtcacagcagagg

SEQ ID NO: 8498821 - DNA, 22 bp, Homo sapiens
tctcactgggtcacagcagagg

SEQ ID NO: 8498822 - DNA, 22 bp, Homo sapiens
tctcactttccagacttttcaa

SEQ ID NO: 8498823 - DNA, 22 bp, Homo sapiens
tctcactttccagacttttcaa

SEQ ID NO: 8498824 - DNA, 21 bp, Homo sapiens
tctcactgtctgctttgttta

SEQ ID NO: 8498825 - DNA, 21 bp, Homo sapiens
tctcactgtctgctttgttta

SEQ ID NO: 8498826 - DNA, 22 bp, Homo sapiens
tctcagagcatcattttcttag

SEQ ID NO: 8498827 - DNA, 19 bp, Homo sapiens
tctcagagccctagaggcc

SEQ ID NO: 8498828 - DNA, 19 bp, Homo sapiens
tctcagagccctagaggcc

SEQ ID NO: 8498829 - DNA, 22 bp, Homo sapiens
tctcagagatgttagggaagag

SEQ ID NO: 8498830 - DNA, 22 bp, Homo sapiens
tctcagagagctgtgttttcct

SEQ ID NO: 8498831 - DNA, 22 bp, Homo sapiens
tctcagagaggggccgggcctt

SEQ ID NO: 8498832 - DNA, 22 bp, Homo sapiens
tctcagagagatgaaacttcca

SEQ ID NO: 8498833 - DNA, 22 bp, Homo sapiens
tctcagaacacccttctatggt

SEQ ID NO: 8498834 - DNA, 22 bp, Homo sapiens
tctcagaacctcagtttgctct

SEQ ID NO: 8498835 - DNA, 22 bp, Homo sapiens
tctcagaacacccttctatggt

SEQ ID NO: 8498836 - DNA, 22 bp, Homo sapiens
tctcagaactttatatgtatca

SEQ ID NO: 8498837 - DNA, 22 bp, Homo sapiens
tctcagaaggcaagggctgggg

SEQ ID NO: 8498838 - DNA, 22 bp, Homo sapiens
tctcagaaggcaagggctgggg

SEQ ID NO: 8498839 - DNA, 22 bp, Homo sapiens
tctcagaaatgacaggaggtac

SEQ ID NO: 8498840 - DNA, 22 bp, Homo sapiens
tctcagaaatactatgttgtca

SEQ ID NO: 8498841 - DNA, 23 bp, Homo sapiens
tctcagaaaggagaagtaatttg

SEQ ID NO: 8498842 - DNA, 23 bp, Homo sapiens
tctcagaaaggagaagtaatttg

SEQ ID NO: 8498843 - DNA, 22 bp, Homo sapiens
tctcagaaatactatgttgtca

SEQ ID NO: 8498844 - DNA, 22 bp, Homo sapiens
tctcagggagttgaggctgcct

SEQ ID NO: 8498845 - DNA, 22 bp, Homo sapiens
tctcagggcagcaaggaagcat

SEQ ID NO: 8498846 - DNA, 22 bp, Homo sapiens
tctcagggccccaaaggctagt

SEQ ID NO: 8498847 - DNA, 22 bp, Homo sapiens
tctcagggccccaaaggctagt

SEQ ID NO: 8498848 - DNA, 19 bp, Homo sapiens
tctcaggctgggcggctgc

SEQ ID NO: 8498849 - DNA, 22 bp, Homo sapiens
tctcaggctgacattgggactc

SEQ ID NO: 8498850 - DNA, 22 bp, Homo sapiens
tctcaggctcttggaacctgtt

SEQ ID NO: 8498851 - DNA, 22 bp, Homo sapiens
tctcaggctgtgtgtggaggac

SEQ ID NO: 8498852 - DNA, 22 bp, Homo sapiens
tctcagggagggcgagtcagcg

SEQ ID NO: 8498853 - DNA, 22 bp, Homo sapiens
tctcaggcttcctggtgctgtg

SEQ ID NO: 8498854 - DNA, 22 bp, Homo sapiens
tctcagggaccatgatgatgac

SEQ ID NO: 8498855 - DNA, 22 bp, Homo sapiens
tctcaggctcctgacatatatg

SEQ ID NO: 8498856 - DNA, 22 bp, Homo sapiens
tctcaggctagtaaaagatggg

SEQ ID NO: 8498857 - DNA, 22 bp, Homo sapiens
tctcaggctaccttgcacaagg

SEQ ID NO: 8498858 - DNA, 22 bp, Homo sapiens
tctcaggctaccttgcacaagg

SEQ ID NO: 8498859 - DNA, 20 bp, Homo sapiens
tctcaggccccctccttgct

SEQ ID NO: 8498860 - DNA, 21 bp, Homo sapiens
tctcaggcgagaattctttta

SEQ ID NO: 8498861 - DNA, 22 bp, Homo sapiens
tctcaggcccctgagtttctct

SEQ ID NO: 8498862 - DNA, 22 bp, Homo sapiens
tctcaggcccctgagtttctct

SEQ ID NO: 8498863 - DNA, 22 bp, Homo sapiens
tctcagctcagcttccacagag

SEQ ID NO: 8498864 - DNA, 22 bp, Homo sapiens
tctcagctcatggcagccttga

SEQ ID NO: 8498865 - DNA, 22 bp, Homo sapiens
tctcagctcatggcagccttga

SEQ ID NO: 8498866 - DNA, 22 bp, Homo sapiens
tctcagctcagcttccacagag

SEQ ID NO: 8498867 - DNA, 22 bp, Homo sapiens
tctcagctcagcttccacagag

SEQ ID NO: 8498868 - DNA, 22 bp, Homo sapiens
tctcagctcttttttcacagaa

SEQ ID NO: 8498869 - DNA, 22 bp, Homo sapiens
tctcagctgactgctttcctcg

SEQ ID NO: 8498870 - DNA, 22 bp, Homo sapiens
tctcagctgcctgccctgctcc

SEQ ID NO: 8498871 - DNA, 22 bp, Homo sapiens
tctcagagtttagagctgagcc

SEQ ID NO: 8498872 - DNA, 22 bp, Homo sapiens
tctcagagtttgaatctggagt

SEQ ID NO: 8498873 - DNA, 22 bp, Homo sapiens
tctcagagtttgaatctggagt

SEQ ID NO: 8498874 - DNA, 22 bp, Homo sapiens
tctcagagtttagagctgagcc

SEQ ID NO: 8498875 - DNA, 22 bp, Homo sapiens
tctcagagtttagagctgagcc

SEQ ID NO: 8498876 - DNA, 22 bp, Homo sapiens
tctcagagggaaacatgagtga

SEQ ID NO: 8498877 - DNA, 22 bp, Homo sapiens
tctcagagggaaacatgagtga

SEQ ID NO: 8498878 - DNA, 22 bp, Homo sapiens
tctcagagggaaacatgagtga

SEQ ID NO: 8498879 - DNA, 22 bp, Homo sapiens
tctcagagggaggattactgcc

SEQ ID NO: 8498880 - DNA, 22 bp, Homo sapiens
tctcagagtggtggtccctctg

SEQ ID NO: 8498881 - DNA, 22 bp, Homo sapiens
tctcagaggtgccctggcatct

SEQ ID NO: 8498882 - DNA, 22 bp, Homo sapiens
tctcagagtgacaatgagaatt

SEQ ID NO: 8498883 - DNA, 22 bp, Homo sapiens
tgccattgggcagtcattgaag

SEQ ID NO: 8498884 - DNA, 22 bp, Homo sapiens
tgccatttaaaaatgaccaaat

SEQ ID NO: 8498885 - DNA, 22 bp, Homo sapiens
tgccatggcctagacctgtgat

SEQ ID NO: 8498886 - DNA, 22 bp, Homo sapiens
tgccatggaatcacctccagct

SEQ ID NO: 8498887 - DNA, 20 bp, Homo sapiens
tgccatggtaacagagtgtg

SEQ ID NO: 8498888 - DNA, 22 bp, Homo sapiens
tgccatggtgactgcaggaggt

SEQ ID NO: 8498889 - DNA, 22 bp, Homo sapiens
tgccatttgccccagcactgtc

SEQ ID NO: 8498890 - DNA, 22 bp, Homo sapiens
tgccatttctttcaatattctt

SEQ ID NO: 8498891 - DNA, 22 bp, Homo sapiens
tgccatttctcaggctatttca

SEQ ID NO: 8498892 - DNA, 22 bp, Homo sapiens
tgcccacaggaagacaccagcg

SEQ ID NO: 8498893 - DNA, 22 bp, Homo sapiens
tgcccacaggaagacaccagcg

SEQ ID NO: 8498894 - DNA, 21 bp, Homo sapiens
tgcccacagcaaatgcagagg

SEQ ID NO: 8498895 - DNA, 21 bp, Homo sapiens
tgcccacagcaaatgcagagg

SEQ ID NO: 8498896 - DNA, 22 bp, Homo sapiens
tgcccacacctgggggaggctg

SEQ ID NO: 8498897 - DNA, 22 bp, Homo sapiens
tgcccaagcagaggagtgattc

SEQ ID NO: 8498898 - DNA, 22 bp, Homo sapiens
tgcccaagccgagctctctgtt

SEQ ID NO: 8498899 - DNA, 22 bp, Homo sapiens
tgcccaagatcctacatcctga

SEQ ID NO: 8498900 - DNA, 22 bp, Homo sapiens
tgcccaagatcctacatcctga

SEQ ID NO: 8498901 - DNA, 22 bp, Homo sapiens
tgcccaaggtcacctagttagt

SEQ ID NO: 8498902 - DNA, 22 bp, Homo sapiens
tgcccaaggtggccttttactc

SEQ ID NO: 8498903 - DNA, 22 bp, Homo sapiens
tgcccaaggatccattggctgg

SEQ ID NO: 8498904 - DNA, 22 bp, Homo sapiens
tgcccaaggatccattggctgg

SEQ ID NO: 8498905 - DNA, 22 bp, Homo sapiens
tgcccaaggatccattggctgg

SEQ ID NO: 8498906 - DNA, 22 bp, Homo sapiens
tgcccaagtgtttggctgagtc

SEQ ID NO: 8498907 - DNA, 22 bp, Homo sapiens
tgcccaagtgtttggctgagtc

SEQ ID NO: 8498908 - DNA, 22 bp, Homo sapiens
tgcccagcactgtgccagtcac

SEQ ID NO: 8498909 - DNA, 22 bp, Homo sapiens
tgcccagcactgtgccagtcac

SEQ ID NO: 8498910 - DNA, 22 bp, Homo sapiens
tgcccagcactgtgccagtcac

SEQ ID NO: 8498911 - DNA, 22 bp, Homo sapiens
tgcccagcactgtgccagtcac

SEQ ID NO: 8498912 - DNA, 22 bp, Homo sapiens
tgcccaggatctggcgatgctc

SEQ ID NO: 8498913 - DNA, 22 bp, Homo sapiens
tgcccagcaataaaccagaaga

SEQ ID NO: 8498914 - DNA, 20 bp, Homo sapiens
tgcccagcaagagtgcagtt

SEQ ID NO: 8498915 - DNA, 22 bp, Homo sapiens
tgcccagcacccagcatgatgc

SEQ ID NO: 8498916 - DNA, 22 bp, Homo sapiens
tgcccagcaataaaccagaaga

SEQ ID NO: 8498917 - DNA, 18 bp, Homo sapiens
tgcccaccagaagaggga

SEQ ID NO: 8498918 - DNA, 21 bp, Homo sapiens
tgcccaccaagctccacactg

SEQ ID NO: 8498919 - DNA, 21 bp, Homo sapiens
tgcccaccaagctccacactg

SEQ ID NO: 8498920 - DNA, 18 bp, Homo sapiens
tgcccaccagaagaggga

SEQ ID NO: 8498921 - DNA, 22 bp, Homo sapiens
tgcccacattcaaaaggtgatg

SEQ ID NO: 8498922 - DNA, 22 bp, Homo sapiens
tgcccacattcaaaaggtgatg

SEQ ID NO: 8498923 - DNA, 22 bp, Homo sapiens
tgcccacattctgaagctccct

SEQ ID NO: 8498924 - DNA, 22 bp, Homo sapiens
tgcccacatggtgccatggcca

SEQ ID NO: 8498925 - DNA, 22 bp, Homo sapiens
tgcccacatctgcttatttcat

SEQ ID NO: 8498926 - DNA, 22 bp, Homo sapiens
tgcccacttcaaaatcttcatt

SEQ ID NO: 8498927 - DNA, 22 bp, Homo sapiens
tgcccactgtgtcaaagaaata

SEQ ID NO: 8498928 - DNA, 20 bp, Homo sapiens
tgcccagcaagagtgcagtt

SEQ ID NO: 8498929 - DNA, 20 bp, Homo sapiens
tgcccagcaagagtgcagtt

SEQ ID NO: 8498930 - DNA, 22 bp, Homo sapiens
tgcccaggtttgagtgcccaag

SEQ ID NO: 8498931 - DNA, 22 bp, Homo sapiens
tgcccagtctccgggccagccc

SEQ ID NO: 8498932 - DNA, 22 bp, Homo sapiens
tgcccaggtttgagtgcccaag

SEQ ID NO: 8498933 - DNA, 22 bp, Homo sapiens
tgcccctcagggaacgggtatc

SEQ ID NO: 8498934 - DNA, 22 bp, Homo sapiens
tgcccctctcctgtgatccaag

SEQ ID NO: 8498935 - DNA, 22 bp, Homo sapiens
tgcccctcgacgcaatgaaggg

SEQ ID NO: 8498936 - DNA, 22 bp, Homo sapiens
tgccccctggtggccagagccg

SEQ ID NO: 8498937 - DNA, 23 bp, Homo sapiens
tgcccattgcatcttggtactgg

SEQ ID NO: 8498938 - DNA, 22 bp, Homo sapiens
tgccccagacctactgaatggg

SEQ ID NO: 8498939 - DNA, 22 bp, Homo sapiens
tgccccagactctgctcacctc

SEQ ID NO: 8498940 - DNA, 22 bp, Homo sapiens
tgccccagactctgctcacctc

SEQ ID NO: 8498941 - DNA, 20 bp, Homo sapiens
tgccccaggcctgcacctgc

SEQ ID NO: 8498942 - DNA, 20 bp, Homo sapiens
tgccccaggcctgcacctgc

SEQ ID NO: 8498943 - DNA, 22 bp, Homo sapiens
tgcccaggattgtgaggtcagg

SEQ ID NO: 8498944 - DNA, 22 bp, Homo sapiens
tgcccagcagggagctacctgg

SEQ ID NO: 8498945 - DNA, 22 bp, Homo sapiens
tgcccaggctcctcgcagcctt

SEQ ID NO: 8498946 - DNA, 22 bp, Homo sapiens
tgcccaggcttcaccctcagag

SEQ ID NO: 8498947 - DNA, 22 bp, Homo sapiens
tgcccaggcttcaccctcagag

SEQ ID NO: 8498948 - DNA, 22 bp, Homo sapiens
tgcccaggctggagtgcagagg

SEQ ID NO: 8498949 - DNA, 22 bp, Homo sapiens
tgccaggcacgtgagagtggcc

SEQ ID NO: 8498950 - DNA, 22 bp, Homo sapiens
tgccaggcaggaccctagaacc

SEQ ID NO: 8498951 - DNA, 20 bp, Homo sapiens
tgccaggcacggagtgcatg

SEQ ID NO: 8498952 - DNA, 22 bp, Homo sapiens
tgccaggcacgtgagagtggcc

SEQ ID NO: 8498953 - DNA, 20 bp, Homo sapiens
tgccaggcacggagtgcatg

SEQ ID NO: 8498954 - DNA, 22 bp, Homo sapiens
tgccaggcatatggcctctttg

SEQ ID NO: 8498955 - DNA, 22 bp, Homo sapiens
tgccaggcatatggcctctttg

SEQ ID NO: 8498956 - DNA, 22 bp, Homo sapiens
tgccaggcatgtagtagacttg

SEQ ID NO: 8498957 - DNA, 18 bp, Homo sapiens
tgccagccgactggcctg

SEQ ID NO: 8498958 - DNA, 17 bp, Homo sapiens
tgccagcctgtcccagg

SEQ ID NO: 8498959 - DNA, 17 bp, Homo sapiens
tgccagcctgtcccagg

SEQ ID NO: 8498960 - DNA, 22 bp, Homo sapiens
tgccagctactctgtaggctga

SEQ ID NO: 8498961 - DNA, 20 bp, Homo sapiens
tgccaggcacggagtgcatg

SEQ ID NO: 8498962 - DNA, 22 bp, Homo sapiens
tgccaggatggccagggggcca

SEQ ID NO: 8498963 - DNA, 22 bp, Homo sapiens
tgccagctcccttttctcctcc

SEQ ID NO: 8498964 - DNA, 19 bp, Homo sapiens
tgccagctcacaggagctc

SEQ ID NO: 8498965 - DNA, 22 bp, Homo sapiens
tgccaggcatatggcctctttg

SEQ ID NO: 8498966 - DNA, 22 bp, Homo sapiens
tgccaggccaatgaaggcaggg

SEQ ID NO: 8498967 - DNA, 22 bp, Homo sapiens
tgccaggccaatgaaggcaggg

SEQ ID NO: 8498968 - DNA, 22 bp, Homo sapiens
tgccaggcatttgacagacact

SEQ ID NO: 8498969 - DNA, 22 bp, Homo sapiens
tgccaggcatttgacagacact

SEQ ID NO: 8498970 - DNA, 22 bp, Homo sapiens
tgccaggcccagcagggcggcc

SEQ ID NO: 8498971 - DNA, 22 bp, Homo sapiens
tgccaggccacgtagcttcaag

SEQ ID NO: 8498972 - DNA, 22 bp, Homo sapiens
tgccaggcccagcagggcggcc

SEQ ID NO: 8498973 - DNA, 22 bp, Homo sapiens
tgccaggcccagctccagagct

SEQ ID NO: 8498974 - DNA, 22 bp, Homo sapiens
tgccaggcccagctccagagct

SEQ ID NO: 8498975 - DNA, 22 bp, Homo sapiens
tgccaggcccagctccagagct

SEQ ID NO: 8498976 - DNA, 22 bp, Homo sapiens
tgccaggccctcccacagatta

SEQ ID NO: 8498977 - DNA, 22 bp, Homo sapiens
tgccaggccctcccacagatta

SEQ ID NO: 8498978 - DNA, 22 bp, Homo sapiens
tgccaggccctgtgctggatgc

SEQ ID NO: 8498979 - DNA, 22 bp, Homo sapiens
tgccaggccctgtgctggatgc

SEQ ID NO: 8498980 - DNA, 22 bp, Homo sapiens
tgccaggccctgtgctggatgc

SEQ ID NO: 8498981 - DNA, 22 bp, Homo sapiens
tgccaggctcagcccctatctt

SEQ ID NO: 8498982 - DNA, 22 bp, Homo sapiens
tgccaggctaagtggaggactt

SEQ ID NO: 8498983 - DNA, 22 bp, Homo sapiens
tgccaggctgaacagggtctta

SEQ ID NO: 8498984 - DNA, 22 bp, Homo sapiens
tgccaggctccggaacgacagt

SEQ ID NO: 8498985 - DNA, 22 bp, Homo sapiens
tgccaggctccggaacgacagt

SEQ ID NO: 8498986 - DNA, 20 bp, Homo sapiens
tgccaggctgcacgcctgcc

SEQ ID NO: 8498987 - DNA, 20 bp, Homo sapiens
tgccaggctgcacgcctgcc

SEQ ID NO: 8498988 - DNA, 22 bp, Homo sapiens
tgccaggctgtcctgggcctgg

SEQ ID NO: 8498989 - DNA, 22 bp, Homo sapiens
tgccaggctttggtcaaaggct

SEQ ID NO: 8498990 - DNA, 22 bp, Homo sapiens
tgccagggagccctgctgacca

SEQ ID NO: 8498991 - DNA, 21 bp, Homo sapiens
tgccagggatttacagagcct

SEQ ID NO: 8498992 - DNA, 21 bp, Homo sapiens
tgccagggatttacagagcct

SEQ ID NO: 8498993 - DNA, 22 bp, Homo sapiens
tgccagggagccctgctgacca

SEQ ID NO: 8498994 - DNA, 20 bp, Homo sapiens
tgccagggccagcagaggct

SEQ ID NO: 8498995 - DNA, 20 bp, Homo sapiens
tgccagggccagcagaggct

SEQ ID NO: 8498996 - DNA, 22 bp, Homo sapiens
tgccagggtcagctgcagctct

SEQ ID NO: 8498997 - DNA, 22 bp, Homo sapiens
tgccaggggacctagggatgtc

SEQ ID NO: 8498998 - DNA, 22 bp, Homo sapiens
tgccagggtgtcaggagagcta

SEQ ID NO: 8498999 - DNA, 22 bp, Homo sapiens
tgccagggtcctgagggccttg

SEQ ID NO: 8499000 - DNA, 22 bp, Homo sapiens
tgccagggccatagggagtcta

SEQ ID NO: 8499001 - DNA, 23 bp, Homo sapiens
tgccagggccctgtgtgcaatgc

SEQ ID NO: 8499002 - DNA, 22 bp, Homo sapiens
tgccagggctgctactggctga

SEQ ID NO: 8499003 - DNA, 22 bp, Homo sapiens
tgccaggggacctagggatgtc

SEQ ID NO: 8499004 - DNA, 22 bp, Homo sapiens
tgccagggtgtcaggagagcta

SEQ ID NO: 8499005 - DNA, 22 bp, Homo sapiens
tgccatccaacagttccatctt

SEQ ID NO: 8499006 - DNA, 22 bp, Homo sapiens
tgccatcactgaacttctgaaa

SEQ ID NO: 8499007 - DNA, 22 bp, Homo sapiens
tgccatcttccttcctctgcac

SEQ ID NO: 8499008 - DNA, 22 bp, Homo sapiens
tgccatctcttcctcgtgctgc

SEQ ID NO: 8499009 - DNA, 22 bp, Homo sapiens
tgccatctgcacccacctgccc

SEQ ID NO: 8499010 - DNA, 22 bp, Homo sapiens
tgccatctgcacccacctgccc

SEQ ID NO: 8499011 - DNA, 22 bp, Homo sapiens
tgccctgcggctatctagatga

SEQ ID NO: 8499012 - DNA, 22 bp, Homo sapiens
tgccctgctgtgcctggagcca

SEQ ID NO: 8499013 - DNA, 22 bp, Homo sapiens
tgccctgccaagactgagtggt

SEQ ID NO: 8499014 - DNA, 22 bp, Homo sapiens
tgccctgccaagaccaagtggt

SEQ ID NO: 8499015 - DNA, 22 bp, Homo sapiens
tgccctgcatgcagggagctgt

SEQ ID NO: 8499016 - DNA, 22 bp, Homo sapiens
tgccctgccaagactcagtggt

SEQ ID NO: 8499017 - DNA, 22 bp, Homo sapiens
tgccctgcagaccctgcagtgt

SEQ ID NO: 8499018 - DNA, 22 bp, Homo sapiens
tgccctgcagtgagtgcgtctg

SEQ ID NO: 8499019 - DNA, 22 bp, Homo sapiens
tgccctcagaattgctccctgc

SEQ ID NO: 8499020 - DNA, 22 bp, Homo sapiens
tgccctcagaattgctccctgc

SEQ ID NO: 8499021 - DNA, 22 bp, Homo sapiens
tgcccctcttgctggccctgtc

SEQ ID NO: 8499022 - DNA, 22 bp, Homo sapiens
tgcccctcttgagaagctcagc

SEQ ID NO: 8499023 - DNA, 22 bp, Homo sapiens
tgccctgctgtggctctgccca

SEQ ID NO: 8499024 - DNA, 22 bp, Homo sapiens
tgccctggaaatgagaggtgtg

SEQ ID NO: 8499025 - DNA, 22 bp, Homo sapiens
tgccctggaaccatctacagtc

SEQ ID NO: 8499026 - DNA, 22 bp, Homo sapiens
tgccctggaaccatctacagtc

SEQ ID NO: 8499027 - DNA, 22 bp, Homo sapiens
tgccctggcattgggttggata

SEQ ID NO: 8499028 - DNA, 22 bp, Homo sapiens
tgccctggcacacacacagctg

SEQ ID NO: 8499029 - DNA, 22 bp, Homo sapiens
tgccctggcacacacacagctg

SEQ ID NO: 8499030 - DNA, 22 bp, Homo sapiens
tgccctggctcctcccacgctg

SEQ ID NO: 8499031 - DNA, 22 bp, Homo sapiens
tgccctgtgccagacttcctgg

SEQ ID NO: 8499032 - DNA, 22 bp, Homo sapiens
tgccctgtgctggaatcttccc

SEQ ID NO: 8499033 - DNA, 17 bp, Homo sapiens
tgccctgtgcctggtgt

SEQ ID NO: 8499034 - DNA, 20 bp, Homo sapiens
tgccctgtggaggggaaagg

SEQ ID NO: 8499035 - DNA, 22 bp, Homo sapiens
tgccctgtgtgtgcaagcactg

SEQ ID NO: 8499036 - DNA, 22 bp, Homo sapiens
tgccctgttatcttggaagagt

SEQ ID NO: 8499037 - DNA, 22 bp, Homo sapiens
tgccctgttatcttggaagagt

SEQ ID NO: 8499038 - DNA, 22 bp, Homo sapiens
tgccctgttcctgcctccagct

SEQ ID NO: 8499039 - DNA, 22 bp, Homo sapiens
tgccctgttcctgcctccagct

SEQ ID NO: 8499040 - DNA, 22 bp, Homo sapiens
tgcccttgaaatacgcttgggg

SEQ ID NO: 8499041 - DNA, 22 bp, Homo sapiens
tgcccttgaggacagctcccag

SEQ ID NO: 8499042 - DNA, 22 bp, Homo sapiens
tgcccttgggtaacttgctgat

SEQ ID NO: 8499043 - DNA, 22 bp, Homo sapiens
tgccctgggaacacagatgcca

SEQ ID NO: 8499044 - DNA, 22 bp, Homo sapiens
tgccctgggaacacagatgcca

SEQ ID NO: 8499045 - DNA, 22 bp, Homo sapiens
tgccctggctggagtgcagtgg

SEQ ID NO: 8499046 - DNA, 22 bp, Homo sapiens
tgccctgtctaagctgtcagta

SEQ ID NO: 8499047 - DNA, 22 bp, Homo sapiens
tgccctgtctaagctgtcagta

SEQ ID NO: 8499048 - DNA, 22 bp, Homo sapiens
tgccctgtctaagctgtcagta

SEQ ID NO: 8499049 - DNA, 22 bp, Homo sapiens
tgccctgtcgctcactcccacc

SEQ ID NO: 8499050 - DNA, 22 bp, Homo sapiens
tgccgcctggtttctccgcccc

SEQ ID NO: 8499051 - DNA, 22 bp, Homo sapiens
tgccgcagtgcggggagggccc

SEQ ID NO: 8499052 - DNA, 22 bp, Homo sapiens
tgccgcagtgcggggagggccc

SEQ ID NO: 8499053 - DNA, 22 bp, Homo sapiens
tgccgtgcccatattgtgggtg

SEQ ID NO: 8499054 - DNA, 20 bp, Homo sapiens
tgccgggcagcctgaggagt

SEQ ID NO: 8499055 - DNA, 22 bp, Homo sapiens
tgccgctgtcgccaccatggct

SEQ ID NO: 8499056 - DNA, 22 bp, Homo sapiens
tgccgtggggctgaggctggag

SEQ ID NO: 8499057 - DNA, 23 bp, Homo sapiens
tgccgtgttagaaatgttttaca

SEQ ID NO: 8499058 - DNA, 22 bp, Homo sapiens
tgccgtgtcccattgtgctctg

SEQ ID NO: 8499059 - DNA, 22 bp, Homo sapiens
tgcctaccctgcccgcagacac

SEQ ID NO: 8499060 - DNA, 22 bp, Homo sapiens
tgcctaactccaccaggcaggt

SEQ ID NO: 8499061 - DNA, 22 bp, Homo sapiens
tgcctaactccaccaggcaggt

SEQ ID NO: 8499062 - DNA, 22 bp, Homo sapiens
tgcctcagagacctgacagtac

SEQ ID NO: 8499063 - DNA, 22 bp, Homo sapiens
tgcctcagagacctgacagtac

SEQ ID NO: 8499064 - DNA, 22 bp, Homo sapiens
tgcctcagagacctgacagtac

SEQ ID NO: 8499065 - DNA, 22 bp, Homo sapiens
tgcctcagagacctgacagtac

SEQ ID NO: 8499066 - DNA, 22 bp, Homo sapiens
tgcctcagagtgggcttgctat

SEQ ID NO: 8499067 - DNA, 22 bp, Homo sapiens
tgcctattcaatatatgcattt

SEQ ID NO: 8499068 - DNA, 23 bp, Homo sapiens
tgcctattcagcagagtgatagc

SEQ ID NO: 8499069 - DNA, 22 bp, Homo sapiens
tgcctagttctgtatttacagt

SEQ ID NO: 8499070 - DNA, 22 bp, Homo sapiens
tgcctagaactttattctttat

SEQ ID NO: 8499071 - DNA, 22 bp, Homo sapiens
tgcctaggaaacctcatgcttc

SEQ ID NO: 8499072 - DNA, 22 bp, Homo sapiens
tgcctaggaaacctcatgcttc

SEQ ID NO: 8499073 - DNA, 22 bp, Homo sapiens
tgcctagaactttattctttat

SEQ ID NO: 8499074 - DNA, 22 bp, Homo sapiens
tgcctaggaaacctcatgcttc

SEQ ID NO: 8499075 - DNA, 22 bp, Homo sapiens
tgcctaggctggagtgcaatgg

SEQ ID NO: 8499076 - DNA, 22 bp, Homo sapiens
tgcctagggcctaaccagagcc

SEQ ID NO: 8499077 - DNA, 22 bp, Homo sapiens
tgcctaggctggagtgtagtgg

SEQ ID NO: 8499078 - DNA, 22 bp, Homo sapiens
tgcctggcaccccagtctgcac

SEQ ID NO: 8499079 - DNA, 22 bp, Homo sapiens
tgcctggcatctagccctggga

SEQ ID NO: 8499080 - DNA, 22 bp, Homo sapiens
tgcctggcagcttgaaagaaat

SEQ ID NO: 8499081 - DNA, 19 bp, Homo sapiens
tgcctggcaccagctccac

SEQ ID NO: 8499082 - DNA, 19 bp, Homo sapiens
tgcctggcaccagctccac

SEQ ID NO: 8499083 - DNA, 22 bp, Homo sapiens
tgcctggcacagagcaggtggc

SEQ ID NO: 8499084 - DNA, 22 bp, Homo sapiens
tgcctggcaatgccagaagcca

SEQ ID NO: 8499085 - DNA, 22 bp, Homo sapiens
tgcctggcaagaggggctggct

SEQ ID NO: 8499086 - DNA, 22 bp, Homo sapiens
tgcctggcaactgtggtgggct

SEQ ID NO: 8499087 - DNA, 22 bp, Homo sapiens
tgcctggcaactgtggtgggct

SEQ ID NO: 8499088 - DNA, 22 bp, Homo sapiens
tgcctggatgtgctggcctcac

SEQ ID NO: 8499089 - DNA, 22 bp, Homo sapiens
tgcctggatgtgctggcctcac

SEQ ID NO: 8499090 - DNA, 22 bp, Homo sapiens
tgcctggatctgaggacccatt

SEQ ID NO: 8499091 - DNA, 22 bp, Homo sapiens
tgcctggatactcattaatttc

SEQ ID NO: 8499092 - DNA, 20 bp, Homo sapiens
tgcctgcccaggtcctgcac

SEQ ID NO: 8499093 - DNA, 22 bp, Homo sapiens
tgcctgctgattggagttgaat

SEQ ID NO: 8499094 - DNA, 22 bp, Homo sapiens
tgcctgccccacaaggggttgc

SEQ ID NO: 8499095 - DNA, 22 bp, Homo sapiens
tgcctgctgattggagttgaat

SEQ ID NO: 8499096 - DNA, 22 bp, Homo sapiens
tgcctgctgccactgctgttac

SEQ ID NO: 8499097 - DNA, 22 bp, Homo sapiens
tgcctgcttgtgtacctggtga

SEQ ID NO: 8499098 - DNA, 22 bp, Homo sapiens
tgcctgcttgtttacctactcc

SEQ ID NO: 8499099 - DNA, 22 bp, Homo sapiens
tgcctgctgctaagctctttgt

SEQ ID NO: 8499100 - DNA, 22 bp, Homo sapiens
tgcctgctgctaagctctttgt

SEQ ID NO: 8499101 - DNA, 22 bp, Homo sapiens
tgcctgcccacgactacagcag

SEQ ID NO: 8499102 - DNA, 20 bp, Homo sapiens
tgcctgcccaggtcctgcac

SEQ ID NO: 8499103 - DNA, 22 bp, Homo sapiens
tgcctgccaggtgcttcttcat

SEQ ID NO: 8499104 - DNA, 22 bp, Homo sapiens
tgcctgccatgcagaaagctga

SEQ ID NO: 8499105 - DNA, 22 bp, Homo sapiens
tgcctgccaggcaacctgggag

SEQ ID NO: 8499106 - DNA, 22 bp, Homo sapiens
tgcctgcatcttggaggcccca

SEQ ID NO: 8499107 - DNA, 22 bp, Homo sapiens
tgcctgatgcaggagtatcaga

SEQ ID NO: 8499108 - DNA, 22 bp, Homo sapiens
tgcctgatgcaggagtatcaga

SEQ ID NO: 8499109 - DNA, 22 bp, Homo sapiens
tgcctgatgcaggagtatcaga

SEQ ID NO: 8499110 - DNA, 22 bp, Homo sapiens
tgcctgagtttaaccctcagag

SEQ ID NO: 8499111 - DNA, 22 bp, Homo sapiens
tgcctctgtgggcagagctgcc

SEQ ID NO: 8499112 - DNA, 22 bp, Homo sapiens
tgcctctgtgggcagagctgcc

SEQ ID NO: 8499113 - DNA, 22 bp, Homo sapiens
tgcctctgtgggcagagctgcc

SEQ ID NO: 8499114 - DNA, 22 bp, Homo sapiens
tgcctctgtgggccttcctggc

SEQ ID NO: 8499115 - DNA, 22 bp, Homo sapiens
tgcctctgtgggccttcctggc

SEQ ID NO: 8499116 - DNA, 22 bp, Homo sapiens
tgcctctgtgggccttcctggc

SEQ ID NO: 8499117 - DNA, 22 bp, Homo sapiens
tgcctctgtgggccttcctggc

SEQ ID NO: 8499118 - DNA, 22 bp, Homo sapiens
tgcctctgtggaaatggtggtc

SEQ ID NO: 8499119 - DNA, 22 bp, Homo sapiens
tgcctctggttatctggtacct

SEQ ID NO: 8499120 - DNA, 22 bp, Homo sapiens
tgcctctggttatctggtacct

SEQ ID NO: 8499121 - DNA, 22 bp, Homo sapiens
tgcctctggttatctggtacct

SEQ ID NO: 8499122 - DNA, 22 bp, Homo sapiens
tgcctctggttatctggtacct

SEQ ID NO: 8499123 - DNA, 22 bp, Homo sapiens
tgcctctgggtgaccaaggagc

SEQ ID NO: 8499124 - DNA, 22 bp, Homo sapiens
tgcctgaggtggtctgcaaatg

SEQ ID NO: 8499125 - DNA, 22 bp, Homo sapiens
tgcctgaggtggtctgcaaatg

SEQ ID NO: 8499126 - DNA, 22 bp, Homo sapiens
tgcctgagtgatgtggcagcca

SEQ ID NO: 8499127 - DNA, 22 bp, Homo sapiens
tgcctgagtgatgtggcagcca

SEQ ID NO: 8499128 - DNA, 22 bp, Homo sapiens
tgcctgaggagtcagggcaggt

SEQ ID NO: 8499129 - DNA, 22 bp, Homo sapiens
tgcctgaggagtcagggcaggt

SEQ ID NO: 8499130 - DNA, 22 bp, Homo sapiens
tgcctgagggagtaagagtcct

SEQ ID NO: 8499131 - DNA, 22 bp, Homo sapiens
tgcctgaggagtcagggcaggt

SEQ ID NO: 8499132 - DNA, 22 bp, Homo sapiens
tgcctgaatgatcagtcagatt

SEQ ID NO: 8499133 - DNA, 22 bp, Homo sapiens
tgcctgaattcaattcctggct

SEQ ID NO: 8499134 - DNA, 22 bp, Homo sapiens
tgcctcttggagcctttcctct

SEQ ID NO: 8499135 - DNA, 22 bp, Homo sapiens
tgcctgaacatgaatagtttat

SEQ ID NO: 8499136 - DNA, 22 bp, Homo sapiens
tgcctctgtgtgcaggtgagca

SEQ ID NO: 8499137 - DNA, 22 bp, Homo sapiens
tgcctctgtgtgcaggtgagca

SEQ ID NO: 8499138 - DNA, 22 bp, Homo sapiens
tgcctctgttgagccttggctg

SEQ ID NO: 8499139 - DNA, 22 bp, Homo sapiens
tgcctctgttgagccttggctg

SEQ ID NO: 8499140 - DNA, 22 bp, Homo sapiens
tgcctctgttgagccttggctg

SEQ ID NO: 8499141 - DNA, 22 bp, Homo sapiens
tgcctctgctgctgtggcatca

SEQ ID NO: 8499142 - DNA, 23 bp, Homo sapiens
tgcctctgcctccctagtctgca

SEQ ID NO: 8499143 - DNA, 23 bp, Homo sapiens
tgcctctgcctccctagtctgca

SEQ ID NO: 8499144 - DNA, 22 bp, Homo sapiens
tgcctctgcctccattgttagt

SEQ ID NO: 8499145 - DNA, 22 bp, Homo sapiens
tgcctctgaggaagattgtgtt

SEQ ID NO: 8499146 - DNA, 22 bp, Homo sapiens
tgcctccctctctgccactgga

SEQ ID NO: 8499147 - DNA, 22 bp, Homo sapiens
tgcctccctggcaagtctctcc

SEQ ID NO: 8499148 - DNA, 22 bp, Homo sapiens
tgcctcgtgtctgagtctgttc

SEQ ID NO: 8499149 - DNA, 22 bp, Homo sapiens
tgcctcagctgaggccgctcca

SEQ ID NO: 8499150 - DNA, 22 bp, Homo sapiens
tgcctcagctgaggccgctcca

SEQ ID NO: 8499151 - DNA, 22 bp, Homo sapiens
tgcctcagctgaggccgctcca

SEQ ID NO: 8499152 - DNA, 22 bp, Homo sapiens
tgcctcaggcacctggcaggtt

SEQ ID NO: 8499153 - DNA, 22 bp, Homo sapiens
tgcctcaggcacctggcaggtt

SEQ ID NO: 8499154 - DNA, 22 bp, Homo sapiens
tgcctcaggcacctggcaggtt

SEQ ID NO: 8499155 - DNA, 22 bp, Homo sapiens
tgcctcagagtgggcttgctat

SEQ ID NO: 8499156 - DNA, 22 bp, Homo sapiens
tgcctcagagtgggcttgctat

SEQ ID NO: 8499157 - DNA, 22 bp, Homo sapiens
tgcctcagagtgggcttgctat

SEQ ID NO: 8499158 - DNA, 22 bp, Homo sapiens
tgcctcagctgaggccgctcca

SEQ ID NO: 8499159 - DNA, 22 bp, Homo sapiens
tgcctcagagttgtccctacca

SEQ ID NO: 8499160 - DNA, 22 bp, Homo sapiens
tgcctcagagttgtccctacca

SEQ ID NO: 8499161 - DNA, 19 bp, Homo sapiens
tgcctcagggctttgagga

SEQ ID NO: 8499162 - DNA, 19 bp, Homo sapiens
tgcctcagggctttgagga

SEQ ID NO: 8499163 - DNA, 22 bp, Homo sapiens
tgcctcagtcagcttccctggg

SEQ ID NO: 8499164 - DNA, 22 bp, Homo sapiens
tgcctcagtcagcttccctggg

SEQ ID NO: 8499165 - DNA, 22 bp, Homo sapiens
tgcctcagtctaaagtctctca

SEQ ID NO: 8499166 - DNA, 22 bp, Homo sapiens
tgcctcagtcagcttccctggg

SEQ ID NO: 8499167 - DNA, 22 bp, Homo sapiens
tgcatctgtagtggaaacctta

SEQ ID NO: 8499168 - DNA, 22 bp, Homo sapiens
tgcatctgttcagagctgtcga

SEQ ID NO: 8499169 - DNA, 22 bp, Homo sapiens
tgcatctgattctcaggcagaa

SEQ ID NO: 8499170 - DNA, 22 bp, Homo sapiens
tgcatccttccatgggtttcaa

SEQ ID NO: 8499171 - DNA, 22 bp, Homo sapiens
tgcatccttaaccagcatcact

SEQ ID NO: 8499172 - DNA, 22 bp, Homo sapiens
tgcatcctcctttgtcctcttg

SEQ ID NO: 8499173 - DNA, 22 bp, Homo sapiens
tgcatcctcctttgtcctcttg

SEQ ID NO: 8499174 - DNA, 22 bp, Homo sapiens
tgcatcctgttctaggtttggg

SEQ ID NO: 8499175 - DNA, 22 bp, Homo sapiens
tgcatcatataatgtctatgga

SEQ ID NO: 8499176 - DNA, 18 bp, Homo sapiens
tgcatcatttatgggtca

SEQ ID NO: 8499177 - DNA, 22 bp, Homo sapiens
tgcatcatttataatgtctttg

SEQ ID NO: 8499178 - DNA, 22 bp, Homo sapiens
tgcatcatataatgtctatgga

SEQ ID NO: 8499179 - DNA, 22 bp, Homo sapiens
tgcatcatgcggaactggcttt

SEQ ID NO: 8499180 - DNA, 22 bp, Homo sapiens
tgcatcatgcggaactggcttt

SEQ ID NO: 8499181 - DNA, 22 bp, Homo sapiens
tgcatcatttataatgtctttg

SEQ ID NO: 8499182 - DNA, 22 bp, Homo sapiens
tgcatagaggatccagtgtggt

SEQ ID NO: 8499183 - DNA, 22 bp, Homo sapiens
tgcatacttttaatgactgttt

SEQ ID NO: 8499184 - DNA, 22 bp, Homo sapiens
tgcatacttgtatgtgttacat

SEQ ID NO: 8499185 - DNA, 22 bp, Homo sapiens
tgcatactgaatctgccatcac

SEQ ID NO: 8499186 - DNA, 22 bp, Homo sapiens
tgcatactgaacagcatgctaa

SEQ ID NO: 8499187 - DNA, 22 bp, Homo sapiens
tgcatagttctccttcctcctc

SEQ ID NO: 8499188 - DNA, 20 bp, Homo sapiens
tgcatagttgctgcagttga

SEQ ID NO: 8499189 - DNA, 22 bp, Homo sapiens
tgcatatacccgcatttacata

SEQ ID NO: 8499190 - DNA, 22 bp, Homo sapiens
tgcataactagagtaattacag

SEQ ID NO: 8499191 - DNA, 22 bp, Homo sapiens
tgcatacataaagtgctatcat

SEQ ID NO: 8499192 - DNA, 22 bp, Homo sapiens
tgcagttttccttcaacattgt

SEQ ID NO: 8499193 - DNA, 22 bp, Homo sapiens
tgcagtgtttttcagggcatat

SEQ ID NO: 8499194 - DNA, 22 bp, Homo sapiens
tgcagttagcctaggattgagc

SEQ ID NO: 8499195 - DNA, 22 bp, Homo sapiens
tgcagttctaagtagacaagtc

SEQ ID NO: 8499196 - DNA, 22 bp, Homo sapiens
tgcagttttatcacatatatag

SEQ ID NO: 8499197 - DNA, 19 bp, Homo sapiens
tgcataaattatatacttt

SEQ ID NO: 8499198 - DNA, 19 bp, Homo sapiens
tgcataaattatatacttt

SEQ ID NO: 8499199 - DNA, 22 bp, Homo sapiens
tgcataaagtgccatagtatta

SEQ ID NO: 8499200 - DNA, 22 bp, Homo sapiens
tgcataaagtgccatagtatta

SEQ ID NO: 8499201 - DNA, 21 bp, Homo sapiens
tgcataaagaaatacaaatac

SEQ ID NO: 8499202 - DNA, 21 bp, Homo sapiens
tgcataaagaaatacaaatac

SEQ ID NO: 8499203 - DNA, 21 bp, Homo sapiens
tgcataaagaaatacaaatac

SEQ ID NO: 8499204 - DNA, 22 bp, Homo sapiens
tgcataaaatatgagaaatgta

SEQ ID NO: 8499205 - DNA, 22 bp, Homo sapiens
tgcataaaatatgagaaatgta

SEQ ID NO: 8499206 - DNA, 22 bp, Homo sapiens
tgcatggtaaccaggatgtcta

SEQ ID NO: 8499207 - DNA, 22 bp, Homo sapiens
tgcatggaggaagatgaatgca

SEQ ID NO: 8499208 - DNA, 21 bp, Homo sapiens
tgcatggaggaaagttataga

SEQ ID NO: 8499209 - DNA, 22 bp, Homo sapiens
tgcatggagtaattgatgcttg

SEQ ID NO: 8499210 - DNA, 22 bp, Homo sapiens
tgcatggataaaagtatattat

SEQ ID NO: 8499211 - DNA, 17 bp, Homo sapiens
tgcatgtcctttgttcc

SEQ ID NO: 8499212 - DNA, 23 bp, Homo sapiens
tgcatgtgaattcatacttgttt

SEQ ID NO: 8499213 - DNA, 22 bp, Homo sapiens
tgcatgtcaaggcactcaggat

SEQ ID NO: 8499214 - DNA, 22 bp, Homo sapiens
tgcatgtatttaaagttgcaat

SEQ ID NO: 8499215 - DNA, 22 bp, Homo sapiens
tgcatgtggacccctggtgcct

SEQ ID NO: 8499216 - DNA, 23 bp, Homo sapiens
tgcatgtgaattcatacttgttt

SEQ ID NO: 8499217 - DNA, 22 bp, Homo sapiens
tgcatgtgcccactctggctta

SEQ ID NO: 8499218 - DNA, 22 bp, Homo sapiens
tgcatgtggatcatatgtccta

SEQ ID NO: 8499219 - DNA, 22 bp, Homo sapiens
tgcatgtgtcgggcctgtgcta

SEQ ID NO: 8499220 - DNA, 22 bp, Homo sapiens
tgcatgtgtgacaaggacagtt

SEQ ID NO: 8499221 - DNA, 22 bp, Homo sapiens
tgcatgtgtttcccagcaagct

SEQ ID NO: 8499222 - DNA, 22 bp, Homo sapiens
tgcatgtgtgtgtatttataaa

SEQ ID NO: 8499223 - DNA, 22 bp, Homo sapiens
tgcatgtgtgtgtatttataaa

SEQ ID NO: 8499224 - DNA, 22 bp, Homo sapiens
tgcattccacagaagggaaaac

SEQ ID NO: 8499225 - DNA, 22 bp, Homo sapiens
tgcatgttatagaattttaact

SEQ ID NO: 8499226 - DNA, 22 bp, Homo sapiens
tgcatgttaagaaaatattgag

SEQ ID NO: 8499227 - DNA, 22 bp, Homo sapiens
tgcatgtttctgtatgttaatg

SEQ ID NO: 8499228 - DNA, 22 bp, Homo sapiens
tgcatgtttataacagatgagg

SEQ ID NO: 8499229 - DNA, 22 bp, Homo sapiens
tgcatgcatgtttttacccaca

SEQ ID NO: 8499230 - DNA, 22 bp, Homo sapiens
tgcatgcatgtgagcatgcata

SEQ ID NO: 8499231 - DNA, 22 bp, Homo sapiens
tgcatgcatgtgagcatgcata

SEQ ID NO: 8499232 - DNA, 22 bp, Homo sapiens
tgcatgcatgctactgggaggt

SEQ ID NO: 8499233 - DNA, 22 bp, Homo sapiens
tgcatgcagctggtgataagaa

SEQ ID NO: 8499234 - DNA, 22 bp, Homo sapiens
tgcatgcataaatgtacacaca

SEQ ID NO: 8499235 - DNA, 22 bp, Homo sapiens
tgcatgcatgatgtttggtagc

SEQ ID NO: 8499236 - DNA, 22 bp, Homo sapiens
tgcatgcataaatgtacacaca

SEQ ID NO: 8499237 - DNA, 17 bp, Homo sapiens
tgcatgcgtctgtgata

SEQ ID NO: 8499238 - DNA, 17 bp, Homo sapiens
tgcatgcgtctgtgata

SEQ ID NO: 8499239 - DNA, 22 bp, Homo sapiens
tgcatgcgttagttggcgtgtt

SEQ ID NO: 8499240 - DNA, 22 bp, Homo sapiens
tgcatgcgttagttggcgtgtt

SEQ ID NO: 8499241 - DNA, 21 bp, Homo sapiens
tgcatgctatgtttttatttc

SEQ ID NO: 8499242 - DNA, 22 bp, Homo sapiens
tgcatgctcaagttagttgtga

SEQ ID NO: 8499243 - DNA, 21 bp, Homo sapiens
tgcatgctatgtttttatttc

SEQ ID NO: 8499244 - DNA, 22 bp, Homo sapiens
tgcatgctccacagcccattca

SEQ ID NO: 8499245 - DNA, 18 bp, Homo sapiens
tgcatgcttttgtttcca

SEQ ID NO: 8499246 - DNA, 22 bp, Homo sapiens
tgcatggaacggtctcctggtc

SEQ ID NO: 8499247 - DNA, 22 bp, Homo sapiens
tgcatggagatatactatttga

SEQ ID NO: 8499248 - DNA, 19 bp, Homo sapiens
tgcatcttgcatgggtgag

SEQ ID NO: 8499249 - DNA, 22 bp, Homo sapiens
tgcatctttagtcttatgtctg

SEQ ID NO: 8499250 - DNA, 22 bp, Homo sapiens
tgcatctttctgcatatgtaaa

SEQ ID NO: 8499251 - DNA, 22 bp, Homo sapiens
tgcatcttacgttttgaaaggg

SEQ ID NO: 8499252 - DNA, 22 bp, Homo sapiens
tgcatcttacgttttgaaaggg

SEQ ID NO: 8499253 - DNA, 22 bp, Homo sapiens
tgcatgaacacatgtgcatgta

SEQ ID NO: 8499254 - DNA, 22 bp, Homo sapiens
tgcatgaaatattttctgtagg

SEQ ID NO: 8499255 - DNA, 22 bp, Homo sapiens
tgcatgaacggagggtaagctg

SEQ ID NO: 8499256 - DNA, 22 bp, Homo sapiens
tgcatgcaacaattcttctata

SEQ ID NO: 8499257 - DNA, 22 bp, Homo sapiens
tgcatgatgttaaacatcaggt

SEQ ID NO: 8499258 - DNA, 22 bp, Homo sapiens
tgcatgatggtttagatggggt

SEQ ID NO: 8499259 - DNA, 22 bp, Homo sapiens
tgcatgatgactaaggtggtga

SEQ ID NO: 8499260 - DNA, 22 bp, Homo sapiens
tgcatgatagagatggtattag

SEQ ID NO: 8499261 - DNA, 22 bp, Homo sapiens
tgcatgatagagatggtattag

SEQ ID NO: 8499262 - DNA, 22 bp, Homo sapiens
tgcatgcacgtgctatgtatga

SEQ ID NO: 8499263 - DNA, 22 bp, Homo sapiens
tgcatgcacttggctggcacgt

SEQ ID NO: 8499264 - DNA, 22 bp, Homo sapiens
tgcatgcagcatatgaggcctc

SEQ ID NO: 8499265 - DNA, 22 bp, Homo sapiens
tgcatgcacgtatctgcgtgtg

SEQ ID NO: 8499266 - DNA, 22 bp, Homo sapiens
tgccagcacttctggctgtctg

SEQ ID NO: 8499267 - DNA, 22 bp, Homo sapiens
tgccagcacaagttaagagatc

SEQ ID NO: 8499268 - DNA, 22 bp, Homo sapiens
tgccagagttacatgagggtca

SEQ ID NO: 8499269 - DNA, 22 bp, Homo sapiens
tgccagagttacatgagggtca

SEQ ID NO: 8499270 - DNA, 23 bp, Homo sapiens
tgccagaggcagtcacagtggtg

SEQ ID NO: 8499271 - DNA, 23 bp, Homo sapiens
tgccagaggcagtcacagtggtg

SEQ ID NO: 8499272 - DNA, 22 bp, Homo sapiens
tgccagcaagaatagacagtaa

SEQ ID NO: 8499273 - DNA, 23 bp, Homo sapiens
tgccagaggcagtcacagtggtg

SEQ ID NO: 8499274 - DNA, 23 bp, Homo sapiens
tgccagaggcagtcacagtggtg

SEQ ID NO: 8499275 - DNA, 22 bp, Homo sapiens
tgccagagagtggctgggtgtc

SEQ ID NO: 8499276 - DNA, 22 bp, Homo sapiens
tgccagagagtggctgggtgtc

SEQ ID NO: 8499277 - DNA, 22 bp, Homo sapiens
tgccagagaggagaaagcattt

SEQ ID NO: 8499278 - DNA, 22 bp, Homo sapiens
tgccagagaagacccagtcact

SEQ ID NO: 8499279 - DNA, 22 bp, Homo sapiens
tgccagcccaccttggggcctc

SEQ ID NO: 8499280 - DNA, 22 bp, Homo sapiens
tgccagccaggttctgaggcta

SEQ ID NO: 8499281 - DNA, 22 bp, Homo sapiens
tgccagccagggaagctcaccc

SEQ ID NO: 8499282 - DNA, 19 bp, Homo sapiens
tgccagcattaggctgaag

SEQ ID NO: 8499283 - DNA, 19 bp, Homo sapiens
tgccagcattaggctgaag

SEQ ID NO: 8499284 - DNA, 21 bp, Homo sapiens
tgccagcatgtaggctagttg

SEQ ID NO: 8499285 - DNA, 21 bp, Homo sapiens
tgccagcattaaacagtcatt

SEQ ID NO: 8499286 - DNA, 21 bp, Homo sapiens
tgccagcatgtaggctagttg

SEQ ID NO: 8499287 - DNA, 22 bp, Homo sapiens
tgccagcagtagcagtaggcca

SEQ ID NO: 8499288 - DNA, 22 bp, Homo sapiens
tgccagaagattctctatcaga

SEQ ID NO: 8499289 - DNA, 22 bp, Homo sapiens
tgccagaagtgctttataagtg

SEQ ID NO: 8499290 - DNA, 22 bp, Homo sapiens
tgccagagaagacccagtcact

SEQ ID NO: 8499291 - DNA, 22 bp, Homo sapiens
tgccagagaagacccagtcact

SEQ ID NO: 8499292 - DNA, 22 bp, Homo sapiens
tgccactggctcaatggtgcag

SEQ ID NO: 8499293 - DNA, 22 bp, Homo sapiens
tgccactggctcaatggtgcag

SEQ ID NO: 8499294 - DNA, 22 bp, Homo sapiens
tgccactggacccagaactctt

SEQ ID NO: 8499295 - DNA, 22 bp, Homo sapiens
tgccagaacagctcatctggcc

SEQ ID NO: 8499296 - DNA, 22 bp, Homo sapiens
tgccactgggcatgcagatgtc

SEQ ID NO: 8499297 - DNA, 22 bp, Homo sapiens
tgccactggggctaggactgtt

SEQ ID NO: 8499298 - DNA, 22 bp, Homo sapiens
tgccacccctctgcaccctcag

SEQ ID NO: 8499299 - DNA, 22 bp, Homo sapiens
tgccacccctctgcaccctcag

SEQ ID NO: 8499300 - DNA, 22 bp, Homo sapiens
tgccaccttgtgcagcaggagg

SEQ ID NO: 8499301 - DNA, 22 bp, Homo sapiens
tgccaccaggagaaccagtgca

SEQ ID NO: 8499302 - DNA, 22 bp, Homo sapiens
tgccacccagccaggagtggga

SEQ ID NO: 8499303 - DNA, 22 bp, Homo sapiens
tgccaccatctggctgtgttga

SEQ ID NO: 8499304 - DNA, 22 bp, Homo sapiens
tgccaccatctggctgtgttga

SEQ ID NO: 8499305 - DNA, 22 bp, Homo sapiens
tgccacagtttcatggattctg

SEQ ID NO: 8499306 - DNA, 22 bp, Homo sapiens
tgccacagttgtttgtgctcta

SEQ ID NO: 8499307 - DNA, 22 bp, Homo sapiens
tgccacagttgtttgtgctcta

SEQ ID NO: 8499308 - DNA, 22 bp, Homo sapiens
tgccacagttgtttgtgctcta

SEQ ID NO: 8499309 - DNA, 22 bp, Homo sapiens
tgccaagaccacaattgctttt

SEQ ID NO: 8499310 - DNA, 22 bp, Homo sapiens
tgccacagggtcctcaggccag

SEQ ID NO: 8499311 - DNA, 22 bp, Homo sapiens
tgccacagggtcctcaggccag

SEQ ID NO: 8499312 - DNA, 22 bp, Homo sapiens
tgcatttagttttaataaagga

SEQ ID NO: 8499313 - DNA, 22 bp, Homo sapiens
tgcatttagttatgagaaaaac

SEQ ID NO: 8499314 - DNA, 18 bp, Homo sapiens
tgcatttagtacatctag

SEQ ID NO: 8499315 - DNA, 18 bp, Homo sapiens
tgcatttagtacatctag

SEQ ID NO: 8499316 - DNA, 18 bp, Homo sapiens
tgcatttagtacatctag

SEQ ID NO: 8499317 - DNA, 22 bp, Homo sapiens
tgcatttagttatgagaaaaac

SEQ ID NO: 8499318 - DNA, 22 bp, Homo sapiens
tgcatttacggtacaacagcag

SEQ ID NO: 8499319 - DNA, 21 bp, Homo sapiens
tgcatttaacagaaacaggaa

SEQ ID NO: 8499320 - DNA, 21 bp, Homo sapiens
tgcatttaacagaaacaggaa

SEQ ID NO: 8499321 - DNA, 22 bp, Homo sapiens
tgcatttaagaaaacatgagtc

SEQ ID NO: 8499322 - DNA, 22 bp, Homo sapiens
tgcattggtcttaatcttcagg

SEQ ID NO: 8499323 - DNA, 22 bp, Homo sapiens
tgcattggtcttaatcttcagg

SEQ ID NO: 8499324 - DNA, 22 bp, Homo sapiens
tgcattggtcatttgaaaatat

SEQ ID NO: 8499325 - DNA, 22 bp, Homo sapiens
tgcattggtaaaatacatacac

SEQ ID NO: 8499326 - DNA, 22 bp, Homo sapiens
tgcattggtcatttagaaaata

SEQ ID NO: 8499327 - DNA, 22 bp, Homo sapiens
tgcattggaaactcagcagcac

SEQ ID NO: 8499328 - DNA, 22 bp, Homo sapiens
tgcattgggagtcagtgctgaa

SEQ ID NO: 8499329 - DNA, 22 bp, Homo sapiens
tgcattgggagagattagggca

SEQ ID NO: 8499330 - DNA, 22 bp, Homo sapiens
tgcattgggttgacatactaaa

SEQ ID NO: 8499331 - DNA, 22 bp, Homo sapiens
tgcattgggttgacatactaaa

SEQ ID NO: 8499332 - DNA, 22 bp, Homo sapiens
tgcattggaaactcagcagcac

SEQ ID NO: 8499333 - DNA, 22 bp, Homo sapiens
tgcattggaaaactatggctca

SEQ ID NO: 8499334 - DNA, 22 bp, Homo sapiens
tgcattgcatttgtcatgaaga

SEQ ID NO: 8499335 - DNA, 22 bp, Homo sapiens
tgcattgatcatatccttcctg

SEQ ID NO: 8499336 - DNA, 22 bp, Homo sapiens
tgcattgaggggctctcttcct

SEQ ID NO: 8499337 - DNA, 19 bp, Homo sapiens
tgcattgagggctgtctca

SEQ ID NO: 8499338 - DNA, 22 bp, Homo sapiens
tgcattctgacttagttaatat

SEQ ID NO: 8499339 - DNA, 21 bp, Homo sapiens
tgcattctagcagctctgagg

SEQ ID NO: 8499340 - DNA, 22 bp, Homo sapiens
tgcattcctttgtctgttaaag

SEQ ID NO: 8499341 - DNA, 22 bp, Homo sapiens
tgcatttcagaagaaaattcgg

SEQ ID NO: 8499342 - DNA, 22 bp, Homo sapiens
tgcatttccagatttctggagt

SEQ ID NO: 8499343 - DNA, 22 bp, Homo sapiens
tgcatttcagaagaaaattcgg

SEQ ID NO: 8499344 - DNA, 21 bp, Homo sapiens
tgcatttctaactagttgacc

SEQ ID NO: 8499345 - DNA, 21 bp, Homo sapiens
tgcatttctaactagttgacc

SEQ ID NO: 8499346 - DNA, 22 bp, Homo sapiens
tgcatttcttttgagtatatgc

SEQ ID NO: 8499347 - DNA, 22 bp, Homo sapiens
tgcatttccagatttctggagt

SEQ ID NO: 8499348 - DNA, 22 bp, Homo sapiens
tgcatttccagatttctggagt

SEQ ID NO: 8499349 - DNA, 22 bp, Homo sapiens
tgcatttgctggggatgtgatt

SEQ ID NO: 8499350 - DNA, 22 bp, Homo sapiens
tgcatttgctggggatgtgatt

SEQ ID NO: 8499351 - DNA, 22 bp, Homo sapiens
tgcatttgcaatgggtacacaa

SEQ ID NO: 8499352 - DNA, 22 bp, Homo sapiens
tgcatttgagttgggagcaggc

SEQ ID NO: 8499353 - DNA, 22 bp, Homo sapiens
tgcatttcagaagaaaattcgg

SEQ ID NO: 8499354 - DNA, 22 bp, Homo sapiens
tgcatttcacagactgagaaat

SEQ ID NO: 8499355 - DNA, 22 bp, Homo sapiens
tgcatttcacagactgagaaat

SEQ ID NO: 8499356 - DNA, 22 bp, Homo sapiens
tgcatttatttgaattgatcta

SEQ ID NO: 8499357 - DNA, 22 bp, Homo sapiens
tgccaaaatgggctttataccg

SEQ ID NO: 8499358 - DNA, 22 bp, Homo sapiens
tgcatttttgataactgtgtac

SEQ ID NO: 8499359 - DNA, 22 bp, Homo sapiens
tgccaaaatggccaaaagctag

SEQ ID NO: 8499360 - DNA, 22 bp, Homo sapiens
tgcatttgttcagtgaaatgtt

SEQ ID NO: 8499361 - DNA, 22 bp, Homo sapiens
tgcatttgtcttgtctcatgaa

SEQ ID NO: 8499362 - DNA, 22 bp, Homo sapiens
tgcatttgtaacattcaagaat

SEQ ID NO: 8499363 - DNA, 22 bp, Homo sapiens
tgcatttgttcagtgaaatgtt

SEQ ID NO: 8499364 - DNA, 20 bp, Homo sapiens
tgcatttgttatttgtactc

SEQ ID NO: 8499365 - DNA, 22 bp, Homo sapiens
tgcaggctgtaatctgaggcta

SEQ ID NO: 8499366 - DNA, 22 bp, Homo sapiens
tgcaggctggggaggcagactt

SEQ ID NO: 8499367 - DNA, 22 bp, Homo sapiens
tgcaggctgccttcacagagcc

SEQ ID NO: 8499368 - DNA, 22 bp, Homo sapiens
tgcaggctgctggcagtagctt

SEQ ID NO: 8499369 - DNA, 22 bp, Homo sapiens
tgcaggctccatgaggacaggc

SEQ ID NO: 8499370 - DNA, 22 bp, Homo sapiens
tgcaggctctctgctgccagat

SEQ ID NO: 8499371 - DNA, 22 bp, Homo sapiens
tgcaggctgtaatctgaggcta

SEQ ID NO: 8499372 - DNA, 22 bp, Homo sapiens
tgcagggaaaacccaggatgct

SEQ ID NO: 8499373 - DNA, 22 bp, Homo sapiens
tgcagggaaaacccaggatgct

SEQ ID NO: 8499374 - DNA, 22 bp, Homo sapiens
tgcagggaaaacccaggatgct

SEQ ID NO: 8499375 - DNA, 22 bp, Homo sapiens
tgcaggctttagccccatggct

SEQ ID NO: 8499376 - DNA, 22 bp, Homo sapiens
tgcagggaagcaagggtggctc

SEQ ID NO: 8499377 - DNA, 22 bp, Homo sapiens
tgcagggaatccagtctagggt

SEQ ID NO: 8499378 - DNA, 22 bp, Homo sapiens
tgcagggaaagtgttggcagca

SEQ ID NO: 8499379 - DNA, 22 bp, Homo sapiens
tgcagggaaagtgttggcagca

SEQ ID NO: 8499380 - DNA, 22 bp, Homo sapiens
tgcagggaacttggacagctag

SEQ ID NO: 8499381 - DNA, 22 bp, Homo sapiens
tgcagggaacttggacagctag

SEQ ID NO: 8499382 - DNA, 22 bp, Homo sapiens
tgcagggcccctctgcatgagt

SEQ ID NO: 8499383 - DNA, 22 bp, Homo sapiens
tgcagggcccctctgcatgagt

SEQ ID NO: 8499384 - DNA, 22 bp, Homo sapiens
tgcagggcccttggggttgaac

SEQ ID NO: 8499385 - DNA, 22 bp, Homo sapiens
tgcagggcccttggggttgaac

SEQ ID NO: 8499386 - DNA, 22 bp, Homo sapiens
tgcagggcccttggggttgaac

SEQ ID NO: 8499387 - DNA, 22 bp, Homo sapiens
tgcagggcccttggggttgaac

SEQ ID NO: 8499388 - DNA, 22 bp, Homo sapiens
tgcagggctacaggactacaac

SEQ ID NO: 8499389 - DNA, 22 bp, Homo sapiens
tgcagggctacaggactacaac

SEQ ID NO: 8499390 - DNA, 22 bp, Homo sapiens
tgcagggccgctggaggtcatg

SEQ ID NO: 8499391 - DNA, 22 bp, Homo sapiens
tgcagggccgctggaggtcatg

SEQ ID NO: 8499392 - DNA, 22 bp, Homo sapiens
tgcagggctacaggactacaac

SEQ ID NO: 8499393 - DNA, 22 bp, Homo sapiens
tgcagggctacaggactacaac

SEQ ID NO: 8499394 - DNA, 22 bp, Homo sapiens
tgcagggccatggtggcggctg

SEQ ID NO: 8499395 - DNA, 22 bp, Homo sapiens
tgcagggccatggtggcggctg

SEQ ID NO: 8499396 - DNA, 22 bp, Homo sapiens
tgcagggccagactgggttgga

SEQ ID NO: 8499397 - DNA, 22 bp, Homo sapiens
tgcagggccagactgggttgga

SEQ ID NO: 8499398 - DNA, 22 bp, Homo sapiens
tgcagggccagactgggttgga

SEQ ID NO: 8499399 - DNA, 22 bp, Homo sapiens
tgcagggccatggtggcggctg

SEQ ID NO: 8499400 - DNA, 22 bp, Homo sapiens
tgcagggccagactgggttgga

SEQ ID NO: 8499401 - DNA, 22 bp, Homo sapiens
tgcagggcatctttgaagtgtg

SEQ ID NO: 8499402 - DNA, 22 bp, Homo sapiens
tgcagggcagtttgtttcggca

SEQ ID NO: 8499403 - DNA, 22 bp, Homo sapiens
tgcagggcagtttgtttcggca

SEQ ID NO: 8499404 - DNA, 22 bp, Homo sapiens
tgcagggcatagggtccagttt

SEQ ID NO: 8499405 - DNA, 22 bp, Homo sapiens
tgcagggcatctttgaagtgtg

SEQ ID NO: 8499406 - DNA, 22 bp, Homo sapiens
tgcagggcagctagggagcttt

SEQ ID NO: 8499407 - DNA, 22 bp, Homo sapiens
tgcagggcagctagggagcttt

SEQ ID NO: 8499408 - DNA, 22 bp, Homo sapiens
tgcagggcagctagggagcttt

SEQ ID NO: 8499409 - DNA, 22 bp, Homo sapiens
tgcagggcagctagggagcttt

SEQ ID NO: 8499410 - DNA, 22 bp, Homo sapiens
tgcagggcagtggaggttgagt

SEQ ID NO: 8499411 - DNA, 22 bp, Homo sapiens
tgcagggcagtggaggttgagt

SEQ ID NO: 8499412 - DNA, 22 bp, Homo sapiens
tgcagggcagtggaggttgagt

SEQ ID NO: 8499413 - DNA, 22 bp, Homo sapiens
tgcagggcacacgcacgggtgt

SEQ ID NO: 8499414 - DNA, 22 bp, Homo sapiens
tgcagggcacacgcacgggtgt

SEQ ID NO: 8499415 - DNA, 22 bp, Homo sapiens
tgcagggcacacgcacgggtgt

SEQ ID NO: 8499416 - DNA, 22 bp, Homo sapiens
tgcagggcacacgcacgggtgt

SEQ ID NO: 8499417 - DNA, 22 bp, Homo sapiens
tgcagggcacggtgcgcgtggg

SEQ ID NO: 8499418 - DNA, 22 bp, Homo sapiens
tgcagggcacggtgcgcgtggg

SEQ ID NO: 8499419 - DNA, 22 bp, Homo sapiens
tgcagggcagatatgactgtag

SEQ ID NO: 8499420 - DNA, 22 bp, Homo sapiens
tgcagggattagaggccgggga

SEQ ID NO: 8499421 - DNA, 22 bp, Homo sapiens
tgcagggatgctagaggtaaga

SEQ ID NO: 8499422 - DNA, 23 bp, Homo sapiens
tgcagggcaagttagagacccca

SEQ ID NO: 8499423 - DNA, 23 bp, Homo sapiens
tgcagggcaagttagagacccca

SEQ ID NO: 8499424 - DNA, 22 bp, Homo sapiens
tgcagggattatgtaggggttg

SEQ ID NO: 8499425 - DNA, 22 bp, Homo sapiens
tgcaggtctccattggcagact

SEQ ID NO: 8499426 - DNA, 22 bp, Homo sapiens
tgcaggtgaaaattatgaggat

SEQ ID NO: 8499427 - DNA, 22 bp, Homo sapiens
tgcaggtaggcctgacttccag

SEQ ID NO: 8499428 - DNA, 22 bp, Homo sapiens
tgcaggtaggcctgacttccag

SEQ ID NO: 8499429 - DNA, 23 bp, Homo sapiens
tgcaggtagggcccagcagtctt

SEQ ID NO: 8499430 - DNA, 22 bp, Homo sapiens
tgcagggtgtccggaggatcac

SEQ ID NO: 8499431 - DNA, 22 bp, Homo sapiens
tgcaggtacttgacaacttggg

SEQ ID NO: 8499432 - DNA, 22 bp, Homo sapiens
tgcaggtaaatttgtggaggat

SEQ ID NO: 8499433 - DNA, 23 bp, Homo sapiens
tgcagggtgttcctgcctttgct

SEQ ID NO: 8499434 - DNA, 20 bp, Homo sapiens
tgcagggctctgcttctctc

SEQ ID NO: 8499435 - DNA, 20 bp, Homo sapiens
tgcagggctgcctcccagct

SEQ ID NO: 8499436 - DNA, 19 bp, Homo sapiens
tgcagggctgcgcctgggg

SEQ ID NO: 8499437 - DNA, 19 bp, Homo sapiens
tgcagggctgcgcctgggg

SEQ ID NO: 8499438 - DNA, 22 bp, Homo sapiens
tgcagggcttcctcttggagtt

SEQ ID NO: 8499439 - DNA, 23 bp, Homo sapiens
tgcaggggaggcttaaagcaggt

SEQ ID NO: 8499440 - DNA, 22 bp, Homo sapiens
tgcagggcttcctcttggagtt

SEQ ID NO: 8499441 - DNA, 22 bp, Homo sapiens
tgcagggcttcctcttggagtt

SEQ ID NO: 8499442 - DNA, 22 bp, Homo sapiens
tgcagggcttcctcttggagtt

SEQ ID NO: 8499443 - DNA, 22 bp, Homo sapiens
tgcagggcttcctcttggagtt

SEQ ID NO: 8499444 - DNA, 22 bp, Homo sapiens
tgcagggtagatgcaggctgtg

SEQ ID NO: 8499445 - DNA, 22 bp, Homo sapiens
tgcagggtagatgcaggctgtg

SEQ ID NO: 8499446 - DNA, 22 bp, Homo sapiens
tgcaggggcttgtctgggcctg

SEQ ID NO: 8499447 - DNA, 22 bp, Homo sapiens
tgcaggggcttgtctgggcctg

SEQ ID NO: 8499448 - DNA, 23 bp, Homo sapiens
tgcaggggaggcttaaagcaggt

SEQ ID NO: 8499449 - DNA, 22 bp, Homo sapiens
tgcaggggcttgtctgggcctg

SEQ ID NO: 8499450 - DNA, 22 bp, Homo sapiens
tgcagtggcgccatctcagctc

SEQ ID NO: 8499451 - DNA, 22 bp, Homo sapiens
tgcagtggcgccatctcagctc

SEQ ID NO: 8499452 - DNA, 22 bp, Homo sapiens
tgcagtgggccggaggccaggg

SEQ ID NO: 8499453 - DNA, 22 bp, Homo sapiens
tgcagtgggccggaggccaggg

SEQ ID NO: 8499454 - DNA, 22 bp, Homo sapiens
tgcagtggtggtaaagatgctc

SEQ ID NO: 8499455 - DNA, 22 bp, Homo sapiens
tgcagtggtgtccaggtgtact

SEQ ID NO: 8499456 - DNA, 22 bp, Homo sapiens
tgcagtggtgtccaggtgtact

SEQ ID NO: 8499457 - DNA, 22 bp, Homo sapiens
tgcagtggtgtccaggtgtact

SEQ ID NO: 8499458 - DNA, 23 bp, Homo sapiens
tgcagtaggatggggctgggcct

SEQ ID NO: 8499459 - DNA, 22 bp, Homo sapiens
tgcagtaggcacgtggctgtga

SEQ ID NO: 8499460 - DNA, 21 bp, Homo sapiens
tgcagtatgtatttgtatcca

SEQ ID NO: 8499461 - DNA, 21 bp, Homo sapiens
tgcagtcctttgacatgattc

SEQ ID NO: 8499462 - DNA, 22 bp, Homo sapiens
tgcagtcctggtgaggggacat

SEQ ID NO: 8499463 - DNA, 21 bp, Homo sapiens
tgcagtatgtatttgtatcca

SEQ ID NO: 8499464 - DNA, 22 bp, Homo sapiens
tgcagtccaagagtctcctggt

SEQ ID NO: 8499465 - DNA, 22 bp, Homo sapiens
tgcagtgtgattttctggctga

SEQ ID NO: 8499466 - DNA, 20 bp, Homo sapiens
tgcagtgtcctcacttgtca

SEQ ID NO: 8499467 - DNA, 22 bp, Homo sapiens
tgcagtggttgagagcccagac

SEQ ID NO: 8499468 - DNA, 22 bp, Homo sapiens
tgcagtggttgagagcccagac

SEQ ID NO: 8499469 - DNA, 22 bp, Homo sapiens
tgcagtgttcctgtgggtttat

SEQ ID NO: 8499470 - DNA, 22 bp, Homo sapiens
tgcagtgttcctgtgggtttat

SEQ ID NO: 8499471 - DNA, 22 bp, Homo sapiens
tgcagtgttcctgtgggtttat

SEQ ID NO: 8499472 - DNA, 22 bp, Homo sapiens
tgcagtgtttggatgctgagtc

SEQ ID NO: 8499473 - DNA, 22 bp, Homo sapiens
tgcagtgtttggatgctgagtc

SEQ ID NO: 8499474 - DNA, 22 bp, Homo sapiens
tgcagtgtttggatgctgagtc

SEQ ID NO: 8499475 - DNA, 22 bp, Homo sapiens
tgcagtgtgctagatttggact

SEQ ID NO: 8499476 - DNA, 20 bp, Homo sapiens
tgcagtgtggaagactgaga

SEQ ID NO: 8499477 - DNA, 22 bp, Homo sapiens
tgcagtgtggccatgtcagcta

SEQ ID NO: 8499478 - DNA, 22 bp, Homo sapiens
tgcagtgttcctgtagcctgcc

SEQ ID NO: 8499479 - DNA, 22 bp, Homo sapiens
tgcaggtgtggttcctcagcca

SEQ ID NO: 8499480 - DNA, 20 bp, Homo sapiens
tgcaggtgggcccttctggg

SEQ ID NO: 8499481 - DNA, 22 bp, Homo sapiens
tgcaggtggtccttcctctgct

SEQ ID NO: 8499482 - DNA, 22 bp, Homo sapiens
tgcaggtggtttggacactgct

SEQ ID NO: 8499483 - DNA, 22 bp, Homo sapiens
tgcaggtggtttggacactgct

SEQ ID NO: 8499484 - DNA, 21 bp, Homo sapiens
tgcaggagtctgtgagtcagg

SEQ ID NO: 8499485 - DNA, 21 bp, Homo sapiens
tgcaggagtctgtgagtcagg

SEQ ID NO: 8499486 - DNA, 21 bp, Homo sapiens
tgcaggagtgtaatgtgaccc

SEQ ID NO: 8499487 - DNA, 21 bp, Homo sapiens
tgcaggagtctgtgagtcagg

SEQ ID NO: 8499488 - DNA, 22 bp, Homo sapiens
tgcaggctcaccctggagctga

SEQ ID NO: 8499489 - DNA, 19 bp, Homo sapiens
tgcaggaggactgagcaga

SEQ ID NO: 8499490 - DNA, 22 bp, Homo sapiens
tgcaggagctgtgcggtgaggg

SEQ ID NO: 8499491 - DNA, 22 bp, Homo sapiens
tgcaggagccttggacttgaaa

SEQ ID NO: 8499492 - DNA, 21 bp, Homo sapiens
tgcaggagtctgtgagtcagg

SEQ ID NO: 8499493 - DNA, 22 bp, Homo sapiens
tgcaggagtccaatcaggagac

SEQ ID NO: 8499494 - DNA, 22 bp, Homo sapiens
tgcaggagtccaatcaggagac

SEQ ID NO: 8499495 - DNA, 22 bp, Homo sapiens
tgcaggagggagggttacagtt

SEQ ID NO: 8499496 - DNA, 22 bp, Homo sapiens
tgcaggaggattttgtggagct

SEQ ID NO: 8499497 - DNA, 19 bp, Homo sapiens
tgcaggaggactgagcaga

SEQ ID NO: 8499498 - DNA, 22 bp, Homo sapiens
tgcaggaggattttgtggagct

SEQ ID NO: 8499499 - DNA, 22 bp, Homo sapiens
tgcaggaggctttattcaggat

SEQ ID NO: 8499500 - DNA, 22 bp, Homo sapiens
tgcaggaaacagaggctcaaat

SEQ ID NO: 8499501 - DNA, 22 bp, Homo sapiens
tgcaggaaaacacctatcaccc

SEQ ID NO: 8499502 - DNA, 22 bp, Homo sapiens
tgcaggaaaaccaacacgcctt

SEQ ID NO: 8499503 - DNA, 22 bp, Homo sapiens
tgcaggaaaacacctatcaccc

SEQ ID NO: 8499504 - DNA, 22 bp, Homo sapiens
tgcaggaaaaataaatagtgtt

SEQ ID NO: 8499505 - DNA, 22 bp, Homo sapiens
tgcagctttaagctttcatcag

SEQ ID NO: 8499506 - DNA, 20 bp, Homo sapiens
tgcagcttctcatcttcaaa

SEQ ID NO: 8499507 - DNA, 22 bp, Homo sapiens
tgcagcttctccaaatattaca

SEQ ID NO: 8499508 - DNA, 22 bp, Homo sapiens
tgcagctgtaacagaggcctca

SEQ ID NO: 8499509 - DNA, 22 bp, Homo sapiens
tgcagctgtaacagaggcctca

SEQ ID NO: 8499510 - DNA, 22 bp, Homo sapiens
tgcagctgttacggaccctgtc

SEQ ID NO: 8499511 - DNA, 19 bp, Homo sapiens
tgcagctgtctctatatta

SEQ ID NO: 8499512 - DNA, 22 bp, Homo sapiens
tgcaggagcagagatggctgga

SEQ ID NO: 8499513 - DNA, 22 bp, Homo sapiens
tgcaggagagtgagtcagtagg

SEQ ID NO: 8499514 - DNA, 22 bp, Homo sapiens
tgcaggagagtgagtcagtagg

SEQ ID NO: 8499515 - DNA, 22 bp, Homo sapiens
tgcaggagaaagtacggagcgt

SEQ ID NO: 8499516 - DNA, 22 bp, Homo sapiens
tgcaggagacataatagggact

SEQ ID NO: 8499517 - DNA, 22 bp, Homo sapiens
tgcaggagacataatagggact

SEQ ID NO: 8499518 - DNA, 22 bp, Homo sapiens
tgcaggaagcaaccaggtccaa

SEQ ID NO: 8499519 - DNA, 22 bp, Homo sapiens
tgcaggaagcaaccaggtccaa

SEQ ID NO: 8499520 - DNA, 22 bp, Homo sapiens
tgcaggaagacttcccaagcca

SEQ ID NO: 8499521 - DNA, 22 bp, Homo sapiens
tgcaggaacttggttttactca

SEQ ID NO: 8499522 - DNA, 21 bp, Homo sapiens
tgcaggaagtatggtgcctat

SEQ ID NO: 8499523 - DNA, 22 bp, Homo sapiens
tgcaggagaaagtacggagcgt

SEQ ID NO: 8499524 - DNA, 22 bp, Homo sapiens
tgcaggagaaagtacggagcgt

SEQ ID NO: 8499525 - DNA, 22 bp, Homo sapiens
tgcaggaaattccagggtggcc

SEQ ID NO: 8499526 - DNA, 22 bp, Homo sapiens
tgcaggaacagaactcactccc

SEQ ID NO: 8499527 - DNA, 22 bp, Homo sapiens
tgcaggaacagaactcactccc

SEQ ID NO: 8499528 - DNA, 21 bp, Homo sapiens
tgcaggaaagtgctgcgaccc

SEQ ID NO: 8499529 - DNA, 21 bp, Homo sapiens
tgcaggaaagtgctgcgaccc

SEQ ID NO: 8499530 - DNA, 21 bp, Homo sapiens
tgcaggaaagtgctgcgaccc

SEQ ID NO: 8499531 - DNA, 22 bp, Homo sapiens
tgcaggaactgggagggatagt

SEQ ID NO: 8499532 - DNA, 22 bp, Homo sapiens
tgcaggaacttggttttactca

SEQ ID NO: 8499533 - DNA, 22 bp, Homo sapiens
tgcaggaacttggttttactca

SEQ ID NO: 8499534 - DNA, 22 bp, Homo sapiens
tgcaggaacataggttccttgg

SEQ ID NO: 8499535 - DNA, 22 bp, Homo sapiens
tgcaggaacataggttccttgg

SEQ ID NO: 8499536 - DNA, 22 bp, Homo sapiens
tgcagctgaggccagctatgcc

SEQ ID NO: 8499537 - DNA, 22 bp, Homo sapiens
tgcagctgatgatacccccatg

SEQ ID NO: 8499538 - DNA, 22 bp, Homo sapiens
tgcagctgcttgattcatcttg

SEQ ID NO: 8499539 - DNA, 22 bp, Homo sapiens
tgcagctgctggcccaggtgct

SEQ ID NO: 8499540 - DNA, 22 bp, Homo sapiens
tgcagctgggtctgccctggct

SEQ ID NO: 8499541 - DNA, 21 bp, Homo sapiens
tgcagctgggttctggtttgc

SEQ ID NO: 8499542 - DNA, 22 bp, Homo sapiens
tgcagctggtttagaactagat

SEQ ID NO: 8499543 - DNA, 20 bp, Homo sapiens
tgcagctggtttcacaggga

SEQ ID NO: 8499544 - DNA, 22 bp, Homo sapiens
tgcagctggtttagaactagat

SEQ ID NO: 8499545 - DNA, 22 bp, Homo sapiens
tgcagctggatttatcttttcc

SEQ ID NO: 8499546 - DNA, 22 bp, Homo sapiens
tgcagctgcttgattcatcttg

SEQ ID NO: 8499547 - DNA, 22 bp, Homo sapiens
tgcagctcattgctggggtctg

SEQ ID NO: 8499548 - DNA, 22 bp, Homo sapiens
tgcagctcctgtgctgagtgtg

SEQ ID NO: 8499549 - DNA, 22 bp, Homo sapiens
tgcagctcctctggctgcctga

SEQ ID NO: 8499550 - DNA, 22 bp, Homo sapiens
tgcagccttggcaaccagggac

SEQ ID NO: 8499551 - DNA, 22 bp, Homo sapiens
tgcagcctttagaagttcagat

SEQ ID NO: 8499552 - DNA, 22 bp, Homo sapiens
tgcagccttgcctcctcccagc

SEQ ID NO: 8499553 - DNA, 22 bp, Homo sapiens
tgcagccttggcaaccagggac

SEQ ID NO: 8499554 - DNA, 22 bp, Homo sapiens
tgcagccttgcctcctcccagc

SEQ ID NO: 8499555 - DNA, 18 bp, Homo sapiens
tgcagcctgtagtcttgt

SEQ ID NO: 8499556 - DNA, 21 bp, Homo sapiens
tgcagctgacaccctttggga

SEQ ID NO: 8499557 - DNA, 22 bp, Homo sapiens
tgcagctgaacctagagtctgt

SEQ ID NO: 8499558 - DNA, 22 bp, Homo sapiens
tgcagctctggggtaaggggtg

SEQ ID NO: 8499559 - DNA, 22 bp, Homo sapiens
tgcagctcttacggagggcggg

SEQ ID NO: 8499560 - DNA, 22 bp, Homo sapiens
tgcagctctgtatgctgattat

SEQ ID NO: 8499561 - DNA, 21 bp, Homo sapiens
tgcagctgacactggtatgcc

SEQ ID NO: 8499562 - DNA, 22 bp, Homo sapiens
tgcagctgaggccagctatgcc

SEQ ID NO: 8499563 - DNA, 19 bp, Homo sapiens
tgcagccacgtgagagact

SEQ ID NO: 8499564 - DNA, 19 bp, Homo sapiens
tgcagccacgtgagagact

SEQ ID NO: 8499565 - DNA, 23 bp, Homo sapiens
tgcagcagggtggtctacttctc

SEQ ID NO: 8499566 - DNA, 22 bp, Homo sapiens
tgcagccaggaaatatttgctg

SEQ ID NO: 8499567 - DNA, 23 bp, Homo sapiens
tgcagccactcaggagctcagtg

SEQ ID NO: 8499568 - DNA, 23 bp, Homo sapiens
tgcagcagggtggtctacttctc

SEQ ID NO: 8499569 - DNA, 23 bp, Homo sapiens
tgcagccactcaggagctcagtg

SEQ ID NO: 8499570 - DNA, 23 bp, Homo sapiens
tgcagccactcaggagctcagtg

SEQ ID NO: 8499571 - DNA, 22 bp, Homo sapiens
tgcagccatctttcttggagga

SEQ ID NO: 8499572 - DNA, 22 bp, Homo sapiens
tgcagccatctttcttggagga

SEQ ID NO: 8499573 - DNA, 22 bp, Homo sapiens
tgcagccatctttcttggagga

SEQ ID NO: 8499574 - DNA, 22 bp, Homo sapiens
tgcagccatcgcagagtctgta

SEQ ID NO: 8499575 - DNA, 22 bp, Homo sapiens
tgcagccatcgcagagtctgta

SEQ ID NO: 8499576 - DNA, 22 bp, Homo sapiens
tgcagccattttctgccaatgc

SEQ ID NO: 8499577 - DNA, 21 bp, Homo sapiens
tgcagccattcagccctatgc

SEQ ID NO: 8499578 - DNA, 22 bp, Homo sapiens
tgcagccatttgaaaagcagtt

SEQ ID NO: 8499579 - DNA, 22 bp, Homo sapiens
tgcagcctctctgcttcaggaa

SEQ ID NO: 8499580 - DNA, 21 bp, Homo sapiens
tgcagcctctgcccagcagtg

SEQ ID NO: 8499581 - DNA, 21 bp, Homo sapiens
tgcagcctctgcccagcagtg

SEQ ID NO: 8499582 - DNA, 22 bp, Homo sapiens
tgcagcctggtggtcactggag

SEQ ID NO: 8499583 - DNA, 22 bp, Homo sapiens
tgcagcccaggcgtcaggtggt

SEQ ID NO: 8499584 - DNA, 22 bp, Homo sapiens
tgcagcctagacattctggtca

SEQ ID NO: 8499585 - DNA, 22 bp, Homo sapiens
tgcagcccttccttcctctggg

SEQ ID NO: 8499586 - DNA, 22 bp, Homo sapiens
tgcagcagagtgggcctgggtg

SEQ ID NO: 8499587 - DNA, 21 bp, Homo sapiens
tgcagcagagtaagcagggga

SEQ ID NO: 8499588 - DNA, 21 bp, Homo sapiens
tgcagcagagtaagcagggga

SEQ ID NO: 8499589 - DNA, 21 bp, Homo sapiens
tgcagcagagtaagcagggga

SEQ ID NO: 8499590 - DNA, 21 bp, Homo sapiens
tgcagcagatttgggggaaga

SEQ ID NO: 8499591 - DNA, 21 bp, Homo sapiens
tgcagcagatttgggggaaga

SEQ ID NO: 8499592 - DNA, 21 bp, Homo sapiens
tgcagcagagtaagcagggga

SEQ ID NO: 8499593 - DNA, 21 bp, Homo sapiens
tgcagcagagtaagcagggga

SEQ ID NO: 8499594 - DNA, 22 bp, Homo sapiens
tgcagcagactgagtatgagaa

SEQ ID NO: 8499595 - DNA, 22 bp, Homo sapiens
tgcagcagaatatggctgcagg

SEQ ID NO: 8499596 - DNA, 22 bp, Homo sapiens
tgcagcagactgagtatgagaa

SEQ ID NO: 8499597 - DNA, 22 bp, Homo sapiens
tgcagcagactgagtatgagaa

SEQ ID NO: 8499598 - DNA, 22 bp, Homo sapiens
tgcagcagacataatgtggatt

SEQ ID NO: 8499599 - DNA, 22 bp, Homo sapiens
tgcagcagcagggaggaggctc

SEQ ID NO: 8499600 - DNA, 22 bp, Homo sapiens
tgcagcagcagggaggaggctc

SEQ ID NO: 8499601 - DNA, 22 bp, Homo sapiens
tgcagcagcagggaggaggctc

SEQ ID NO: 8499602 - DNA, 22 bp, Homo sapiens
tgcagcagcagggaggaggctc

SEQ ID NO: 8499603 - DNA, 22 bp, Homo sapiens
tgcagcagcagggaggaggctc

SEQ ID NO: 8499604 - DNA, 22 bp, Homo sapiens
tgcagcagccaaggttctgtgc

SEQ ID NO: 8499605 - DNA, 22 bp, Homo sapiens
tgcagcagcctcatctggtttc

SEQ ID NO: 8499606 - DNA, 22 bp, Homo sapiens
tgcagcaggagccaggcctggt

SEQ ID NO: 8499607 - DNA, 22 bp, Homo sapiens
tgcagcagctccaggttaccct

SEQ ID NO: 8499608 - DNA, 22 bp, Homo sapiens
tgcagcagctccaggttaccct

SEQ ID NO: 8499609 - DNA, 22 bp, Homo sapiens
tgcagcagggcccaggcacaga

SEQ ID NO: 8499610 - DNA, 22 bp, Homo sapiens
tgcagcagggcccaggcacaga

SEQ ID NO: 8499611 - DNA, 22 bp, Homo sapiens
tgcagcagggacctctatgtga

SEQ ID NO: 8499612 - DNA, 22 bp, Homo sapiens
tgcagcaggcacaggacggaag

SEQ ID NO: 8499613 - DNA, 22 bp, Homo sapiens
tgcagcaggcacaggacggaag

SEQ ID NO: 8499614 - DNA, 22 bp, Homo sapiens
tgcagcaggcacaggacggaag

SEQ ID NO: 8499615 - DNA, 22 bp, Homo sapiens
tgcagcaggcacaggacggaag

SEQ ID NO: 8499616 - DNA, 22 bp, Homo sapiens
tgcagcaggagccaggcctggt

SEQ ID NO: 8499617 - DNA, 22 bp, Homo sapiens
tgcacatctttcagcatcatac

SEQ ID NO: 8499618 - DNA, 22 bp, Homo sapiens
tgcacatggcaatgctgctccc

SEQ ID NO: 8499619 - DNA, 22 bp, Homo sapiens
tgcacatggcaatgctgctccc

SEQ ID NO: 8499620 - DNA, 22 bp, Homo sapiens
tgcacatggcctgagtgcctga

SEQ ID NO: 8499621 - DNA, 20 bp, Homo sapiens
tgcacatggcagccatctag

SEQ ID NO: 8499622 - DNA, 22 bp, Homo sapiens
tgcacattagtgtttgagatgc

SEQ ID NO: 8499623 - DNA, 22 bp, Homo sapiens
tgcacatgtgcctgtggcacat

SEQ ID NO: 8499624 - DNA, 22 bp, Homo sapiens
tgcacattgaatgagcaaactg

SEQ ID NO: 8499625 - DNA, 22 bp, Homo sapiens
tgcacattcacttaggtattgt

SEQ ID NO: 8499626 - DNA, 22 bp, Homo sapiens
tgcacagtaaacatgactggag

SEQ ID NO: 8499627 - DNA, 22 bp, Homo sapiens
tgcacaggtggtccatctgcac

SEQ ID NO: 8499628 - DNA, 22 bp, Homo sapiens
tgcacaggtggtccatctgcac

SEQ ID NO: 8499629 - DNA, 22 bp, Homo sapiens
tgcacagtgacccctggtgact

SEQ ID NO: 8499630 - DNA, 22 bp, Homo sapiens
tgcaccagtttctcagagaatc

SEQ ID NO: 8499631 - DNA, 22 bp, Homo sapiens
tgcaccagagcagggtgcccaa

SEQ ID NO: 8499632 - DNA, 22 bp, Homo sapiens
tgcaccagtttctcagagaatc

SEQ ID NO: 8499633 - DNA, 22 bp, Homo sapiens
tgcaccccattttacatttaca

SEQ ID NO: 8499634 - DNA, 21 bp, Homo sapiens
tgcacctgttcactgcagttc

SEQ ID NO: 8499635 - DNA, 21 bp, Homo sapiens
tgcacctgttcactgcagttc

SEQ ID NO: 8499636 - DNA, 22 bp, Homo sapiens
tgcacctgagaggtctctgagg

SEQ ID NO: 8499637 - DNA, 22 bp, Homo sapiens
tgcaccctcatcagtcaaatgg

SEQ ID NO: 8499638 - DNA, 22 bp, Homo sapiens
tgcaccctcatcagtcaaatgg

SEQ ID NO: 8499639 - DNA, 22 bp, Homo sapiens
tgcaccctgcctgcctgcgggt

SEQ ID NO: 8499640 - DNA, 22 bp, Homo sapiens
tgcacctgagaggtctctgagg

SEQ ID NO: 8499641 - DNA, 22 bp, Homo sapiens
tgcacaggaggctgtggagaag

SEQ ID NO: 8499642 - DNA, 22 bp, Homo sapiens
tgcacaggaggctgtggagaag

SEQ ID NO: 8499643 - DNA, 23 bp, Homo sapiens
tgcacaggacggccttataagta

SEQ ID NO: 8499644 - DNA, 22 bp, Homo sapiens
tgcacagctggctctccttttc

SEQ ID NO: 8499645 - DNA, 22 bp, Homo sapiens
tgcacagcgggtgtctgtcagg

SEQ ID NO: 8499646 - DNA, 22 bp, Homo sapiens
tgcacacagttctcaggaaaga

SEQ ID NO: 8499647 - DNA, 20 bp, Homo sapiens
tgcacagggtgggaagcaac

SEQ ID NO: 8499648 - DNA, 20 bp, Homo sapiens
tgcacagggtgggaagcaac

SEQ ID NO: 8499649 - DNA, 20 bp, Homo sapiens
tgcacagggtgggaagcaac

SEQ ID NO: 8499650 - DNA, 22 bp, Homo sapiens
tgcacaggtatgcaaagcatgt

SEQ ID NO: 8499651 - DNA, 22 bp, Homo sapiens
tgcacaggtgagactcaggaag

SEQ ID NO: 8499652 - DNA, 22 bp, Homo sapiens
tgcacaggtgagactcaggaag

SEQ ID NO: 8499653 - DNA, 22 bp, Homo sapiens
tgcacaggtgagactcaggaag

SEQ ID NO: 8499654 - DNA, 21 bp, Homo sapiens
tgcacagggcccaggagagcc

SEQ ID NO: 8499655 - DNA, 21 bp, Homo sapiens
tgcacagggcccaggagagcc

SEQ ID NO: 8499656 - DNA, 21 bp, Homo sapiens
tgcacagggcccaggagagcc

SEQ ID NO: 8499657 - DNA, 22 bp, Homo sapiens
tgcacagggagggggccagctc

SEQ ID NO: 8499658 - DNA, 21 bp, Homo sapiens
tgcacagggcccaggagagcc

SEQ ID NO: 8499659 - DNA, 22 bp, Homo sapiens
tgcacaggccttgaagggagag

SEQ ID NO: 8499660 - DNA, 22 bp, Homo sapiens
tgcacaggccttgaagggagag

SEQ ID NO: 8499661 - DNA, 22 bp, Homo sapiens
tgcacaggccttgaagggagag

SEQ ID NO: 8499662 - DNA, 22 bp, Homo sapiens
tgcacaggccttgaagggagag

SEQ ID NO: 8499663 - DNA, 22 bp, Homo sapiens
tgcacagggagggggccagctc

SEQ ID NO: 8499664 - DNA, 22 bp, Homo sapiens
tgcagaaggaggaggaaatcca

SEQ ID NO: 8499665 - DNA, 22 bp, Homo sapiens
tgcagaaggcctgacattgcac

SEQ ID NO: 8499666 - DNA, 22 bp, Homo sapiens
tgcagaagtgagtcatgaggaa

SEQ ID NO: 8499667 - DNA, 22 bp, Homo sapiens
tgcagaagtattccaggcccca

SEQ ID NO: 8499668 - DNA, 22 bp, Homo sapiens
tgcagaagtgagtcatgaggaa

SEQ ID NO: 8499669 - DNA, 22 bp, Homo sapiens
tgcagaagtgagtcatgaggaa

SEQ ID NO: 8499670 - DNA, 22 bp, Homo sapiens
tgcagaagatggtctgagcacc

SEQ ID NO: 8499671 - DNA, 22 bp, Homo sapiens
tgcagaagcagagagttgccaa

SEQ ID NO: 8499672 - DNA, 22 bp, Homo sapiens
tgcagaagcagagccggtggcc

SEQ ID NO: 8499673 - DNA, 22 bp, Homo sapiens
tgcagaagcagagagttgccaa

SEQ ID NO: 8499674 - DNA, 22 bp, Homo sapiens
tgcagaagctgcaggtcagtgg

SEQ ID NO: 8499675 - DNA, 22 bp, Homo sapiens
tgcagaagctgcaggtcagtgg

SEQ ID NO: 8499676 - DNA, 19 bp, Homo sapiens
tgcagaagacacagtggtg

SEQ ID NO: 8499677 - DNA, 22 bp, Homo sapiens
tgcagaagaccttccagggctg

SEQ ID NO: 8499678 - DNA, 19 bp, Homo sapiens
tgcagaagacacagtggtg

SEQ ID NO: 8499679 - DNA, 22 bp, Homo sapiens
tgcagaagacacaaggtaacgt

SEQ ID NO: 8499680 - DNA, 22 bp, Homo sapiens
tgcagaagaatgtaggcataag

SEQ ID NO: 8499681 - DNA, 22 bp, Homo sapiens
tgcagaagaatgtaggcataag

SEQ ID NO: 8499682 - DNA, 22 bp, Homo sapiens
tgcagaagaatgagcttggagt

SEQ ID NO: 8499683 - DNA, 22 bp, Homo sapiens
tgcagaagaatgagcttggagt

SEQ ID NO: 8499684 - DNA, 20 bp, Homo sapiens
tgcagaagaacgttctggtt

SEQ ID NO: 8499685 - DNA, 20 bp, Homo sapiens
tgcagaagaacgttctggtt

SEQ ID NO: 8499686 - DNA, 22 bp, Homo sapiens
tgcagaagaaaacagctgtgtg

SEQ ID NO: 8499687 - DNA, 22 bp, Homo sapiens
tgcagaagaaaacagctgtgtg

SEQ ID NO: 8499688 - DNA, 22 bp, Homo sapiens
tgcagaagaaaacagctgtgtg

SEQ ID NO: 8499689 - DNA, 22 bp, Homo sapiens
tgcagaaccagtcctcagaccc

SEQ ID NO: 8499690 - DNA, 22 bp, Homo sapiens
tgcagaacagggccatgtcacc

SEQ ID NO: 8499691 - DNA, 19 bp, Homo sapiens
tgcacgttggaatcacctg

SEQ ID NO: 8499692 - DNA, 22 bp, Homo sapiens
tgcacgtgtgagcattcacatg

SEQ ID NO: 8499693 - DNA, 22 bp, Homo sapiens
tgcacctttaaattcagcagta

SEQ ID NO: 8499694 - DNA, 22 bp, Homo sapiens
tgcacgtgggctctctgctctt

SEQ ID NO: 8499695 - DNA, 22 bp, Homo sapiens
tgcacgtatggcagtggagccc

SEQ ID NO: 8499696 - DNA, 22 bp, Homo sapiens
tgcagaaacaagccatcattca

SEQ ID NO: 8499697 - DNA, 22 bp, Homo sapiens
tgcagaaacaagccatcattca

SEQ ID NO: 8499698 - DNA, 22 bp, Homo sapiens
tgcactactgtgatacacagcc

SEQ ID NO: 8499699 - DNA, 18 bp, Homo sapiens
tgcactagatgctggcag

SEQ ID NO: 8499700 - DNA, 22 bp, Homo sapiens
tgcactactgtgatacacagcc

SEQ ID NO: 8499701 - DNA, 22 bp, Homo sapiens
tgcagaaataactcatattgca

SEQ ID NO: 8499702 - DNA, 22 bp, Homo sapiens
tgcagaaataactcatattgca

SEQ ID NO: 8499703 - DNA, 22 bp, Homo sapiens
tgcagaaaccaattcaagtaag

SEQ ID NO: 8499704 - DNA, 22 bp, Homo sapiens
tgcagaaagcattgactcttcc

SEQ ID NO: 8499705 - DNA, 22 bp, Homo sapiens
tgcagaggcgccgtgggtgggg

SEQ ID NO: 8499706 - DNA, 22 bp, Homo sapiens
tgcagaggcgccgtgggtgggg

SEQ ID NO: 8499707 - DNA, 22 bp, Homo sapiens
tgcagaggctggctcgccgggt

SEQ ID NO: 8499708 - DNA, 22 bp, Homo sapiens
tgcagaggcccagcggttcttc

SEQ ID NO: 8499709 - DNA, 22 bp, Homo sapiens
tgcagaggcatttattgatgta

SEQ ID NO: 8499710 - DNA, 23 bp, Homo sapiens
tgcagaggcatgatcactgctca

SEQ ID NO: 8499711 - DNA, 23 bp, Homo sapiens
tgcagaggcatgatcactgctca

SEQ ID NO: 8499712 - DNA, 21 bp, Homo sapiens
tgcagaggcacaaacaagccc

SEQ ID NO: 8499713 - DNA, 21 bp, Homo sapiens
tgcagaggcacaaacaagccc

SEQ ID NO: 8499714 - DNA, 22 bp, Homo sapiens
tgcagaggagtcagcctgggca

SEQ ID NO: 8499715 - DNA, 22 bp, Homo sapiens
tgcagaggagtcagcctgggca

SEQ ID NO: 8499716 - DNA, 22 bp, Homo sapiens
tgcagaggagtcagcctgggca

SEQ ID NO: 8499717 - DNA, 22 bp, Homo sapiens
tgcagaggagtcagcctgggca

SEQ ID NO: 8499718 - DNA, 22 bp, Homo sapiens
tgcagaggagctggaaggctgg

SEQ ID NO: 8499719 - DNA, 22 bp, Homo sapiens
tgcagaggagctggaaggctgg

SEQ ID NO: 8499720 - DNA, 22 bp, Homo sapiens
tgcagaggagctggaaggctgg

SEQ ID NO: 8499721 - DNA, 22 bp, Homo sapiens
tgcagaggagctggaaggctgg

SEQ ID NO: 8499722 - DNA, 22 bp, Homo sapiens
tgcagaggagctggaaggctgg

SEQ ID NO: 8499723 - DNA, 22 bp, Homo sapiens
tgcagaggagctggaaggctgg

SEQ ID NO: 8499724 - DNA, 22 bp, Homo sapiens
tgcagaggagctggaaggctgg

SEQ ID NO: 8499725 - DNA, 22 bp, Homo sapiens
tgcagaggagctggaaggctgg

SEQ ID NO: 8499726 - DNA, 22 bp, Homo sapiens
tgcagaggagctggaaggctgg

SEQ ID NO: 8499727 - DNA, 22 bp, Homo sapiens
tgcagaggaccattgtcctgga

SEQ ID NO: 8499728 - DNA, 20 bp, Homo sapiens
tgcagagctggctggctcct

SEQ ID NO: 8499729 - DNA, 20 bp, Homo sapiens
tgcagagctggctggctcct

SEQ ID NO: 8499730 - DNA, 22 bp, Homo sapiens
tgcagaggaccattgtcctgga

SEQ ID NO: 8499731 - DNA, 22 bp, Homo sapiens
tgcagagcttcattgcataggc

SEQ ID NO: 8499732 - DNA, 22 bp, Homo sapiens
tgcagagcttcattgcataggc

SEQ ID NO: 8499733 - DNA, 22 bp, Homo sapiens
tgcagagattgaacaagaagga

SEQ ID NO: 8499734 - DNA, 22 bp, Homo sapiens
tgcagagcagcaactgcgtgcg

SEQ ID NO: 8499735 - DNA, 22 bp, Homo sapiens
tgcagagccccagattggagag

SEQ ID NO: 8499736 - DNA, 20 bp, Homo sapiens
tgcagagctggctggctcct

SEQ ID NO: 8499737 - DNA, 22 bp, Homo sapiens
tgcagaatgtggacagtgggtt

SEQ ID NO: 8499738 - DNA, 22 bp, Homo sapiens
tgcagacagagaaatgaggccc

SEQ ID NO: 8499739 - DNA, 22 bp, Homo sapiens
tgcagacagagaaatgaggccc

SEQ ID NO: 8499740 - DNA, 22 bp, Homo sapiens
tgcagacaagtcgtgggatctt

SEQ ID NO: 8499741 - DNA, 21 bp, Homo sapiens
tgcagagatatctgaagcaga

SEQ ID NO: 8499742 - DNA, 22 bp, Homo sapiens
tgcagagaaaccagtggaggac

SEQ ID NO: 8499743 - DNA, 23 bp, Homo sapiens
tgcagacttcgaggagggggata

SEQ ID NO: 8499744 - DNA, 22 bp, Homo sapiens
tgcagagaaaactcctgggtac

SEQ ID NO: 8499745 - DNA, 21 bp, Homo sapiens
tgcagacagggacagaatgga

SEQ ID NO: 8499746 - DNA, 22 bp, Homo sapiens
tgcagacctcccatggctgcct

SEQ ID NO: 8499747 - DNA, 22 bp, Homo sapiens
tgcagacctcccatggctgcct

SEQ ID NO: 8499748 - DNA, 22 bp, Homo sapiens
tgcagattcaaatgaaatgcaa

SEQ ID NO: 8499749 - DNA, 22 bp, Homo sapiens
tgcagattcaaatgaaatgcaa

SEQ ID NO: 8499750 - DNA, 22 bp, Homo sapiens
tgcagattcaaatgaaatgcaa

SEQ ID NO: 8499751 - DNA, 22 bp, Homo sapiens
tgcagatgagggatgaaaatga

SEQ ID NO: 8499752 - DNA, 20 bp, Homo sapiens
tgcagcagaagcccatgctc

SEQ ID NO: 8499753 - DNA, 21 bp, Homo sapiens
tgcagcagaagtctctgtgtc

SEQ ID NO: 8499754 - DNA, 22 bp, Homo sapiens
tgcagcagaatatggctgcagg

SEQ ID NO: 8499755 - DNA, 22 bp, Homo sapiens
tgcagcagaatatggctgcagg

SEQ ID NO: 8499756 - DNA, 22 bp, Homo sapiens
tgcagcagaagtgttcttctct

SEQ ID NO: 8499757 - DNA, 22 bp, Homo sapiens
tgcagcacctatggacacttgt

SEQ ID NO: 8499758 - DNA, 22 bp, Homo sapiens
tgcagcaccacacctggctaat

SEQ ID NO: 8499759 - DNA, 22 bp, Homo sapiens
tgcagagggaaaaggtgctcct

SEQ ID NO: 8499760 - DNA, 22 bp, Homo sapiens
tgcagagggacagccacagctc

SEQ ID NO: 8499761 - DNA, 22 bp, Homo sapiens
tgcagagggacagccacagctc

SEQ ID NO: 8499762 - DNA, 22 bp, Homo sapiens
tgcagagggacagccacagctc

SEQ ID NO: 8499763 - DNA, 22 bp, Homo sapiens
tgcagagggacagccacagctc

SEQ ID NO: 8499764 - DNA, 19 bp, Homo sapiens
tgcagagggtaggaaggcc

SEQ ID NO: 8499765 - DNA, 22 bp, Homo sapiens
tgcagagggagtgacggttcac

SEQ ID NO: 8499766 - DNA, 23 bp, Homo sapiens
tgcagagggactgaagccagctt

SEQ ID NO: 8499767 - DNA, 23 bp, Homo sapiens
tgcagagggactgaagccagctt

SEQ ID NO: 8499768 - DNA, 23 bp, Homo sapiens
tgcagagggactgaagccagctt

SEQ ID NO: 8499769 - DNA, 22 bp, Homo sapiens
tgcagagtagtgaggggacaga

SEQ ID NO: 8499770 - DNA, 22 bp, Homo sapiens
tgcagagtagctataccatttt

SEQ ID NO: 8499771 - DNA, 19 bp, Homo sapiens
tgcagagggtaggaaggcc

SEQ ID NO: 8499772 - DNA, 19 bp, Homo sapiens
tgcagagggtaggaaggcc

SEQ ID NO: 8499773 - DNA, 19 bp, Homo sapiens
tgcagagggtaggaaggcc

SEQ ID NO: 8499774 - DNA, 23 bp, Homo sapiens
tgcagagtgtcacttgaaaacca

SEQ ID NO: 8499775 - DNA, 22 bp, Homo sapiens
tgcagagtgggagaggtgcggg

SEQ ID NO: 8499776 - DNA, 22 bp, Homo sapiens
tgcagagtcctctggagggact

SEQ ID NO: 8499777 - DNA, 22 bp, Homo sapiens
tgcagagtggattctgtatacc

SEQ ID NO: 8499778 - DNA, 22 bp, Homo sapiens
tgcagagttgctttgatagtcc

SEQ ID NO: 8499779 - DNA, 21 bp, Homo sapiens
tgcaatccagcctgggcgaca

SEQ ID NO: 8499780 - DNA, 21 bp, Homo sapiens
tgcaatccagcctgggcgaca

SEQ ID NO: 8499781 - DNA, 21 bp, Homo sapiens
tgcaatccagcctgggcgaca

SEQ ID NO: 8499782 - DNA, 21 bp, Homo sapiens
tgcaatccagcctgggcgaca

SEQ ID NO: 8499783 - DNA, 21 bp, Homo sapiens
tgcaatccagcctgggcgaca

SEQ ID NO: 8499784 - DNA, 22 bp, Homo sapiens
tgcaagggtagaagtgatggca

SEQ ID NO: 8499785 - DNA, 22 bp, Homo sapiens
tgcaaggggtttatgcagatga

SEQ ID NO: 8499786 - DNA, 22 bp, Homo sapiens
tgcaaggggtttatgcagatga

SEQ ID NO: 8499787 - DNA, 22 bp, Homo sapiens
tgcaagggcttagggggctgtg

SEQ ID NO: 8499788 - DNA, 22 bp, Homo sapiens
tgcaagggtgtttgagctgccc

SEQ ID NO: 8499789 - DNA, 22 bp, Homo sapiens
tgcaagggtgtttgagctgccc

SEQ ID NO: 8499790 - DNA, 22 bp, Homo sapiens
tgcaagggtgtttgagctgccc

SEQ ID NO: 8499791 - DNA, 22 bp, Homo sapiens
tgcaagggtagaagtgatggca

SEQ ID NO: 8499792 - DNA, 22 bp, Homo sapiens
tgcaagggtgacaggttgctct

SEQ ID NO: 8499793 - DNA, 22 bp, Homo sapiens
tgcaaggcacccactctgcttt

SEQ ID NO: 8499794 - DNA, 19 bp, Homo sapiens
tgcaagctttttcttgtta

SEQ ID NO: 8499795 - DNA, 22 bp, Homo sapiens
tgcaaggaagggacagctgaga

SEQ ID NO: 8499796 - DNA, 22 bp, Homo sapiens
tgcaagcactcaatgcaaacag

SEQ ID NO: 8499797 - DNA, 22 bp, Homo sapiens
tgcaagcttggctgatgttgat

SEQ ID NO: 8499798 - DNA, 22 bp, Homo sapiens
tgcaaggcccagacaagagctc

SEQ ID NO: 8499799 - DNA, 22 bp, Homo sapiens
tgcaaggctattcacatgtatt

SEQ ID NO: 8499800 - DNA, 22 bp, Homo sapiens
tgcaaggctgcctctgaggacc

SEQ ID NO: 8499801 - DNA, 22 bp, Homo sapiens
tgcaaggcttgcaatggtgatc

SEQ ID NO: 8499802 - DNA, 22 bp, Homo sapiens
tgcaagggcttagggggctgtg

SEQ ID NO: 8499803 - DNA, 22 bp, Homo sapiens
tgcaagggcttagggggctgtg

SEQ ID NO: 8499804 - DNA, 22 bp, Homo sapiens
tgcaaggctattcacatgtatt

SEQ ID NO: 8499805 - DNA, 23 bp, Homo sapiens
tgcaagagttccaaactgttcaa

SEQ ID NO: 8499806 - DNA, 22 bp, Homo sapiens
tgcaagaggtaaaatgaaagga

SEQ ID NO: 8499807 - DNA, 22 bp, Homo sapiens
tgcaagaggaattctagaagca

SEQ ID NO: 8499808 - DNA, 22 bp, Homo sapiens
tgcaagaggaattctagaagca

SEQ ID NO: 8499809 - DNA, 22 bp, Homo sapiens
tgcaagaggaattctagaagca

SEQ ID NO: 8499810 - DNA, 22 bp, Homo sapiens
tgcaagagctgtggcaaaagca

SEQ ID NO: 8499811 - DNA, 22 bp, Homo sapiens
tgcaagagcccagggccaggaa

SEQ ID NO: 8499812 - DNA, 22 bp, Homo sapiens
tgcaagagcccagggccaggaa

SEQ ID NO: 8499813 - DNA, 22 bp, Homo sapiens
tgcaagagcagaaagaactgag

SEQ ID NO: 8499814 - DNA, 22 bp, Homo sapiens
tgcaagacgtgaaattgagaca

SEQ ID NO: 8499815 - DNA, 21 bp, Homo sapiens
tgcaagaatcaggaagctgcc

SEQ ID NO: 8499816 - DNA, 22 bp, Homo sapiens
tgcaaatttctttagtacataa

SEQ ID NO: 8499817 - DNA, 22 bp, Homo sapiens
tgcaacaaggcctcatttcttg

SEQ ID NO: 8499818 - DNA, 23 bp, Homo sapiens
tgcaacaatgaggaaagctactg

SEQ ID NO: 8499819 - DNA, 22 bp, Homo sapiens
tgcaacaggctgtgacatggaa

SEQ ID NO: 8499820 - DNA, 22 bp, Homo sapiens
tgcaacaggctgtgacatggaa

SEQ ID NO: 8499821 - DNA, 22 bp, Homo sapiens
tgcaacctgacccagccagccc

SEQ ID NO: 8499822 - DNA, 22 bp, Homo sapiens
tgcaactaggaggttcttagct

SEQ ID NO: 8499823 - DNA, 22 bp, Homo sapiens
tgcaactctggatcttctggta

SEQ ID NO: 8499824 - DNA, 22 bp, Homo sapiens
tgcaacagtggggcatgctgaa

SEQ ID NO: 8499825 - DNA, 22 bp, Homo sapiens
tgcaacattattaaactaagca

SEQ ID NO: 8499826 - DNA, 22 bp, Homo sapiens
tgcacacagtggacaagtcttg

SEQ ID NO: 8499827 - DNA, 22 bp, Homo sapiens
tgcacacactctgcatatactt

SEQ ID NO: 8499828 - DNA, 22 bp, Homo sapiens
tgcacacactctgcatatactt

SEQ ID NO: 8499829 - DNA, 22 bp, Homo sapiens
tgcacacactcgtgtatatgag

SEQ ID NO: 8499830 - DNA, 22 bp, Homo sapiens
tgcacacacatgaagtagcatg

SEQ ID NO: 8499831 - DNA, 22 bp, Homo sapiens
tgcacacacatgaagtagcatg

SEQ ID NO: 8499832 - DNA, 22 bp, Homo sapiens
tgcacacacaggagtctcctcc

SEQ ID NO: 8499833 - DNA, 22 bp, Homo sapiens
tgcacacacgcggcacatctgt

SEQ ID NO: 8499834 - DNA, 22 bp, Homo sapiens
tgcacacacgcggcacatctgt

SEQ ID NO: 8499835 - DNA, 22 bp, Homo sapiens
tgcacacacgcggcacatctgt

SEQ ID NO: 8499836 - DNA, 22 bp, Homo sapiens
tgcacacaccgtgcttcactga

SEQ ID NO: 8499837 - DNA, 22 bp, Homo sapiens
tgcaattaatttacatgcttaa

SEQ ID NO: 8499838 - DNA, 21 bp, Homo sapiens
tgcaatgcattgacagcagca

SEQ ID NO: 8499839 - DNA, 20 bp, Homo sapiens
tgcaatgtccatgttccagg

SEQ ID NO: 8499840 - DNA, 22 bp, Homo sapiens
tgcaatccccgcctcaacagga

SEQ ID NO: 8499841 - DNA, 21 bp, Homo sapiens
tgcaatttagacttgaacatt

SEQ ID NO: 8499842 - DNA, 21 bp, Homo sapiens
tgcaatttagacttgaacatt

SEQ ID NO: 8499843 - DNA, 22 bp, Homo sapiens
tgcaatttcaaatatcagaaag

SEQ ID NO: 8499844 - DNA, 22 bp, Homo sapiens
tgcaatttatgtgcaagtggtt

SEQ ID NO: 8499845 - DNA, 22 bp, Homo sapiens
tgcaatttggggaagaaagaga

SEQ ID NO: 8499846 - DNA, 17 bp, Homo sapiens
tgcacaagagacaatag

SEQ ID NO: 8499847 - DNA, 22 bp, Homo sapiens
tgcacaaatttgtgtatgctca

SEQ ID NO: 8499848 - DNA, 22 bp, Homo sapiens
tgcacaaaggctccctgctgag

SEQ ID NO: 8499849 - DNA, 22 bp, Homo sapiens
tgcacacaagttggagaatgaa

SEQ ID NO: 8499850 - DNA, 22 bp, Homo sapiens
tgcacacaaatgtgaacgtgcc

SEQ ID NO: 8499851 - DNA, 22 bp, Homo sapiens
tgcaattttttagcacaaggag

SEQ ID NO: 8499852 - DNA, 22 bp, Homo sapiens
tgcaattttaatacattagagg

SEQ ID NO: 8499853 - DNA, 22 bp, Homo sapiens
tgcaaacaggagagtaagtata

SEQ ID NO: 8499854 - DNA, 22 bp, Homo sapiens
tgcaaacaggcatttcacaaac

SEQ ID NO: 8499855 - DNA, 22 bp, Homo sapiens
tgcaaacagttaagatgcaggc

SEQ ID NO: 8499856 - DNA, 22 bp, Homo sapiens
tgcaaacagttaagatgcaggc

SEQ ID NO: 8499857 - DNA, 22 bp, Homo sapiens
tgcaaactattggtagagatgg

SEQ ID NO: 8499858 - DNA, 22 bp, Homo sapiens
tgcaaactagcatcaactagta

SEQ ID NO: 8499859 - DNA, 22 bp, Homo sapiens
tgcaaacatccgactgaaagcc

SEQ ID NO: 8499860 - DNA, 22 bp, Homo sapiens
tgcaaacatccgactgaaagcc

SEQ ID NO: 8499861 - DNA, 22 bp, Homo sapiens
tgcaaacacttcaacgtgcatc

SEQ ID NO: 8499862 - DNA, 22 bp, Homo sapiens
tgcaaacacttcaacgtgcatc

SEQ ID NO: 8499863 - DNA, 20 bp, Homo sapiens
tgcaaacacagagtgtatga

SEQ ID NO: 8499864 - DNA, 22 bp, Homo sapiens
tgcaaacaccacagagacaatt

SEQ ID NO: 8499865 - DNA, 20 bp, Homo sapiens
tgcaaacacagagtgtatga

SEQ ID NO: 8499866 - DNA, 17 bp, Homo sapiens
tgcaaacaatcacatat

SEQ ID NO: 8499867 - DNA, 22 bp, Homo sapiens
tgcaaacaatttcctataaagt

SEQ ID NO: 8499868 - DNA, 23 bp, Homo sapiens
tgcaaaatttgcagagttcgatg

SEQ ID NO: 8499869 - DNA, 22 bp, Homo sapiens
tgcaaagaagcctttgccttct

SEQ ID NO: 8499870 - DNA, 22 bp, Homo sapiens
tgcaaagaagccacagtcccag

SEQ ID NO: 8499871 - DNA, 22 bp, Homo sapiens
tgcaaagaaggggaggaggatt

SEQ ID NO: 8499872 - DNA, 22 bp, Homo sapiens
tgcaaagatgaaatattaaagg

SEQ ID NO: 8499873 - DNA, 22 bp, Homo sapiens
tgcaaagatgaaatattaaagg

SEQ ID NO: 8499874 - DNA, 22 bp, Homo sapiens
tgcaaatattgggacagtctag

SEQ ID NO: 8499875 - DNA, 22 bp, Homo sapiens
tgcaaatcataaacaatagtgt

SEQ ID NO: 8499876 - DNA, 22 bp, Homo sapiens
tgcaaatgcccatttattttct

SEQ ID NO: 8499877 - DNA, 22 bp, Homo sapiens
tgcaaatgcccatttattttct

SEQ ID NO: 8499878 - DNA, 19 bp, Homo sapiens
tgcaaattctaaaaactga

SEQ ID NO: 8499879 - DNA, 18 bp, Homo sapiens
tgcaaatggctgtttgat

SEQ ID NO: 8499880 - DNA, 22 bp, Homo sapiens
tgatttccccagtcttgctgct

SEQ ID NO: 8499881 - DNA, 22 bp, Homo sapiens
tgatttatgcattatactgttg

SEQ ID NO: 8499882 - DNA, 22 bp, Homo sapiens
tgatttatgcattatactgttg

SEQ ID NO: 8499883 - DNA, 22 bp, Homo sapiens
tgatttcaagccagggggcgtt

SEQ ID NO: 8499884 - DNA, 22 bp, Homo sapiens
tgatttcagtaatgaggatgaa

SEQ ID NO: 8499885 - DNA, 22 bp, Homo sapiens
tgatttcaagtagtgacatgct

SEQ ID NO: 8499886 - DNA, 22 bp, Homo sapiens
tgatttaggaaacagctacagg

SEQ ID NO: 8499887 - DNA, 22 bp, Homo sapiens
tgatttatgaccaagttagaat

SEQ ID NO: 8499888 - DNA, 22 bp, Homo sapiens
tgatttttaaaattctccttgc

SEQ ID NO: 8499889 - DNA, 22 bp, Homo sapiens
tgatttttagctattctgaaga

SEQ ID NO: 8499890 - DNA, 22 bp, Homo sapiens
tgatttttagctattctgaaga

SEQ ID NO: 8499891 - DNA, 22 bp, Homo sapiens
tgcaaaaacagccttgaggcct

SEQ ID NO: 8499892 - DNA, 22 bp, Homo sapiens
tgatttttggatctgagctgca

SEQ ID NO: 8499893 - DNA, 22 bp, Homo sapiens
tgattttcatgggtgatctttg

SEQ ID NO: 8499894 - DNA, 22 bp, Homo sapiens
tgattttgaggtttcaggtctt

SEQ ID NO: 8499895 - DNA, 22 bp, Homo sapiens
tgcaaaaactgcaattgctttt

SEQ ID NO: 8499896 - DNA, 22 bp, Homo sapiens
tgcaaaaaggcagactggtgat

SEQ ID NO: 8499897 - DNA, 22 bp, Homo sapiens
tgcaaaaagagcgaggagccct

SEQ ID NO: 8499898 - DNA, 22 bp, Homo sapiens
tgcaaaaagagcgaggagccct

SEQ ID NO: 8499899 - DNA, 22 bp, Homo sapiens
tgcaaaaattgctggaatcttt

SEQ ID NO: 8499900 - DNA, 22 bp, Homo sapiens
tgcaaaataatgaacgattttt

SEQ ID NO: 8499901 - DNA, 22 bp, Homo sapiens
tgcaaaatgacttctgaaaaga

SEQ ID NO: 8499902 - DNA, 22 bp, Homo sapiens
tgatcagtgttggttctatcta

SEQ ID NO: 8499903 - DNA, 21 bp, Homo sapiens
tgatcatttgtgtaaaggaga

SEQ ID NO: 8499904 - DNA, 21 bp, Homo sapiens
tgatcatttgtgtaaaggaga

SEQ ID NO: 8499905 - DNA, 21 bp, Homo sapiens
tgatcatttgtgtaaaggaga

SEQ ID NO: 8499906 - DNA, 22 bp, Homo sapiens
tgatcattatcaaactggtcat

SEQ ID NO: 8499907 - DNA, 22 bp, Homo sapiens
tgatcagcatcttcccagctcg

SEQ ID NO: 8499908 - DNA, 22 bp, Homo sapiens
tgatcagacagttatgtgcatg

SEQ ID NO: 8499909 - DNA, 21 bp, Homo sapiens
tgatcacatgaaaaccatgca

SEQ ID NO: 8499910 - DNA, 22 bp, Homo sapiens
tgatcaaagccaaagttgagat

SEQ ID NO: 8499911 - DNA, 22 bp, Homo sapiens
tgatcaaaacattactccacca

SEQ ID NO: 8499912 - DNA, 22 bp, Homo sapiens
tgatcacaagtctgaagaatga

SEQ ID NO: 8499913 - DNA, 22 bp, Homo sapiens
tgatcacaagtctgaagaatga

SEQ ID NO: 8499914 - DNA, 22 bp, Homo sapiens
tgatcaaattcaggagtctgga

SEQ ID NO: 8499915 - DNA, 22 bp, Homo sapiens
tgatcaaaacattactccacca

SEQ ID NO: 8499916 - DNA, 22 bp, Homo sapiens
tgatcaaaacattactccacca

SEQ ID NO: 8499917 - DNA, 22 bp, Homo sapiens
tgatatttttcactggcctctg

SEQ ID NO: 8499918 - DNA, 22 bp, Homo sapiens
tgatattttatgagctttcata

SEQ ID NO: 8499919 - DNA, 22 bp, Homo sapiens
tgatctaggttggcttcaactg

SEQ ID NO: 8499920 - DNA, 22 bp, Homo sapiens
tgatctaggttggcttcaactg

SEQ ID NO: 8499921 - DNA, 22 bp, Homo sapiens
tgatcccaatctttcctgctcc

SEQ ID NO: 8499922 - DNA, 22 bp, Homo sapiens
tgatctggtcctactgtgggca

SEQ ID NO: 8499923 - DNA, 18 bp, Homo sapiens
tgatctttcatgattcca

SEQ ID NO: 8499924 - DNA, 22 bp, Homo sapiens
tgatctttcctcttgtttgtct

SEQ ID NO: 8499925 - DNA, 22 bp, Homo sapiens
tgatcttcaccttgttctttgg

SEQ ID NO: 8499926 - DNA, 22 bp, Homo sapiens
tgatctttactgctgtttataa

SEQ ID NO: 8499927 - DNA, 22 bp, Homo sapiens
tgatattttatgagctttcata

SEQ ID NO: 8499928 - DNA, 22 bp, Homo sapiens
tgatatttgctgactgcattgt

SEQ ID NO: 8499929 - DNA, 20 bp, Homo sapiens
tgatatttctggaagtggag

SEQ ID NO: 8499930 - DNA, 22 bp, Homo sapiens
tgatatttaagcaaaaatatgg

SEQ ID NO: 8499931 - DNA, 22 bp, Homo sapiens
tgatatgtgaagctattagttc

SEQ ID NO: 8499932 - DNA, 22 bp, Homo sapiens
tgatatgcatgtaagggagaca

SEQ ID NO: 8499933 - DNA, 22 bp, Homo sapiens
tgatatggaaggaagatgtaca

SEQ ID NO: 8499934 - DNA, 22 bp, Homo sapiens
tgatatggctaaagaaagtttc

SEQ ID NO: 8499935 - DNA, 22 bp, Homo sapiens
tgatatgtaactactccttata

SEQ ID NO: 8499936 - DNA, 22 bp, Homo sapiens
tgagttctgactgtgatgccag

SEQ ID NO: 8499937 - DNA, 22 bp, Homo sapiens
tgatacttttcttttagactaa

SEQ ID NO: 8499938 - DNA, 22 bp, Homo sapiens
tgatactttggagacttgagta

SEQ ID NO: 8499939 - DNA, 22 bp, Homo sapiens
tgagttctcatgaaatctagtt

SEQ ID NO: 8499940 - DNA, 22 bp, Homo sapiens
tgagttctcacccattcttctt

SEQ ID NO: 8499941 - DNA, 23 bp, Homo sapiens
tgatagatgtcatggtcttgagt

SEQ ID NO: 8499942 - DNA, 22 bp, Homo sapiens
tgatagaaaggaaattaattgg

SEQ ID NO: 8499943 - DNA, 22 bp, Homo sapiens
tgagttataatgaatatttgaa

SEQ ID NO: 8499944 - DNA, 21 bp, Homo sapiens
tgagttaaggatccaattctg

SEQ ID NO: 8499945 - DNA, 22 bp, Homo sapiens
tgagttaatctctacgatagaa

SEQ ID NO: 8499946 - DNA, 22 bp, Homo sapiens
tgagttactgcctagtaacttg

SEQ ID NO: 8499947 - DNA, 22 bp, Homo sapiens
tgagttaagcaggtagcaagct

SEQ ID NO: 8499948 - DNA, 22 bp, Homo sapiens
tgagttaaatgagaacatgaaa

SEQ ID NO: 8499949 - DNA, 21 bp, Homo sapiens
tgagttaaaatgtcagtgcca

SEQ ID NO: 8499950 - DNA, 21 bp, Homo sapiens
tgagttaaaatggagagtctt

SEQ ID NO: 8499951 - DNA, 22 bp, Homo sapiens
tgagttaaatgagaacatgaaa

SEQ ID NO: 8499952 - DNA, 22 bp, Homo sapiens
tgagttaaatgagaacatgaaa

SEQ ID NO: 8499953 - DNA, 23 bp, Homo sapiens
tgagtgtgttccctgtgagattt

SEQ ID NO: 8499954 - DNA, 23 bp, Homo sapiens
tgagtgtgttccctgtgagattt

SEQ ID NO: 8499955 - DNA, 23 bp, Homo sapiens
tgagtgtgttccctgtgagattt

SEQ ID NO: 8499956 - DNA, 19 bp, Homo sapiens
tgagtgtgtgtttctctaa

SEQ ID NO: 8499957 - DNA, 23 bp, Homo sapiens
tgagtgtgttccctgtgagattt

SEQ ID NO: 8499958 - DNA, 22 bp, Homo sapiens
tgagttcaaattttggctctgc

SEQ ID NO: 8499959 - DNA, 22 bp, Homo sapiens
tgagttcagatcctggctctgc

SEQ ID NO: 8499960 - DNA, 22 bp, Homo sapiens
tgagttatctaaaatagtcaaa

SEQ ID NO: 8499961 - DNA, 22 bp, Homo sapiens
tgagttatctaaaatagtcaaa

SEQ ID NO: 8499962 - DNA, 22 bp, Homo sapiens
tgagttatatatactggctctg

SEQ ID NO: 8499963 - DNA, 22 bp, Homo sapiens
tgagttattgagaaataactgc

SEQ ID NO: 8499964 - DNA, 22 bp, Homo sapiens
tgagttatggagaataaagtca

SEQ ID NO: 8499965 - DNA, 22 bp, Homo sapiens
tgagttcaaagacaggtatagg

SEQ ID NO: 8499966 - DNA, 22 bp, Homo sapiens
tgagttattgcagcttcctcct

SEQ ID NO: 8499967 - DNA, 22 bp, Homo sapiens
tgagtgggttatcaggaaaggt

SEQ ID NO: 8499968 - DNA, 22 bp, Homo sapiens
tgagtgtatatgaaggttgtaa

SEQ ID NO: 8499969 - DNA, 19 bp, Homo sapiens
tgagtgtcacgtcagtgcc

SEQ ID NO: 8499970 - DNA, 22 bp, Homo sapiens
tgagtgtatatgaaggttgtaa

SEQ ID NO: 8499971 - DNA, 22 bp, Homo sapiens
tgagtgggttatcaggaaaggt

SEQ ID NO: 8499972 - DNA, 23 bp, Homo sapiens
tgagtgtgaaaatcctggagatg

SEQ ID NO: 8499973 - DNA, 22 bp, Homo sapiens
tgagtgggattaaatgaggtga

SEQ ID NO: 8499974 - DNA, 19 bp, Homo sapiens
tgagtgggcccctgcagac

SEQ ID NO: 8499975 - DNA, 22 bp, Homo sapiens
tgagtgtgaggtgggagcttgg

SEQ ID NO: 8499976 - DNA, 22 bp, Homo sapiens
tgagtgtgctaggtgtctcggt

SEQ ID NO: 8499977 - DNA, 22 bp, Homo sapiens
tgagtgtgctaggtgtctcggt

SEQ ID NO: 8499978 - DNA, 22 bp, Homo sapiens
tgagtgtgctaggtgtctcggt

SEQ ID NO: 8499979 - DNA, 22 bp, Homo sapiens
tgagtgtggggaatgtcatgag

SEQ ID NO: 8499980 - DNA, 22 bp, Homo sapiens
tgagtgtggggaatgtcatgag

SEQ ID NO: 8499981 - DNA, 22 bp, Homo sapiens
tgagtgtggggaatgtcatgag

SEQ ID NO: 8499982 - DNA, 23 bp, Homo sapiens
tgagtgtggggacagtggtttgc

SEQ ID NO: 8499983 - DNA, 23 bp, Homo sapiens
tgagtgtggggacagtggtttgc

SEQ ID NO: 8499984 - DNA, 22 bp, Homo sapiens
tgagtgtgtattatgtatcagg

SEQ ID NO: 8499985 - DNA, 22 bp, Homo sapiens
tgagtgtgtattatgtatcagg

SEQ ID NO: 8499986 - DNA, 19 bp, Homo sapiens
tgagtgtgtgtttctctaa

SEQ ID NO: 8499987 - DNA, 22 bp, Homo sapiens
tgagtggacacctgcttcttta

SEQ ID NO: 8499988 - DNA, 22 bp, Homo sapiens
tgagtggagaacagaggctctc

SEQ ID NO: 8499989 - DNA, 22 bp, Homo sapiens
tgagtggagactgtgtgtagag

SEQ ID NO: 8499990 - DNA, 22 bp, Homo sapiens
tgagtggacacctgcttcttta

SEQ ID NO: 8499991 - DNA, 22 bp, Homo sapiens
tgagtggagtagtgaatgcatt

SEQ ID NO: 8499992 - DNA, 20 bp, Homo sapiens
tgagtggccactgggtcgca

SEQ ID NO: 8499993 - DNA, 22 bp, Homo sapiens
tgagtgaaaaatttgcctggag

SEQ ID NO: 8499994 - DNA, 22 bp, Homo sapiens
tgagtgaaattctggtaaagga

SEQ ID NO: 8499995 - DNA, 22 bp, Homo sapiens
tgagtgaattcaagtaaagggc

SEQ ID NO: 8499996 - DNA, 22 bp, Homo sapiens
tgagtgagctggggagccggtg

SEQ ID NO: 8499997 - DNA, 22 bp, Homo sapiens
tgagtgagctggggagccggtg

SEQ ID NO: 8499998 - DNA, 22 bp, Homo sapiens
tgagtgaggaagcggtggagga

SEQ ID NO: 8499999 - DNA, 22 bp, Homo sapiens
tgagtgaggaagcggtggagga

SEQ ID NO: 8500000 - DNA, 22 bp, Homo sapiens
tgagtgctctgtatgtgccaga

SEQ ID NO: 8500001 - DNA, 20 bp, Homo sapiens
tgagtgctccattctgccca

SEQ ID NO: 8500002 - DNA, 21 bp, Homo sapiens
tgagtgccacctgctggccaa

SEQ ID NO: 8500003 - DNA, 22 bp, Homo sapiens
tgagtgcctacggcacaggcgc

SEQ ID NO: 8500004 - DNA, 22 bp, Homo sapiens
tgagtgcctgaacatagagtag

SEQ ID NO: 8500005 - DNA, 20 bp, Homo sapiens
tgagtgagtttgtggcagga

SEQ ID NO: 8500006 - DNA, 20 bp, Homo sapiens
tgagtgatggaggcgggtca

SEQ ID NO: 8500007 - DNA, 22 bp, Homo sapiens
tgattctgagggagcattctgc

SEQ ID NO: 8500008 - DNA, 22 bp, Homo sapiens
tgattctgaggaccctgtgacg

SEQ ID NO: 8500009 - DNA, 22 bp, Homo sapiens
tgattctgatcatcatcatggt

SEQ ID NO: 8500010 - DNA, 22 bp, Homo sapiens
tgattctgagggagcattctgc

SEQ ID NO: 8500011 - DNA, 22 bp, Homo sapiens
tgattctgatcatcatcatggt

SEQ ID NO: 8500012 - DNA, 22 bp, Homo sapiens
tgattctgccacgtactggctg

SEQ ID NO: 8500013 - DNA, 22 bp, Homo sapiens
tgattctgccccttggctctgg

SEQ ID NO: 8500014 - DNA, 21 bp, Homo sapiens
tgattctgcatttctaacagg

SEQ ID NO: 8500015 - DNA, 22 bp, Homo sapiens
tgattctgccacgtactggctg

SEQ ID NO: 8500016 - DNA, 20 bp, Homo sapiens
tgattctggtctacgcttta

SEQ ID NO: 8500017 - DNA, 22 bp, Homo sapiens
tgattctgccctttcttctgac

SEQ ID NO: 8500018 - DNA, 22 bp, Homo sapiens
tgattctgcttatgggtggatt

SEQ ID NO: 8500019 - DNA, 23 bp, Homo sapiens
tgattctgctttgagaatcatgg

SEQ ID NO: 8500020 - DNA, 22 bp, Homo sapiens
tgattctgccccttggctctgg

SEQ ID NO: 8500021 - DNA, 22 bp, Homo sapiens
tgattcctaggcactcttctcc

SEQ ID NO: 8500022 - DNA, 22 bp, Homo sapiens
tgattctaggtccattatttgc

SEQ ID NO: 8500023 - DNA, 22 bp, Homo sapiens
tgattccactctgaggatcgta

SEQ ID NO: 8500024 - DNA, 22 bp, Homo sapiens
tgattcatcagaataggagttt

SEQ ID NO: 8500025 - DNA, 22 bp, Homo sapiens
tgattctgtaaacatgtcttta

SEQ ID NO: 8500026 - DNA, 22 bp, Homo sapiens
tgattctgtaagtcatattgtt

SEQ ID NO: 8500027 - DNA, 22 bp, Homo sapiens
tgattctgctttgatccttgtg

SEQ ID NO: 8500028 - DNA, 20 bp, Homo sapiens
tgattctggtctacgcttta

SEQ ID NO: 8500029 - DNA, 22 bp, Homo sapiens
tgattctgtgaattagttgggt

SEQ ID NO: 8500030 - DNA, 18 bp, Homo sapiens
tgattctgtgatgtggtc

SEQ ID NO: 8500031 - DNA, 22 bp, Homo sapiens
tgattctgtctccttcactccg

SEQ ID NO: 8500032 - DNA, 21 bp, Homo sapiens
tgattctgttttatcatcagc

SEQ ID NO: 8500033 - DNA, 22 bp, Homo sapiens
tgattctgttctccttgagaat

SEQ ID NO: 8500034 - DNA, 22 bp, Homo sapiens
tgattgaagaggtgaggaagtt

SEQ ID NO: 8500035 - DNA, 22 bp, Homo sapiens
tgattgaagctagaacaaccat

SEQ ID NO: 8500036 - DNA, 22 bp, Homo sapiens
tgattgaagtgttctgttccag

SEQ ID NO: 8500037 - DNA, 22 bp, Homo sapiens
tgattgaatattcccttgggcc

SEQ ID NO: 8500038 - DNA, 22 bp, Homo sapiens
tgattgtttcctatgtacacct

SEQ ID NO: 8500039 - DNA, 22 bp, Homo sapiens
tgattgtatgattgaaatattt

SEQ ID NO: 8500040 - DNA, 22 bp, Homo sapiens
tgattgtatgattgaaatattt

SEQ ID NO: 8500041 - DNA, 22 bp, Homo sapiens
tgatttaaaagaaacattgtct

SEQ ID NO: 8500042 - DNA, 22 bp, Homo sapiens
tgatttaaaagaaacattgtct

SEQ ID NO: 8500043 - DNA, 22 bp, Homo sapiens
tgatttaaaagaaacattgtct

SEQ ID NO: 8500044 - DNA, 22 bp, Homo sapiens
tgattgaattcaaatgcaatct

SEQ ID NO: 8500045 - DNA, 21 bp, Homo sapiens
tgattgatatttgcaaacaga

SEQ ID NO: 8500046 - DNA, 22 bp, Homo sapiens
tgattgcctactatgtgccatg

SEQ ID NO: 8500047 - DNA, 22 bp, Homo sapiens
tgattgtataggggttattaat

SEQ ID NO: 8500048 - DNA, 22 bp, Homo sapiens
tgattgcttctttgctatctgt

SEQ ID NO: 8500049 - DNA, 22 bp, Homo sapiens
tgattgctgaattttaggaact

SEQ ID NO: 8500050 - DNA, 22 bp, Homo sapiens
tgattaaaatttaacttagtta

SEQ ID NO: 8500051 - DNA, 22 bp, Homo sapiens
tgattaaaatttaacttagtta

SEQ ID NO: 8500052 - DNA, 22 bp, Homo sapiens
tgattaaattaattaagatgag

SEQ ID NO: 8500053 - DNA, 22 bp, Homo sapiens
tgatgtttaatactatgctttt

SEQ ID NO: 8500054 - DNA, 22 bp, Homo sapiens
tgatgtgtgattcattctcaaa

SEQ ID NO: 8500055 - DNA, 22 bp, Homo sapiens
tgatgtctctctatactctaac

SEQ ID NO: 8500056 - DNA, 22 bp, Homo sapiens
tgatgtctgccagggtcctggg

SEQ ID NO: 8500057 - DNA, 22 bp, Homo sapiens
tgatggttttattaataggacc

SEQ ID NO: 8500058 - DNA, 22 bp, Homo sapiens
tgatgtaagagatacacttgat

SEQ ID NO: 8500059 - DNA, 23 bp, Homo sapiens
tgattacaagggccaaagaaagg

SEQ ID NO: 8500060 - DNA, 22 bp, Homo sapiens
tgattacaattgtcttagattt

SEQ ID NO: 8500061 - DNA, 22 bp, Homo sapiens
tgattacaaaagattgtttgaa

SEQ ID NO: 8500062 - DNA, 22 bp, Homo sapiens
tgattacaacagagtcatccat

SEQ ID NO: 8500063 - DNA, 22 bp, Homo sapiens
tgattaacgttttaggcatact

SEQ ID NO: 8500064 - DNA, 22 bp, Homo sapiens
tgattaactgtctattaatcat

SEQ ID NO: 8500065 - DNA, 22 bp, Homo sapiens
tgattaactgtctattaatcat

SEQ ID NO: 8500066 - DNA, 22 bp, Homo sapiens
tgattaagttcaaaatatagaa

SEQ ID NO: 8500067 - DNA, 22 bp, Homo sapiens
tgattcagacctgtcagacttc

SEQ ID NO: 8500068 - DNA, 22 bp, Homo sapiens
tgattcagttggttttgttcag

SEQ ID NO: 8500069 - DNA, 22 bp, Homo sapiens
tgattcatatgtaacatccctg

SEQ ID NO: 8500070 - DNA, 22 bp, Homo sapiens
tgattcatcagaataggagttt

SEQ ID NO: 8500071 - DNA, 22 bp, Homo sapiens
tgattcaattatctgatgcttt

SEQ ID NO: 8500072 - DNA, 22 bp, Homo sapiens
tgattcaataggaattgagtag

SEQ ID NO: 8500073 - DNA, 22 bp, Homo sapiens
tgattcacagacttcacaaggc

SEQ ID NO: 8500074 - DNA, 22 bp, Homo sapiens
tgattcaataggaattgagtag

SEQ ID NO: 8500075 - DNA, 22 bp, Homo sapiens
tgattcaataggaattgagtag

SEQ ID NO: 8500076 - DNA, 18 bp, Homo sapiens
tgattcaagttgccctcc

SEQ ID NO: 8500077 - DNA, 19 bp, Homo sapiens
tgatggaatttgacattcc

SEQ ID NO: 8500078 - DNA, 22 bp, Homo sapiens
tgatggagcatgtgtgcttcct

SEQ ID NO: 8500079 - DNA, 22 bp, Homo sapiens
tgatggaaatttgggaagcttt

SEQ ID NO: 8500080 - DNA, 22 bp, Homo sapiens
tgatggaaatgttctgtatctg

SEQ ID NO: 8500081 - DNA, 22 bp, Homo sapiens
tgatggcttatggagagagcaa

SEQ ID NO: 8500082 - DNA, 22 bp, Homo sapiens
tgatggctatccctggaagggc

SEQ ID NO: 8500083 - DNA, 22 bp, Homo sapiens
tgatggctccttcattatgggt

SEQ ID NO: 8500084 - DNA, 22 bp, Homo sapiens
tgatggatgtggctctggagct

SEQ ID NO: 8500085 - DNA, 18 bp, Homo sapiens
tgatggaggagggctggt

SEQ ID NO: 8500086 - DNA, 22 bp, Homo sapiens
tgatgggaggtgctgcaggacc

SEQ ID NO: 8500087 - DNA, 22 bp, Homo sapiens
tgatggtcaggatgcatggaga

SEQ ID NO: 8500088 - DNA, 22 bp, Homo sapiens
tgatgggactgccagctgctga

SEQ ID NO: 8500089 - DNA, 22 bp, Homo sapiens
tgatgggaggtgctgcaggacc

SEQ ID NO: 8500090 - DNA, 22 bp, Homo sapiens
tgatgggaggtgctgcaggacc

SEQ ID NO: 8500091 - DNA, 22 bp, Homo sapiens
tgatgggaaaatgaggcctggg

SEQ ID NO: 8500092 - DNA, 23 bp, Homo sapiens
tgatgggaaggaacgactaccac

SEQ ID NO: 8500093 - DNA, 22 bp, Homo sapiens
tgatgggaaaatgaggcctggg

SEQ ID NO: 8500094 - DNA, 22 bp, Homo sapiens
tgatgcaatgtttacatcttga

SEQ ID NO: 8500095 - DNA, 22 bp, Homo sapiens
tgatgcaatgtttacatcttga

SEQ ID NO: 8500096 - DNA, 22 bp, Homo sapiens
tgatgcacaaagtcagcatcct

SEQ ID NO: 8500097 - DNA, 22 bp, Homo sapiens
tgatgcattgccgacttactgg

SEQ ID NO: 8500098 - DNA, 22 bp, Homo sapiens
tgatgctgtgtacctcatggga

SEQ ID NO: 8500099 - DNA, 22 bp, Homo sapiens
tgatgctgttccagttatattg

SEQ ID NO: 8500100 - DNA, 22 bp, Homo sapiens
tgatgcttcacgctgaatatgc

SEQ ID NO: 8500101 - DNA, 22 bp, Homo sapiens
tgatgctgctgggagtggtgct

SEQ ID NO: 8500102 - DNA, 20 bp, Homo sapiens
tgatgctggtctgaattgca

SEQ ID NO: 8500103 - DNA, 22 bp, Homo sapiens
tgatgcctatgaattgtaatgt

SEQ ID NO: 8500104 - DNA, 22 bp, Homo sapiens
tgatgctgagcctgggactgac

SEQ ID NO: 8500105 - DNA, 22 bp, Homo sapiens
tgatgaaagttcagtagtgaat

SEQ ID NO: 8500106 - DNA, 22 bp, Homo sapiens
tgatgaaagtgtttactcacct

SEQ ID NO: 8500107 - DNA, 22 bp, Homo sapiens
tgatgaggtggattcaaagcag

SEQ ID NO: 8500108 - DNA, 22 bp, Homo sapiens
tgatgaatgtcatacataatga

SEQ ID NO: 8500109 - DNA, 22 bp, Homo sapiens
tgatgatgtttatcttggtatt

SEQ ID NO: 8500110 - DNA, 22 bp, Homo sapiens
tgatgaataaacttgagagtca

SEQ ID NO: 8500111 - DNA, 22 bp, Homo sapiens
tgatctttggtaatctggcaca

SEQ ID NO: 8500112 - DNA, 22 bp, Homo sapiens
tgatctttggtagtacgataat

SEQ ID NO: 8500113 - DNA, 18 bp, Homo sapiens
tgatctttgagtataatg

SEQ ID NO: 8500114 - DNA, 18 bp, Homo sapiens
tgatctttgagtataatg

SEQ ID NO: 8500115 - DNA, 22 bp, Homo sapiens
tgatgaaaaccagaactctcat

SEQ ID NO: 8500116 - DNA, 22 bp, Homo sapiens
tgatctttttggtcatttgggt

SEQ ID NO: 8500117 - DNA, 22 bp, Homo sapiens
tgatcttttctatttatggtag

SEQ ID NO: 8500118 - DNA, 22 bp, Homo sapiens
tgatctttttggtcatttgggt

SEQ ID NO: 8500119 - DNA, 22 bp, Homo sapiens
tgacaaaactgcaattactttt

SEQ ID NO: 8500120 - DNA, 22 bp, Homo sapiens
tgacaaaccagtagcaataaag

SEQ ID NO: 8500121 - DNA, 22 bp, Homo sapiens
tgacaaaccctgcaaatagctc

SEQ ID NO: 8500122 - DNA, 22 bp, Homo sapiens
tgacaaaccctgcaaatagctc

SEQ ID NO: 8500123 - DNA, 22 bp, Homo sapiens
tgacaaactctttgagaacaag

SEQ ID NO: 8500124 - DNA, 22 bp, Homo sapiens
tgacaaagaccttcaacaagat

SEQ ID NO: 8500125 - DNA, 22 bp, Homo sapiens
tgacaaagcatgatggtgacag

SEQ ID NO: 8500126 - DNA, 20 bp, Homo sapiens
tgacaaatgatctgattttc

SEQ ID NO: 8500127 - DNA, 22 bp, Homo sapiens
tgacaaatacaataagatctgt

SEQ ID NO: 8500128 - DNA, 22 bp, Homo sapiens
tgacaaagtgaggtcttcagta

SEQ ID NO: 8500129 - DNA, 22 bp, Homo sapiens
tgacaattgtgggcagtttgtg

SEQ ID NO: 8500130 - DNA, 22 bp, Homo sapiens
tgacaattgtgggcagtttgtg

SEQ ID NO: 8500131 - DNA, 22 bp, Homo sapiens
tgacacaaaggaaagcataatc

SEQ ID NO: 8500132 - DNA, 22 bp, Homo sapiens
tgacacaaaggaaagcataatc

SEQ ID NO: 8500133 - DNA, 22 bp, Homo sapiens
tgacacaaacaagatatttgcc

SEQ ID NO: 8500134 - DNA, 20 bp, Homo sapiens
tgacacaaattgctttctca

SEQ ID NO: 8500135 - DNA, 22 bp, Homo sapiens
tgaattgtggctttttccaatt

SEQ ID NO: 8500136 - DNA, 22 bp, Homo sapiens
tgaattgtgacccctctgtatt

SEQ ID NO: 8500137 - DNA, 22 bp, Homo sapiens
tgaattgtacagtatgtgaatt

SEQ ID NO: 8500138 - DNA, 21 bp, Homo sapiens
tgaatttcggtatggctataa

SEQ ID NO: 8500139 - DNA, 23 bp, Homo sapiens
tgaattttggcatattctgaaat

SEQ ID NO: 8500140 - DNA, 22 bp, Homo sapiens
tgaattcttaatgaaatctact

SEQ ID NO: 8500141 - DNA, 23 bp, Homo sapiens
tgaatcaattatgggattcaatg

SEQ ID NO: 8500142 - DNA, 22 bp, Homo sapiens
tgaatcagtataaattctcaaa

SEQ ID NO: 8500143 - DNA, 22 bp, Homo sapiens
tgaatccagagctatttcgtcc

SEQ ID NO: 8500144 - DNA, 22 bp, Homo sapiens
tgaatcctaattctatcactta

SEQ ID NO: 8500145 - DNA, 22 bp, Homo sapiens
tgaatatggcaactcttgtaac

SEQ ID NO: 8500146 - DNA, 22 bp, Homo sapiens
tgaatatgctttgcaatcctaa

SEQ ID NO: 8500147 - DNA, 22 bp, Homo sapiens
tgaatagttctactacttgaca

SEQ ID NO: 8500148 - DNA, 22 bp, Homo sapiens
tgaatacactaaaaatcacttt

SEQ ID NO: 8500149 - DNA, 22 bp, Homo sapiens
tgaatacactaaaaatcacttt

SEQ ID NO: 8500150 - DNA, 22 bp, Homo sapiens
tgaatacactaaaaatcacttt

SEQ ID NO: 8500151 - DNA, 22 bp, Homo sapiens
tgaataattcctttttgtcaag

SEQ ID NO: 8500152 - DNA, 22 bp, Homo sapiens
tgaatacaggaaaatatactga

SEQ ID NO: 8500153 - DNA, 22 bp, Homo sapiens
tgaatacaggaaaatatactga

SEQ ID NO: 8500154 - DNA, 22 bp, Homo sapiens
tgaatacaggaaaatatactga

SEQ ID NO: 8500155 - DNA, 22 bp, Homo sapiens
tgaatacaggaaaatatactga

SEQ ID NO: 8500156 - DNA, 19 bp, Homo sapiens
tgaatacagagatacagaa

SEQ ID NO: 8500157 - DNA, 22 bp, Homo sapiens
tgaatagatggtgacagtatga

SEQ ID NO: 8500158 - DNA, 22 bp, Homo sapiens
tgaatagtccttggaataactg

SEQ ID NO: 8500159 - DNA, 22 bp, Homo sapiens
tgaatacaggaaaatatactga

SEQ ID NO: 8500160 - DNA, 22 bp, Homo sapiens
tgaatactatttcataatgtgg

SEQ ID NO: 8500161 - DNA, 22 bp, Homo sapiens
tgaatgctttggagccttctaa

SEQ ID NO: 8500162 - DNA, 22 bp, Homo sapiens
tgaatggatataacaacagtgt

SEQ ID NO: 8500163 - DNA, 21 bp, Homo sapiens
tgaatgcttcgtcatcctggc

SEQ ID NO: 8500164 - DNA, 22 bp, Homo sapiens
tgaatgcttggagtcataaaat

SEQ ID NO: 8500165 - DNA, 21 bp, Homo sapiens
tgaatgaggaggatggcattt

SEQ ID NO: 8500166 - DNA, 22 bp, Homo sapiens
tgaatctttttggaaataaaga

SEQ ID NO: 8500167 - DNA, 22 bp, Homo sapiens
tgaatctggatctatgatcaat

SEQ ID NO: 8500168 - DNA, 22 bp, Homo sapiens
tgaatctggatctatgatcaat

SEQ ID NO: 8500169 - DNA, 22 bp, Homo sapiens
tgaatctgatttccctggaggc

SEQ ID NO: 8500170 - DNA, 22 bp, Homo sapiens
tgaatgacctttgaggatggaa

SEQ ID NO: 8500171 - DNA, 22 bp, Homo sapiens
tgaatgtgatgctaaacatatg

SEQ ID NO: 8500172 - DNA, 22 bp, Homo sapiens
tgaatgtgggagagctggcaat

SEQ ID NO: 8500173 - DNA, 18 bp, Homo sapiens
tgaatgttttctggaccc

SEQ ID NO: 8500174 - DNA, 22 bp, Homo sapiens
tgaattatcttgtaattttgaa

SEQ ID NO: 8500175 - DNA, 22 bp, Homo sapiens
tgaaggcacttgcctaggggca

SEQ ID NO: 8500176 - DNA, 22 bp, Homo sapiens
tgaaggctgttggatggggaag

SEQ ID NO: 8500177 - DNA, 22 bp, Homo sapiens
tgaaggcttgactgaggcagga

SEQ ID NO: 8500178 - DNA, 22 bp, Homo sapiens
tgaaggctgggctcagccagct

SEQ ID NO: 8500179 - DNA, 22 bp, Homo sapiens
tgaaggggttcagcatgggggt

SEQ ID NO: 8500180 - DNA, 21 bp, Homo sapiens
tgaaggggtggcagtgtgctt

SEQ ID NO: 8500181 - DNA, 22 bp, Homo sapiens
tgaaggggttcagcatgggggt

SEQ ID NO: 8500182 - DNA, 21 bp, Homo sapiens
tgaaggggtggcagtgtgctt

SEQ ID NO: 8500183 - DNA, 22 bp, Homo sapiens
tgaagggggagatatatgtgtg

SEQ ID NO: 8500184 - DNA, 21 bp, Homo sapiens
tgaaggggccatcacaaaggc

SEQ ID NO: 8500185 - DNA, 21 bp, Homo sapiens
tgaagggcagcctcaggctcc

SEQ ID NO: 8500186 - DNA, 21 bp, Homo sapiens
tgaagggcagcctcaggctcc

SEQ ID NO: 8500187 - DNA, 22 bp, Homo sapiens
tgaaggtgagcatttgctgatt

SEQ ID NO: 8500188 - DNA, 22 bp, Homo sapiens
tgaaggtggaagggtggttctg

SEQ ID NO: 8500189 - DNA, 22 bp, Homo sapiens
tgaaggtggcataggagagatg

SEQ ID NO: 8500190 - DNA, 22 bp, Homo sapiens
tgaaggtgacctgacagtggct

SEQ ID NO: 8500191 - DNA, 23 bp, Homo sapiens
tgaaggtattacctgagatgctc

SEQ ID NO: 8500192 - DNA, 22 bp, Homo sapiens
tgaataaattgagagcgaatgt

SEQ ID NO: 8500193 - DNA, 22 bp, Homo sapiens
tgaataaattgagagcgaatgt

SEQ ID NO: 8500194 - DNA, 22 bp, Homo sapiens
tgaataaattgagagcgaatgt

SEQ ID NO: 8500195 - DNA, 22 bp, Homo sapiens
tgaataagaattattataatga

SEQ ID NO: 8500196 - DNA, 22 bp, Homo sapiens
tgaataaatcaaagactgccct

SEQ ID NO: 8500197 - DNA, 22 bp, Homo sapiens
tgaataaagtatgtcctgggaa

SEQ ID NO: 8500198 - DNA, 21 bp, Homo sapiens
tgaataaagctgctgtcgata

SEQ ID NO: 8500199 - DNA, 22 bp, Homo sapiens
tgaataatcttgggtattaata

SEQ ID NO: 8500200 - DNA, 22 bp, Homo sapiens
tgaataatccacagtcattcat

SEQ ID NO: 8500201 - DNA, 22 bp, Homo sapiens
tgaataaactatgaggaggaat

SEQ ID NO: 8500202 - DNA, 22 bp, Homo sapiens
tgaataaactatgaggaggaat

SEQ ID NO: 8500203 - DNA, 22 bp, Homo sapiens
tgaataaactatgaggaggaat

SEQ ID NO: 8500204 - DNA, 22 bp, Homo sapiens
tgaaggagatttttagggaggc

SEQ ID NO: 8500205 - DNA, 22 bp, Homo sapiens
tgaaggagctcaatgatgatgc

SEQ ID NO: 8500206 - DNA, 22 bp, Homo sapiens
tgaagcttgtatttaaataagt

SEQ ID NO: 8500207 - DNA, 22 bp, Homo sapiens
tgaagcttgagtgtcagttcct

SEQ ID NO: 8500208 - DNA, 22 bp, Homo sapiens
tgaagcttgtatttaaataagt

SEQ ID NO: 8500209 - DNA, 22 bp, Homo sapiens
tgaaggagctcaggagatagtc

SEQ ID NO: 8500210 - DNA, 22 bp, Homo sapiens
tgaaggagctcaggagatagtc

SEQ ID NO: 8500211 - DNA, 22 bp, Homo sapiens
tgaagctgcctgctcacagcca

SEQ ID NO: 8500212 - DNA, 22 bp, Homo sapiens
tgaagctggaagcatgcagact

SEQ ID NO: 8500213 - DNA, 22 bp, Homo sapiens
tgaagctggaagttaggtagac

SEQ ID NO: 8500214 - DNA, 22 bp, Homo sapiens
tgaagctgtgggcagtggagcc

SEQ ID NO: 8500215 - DNA, 22 bp, Homo sapiens
tgaagctgtgggcagtggagcc

SEQ ID NO: 8500216 - DNA, 22 bp, Homo sapiens
tgaaggcaacctctgtggtcct

SEQ ID NO: 8500217 - DNA, 22 bp, Homo sapiens
tgaaggcaacctctgtggtcct

SEQ ID NO: 8500218 - DNA, 22 bp, Homo sapiens
tgaaggcacgtgggtggatact

SEQ ID NO: 8500219 - DNA, 19 bp, Homo sapiens
tgaaggagggggatggcca

SEQ ID NO: 8500220 - DNA, 19 bp, Homo sapiens
tgaaggagggggatggcca

SEQ ID NO: 8500221 - DNA, 19 bp, Homo sapiens
tgaaggagggggatggcca

SEQ ID NO: 8500222 - DNA, 19 bp, Homo sapiens
tgaaggagggggatggcca

SEQ ID NO: 8500223 - DNA, 22 bp, Homo sapiens
tgaaggaggaatgtggcctcca

SEQ ID NO: 8500224 - DNA, 22 bp, Homo sapiens
tgaaggagctgatgtaaggggt

SEQ ID NO: 8500225 - DNA, 22 bp, Homo sapiens
tgaaggagctgatgtaaggggt

SEQ ID NO: 8500226 - DNA, 22 bp, Homo sapiens
tgaagccatcaggaagccagca

SEQ ID NO: 8500227 - DNA, 22 bp, Homo sapiens
tgaagccatccctcagatggcc

SEQ ID NO: 8500228 - DNA, 22 bp, Homo sapiens
tgaagccctgtcttatggaaga

SEQ ID NO: 8500229 - DNA, 23 bp, Homo sapiens
tgaagcccagtgattttgtttca

SEQ ID NO: 8500230 - DNA, 22 bp, Homo sapiens
tgaagccctgtgtcagcttcca

SEQ ID NO: 8500231 - DNA, 21 bp, Homo sapiens
tgaagcctgaggcatagcccc

SEQ ID NO: 8500232 - DNA, 22 bp, Homo sapiens
tgaagccttgtgtggcctctct

SEQ ID NO: 8500233 - DNA, 22 bp, Homo sapiens
tgaagctatataagttacagca

SEQ ID NO: 8500234 - DNA, 22 bp, Homo sapiens
tgaagccactttccagaatcac

SEQ ID NO: 8500235 - DNA, 22 bp, Homo sapiens
tgaagccagctttggaagacac

SEQ ID NO: 8500236 - DNA, 22 bp, Homo sapiens
tgaagccagggactgacacttc

SEQ ID NO: 8500237 - DNA, 22 bp, Homo sapiens
tgaagccaatctgccaggcaga

SEQ ID NO: 8500238 - DNA, 22 bp, Homo sapiens
tgaagccacagagcatctgcct

SEQ ID NO: 8500239 - DNA, 22 bp, Homo sapiens
tgaagccaaggatgcctttctc

SEQ ID NO: 8500240 - DNA, 22 bp, Homo sapiens
tgaagcatctggtctgagaatt

SEQ ID NO: 8500241 - DNA, 23 bp, Homo sapiens
tgaagcatggataactcacacct

SEQ ID NO: 8500242 - DNA, 22 bp, Homo sapiens
tgacacagaaattaagctgtca

SEQ ID NO: 8500243 - DNA, 22 bp, Homo sapiens
tgacacagattagagacatacc

SEQ ID NO: 8500244 - DNA, 22 bp, Homo sapiens
tgacacagattagagacatacc

SEQ ID NO: 8500245 - DNA, 19 bp, Homo sapiens
tgacacagctaggtttgct

SEQ ID NO: 8500246 - DNA, 22 bp, Homo sapiens
tgacacagggaaagcggatcca

SEQ ID NO: 8500247 - DNA, 22 bp, Homo sapiens
tgacacaggcagctcccagcac

SEQ ID NO: 8500248 - DNA, 23 bp, Homo sapiens
tgacacaggtcaaaaataagatg

SEQ ID NO: 8500249 - DNA, 22 bp, Homo sapiens
tgacaccttgctaaatggcacc

SEQ ID NO: 8500250 - DNA, 22 bp, Homo sapiens
tgacaccttgctaaatggcacc

SEQ ID NO: 8500251 - DNA, 22 bp, Homo sapiens
tgacacattaaatgctcacaaa

SEQ ID NO: 8500252 - DNA, 23 bp, Homo sapiens
tgacacatttcctttccactgca

SEQ ID NO: 8500253 - DNA, 22 bp, Homo sapiens
tgacacattaaatgctcacaaa

SEQ ID NO: 8500254 - DNA, 22 bp, Homo sapiens
tgacacagtagaaagatgatga

SEQ ID NO: 8500255 - DNA, 22 bp, Homo sapiens
tgacacagtatcaaacatgatt

SEQ ID NO: 8500256 - DNA, 22 bp, Homo sapiens
tgacagaaatagttcttaattt

SEQ ID NO: 8500257 - DNA, 22 bp, Homo sapiens
tgacagaaagagtattaaagat

SEQ ID NO: 8500258 - DNA, 22 bp, Homo sapiens
tgacagaaagaatatgtcaatc

SEQ ID NO: 8500259 - DNA, 22 bp, Homo sapiens
tgacagaaagaatatgtcaatc

SEQ ID NO: 8500260 - DNA, 22 bp, Homo sapiens
tgacactgacctaaagacctgg

SEQ ID NO: 8500261 - DNA, 22 bp, Homo sapiens
tgacactgcaaatataaatatt

SEQ ID NO: 8500262 - DNA, 22 bp, Homo sapiens
tgacactgcatatattgaagtt

SEQ ID NO: 8500263 - DNA, 22 bp, Homo sapiens
tgacactgccgaaactgtagag

SEQ ID NO: 8500264 - DNA, 21 bp, Homo sapiens
tgacagcacatgcaatcggag

SEQ ID NO: 8500265 - DNA, 22 bp, Homo sapiens
tgacagaccactgcaactctgt

SEQ ID NO: 8500266 - DNA, 22 bp, Homo sapiens
tgacagagttcggattgagttt

SEQ ID NO: 8500267 - DNA, 22 bp, Homo sapiens
tgacagaacaggttgggagcaa

SEQ ID NO: 8500268 - DNA, 18 bp, Homo sapiens
tgacagaacctggagcct

SEQ ID NO: 8500269 - DNA, 22 bp, Homo sapiens
tgacagaactttttcacatctc

SEQ ID NO: 8500270 - DNA, 22 bp, Homo sapiens
tgacagaatgtgactctcagat

SEQ ID NO: 8500271 - DNA, 22 bp, Homo sapiens
tgacagaatgtgactctcagat

SEQ ID NO: 8500272 - DNA, 22 bp, Homo sapiens
tgacagacagcttctcatttta

SEQ ID NO: 8500273 - DNA, 22 bp, Homo sapiens
tgacagacagcttctcatttta

SEQ ID NO: 8500274 - DNA, 22 bp, Homo sapiens
tgacaggctaggaggctgaagg

SEQ ID NO: 8500275 - DNA, 22 bp, Homo sapiens
tgacaggcttgctaagacatag

SEQ ID NO: 8500276 - DNA, 22 bp, Homo sapiens
tgacagggacagtggagatgga

SEQ ID NO: 8500277 - DNA, 22 bp, Homo sapiens
tgacaggcaggacagaggtgtg

SEQ ID NO: 8500278 - DNA, 21 bp, Homo sapiens
tgacaggcaccctggctgtga

SEQ ID NO: 8500279 - DNA, 22 bp, Homo sapiens
tgacaggattggttgcttctga

SEQ ID NO: 8500280 - DNA, 22 bp, Homo sapiens
tgacaggagtggctagtgggag

SEQ ID NO: 8500281 - DNA, 21 bp, Homo sapiens
tgacagcatagagcagggagg

SEQ ID NO: 8500282 - DNA, 22 bp, Homo sapiens
tgacagcataacactggtcttg

SEQ ID NO: 8500283 - DNA, 22 bp, Homo sapiens
tgacagcagcatagtgagcaat

SEQ ID NO: 8500284 - DNA, 22 bp, Homo sapiens
tgacagcagcatagtgagcaat

SEQ ID NO: 8500285 - DNA, 22 bp, Homo sapiens
tgacagggtcagagctgagctg

SEQ ID NO: 8500286 - DNA, 22 bp, Homo sapiens
tgacagggtcagagctgagctg

SEQ ID NO: 8500287 - DNA, 22 bp, Homo sapiens
tgacagggggcagaggtggctg

SEQ ID NO: 8500288 - DNA, 22 bp, Homo sapiens
tgacagggtgattatgagagct

SEQ ID NO: 8500289 - DNA, 22 bp, Homo sapiens
tgacagggtcagagctgagctg

SEQ ID NO: 8500290 - DNA, 22 bp, Homo sapiens
tgacagggtgattatgagagct

SEQ ID NO: 8500291 - DNA, 22 bp, Homo sapiens
tgacaggtgattgtgaactaag

SEQ ID NO: 8500292 - DNA, 22 bp, Homo sapiens
tgacagggacagtggagatgga

SEQ ID NO: 8500293 - DNA, 22 bp, Homo sapiens
tgacagggctagaggcaatgca

SEQ ID NO: 8500294 - DNA, 22 bp, Homo sapiens
tgacagggctagaggcaatgca

SEQ ID NO: 8500295 - DNA, 22 bp, Homo sapiens
tgacaggggctggtggataaat

SEQ ID NO: 8500296 - DNA, 22 bp, Homo sapiens
tgacagtatacttgtgatggga

SEQ ID NO: 8500297 - DNA, 22 bp, Homo sapiens
tgacagtagaagatgctgttac

SEQ ID NO: 8500298 - DNA, 22 bp, Homo sapiens
tgacagtgaacaggttaccact

SEQ ID NO: 8500299 - DNA, 22 bp, Homo sapiens
tgacagtgagcttggggtactt

SEQ ID NO: 8500300 - DNA, 22 bp, Homo sapiens
tgacagtgcgggtacatcatag

SEQ ID NO: 8500301 - DNA, 22 bp, Homo sapiens
tgactcagtacatctggagttg

SEQ ID NO: 8500302 - DNA, 22 bp, Homo sapiens
tgactctcccaagtttgaggga

SEQ ID NO: 8500303 - DNA, 22 bp, Homo sapiens
tgactccacaatttgacttata

SEQ ID NO: 8500304 - DNA, 18 bp, Homo sapiens
tgactcaccctgtcagtg

SEQ ID NO: 8500305 - DNA, 22 bp, Homo sapiens
tgactattttttatagattcca

SEQ ID NO: 8500306 - DNA, 22 bp, Homo sapiens
tgactattacggccacgaattt

SEQ ID NO: 8500307 - DNA, 21 bp, Homo sapiens
tgactgaaatagaatttagct

SEQ ID NO: 8500308 - DNA, 22 bp, Homo sapiens
tgactcttaaatatactgttga

SEQ ID NO: 8500309 - DNA, 22 bp, Homo sapiens
tgactctggggttgaccagatg

SEQ ID NO: 8500310 - DNA, 22 bp, Homo sapiens
tgactctgtacctgtctgcctt

SEQ ID NO: 8500311 - DNA, 22 bp, Homo sapiens
tgactctgctgtgaaagcattt

SEQ ID NO: 8500312 - DNA, 20 bp, Homo sapiens
tgactctgcaaccgtctctc

SEQ ID NO: 8500313 - DNA, 22 bp, Homo sapiens
tgactctgattgccttagcttg

SEQ ID NO: 8500314 - DNA, 22 bp, Homo sapiens
tgactacaacctccacctcccg

SEQ ID NO: 8500315 - DNA, 22 bp, Homo sapiens
tgactacaacctccacctcccg

SEQ ID NO: 8500316 - DNA, 22 bp, Homo sapiens
tgactaaaataggacattaact

SEQ ID NO: 8500317 - DNA, 22 bp, Homo sapiens
tgacgtcaactgcaaaggcctt

SEQ ID NO: 8500318 - DNA, 22 bp, Homo sapiens
tgacctttctttgagattcctg

SEQ ID NO: 8500319 - DNA, 22 bp, Homo sapiens
tgacctttctctgggtgcttgg

SEQ ID NO: 8500320 - DNA, 22 bp, Homo sapiens
tgacctttcaacccttcttggc

SEQ ID NO: 8500321 - DNA, 22 bp, Homo sapiens
tgacctgacatgaattaaaaac

SEQ ID NO: 8500322 - DNA, 22 bp, Homo sapiens
tgacctcttgtcggagctccag

SEQ ID NO: 8500323 - DNA, 22 bp, Homo sapiens
tgacctctgtcctgcagtctgg

SEQ ID NO: 8500324 - DNA, 22 bp, Homo sapiens
tgactgccgattgtccttctct

SEQ ID NO: 8500325 - DNA, 22 bp, Homo sapiens
tgactgccccttccattcctgc

SEQ ID NO: 8500326 - DNA, 22 bp, Homo sapiens
tgactgccccttccattcctgc

SEQ ID NO: 8500327 - DNA, 22 bp, Homo sapiens
tgactggagacctcagtagggt

SEQ ID NO: 8500328 - DNA, 22 bp, Homo sapiens
tgactgccgattgtccttctct

SEQ ID NO: 8500329 - DNA, 22 bp, Homo sapiens
tgactgaggcctgataacagtt

SEQ ID NO: 8500330 - DNA, 22 bp, Homo sapiens
tgactgaaggactagattgatt

SEQ ID NO: 8500331 - DNA, 21 bp, Homo sapiens
tgactgaggcttcttcacaca

SEQ ID NO: 8500332 - DNA, 21 bp, Homo sapiens
tgactgaggcttcttcacaca

SEQ ID NO: 8500333 - DNA, 22 bp, Homo sapiens
tgacttcctgcactcaggtgat

SEQ ID NO: 8500334 - DNA, 22 bp, Homo sapiens
tgacttcctgcactcaggtgat

SEQ ID NO: 8500335 - DNA, 22 bp, Homo sapiens
tgacttcctgcactcaggtgat

SEQ ID NO: 8500336 - DNA, 22 bp, Homo sapiens
tgacttcctgcactcaggtgat

SEQ ID NO: 8500337 - DNA, 17 bp, Homo sapiens
tgacttaacagcaaggc

SEQ ID NO: 8500338 - DNA, 22 bp, Homo sapiens
tgacttcaaaggctctactcct

SEQ ID NO: 8500339 - DNA, 22 bp, Homo sapiens
tgacttcaaaggctctactcct

SEQ ID NO: 8500340 - DNA, 22 bp, Homo sapiens
tgacttgtcaaagaaatgtgtg

SEQ ID NO: 8500341 - DNA, 22 bp, Homo sapiens
tgacttgtctctttgggagaca

SEQ ID NO: 8500342 - DNA, 22 bp, Homo sapiens
tgacttctctggcctggtgcag

SEQ ID NO: 8500343 - DNA, 22 bp, Homo sapiens
tgacttctgattgcttctattt

SEQ ID NO: 8500344 - DNA, 22 bp, Homo sapiens
tgacttctgattgcttctattt

SEQ ID NO: 8500345 - DNA, 22 bp, Homo sapiens
tgacttctgggtgagccagcat

SEQ ID NO: 8500346 - DNA, 22 bp, Homo sapiens
tgacctattagatttccttgcc

SEQ ID NO: 8500347 - DNA, 18 bp, Homo sapiens
tgaccctttctccctgtg

SEQ ID NO: 8500348 - DNA, 22 bp, Homo sapiens
tgacccttagtgaacattagaa

SEQ ID NO: 8500349 - DNA, 21 bp, Homo sapiens
tgacccttctagcagaacaca

SEQ ID NO: 8500350 - DNA, 21 bp, Homo sapiens
tgacatttggattcatagtaa

SEQ ID NO: 8500351 - DNA, 22 bp, Homo sapiens
tgacattttatcaatatcacag

SEQ ID NO: 8500352 - DNA, 22 bp, Homo sapiens
tgacattttatcaatatcacag

SEQ ID NO: 8500353 - DNA, 22 bp, Homo sapiens
tgacatttttataagagtcaaa

SEQ ID NO: 8500354 - DNA, 22 bp, Homo sapiens
tgacatttttaaaaccactagt

SEQ ID NO: 8500355 - DNA, 22 bp, Homo sapiens
tgacatttttaaaaccactagt

SEQ ID NO: 8500356 - DNA, 18 bp, Homo sapiens
tgacatttccagagtgta

SEQ ID NO: 8500357 - DNA, 22 bp, Homo sapiens
tgacatttcctagtgctttgtg

SEQ ID NO: 8500358 - DNA, 22 bp, Homo sapiens
tgacatttcctagtgctttgtg

SEQ ID NO: 8500359 - DNA, 22 bp, Homo sapiens
tgacatttcctagtgctttgtg

SEQ ID NO: 8500360 - DNA, 22 bp, Homo sapiens
tgacatttcttgttgatataaa

SEQ ID NO: 8500361 - DNA, 22 bp, Homo sapiens
tgacatttcttgttgatataaa

SEQ ID NO: 8500362 - DNA, 22 bp, Homo sapiens
tgacatttcttgttgatataaa

SEQ ID NO: 8500363 - DNA, 22 bp, Homo sapiens
tgacatttcggtgtatgtgatg

SEQ ID NO: 8500364 - DNA, 22 bp, Homo sapiens
tgacatttgagcatacatgtaa

SEQ ID NO: 8500365 - DNA, 22 bp, Homo sapiens
tgacatttgagcatacatgtaa

SEQ ID NO: 8500366 - DNA, 22 bp, Homo sapiens
tgacatttgagagagatataca

SEQ ID NO: 8500367 - DNA, 22 bp, Homo sapiens
tgacatttcttgttgatataaa

SEQ ID NO: 8500368 - DNA, 22 bp, Homo sapiens
tgacatttatcttctacaatga

SEQ ID NO: 8500369 - DNA, 22 bp, Homo sapiens
tgacatttatcaaagaaatggt

SEQ ID NO: 8500370 - DNA, 21 bp, Homo sapiens
tgacatttagtagcattgtca

SEQ ID NO: 8500371 - DNA, 21 bp, Homo sapiens
tgacatttagtagcattgtca

SEQ ID NO: 8500372 - DNA, 22 bp, Homo sapiens
tgacatttactattcctggtta

SEQ ID NO: 8500373 - DNA, 22 bp, Homo sapiens
tgacatttcagatatggtattt

SEQ ID NO: 8500374 - DNA, 22 bp, Homo sapiens
tgacatttatcttctacaatga

SEQ ID NO: 8500375 - DNA, 21 bp, Homo sapiens
tgacatttccaatataaagcc

SEQ ID NO: 8500376 - DNA, 18 bp, Homo sapiens
tgacatttccagagtgta

SEQ ID NO: 8500377 - DNA, 22 bp, Homo sapiens
tgacatttaattaacgaatgct

SEQ ID NO: 8500378 - DNA, 22 bp, Homo sapiens
tgacatttaatccctaaatatt

SEQ ID NO: 8500379 - DNA, 22 bp, Homo sapiens
tgacatttaatccctaaatatt

SEQ ID NO: 8500380 - DNA, 22 bp, Homo sapiens
tgacatttaagcctctgatttc

SEQ ID NO: 8500381 - DNA, 22 bp, Homo sapiens
tgacatttaagcctctgatttc

SEQ ID NO: 8500382 - DNA, 22 bp, Homo sapiens
tgacatttaagcctctgatttc

SEQ ID NO: 8500383 - DNA, 22 bp, Homo sapiens
tgacatttaagcctctgatttc

SEQ ID NO: 8500384 - DNA, 22 bp, Homo sapiens
tgaaacaaaagtatgtagcttg

SEQ ID NO: 8500385 - DNA, 22 bp, Homo sapiens
tgaaacaaaagtatgtagcttg

SEQ ID NO: 8500386 - DNA, 22 bp, Homo sapiens
tgaaaatttccatcagttatat

SEQ ID NO: 8500387 - DNA, 22 bp, Homo sapiens
tgaaaattgttgtacttgataa

SEQ ID NO: 8500388 - DNA, 22 bp, Homo sapiens
tgaaaattgttgtacttgataa

SEQ ID NO: 8500389 - DNA, 22 bp, Homo sapiens
tgaaaattcatctcatagcaga

SEQ ID NO: 8500390 - DNA, 22 bp, Homo sapiens
tgaaaattgttgtacttgataa

SEQ ID NO: 8500391 - DNA, 22 bp, Homo sapiens
tgaaaatggcctgaagaagcaa

SEQ ID NO: 8500392 - DNA, 22 bp, Homo sapiens
tgaaaattaagcagatgaatga

SEQ ID NO: 8500393 - DNA, 22 bp, Homo sapiens
tgaaaagactgcaagagagcat

SEQ ID NO: 8500394 - DNA, 22 bp, Homo sapiens
tgaaaagactgcaagagagcat

SEQ ID NO: 8500395 - DNA, 22 bp, Homo sapiens
tgaaaagggtagatccctaagt

SEQ ID NO: 8500396 - DNA, 22 bp, Homo sapiens
tgaaaatatagttttccagact

SEQ ID NO: 8500397 - DNA, 22 bp, Homo sapiens
tgaaaatatagttttccagact

SEQ ID NO: 8500398 - DNA, 22 bp, Homo sapiens
tgaaaagtgatcatggattagg

SEQ ID NO: 8500399 - DNA, 22 bp, Homo sapiens
tgaaaagtgatcatggattagg

SEQ ID NO: 8500400 - DNA, 22 bp, Homo sapiens
tgaaaatgcacgctggaaagca

SEQ ID NO: 8500401 - DNA, 22 bp, Homo sapiens
tgaaaatatagttttccagact

SEQ ID NO: 8500402 - DNA, 22 bp, Homo sapiens
tgaaaatatagttttccagact

SEQ ID NO: 8500403 - DNA, 23 bp, Homo sapiens
tctttttaagagatctagtgacg

SEQ ID NO: 8500404 - DNA, 23 bp, Homo sapiens
tctttttaagagatctagtgacg

SEQ ID NO: 8500405 - DNA, 22 bp, Homo sapiens
tcttttgttgcctacttattaa

SEQ ID NO: 8500406 - DNA, 22 bp, Homo sapiens
tctttttatattgacaaaaggt

SEQ ID NO: 8500407 - DNA, 22 bp, Homo sapiens
tctttttatattgacaaaaggt

SEQ ID NO: 8500408 - DNA, 22 bp, Homo sapiens
tctttttatattgacaaaaggt

SEQ ID NO: 8500409 - DNA, 22 bp, Homo sapiens
tctttttttcctgtgcagagct

SEQ ID NO: 8500410 - DNA, 22 bp, Homo sapiens
tctttttttcctgtgcagagct

SEQ ID NO: 8500411 - DNA, 22 bp, Homo sapiens
tgaaaaactttaatccataaag

SEQ ID NO: 8500412 - DNA, 22 bp, Homo sapiens
tgaaaaactgaatagttgagta

SEQ ID NO: 8500413 - DNA, 22 bp, Homo sapiens
tgaaaaactttaatccataaag

SEQ ID NO: 8500414 - DNA, 22 bp, Homo sapiens
tgaaaacagaatccttgttttc

SEQ ID NO: 8500415 - DNA, 22 bp, Homo sapiens
tgaaaactccaagtttcatcag

SEQ ID NO: 8500416 - DNA, 22 bp, Homo sapiens
tgaaaacactttagtttaggtc

SEQ ID NO: 8500417 - DNA, 22 bp, Homo sapiens
tgaaaaacactaattggaaagc

SEQ ID NO: 8500418 - DNA, 22 bp, Homo sapiens
tgaaaaacactaattggaaagc

SEQ ID NO: 8500419 - DNA, 22 bp, Homo sapiens
tgaaaaactgaatagttgagta

SEQ ID NO: 8500420 - DNA, 22 bp, Homo sapiens
tgaaaaacctcagtccgcttta

SEQ ID NO: 8500421 - DNA, 22 bp, Homo sapiens
tgaaaaaacaagttggcccatt

SEQ ID NO: 8500422 - DNA, 22 bp, Homo sapiens
tgaaaaaacaagttggcccatt

SEQ ID NO: 8500423 - DNA, 19 bp, Homo sapiens
tgaaacaaacttaaaagga

SEQ ID NO: 8500424 - DNA, 19 bp, Homo sapiens
tgaaacaaacttaaaagga

SEQ ID NO: 8500425 - DNA, 22 bp, Homo sapiens
tgaaacaaaccagtaattttgt

SEQ ID NO: 8500426 - DNA, 22 bp, Homo sapiens
tgaaacaaaccagtaattttgt

SEQ ID NO: 8500427 - DNA, 22 bp, Homo sapiens
tgaaacaaaccagtaattttgt

SEQ ID NO: 8500428 - DNA, 22 bp, Homo sapiens
tgaaacaaaccagtaattttgt

SEQ ID NO: 8500429 - DNA, 22 bp, Homo sapiens
tgaaacaaaattaagattctcg

SEQ ID NO: 8500430 - DNA, 22 bp, Homo sapiens
tgaaacaaaattaagattctcg

SEQ ID NO: 8500431 - DNA, 19 bp, Homo sapiens
tgaaacaaacttaaaagga

SEQ ID NO: 8500432 - DNA, 19 bp, Homo sapiens
tgaaacaaacttaaaagga

SEQ ID NO: 8500433 - DNA, 22 bp, Homo sapiens
tgaaacaggcaaaactgcagat

SEQ ID NO: 8500434 - DNA, 22 bp, Homo sapiens
tgaaacagtctccagacttgga

SEQ ID NO: 8500435 - DNA, 22 bp, Homo sapiens
tgaaacagtctccagacttgga

SEQ ID NO: 8500436 - DNA, 22 bp, Homo sapiens
tgaaacagtctccagacttgga

SEQ ID NO: 8500437 - DNA, 21 bp, Homo sapiens
tgaaacatttgatcaaagcac

SEQ ID NO: 8500438 - DNA, 21 bp, Homo sapiens
tgaaacatttgatcaaagcac

SEQ ID NO: 8500439 - DNA, 21 bp, Homo sapiens
tgaaacatttgatcaaagcac

SEQ ID NO: 8500440 - DNA, 21 bp, Homo sapiens
tgaaacatttgatcaaagcac

SEQ ID NO: 8500441 - DNA, 22 bp, Homo sapiens
tgaaacatttgatgatctttgg

SEQ ID NO: 8500442 - DNA, 22 bp, Homo sapiens
tgaaacatttgatgatctttgg

SEQ ID NO: 8500443 - DNA, 23 bp, Homo sapiens
tgaaacatttagggtagaatttc

SEQ ID NO: 8500444 - DNA, 23 bp, Homo sapiens
tgaaacatttagggtagaatttc

SEQ ID NO: 8500445 - DNA, 22 bp, Homo sapiens
tgaaacattgcactgtatgaat

SEQ ID NO: 8500446 - DNA, 22 bp, Homo sapiens
tgaaacattgcactgtatgaat

SEQ ID NO: 8500447 - DNA, 22 bp, Homo sapiens
tgaaacattaggaaatcattat

SEQ ID NO: 8500448 - DNA, 22 bp, Homo sapiens
tgaaacattaggaaatcattat

SEQ ID NO: 8500449 - DNA, 22 bp, Homo sapiens
tgaaacataaagttatcttcag

SEQ ID NO: 8500450 - DNA, 22 bp, Homo sapiens
tgaaacataaagttatcttcag

SEQ ID NO: 8500451 - DNA, 22 bp, Homo sapiens
tgaaacataaagttatcttcag

SEQ ID NO: 8500452 - DNA, 22 bp, Homo sapiens
tgaaacattatagaatatttat

SEQ ID NO: 8500453 - DNA, 22 bp, Homo sapiens
tgaaacattatagaatatttat

SEQ ID NO: 8500454 - DNA, 22 bp, Homo sapiens
tgaaacattatagaatatttat

SEQ ID NO: 8500455 - DNA, 22 bp, Homo sapiens
tgaaacattaggaaatcattat

SEQ ID NO: 8500456 - DNA, 22 bp, Homo sapiens
tgaaacggaatgttctttatcg

SEQ ID NO: 8500457 - DNA, 22 bp, Homo sapiens
tgaaaccattctcaggtacact

SEQ ID NO: 8500458 - DNA, 22 bp, Homo sapiens
tgaaactgaaaggtatttatag

SEQ ID NO: 8500459 - DNA, 21 bp, Homo sapiens
tgaaactacctacaagctacc

SEQ ID NO: 8500460 - DNA, 22 bp, Homo sapiens
tgaaacttataagaatatgaat

SEQ ID NO: 8500461 - DNA, 22 bp, Homo sapiens
tgaaacttataagaatatgaat

SEQ ID NO: 8500462 - DNA, 22 bp, Homo sapiens
tgaaacttataagaatatgaat

SEQ ID NO: 8500463 - DNA, 22 bp, Homo sapiens
tgaaacttctaatatgaatagt

SEQ ID NO: 8500464 - DNA, 22 bp, Homo sapiens
tgaaacttattcagtttctacc

SEQ ID NO: 8500465 - DNA, 22 bp, Homo sapiens
tgaaacttttgaggttcttcca

SEQ ID NO: 8500466 - DNA, 22 bp, Homo sapiens
tgaaacttttgaggttcttcca

SEQ ID NO: 8500467 - DNA, 22 bp, Homo sapiens
tgaaagaaacaggtatattggg

SEQ ID NO: 8500468 - DNA, 22 bp, Homo sapiens
tgaaagaaacaggtatattggg

SEQ ID NO: 8500469 - DNA, 22 bp, Homo sapiens
tgaaagaagggtggaaaatgta

SEQ ID NO: 8500470 - DNA, 22 bp, Homo sapiens
tgaaagaagcctccctttggag

SEQ ID NO: 8500471 - DNA, 22 bp, Homo sapiens
tgaaagaactagcatcttcaag

SEQ ID NO: 8500472 - DNA, 22 bp, Homo sapiens
tgaaagaactagcatcttcaag

SEQ ID NO: 8500473 - DNA, 22 bp, Homo sapiens
tgaaagaactagcatcttcaag

SEQ ID NO: 8500474 - DNA, 22 bp, Homo sapiens
tgaaagaactagcatcttcaag

SEQ ID NO: 8500475 - DNA, 22 bp, Homo sapiens
tgaaagaagtgtcacattgcca

SEQ ID NO: 8500476 - DNA, 22 bp, Homo sapiens
tgaaagaagtgtcacattgcca

SEQ ID NO: 8500477 - DNA, 22 bp, Homo sapiens
tgaaagaagtgtcacattgcca

SEQ ID NO: 8500478 - DNA, 21 bp, Homo sapiens
tgaaagaaggtgcagtctgaa

SEQ ID NO: 8500479 - DNA, 17 bp, Homo sapiens
tgaaagaatcagggaga

SEQ ID NO: 8500480 - DNA, 21 bp, Homo sapiens
tgaaagaggatgtggtcattc

SEQ ID NO: 8500481 - DNA, 21 bp, Homo sapiens
tgaaagaggatgtggtcattc

SEQ ID NO: 8500482 - DNA, 21 bp, Homo sapiens
tgaaagaggatgtggtcattc

SEQ ID NO: 8500483 - DNA, 22 bp, Homo sapiens
tcttttattaggctgaaatggg

SEQ ID NO: 8500484 - DNA, 22 bp, Homo sapiens
tcttttattaggctgaaatggg

SEQ ID NO: 8500485 - DNA, 22 bp, Homo sapiens
tcttttatctgttgtgtaacaa

SEQ ID NO: 8500486 - DNA, 22 bp, Homo sapiens
tcttttattaggctgaaatggg

SEQ ID NO: 8500487 - DNA, 22 bp, Homo sapiens
tcttttatcctacatttagctc

SEQ ID NO: 8500488 - DNA, 22 bp, Homo sapiens
tcttttcacagacaaatggaga

SEQ ID NO: 8500489 - DNA, 19 bp, Homo sapiens
tcttttcacgcattttgaa

SEQ ID NO: 8500490 - DNA, 19 bp, Homo sapiens
tcttttcacgcattttgaa

SEQ ID NO: 8500491 - DNA, 22 bp, Homo sapiens
tcttttcattgagaacacactg

SEQ ID NO: 8500492 - DNA, 22 bp, Homo sapiens
tcttttcatcatttaataggta

SEQ ID NO: 8500493 - DNA, 22 bp, Homo sapiens
tcttttcaggaatggctctagt

SEQ ID NO: 8500494 - DNA, 22 bp, Homo sapiens
tcttttcattgagaacacactg

SEQ ID NO: 8500495 - DNA, 18 bp, Homo sapiens
tcttttccttccacttcc

SEQ ID NO: 8500496 - DNA, 18 bp, Homo sapiens
tcttttccttccacttcc

SEQ ID NO: 8500497 - DNA, 22 bp, Homo sapiens
tcttttctccagacctgggatc

SEQ ID NO: 8500498 - DNA, 21 bp, Homo sapiens
tcttttctctgcaggattcct

SEQ ID NO: 8500499 - DNA, 21 bp, Homo sapiens
tcttttctctgcaggattcct

SEQ ID NO: 8500500 - DNA, 22 bp, Homo sapiens
tcttttctagcaaatccaggag

SEQ ID NO: 8500501 - DNA, 21 bp, Homo sapiens
tcttttctcagctttgtggtt

SEQ ID NO: 8500502 - DNA, 21 bp, Homo sapiens
tcttttctcagctttgtggtt

SEQ ID NO: 8500503 - DNA, 22 bp, Homo sapiens
tcttttatagtgaattttcttg

SEQ ID NO: 8500504 - DNA, 22 bp, Homo sapiens
tcttttatagtgaattttcttg

SEQ ID NO: 8500505 - DNA, 22 bp, Homo sapiens
tcttttatcctacatttagctc

SEQ ID NO: 8500506 - DNA, 22 bp, Homo sapiens
tcttttatcctacatttagctc

SEQ ID NO: 8500507 - DNA, 22 bp, Homo sapiens
tcttttagagcatttctgattc

SEQ ID NO: 8500508 - DNA, 22 bp, Homo sapiens
tcttttagctctgcaaggaaag

SEQ ID NO: 8500509 - DNA, 22 bp, Homo sapiens
tcttttagaaaagttgaatgta

SEQ ID NO: 8500510 - DNA, 22 bp, Homo sapiens
tcttttaagcctctggcatagg

SEQ ID NO: 8500511 - DNA, 22 bp, Homo sapiens
tcttttaagcctctggcatagg

SEQ ID NO: 8500512 - DNA, 22 bp, Homo sapiens
tcttttaacctaactagcttgg

SEQ ID NO: 8500513 - DNA, 22 bp, Homo sapiens
tcttttaacctaactagcttgg

SEQ ID NO: 8500514 - DNA, 21 bp, Homo sapiens
tcttttaacaccaggaattcc

SEQ ID NO: 8500515 - DNA, 18 bp, Homo sapiens
tctttgtttccttcttgc

SEQ ID NO: 8500516 - DNA, 22 bp, Homo sapiens
tctttgttattgtgaatagggt

SEQ ID NO: 8500517 - DNA, 22 bp, Homo sapiens
tctttgttattgctttatctat

SEQ ID NO: 8500518 - DNA, 22 bp, Homo sapiens
tctttgttattgctttatctat

SEQ ID NO: 8500519 - DNA, 20 bp, Homo sapiens
tctttgttaattttatctcc

SEQ ID NO: 8500520 - DNA, 20 bp, Homo sapiens
tctttgttaattttatctcc

SEQ ID NO: 8500521 - DNA, 20 bp, Homo sapiens
tctttgtgtcagatggacag

SEQ ID NO: 8500522 - DNA, 22 bp, Homo sapiens
tctttgcatggacatgtgtttt

SEQ ID NO: 8500523 - DNA, 22 bp, Homo sapiens
tctttgcatgcattttccctta

SEQ ID NO: 8500524 - DNA, 22 bp, Homo sapiens
tctttgcatgcattttccctta

SEQ ID NO: 8500525 - DNA, 22 bp, Homo sapiens
tctttgcatgcattttccctta

SEQ ID NO: 8500526 - DNA, 22 bp, Homo sapiens
tctttgcatcccttccatagtt

SEQ ID NO: 8500527 - DNA, 21 bp, Homo sapiens
tctttgcatcagttgttttct

SEQ ID NO: 8500528 - DNA, 22 bp, Homo sapiens
tctttgctattgtgaatagtgc

SEQ ID NO: 8500529 - DNA, 22 bp, Homo sapiens
tctttgcatgtgcttcttggcc

SEQ ID NO: 8500530 - DNA, 22 bp, Homo sapiens
tctttgcatgtgcttcttggcc

SEQ ID NO: 8500531 - DNA, 22 bp, Homo sapiens
tctttgcatgtgcttcttggcc

SEQ ID NO: 8500532 - DNA, 22 bp, Homo sapiens
tctttgctattgtgagtagtgc

SEQ ID NO: 8500533 - DNA, 22 bp, Homo sapiens
tctttgctccacactctagaga

SEQ ID NO: 8500534 - DNA, 22 bp, Homo sapiens
tctttgctccacactctagaga

SEQ ID NO: 8500535 - DNA, 22 bp, Homo sapiens
tctttgcaaaatacaacaatgg

SEQ ID NO: 8500536 - DNA, 22 bp, Homo sapiens
tctttgcaaatgttattatctt

SEQ ID NO: 8500537 - DNA, 22 bp, Homo sapiens
tctttgatttgacaatatcttg

SEQ ID NO: 8500538 - DNA, 22 bp, Homo sapiens
tctttgcaactcccatttccat

SEQ ID NO: 8500539 - DNA, 22 bp, Homo sapiens
tctttgcaactcccatttccat

SEQ ID NO: 8500540 - DNA, 22 bp, Homo sapiens
tctttgcaaatgttattatctt

SEQ ID NO: 8500541 - DNA, 22 bp, Homo sapiens
tctttgcaaatgttattatctt

SEQ ID NO: 8500542 - DNA, 22 bp, Homo sapiens
tctttgcacacagcgattcttc

SEQ ID NO: 8500543 - DNA, 22 bp, Homo sapiens
tctttgcactgtgcaagcagaa

SEQ ID NO: 8500544 - DNA, 22 bp, Homo sapiens
tctttgcaggagccctttgaac

SEQ ID NO: 8500545 - DNA, 22 bp, Homo sapiens
tctttgcagaatttaactttgc

SEQ ID NO: 8500546 - DNA, 22 bp, Homo sapiens
tctttgcagaatttaactttgc

SEQ ID NO: 8500547 - DNA, 22 bp, Homo sapiens
tctttgcagaatttaactttgc

SEQ ID NO: 8500548 - DNA, 22 bp, Homo sapiens
tctttgcaggccaaattgttaa

SEQ ID NO: 8500549 - DNA, 22 bp, Homo sapiens
tctttgcaggccaaattgttaa

SEQ ID NO: 8500550 - DNA, 21 bp, Homo sapiens
tctttgcatcagttgttttct

SEQ ID NO: 8500551 - DNA, 22 bp, Homo sapiens
tctttgcagttctgattaaata

SEQ ID NO: 8500552 - DNA, 22 bp, Homo sapiens
tctttgcagtggtgaataaaga

SEQ ID NO: 8500553 - DNA, 22 bp, Homo sapiens
tctttggatgcgttacttttac

SEQ ID NO: 8500554 - DNA, 22 bp, Homo sapiens
tctttggatcccaactggctgg

SEQ ID NO: 8500555 - DNA, 22 bp, Homo sapiens
tctttggatatgtatggataga

SEQ ID NO: 8500556 - DNA, 22 bp, Homo sapiens
tctttggatatcgctagaccgt

SEQ ID NO: 8500557 - DNA, 22 bp, Homo sapiens
tctttggagtgttatcagtaat

SEQ ID NO: 8500558 - DNA, 18 bp, Homo sapiens
tctttggacaactactgg

SEQ ID NO: 8500559 - DNA, 22 bp, Homo sapiens
tctttggactttccaatttgtt

SEQ ID NO: 8500560 - DNA, 18 bp, Homo sapiens
tctttggacaactactgg

SEQ ID NO: 8500561 - DNA, 22 bp, Homo sapiens
tctttggcacttctgttttaag

SEQ ID NO: 8500562 - DNA, 22 bp, Homo sapiens
tctttgtaaatgcctagcataa

SEQ ID NO: 8500563 - DNA, 22 bp, Homo sapiens
tctttgtaactgtctattgaga

SEQ ID NO: 8500564 - DNA, 22 bp, Homo sapiens
tctttgtaactgtctattgaga

SEQ ID NO: 8500565 - DNA, 22 bp, Homo sapiens
tctttgtaagacatgtaagtcc

SEQ ID NO: 8500566 - DNA, 22 bp, Homo sapiens
tctttgtaagacatgtaagtcc

SEQ ID NO: 8500567 - DNA, 22 bp, Homo sapiens
tctttgtaactgtctattgaga

SEQ ID NO: 8500568 - DNA, 22 bp, Homo sapiens
tctttgtaagaaattcttccgt

SEQ ID NO: 8500569 - DNA, 22 bp, Homo sapiens
tctttgtaagttatatgtagta

SEQ ID NO: 8500570 - DNA, 22 bp, Homo sapiens
tctttgtaagttatatgtagta

SEQ ID NO: 8500571 - DNA, 22 bp, Homo sapiens
tctttgtaagttatatgtagta

SEQ ID NO: 8500572 - DNA, 22 bp, Homo sapiens
tctttgtacaggaaggcactgt

SEQ ID NO: 8500573 - DNA, 19 bp, Homo sapiens
tctttgtacaagtctctgc

SEQ ID NO: 8500574 - DNA, 22 bp, Homo sapiens
tctttgtactttctggctgtcc

SEQ ID NO: 8500575 - DNA, 22 bp, Homo sapiens
tctttgtgccatgcagtgaggc

SEQ ID NO: 8500576 - DNA, 22 bp, Homo sapiens
tctttgtgccatgcagtgaggc

SEQ ID NO: 8500577 - DNA, 22 bp, Homo sapiens
tgaaataggaaacagatgtttc

SEQ ID NO: 8500578 - DNA, 22 bp, Homo sapiens
tgaaatatcattttcatctccc

SEQ ID NO: 8500579 - DNA, 22 bp, Homo sapiens
tgaaataatatctggatcaatc

SEQ ID NO: 8500580 - DNA, 22 bp, Homo sapiens
tgaaataatatctggatcaatc

SEQ ID NO: 8500581 - DNA, 17 bp, Homo sapiens
tgaaatcagcacccagg

SEQ ID NO: 8500582 - DNA, 22 bp, Homo sapiens
tgaaatcagtatgtctttctca

SEQ ID NO: 8500583 - DNA, 22 bp, Homo sapiens
tgaaatcatctgccaataagtt

SEQ ID NO: 8500584 - DNA, 23 bp, Homo sapiens
tgaaatattcttttgcatgagct

SEQ ID NO: 8500585 - DNA, 23 bp, Homo sapiens
tgaaatattcttttgcatgagct

SEQ ID NO: 8500586 - DNA, 22 bp, Homo sapiens
tgaaatatttagagagtaagtt

SEQ ID NO: 8500587 - DNA, 22 bp, Homo sapiens
tgaaatcaatgtcttctgtctc

SEQ ID NO: 8500588 - DNA, 22 bp, Homo sapiens
tgaaatcaataattggtgattg

SEQ ID NO: 8500589 - DNA, 22 bp, Homo sapiens
tgaaagtctctgttatagagaa

SEQ ID NO: 8500590 - DNA, 22 bp, Homo sapiens
tgaaagtatttgatttctatta

SEQ ID NO: 8500591 - DNA, 22 bp, Homo sapiens
tgaaaggttaaaagtagtattg

SEQ ID NO: 8500592 - DNA, 22 bp, Homo sapiens
tgaaaggtgacatttcttggat

SEQ ID NO: 8500593 - DNA, 20 bp, Homo sapiens
tgaaaggtgggaattgtggg

SEQ ID NO: 8500594 - DNA, 22 bp, Homo sapiens
tgaaaggtgtccaatatttctc

SEQ ID NO: 8500595 - DNA, 22 bp, Homo sapiens
tgaaaggtgtccaatatttctc

SEQ ID NO: 8500596 - DNA, 22 bp, Homo sapiens
tgaaaggttatttaggtctgct

SEQ ID NO: 8500597 - DNA, 22 bp, Homo sapiens
tgaaaggttaaaagtagtattg

SEQ ID NO: 8500598 - DNA, 22 bp, Homo sapiens
tgaaagttattactgatgatgt

SEQ ID NO: 8500599 - DNA, 22 bp, Homo sapiens
tgaaagttacaggaaaacagat

SEQ ID NO: 8500600 - DNA, 22 bp, Homo sapiens
tgaaagttgcacataagagaat

SEQ ID NO: 8500601 - DNA, 22 bp, Homo sapiens
tgaaagttgcacataagagaat

SEQ ID NO: 8500602 - DNA, 21 bp, Homo sapiens
tgaaagttggagtcaaatgta

SEQ ID NO: 8500603 - DNA, 21 bp, Homo sapiens
tgaaagttggagtcaaatgta

SEQ ID NO: 8500604 - DNA, 23 bp, Homo sapiens
tgaaagcaatgggtctatagtat

SEQ ID NO: 8500605 - DNA, 23 bp, Homo sapiens
tgaaagcaatgggtctatagtat

SEQ ID NO: 8500606 - DNA, 22 bp, Homo sapiens
tgaaagcacaagttctaacagg

SEQ ID NO: 8500607 - DNA, 22 bp, Homo sapiens
tgaaaggtagctggcctcatag

SEQ ID NO: 8500608 - DNA, 22 bp, Homo sapiens
tgaaagcacaagttctaacagg

SEQ ID NO: 8500609 - DNA, 22 bp, Homo sapiens
tgaaagcactcacttctgctct

SEQ ID NO: 8500610 - DNA, 22 bp, Homo sapiens
tgaaagcactcacttctgctct

SEQ ID NO: 8500611 - DNA, 22 bp, Homo sapiens
tgaaagcaacctgtaacagtga

SEQ ID NO: 8500612 - DNA, 22 bp, Homo sapiens
tgaaagatgctcaatgaatggt

SEQ ID NO: 8500613 - DNA, 22 bp, Homo sapiens
tgaaagagtttgacatgattct

SEQ ID NO: 8500614 - DNA, 22 bp, Homo sapiens
tgaaagatgaaagcaggctggt

SEQ ID NO: 8500615 - DNA, 22 bp, Homo sapiens
tgaaagatgaaagcaggctggt

SEQ ID NO: 8500616 - DNA, 22 bp, Homo sapiens
tgaaagataagttattatgtac

SEQ ID NO: 8500617 - DNA, 22 bp, Homo sapiens
tgaaatgcttttacaggatatt

SEQ ID NO: 8500618 - DNA, 22 bp, Homo sapiens
tgaaatggcaaggcagagcttt

SEQ ID NO: 8500619 - DNA, 22 bp, Homo sapiens
tgaaatgctgtagagactgtat

SEQ ID NO: 8500620 - DNA, 22 bp, Homo sapiens
tgaaatgctgtagagactgtat

SEQ ID NO: 8500621 - DNA, 22 bp, Homo sapiens
tgaaatctcctctttatatatc

SEQ ID NO: 8500622 - DNA, 22 bp, Homo sapiens
tgaaatcattggggttgaataa

SEQ ID NO: 8500623 - DNA, 22 bp, Homo sapiens
tgaaatcatgaacaaggtaggt

SEQ ID NO: 8500624 - DNA, 22 bp, Homo sapiens
tgaaatcatgagatagtgtcac

SEQ ID NO: 8500625 - DNA, 22 bp, Homo sapiens
tgaaatcatgagatagtgtcac

SEQ ID NO: 8500626 - DNA, 22 bp, Homo sapiens
tgaaatcattgccaagtattga

SEQ ID NO: 8500627 - DNA, 22 bp, Homo sapiens
tgaaatcatgtagttattgcaa

SEQ ID NO: 8500628 - DNA, 22 bp, Homo sapiens
tgaaatgtttgggtccagaagt

SEQ ID NO: 8500629 - DNA, 22 bp, Homo sapiens
tgaaatgttggtaattttatat

SEQ ID NO: 8500630 - DNA, 22 bp, Homo sapiens
tgaaatgttggtaattttatat

SEQ ID NO: 8500631 - DNA, 22 bp, Homo sapiens
tgaaatgtgttctagtgttttg

SEQ ID NO: 8500632 - DNA, 22 bp, Homo sapiens
tgaaatgtgttctagtgttttg

SEQ ID NO: 8500633 - DNA, 22 bp, Homo sapiens
tgaaatgttctggagtttctgt

SEQ ID NO: 8500634 - DNA, 22 bp, Homo sapiens
tgaaatgtgtccatgttatttc

SEQ ID NO: 8500635 - DNA, 22 bp, Homo sapiens
tgaaatgtagattaggcattct

SEQ ID NO: 8500636 - DNA, 22 bp, Homo sapiens
tgaaatgtcagtgttttataag

SEQ ID NO: 8500637 - DNA, 20 bp, Homo sapiens
tgaagcagccttgattctgt

SEQ ID NO: 8500638 - DNA, 22 bp, Homo sapiens
tgaagcaagatagaaagctgct

SEQ ID NO: 8500639 - DNA, 22 bp, Homo sapiens
tgaagcaagatagaaagctgct

SEQ ID NO: 8500640 - DNA, 22 bp, Homo sapiens
tgaagattttcgggtacttgat

SEQ ID NO: 8500641 - DNA, 22 bp, Homo sapiens
tgaagattttgtagctttcagc

SEQ ID NO: 8500642 - DNA, 20 bp, Homo sapiens
tgaagattttgtgtttagaa

SEQ ID NO: 8500643 - DNA, 22 bp, Homo sapiens
tgaagcaatagagacaagacca

SEQ ID NO: 8500644 - DNA, 22 bp, Homo sapiens
tgaagcaatagagacaagacca

SEQ ID NO: 8500645 - DNA, 22 bp, Homo sapiens
tgaagcaatgatagcagaatga

SEQ ID NO: 8500646 - DNA, 22 bp, Homo sapiens
tgaagcacagacctgggcatca

SEQ ID NO: 8500647 - DNA, 22 bp, Homo sapiens
tgaagcagaggggtcttgagct

SEQ ID NO: 8500648 - DNA, 22 bp, Homo sapiens
tgaagcacatttcttgagatga

SEQ ID NO: 8500649 - DNA, 22 bp, Homo sapiens
tgaagacaaagtcaggcccaga

SEQ ID NO: 8500650 - DNA, 22 bp, Homo sapiens
tgaagacaagaaaacactgggg

SEQ ID NO: 8500651 - DNA, 22 bp, Homo sapiens
tgaagacaaagtcaggcccaga

SEQ ID NO: 8500652 - DNA, 22 bp, Homo sapiens
tgaagacaaagtcaggcccaga

SEQ ID NO: 8500653 - DNA, 22 bp, Homo sapiens
tgaagaatcccagggaatttgg

SEQ ID NO: 8500654 - DNA, 22 bp, Homo sapiens
tgaagacagaccaaggagaatg

SEQ ID NO: 8500655 - DNA, 22 bp, Homo sapiens
tgaagacagaccaaggagaatg

SEQ ID NO: 8500656 - DNA, 22 bp, Homo sapiens
tgaagacagaccaaggagaatg

SEQ ID NO: 8500657 - DNA, 22 bp, Homo sapiens
tgaagacacatacaagggaatg

SEQ ID NO: 8500658 - DNA, 22 bp, Homo sapiens
tgaagacacatacaagggaatg

SEQ ID NO: 8500659 - DNA, 22 bp, Homo sapiens
tgaagacacatacaagggaatg

SEQ ID NO: 8500660 - DNA, 22 bp, Homo sapiens
tgaagacaagtgtgctggtgtt

SEQ ID NO: 8500661 - DNA, 22 bp, Homo sapiens
tgaagacaagtgtgctggtgtt

SEQ ID NO: 8500662 - DNA, 22 bp, Homo sapiens
tgaagacacatacaagggaatg

SEQ ID NO: 8500663 - DNA, 18 bp, Homo sapiens
tgaagacatgaggttagt

SEQ ID NO: 8500664 - DNA, 18 bp, Homo sapiens
tgaagacatgaggttagt

SEQ ID NO: 8500665 - DNA, 22 bp, Homo sapiens
tgaagacagttttactcatgag

SEQ ID NO: 8500666 - DNA, 15 bp, Homo sapiens
tgaagacataaggtg

SEQ ID NO: 8500667 - DNA, 22 bp, Homo sapiens
tgaagacagttttactcatgag

SEQ ID NO: 8500668 - DNA, 22 bp, Homo sapiens
tgaagacagggtctttaacgag

SEQ ID NO: 8500669 - DNA, 22 bp, Homo sapiens
tgaagacagaccaaggagaatg

SEQ ID NO: 8500670 - DNA, 22 bp, Homo sapiens
tgaagactcagaagctaagata

SEQ ID NO: 8500671 - DNA, 22 bp, Homo sapiens
tgaagactttgctcttaaccac

SEQ ID NO: 8500672 - DNA, 22 bp, Homo sapiens
tgaagactcagaagctaagata

SEQ ID NO: 8500673 - DNA, 22 bp, Homo sapiens
tgaagactcagaagctaagata

SEQ ID NO: 8500674 - DNA, 22 bp, Homo sapiens
tgaagaaaggtgtgggatactc

SEQ ID NO: 8500675 - DNA, 22 bp, Homo sapiens
tgaagaaacgcagagaggtagg

SEQ ID NO: 8500676 - DNA, 22 bp, Homo sapiens
tgaagaacgtgagatccagaaa

SEQ ID NO: 8500677 - DNA, 22 bp, Homo sapiens
tgaagaataaatggttgagact

SEQ ID NO: 8500678 - DNA, 22 bp, Homo sapiens
tgaagaaacagaccaagaggat

SEQ ID NO: 8500679 - DNA, 22 bp, Homo sapiens
tgaacagtcatttagaatgtgc

SEQ ID NO: 8500680 - DNA, 22 bp, Homo sapiens
tgaacacacacctatgtacaaa

SEQ ID NO: 8500681 - DNA, 22 bp, Homo sapiens
tgaacagtttcaagaaaacttt

SEQ ID NO: 8500682 - DNA, 22 bp, Homo sapiens
tgaacaactgcaaaaatctcca

SEQ ID NO: 8500683 - DNA, 22 bp, Homo sapiens
tgaacacacacatcttaataat

SEQ ID NO: 8500684 - DNA, 21 bp, Homo sapiens
tgaacaaagttcttatcgtga

SEQ ID NO: 8500685 - DNA, 21 bp, Homo sapiens
tgaacaaagttcttatcgtga

SEQ ID NO: 8500686 - DNA, 22 bp, Homo sapiens
tgaacaaatggaaataaccagt

SEQ ID NO: 8500687 - DNA, 22 bp, Homo sapiens
tgaacaaatggaaataaccagt

SEQ ID NO: 8500688 - DNA, 22 bp, Homo sapiens
tgaacaaatgaatcagtgtagc

SEQ ID NO: 8500689 - DNA, 22 bp, Homo sapiens
tgaaattatgcattgttgtacc

SEQ ID NO: 8500690 - DNA, 22 bp, Homo sapiens
tgaaattatgcattgttgtacc

SEQ ID NO: 8500691 - DNA, 22 bp, Homo sapiens
tgaaattcaaaacacatttgtc

SEQ ID NO: 8500692 - DNA, 22 bp, Homo sapiens
tgaaattagtgaagttacagtt

SEQ ID NO: 8500693 - DNA, 22 bp, Homo sapiens
tgaaattagtgaagttacagtt

SEQ ID NO: 8500694 - DNA, 22 bp, Homo sapiens
tgaacaaactgcattcttcact

SEQ ID NO: 8500695 - DNA, 22 bp, Homo sapiens
tgaacaaactgcattcttcact

SEQ ID NO: 8500696 - DNA, 22 bp, Homo sapiens
tgaacaaactgcattcttcact

SEQ ID NO: 8500697 - DNA, 22 bp, Homo sapiens
tgaaattcattgttttatgtgt

SEQ ID NO: 8500698 - DNA, 22 bp, Homo sapiens
tgaaattcaaaacacatttgtc

SEQ ID NO: 8500699 - DNA, 22 bp, Homo sapiens
tgaaccttgttcctgccctcct

SEQ ID NO: 8500700 - DNA, 22 bp, Homo sapiens
tgaaccctgacctctggaagga

SEQ ID NO: 8500701 - DNA, 22 bp, Homo sapiens
tgaaccaggaggcagccagcac

SEQ ID NO: 8500702 - DNA, 22 bp, Homo sapiens
tgaaccagagtctccagtggtt

SEQ ID NO: 8500703 - DNA, 22 bp, Homo sapiens
tgaaccaggaggcagccagcac

SEQ ID NO: 8500704 - DNA, 22 bp, Homo sapiens
tgaacattgtcacattcctagc

SEQ ID NO: 8500705 - DNA, 22 bp, Homo sapiens
tgaacattgtcacattcctagc

SEQ ID NO: 8500706 - DNA, 22 bp, Homo sapiens
tgaacatgctgttgatggcctg

SEQ ID NO: 8500707 - DNA, 22 bp, Homo sapiens
tgaacatattcacctctaaata

SEQ ID NO: 8500708 - DNA, 22 bp, Homo sapiens
tgaacattggcacaaggcagca

SEQ ID NO: 8500709 - DNA, 22 bp, Homo sapiens
tgaacattcctgaatgaagcat

SEQ ID NO: 8500710 - DNA, 22 bp, Homo sapiens
tgaacattcctgaatgaagcat

SEQ ID NO: 8500711 - DNA, 22 bp, Homo sapiens
tgaacattagttgagtaaagtc

SEQ ID NO: 8500712 - DNA, 18 bp, Homo sapiens
tgaactttggtgtctctc

SEQ ID NO: 8500713 - DNA, 22 bp, Homo sapiens
tgaactgtacatccctaaccta

SEQ ID NO: 8500714 - DNA, 21 bp, Homo sapiens
tgaactctggtcatcttcatt

SEQ ID NO: 8500715 - DNA, 21 bp, Homo sapiens
tgaactctggtcatcttcatt

SEQ ID NO: 8500716 - DNA, 22 bp, Homo sapiens
tgaactgcaggaatctcagtgg

SEQ ID NO: 8500717 - DNA, 22 bp, Homo sapiens
tgaacgcaggtccacatggctc

SEQ ID NO: 8500718 - DNA, 22 bp, Homo sapiens
tgaactccaaatactgctgatt

SEQ ID NO: 8500719 - DNA, 22 bp, Homo sapiens
tgaactcctgacctcatgatcc

SEQ ID NO: 8500720 - DNA, 22 bp, Homo sapiens
tgaactcctgacctcatgatcc

SEQ ID NO: 8500721 - DNA, 22 bp, Homo sapiens
tgaactctaatggtgcttttct

SEQ ID NO: 8500722 - DNA, 22 bp, Homo sapiens
tgaactctcccccattgccctc

SEQ ID NO: 8500723 - DNA, 22 bp, Homo sapiens
tgaactctctcaagtgacagaa

SEQ ID NO: 8500724 - DNA, 22 bp, Homo sapiens
tgaactctccaggcaaatgatc

SEQ ID NO: 8500725 - DNA, 22 bp, Homo sapiens
tgagatgaataactcctgctaa

SEQ ID NO: 8500726 - DNA, 22 bp, Homo sapiens
tgagatgaataactcctgctaa

SEQ ID NO: 8500727 - DNA, 22 bp, Homo sapiens
tgagatgctaaagggctgctca

SEQ ID NO: 8500728 - DNA, 22 bp, Homo sapiens
tgagatgatgggataagagggc

SEQ ID NO: 8500729 - DNA, 22 bp, Homo sapiens
tgagatccccaggaaggacaac

SEQ ID NO: 8500730 - DNA, 22 bp, Homo sapiens
tgagatcattgacttgttcctg

SEQ ID NO: 8500731 - DNA, 22 bp, Homo sapiens
tgagatcatttatttacctttc

SEQ ID NO: 8500732 - DNA, 22 bp, Homo sapiens
tgagatcttcgctcttcacaga

SEQ ID NO: 8500733 - DNA, 22 bp, Homo sapiens
tgagaggtcaaagggcatggag

SEQ ID NO: 8500734 - DNA, 22 bp, Homo sapiens
tgagataataaatagctttctt

SEQ ID NO: 8500735 - DNA, 22 bp, Homo sapiens
tgagataattaaatcaaaacct

SEQ ID NO: 8500736 - DNA, 22 bp, Homo sapiens
tgagatagtatgtagcacctga

SEQ ID NO: 8500737 - DNA, 22 bp, Homo sapiens
tgagcaaaagttgatggtgctt

SEQ ID NO: 8500738 - DNA, 21 bp, Homo sapiens
tgagcaaaatttagagtgatg

SEQ ID NO: 8500739 - DNA, 22 bp, Homo sapiens
tgagattctgttcagaaaaatg

SEQ ID NO: 8500740 - DNA, 22 bp, Homo sapiens
tgagattgtgtgcttcagaaat

SEQ ID NO: 8500741 - DNA, 19 bp, Homo sapiens
tgagatttcttaggtgatt

SEQ ID NO: 8500742 - DNA, 22 bp, Homo sapiens
tgagatggttgaccagagagca

SEQ ID NO: 8500743 - DNA, 22 bp, Homo sapiens
tgagatggttcacagagaaggc

SEQ ID NO: 8500744 - DNA, 22 bp, Homo sapiens
tgagatggttcacagagaaggc

SEQ ID NO: 8500745 - DNA, 21 bp, Homo sapiens
tgagagactggtggatacagg

SEQ ID NO: 8500746 - DNA, 22 bp, Homo sapiens
tgagagagcctgaatctcttac

SEQ ID NO: 8500747 - DNA, 22 bp, Homo sapiens
tgagacttgtgagtccttctag

SEQ ID NO: 8500748 - DNA, 22 bp, Homo sapiens
tgagagaaacgttccttacatc

SEQ ID NO: 8500749 - DNA, 22 bp, Homo sapiens
tgagagaaacgttccttacatc

SEQ ID NO: 8500750 - DNA, 22 bp, Homo sapiens
tgagacagttctgcagctgggt

SEQ ID NO: 8500751 - DNA, 22 bp, Homo sapiens
tgagagagtaattgagtggtaa

SEQ ID NO: 8500752 - DNA, 22 bp, Homo sapiens
tgagagagtaattgagtggtaa

SEQ ID NO: 8500753 - DNA, 22 bp, Homo sapiens
tgagagaggggactgcctgctt

SEQ ID NO: 8500754 - DNA, 22 bp, Homo sapiens
tgagagagcgcctgggatcatt

SEQ ID NO: 8500755 - DNA, 22 bp, Homo sapiens
tgagagattttcatgagtgctt

SEQ ID NO: 8500756 - DNA, 22 bp, Homo sapiens
tgagagatgaagttagttgttc

SEQ ID NO: 8500757 - DNA, 22 bp, Homo sapiens
tgagagatgaagttagttgttc

SEQ ID NO: 8500758 - DNA, 22 bp, Homo sapiens
tgagagattgctgtatgttttg

SEQ ID NO: 8500759 - DNA, 21 bp, Homo sapiens
tgagagagtagcaggacatat

SEQ ID NO: 8500760 - DNA, 21 bp, Homo sapiens
tgagagagtagcaggacatat

SEQ ID NO: 8500761 - DNA, 23 bp, Homo sapiens
tgagagcctggcagcctgggttc

SEQ ID NO: 8500762 - DNA, 18 bp, Homo sapiens
tgagagcctgcttgtccc

SEQ ID NO: 8500763 - DNA, 22 bp, Homo sapiens
tgagagccagaagggcctgagg

SEQ ID NO: 8500764 - DNA, 22 bp, Homo sapiens
tgagagccaggatctgctctat

SEQ ID NO: 8500765 - DNA, 17 bp, Homo sapiens
tgagagcagggctgggc

SEQ ID NO: 8500766 - DNA, 22 bp, Homo sapiens
tgagagctgggaaatgttagct

SEQ ID NO: 8500767 - DNA, 22 bp, Homo sapiens
tgagagctgctgagactgtcct

SEQ ID NO: 8500768 - DNA, 22 bp, Homo sapiens
tgagagctgccacgtgaccatg

SEQ ID NO: 8500769 - DNA, 22 bp, Homo sapiens
tgagagctgaagatatgttaac

SEQ ID NO: 8500770 - DNA, 22 bp, Homo sapiens
tgagagcctgtgttcaaatgcc

SEQ ID NO: 8500771 - DNA, 22 bp, Homo sapiens
tgagaggaacaggcagtaggtt

SEQ ID NO: 8500772 - DNA, 22 bp, Homo sapiens
tgagaggaacaggcagtaggtt

SEQ ID NO: 8500773 - DNA, 22 bp, Homo sapiens
tgagaggaacaggcagtaggtt

SEQ ID NO: 8500774 - DNA, 22 bp, Homo sapiens
tgagagcttgagtatcactggc

SEQ ID NO: 8500775 - DNA, 22 bp, Homo sapiens
tgagagctgtccacctgtggga

SEQ ID NO: 8500776 - DNA, 22 bp, Homo sapiens
tgagaggagtgattgtaaaatt

SEQ ID NO: 8500777 - DNA, 20 bp, Homo sapiens
tgagaggacatttttcatgt

SEQ ID NO: 8500778 - DNA, 22 bp, Homo sapiens
tgagaggagtgattgtaaaatt

SEQ ID NO: 8500779 - DNA, 22 bp, Homo sapiens
tgagaggaacaggcagtaggtt

SEQ ID NO: 8500780 - DNA, 22 bp, Homo sapiens
tgagaggatattttgggaggat

SEQ ID NO: 8500781 - DNA, 22 bp, Homo sapiens
tgagaggagtgattgtaaaatt

SEQ ID NO: 8500782 - DNA, 22 bp, Homo sapiens
tgagaggatattttgggaggat

SEQ ID NO: 8500783 - DNA, 22 bp, Homo sapiens
tgagaggatattttgggaggat

SEQ ID NO: 8500784 - DNA, 22 bp, Homo sapiens
tgagaggcagaatggtgcctgc

SEQ ID NO: 8500785 - DNA, 22 bp, Homo sapiens
tgagagggttcccaggggtttc

SEQ ID NO: 8500786 - DNA, 22 bp, Homo sapiens
tgagagggcccagagcacacca

SEQ ID NO: 8500787 - DNA, 22 bp, Homo sapiens
tgagagggttcccaggggtttc

SEQ ID NO: 8500788 - DNA, 22 bp, Homo sapiens
tgagaggtaggaaatgaacaag

SEQ ID NO: 8500789 - DNA, 22 bp, Homo sapiens
tgagaggtaggaaatgaacaag

SEQ ID NO: 8500790 - DNA, 19 bp, Homo sapiens
tgagaggcttaaggcagct

SEQ ID NO: 8500791 - DNA, 18 bp, Homo sapiens
tgagaggctattttttgc

SEQ ID NO: 8500792 - DNA, 19 bp, Homo sapiens
tgagaggcttaaggcagct

SEQ ID NO: 8500793 - DNA, 19 bp, Homo sapiens
tgagaggcttaaggcagct

SEQ ID NO: 8500794 - DNA, 19 bp, Homo sapiens
tgagaggcttaaggcagct

SEQ ID NO: 8500795 - DNA, 18 bp, Homo sapiens
tgagaggcaggtagagga

SEQ ID NO: 8500796 - DNA, 18 bp, Homo sapiens
tgagaggctattttttgc

SEQ ID NO: 8500797 - DNA, 18 bp, Homo sapiens
tgagaggctattttttgc

SEQ ID NO: 8500798 - DNA, 22 bp, Homo sapiens
tgagaaattacttcagtgatgg

SEQ ID NO: 8500799 - DNA, 19 bp, Homo sapiens
tgagaaattccacaggatg

SEQ ID NO: 8500800 - DNA, 22 bp, Homo sapiens
tgagaaatggcagcattactgg

SEQ ID NO: 8500801 - DNA, 22 bp, Homo sapiens
tgagaaatgggtctgctgaaga

SEQ ID NO: 8500802 - DNA, 20 bp, Homo sapiens
tgagaaagtagagactcagg

SEQ ID NO: 8500803 - DNA, 20 bp, Homo sapiens
tgagaaagtagagactcagg

SEQ ID NO: 8500804 - DNA, 22 bp, Homo sapiens
tgagaaagtgggtgcctagcaa

SEQ ID NO: 8500805 - DNA, 22 bp, Homo sapiens
tgagaaagcctttagtcccagg

SEQ ID NO: 8500806 - DNA, 22 bp, Homo sapiens
tgagaaagcctttagtcccagg

SEQ ID NO: 8500807 - DNA, 22 bp, Homo sapiens
tgagaaacatatgagagatttg

SEQ ID NO: 8500808 - DNA, 18 bp, Homo sapiens
tgagaaactgacacatgg

SEQ ID NO: 8500809 - DNA, 22 bp, Homo sapiens
tgagaaacatatgagagatttg

SEQ ID NO: 8500810 - DNA, 22 bp, Homo sapiens
tgagaaaagtgtggaggtcaat

SEQ ID NO: 8500811 - DNA, 22 bp, Homo sapiens
tgagaaaattactataattgtc

SEQ ID NO: 8500812 - DNA, 22 bp, Homo sapiens
tgagaaaattactataattgtc

SEQ ID NO: 8500813 - DNA, 22 bp, Homo sapiens
tgagaaaattactataattgtc

SEQ ID NO: 8500814 - DNA, 22 bp, Homo sapiens
tgagaaaattactataattgtc

SEQ ID NO: 8500815 - DNA, 22 bp, Homo sapiens
tgagaagcccacactctttcct

SEQ ID NO: 8500816 - DNA, 23 bp, Homo sapiens
tgagaagccattagagcaggtgg

SEQ ID NO: 8500817 - DNA, 22 bp, Homo sapiens
tgagaagcagtttcagtaagaa

SEQ ID NO: 8500818 - DNA, 23 bp, Homo sapiens
tgagaagccaggggagcgtgagg

SEQ ID NO: 8500819 - DNA, 22 bp, Homo sapiens
tgagaagattgggcagagtgga

SEQ ID NO: 8500820 - DNA, 22 bp, Homo sapiens
tgagaagattgggcagagtgga

SEQ ID NO: 8500821 - DNA, 22 bp, Homo sapiens
tgagaagattgggcagagtgga

SEQ ID NO: 8500822 - DNA, 22 bp, Homo sapiens
tgagaagcagcttacaggtgtc

SEQ ID NO: 8500823 - DNA, 22 bp, Homo sapiens
tgagaacctcgaagattttgcc

SEQ ID NO: 8500824 - DNA, 22 bp, Homo sapiens
tgagaacggatactaagggctg

SEQ ID NO: 8500825 - DNA, 22 bp, Homo sapiens
tgagaacggatactaagggctg

SEQ ID NO: 8500826 - DNA, 22 bp, Homo sapiens
tgagaaccatgaaaagctgtca

SEQ ID NO: 8500827 - DNA, 22 bp, Homo sapiens
tgagaactgaggatttgaattc

SEQ ID NO: 8500828 - DNA, 22 bp, Homo sapiens
tgagaacttgtgctattgcaca

SEQ ID NO: 8500829 - DNA, 22 bp, Homo sapiens
tgagaacagttggaagcagtca

SEQ ID NO: 8500830 - DNA, 22 bp, Homo sapiens
tgagaacatacaaacagagaaa

SEQ ID NO: 8500831 - DNA, 22 bp, Homo sapiens
tgagaacagttggaagcagtca

SEQ ID NO: 8500832 - DNA, 23 bp, Homo sapiens
tgagaaattttgattcagtagga

SEQ ID NO: 8500833 - DNA, 22 bp, Homo sapiens
tgagaacattgggaaagctatg

SEQ ID NO: 8500834 - DNA, 22 bp, Homo sapiens
tgagaacattgggaaagctatg

SEQ ID NO: 8500835 - DNA, 22 bp, Homo sapiens
tgagaacatttgcagggagagt

SEQ ID NO: 8500836 - DNA, 22 bp, Homo sapiens
tgagaacatacaaacagagaaa

SEQ ID NO: 8500837 - DNA, 22 bp, Homo sapiens
tgagaacattgggaaagctatg

SEQ ID NO: 8500838 - DNA, 22 bp, Homo sapiens
tgagacagggtcttgctctgtt

SEQ ID NO: 8500839 - DNA, 22 bp, Homo sapiens
tgagacagggtcttgctctgtt

SEQ ID NO: 8500840 - DNA, 22 bp, Homo sapiens
tgagacagggtcttgctctgtt

SEQ ID NO: 8500841 - DNA, 17 bp, Homo sapiens
tgagacagggcaggccc

SEQ ID NO: 8500842 - DNA, 17 bp, Homo sapiens
tgagacagggcaggccc

SEQ ID NO: 8500843 - DNA, 22 bp, Homo sapiens
tgagacagggtcttgctctgtt

SEQ ID NO: 8500844 - DNA, 17 bp, Homo sapiens
tgagacagggcaggccc

SEQ ID NO: 8500845 - DNA, 22 bp, Homo sapiens
tgagacagttctgcagctgggt

SEQ ID NO: 8500846 - DNA, 22 bp, Homo sapiens
tgagacagtcccatgatctgca

SEQ ID NO: 8500847 - DNA, 22 bp, Homo sapiens
tgagacagtcaccaggcaggcc

SEQ ID NO: 8500848 - DNA, 22 bp, Homo sapiens
tgagacagtaattgtatagttt

SEQ ID NO: 8500849 - DNA, 22 bp, Homo sapiens
tgagacagtatcgccccaaggc

SEQ ID NO: 8500850 - DNA, 22 bp, Homo sapiens
tgagacagtcaccaggcaggcc

SEQ ID NO: 8500851 - DNA, 22 bp, Homo sapiens
tgagacagtcaccaggcaggcc

SEQ ID NO: 8500852 - DNA, 22 bp, Homo sapiens
tgagacagtcaccaggcaggcc

SEQ ID NO: 8500853 - DNA, 22 bp, Homo sapiens
tgagacaggcttccttcttggg

SEQ ID NO: 8500854 - DNA, 19 bp, Homo sapiens
tgagacagggattcaggtg

SEQ ID NO: 8500855 - DNA, 19 bp, Homo sapiens
tgagacagggattcaggtg

SEQ ID NO: 8500856 - DNA, 19 bp, Homo sapiens
tgagacagggattcaggtg

SEQ ID NO: 8500857 - DNA, 19 bp, Homo sapiens
tgagacagggattcaggtg

SEQ ID NO: 8500858 - DNA, 17 bp, Homo sapiens
tgagacagggcaggccc

SEQ ID NO: 8500859 - DNA, 18 bp, Homo sapiens
tgagacagctaccacttg

SEQ ID NO: 8500860 - DNA, 22 bp, Homo sapiens
tgagacaggagaggcccctcct

SEQ ID NO: 8500861 - DNA, 22 bp, Homo sapiens
tgagacagcccttctgcacagg

SEQ ID NO: 8500862 - DNA, 22 bp, Homo sapiens
tgagacagcctctgcactcatg

SEQ ID NO: 8500863 - DNA, 22 bp, Homo sapiens
tgagacagcctctgcactcatg

SEQ ID NO: 8500864 - DNA, 22 bp, Homo sapiens
tgagacagcctctgcactcatg

SEQ ID NO: 8500865 - DNA, 22 bp, Homo sapiens
tgagacagcctctgcactcatg

SEQ ID NO: 8500866 - DNA, 22 bp, Homo sapiens
tgagacagcccttctgcacagg

SEQ ID NO: 8500867 - DNA, 22 bp, Homo sapiens
tgagacagcccttctgcacagg

SEQ ID NO: 8500868 - DNA, 22 bp, Homo sapiens
tgagacagcagtcagggaaata

SEQ ID NO: 8500869 - DNA, 22 bp, Homo sapiens
tgagaatttttggcagaaacaa

SEQ ID NO: 8500870 - DNA, 22 bp, Homo sapiens
tgagaattctacaatagatcaa

SEQ ID NO: 8500871 - DNA, 22 bp, Homo sapiens
tgagaatttgcatttctaacaa

SEQ ID NO: 8500872 - DNA, 22 bp, Homo sapiens
tgagaatttgcatttctaacaa

SEQ ID NO: 8500873 - DNA, 22 bp, Homo sapiens
tgagaatttgtgaacttttctc

SEQ ID NO: 8500874 - DNA, 22 bp, Homo sapiens
tgagaattttcagtttcacttt

SEQ ID NO: 8500875 - DNA, 22 bp, Homo sapiens
tgagaattttcagtttcacttt

SEQ ID NO: 8500876 - DNA, 22 bp, Homo sapiens
tgagaatttgtgaacttttctc

SEQ ID NO: 8500877 - DNA, 20 bp, Homo sapiens
tgagaagctcctgtctcctc

SEQ ID NO: 8500878 - DNA, 23 bp, Homo sapiens
tgagaagccgccgggcagcctgg

SEQ ID NO: 8500879 - DNA, 18 bp, Homo sapiens
tgagaatgtaagaaatgg

SEQ ID NO: 8500880 - DNA, 22 bp, Homo sapiens
tgagaattacaaatgagtcaca

SEQ ID NO: 8500881 - DNA, 22 bp, Homo sapiens
tgagaatgccataagagctatt

SEQ ID NO: 8500882 - DNA, 20 bp, Homo sapiens
tgagacaaggctggagagac

SEQ ID NO: 8500883 - DNA, 22 bp, Homo sapiens
tgagacaataaggctgagaagc

SEQ ID NO: 8500884 - DNA, 22 bp, Homo sapiens
tgagacaacctaattaaacacc

SEQ ID NO: 8500885 - DNA, 19 bp, Homo sapiens
tgagacagagaccagttct

SEQ ID NO: 8500886 - DNA, 22 bp, Homo sapiens
tgagacagcagattagcaatga

SEQ ID NO: 8500887 - DNA, 22 bp, Homo sapiens
tgagacagcagattagcaatga

SEQ ID NO: 8500888 - DNA, 22 bp, Homo sapiens
tgagacagcagattagcaatga

SEQ ID NO: 8500889 - DNA, 22 bp, Homo sapiens
tgagacagcagtcagggaaata

SEQ ID NO: 8500890 - DNA, 22 bp, Homo sapiens
tgagacagcagtcagggaaata

SEQ ID NO: 8500891 - DNA, 19 bp, Homo sapiens
tgagacagaagatgagcct

SEQ ID NO: 8500892 - DNA, 19 bp, Homo sapiens
tgagacagaagatgagcct

SEQ ID NO: 8500893 - DNA, 22 bp, Homo sapiens
tgagacactctcgggcacattt

SEQ ID NO: 8500894 - DNA, 19 bp, Homo sapiens
tgagacagaagatgagcct

SEQ ID NO: 8500895 - DNA, 19 bp, Homo sapiens
tgagacagaagatgagcct

SEQ ID NO: 8500896 - DNA, 19 bp, Homo sapiens
tgagacagaagatgagcct

SEQ ID NO: 8500897 - DNA, 22 bp, Homo sapiens
tgagctggtcactccttctgaa

SEQ ID NO: 8500898 - DNA, 22 bp, Homo sapiens
tgagctggtcttgagtgtagct

SEQ ID NO: 8500899 - DNA, 22 bp, Homo sapiens
tgagctggtcttgagtgtagct

SEQ ID NO: 8500900 - DNA, 22 bp, Homo sapiens
tgagctgtaaggctgtcactga

SEQ ID NO: 8500901 - DNA, 22 bp, Homo sapiens
tgagctgtaaggctgtcactga

SEQ ID NO: 8500902 - DNA, 22 bp, Homo sapiens
tgagctggttcttgaggcatga

SEQ ID NO: 8500903 - DNA, 22 bp, Homo sapiens
tgagctggttcttgaggcatga

SEQ ID NO: 8500904 - DNA, 22 bp, Homo sapiens
tgagctggaggacaggagggta

SEQ ID NO: 8500905 - DNA, 19 bp, Homo sapiens
tgagctgctgctgcccatc

SEQ ID NO: 8500906 - DNA, 22 bp, Homo sapiens
tgagctggaggacaggagggta

SEQ ID NO: 8500907 - DNA, 22 bp, Homo sapiens
tgagctggagtctgtggctcct

SEQ ID NO: 8500908 - DNA, 22 bp, Homo sapiens
tgagctggtcactccttctgaa

SEQ ID NO: 8500909 - DNA, 22 bp, Homo sapiens
tgagctggagtctgtggctcct

SEQ ID NO: 8500910 - DNA, 22 bp, Homo sapiens
tgagctggagtcgtgagcaaag

SEQ ID NO: 8500911 - DNA, 19 bp, Homo sapiens
tgagctgctgctgcccatc

SEQ ID NO: 8500912 - DNA, 22 bp, Homo sapiens
tgagctgcattacagcctctgt

SEQ ID NO: 8500913 - DNA, 22 bp, Homo sapiens
tgagctgcagtgagctgagatg

SEQ ID NO: 8500914 - DNA, 23 bp, Homo sapiens
tgagctctatggaggactgaacc

SEQ ID NO: 8500915 - DNA, 22 bp, Homo sapiens
tgagctctaagatcccctcaag

SEQ ID NO: 8500916 - DNA, 22 bp, Homo sapiens
tgagctcctggtcacaattatc

SEQ ID NO: 8500917 - DNA, 22 bp, Homo sapiens
tgagctccggcatatggaatta

SEQ ID NO: 8500918 - DNA, 22 bp, Homo sapiens
tgagctcttctaactaattgtg

SEQ ID NO: 8500919 - DNA, 22 bp, Homo sapiens
tgagctgtatattgttttaata

SEQ ID NO: 8500920 - DNA, 22 bp, Homo sapiens
tgagctgtagcagatgctgttg

SEQ ID NO: 8500921 - DNA, 22 bp, Homo sapiens
tgagctgtctatggtcctgtct

SEQ ID NO: 8500922 - DNA, 22 bp, Homo sapiens
tgagctgtcaaggtacagtgaa

SEQ ID NO: 8500923 - DNA, 22 bp, Homo sapiens
tgagctgtcaaggtacagtgaa

SEQ ID NO: 8500924 - DNA, 22 bp, Homo sapiens
tgagctgtagcagatgctgttg

SEQ ID NO: 8500925 - DNA, 22 bp, Homo sapiens
tgagctgtagcagatgctgttg

SEQ ID NO: 8500926 - DNA, 22 bp, Homo sapiens
tgagctgtagcagatgctgttg

SEQ ID NO: 8500927 - DNA, 22 bp, Homo sapiens
tgagctgtactcctccccaggg

SEQ ID NO: 8500928 - DNA, 22 bp, Homo sapiens
tgagctgtagcagatgctgttg

SEQ ID NO: 8500929 - DNA, 22 bp, Homo sapiens
tgagctgtgattaactctgaga

SEQ ID NO: 8500930 - DNA, 22 bp, Homo sapiens
tgagctgtgattaactctgaga

SEQ ID NO: 8500931 - DNA, 22 bp, Homo sapiens
tgagctgtgattaactctgaga

SEQ ID NO: 8500932 - DNA, 22 bp, Homo sapiens
tgagctgtgctacgccctggga

SEQ ID NO: 8500933 - DNA, 22 bp, Homo sapiens
tgagctgtggtggggtagagga

SEQ ID NO: 8500934 - DNA, 22 bp, Homo sapiens
tgagctgtgagggtacagatat

SEQ ID NO: 8500935 - DNA, 22 bp, Homo sapiens
tgagctgtgagggtacagatat

SEQ ID NO: 8500936 - DNA, 22 bp, Homo sapiens
tgagctgtgatctatgataaat

SEQ ID NO: 8500937 - DNA, 22 bp, Homo sapiens
tgagctgtctgaatggtgagga

SEQ ID NO: 8500938 - DNA, 22 bp, Homo sapiens
tgagctgtctatggtcctgtct

SEQ ID NO: 8500939 - DNA, 22 bp, Homo sapiens
tgagctgtctgaatggtgagga

SEQ ID NO: 8500940 - DNA, 17 bp, Homo sapiens
tgagcttcaatcaggtg

SEQ ID NO: 8500941 - DNA, 17 bp, Homo sapiens
tgagcttcaatcaggtg

SEQ ID NO: 8500942 - DNA, 22 bp, Homo sapiens
tgagcttcaaagttggatctga

SEQ ID NO: 8500943 - DNA, 22 bp, Homo sapiens
tgagcttcaaaatatgtgaatc

SEQ ID NO: 8500944 - DNA, 22 bp, Homo sapiens
tgagctgtgtcctgggggcagt

SEQ ID NO: 8500945 - DNA, 22 bp, Homo sapiens
tgagctgtgtcctgggggcagt

SEQ ID NO: 8500946 - DNA, 22 bp, Homo sapiens
tgagctgtgtcttggtgagagt

SEQ ID NO: 8500947 - DNA, 22 bp, Homo sapiens
tgagctgtgtgacattgagcca

SEQ ID NO: 8500948 - DNA, 22 bp, Homo sapiens
tgagcttacttctgtacacaga

SEQ ID NO: 8500949 - DNA, 22 bp, Homo sapiens
tgagcttacgtgggaacagact

SEQ ID NO: 8500950 - DNA, 22 bp, Homo sapiens
tgagctgtttctctggtggctt

SEQ ID NO: 8500951 - DNA, 22 bp, Homo sapiens
tgagcttacgtgggaacagact

SEQ ID NO: 8500952 - DNA, 22 bp, Homo sapiens
tgagcttccctcctgcactaca

SEQ ID NO: 8500953 - DNA, 20 bp, Homo sapiens
tgagcttcagatatcgtgca

SEQ ID NO: 8500954 - DNA, 22 bp, Homo sapiens
tgagcttccctcctgcactaca

SEQ ID NO: 8500955 - DNA, 22 bp, Homo sapiens
tgagcttcctccctgcatccat

SEQ ID NO: 8500956 - DNA, 22 bp, Homo sapiens
tgagcttcctccctgcatccat

SEQ ID NO: 8500957 - DNA, 22 bp, Homo sapiens
tgagcttgctacatagatcaga

SEQ ID NO: 8500958 - DNA, 22 bp, Homo sapiens
tgagcttctttatttggccaga

SEQ ID NO: 8500959 - DNA, 22 bp, Homo sapiens
tgagcttgcagtgccagccttg

SEQ ID NO: 8500960 - DNA, 22 bp, Homo sapiens
tgaggaaacttacaaggcagaa

SEQ ID NO: 8500961 - DNA, 22 bp, Homo sapiens
tgagcctggcggaagcagcgtg

SEQ ID NO: 8500962 - DNA, 22 bp, Homo sapiens
tgagcctggcctgcagagacca

SEQ ID NO: 8500963 - DNA, 22 bp, Homo sapiens
tgagcctgctgtcgctggaccc

SEQ ID NO: 8500964 - DNA, 22 bp, Homo sapiens
tgagcctggagtcgtggagggg

SEQ ID NO: 8500965 - DNA, 22 bp, Homo sapiens
tgagcctgagttcaaggctgca

SEQ ID NO: 8500966 - DNA, 22 bp, Homo sapiens
tgagcctgcaataagcacagcc

SEQ ID NO: 8500967 - DNA, 22 bp, Homo sapiens
tgagcctgcaataagcacagcc

SEQ ID NO: 8500968 - DNA, 22 bp, Homo sapiens
tgagcctgcaataagcacagcc

SEQ ID NO: 8500969 - DNA, 22 bp, Homo sapiens
tgagcctgggagatggaggctg

SEQ ID NO: 8500970 - DNA, 22 bp, Homo sapiens
tgagcctggggcctgggcagcg

SEQ ID NO: 8500971 - DNA, 22 bp, Homo sapiens
tgagcctgggtggtcgaggctg

SEQ ID NO: 8500972 - DNA, 22 bp, Homo sapiens
tgagcctggttgcagtgtctgg

SEQ ID NO: 8500973 - DNA, 22 bp, Homo sapiens
tgagcgtgcagtagtgttggta

SEQ ID NO: 8500974 - DNA, 22 bp, Homo sapiens
tgagcctgtggggtgacaacca

SEQ ID NO: 8500975 - DNA, 22 bp, Homo sapiens
tgagcctgtcctgtgcatgtga

SEQ ID NO: 8500976 - DNA, 22 bp, Homo sapiens
tgagctagggctggtgaggagc

SEQ ID NO: 8500977 - DNA, 22 bp, Homo sapiens
tgagctaagtactctcatcaag

SEQ ID NO: 8500978 - DNA, 22 bp, Homo sapiens
tgagctaggtcctgtgtcagct

SEQ ID NO: 8500979 - DNA, 22 bp, Homo sapiens
tgagctagggctggtgaggagc

SEQ ID NO: 8500980 - DNA, 22 bp, Homo sapiens
tgagctcatagctcttattatg

SEQ ID NO: 8500981 - DNA, 22 bp, Homo sapiens
tgagctaggtgtgcagatatga

SEQ ID NO: 8500982 - DNA, 22 bp, Homo sapiens
tgagccagtctctcagaaccct

SEQ ID NO: 8500983 - DNA, 22 bp, Homo sapiens
tgagccagtctctcagaaccct

SEQ ID NO: 8500984 - DNA, 22 bp, Homo sapiens
tgagccagtctgtctgggtgaa

SEQ ID NO: 8500985 - DNA, 22 bp, Homo sapiens
tgagccagtctgtctgggtgaa

SEQ ID NO: 8500986 - DNA, 22 bp, Homo sapiens
tgagccagtctgtctgggtgaa

SEQ ID NO: 8500987 - DNA, 22 bp, Homo sapiens
tgagccagtctgtctgggtgaa

SEQ ID NO: 8500988 - DNA, 22 bp, Homo sapiens
tgagcccagtctgtctgacatg

SEQ ID NO: 8500989 - DNA, 22 bp, Homo sapiens
tgagccaggttaagacaggagc

SEQ ID NO: 8500990 - DNA, 22 bp, Homo sapiens
tgagccaggttttccatcattc

SEQ ID NO: 8500991 - DNA, 20 bp, Homo sapiens
tgagccagtcaagctacatt

SEQ ID NO: 8500992 - DNA, 22 bp, Homo sapiens
tgagccctaagggtcaagcagg

SEQ ID NO: 8500993 - DNA, 22 bp, Homo sapiens
tgagccctaatttacaacatct

SEQ ID NO: 8500994 - DNA, 22 bp, Homo sapiens
tgagccctaagggtcaagcagg

SEQ ID NO: 8500995 - DNA, 22 bp, Homo sapiens
tgagccctacctgctcatctcc

SEQ ID NO: 8500996 - DNA, 22 bp, Homo sapiens
tgagccctccaaacccaggatt

SEQ ID NO: 8500997 - DNA, 22 bp, Homo sapiens
tgagccctggagccctctgtta

SEQ ID NO: 8500998 - DNA, 22 bp, Homo sapiens
tgagccctcttcccattttatt

SEQ ID NO: 8500999 - DNA, 22 bp, Homo sapiens
tgagccctgaggatctgttcgg

SEQ ID NO: 8501000 - DNA, 22 bp, Homo sapiens
tgagccctggctctttcactta

SEQ ID NO: 8501001 - DNA, 22 bp, Homo sapiens
tgagccctgtgactgctttgag

SEQ ID NO: 8501002 - DNA, 22 bp, Homo sapiens
tgagccctgacctagcctggcc

SEQ ID NO: 8501003 - DNA, 22 bp, Homo sapiens
tgagccctcggctggggcagag

SEQ ID NO: 8501004 - DNA, 22 bp, Homo sapiens
tgagccctccaaacccaggatt

SEQ ID NO: 8501005 - DNA, 22 bp, Homo sapiens
tgagccctcggctggggcagag

SEQ ID NO: 8501006 - DNA, 21 bp, Homo sapiens
tgagcccttgcctcagagccc

SEQ ID NO: 8501007 - DNA, 21 bp, Homo sapiens
tgagcccttgcctcagagccc

SEQ ID NO: 8501008 - DNA, 22 bp, Homo sapiens
tgagcccttgacatcgcccact

SEQ ID NO: 8501009 - DNA, 18 bp, Homo sapiens
tgagcccttatctttggc

SEQ ID NO: 8501010 - DNA, 22 bp, Homo sapiens
tgagccgtggtctctgagggtg

SEQ ID NO: 8501011 - DNA, 22 bp, Homo sapiens
tgagcccttgacatcgcccact

SEQ ID NO: 8501012 - DNA, 22 bp, Homo sapiens
tgagcagatttgttctaggggt

SEQ ID NO: 8501013 - DNA, 22 bp, Homo sapiens
tgagcagatgtgccaaactgta

SEQ ID NO: 8501014 - DNA, 22 bp, Homo sapiens
tgagcagatgtgccaaactgta

SEQ ID NO: 8501015 - DNA, 23 bp, Homo sapiens
tgagcagctaaaggtgatgcggg

SEQ ID NO: 8501016 - DNA, 22 bp, Homo sapiens
tgagcagctactgtgttcaggg

SEQ ID NO: 8501017 - DNA, 22 bp, Homo sapiens
tgagcaggactgaccggcctta

SEQ ID NO: 8501018 - DNA, 22 bp, Homo sapiens
tgagcaggactcactgcagcct

SEQ ID NO: 8501019 - DNA, 22 bp, Homo sapiens
tgagcagcttgttccgagtgtt

SEQ ID NO: 8501020 - DNA, 22 bp, Homo sapiens
tgagcaggcaaacaatggttat

SEQ ID NO: 8501021 - DNA, 22 bp, Homo sapiens
tgagcaggagataaacaggtag

SEQ ID NO: 8501022 - DNA, 21 bp, Homo sapiens
tgagcaggagtcatgggaatg

SEQ ID NO: 8501023 - DNA, 22 bp, Homo sapiens
tgagcagggactttgagtgtag

SEQ ID NO: 8501024 - DNA, 22 bp, Homo sapiens
tgagcaggcgcagcaggaggtc

SEQ ID NO: 8501025 - DNA, 22 bp, Homo sapiens
tgagcaggcgcagcaggaggtc

SEQ ID NO: 8501026 - DNA, 22 bp, Homo sapiens
tgagcaggcgcagcaggaggtc

SEQ ID NO: 8501027 - DNA, 22 bp, Homo sapiens
tgagcagagatgactgggcatt

SEQ ID NO: 8501028 - DNA, 22 bp, Homo sapiens
tgagcagagcaataggactctc

SEQ ID NO: 8501029 - DNA, 22 bp, Homo sapiens
tgagcagagcaggctgcgccct

SEQ ID NO: 8501030 - DNA, 22 bp, Homo sapiens
tgagcagagacttcaagggcag

SEQ ID NO: 8501031 - DNA, 22 bp, Homo sapiens
tgagcacatttcacatgacagg

SEQ ID NO: 8501032 - DNA, 22 bp, Homo sapiens
tgagcacagctttcactagaaa

SEQ ID NO: 8501033 - DNA, 22 bp, Homo sapiens
tgagcacagctcgcaccagctt

SEQ ID NO: 8501034 - DNA, 23 bp, Homo sapiens
tgagcaagtgaccaactgtctgt

SEQ ID NO: 8501035 - DNA, 22 bp, Homo sapiens
tgagcaagagaaactgactgta

SEQ ID NO: 8501036 - DNA, 22 bp, Homo sapiens
tgagcaaggagcagtctttctt

SEQ ID NO: 8501037 - DNA, 22 bp, Homo sapiens
tgagcaagacccggcctctgcc

SEQ ID NO: 8501038 - DNA, 22 bp, Homo sapiens
tgagcagaggaggctgccaact

SEQ ID NO: 8501039 - DNA, 22 bp, Homo sapiens
tgagcagaggaggctgccaact

SEQ ID NO: 8501040 - DNA, 22 bp, Homo sapiens
tgagcagagcagtaacaggagc

SEQ ID NO: 8501041 - DNA, 22 bp, Homo sapiens
tgagcagagcagtaacaggagc

SEQ ID NO: 8501042 - DNA, 22 bp, Homo sapiens
tgagcagaggccagcacctggg

SEQ ID NO: 8501043 - DNA, 22 bp, Homo sapiens
tgagcagaggccagcacctggg

SEQ ID NO: 8501044 - DNA, 22 bp, Homo sapiens
tgagcagaggagtgacgtaggt

SEQ ID NO: 8501045 - DNA, 22 bp, Homo sapiens
tgagcagatgtctaacttttac

SEQ ID NO: 8501046 - DNA, 22 bp, Homo sapiens
tgagcagatggaggcttctgca

SEQ ID NO: 8501047 - DNA, 22 bp, Homo sapiens
tgagcagatggaggcttctgca

SEQ ID NO: 8501048 - DNA, 22 bp, Homo sapiens
tgagcagagtcgctccagagtg

SEQ ID NO: 8501049 - DNA, 22 bp, Homo sapiens
tgagcagagttgtttctcctga

SEQ ID NO: 8501050 - DNA, 22 bp, Homo sapiens
tgagcagagtcgctccagagtg

SEQ ID NO: 8501051 - DNA, 18 bp, Homo sapiens
tgagcagagtaaggcttt

SEQ ID NO: 8501052 - DNA, 22 bp, Homo sapiens
tgagccagcctcagaagtcacg

SEQ ID NO: 8501053 - DNA, 22 bp, Homo sapiens
tgagccagccttgcagctgtgc

SEQ ID NO: 8501054 - DNA, 22 bp, Homo sapiens
tgagccagccttgcagctgtgc

SEQ ID NO: 8501055 - DNA, 22 bp, Homo sapiens
tgagccagccttgcagctgtgc

SEQ ID NO: 8501056 - DNA, 22 bp, Homo sapiens
tgagccagccttgcagctgtgc

SEQ ID NO: 8501057 - DNA, 22 bp, Homo sapiens
tgagccagcaggcctccagtgg

SEQ ID NO: 8501058 - DNA, 22 bp, Homo sapiens
tgagccagataagggctcacgc

SEQ ID NO: 8501059 - DNA, 22 bp, Homo sapiens
tgagccagcaggcctccagtgg

SEQ ID NO: 8501060 - DNA, 22 bp, Homo sapiens
tgagccaggcactgctcctgga

SEQ ID NO: 8501061 - DNA, 22 bp, Homo sapiens
tgagccaggagtttgaggctgt

SEQ ID NO: 8501062 - DNA, 22 bp, Homo sapiens
tgagccagctccttgcctgtca

SEQ ID NO: 8501063 - DNA, 22 bp, Homo sapiens
tgagccaggagtttgaggctgt

SEQ ID NO: 8501064 - DNA, 22 bp, Homo sapiens
tgagccaggcccagtggggtca

SEQ ID NO: 8501065 - DNA, 22 bp, Homo sapiens
tgagccaggcccagtggggtca

SEQ ID NO: 8501066 - DNA, 20 bp, Homo sapiens
tgagccaggctaggaagggc

SEQ ID NO: 8501067 - DNA, 22 bp, Homo sapiens
tgagccaggctcaagtgatcct

SEQ ID NO: 8501068 - DNA, 22 bp, Homo sapiens
tgagccaggctcaagtgatcct

SEQ ID NO: 8501069 - DNA, 21 bp, Homo sapiens
tgagccaggctgacggctgtg

SEQ ID NO: 8501070 - DNA, 21 bp, Homo sapiens
tgagccaggctgacggctgtg

SEQ ID NO: 8501071 - DNA, 22 bp, Homo sapiens
tgagccaggctccatgccacct

SEQ ID NO: 8501072 - DNA, 19 bp, Homo sapiens
tgagccagggaggccatgc

SEQ ID NO: 8501073 - DNA, 22 bp, Homo sapiens
tgagccagggtttccggctgct

SEQ ID NO: 8501074 - DNA, 19 bp, Homo sapiens
tgagccagggaggccatgc

SEQ ID NO: 8501075 - DNA, 19 bp, Homo sapiens
tgagccagggaggccatgc

SEQ ID NO: 8501076 - DNA, 22 bp, Homo sapiens
tgagccaaggcctcaagaattt

SEQ ID NO: 8501077 - DNA, 22 bp, Homo sapiens
tgagccaagatcatgccgttgt

SEQ ID NO: 8501078 - DNA, 22 bp, Homo sapiens
tgagcattggatcaaatgactt

SEQ ID NO: 8501079 - DNA, 19 bp, Homo sapiens
tgagcatgcgagctgagaa

SEQ ID NO: 8501080 - DNA, 22 bp, Homo sapiens
tgagccacagtgagagctcctg

SEQ ID NO: 8501081 - DNA, 22 bp, Homo sapiens
tgagccagagaggttgaggcta

SEQ ID NO: 8501082 - DNA, 22 bp, Homo sapiens
tgagccagagaggttgaggcta

SEQ ID NO: 8501083 - DNA, 22 bp, Homo sapiens
tgagccagagtggagtgtgcct

SEQ ID NO: 8501084 - DNA, 22 bp, Homo sapiens
tgagccagaggaggctgtgtgg

SEQ ID NO: 8501085 - DNA, 22 bp, Homo sapiens
tgagccagaggaggctgtgtgg

SEQ ID NO: 8501086 - DNA, 22 bp, Homo sapiens
tgagccagagtggagtgtgcct

SEQ ID NO: 8501087 - DNA, 22 bp, Homo sapiens
tgagccagagtggagtgtgcct

SEQ ID NO: 8501088 - DNA, 22 bp, Homo sapiens
tgagccagataagggctcacgc

SEQ ID NO: 8501089 - DNA, 22 bp, Homo sapiens
tgagccagataagggctcacgc

SEQ ID NO: 8501090 - DNA, 22 bp, Homo sapiens
tgagcagggactttggagtctg

SEQ ID NO: 8501091 - DNA, 22 bp, Homo sapiens
tgagcagggactttggagtctg

SEQ ID NO: 8501092 - DNA, 22 bp, Homo sapiens
tgagcagggactttgagtgtag

SEQ ID NO: 8501093 - DNA, 22 bp, Homo sapiens
tgagcagggactttggagtctg

SEQ ID NO: 8501094 - DNA, 22 bp, Homo sapiens
tgagcagggagctgggctgagc

SEQ ID NO: 8501095 - DNA, 22 bp, Homo sapiens
tgagcatcttcgtgaaagcttc

SEQ ID NO: 8501096 - DNA, 22 bp, Homo sapiens
tgaggatggcagtgtgctcagc

SEQ ID NO: 8501097 - DNA, 22 bp, Homo sapiens
tgaggatggcagtgtgctcagc

SEQ ID NO: 8501098 - DNA, 22 bp, Homo sapiens
tgaggatggaatgctgtgcaag

SEQ ID NO: 8501099 - DNA, 22 bp, Homo sapiens
tgaggatggggagatggtgtct

SEQ ID NO: 8501100 - DNA, 22 bp, Homo sapiens
tgaggatggtcccgaggacact

SEQ ID NO: 8501101 - DNA, 22 bp, Homo sapiens
tgaggatggtcccgaggacact

SEQ ID NO: 8501102 - DNA, 22 bp, Homo sapiens
tgaggagtttttctagagctaa

SEQ ID NO: 8501103 - DNA, 22 bp, Homo sapiens
tgaggaggtgggcacacagagt

SEQ ID NO: 8501104 - DNA, 22 bp, Homo sapiens
tgaggatgacgatggcaatggc

SEQ ID NO: 8501105 - DNA, 22 bp, Homo sapiens
tgaggatgacgatggcaatggc

SEQ ID NO: 8501106 - DNA, 21 bp, Homo sapiens
tgaggataagtaaagctgaag

SEQ ID NO: 8501107 - DNA, 22 bp, Homo sapiens
tgaggatgagatgagataacac

SEQ ID NO: 8501108 - DNA, 22 bp, Homo sapiens
tgaggaggtgggcacacagagt

SEQ ID NO: 8501109 - DNA, 22 bp, Homo sapiens
tgaggaggcccaggttggggct

SEQ ID NO: 8501110 - DNA, 22 bp, Homo sapiens
tgaggaagggtgtgacggcacc

SEQ ID NO: 8501111 - DNA, 22 bp, Homo sapiens
tgaggaagggcacacggaccct

SEQ ID NO: 8501112 - DNA, 18 bp, Homo sapiens
tgaggaaggggaagtatt

SEQ ID NO: 8501113 - DNA, 22 bp, Homo sapiens
tgaggaagggtgtgacggcacc

SEQ ID NO: 8501114 - DNA, 23 bp, Homo sapiens
tgaggaagtaattgtaaaggtct

SEQ ID NO: 8501115 - DNA, 22 bp, Homo sapiens
tgaggaagggtgtgacggcacc

SEQ ID NO: 8501116 - DNA, 22 bp, Homo sapiens
tgaggaagggtgtgacggcacc

SEQ ID NO: 8501117 - DNA, 22 bp, Homo sapiens
tgaggaagtggttgtatggttt

SEQ ID NO: 8501118 - DNA, 22 bp, Homo sapiens
tgaggaagttgatctcatcagt

SEQ ID NO: 8501119 - DNA, 22 bp, Homo sapiens
tgaggaagtggttgtatggttt

SEQ ID NO: 8501120 - DNA, 22 bp, Homo sapiens
tgaggagaaatgctcagagcca

SEQ ID NO: 8501121 - DNA, 22 bp, Homo sapiens
tgaggagaaatgctcagagcca

SEQ ID NO: 8501122 - DNA, 22 bp, Homo sapiens
tgaggaagttgtttctcttcta

SEQ ID NO: 8501123 - DNA, 22 bp, Homo sapiens
tgaggaagttgatctcatcagt

SEQ ID NO: 8501124 - DNA, 22 bp, Homo sapiens
tgaggaaggaattgaggtttta

SEQ ID NO: 8501125 - DNA, 22 bp, Homo sapiens
tgaggaaggaattgaggtttta

SEQ ID NO: 8501126 - DNA, 22 bp, Homo sapiens
tgaggaaggaattgaggtttta

SEQ ID NO: 8501127 - DNA, 22 bp, Homo sapiens
tgaggaagccaaacagctacac

SEQ ID NO: 8501128 - DNA, 22 bp, Homo sapiens
tgaggaagccaaacagctacac

SEQ ID NO: 8501129 - DNA, 22 bp, Homo sapiens
tgaggaagcaaaggcttgtgtg

SEQ ID NO: 8501130 - DNA, 22 bp, Homo sapiens
tgaggaagcaaaggcttgtgtg

SEQ ID NO: 8501131 - DNA, 22 bp, Homo sapiens
tgaggaagcaaaggcttgtgtg

SEQ ID NO: 8501132 - DNA, 22 bp, Homo sapiens
tgaggaagaacaagaatttaga

SEQ ID NO: 8501133 - DNA, 22 bp, Homo sapiens
tgaggaagaacaagaatttaga

SEQ ID NO: 8501134 - DNA, 22 bp, Homo sapiens
tgaggaactcaccaggcagaga

SEQ ID NO: 8501135 - DNA, 22 bp, Homo sapiens
tgaggaactgccagactgtttt

SEQ ID NO: 8501136 - DNA, 22 bp, Homo sapiens
tgaggcaggagaatcacatgaa

SEQ ID NO: 8501137 - DNA, 22 bp, Homo sapiens
tgaggcaggagaatcacatgaa

SEQ ID NO: 8501138 - DNA, 22 bp, Homo sapiens
tgaggcaggagaatcacatgaa

SEQ ID NO: 8501139 - DNA, 22 bp, Homo sapiens
tgaggcaggagaatcacatgaa

SEQ ID NO: 8501140 - DNA, 22 bp, Homo sapiens
tgaggcaggagaatcaccggaa

SEQ ID NO: 8501141 - DNA, 22 bp, Homo sapiens
tgaggcaggactgagcgggatg

SEQ ID NO: 8501142 - DNA, 22 bp, Homo sapiens
tgaggcactgggagagcacact

SEQ ID NO: 8501143 - DNA, 22 bp, Homo sapiens
tgaggcagaaaatagcagttca

SEQ ID NO: 8501144 - DNA, 22 bp, Homo sapiens
tgaggcagctttttctgtgtgt

SEQ ID NO: 8501145 - DNA, 22 bp, Homo sapiens
tgaggcagctttttctgtgtgt

SEQ ID NO: 8501146 - DNA, 22 bp, Homo sapiens
tgaggcagctttttctgtgtgt

SEQ ID NO: 8501147 - DNA, 22 bp, Homo sapiens
tgaggcagctttttctgtgtgt

SEQ ID NO: 8501148 - DNA, 22 bp, Homo sapiens
tgaggcaggaatggggaaaagt

SEQ ID NO: 8501149 - DNA, 22 bp, Homo sapiens
tgaggcaggaatggggaaaagt

SEQ ID NO: 8501150 - DNA, 22 bp, Homo sapiens
tgaggcaggacatggacaactg

SEQ ID NO: 8501151 - DNA, 22 bp, Homo sapiens
tgaggcaggacatggacaactg

SEQ ID NO: 8501152 - DNA, 22 bp, Homo sapiens
tgaggatggttaaagaacattg

SEQ ID NO: 8501153 - DNA, 21 bp, Homo sapiens
tgaggatgtgcagcagcagga

SEQ ID NO: 8501154 - DNA, 22 bp, Homo sapiens
tgaggattggcaaaactcaggg

SEQ ID NO: 8501155 - DNA, 22 bp, Homo sapiens
tgaggcaatgtccttcatcctt

SEQ ID NO: 8501156 - DNA, 22 bp, Homo sapiens
tgaggcacatccaggccagctc

SEQ ID NO: 8501157 - DNA, 22 bp, Homo sapiens
tgaggcactccaggatgctgtt

SEQ ID NO: 8501158 - DNA, 22 bp, Homo sapiens
tgaggccctctgggctggtcct

SEQ ID NO: 8501159 - DNA, 22 bp, Homo sapiens
tgaggccctctgggctggtcct

SEQ ID NO: 8501160 - DNA, 22 bp, Homo sapiens
tgaggccctagggcatgggaga

SEQ ID NO: 8501161 - DNA, 22 bp, Homo sapiens
tgaggccctagggcatgggaga

SEQ ID NO: 8501162 - DNA, 22 bp, Homo sapiens
tgaggcctcatttagggagagg

SEQ ID NO: 8501163 - DNA, 22 bp, Homo sapiens
tgaggccaggatcccaggctct

SEQ ID NO: 8501164 - DNA, 22 bp, Homo sapiens
tgaggccccgaagctgaggttt

SEQ ID NO: 8501165 - DNA, 22 bp, Homo sapiens
tgaggccaggatcccaggctct

SEQ ID NO: 8501166 - DNA, 22 bp, Homo sapiens
tgaggccaggacccccagcagg

SEQ ID NO: 8501167 - DNA, 22 bp, Homo sapiens
tgaggccaggatcccaggctct

SEQ ID NO: 8501168 - DNA, 22 bp, Homo sapiens
tgaggccctagggcatgggaga

SEQ ID NO: 8501169 - DNA, 22 bp, Homo sapiens
tgaggcccgggtggaggaatgc

SEQ ID NO: 8501170 - DNA, 18 bp, Homo sapiens
tgaggcccgcagaggtgg

SEQ ID NO: 8501171 - DNA, 18 bp, Homo sapiens
tgaggcccgcagaggtgg

SEQ ID NO: 8501172 - DNA, 22 bp, Homo sapiens
tgaggccccgaagctgaggttt

SEQ ID NO: 8501173 - DNA, 22 bp, Homo sapiens
tgaggcctctgtgccatccagg

SEQ ID NO: 8501174 - DNA, 22 bp, Homo sapiens
tgaggcctgaagcctgaagtga

SEQ ID NO: 8501175 - DNA, 18 bp, Homo sapiens
tgaggcctctgctgggcc

SEQ ID NO: 8501176 - DNA, 21 bp, Homo sapiens
tgaggcctctcctgggctggc

SEQ ID NO: 8501177 - DNA, 22 bp, Homo sapiens
tgaggcctctgaggcctaggct

SEQ ID NO: 8501178 - DNA, 17 bp, Homo sapiens
tgaggcctgcatcagtg

SEQ ID NO: 8501179 - DNA, 17 bp, Homo sapiens
tgaggcctgcatcagtg

SEQ ID NO: 8501180 - DNA, 22 bp, Homo sapiens
tgaggcctgcattgaactagaa

SEQ ID NO: 8501181 - DNA, 22 bp, Homo sapiens
tgaggcctgaagcctggagcct

SEQ ID NO: 8501182 - DNA, 17 bp, Homo sapiens
tgaggcctgcatcagtg

SEQ ID NO: 8501183 - DNA, 22 bp, Homo sapiens
tgaggccagccacagccaccct

SEQ ID NO: 8501184 - DNA, 22 bp, Homo sapiens
tgaggccagagtttttaattcc

SEQ ID NO: 8501185 - DNA, 22 bp, Homo sapiens
tgaggccagccacagccaccct

SEQ ID NO: 8501186 - DNA, 16 bp, Homo sapiens
tgaggccagccatttc

SEQ ID NO: 8501187 - DNA, 22 bp, Homo sapiens
tgaggccagagagtttgcattt

SEQ ID NO: 8501188 - DNA, 18 bp, Homo sapiens
tgaggccagagtgggcat

SEQ ID NO: 8501189 - DNA, 22 bp, Homo sapiens
tgaggccagcttcagcagtgga

SEQ ID NO: 8501190 - DNA, 19 bp, Homo sapiens
tgaggccagctggcatttt

SEQ ID NO: 8501191 - DNA, 19 bp, Homo sapiens
tgaggccagctggcatttt

SEQ ID NO: 8501192 - DNA, 22 bp, Homo sapiens
tgaggccagcttcagcagtgga

SEQ ID NO: 8501193 - DNA, 22 bp, Homo sapiens
tgaggccacttccccacagccc

SEQ ID NO: 8501194 - DNA, 22 bp, Homo sapiens
tgaggccacttccccacagccc

SEQ ID NO: 8501195 - DNA, 22 bp, Homo sapiens
tgaggccagagagtttgcattt

SEQ ID NO: 8501196 - DNA, 22 bp, Homo sapiens
tgaggccagactgaaaccaaca

SEQ ID NO: 8501197 - DNA, 22 bp, Homo sapiens
tgaggccacagtatcagaacag

SEQ ID NO: 8501198 - DNA, 21 bp, Homo sapiens
tgaggccaatagcccctggac

SEQ ID NO: 8501199 - DNA, 21 bp, Homo sapiens
tgaggccaatagcccctggac

SEQ ID NO: 8501200 - DNA, 21 bp, Homo sapiens
tgaggccaatagcccctggac

SEQ ID NO: 8501201 - DNA, 22 bp, Homo sapiens
tgaggccaatgaccctgggcag

SEQ ID NO: 8501202 - DNA, 22 bp, Homo sapiens
tgaggccaatgaccctgggcag

SEQ ID NO: 8501203 - DNA, 22 bp, Homo sapiens
tgaggccacaggaaagggcccg

SEQ ID NO: 8501204 - DNA, 20 bp, Homo sapiens
tgaggcaggagaatggcatg

SEQ ID NO: 8501205 - DNA, 20 bp, Homo sapiens
tgaggcaggagaatggcatg

SEQ ID NO: 8501206 - DNA, 22 bp, Homo sapiens
tgaggcaggagaatggcgggaa

SEQ ID NO: 8501207 - DNA, 22 bp, Homo sapiens
tgaggcaggagaatggcgggaa

SEQ ID NO: 8501208 - DNA, 22 bp, Homo sapiens
tgaggcaggaggttgagaactg

SEQ ID NO: 8501209 - DNA, 22 bp, Homo sapiens
tgaggcaggaggttgagaactg

SEQ ID NO: 8501210 - DNA, 22 bp, Homo sapiens
tgaggcaggaggttgagaactg

SEQ ID NO: 8501211 - DNA, 22 bp, Homo sapiens
tgaggcaggaggattgcaggat

SEQ ID NO: 8501212 - DNA, 22 bp, Homo sapiens
tgaggcaggaggattgcaggat

SEQ ID NO: 8501213 - DNA, 22 bp, Homo sapiens
tgaggcaggaggattgcaggat

SEQ ID NO: 8501214 - DNA, 22 bp, Homo sapiens
tgaggcaggatgcttgcacagg

SEQ ID NO: 8501215 - DNA, 23 bp, Homo sapiens
tgaggcaggcggatcacgaggtc

SEQ ID NO: 8501216 - DNA, 22 bp, Homo sapiens
tgaggcaggatgcttgcacagg

SEQ ID NO: 8501217 - DNA, 22 bp, Homo sapiens
tgaggcaggagttcaggctgcg

SEQ ID NO: 8501218 - DNA, 22 bp, Homo sapiens
tgaggcaggagttcaggctgcg

SEQ ID NO: 8501219 - DNA, 22 bp, Homo sapiens
tgaggcaggagttaatgtgctc

SEQ ID NO: 8501220 - DNA, 22 bp, Homo sapiens
tgaggcaggagttcaggctgcg

SEQ ID NO: 8501221 - DNA, 22 bp, Homo sapiens
tgaggcaggagttcaggctgcg

SEQ ID NO: 8501222 - DNA, 22 bp, Homo sapiens
tgaggcaggagttcaggctgcg

SEQ ID NO: 8501223 - DNA, 22 bp, Homo sapiens
tgaggcaggagttcaggctgcg

SEQ ID NO: 8501224 - DNA, 22 bp, Homo sapiens
tgaggcaggagttcaggctgcg

SEQ ID NO: 8501225 - DNA, 22 bp, Homo sapiens
tgaggccaactagggagatgga

SEQ ID NO: 8501226 - DNA, 22 bp, Homo sapiens
tgaggccaactagggagatgga

SEQ ID NO: 8501227 - DNA, 22 bp, Homo sapiens
tgaggccaaaatgactcaaatg

SEQ ID NO: 8501228 - DNA, 22 bp, Homo sapiens
tgaggcatggtcctgagggagc

SEQ ID NO: 8501229 - DNA, 22 bp, Homo sapiens
tgaggcagttgagcttcctgag

SEQ ID NO: 8501230 - DNA, 22 bp, Homo sapiens
tgaggccaagcctcctctgcca

SEQ ID NO: 8501231 - DNA, 22 bp, Homo sapiens
tgaggccaagcctcctctgcca

SEQ ID NO: 8501232 - DNA, 22 bp, Homo sapiens
tgaggccaagaaaagctgggtg

SEQ ID NO: 8501233 - DNA, 19 bp, Homo sapiens
tgaggccaaggtcacagat

SEQ ID NO: 8501234 - DNA, 19 bp, Homo sapiens
tgaggccaaggtcacagat

SEQ ID NO: 8501235 - DNA, 19 bp, Homo sapiens
tgaggccaaggtcacagat

SEQ ID NO: 8501236 - DNA, 22 bp, Homo sapiens
tgaggcagttcttacttgtatt

SEQ ID NO: 8501237 - DNA, 22 bp, Homo sapiens
tgaggcagttcttacttgtatt

SEQ ID NO: 8501238 - DNA, 22 bp, Homo sapiens
tgaggcagtgtgagataataaa

SEQ ID NO: 8501239 - DNA, 22 bp, Homo sapiens
tgaggcagggagtttaattgtc

SEQ ID NO: 8501240 - DNA, 22 bp, Homo sapiens
tgaggcagggagagtggatatg

SEQ ID NO: 8501241 - DNA, 22 bp, Homo sapiens
tgaggcagggagagtggatatg

SEQ ID NO: 8501242 - DNA, 22 bp, Homo sapiens
tgaggcagggagagtggatatg

SEQ ID NO: 8501243 - DNA, 23 bp, Homo sapiens
tgaggcaggcggatcacgaggtc

SEQ ID NO: 8501244 - DNA, 23 bp, Homo sapiens
tgaggcaggcggatcacgaggtc

SEQ ID NO: 8501245 - DNA, 23 bp, Homo sapiens
tgaggcaggcggatcacgaggtc

SEQ ID NO: 8501246 - DNA, 23 bp, Homo sapiens
tgaggcaggcggatcacgaggtc

SEQ ID NO: 8501247 - DNA, 23 bp, Homo sapiens
tgaggcaggcggatcacgaggtc

SEQ ID NO: 8501248 - DNA, 23 bp, Homo sapiens
tgaggcaggcggatcacgaggtc

SEQ ID NO: 8501249 - DNA, 22 bp, Homo sapiens
tgaggtaaatagaaaaaccatg

SEQ ID NO: 8501250 - DNA, 22 bp, Homo sapiens
tgaggtaataagtgtttgtttt

SEQ ID NO: 8501251 - DNA, 22 bp, Homo sapiens
tgaggtaatgtgtacgttaatt

SEQ ID NO: 8501252 - DNA, 22 bp, Homo sapiens
tgaggtagaagcctgggttgag

SEQ ID NO: 8501253 - DNA, 22 bp, Homo sapiens
tgagggtggcacaggcacaaag

SEQ ID NO: 8501254 - DNA, 22 bp, Homo sapiens
tgagggtggcacaggcacaaag

SEQ ID NO: 8501255 - DNA, 22 bp, Homo sapiens
tgagggtggccttgtgtggact

SEQ ID NO: 8501256 - DNA, 22 bp, Homo sapiens
tgagggtggccttgtgtggact

SEQ ID NO: 8501257 - DNA, 22 bp, Homo sapiens
tgagggtgggccctgggcatct

SEQ ID NO: 8501258 - DNA, 22 bp, Homo sapiens
tgagggtgggccctgggcatct

SEQ ID NO: 8501259 - DNA, 22 bp, Homo sapiens
tgagggtgggcctgcaggaaga

SEQ ID NO: 8501260 - DNA, 22 bp, Homo sapiens
tgagggtgggcctgcaggaaga

SEQ ID NO: 8501261 - DNA, 22 bp, Homo sapiens
tgagggtgtgcggcccagacag

SEQ ID NO: 8501262 - DNA, 22 bp, Homo sapiens
tgagggtgggcctgcaggaaga

SEQ ID NO: 8501263 - DNA, 22 bp, Homo sapiens
tgaggtgacaattcattctcca

SEQ ID NO: 8501264 - DNA, 22 bp, Homo sapiens
tgaggtgaccgcagatgggaag

SEQ ID NO: 8501265 - DNA, 22 bp, Homo sapiens
tgaggtctgcagggctgtgcat

SEQ ID NO: 8501266 - DNA, 22 bp, Homo sapiens
tgaggtgaagagtggagctcag

SEQ ID NO: 8501267 - DNA, 22 bp, Homo sapiens
tgagggggttaattaggagagt

SEQ ID NO: 8501268 - DNA, 22 bp, Homo sapiens
tgagggggttaattaggagagt

SEQ ID NO: 8501269 - DNA, 22 bp, Homo sapiens
tgagggggttaattaggagagt

SEQ ID NO: 8501270 - DNA, 22 bp, Homo sapiens
tgaggggggtaatcactgggtt

SEQ ID NO: 8501271 - DNA, 22 bp, Homo sapiens
tgaggggggtaatcactgggtt

SEQ ID NO: 8501272 - DNA, 22 bp, Homo sapiens
tgaggggggtaatcactgggtt

SEQ ID NO: 8501273 - DNA, 22 bp, Homo sapiens
tgaggggggtaatcactgggtt

SEQ ID NO: 8501274 - DNA, 22 bp, Homo sapiens
tgagggtaacctggagctgctg

SEQ ID NO: 8501275 - DNA, 22 bp, Homo sapiens
tgagggtagctggatcacggag

SEQ ID NO: 8501276 - DNA, 22 bp, Homo sapiens
tgaggggttgtgagaaatgtag

SEQ ID NO: 8501277 - DNA, 21 bp, Homo sapiens
tgaggggttataacagggtgg

SEQ ID NO: 8501278 - DNA, 19 bp, Homo sapiens
tgagggtgagctttggaga

SEQ ID NO: 8501279 - DNA, 22 bp, Homo sapiens
tgagggtgcatttagcatgtag

SEQ ID NO: 8501280 - DNA, 22 bp, Homo sapiens
tgagggtggcacaggcacaaag

SEQ ID NO: 8501281 - DNA, 22 bp, Homo sapiens
tgagggtgcatttagcatgtag

SEQ ID NO: 8501282 - DNA, 22 bp, Homo sapiens
tgaggggcggcctgcagaggcc

SEQ ID NO: 8501283 - DNA, 22 bp, Homo sapiens
tgaggggcggcctgcagaggcc

SEQ ID NO: 8501284 - DNA, 22 bp, Homo sapiens
tgaggggcggcctgcagaggcc

SEQ ID NO: 8501285 - DNA, 19 bp, Homo sapiens
tgaggggctcacagtctca

SEQ ID NO: 8501286 - DNA, 19 bp, Homo sapiens
tgaggggctcacagtctca

SEQ ID NO: 8501287 - DNA, 19 bp, Homo sapiens
tgaggggctcacagtctca

SEQ ID NO: 8501288 - DNA, 22 bp, Homo sapiens
tgaggggcggcctgcagaggcc

SEQ ID NO: 8501289 - DNA, 22 bp, Homo sapiens
tgaggggcggcctgcagaggcc

SEQ ID NO: 8501290 - DNA, 19 bp, Homo sapiens
tgaggggctcacagtctca

SEQ ID NO: 8501291 - DNA, 22 bp, Homo sapiens
tgaggggcatgtgtttacacat

SEQ ID NO: 8501292 - DNA, 22 bp, Homo sapiens
tgaggggccagaccccacctag

SEQ ID NO: 8501293 - DNA, 22 bp, Homo sapiens
tgaggggcgctggcaggttcct

SEQ ID NO: 8501294 - DNA, 22 bp, Homo sapiens
tgaggggccgcccaagcacttc

SEQ ID NO: 8501295 - DNA, 22 bp, Homo sapiens
tgaggggccgcccaagcacttc

SEQ ID NO: 8501296 - DNA, 22 bp, Homo sapiens
tgaggggccgcccaagcacttc

SEQ ID NO: 8501297 - DNA, 22 bp, Homo sapiens
tgaggtggccgaggagcaggac

SEQ ID NO: 8501298 - DNA, 22 bp, Homo sapiens
tgaggtggccgaggagcaggac

SEQ ID NO: 8501299 - DNA, 22 bp, Homo sapiens
tgaggtggaaggatcctttgaa

SEQ ID NO: 8501300 - DNA, 22 bp, Homo sapiens
tgaggtggcacacacttcctgc

SEQ ID NO: 8501301 - DNA, 22 bp, Homo sapiens
tgaggtggctagggaggcactc

SEQ ID NO: 8501302 - DNA, 22 bp, Homo sapiens
tgaggtggctagggaggcactc

SEQ ID NO: 8501303 - DNA, 22 bp, Homo sapiens
tgaggtggctagggaggcactc

SEQ ID NO: 8501304 - DNA, 22 bp, Homo sapiens
tgaggtggctagggaggcactc

SEQ ID NO: 8501305 - DNA, 22 bp, Homo sapiens
tgaggtggctagggaggcactc

SEQ ID NO: 8501306 - DNA, 22 bp, Homo sapiens
tgaggtggctagggaggcactc

SEQ ID NO: 8501307 - DNA, 22 bp, Homo sapiens
tgaggtggctggatctcagcct

SEQ ID NO: 8501308 - DNA, 22 bp, Homo sapiens
tgaggtggttactgtggtgctc

SEQ ID NO: 8501309 - DNA, 22 bp, Homo sapiens
tgaggtggttactgtggtgctc

SEQ ID NO: 8501310 - DNA, 22 bp, Homo sapiens
tgaggtgggtgtcaggtcagag

SEQ ID NO: 8501311 - DNA, 22 bp, Homo sapiens
tgaggtgggtgtcaggtcagag

SEQ ID NO: 8501312 - DNA, 22 bp, Homo sapiens
tgaggtgggtgtcaggtcagag

SEQ ID NO: 8501313 - DNA, 22 bp, Homo sapiens
tgaggtggttactgtggtgctc

SEQ ID NO: 8501314 - DNA, 22 bp, Homo sapiens
tgaggtggttactgtggtgctc

SEQ ID NO: 8501315 - DNA, 22 bp, Homo sapiens
tgaggtggttcaagagccttgt

SEQ ID NO: 8501316 - DNA, 22 bp, Homo sapiens
tgaggttatttattatgcatga

SEQ ID NO: 8501317 - DNA, 22 bp, Homo sapiens
tgaggttagctgggatttcatg

SEQ ID NO: 8501318 - DNA, 22 bp, Homo sapiens
tgaggtgtgtccccagggaggt

SEQ ID NO: 8501319 - DNA, 22 bp, Homo sapiens
tgaggtggtttgtatcactggg

SEQ ID NO: 8501320 - DNA, 22 bp, Homo sapiens
tgaggtggtttgtatcactggg

SEQ ID NO: 8501321 - DNA, 22 bp, Homo sapiens
tgagtcacatccatttttgtgt

SEQ ID NO: 8501322 - DNA, 23 bp, Homo sapiens
tgagtcaccacagttacagtcac

SEQ ID NO: 8501323 - DNA, 23 bp, Homo sapiens
tgagtcttgagctttggattctg

SEQ ID NO: 8501324 - DNA, 22 bp, Homo sapiens
tgagtatcctatatggtgtaag

SEQ ID NO: 8501325 - DNA, 22 bp, Homo sapiens
tgagtatcaattacatagttgt

SEQ ID NO: 8501326 - DNA, 22 bp, Homo sapiens
tgagtatcaattacatagttgt

SEQ ID NO: 8501327 - DNA, 22 bp, Homo sapiens
tgagtattccttatctgaaatg

SEQ ID NO: 8501328 - DNA, 22 bp, Homo sapiens
tgagtattctgaatttcaaact

SEQ ID NO: 8501329 - DNA, 22 bp, Homo sapiens
tgagtcacagccttgccttggt

SEQ ID NO: 8501330 - DNA, 22 bp, Homo sapiens
tgagtcacacatttcttcatac

SEQ ID NO: 8501331 - DNA, 22 bp, Homo sapiens
tgagtattttaagttctcaatc

SEQ ID NO: 8501332 - DNA, 22 bp, Homo sapiens
tgagtaaaaattctacatttcc

SEQ ID NO: 8501333 - DNA, 22 bp, Homo sapiens
tgaggttatttattatgcatga

SEQ ID NO: 8501334 - DNA, 22 bp, Homo sapiens
tgagtaaaagtgaatcttatgt

SEQ ID NO: 8501335 - DNA, 22 bp, Homo sapiens
tgagtaaatacaaaatcacctc

SEQ ID NO: 8501336 - DNA, 22 bp, Homo sapiens
tgagtagacctcacgtgtcaga

SEQ ID NO: 8501337 - DNA, 22 bp, Homo sapiens
tgagtagacgtgatctagtaac

SEQ ID NO: 8501338 - DNA, 22 bp, Homo sapiens
tgagtagagaattcagctaagg

SEQ ID NO: 8501339 - DNA, 22 bp, Homo sapiens
tgagtactcttctcactacacc

SEQ ID NO: 8501340 - DNA, 22 bp, Homo sapiens
tgagtactttatgttagttatt

SEQ ID NO: 8501341 - DNA, 22 bp, Homo sapiens
tgagtaattcacaaaacagatg

SEQ ID NO: 8501342 - DNA, 22 bp, Homo sapiens
tgagtaataaactgtcttgctc

SEQ ID NO: 8501343 - DNA, 22 bp, Homo sapiens
tgagtaggtggttaagcatgga

SEQ ID NO: 8501344 - DNA, 22 bp, Homo sapiens
tgagtagatccaagactgtcct

SEQ ID NO: 8501345 - DNA, 22 bp, Homo sapiens
tgagtatatacccagaagtgga

SEQ ID NO: 8501346 - DNA, 22 bp, Homo sapiens
tgagtagcggctatgtgtaact

SEQ ID NO: 8501347 - DNA, 22 bp, Homo sapiens
tgagtagagaattcagctaagg

SEQ ID NO: 8501348 - DNA, 22 bp, Homo sapiens
tgagtagagaattcagctaagg

SEQ ID NO: 8501349 - DNA, 22 bp, Homo sapiens
tgagtagagaattcagctaagg

SEQ ID NO: 8501350 - DNA, 22 bp, Homo sapiens
tgagtagagaattcagctaagg

SEQ ID NO: 8501351 - DNA, 22 bp, Homo sapiens
tgaggctgccttgggaagaggg

SEQ ID NO: 8501352 - DNA, 17 bp, Homo sapiens
tgaggctcggtgaggag

SEQ ID NO: 8501353 - DNA, 17 bp, Homo sapiens
tgaggctcggtgaggag

SEQ ID NO: 8501354 - DNA, 22 bp, Homo sapiens
tgaggctctccaagcagatgag

SEQ ID NO: 8501355 - DNA, 22 bp, Homo sapiens
tgaggctctatgtggtagatta

SEQ ID NO: 8501356 - DNA, 22 bp, Homo sapiens
tgaggctggcaaggctggtatt

SEQ ID NO: 8501357 - DNA, 22 bp, Homo sapiens
tgaggctggatgggatgcctcc

SEQ ID NO: 8501358 - DNA, 22 bp, Homo sapiens
tgaggctggcaaggctggtatt

SEQ ID NO: 8501359 - DNA, 22 bp, Homo sapiens
tgaggctggcaaggctggtatt

SEQ ID NO: 8501360 - DNA, 22 bp, Homo sapiens
tgaggctgccttgggaagaggg

SEQ ID NO: 8501361 - DNA, 22 bp, Homo sapiens
tgaggctggatgggatgcctcc

SEQ ID NO: 8501362 - DNA, 22 bp, Homo sapiens
tgaggctggatgggatgcctcc

SEQ ID NO: 8501363 - DNA, 22 bp, Homo sapiens
tgaggctgccttgggaagaggg

SEQ ID NO: 8501364 - DNA, 22 bp, Homo sapiens
tgaggcttagatttggtaactc

SEQ ID NO: 8501365 - DNA, 22 bp, Homo sapiens
tgaggcttggagaggtcaggga

SEQ ID NO: 8501366 - DNA, 21 bp, Homo sapiens
tgaggctgttgtaccagggag

SEQ ID NO: 8501367 - DNA, 21 bp, Homo sapiens
tgaggctgttgtaccagggag

SEQ ID NO: 8501368 - DNA, 22 bp, Homo sapiens
tgaggctgttctaccagggcca

SEQ ID NO: 8501369 - DNA, 21 bp, Homo sapiens
tgaggctgttgtaccagggag

SEQ ID NO: 8501370 - DNA, 22 bp, Homo sapiens
tgaggctgttctaccagggcca

SEQ ID NO: 8501371 - DNA, 21 bp, Homo sapiens
tgaggctgttgtaccagggag

SEQ ID NO: 8501372 - DNA, 22 bp, Homo sapiens
tgaggctgttctaccagggcca

SEQ ID NO: 8501373 - DNA, 22 bp, Homo sapiens
tgaggctgttctaccagggcca

SEQ ID NO: 8501374 - DNA, 22 bp, Homo sapiens
tgaggctgttctaccagggcca

SEQ ID NO: 8501375 - DNA, 22 bp, Homo sapiens
tgaggctggcaaggctggtatt

SEQ ID NO: 8501376 - DNA, 20 bp, Homo sapiens
tgaggctcagagaggttgag

SEQ ID NO: 8501377 - DNA, 22 bp, Homo sapiens
tgaggctcagagcacctgctcc

SEQ ID NO: 8501378 - DNA, 22 bp, Homo sapiens
tgaggctcattctgcatgccaa

SEQ ID NO: 8501379 - DNA, 22 bp, Homo sapiens
tgaggctccttgtagagagtgg

SEQ ID NO: 8501380 - DNA, 22 bp, Homo sapiens
tgaggctcagagaagtgctgtt

SEQ ID NO: 8501381 - DNA, 22 bp, Homo sapiens
tgaggctcagagaagtgctgtt

SEQ ID NO: 8501382 - DNA, 18 bp, Homo sapiens
tgaggctcagagacggtg

SEQ ID NO: 8501383 - DNA, 22 bp, Homo sapiens
tgaggctcacgaacagaagact

SEQ ID NO: 8501384 - DNA, 22 bp, Homo sapiens
tgaggctcacgaacagaagact

SEQ ID NO: 8501385 - DNA, 22 bp, Homo sapiens
tgaggctcagagaacagtgact

SEQ ID NO: 8501386 - DNA, 22 bp, Homo sapiens
tgaggcctgcttggaattgaat

SEQ ID NO: 8501387 - DNA, 22 bp, Homo sapiens
tgaggcctggactctgcatgga

SEQ ID NO: 8501388 - DNA, 22 bp, Homo sapiens
tgaggcctggactctgcatgga

SEQ ID NO: 8501389 - DNA, 21 bp, Homo sapiens
tgaggcctgccagtctcagaa

SEQ ID NO: 8501390 - DNA, 22 bp, Homo sapiens
tgaggcctgggcacataacctc

SEQ ID NO: 8501391 - DNA, 22 bp, Homo sapiens
tgaggcctggagggaggagttt

SEQ ID NO: 8501392 - DNA, 22 bp, Homo sapiens
tgaggctcaagaaagatttgtt

SEQ ID NO: 8501393 - DNA, 22 bp, Homo sapiens
tgaggctaaaggtgaccagatt

SEQ ID NO: 8501394 - DNA, 22 bp, Homo sapiens
tgagggagcacacactgaagtg

SEQ ID NO: 8501395 - DNA, 22 bp, Homo sapiens
tgagggagcacacactgaagtg

SEQ ID NO: 8501396 - DNA, 22 bp, Homo sapiens
tgagggagcacacactgaagtg

SEQ ID NO: 8501397 - DNA, 22 bp, Homo sapiens
tgagggaggccctttgagcaga

SEQ ID NO: 8501398 - DNA, 22 bp, Homo sapiens
tgagggaggccctttgagcaga

SEQ ID NO: 8501399 - DNA, 22 bp, Homo sapiens
tgagggagctgacctttctgtg

SEQ ID NO: 8501400 - DNA, 22 bp, Homo sapiens
tgagggagctgacctttctgtg

SEQ ID NO: 8501401 - DNA, 22 bp, Homo sapiens
tgagggagctgacctttctgtg

SEQ ID NO: 8501402 - DNA, 22 bp, Homo sapiens
tgagggaggcctccatctgcca

SEQ ID NO: 8501403 - DNA, 20 bp, Homo sapiens
tgagggagtattgatttccc

SEQ ID NO: 8501404 - DNA, 22 bp, Homo sapiens
tgagggagtcatgattaaggaa

SEQ ID NO: 8501405 - DNA, 22 bp, Homo sapiens
tgagggacttgctagttctctg

SEQ ID NO: 8501406 - DNA, 22 bp, Homo sapiens
tgagggagagggcgaaaatgaa

SEQ ID NO: 8501407 - DNA, 22 bp, Homo sapiens
tgagggagagggcgaaaatgaa

SEQ ID NO: 8501408 - DNA, 22 bp, Homo sapiens
tgaggcttggaggctccagtgg

SEQ ID NO: 8501409 - DNA, 22 bp, Homo sapiens
tgagggaatcctcacatcaatc

SEQ ID NO: 8501410 - DNA, 22 bp, Homo sapiens
tgagggaatattgatagatccg

SEQ ID NO: 8501411 - DNA, 22 bp, Homo sapiens
tgaggggatacggtacacattg

SEQ ID NO: 8501412 - DNA, 22 bp, Homo sapiens
tgaggggcagagaggtgtccag

SEQ ID NO: 8501413 - DNA, 22 bp, Homo sapiens
tgaggggaggttggggcacatc

SEQ ID NO: 8501414 - DNA, 22 bp, Homo sapiens
tgaggggaggttggggcacatc

SEQ ID NO: 8501415 - DNA, 22 bp, Homo sapiens
tgaggggaggttggggcacatc

SEQ ID NO: 8501416 - DNA, 22 bp, Homo sapiens
tgaggggagcccgccctggacg

SEQ ID NO: 8501417 - DNA, 19 bp, Homo sapiens
tgaggggaggagaggcctg

SEQ ID NO: 8501418 - DNA, 19 bp, Homo sapiens
tgaggggaggagaggcctg

SEQ ID NO: 8501419 - DNA, 19 bp, Homo sapiens
tgaggggaggagaggcctg

SEQ ID NO: 8501420 - DNA, 19 bp, Homo sapiens
tgaggggaggagaggcctg

SEQ ID NO: 8501421 - DNA, 22 bp, Homo sapiens
tgaggggagaagcagcagcctg

SEQ ID NO: 8501422 - DNA, 22 bp, Homo sapiens
tgaggggagacagagtggactc

SEQ ID NO: 8501423 - DNA, 22 bp, Homo sapiens
tgaggggaactgatgcccattg

SEQ ID NO: 8501424 - DNA, 22 bp, Homo sapiens
tgaggggagaagcagcagcctg

SEQ ID NO: 8501425 - DNA, 22 bp, Homo sapiens
tgaggggagaagcagcagcctg

SEQ ID NO: 8501426 - DNA, 22 bp, Homo sapiens
tgaggggaaggcatgataaata

SEQ ID NO: 8501427 - DNA, 22 bp, Homo sapiens
tgagggagtgtggatacagtag

SEQ ID NO: 8501428 - DNA, 22 bp, Homo sapiens
tgagggagtcatgattaaggaa

SEQ ID NO: 8501429 - DNA, 22 bp, Homo sapiens
tgagggagtcatgattaaggaa

SEQ ID NO: 8501430 - DNA, 22 bp, Homo sapiens
tgagggagttgggtgtatagga

SEQ ID NO: 8501431 - DNA, 22 bp, Homo sapiens
tgagggagttgggtgtatagga

SEQ ID NO: 8501432 - DNA, 22 bp, Homo sapiens
tgagggagtgtggatacagtag

SEQ ID NO: 8501433 - DNA, 22 bp, Homo sapiens
tgggaatgtgagcattcattca

SEQ ID NO: 8501434 - DNA, 22 bp, Homo sapiens
tgggaattgaggtgattgtgag

SEQ ID NO: 8501435 - DNA, 23 bp, Homo sapiens
tgggaattgcagggggttctgcc

SEQ ID NO: 8501436 - DNA, 22 bp, Homo sapiens
tgggaatggatgctaagtgcta

SEQ ID NO: 8501437 - DNA, 22 bp, Homo sapiens
tgggaatgggcctagaaggctg

SEQ ID NO: 8501438 - DNA, 22 bp, Homo sapiens
tgggaagttaggatgccaggga

SEQ ID NO: 8501439 - DNA, 22 bp, Homo sapiens
tgggaatacaagttattcacct

SEQ ID NO: 8501440 - DNA, 22 bp, Homo sapiens
tgggacaggttggagagaagca

SEQ ID NO: 8501441 - DNA, 22 bp, Homo sapiens
tgggacagtgaccccagaggtc

SEQ ID NO: 8501442 - DNA, 22 bp, Homo sapiens
tgggacaggttggagagaagca

SEQ ID NO: 8501443 - DNA, 22 bp, Homo sapiens
tgggacaggttggagagaagca

SEQ ID NO: 8501444 - DNA, 22 bp, Homo sapiens
tgggacacaaaccagaccagga

SEQ ID NO: 8501445 - DNA, 22 bp, Homo sapiens
tgggacaccctcacgcctgcac

SEQ ID NO: 8501446 - DNA, 22 bp, Homo sapiens
tgggacagttgtcctccactct

SEQ ID NO: 8501447 - DNA, 22 bp, Homo sapiens
tgggacagtgtgccttgctcct

SEQ ID NO: 8501448 - DNA, 22 bp, Homo sapiens
tgggaccaagtcatttctttag

SEQ ID NO: 8501449 - DNA, 22 bp, Homo sapiens
tgggacagtgaccccagaggtc

SEQ ID NO: 8501450 - DNA, 22 bp, Homo sapiens
tgggacagtgaccccagaggtc

SEQ ID NO: 8501451 - DNA, 21 bp, Homo sapiens
tgggacagtgatggctcctcc

SEQ ID NO: 8501452 - DNA, 22 bp, Homo sapiens
tgggactcactcttttggccag

SEQ ID NO: 8501453 - DNA, 22 bp, Homo sapiens
tgggactcactcttttggccag

SEQ ID NO: 8501454 - DNA, 22 bp, Homo sapiens
tgggactgctcttgctggggtc

SEQ ID NO: 8501455 - DNA, 22 bp, Homo sapiens
tgggactcactcttttggccag

SEQ ID NO: 8501456 - DNA, 22 bp, Homo sapiens
tgggaagggtcaacagctggaa

SEQ ID NO: 8501457 - DNA, 22 bp, Homo sapiens
tgggaagggtcagtttcttcat

SEQ ID NO: 8501458 - DNA, 22 bp, Homo sapiens
tgggaaggtacacgggaaagag

SEQ ID NO: 8501459 - DNA, 22 bp, Homo sapiens
tgggaaggtgtagaaagaacaa

SEQ ID NO: 8501460 - DNA, 22 bp, Homo sapiens
tgggaaggggagctggaaagga

SEQ ID NO: 8501461 - DNA, 22 bp, Homo sapiens
tgggaaggggagctggaaagga

SEQ ID NO: 8501462 - DNA, 22 bp, Homo sapiens
tgggaagggtcaacagctggaa

SEQ ID NO: 8501463 - DNA, 22 bp, Homo sapiens
tgggaaggggagctggaaagga

SEQ ID NO: 8501464 - DNA, 22 bp, Homo sapiens
tgggaagatggagtgacaggca

SEQ ID NO: 8501465 - DNA, 22 bp, Homo sapiens
tgggaagatggagtgacaggca

SEQ ID NO: 8501466 - DNA, 22 bp, Homo sapiens
tgggaagatgataattcacagt

SEQ ID NO: 8501467 - DNA, 22 bp, Homo sapiens
tgggaagatggagtgacaggca

SEQ ID NO: 8501468 - DNA, 22 bp, Homo sapiens
tgggaagatggagtgacaggca

SEQ ID NO: 8501469 - DNA, 22 bp, Homo sapiens
tgggaagaggcgggaggctgtt

SEQ ID NO: 8501470 - DNA, 22 bp, Homo sapiens
tgggaagagttagagacagctg

SEQ ID NO: 8501471 - DNA, 23 bp, Homo sapiens
tgggaagatatgtatgttcaagg

SEQ ID NO: 8501472 - DNA, 22 bp, Homo sapiens
tgggaagatatgagtgaccaac

SEQ ID NO: 8501473 - DNA, 22 bp, Homo sapiens
tgggaagagttagagacagctg

SEQ ID NO: 8501474 - DNA, 22 bp, Homo sapiens
tgggaagatatgagtgaccaac

SEQ ID NO: 8501475 - DNA, 22 bp, Homo sapiens
tgggaaggcgtggaagtagaag

SEQ ID NO: 8501476 - DNA, 22 bp, Homo sapiens
tgggaagggagagtgtcctgga

SEQ ID NO: 8501477 - DNA, 22 bp, Homo sapiens
tgggaaggcgtggaagtagaag

SEQ ID NO: 8501478 - DNA, 22 bp, Homo sapiens
tgggaagggccgatggagcctc

SEQ ID NO: 8501479 - DNA, 22 bp, Homo sapiens
tgggaagggccgatggagcctc

SEQ ID NO: 8501480 - DNA, 22 bp, Homo sapiens
tgggagagaataatcaataggt

SEQ ID NO: 8501481 - DNA, 23 bp, Homo sapiens
tgggagacttttcattttgttct

SEQ ID NO: 8501482 - DNA, 22 bp, Homo sapiens
tgggagagcttcatgccttcag

SEQ ID NO: 8501483 - DNA, 22 bp, Homo sapiens
tgggagaagcatggggtgcaga

SEQ ID NO: 8501484 - DNA, 22 bp, Homo sapiens
tgggagaatatatttaaaactt

SEQ ID NO: 8501485 - DNA, 22 bp, Homo sapiens
tgggagaatcttgctctgctac

SEQ ID NO: 8501486 - DNA, 22 bp, Homo sapiens
tgggagaagcagtgggacagta

SEQ ID NO: 8501487 - DNA, 22 bp, Homo sapiens
tgggagaagcagtgggacagta

SEQ ID NO: 8501488 - DNA, 22 bp, Homo sapiens
tgggagaaagaaccctgagtga

SEQ ID NO: 8501489 - DNA, 22 bp, Homo sapiens
tgggagaacactgctctggatg

SEQ ID NO: 8501490 - DNA, 22 bp, Homo sapiens
tgggagaaactgtctctcccac

SEQ ID NO: 8501491 - DNA, 22 bp, Homo sapiens
tgggacttaatatgcccttgat

SEQ ID NO: 8501492 - DNA, 22 bp, Homo sapiens
tgggacttcaatgcaatgaggt

SEQ ID NO: 8501493 - DNA, 20 bp, Homo sapiens
tgggagaagaacactggaac

SEQ ID NO: 8501494 - DNA, 20 bp, Homo sapiens
tgggagaagaacactggaac

SEQ ID NO: 8501495 - DNA, 22 bp, Homo sapiens
tgggagaagacgtactttagac

SEQ ID NO: 8501496 - DNA, 22 bp, Homo sapiens
tgggagaacccagggtcaggct

SEQ ID NO: 8501497 - DNA, 22 bp, Homo sapiens
tgggagaagagaaattactgcc

SEQ ID NO: 8501498 - DNA, 22 bp, Homo sapiens
tgggagaagcagcagccaagtg

SEQ ID NO: 8501499 - DNA, 22 bp, Homo sapiens
tgggagcaaatgactgggagat

SEQ ID NO: 8501500 - DNA, 22 bp, Homo sapiens
tgggagcaagctacttagggaa

SEQ ID NO: 8501501 - DNA, 20 bp, Homo sapiens
tgggagatgatctccttgct

SEQ ID NO: 8501502 - DNA, 22 bp, Homo sapiens
tgggagatggttctgagacttt

SEQ ID NO: 8501503 - DNA, 22 bp, Homo sapiens
tgggagagtgctcaatgtgcaa

SEQ ID NO: 8501504 - DNA, 22 bp, Homo sapiens
tgggagagtgctcaatgtgcaa

SEQ ID NO: 8501505 - DNA, 22 bp, Homo sapiens
tgggagagtgctcaatgtgcaa

SEQ ID NO: 8501506 - DNA, 22 bp, Homo sapiens
tgggagagtctaaaaccgaggt

SEQ ID NO: 8501507 - DNA, 21 bp, Homo sapiens
tgggagagggctcagctaccc

SEQ ID NO: 8501508 - DNA, 21 bp, Homo sapiens
tgggagagggctcagctaccc

SEQ ID NO: 8501509 - DNA, 21 bp, Homo sapiens
tgggagagggctcagctaccc

SEQ ID NO: 8501510 - DNA, 22 bp, Homo sapiens
tgggagaggctgccatcttgca

SEQ ID NO: 8501511 - DNA, 21 bp, Homo sapiens
tgggagagggctcagctaccc

SEQ ID NO: 8501512 - DNA, 22 bp, Homo sapiens
tgggagaggctgccatcttgca

SEQ ID NO: 8501513 - DNA, 19 bp, Homo sapiens
tgggagaggcaacagagta

SEQ ID NO: 8501514 - DNA, 19 bp, Homo sapiens
tgggagaggcaacagagta

SEQ ID NO: 8501515 - DNA, 19 bp, Homo sapiens
tgggagaggcaacagagta

SEQ ID NO: 8501516 - DNA, 22 bp, Homo sapiens
tgggagcaagctggtgctggag

SEQ ID NO: 8501517 - DNA, 22 bp, Homo sapiens
tgggagcaagctggtgctggag

SEQ ID NO: 8501518 - DNA, 22 bp, Homo sapiens
tgggagcaagctggtgctggag

SEQ ID NO: 8501519 - DNA, 22 bp, Homo sapiens
tgggagcaagctggtgctggag

SEQ ID NO: 8501520 - DNA, 22 bp, Homo sapiens
tgggagcaagctggtgctggag

SEQ ID NO: 8501521 - DNA, 22 bp, Homo sapiens
tgggagcaccctgaggagcttc

SEQ ID NO: 8501522 - DNA, 22 bp, Homo sapiens
tgggagcaagctggtgctggag

SEQ ID NO: 8501523 - DNA, 22 bp, Homo sapiens
tgggagcactctttgggaagca

SEQ ID NO: 8501524 - DNA, 22 bp, Homo sapiens
tgggagcactctttgggaagca

SEQ ID NO: 8501525 - DNA, 22 bp, Homo sapiens
tgggagcaccttgagggcagaa

SEQ ID NO: 8501526 - DNA, 22 bp, Homo sapiens
tgggagcaccttgagggcagaa

SEQ ID NO: 8501527 - DNA, 22 bp, Homo sapiens
tgggagcaccctgaggagcttc

SEQ ID NO: 8501528 - DNA, 22 bp, Homo sapiens
tgggagctcctggagggcagga

SEQ ID NO: 8501529 - DNA, 22 bp, Homo sapiens
tgggagcagctttgcgagggag

SEQ ID NO: 8501530 - DNA, 22 bp, Homo sapiens
tgggagcagctgggaacacagc

SEQ ID NO: 8501531 - DNA, 22 bp, Homo sapiens
tgggagcagccaacatggcctt

SEQ ID NO: 8501532 - DNA, 22 bp, Homo sapiens
tgggagcagccaacatggcctt

SEQ ID NO: 8501533 - DNA, 22 bp, Homo sapiens
tgggagcagccaacatggcctt

SEQ ID NO: 8501534 - DNA, 22 bp, Homo sapiens
tgggagcagcagggagatgcgg

SEQ ID NO: 8501535 - DNA, 22 bp, Homo sapiens
tgggagctggggttggacgtct

SEQ ID NO: 8501536 - DNA, 22 bp, Homo sapiens
tgggagctctgagcctgctgtg

SEQ ID NO: 8501537 - DNA, 22 bp, Homo sapiens
tgggaggaagtgctaatgggag

SEQ ID NO: 8501538 - DNA, 20 bp, Homo sapiens
tgggagctggtgaggtctca

SEQ ID NO: 8501539 - DNA, 22 bp, Homo sapiens
tgggagctggggttggacgtct

SEQ ID NO: 8501540 - DNA, 22 bp, Homo sapiens
tgggaggaatgtcactgagcca

SEQ ID NO: 8501541 - DNA, 22 bp, Homo sapiens
tgggaggaatgtcactgagcca

SEQ ID NO: 8501542 - DNA, 22 bp, Homo sapiens
tgggaggacttgtgggcttcat

SEQ ID NO: 8501543 - DNA, 22 bp, Homo sapiens
tgggaggacttgtgggcttcat

SEQ ID NO: 8501544 - DNA, 22 bp, Homo sapiens
tgggaggacttgtgggcttcat

SEQ ID NO: 8501545 - DNA, 22 bp, Homo sapiens
tgggaggagccctctgggaagg

SEQ ID NO: 8501546 - DNA, 22 bp, Homo sapiens
tgggaggagccctctgggaagg

SEQ ID NO: 8501547 - DNA, 22 bp, Homo sapiens
tgggaggatcgcttgagcccag

SEQ ID NO: 8501548 - DNA, 22 bp, Homo sapiens
tgggaggatcgcttgagcccag

SEQ ID NO: 8501549 - DNA, 22 bp, Homo sapiens
tgggaggatcgcttgagcccag

SEQ ID NO: 8501550 - DNA, 22 bp, Homo sapiens
tgggaggcaggtaggtgatgat

SEQ ID NO: 8501551 - DNA, 22 bp, Homo sapiens
tgggaggcagaagttgactgga

SEQ ID NO: 8501552 - DNA, 22 bp, Homo sapiens
tgggaggatctcttgaggccag

SEQ ID NO: 8501553 - DNA, 22 bp, Homo sapiens
tggctgggcccccacctgcctc

SEQ ID NO: 8501554 - DNA, 22 bp, Homo sapiens
tggctgggcccccacctgcctc

SEQ ID NO: 8501555 - DNA, 22 bp, Homo sapiens
tggctgggagctggaactgggc

SEQ ID NO: 8501556 - DNA, 22 bp, Homo sapiens
tggctgggagctggaactgggc

SEQ ID NO: 8501557 - DNA, 22 bp, Homo sapiens
tggctgggagctggaactgggc

SEQ ID NO: 8501558 - DNA, 22 bp, Homo sapiens
tggctgggagctggaactgggc

SEQ ID NO: 8501559 - DNA, 22 bp, Homo sapiens
tggctgggagctggaactgggc

SEQ ID NO: 8501560 - DNA, 22 bp, Homo sapiens
tggctggcgccgggctagccac

SEQ ID NO: 8501561 - DNA, 22 bp, Homo sapiens
tggctggcgccgggctagccac

SEQ ID NO: 8501562 - DNA, 22 bp, Homo sapiens
tggctggccctgggagtgcaga

SEQ ID NO: 8501563 - DNA, 22 bp, Homo sapiens
tggctggccctgggagtgcaga

SEQ ID NO: 8501564 - DNA, 22 bp, Homo sapiens
tggctggcatagccattgctcc

SEQ ID NO: 8501565 - DNA, 18 bp, Homo sapiens
tggctggcagtgggcagc

SEQ ID NO: 8501566 - DNA, 23 bp, Homo sapiens
tggctggcagaaactgaagcatg

SEQ ID NO: 8501567 - DNA, 22 bp, Homo sapiens
tggctggcagtaggctagtggc

SEQ ID NO: 8501568 - DNA, 22 bp, Homo sapiens
tggctggcagtaggctagtggc

SEQ ID NO: 8501569 - DNA, 19 bp, Homo sapiens
tggctggagatctgctact

SEQ ID NO: 8501570 - DNA, 22 bp, Homo sapiens
tggctggagagggtcccatgag

SEQ ID NO: 8501571 - DNA, 22 bp, Homo sapiens
tggctggagaacttggggatct

SEQ ID NO: 8501572 - DNA, 22 bp, Homo sapiens
tggctggacagtgggcagtgga

SEQ ID NO: 8501573 - DNA, 22 bp, Homo sapiens
tggctggacctgggctggaatt

SEQ ID NO: 8501574 - DNA, 22 bp, Homo sapiens
tggctggacagtgggcagtgga

SEQ ID NO: 8501575 - DNA, 22 bp, Homo sapiens
tggctggaatggagctgagcct

SEQ ID NO: 8501576 - DNA, 22 bp, Homo sapiens
tggctggaatggagctgagcct

SEQ ID NO: 8501577 - DNA, 22 bp, Homo sapiens
tggctggaatggagctgagcct

SEQ ID NO: 8501578 - DNA, 22 bp, Homo sapiens
tggctggaggaaggaactgagg

SEQ ID NO: 8501579 - DNA, 22 bp, Homo sapiens
tggctggaggcatgcaagctcc

SEQ ID NO: 8501580 - DNA, 22 bp, Homo sapiens
tggctggagggacccactcaga

SEQ ID NO: 8501581 - DNA, 22 bp, Homo sapiens
tggctggagcgccctcctctgc

SEQ ID NO: 8501582 - DNA, 22 bp, Homo sapiens
tggctggagcccctcaagagca

SEQ ID NO: 8501583 - DNA, 22 bp, Homo sapiens
tggctggagcattccttgtctt

SEQ ID NO: 8501584 - DNA, 22 bp, Homo sapiens
tggctggcaaggctggagtcag

SEQ ID NO: 8501585 - DNA, 22 bp, Homo sapiens
tggctggcaaggctggagtcag

SEQ ID NO: 8501586 - DNA, 22 bp, Homo sapiens
tggctggattattggctagtac

SEQ ID NO: 8501587 - DNA, 22 bp, Homo sapiens
tggctggatgtgagatcaagag

SEQ ID NO: 8501588 - DNA, 22 bp, Homo sapiens
tggctggattattggctagtac

SEQ ID NO: 8501589 - DNA, 22 bp, Homo sapiens
tggctggatatcagaggaagtg

SEQ ID NO: 8501590 - DNA, 22 bp, Homo sapiens
tggctggatatcaggcaagggg

SEQ ID NO: 8501591 - DNA, 22 bp, Homo sapiens
tggctggataatattctgttgt

SEQ ID NO: 8501592 - DNA, 22 bp, Homo sapiens
tggctggagtgggagaagttta

SEQ ID NO: 8501593 - DNA, 22 bp, Homo sapiens
tggctggagtgggagaagttta

SEQ ID NO: 8501594 - DNA, 21 bp, Homo sapiens
tggctggatagatgggaactg

SEQ ID NO: 8501595 - DNA, 22 bp, Homo sapiens
tggctggagtataggagtagga

SEQ ID NO: 8501596 - DNA, 22 bp, Homo sapiens
tggctggagggttagtgagata

SEQ ID NO: 8501597 - DNA, 22 bp, Homo sapiens
tggctggagtctggtgctagcc

SEQ ID NO: 8501598 - DNA, 22 bp, Homo sapiens
tggctggagtctggtgctagcc

SEQ ID NO: 8501599 - DNA, 22 bp, Homo sapiens
tggctggagtctggtgctagcc

SEQ ID NO: 8501600 - DNA, 22 bp, Homo sapiens
tggctggggagccccgactccc

SEQ ID NO: 8501601 - DNA, 19 bp, Homo sapiens
tggctgggcgtgcctccgt

SEQ ID NO: 8501602 - DNA, 19 bp, Homo sapiens
tggctgggcgtgcctccgt

SEQ ID NO: 8501603 - DNA, 22 bp, Homo sapiens
tggctgggccgggccttgtgcc

SEQ ID NO: 8501604 - DNA, 22 bp, Homo sapiens
tggctgggccgggccttgtgcc

SEQ ID NO: 8501605 - DNA, 22 bp, Homo sapiens
tggctgggccgggccttgtgcc

SEQ ID NO: 8501606 - DNA, 22 bp, Homo sapiens
tggctgggccgggccttgtgcc

SEQ ID NO: 8501607 - DNA, 22 bp, Homo sapiens
tggctggggccacagttttcct

SEQ ID NO: 8501608 - DNA, 22 bp, Homo sapiens
tggctggggcctgaatcctgca

SEQ ID NO: 8501609 - DNA, 22 bp, Homo sapiens
tggctggggcctgaatcctgca

SEQ ID NO: 8501610 - DNA, 22 bp, Homo sapiens
tggctggggagccccgactccc

SEQ ID NO: 8501611 - DNA, 22 bp, Homo sapiens
tggctggggccacagttttcct

SEQ ID NO: 8501612 - DNA, 22 bp, Homo sapiens
tggctggggccacagttttcct

SEQ ID NO: 8501613 - DNA, 19 bp, Homo sapiens
tggctgggtgccaatggcc

SEQ ID NO: 8501614 - DNA, 19 bp, Homo sapiens
tggctgggtgccaatggcc

SEQ ID NO: 8501615 - DNA, 22 bp, Homo sapiens
tggctgggggtgctatagctgc

SEQ ID NO: 8501616 - DNA, 22 bp, Homo sapiens
tggctgggggtgctatagctgc

SEQ ID NO: 8501617 - DNA, 22 bp, Homo sapiens
tggctgtcagctgcctggtgcg

SEQ ID NO: 8501618 - DNA, 22 bp, Homo sapiens
tggctgtagaacagtggatatt

SEQ ID NO: 8501619 - DNA, 22 bp, Homo sapiens
tggctggttttggtgagctccg

SEQ ID NO: 8501620 - DNA, 22 bp, Homo sapiens
tggctggtcacatggtaggtct

SEQ ID NO: 8501621 - DNA, 22 bp, Homo sapiens
tggctgggtgctatccagtact

SEQ ID NO: 8501622 - DNA, 22 bp, Homo sapiens
tggctgggtgctatccagtact

SEQ ID NO: 8501623 - DNA, 19 bp, Homo sapiens
tggctgtggggaaatgctt

SEQ ID NO: 8501624 - DNA, 20 bp, Homo sapiens
tggctgtgggcatctgtttc

SEQ ID NO: 8501625 - DNA, 19 bp, Homo sapiens
tggctgtggggaaatgctt

SEQ ID NO: 8501626 - DNA, 22 bp, Homo sapiens
tggctgtggtttatcccagttc

SEQ ID NO: 8501627 - DNA, 22 bp, Homo sapiens
tggctgtgggtggaaggaaacc

SEQ ID NO: 8501628 - DNA, 22 bp, Homo sapiens
tggctgtgggatgagagcctca

SEQ ID NO: 8501629 - DNA, 22 bp, Homo sapiens
tggctgtgggatatgtgactga

SEQ ID NO: 8501630 - DNA, 22 bp, Homo sapiens
tggctgtggactcagatggctc

SEQ ID NO: 8501631 - DNA, 22 bp, Homo sapiens
tggctgtgcggcctcgggcaga

SEQ ID NO: 8501632 - DNA, 22 bp, Homo sapiens
tggctgtgcctctttccaggcc

SEQ ID NO: 8501633 - DNA, 22 bp, Homo sapiens
tggctgtgcctctttccaggcc

SEQ ID NO: 8501634 - DNA, 22 bp, Homo sapiens
tggctgtgcctctttccaggcc

SEQ ID NO: 8501635 - DNA, 22 bp, Homo sapiens
tggctgtgatttgcacgagatg

SEQ ID NO: 8501636 - DNA, 22 bp, Homo sapiens
tggctgtgaatggcaaataatc

SEQ ID NO: 8501637 - DNA, 22 bp, Homo sapiens
tggctgtgaacaaagagaataa

SEQ ID NO: 8501638 - DNA, 22 bp, Homo sapiens
tggctgtcagtcgcctgcattc

SEQ ID NO: 8501639 - DNA, 22 bp, Homo sapiens
tggcttagttctagaaatttgg

SEQ ID NO: 8501640 - DNA, 22 bp, Homo sapiens
tggcttcaaaatctagtggtct

SEQ ID NO: 8501641 - DNA, 22 bp, Homo sapiens
tggcttcaaaatctagtggtct

SEQ ID NO: 8501642 - DNA, 22 bp, Homo sapiens
tggcttcaaaggtagcatacaa

SEQ ID NO: 8501643 - DNA, 22 bp, Homo sapiens
tggcttcaaaggtagcatacaa

SEQ ID NO: 8501644 - DNA, 22 bp, Homo sapiens
tggcttcaagtctaggttctac

SEQ ID NO: 8501645 - DNA, 22 bp, Homo sapiens
tggcttcaagtctaggttctac

SEQ ID NO: 8501646 - DNA, 22 bp, Homo sapiens
tggctgtgttaccacttcatgt

SEQ ID NO: 8501647 - DNA, 22 bp, Homo sapiens
tggctgtgttaccacttcatgt

SEQ ID NO: 8501648 - DNA, 22 bp, Homo sapiens
tggctgtgtgccaggctgtctg

SEQ ID NO: 8501649 - DNA, 22 bp, Homo sapiens
tggctgtgtccctgtccagagt

SEQ ID NO: 8501650 - DNA, 22 bp, Homo sapiens
tggctgtgtcatcatagctgtg

SEQ ID NO: 8501651 - DNA, 22 bp, Homo sapiens
tggcttctgggacttgtgagca

SEQ ID NO: 8501652 - DNA, 22 bp, Homo sapiens
tggcttctgggacttgtgagca

SEQ ID NO: 8501653 - DNA, 22 bp, Homo sapiens
tggcttctggctggtgagaaat

SEQ ID NO: 8501654 - DNA, 22 bp, Homo sapiens
tggcttctggctggtgagaaat

SEQ ID NO: 8501655 - DNA, 19 bp, Homo sapiens
tggcttctgttttcatgtt

SEQ ID NO: 8501656 - DNA, 19 bp, Homo sapiens
tggcttctgttttcatgtt

SEQ ID NO: 8501657 - DNA, 22 bp, Homo sapiens
tggcttctgtccctgctacatt

SEQ ID NO: 8501658 - DNA, 22 bp, Homo sapiens
tggcttctgtccctgctacatt

SEQ ID NO: 8501659 - DNA, 19 bp, Homo sapiens
tggcttctgttttcatgtt

SEQ ID NO: 8501660 - DNA, 19 bp, Homo sapiens
tggcttctgttttcatgtt

SEQ ID NO: 8501661 - DNA, 22 bp, Homo sapiens
tggcttctggggtggcctgcat

SEQ ID NO: 8501662 - DNA, 22 bp, Homo sapiens
tggcttctgctttcagtggagg

SEQ ID NO: 8501663 - DNA, 22 bp, Homo sapiens
tggcttctgctttcagtggagg

SEQ ID NO: 8501664 - DNA, 22 bp, Homo sapiens
tggcttctggccaggcacagga

SEQ ID NO: 8501665 - DNA, 22 bp, Homo sapiens
tggcttctgctttcagtggagg

SEQ ID NO: 8501666 - DNA, 23 bp, Homo sapiens
tggcttctgccccattctctcca

SEQ ID NO: 8501667 - DNA, 23 bp, Homo sapiens
tggcttctgccccattctctcca

SEQ ID NO: 8501668 - DNA, 23 bp, Homo sapiens
tggcttctgccccattctctcca

SEQ ID NO: 8501669 - DNA, 18 bp, Homo sapiens
tggcttctgctagctgga

SEQ ID NO: 8501670 - DNA, 18 bp, Homo sapiens
tggcttctgctagctgga

SEQ ID NO: 8501671 - DNA, 22 bp, Homo sapiens
tggcttctgcatatttttagag

SEQ ID NO: 8501672 - DNA, 21 bp, Homo sapiens
tggcttctgccaatgttaaga

SEQ ID NO: 8501673 - DNA, 23 bp, Homo sapiens
tggcttctgccccattctctcca

SEQ ID NO: 8501674 - DNA, 20 bp, Homo sapiens
tggcttctcttcactcctgt

SEQ ID NO: 8501675 - DNA, 18 bp, Homo sapiens
tggcttctgaacaactgc

SEQ ID NO: 8501676 - DNA, 20 bp, Homo sapiens
tggcttctcttcactcctgt

SEQ ID NO: 8501677 - DNA, 22 bp, Homo sapiens
tggcttctctgttttagtattt

SEQ ID NO: 8501678 - DNA, 22 bp, Homo sapiens
tggcttctctgttttagtattt

SEQ ID NO: 8501679 - DNA, 22 bp, Homo sapiens
tggcttctctgtgtgagggaga

SEQ ID NO: 8501680 - DNA, 22 bp, Homo sapiens
tggcttctgagtctcctgacat

SEQ ID NO: 8501681 - DNA, 22 bp, Homo sapiens
tggcttctgagtctcctgacat

SEQ ID NO: 8501682 - DNA, 22 bp, Homo sapiens
tggcttctgcatatttttagag

SEQ ID NO: 8501683 - DNA, 22 bp, Homo sapiens
tggcttctgagcattgaaacgt

SEQ ID NO: 8501684 - DNA, 18 bp, Homo sapiens
tggcttctgaacaactgc

SEQ ID NO: 8501685 - DNA, 22 bp, Homo sapiens
tggcttctgagcattgaaacgt

SEQ ID NO: 8501686 - DNA, 22 bp, Homo sapiens
tggcttctccctccccatctag

SEQ ID NO: 8501687 - DNA, 22 bp, Homo sapiens
tggcttctccctacaacatgcc

SEQ ID NO: 8501688 - DNA, 22 bp, Homo sapiens
tggcttctcccgacaccctggc

SEQ ID NO: 8501689 - DNA, 22 bp, Homo sapiens
tggcttctcccgacaccctggc

SEQ ID NO: 8501690 - DNA, 22 bp, Homo sapiens
tggcttctccagaaatcttggt

SEQ ID NO: 8501691 - DNA, 22 bp, Homo sapiens
tggcttctccctccccatctag

SEQ ID NO: 8501692 - DNA, 22 bp, Homo sapiens
tggcttctcgcctgtcatcccg

SEQ ID NO: 8501693 - DNA, 22 bp, Homo sapiens
tggcttctccctctgcctgatt

SEQ ID NO: 8501694 - DNA, 22 bp, Homo sapiens
tggcttctccctctgcctgatt

SEQ ID NO: 8501695 - DNA, 22 bp, Homo sapiens
tggcttctcgcctgtcatcccg

SEQ ID NO: 8501696 - DNA, 22 bp, Homo sapiens
tggcttcctgcacagtgtctgc

SEQ ID NO: 8501697 - DNA, 22 bp, Homo sapiens
tggcttcctgcacagtgtctgc

SEQ ID NO: 8501698 - DNA, 22 bp, Homo sapiens
tggcttcctgcatggatcctct

SEQ ID NO: 8501699 - DNA, 22 bp, Homo sapiens
tggcttcctgcatggatcctct

SEQ ID NO: 8501700 - DNA, 19 bp, Homo sapiens
tggcttcctgactctcatc

SEQ ID NO: 8501701 - DNA, 19 bp, Homo sapiens
tggcttcctgactctcatc

SEQ ID NO: 8501702 - DNA, 22 bp, Homo sapiens
tggcttcctgcacagtgtctgc

SEQ ID NO: 8501703 - DNA, 22 bp, Homo sapiens
tggcttcctaggagcccgtgct

SEQ ID NO: 8501704 - DNA, 22 bp, Homo sapiens
tggcttcctccagagcaggagg

SEQ ID NO: 8501705 - DNA, 22 bp, Homo sapiens
tggcttcctaaactgatttcca

SEQ ID NO: 8501706 - DNA, 17 bp, Homo sapiens
tggcttccctgggccac

SEQ ID NO: 8501707 - DNA, 22 bp, Homo sapiens
tggcttccgccgcgggcctcgg

SEQ ID NO: 8501708 - DNA, 17 bp, Homo sapiens
tggcttccctgggccac

SEQ ID NO: 8501709 - DNA, 22 bp, Homo sapiens
tggcttcagagtctgagttctt

SEQ ID NO: 8501710 - DNA, 22 bp, Homo sapiens
tggcttcagagacagaatctat

SEQ ID NO: 8501711 - DNA, 22 bp, Homo sapiens
tggcttcagagacagaatctat

SEQ ID NO: 8501712 - DNA, 22 bp, Homo sapiens
tggcttcactgctcaagtgatt

SEQ ID NO: 8501713 - DNA, 22 bp, Homo sapiens
tggcttcctgtgtaatgaggtg

SEQ ID NO: 8501714 - DNA, 22 bp, Homo sapiens
tggcttcctggacagatgcggt

SEQ ID NO: 8501715 - DNA, 22 bp, Homo sapiens
tggcttcctggacagatgcggt

SEQ ID NO: 8501716 - DNA, 22 bp, Homo sapiens
tggcttctaaagtttcttttag

SEQ ID NO: 8501717 - DNA, 22 bp, Homo sapiens
tggcttcctgtttcccagaaag

SEQ ID NO: 8501718 - DNA, 22 bp, Homo sapiens
tggcttctagtttgaggaaaaa

SEQ ID NO: 8501719 - DNA, 22 bp, Homo sapiens
tggcttctagagcccatccttc

SEQ ID NO: 8501720 - DNA, 22 bp, Homo sapiens
tggcttctagcagtgttgattt

SEQ ID NO: 8501721 - DNA, 22 bp, Homo sapiens
tggcttctagagcccatccttc

SEQ ID NO: 8501722 - DNA, 22 bp, Homo sapiens
tggcttctattgctgtggcatt

SEQ ID NO: 8501723 - DNA, 18 bp, Homo sapiens
tggcttctattttactca

SEQ ID NO: 8501724 - DNA, 22 bp, Homo sapiens
tggcttctattgctgtggcatt

SEQ ID NO: 8501725 - DNA, 22 bp, Homo sapiens
tggcttctcagaatactctgga

SEQ ID NO: 8501726 - DNA, 22 bp, Homo sapiens
tggcttctcagaatactctgga

SEQ ID NO: 8501727 - DNA, 22 bp, Homo sapiens
tggcttctcagtttcataatga

SEQ ID NO: 8501728 - DNA, 22 bp, Homo sapiens
tggcttctcatttgcattaaac

SEQ ID NO: 8501729 - DNA, 22 bp, Homo sapiens
tgggaacaacatgcactgccac

SEQ ID NO: 8501730 - DNA, 22 bp, Homo sapiens
tgggaacaacatgcactgccac

SEQ ID NO: 8501731 - DNA, 22 bp, Homo sapiens
tgggaaattgtatttctatttc

SEQ ID NO: 8501732 - DNA, 22 bp, Homo sapiens
tgggaacacctgctgcccagtg

SEQ ID NO: 8501733 - DNA, 22 bp, Homo sapiens
tgggaaattgtatttctatttc

SEQ ID NO: 8501734 - DNA, 22 bp, Homo sapiens
tgggaaatattctaaaagtctt

SEQ ID NO: 8501735 - DNA, 22 bp, Homo sapiens
tgggaaagtgttgaggtgtctt

SEQ ID NO: 8501736 - DNA, 22 bp, Homo sapiens
tgggaaatataatttagctgtg

SEQ ID NO: 8501737 - DNA, 22 bp, Homo sapiens
tgggaaagtgttgaggtgtctt

SEQ ID NO: 8501738 - DNA, 22 bp, Homo sapiens
tgggaaagtgtagcctgcaggc

SEQ ID NO: 8501739 - DNA, 22 bp, Homo sapiens
tgggaaagtgtagcctgcaggc

SEQ ID NO: 8501740 - DNA, 22 bp, Homo sapiens
tgggaagaagcagagaactgga

SEQ ID NO: 8501741 - DNA, 22 bp, Homo sapiens
tgggaagaagcagagaactgga

SEQ ID NO: 8501742 - DNA, 22 bp, Homo sapiens
tgggaagaagcagagaactgga

SEQ ID NO: 8501743 - DNA, 22 bp, Homo sapiens
tgggaagactcctcaggaggcg

SEQ ID NO: 8501744 - DNA, 22 bp, Homo sapiens
tgggaagactcctcaggaggcg

SEQ ID NO: 8501745 - DNA, 22 bp, Homo sapiens
tgggaagactcctcaggaggcg

SEQ ID NO: 8501746 - DNA, 22 bp, Homo sapiens
tgggaagaggagcactggaatg

SEQ ID NO: 8501747 - DNA, 22 bp, Homo sapiens
tgggaagaggcgggaggctgtt

SEQ ID NO: 8501748 - DNA, 22 bp, Homo sapiens
tgggaagaggatgaggcatatg

SEQ ID NO: 8501749 - DNA, 21 bp, Homo sapiens
tggctttgccctgcttgcccc

SEQ ID NO: 8501750 - DNA, 22 bp, Homo sapiens
tggctttgaaatccagtcatta

SEQ ID NO: 8501751 - DNA, 22 bp, Homo sapiens
tgggaaagtaattgtcatcctt

SEQ ID NO: 8501752 - DNA, 22 bp, Homo sapiens
tgggaaagtaattgtcatcctt

SEQ ID NO: 8501753 - DNA, 22 bp, Homo sapiens
tgggaaagtaattgtcatcctt

SEQ ID NO: 8501754 - DNA, 22 bp, Homo sapiens
tggcttcttgggatgggtcatt

SEQ ID NO: 8501755 - DNA, 22 bp, Homo sapiens
tggcttcttgatcttggacttg

SEQ ID NO: 8501756 - DNA, 18 bp, Homo sapiens
tggcttcttgagctaaca

SEQ ID NO: 8501757 - DNA, 22 bp, Homo sapiens
tggcttcttgacttcttggctg

SEQ ID NO: 8501758 - DNA, 22 bp, Homo sapiens
tggcttcttgacttcttggctg

SEQ ID NO: 8501759 - DNA, 22 bp, Homo sapiens
tggcttcttagaccagtggcct

SEQ ID NO: 8501760 - DNA, 22 bp, Homo sapiens
tggcttcttagaccagtggcct

SEQ ID NO: 8501761 - DNA, 22 bp, Homo sapiens
tggcttcttagaccagtggcct

SEQ ID NO: 8501762 - DNA, 19 bp, Homo sapiens
tggcttcttcggtgttccc

SEQ ID NO: 8501763 - DNA, 22 bp, Homo sapiens
tggcttcttcatatgtgatctt

SEQ ID NO: 8501764 - DNA, 22 bp, Homo sapiens
tggctttcgctatagagcacgg

SEQ ID NO: 8501765 - DNA, 22 bp, Homo sapiens
tggctttctcccccagcttctc

SEQ ID NO: 8501766 - DNA, 22 bp, Homo sapiens
tggctttataaatccactggtt

SEQ ID NO: 8501767 - DNA, 22 bp, Homo sapiens
tggcttcttgggatgggtcatt

SEQ ID NO: 8501768 - DNA, 22 bp, Homo sapiens
tggcctggctcacagtgagatt

SEQ ID NO: 8501769 - DNA, 22 bp, Homo sapiens
tggcctggctcacagtgagatt

SEQ ID NO: 8501770 - DNA, 22 bp, Homo sapiens
tggcctggctcacagtgagatt

SEQ ID NO: 8501771 - DNA, 22 bp, Homo sapiens
tggcctgggtcacaccagggtc

SEQ ID NO: 8501772 - DNA, 22 bp, Homo sapiens
tggcctggccctgaggccctgt

SEQ ID NO: 8501773 - DNA, 22 bp, Homo sapiens
tggcctggccctgaggccctgt

SEQ ID NO: 8501774 - DNA, 22 bp, Homo sapiens
tggcctggctcacagtgagatt

SEQ ID NO: 8501775 - DNA, 22 bp, Homo sapiens
tggcctgggtgctgctgacatc

SEQ ID NO: 8501776 - DNA, 22 bp, Homo sapiens
tggcctgggtgctgctgacatc

SEQ ID NO: 8501777 - DNA, 22 bp, Homo sapiens
tggcctgggtgctgctgacatc

SEQ ID NO: 8501778 - DNA, 22 bp, Homo sapiens
tggcctggtaccacatagattt

SEQ ID NO: 8501779 - DNA, 22 bp, Homo sapiens
tggcctggtgctcaggcagtag

SEQ ID NO: 8501780 - DNA, 22 bp, Homo sapiens
tggcctggtgctcaggcagtag

SEQ ID NO: 8501781 - DNA, 22 bp, Homo sapiens
tggcctggtgctcaggcagtag

SEQ ID NO: 8501782 - DNA, 22 bp, Homo sapiens
tggcctggtccttgtcaaggca

SEQ ID NO: 8501783 - DNA, 22 bp, Homo sapiens
tggcctggtgtctgcgaggcct

SEQ ID NO: 8501784 - DNA, 22 bp, Homo sapiens
tggcctggtgtctgcgaggcct

SEQ ID NO: 8501785 - DNA, 22 bp, Homo sapiens
tggcctggttgttgctgccgtt

SEQ ID NO: 8501786 - DNA, 22 bp, Homo sapiens
tggcctggttgttgctgccgtt

SEQ ID NO: 8501787 - DNA, 22 bp, Homo sapiens
tggcctggttgttgctgccgtt

SEQ ID NO: 8501788 - DNA, 22 bp, Homo sapiens
tggcctggtgtctgcgaggcct

SEQ ID NO: 8501789 - DNA, 22 bp, Homo sapiens
tggcctggttatattgctatca

SEQ ID NO: 8501790 - DNA, 22 bp, Homo sapiens
tggcctggttgttgctgccgtt

SEQ ID NO: 8501791 - DNA, 22 bp, Homo sapiens
tggcctggttatattgctatca

SEQ ID NO: 8501792 - DNA, 22 bp, Homo sapiens
tggccttggagaggcacggccc

SEQ ID NO: 8501793 - DNA, 22 bp, Homo sapiens
tggccttggcagtgagaagagt

SEQ ID NO: 8501794 - DNA, 22 bp, Homo sapiens
tggccttcctggtgactcatga

SEQ ID NO: 8501795 - DNA, 22 bp, Homo sapiens
tggccttcctggtgactcatga

SEQ ID NO: 8501796 - DNA, 22 bp, Homo sapiens
tggcctgtcttgttgtgctaga

SEQ ID NO: 8501797 - DNA, 22 bp, Homo sapiens
tggcctgtcttgttgtgctaga

SEQ ID NO: 8501798 - DNA, 22 bp, Homo sapiens
tggcctgtggcttaaggtctgt

SEQ ID NO: 8501799 - DNA, 20 bp, Homo sapiens
tggccttggggagctcacac

SEQ ID NO: 8501800 - DNA, 22 bp, Homo sapiens
tggccttgtgtttaagcaagaa

SEQ ID NO: 8501801 - DNA, 22 bp, Homo sapiens
tggccttgtgtttaagcaagaa

SEQ ID NO: 8501802 - DNA, 22 bp, Homo sapiens
tggcgcagtttctctgctgcct

SEQ ID NO: 8501803 - DNA, 18 bp, Homo sapiens
tggcgatggtcatttttc

SEQ ID NO: 8501804 - DNA, 22 bp, Homo sapiens
tggcgagccccgactgagtgtt

SEQ ID NO: 8501805 - DNA, 22 bp, Homo sapiens
tggctcagaaggctgccttcac

SEQ ID NO: 8501806 - DNA, 22 bp, Homo sapiens
tggctcagagagggagtgtgga

SEQ ID NO: 8501807 - DNA, 22 bp, Homo sapiens
tggctcagagagggagtgtgga

SEQ ID NO: 8501808 - DNA, 22 bp, Homo sapiens
tggctcagagccttgagagctg

SEQ ID NO: 8501809 - DNA, 22 bp, Homo sapiens
tggctcagagcagggactctgg

SEQ ID NO: 8501810 - DNA, 22 bp, Homo sapiens
tggctcagatgctcttccagtg

SEQ ID NO: 8501811 - DNA, 22 bp, Homo sapiens
tggctcagatgctcttccagtg

SEQ ID NO: 8501812 - DNA, 22 bp, Homo sapiens
tggctcagatttttgtaggctt

SEQ ID NO: 8501813 - DNA, 22 bp, Homo sapiens
tggctcagatttttgtaggctt

SEQ ID NO: 8501814 - DNA, 22 bp, Homo sapiens
tggctcagataattcaaggggc

SEQ ID NO: 8501815 - DNA, 22 bp, Homo sapiens
tggctatgacttcgtactgtct

SEQ ID NO: 8501816 - DNA, 22 bp, Homo sapiens
tggctatggtattgatgggttt

SEQ ID NO: 8501817 - DNA, 22 bp, Homo sapiens
tggctcaagtaacaaaaatata

SEQ ID NO: 8501818 - DNA, 22 bp, Homo sapiens
tggctcacaatctcccatgaag

SEQ ID NO: 8501819 - DNA, 22 bp, Homo sapiens
tggctcaccttcagaatatacc

SEQ ID NO: 8501820 - DNA, 22 bp, Homo sapiens
tggctcacaggactctctgggc

SEQ ID NO: 8501821 - DNA, 22 bp, Homo sapiens
tggctcagaactacttctagtt

SEQ ID NO: 8501822 - DNA, 22 bp, Homo sapiens
tggctcactgtagccttgacct

SEQ ID NO: 8501823 - DNA, 22 bp, Homo sapiens
tggctcacttccgtggagaggt

SEQ ID NO: 8501824 - DNA, 22 bp, Homo sapiens
tggctcagaactacttctagtt

SEQ ID NO: 8501825 - DNA, 22 bp, Homo sapiens
tggctcagaagaaaaggtaaac

SEQ ID NO: 8501826 - DNA, 21 bp, Homo sapiens
tggcggggacttgtggctgcc

SEQ ID NO: 8501827 - DNA, 17 bp, Homo sapiens
tggcgctcccagggtgc

SEQ ID NO: 8501828 - DNA, 22 bp, Homo sapiens
tggcgcgacgtgccccctgctt

SEQ ID NO: 8501829 - DNA, 22 bp, Homo sapiens
tggcggggcagctctggcttct

SEQ ID NO: 8501830 - DNA, 20 bp, Homo sapiens
tggcggggatgagggagtta

SEQ ID NO: 8501831 - DNA, 22 bp, Homo sapiens
tggcgtgccctccagacttggc

SEQ ID NO: 8501832 - DNA, 22 bp, Homo sapiens
tggcgtctctcataagtatgtg

SEQ ID NO: 8501833 - DNA, 21 bp, Homo sapiens
tggctaaaccctagtaaatta

SEQ ID NO: 8501834 - DNA, 22 bp, Homo sapiens
tggctaaaccctagtaaattaa

SEQ ID NO: 8501835 - DNA, 22 bp, Homo sapiens
tggctaaacttgggtcagatgt

SEQ ID NO: 8501836 - DNA, 21 bp, Homo sapiens
tggctaaaccctagtaaatta

SEQ ID NO: 8501837 - DNA, 22 bp, Homo sapiens
tggctaaacttgggtcagatgt

SEQ ID NO: 8501838 - DNA, 22 bp, Homo sapiens
tggctagtaggtgagtagtgct

SEQ ID NO: 8501839 - DNA, 23 bp, Homo sapiens
tggctaaaggctctagtcctgct

SEQ ID NO: 8501840 - DNA, 22 bp, Homo sapiens
tggctccatcatccatgcaaga

SEQ ID NO: 8501841 - DNA, 22 bp, Homo sapiens
tggctccatgatagttcttaca

SEQ ID NO: 8501842 - DNA, 22 bp, Homo sapiens
tggctccattctttatgagttg

SEQ ID NO: 8501843 - DNA, 22 bp, Homo sapiens
tggctcctaggatggtgcctgg

SEQ ID NO: 8501844 - DNA, 22 bp, Homo sapiens
tggctcctatcaaggagtgggt

SEQ ID NO: 8501845 - DNA, 22 bp, Homo sapiens
tggctcctatcaaggagtgggt

SEQ ID NO: 8501846 - DNA, 20 bp, Homo sapiens
tggctcctcttggctgtggc

SEQ ID NO: 8501847 - DNA, 22 bp, Homo sapiens
tggctcctcatcacagttggtg

SEQ ID NO: 8501848 - DNA, 22 bp, Homo sapiens
tggctcctcacgtcctcagagc

SEQ ID NO: 8501849 - DNA, 22 bp, Homo sapiens
tggctcctcacgtcctcagagc

SEQ ID NO: 8501850 - DNA, 18 bp, Homo sapiens
tggctcctgcctcctgca

SEQ ID NO: 8501851 - DNA, 22 bp, Homo sapiens
tggctcctgcatttgtgctaac

SEQ ID NO: 8501852 - DNA, 19 bp, Homo sapiens
tggctcctgcctgccttct

SEQ ID NO: 8501853 - DNA, 20 bp, Homo sapiens
tggctcctgcggtggaacca

SEQ ID NO: 8501854 - DNA, 20 bp, Homo sapiens
tggctcctgcggtggaacca

SEQ ID NO: 8501855 - DNA, 22 bp, Homo sapiens
tggctccagatctgtctcctgt

SEQ ID NO: 8501856 - DNA, 22 bp, Homo sapiens
tggctccagatctgtctcctgt

SEQ ID NO: 8501857 - DNA, 22 bp, Homo sapiens
tggctccagatttcctgctgca

SEQ ID NO: 8501858 - DNA, 22 bp, Homo sapiens
tggctccagatttcctgctgca

SEQ ID NO: 8501859 - DNA, 22 bp, Homo sapiens
tggctccactactgggtgtgtt

SEQ ID NO: 8501860 - DNA, 22 bp, Homo sapiens
tggctccactctccaggagttt

SEQ ID NO: 8501861 - DNA, 22 bp, Homo sapiens
tggctccagaagggagggcgcc

SEQ ID NO: 8501862 - DNA, 22 bp, Homo sapiens
tggctccaccgccgcggagctc

SEQ ID NO: 8501863 - DNA, 22 bp, Homo sapiens
tggctccactactgggtgtgtt

SEQ ID NO: 8501864 - DNA, 22 bp, Homo sapiens
tggctccagcgtccacgtcctg

SEQ ID NO: 8501865 - DNA, 22 bp, Homo sapiens
tggctccagccctgagcaagct

SEQ ID NO: 8501866 - DNA, 22 bp, Homo sapiens
tggctccagccctgagcaagct

SEQ ID NO: 8501867 - DNA, 22 bp, Homo sapiens
tggctccagatttcctgctgca

SEQ ID NO: 8501868 - DNA, 22 bp, Homo sapiens
tggctccagctcaagtatggca

SEQ ID NO: 8501869 - DNA, 23 bp, Homo sapiens
tggctccaggagaagccagaagc

SEQ ID NO: 8501870 - DNA, 22 bp, Homo sapiens
tggctcagttaggtcagaaaca

SEQ ID NO: 8501871 - DNA, 22 bp, Homo sapiens
tggctcagttccatcatctgga

SEQ ID NO: 8501872 - DNA, 22 bp, Homo sapiens
tggctccaaatcaactgctgtt

SEQ ID NO: 8501873 - DNA, 22 bp, Homo sapiens
tggctccaaatcaactgctgtt

SEQ ID NO: 8501874 - DNA, 22 bp, Homo sapiens
tggctccaaaaacaaatgacat

SEQ ID NO: 8501875 - DNA, 21 bp, Homo sapiens
tggctcagttgctgggcacag

SEQ ID NO: 8501876 - DNA, 22 bp, Homo sapiens
tggctcatggaattagctatta

SEQ ID NO: 8501877 - DNA, 22 bp, Homo sapiens
tggctcattctactctccctgg

SEQ ID NO: 8501878 - DNA, 22 bp, Homo sapiens
tggctcattctttagaatatac

SEQ ID NO: 8501879 - DNA, 22 bp, Homo sapiens
tggctcaggcttgaaaatagat

SEQ ID NO: 8501880 - DNA, 22 bp, Homo sapiens
tggctcaggcctacgacgcctt

SEQ ID NO: 8501881 - DNA, 22 bp, Homo sapiens
tggctcaggatctaagcagaat

SEQ ID NO: 8501882 - DNA, 22 bp, Homo sapiens
tggctcagctttccccatctgg

SEQ ID NO: 8501883 - DNA, 22 bp, Homo sapiens
tggctcagctttccccatctgg

SEQ ID NO: 8501884 - DNA, 22 bp, Homo sapiens
tggctcaggagggatctttgct

SEQ ID NO: 8501885 - DNA, 22 bp, Homo sapiens
tggctcagccagccctaggaac

SEQ ID NO: 8501886 - DNA, 22 bp, Homo sapiens
tggctcagccagccctaggaac

SEQ ID NO: 8501887 - DNA, 22 bp, Homo sapiens
tggctcagcttacttttgaggg

SEQ ID NO: 8501888 - DNA, 22 bp, Homo sapiens
tggctcagcattcactggtctt

SEQ ID NO: 8501889 - DNA, 22 bp, Homo sapiens
tggctcagcaagacattgacct

SEQ ID NO: 8501890 - DNA, 22 bp, Homo sapiens
tggctcagtggcagccgcagct

SEQ ID NO: 8501891 - DNA, 22 bp, Homo sapiens
tggctcagtggcagccgcagct

SEQ ID NO: 8501892 - DNA, 22 bp, Homo sapiens
tggctcagtgcattcacagtaa

SEQ ID NO: 8501893 - DNA, 22 bp, Homo sapiens
tggctcagtgcattcacagtaa

SEQ ID NO: 8501894 - DNA, 22 bp, Homo sapiens
tggctcagtctgggttgactga

SEQ ID NO: 8501895 - DNA, 22 bp, Homo sapiens
tggctcagtgaagagataactt

SEQ ID NO: 8501896 - DNA, 22 bp, Homo sapiens
tggctcagtcatggatgagtaa

SEQ ID NO: 8501897 - DNA, 22 bp, Homo sapiens
tggctcagtcatggatgagtaa

SEQ ID NO: 8501898 - DNA, 22 bp, Homo sapiens
tggctcaggtgtgagctgaaga

SEQ ID NO: 8501899 - DNA, 22 bp, Homo sapiens
tggctcagtagcagtgtggtca

SEQ ID NO: 8501900 - DNA, 22 bp, Homo sapiens
tggctcagtagcagtgtggtca

SEQ ID NO: 8501901 - DNA, 22 bp, Homo sapiens
tggctcaggggtctggctctgt

SEQ ID NO: 8501902 - DNA, 22 bp, Homo sapiens
tggctcaggggtctggctctgt

SEQ ID NO: 8501903 - DNA, 22 bp, Homo sapiens
tggctcagggtccccaaatggt

SEQ ID NO: 8501904 - DNA, 23 bp, Homo sapiens
tggctcagggtctcttatgaagt

SEQ ID NO: 8501905 - DNA, 23 bp, Homo sapiens
tggctcagggtctcttatgaagt

SEQ ID NO: 8501906 - DNA, 22 bp, Homo sapiens
tggctgagtgaacatgtccatt

SEQ ID NO: 8501907 - DNA, 22 bp, Homo sapiens
tggctgagtgatatttgcaaag

SEQ ID NO: 8501908 - DNA, 21 bp, Homo sapiens
tggctgagtggatgcatgaat

SEQ ID NO: 8501909 - DNA, 22 bp, Homo sapiens
tggctgagtgttccaaggagca

SEQ ID NO: 8501910 - DNA, 22 bp, Homo sapiens
tggctgagttcctggcacacgg

SEQ ID NO: 8501911 - DNA, 22 bp, Homo sapiens
tggctgagttcctggcacacgg

SEQ ID NO: 8501912 - DNA, 22 bp, Homo sapiens
tggctgagttacgaacagagca

SEQ ID NO: 8501913 - DNA, 22 bp, Homo sapiens
tggctgagtgttccaaggagca

SEQ ID NO: 8501914 - DNA, 22 bp, Homo sapiens
tggctgagttctccaggagtag

SEQ ID NO: 8501915 - DNA, 22 bp, Homo sapiens
tggctgagttctccaggagtag

SEQ ID NO: 8501916 - DNA, 22 bp, Homo sapiens
tggctgagtttcatgcatcatg

SEQ ID NO: 8501917 - DNA, 22 bp, Homo sapiens
tggctgcagatcaagggcaggc

SEQ ID NO: 8501918 - DNA, 22 bp, Homo sapiens
tggctgcagatctgtgggacac

SEQ ID NO: 8501919 - DNA, 22 bp, Homo sapiens
tggctgcagacacctatggcag

SEQ ID NO: 8501920 - DNA, 22 bp, Homo sapiens
tggctgcagaacctcctcagga

SEQ ID NO: 8501921 - DNA, 20 bp, Homo sapiens
tggctgcacaccaggacagg

SEQ ID NO: 8501922 - DNA, 21 bp, Homo sapiens
tggctgcactgtggctttcat

SEQ ID NO: 8501923 - DNA, 21 bp, Homo sapiens
tggctgctggccctctctcca

SEQ ID NO: 8501924 - DNA, 21 bp, Homo sapiens
tggctgctggccctctctcca

SEQ ID NO: 8501925 - DNA, 22 bp, Homo sapiens
tggctgctgcttggtcttcttc

SEQ ID NO: 8501926 - DNA, 22 bp, Homo sapiens
tggctgctgcttggtcttcttc

SEQ ID NO: 8501927 - DNA, 22 bp, Homo sapiens
tggctgctgctcactcagcctc

SEQ ID NO: 8501928 - DNA, 22 bp, Homo sapiens
tggctgctgcagacagacagga

SEQ ID NO: 8501929 - DNA, 22 bp, Homo sapiens
tggctggaaacaggagattcag

SEQ ID NO: 8501930 - DNA, 22 bp, Homo sapiens
tggctggaaacaggagattcag

SEQ ID NO: 8501931 - DNA, 22 bp, Homo sapiens
tggctggaagtcagaaatggga

SEQ ID NO: 8501932 - DNA, 22 bp, Homo sapiens
tggctggaatatgtggagacca

SEQ ID NO: 8501933 - DNA, 22 bp, Homo sapiens
tggctgcttgttttagtgaggc

SEQ ID NO: 8501934 - DNA, 22 bp, Homo sapiens
tggctgcttgttttagtgaggc

SEQ ID NO: 8501935 - DNA, 18 bp, Homo sapiens
tggctgcttccaggtaca

SEQ ID NO: 8501936 - DNA, 22 bp, Homo sapiens
tggctgcttaaaattgctgcaa

SEQ ID NO: 8501937 - DNA, 22 bp, Homo sapiens
tggctgcagttgggccctcaga

SEQ ID NO: 8501938 - DNA, 22 bp, Homo sapiens
tggctgccagctcctcgccttg

SEQ ID NO: 8501939 - DNA, 22 bp, Homo sapiens
tggctgcagtgcttgagatgtc

SEQ ID NO: 8501940 - DNA, 20 bp, Homo sapiens
tggctgcccgaggcacacac

SEQ ID NO: 8501941 - DNA, 20 bp, Homo sapiens
tggctgcccgaggcacacac

SEQ ID NO: 8501942 - DNA, 22 bp, Homo sapiens
tggctgccatgacgcctgggga

SEQ ID NO: 8501943 - DNA, 22 bp, Homo sapiens
tggctgctgagaaggcagctgt

SEQ ID NO: 8501944 - DNA, 22 bp, Homo sapiens
tggctgctgagaaggcagctgt

SEQ ID NO: 8501945 - DNA, 22 bp, Homo sapiens
tggctgagcctttggggctttc

SEQ ID NO: 8501946 - DNA, 22 bp, Homo sapiens
tggctgagctgcagcgtggctt

SEQ ID NO: 8501947 - DNA, 22 bp, Homo sapiens
tggctgagctccctgtgtgttg

SEQ ID NO: 8501948 - DNA, 22 bp, Homo sapiens
tggctgagctccctgtgtgttg

SEQ ID NO: 8501949 - DNA, 22 bp, Homo sapiens
tggctgagctgcagcgtggctt

SEQ ID NO: 8501950 - DNA, 19 bp, Homo sapiens
tggctgagctggactgagg

SEQ ID NO: 8501951 - DNA, 22 bp, Homo sapiens
tggctgaggagagggcggaagt

SEQ ID NO: 8501952 - DNA, 22 bp, Homo sapiens
tggctgaggcacagctgccgcc

SEQ ID NO: 8501953 - DNA, 22 bp, Homo sapiens
tggctgaggcacagctgccgcc

SEQ ID NO: 8501954 - DNA, 22 bp, Homo sapiens
tggctgaggagggtcttctggt

SEQ ID NO: 8501955 - DNA, 22 bp, Homo sapiens
tggctgaggagggtcttctggt

SEQ ID NO: 8501956 - DNA, 22 bp, Homo sapiens
tggctgaggttatgctggttgt

SEQ ID NO: 8501957 - DNA, 22 bp, Homo sapiens
tggctgaggtctggggcttctg

SEQ ID NO: 8501958 - DNA, 22 bp, Homo sapiens
tggctgaggtctggggcttctg

SEQ ID NO: 8501959 - DNA, 22 bp, Homo sapiens
tggctgagggcactatgaagcc

SEQ ID NO: 8501960 - DNA, 22 bp, Homo sapiens
tggctgaggttatgctggttgt

SEQ ID NO: 8501961 - DNA, 22 bp, Homo sapiens
tggctgaggttatgctggttgt

SEQ ID NO: 8501962 - DNA, 22 bp, Homo sapiens
tggctgagtaagttgtgatatg

SEQ ID NO: 8501963 - DNA, 22 bp, Homo sapiens
tggctgagtaagttgtgatatg

SEQ ID NO: 8501964 - DNA, 22 bp, Homo sapiens
tggctgagtaagttgtgatatg

SEQ ID NO: 8501965 - DNA, 22 bp, Homo sapiens
tggctgaggctggagtgcagtg

SEQ ID NO: 8501966 - DNA, 22 bp, Homo sapiens
tggctgagggcactatgaagcc

SEQ ID NO: 8501967 - DNA, 22 bp, Homo sapiens
tggctgaggctggagtgcagtg

SEQ ID NO: 8501968 - DNA, 22 bp, Homo sapiens
tggctgaggcttttcttaaaga

SEQ ID NO: 8501969 - DNA, 22 bp, Homo sapiens
tggctgaggctggagtgcagtg

SEQ ID NO: 8501970 - DNA, 22 bp, Homo sapiens
tggctgagccacttgttcagat

SEQ ID NO: 8501971 - DNA, 23 bp, Homo sapiens
tggctgagatcctactgtttgct

SEQ ID NO: 8501972 - DNA, 22 bp, Homo sapiens
tggctgagagtcatcctgtgtg

SEQ ID NO: 8501973 - DNA, 23 bp, Homo sapiens
tggctgagatcctactgtttgct

SEQ ID NO: 8501974 - DNA, 23 bp, Homo sapiens
tggctgagatcctactgtttgct

SEQ ID NO: 8501975 - DNA, 22 bp, Homo sapiens
tggctgagagtcatcctgtgtg

SEQ ID NO: 8501976 - DNA, 22 bp, Homo sapiens
tggctgagagtcatcctgtgtg

SEQ ID NO: 8501977 - DNA, 22 bp, Homo sapiens
tggctgagagcaattgactctg

SEQ ID NO: 8501978 - DNA, 22 bp, Homo sapiens
tggctgagaagttctggtggga

SEQ ID NO: 8501979 - DNA, 23 bp, Homo sapiens
tggctgagcccactatcttggcc

SEQ ID NO: 8501980 - DNA, 23 bp, Homo sapiens
tggctgagcccactatcttggcc

SEQ ID NO: 8501981 - DNA, 22 bp, Homo sapiens
tggctgagcctttggggctttc

SEQ ID NO: 8501982 - DNA, 21 bp, Homo sapiens
tggctgagccaggtgtgtgga

SEQ ID NO: 8501983 - DNA, 21 bp, Homo sapiens
tggctgagccaggtgtgtgga

SEQ ID NO: 8501984 - DNA, 21 bp, Homo sapiens
tggctgagccaggtgtgtgga

SEQ ID NO: 8501985 - DNA, 21 bp, Homo sapiens
tggctgagccaggtgtgtgga

SEQ ID NO: 8501986 - DNA, 21 bp, Homo sapiens
tggctgagccaggtgtgtgga

SEQ ID NO: 8501987 - DNA, 22 bp, Homo sapiens
tggctgagccacttgttcagat

SEQ ID NO: 8501988 - DNA, 22 bp, Homo sapiens
tggctgagccacttgttcagat

SEQ ID NO: 8501989 - DNA, 22 bp, Homo sapiens
tggctgagaagttctggtggga

SEQ ID NO: 8501990 - DNA, 22 bp, Homo sapiens
tggctgagaaaatggttttagg

SEQ ID NO: 8501991 - DNA, 22 bp, Homo sapiens
tggctgagaaaatggttttagg

SEQ ID NO: 8501992 - DNA, 22 bp, Homo sapiens
tggctgagaaaaaagagctata

SEQ ID NO: 8501993 - DNA, 22 bp, Homo sapiens
tggctgagaaaaaagagctata

SEQ ID NO: 8501994 - DNA, 22 bp, Homo sapiens
tggctgaataatattctgttgt

SEQ ID NO: 8501995 - DNA, 22 bp, Homo sapiens
tggctctgtttgttaactagac

SEQ ID NO: 8501996 - DNA, 22 bp, Homo sapiens
tggctctgttttatgagtacca

SEQ ID NO: 8501997 - DNA, 22 bp, Homo sapiens
tggctcttaaggtccctgtgct

SEQ ID NO: 8501998 - DNA, 22 bp, Homo sapiens
tggctctgttttatgagtacca

SEQ ID NO: 8501999 - DNA, 22 bp, Homo sapiens
tggctcttttcacgtcccctct

SEQ ID NO: 8502000 - DNA, 22 bp, Homo sapiens
tggctctttctgtctgggatcc

SEQ ID NO: 8502001 - DNA, 22 bp, Homo sapiens
tggctctgttgtgctgagccag

SEQ ID NO: 8502002 - DNA, 22 bp, Homo sapiens
tggctctgttgtgctgagccag

SEQ ID NO: 8502003 - DNA, 22 bp, Homo sapiens
tggctctgttgtgctgagccag

SEQ ID NO: 8502004 - DNA, 22 bp, Homo sapiens
tggctctgttgtgctgagccag

SEQ ID NO: 8502005 - DNA, 22 bp, Homo sapiens
tggctctgttgtgctgagccag

SEQ ID NO: 8502006 - DNA, 22 bp, Homo sapiens
tggctctgttcgccatcaggag

SEQ ID NO: 8502007 - DNA, 22 bp, Homo sapiens
tggctctgttcgccatcaggag

SEQ ID NO: 8502008 - DNA, 22 bp, Homo sapiens
tggctctgttcgccatcaggag

SEQ ID NO: 8502009 - DNA, 22 bp, Homo sapiens
tggctctgttgaggtatggatt

SEQ ID NO: 8502010 - DNA, 22 bp, Homo sapiens
tggctctgttgaggtatggatt

SEQ ID NO: 8502011 - DNA, 22 bp, Homo sapiens
tggctctgttgaggtatggatt

SEQ ID NO: 8502012 - DNA, 22 bp, Homo sapiens
tggctctgtgtctcccagcagc

SEQ ID NO: 8502013 - DNA, 22 bp, Homo sapiens
tggctctgtgtctcccagcagc

SEQ ID NO: 8502014 - DNA, 23 bp, Homo sapiens
tggctctgtgtcacatacaggat

SEQ ID NO: 8502015 - DNA, 23 bp, Homo sapiens
tggctctgtgtcacatacaggat

SEQ ID NO: 8502016 - DNA, 21 bp, Homo sapiens
tggctctgttcaatatatgga

SEQ ID NO: 8502017 - DNA, 22 bp, Homo sapiens
tggctctggcgtgaagcccaga

SEQ ID NO: 8502018 - DNA, 22 bp, Homo sapiens
tggctctgggaatctgttgctt

SEQ ID NO: 8502019 - DNA, 22 bp, Homo sapiens
tggctctgggcaccgtgtccac

SEQ ID NO: 8502020 - DNA, 22 bp, Homo sapiens
tggctctgggcaccgtgtccac

SEQ ID NO: 8502021 - DNA, 22 bp, Homo sapiens
tggctctggattaatctaggaa

SEQ ID NO: 8502022 - DNA, 22 bp, Homo sapiens
tggctctggattaatctaggaa

SEQ ID NO: 8502023 - DNA, 22 bp, Homo sapiens
tggctctggattaatctaggaa

SEQ ID NO: 8502024 - DNA, 22 bp, Homo sapiens
tggctctggccaccgggagggc

SEQ ID NO: 8502025 - DNA, 22 bp, Homo sapiens
tggctctggccaccgggagggc

SEQ ID NO: 8502026 - DNA, 22 bp, Homo sapiens
tggctctgtgcttctagtatct

SEQ ID NO: 8502027 - DNA, 22 bp, Homo sapiens
tggctctgtgaacagacgactg

SEQ ID NO: 8502028 - DNA, 22 bp, Homo sapiens
tggctctgtcgccgtttggaat

SEQ ID NO: 8502029 - DNA, 22 bp, Homo sapiens
tggctctggggacagtaagtcc

SEQ ID NO: 8502030 - DNA, 23 bp, Homo sapiens
tggctctgtggatccctcaggag

SEQ ID NO: 8502031 - DNA, 23 bp, Homo sapiens
tggctctgtggatccctcaggag

SEQ ID NO: 8502032 - DNA, 22 bp, Homo sapiens
tggctctgtggatgttctgacc

SEQ ID NO: 8502033 - DNA, 18 bp, Homo sapiens
tggctctgcagccagatg

SEQ ID NO: 8502034 - DNA, 22 bp, Homo sapiens
tggctctgccactaacttggta

SEQ ID NO: 8502035 - DNA, 22 bp, Homo sapiens
tggctctgccactaacttggta

SEQ ID NO: 8502036 - DNA, 22 bp, Homo sapiens
tggctctgcacctcagtgtacc

SEQ ID NO: 8502037 - DNA, 22 bp, Homo sapiens
tggctctgcacctcagtgtacc

SEQ ID NO: 8502038 - DNA, 22 bp, Homo sapiens
tggctctgcagcagtgtgcgtg

SEQ ID NO: 8502039 - DNA, 22 bp, Homo sapiens
tggctctgatcagatgtccagt

SEQ ID NO: 8502040 - DNA, 22 bp, Homo sapiens
tggctctgatcagatgtccagt

SEQ ID NO: 8502041 - DNA, 22 bp, Homo sapiens
tggctctgctgaacctagtgca

SEQ ID NO: 8502042 - DNA, 22 bp, Homo sapiens
tggctctgctgaacctagtgca

SEQ ID NO: 8502043 - DNA, 18 bp, Homo sapiens
tggctctggacttgctcc

SEQ ID NO: 8502044 - DNA, 22 bp, Homo sapiens
tggctctggagctcctgggccc

SEQ ID NO: 8502045 - DNA, 22 bp, Homo sapiens
tggctctggagctcctgggccc

SEQ ID NO: 8502046 - DNA, 21 bp, Homo sapiens
tggctctgctcagagcagtcc

SEQ ID NO: 8502047 - DNA, 21 bp, Homo sapiens
tggctctgctcagagcagtcc

SEQ ID NO: 8502048 - DNA, 21 bp, Homo sapiens
tggctctgctcagagcagtcc

SEQ ID NO: 8502049 - DNA, 21 bp, Homo sapiens
tggctctgctcagagcagtcc

SEQ ID NO: 8502050 - DNA, 22 bp, Homo sapiens
tggctctgcgtctgttcgtggg

SEQ ID NO: 8502051 - DNA, 22 bp, Homo sapiens
tggctctgccccatacccctgc

SEQ ID NO: 8502052 - DNA, 21 bp, Homo sapiens
tggctctgagcctcatggctg

SEQ ID NO: 8502053 - DNA, 21 bp, Homo sapiens
tggctctgagcctcatggctg

SEQ ID NO: 8502054 - DNA, 23 bp, Homo sapiens
tggctctgagaggttcagatgct

SEQ ID NO: 8502055 - DNA, 17 bp, Homo sapiens
tggctctgaggctgaat

SEQ ID NO: 8502056 - DNA, 23 bp, Homo sapiens
tggctctgagcttcctggtggcc

SEQ ID NO: 8502057 - DNA, 22 bp, Homo sapiens
tggctccttccgcagcatgcct

SEQ ID NO: 8502058 - DNA, 22 bp, Homo sapiens
tggctccttcattctcctgcca

SEQ ID NO: 8502059 - DNA, 22 bp, Homo sapiens
tggctccttcattctcctgcca

SEQ ID NO: 8502060 - DNA, 20 bp, Homo sapiens
tggctcctggctcctccctc

SEQ ID NO: 8502061 - DNA, 20 bp, Homo sapiens
tggctcctggctcctccctc

SEQ ID NO: 8502062 - DNA, 20 bp, Homo sapiens
tggctcctggctcctccctc

SEQ ID NO: 8502063 - DNA, 22 bp, Homo sapiens
tggctctgagacacaggctctc

SEQ ID NO: 8502064 - DNA, 20 bp, Homo sapiens
tggctctcaccctgtgcgat

SEQ ID NO: 8502065 - DNA, 20 bp, Homo sapiens
tggctctcaccctgtgcgat

SEQ ID NO: 8502066 - DNA, 22 bp, Homo sapiens
tggctctcaatggctgtactat

SEQ ID NO: 8502067 - DNA, 22 bp, Homo sapiens
tggctctcaatggctgtactat

SEQ ID NO: 8502068 - DNA, 21 bp, Homo sapiens
tggctcgatttatagcatttc

SEQ ID NO: 8502069 - DNA, 23 bp, Homo sapiens
tggcctggagagaaaagatgagt

SEQ ID NO: 8502070 - DNA, 23 bp, Homo sapiens
tggcctggagagaaaagatgagt

SEQ ID NO: 8502071 - DNA, 18 bp, Homo sapiens
tggcctggagacaactct

SEQ ID NO: 8502072 - DNA, 18 bp, Homo sapiens
tggcctggagacaactct

SEQ ID NO: 8502073 - DNA, 22 bp, Homo sapiens
tggcctggaagagaggtcgagg

SEQ ID NO: 8502074 - DNA, 22 bp, Homo sapiens
tggcctggaagagaggtcgagg

SEQ ID NO: 8502075 - DNA, 18 bp, Homo sapiens
tggcctggagacaactct

SEQ ID NO: 8502076 - DNA, 18 bp, Homo sapiens
tggcctggagacaactct

SEQ ID NO: 8502077 - DNA, 22 bp, Homo sapiens
tggcctggccacatccagcagg

SEQ ID NO: 8502078 - DNA, 22 bp, Homo sapiens
tggcctggccacatccagcagg

SEQ ID NO: 8502079 - DNA, 22 bp, Homo sapiens
tggcctggccctgaggccctgt

SEQ ID NO: 8502080 - DNA, 22 bp, Homo sapiens
tggcctggccacatccagcagg

SEQ ID NO: 8502081 - DNA, 22 bp, Homo sapiens
tggcctggcagagcaaggcctg

SEQ ID NO: 8502082 - DNA, 22 bp, Homo sapiens
tggcctggcagagcaaggcctg

SEQ ID NO: 8502083 - DNA, 22 bp, Homo sapiens
tggcctggaaaaatgcagatgg

SEQ ID NO: 8502084 - DNA, 22 bp, Homo sapiens
tggcctggaaaaatgcagatgg

SEQ ID NO: 8502085 - DNA, 22 bp, Homo sapiens
tggcctggaaaaatgcagatgg

SEQ ID NO: 8502086 - DNA, 22 bp, Homo sapiens
tggcctggaacctggcagggac

SEQ ID NO: 8502087 - DNA, 22 bp, Homo sapiens
tggcctggaaaaatgcagatgg

SEQ ID NO: 8502088 - DNA, 22 bp, Homo sapiens
tggcctgctttcatttgatgct

SEQ ID NO: 8502089 - DNA, 22 bp, Homo sapiens
tggcctgccttcgctgagctga

SEQ ID NO: 8502090 - DNA, 22 bp, Homo sapiens
tggcctgcccagagcagctctg

SEQ ID NO: 8502091 - DNA, 22 bp, Homo sapiens
tggcctgcccagagcagctctg

SEQ ID NO: 8502092 - DNA, 22 bp, Homo sapiens
tggcctgcagctctcagggaag

SEQ ID NO: 8502093 - DNA, 22 bp, Homo sapiens
tggcctgccccgagatcctggc

SEQ ID NO: 8502094 - DNA, 22 bp, Homo sapiens
tggcctgccccgagatcctggc

SEQ ID NO: 8502095 - DNA, 22 bp, Homo sapiens
tggcctgcctcccggcttcttt

SEQ ID NO: 8502096 - DNA, 22 bp, Homo sapiens
tggcctgcctgggagcagcagg

SEQ ID NO: 8502097 - DNA, 23 bp, Homo sapiens
tggcctgcagagtttctgctggg

SEQ ID NO: 8502098 - DNA, 22 bp, Homo sapiens
tggcctgcagctctcagggaag

SEQ ID NO: 8502099 - DNA, 22 bp, Homo sapiens
tggcctgcagaggctgtggggc

SEQ ID NO: 8502100 - DNA, 22 bp, Homo sapiens
tggcctgcaagctaaaaatcta

SEQ ID NO: 8502101 - DNA, 22 bp, Homo sapiens
tggcctgagttgtctgcaggcc

SEQ ID NO: 8502102 - DNA, 22 bp, Homo sapiens
tggcctctgcactgggctcccc

SEQ ID NO: 8502103 - DNA, 22 bp, Homo sapiens
tggcctctgaggcacctttgcc

SEQ ID NO: 8502104 - DNA, 22 bp, Homo sapiens
tggcctcttaggacatcctcta

SEQ ID NO: 8502105 - DNA, 22 bp, Homo sapiens
tggcctcttaggacatcctcta

SEQ ID NO: 8502106 - DNA, 22 bp, Homo sapiens
tggcctgaattatggcagatct

SEQ ID NO: 8502107 - DNA, 22 bp, Homo sapiens
tggccctggtggcacagcctgc

SEQ ID NO: 8502108 - DNA, 22 bp, Homo sapiens
tggccctgggtggaatgtccca

SEQ ID NO: 8502109 - DNA, 22 bp, Homo sapiens
tggccctgggtggaatgtccca

SEQ ID NO: 8502110 - DNA, 22 bp, Homo sapiens
tggccctggtggcacagcctgc

SEQ ID NO: 8502111 - DNA, 22 bp, Homo sapiens
tggccctgtccctggagcctgg

SEQ ID NO: 8502112 - DNA, 22 bp, Homo sapiens
tggccctgtccctggagcctgg

SEQ ID NO: 8502113 - DNA, 22 bp, Homo sapiens
tggccctgtgactgagttctag

SEQ ID NO: 8502114 - DNA, 22 bp, Homo sapiens
tggccctgtgactgagttctag

SEQ ID NO: 8502115 - DNA, 22 bp, Homo sapiens
tggccctgtcctcatttcatct

SEQ ID NO: 8502116 - DNA, 22 bp, Homo sapiens
tggccctgtctgcacacaggat

SEQ ID NO: 8502117 - DNA, 22 bp, Homo sapiens
tggccctgtcctcatttcatct

SEQ ID NO: 8502118 - DNA, 22 bp, Homo sapiens
tggccctgccctcttcatcttt

SEQ ID NO: 8502119 - DNA, 22 bp, Homo sapiens
tggccctgccgcactatcctca

SEQ ID NO: 8502120 - DNA, 22 bp, Homo sapiens
tggccctgccactcactgctga

SEQ ID NO: 8502121 - DNA, 22 bp, Homo sapiens
tggccctgccactcactgctga

SEQ ID NO: 8502122 - DNA, 22 bp, Homo sapiens
tggccctgccactcactgctga

SEQ ID NO: 8502123 - DNA, 22 bp, Homo sapiens
tggccctggctgagttagattt

SEQ ID NO: 8502124 - DNA, 22 bp, Homo sapiens
tggccctgccgccacgacgtct

SEQ ID NO: 8502125 - DNA, 21 bp, Homo sapiens
tggccctggccacggctgcca

SEQ ID NO: 8502126 - DNA, 21 bp, Homo sapiens
tggccctggccacggctgcca

SEQ ID NO: 8502127 - DNA, 22 bp, Homo sapiens
tggccctgggcatctttcgtga

SEQ ID NO: 8502128 - DNA, 22 bp, Homo sapiens
tggccctgggcagaggcaacat

SEQ ID NO: 8502129 - DNA, 22 bp, Homo sapiens
tggccctgggcagaggcaacat

SEQ ID NO: 8502130 - DNA, 20 bp, Homo sapiens
tggccctgttttctccaggc

SEQ ID NO: 8502131 - DNA, 20 bp, Homo sapiens
tggccctgttttctccaggc

SEQ ID NO: 8502132 - DNA, 20 bp, Homo sapiens
tggccctgttttctccaggc

SEQ ID NO: 8502133 - DNA, 22 bp, Homo sapiens
tggcccttctgagcacagggcc

SEQ ID NO: 8502134 - DNA, 22 bp, Homo sapiens
tggcccttcaaattccctagtc

SEQ ID NO: 8502135 - DNA, 22 bp, Homo sapiens
tggccctgttctgtacctcata

SEQ ID NO: 8502136 - DNA, 22 bp, Homo sapiens
tggccctgttctgtacctcata

SEQ ID NO: 8502137 - DNA, 20 bp, Homo sapiens
tggccctgttttctccaggc

SEQ ID NO: 8502138 - DNA, 22 bp, Homo sapiens
tggcccttttgtgaagtggcca

SEQ ID NO: 8502139 - DNA, 22 bp, Homo sapiens
tggccctttggtttatgactga

SEQ ID NO: 8502140 - DNA, 22 bp, Homo sapiens
tggccctttgggtgcaggggca

SEQ ID NO: 8502141 - DNA, 22 bp, Homo sapiens
tggcccttgtcctgggagagtt

SEQ ID NO: 8502142 - DNA, 22 bp, Homo sapiens
tggccgtgttagatgtttggct

SEQ ID NO: 8502143 - DNA, 22 bp, Homo sapiens
tggccgggccgggcgcctccac

SEQ ID NO: 8502144 - DNA, 23 bp, Homo sapiens
tggccctgtgcatgctgcttccc

SEQ ID NO: 8502145 - DNA, 22 bp, Homo sapiens
tggccctgtggaggtcagtgag

SEQ ID NO: 8502146 - DNA, 22 bp, Homo sapiens
tggccctgtggaggtcagtgag

SEQ ID NO: 8502147 - DNA, 22 bp, Homo sapiens
tggccctgtggaggtcagtgag

SEQ ID NO: 8502148 - DNA, 23 bp, Homo sapiens
tggccctgtgcatgctgcttccc

SEQ ID NO: 8502149 - DNA, 22 bp, Homo sapiens
tggccctgtggcttcagaacag

SEQ ID NO: 8502150 - DNA, 22 bp, Homo sapiens
tggccctgtggcttcagaacag

SEQ ID NO: 8502151 - DNA, 22 bp, Homo sapiens
tggccctgtggaggtcagtgag

SEQ ID NO: 8502152 - DNA, 22 bp, Homo sapiens
tggccctgtggaggtcagtgag

SEQ ID NO: 8502153 - DNA, 22 bp, Homo sapiens
tggccctgtgtcctgctgccag

SEQ ID NO: 8502154 - DNA, 22 bp, Homo sapiens
tggccctgtgtcctgctgccag

SEQ ID NO: 8502155 - DNA, 22 bp, Homo sapiens
tggccctgtgtcctgctgccag

SEQ ID NO: 8502156 - DNA, 22 bp, Homo sapiens
tggccctgtgtgcaggctgcac

SEQ ID NO: 8502157 - DNA, 22 bp, Homo sapiens
tggccctgtgtgcaggctgcac

SEQ ID NO: 8502158 - DNA, 22 bp, Homo sapiens
tggccctgtgtgcaggctgcac

SEQ ID NO: 8502159 - DNA, 22 bp, Homo sapiens
tggccctgacaggtcctgggca

SEQ ID NO: 8502160 - DNA, 22 bp, Homo sapiens
tggccctgacaggtcctgggca

SEQ ID NO: 8502161 - DNA, 22 bp, Homo sapiens
tggccctgactgatgtggaggg

SEQ ID NO: 8502162 - DNA, 22 bp, Homo sapiens
tggccctgacacgtggtactgg

SEQ ID NO: 8502163 - DNA, 22 bp, Homo sapiens
tggccctgacacgtggtactgg

SEQ ID NO: 8502164 - DNA, 22 bp, Homo sapiens
tggccctgacaggtcctgggca

SEQ ID NO: 8502165 - DNA, 22 bp, Homo sapiens
tggccctgaggacccagtgtgg

SEQ ID NO: 8502166 - DNA, 22 bp, Homo sapiens
tggccctgaggacccagtgtgg

SEQ ID NO: 8502167 - DNA, 22 bp, Homo sapiens
tggccctgaggacccagtgtgg

SEQ ID NO: 8502168 - DNA, 22 bp, Homo sapiens
tggccctgacttggaggcctga

SEQ ID NO: 8502169 - DNA, 22 bp, Homo sapiens
tggccctgacttggaggcctga

SEQ ID NO: 8502170 - DNA, 22 bp, Homo sapiens
tggccctgactgatgtggaggg

SEQ ID NO: 8502171 - DNA, 22 bp, Homo sapiens
tggccctgactgatgtggaggg

SEQ ID NO: 8502172 - DNA, 22 bp, Homo sapiens
tggccctgaggggctgtgcccc

SEQ ID NO: 8502173 - DNA, 22 bp, Homo sapiens
tggccctgaggggctgtgcccc

SEQ ID NO: 8502174 - DNA, 22 bp, Homo sapiens
tggccctgagggctcggagcca

SEQ ID NO: 8502175 - DNA, 22 bp, Homo sapiens
tggccctgagggctcggagcca

SEQ ID NO: 8502176 - DNA, 22 bp, Homo sapiens
tggccctgcagaactagcctgg

SEQ ID NO: 8502177 - DNA, 22 bp, Homo sapiens
tggccctgcagaactagcctgg

SEQ ID NO: 8502178 - DNA, 22 bp, Homo sapiens
tggccctgcagaactagcctgg

SEQ ID NO: 8502179 - DNA, 22 bp, Homo sapiens
tggccctgcacccagagcagtt

SEQ ID NO: 8502180 - DNA, 22 bp, Homo sapiens
tggccctgcacccagagcagtt

SEQ ID NO: 8502181 - DNA, 22 bp, Homo sapiens
tggcccagtcagcaggagaggg

SEQ ID NO: 8502182 - DNA, 22 bp, Homo sapiens
tggcccagtatgtataatctta

SEQ ID NO: 8502183 - DNA, 22 bp, Homo sapiens
tggcccaggtgcacccagaggc

SEQ ID NO: 8502184 - DNA, 22 bp, Homo sapiens
tggcccaggtgcacccagaggc

SEQ ID NO: 8502185 - DNA, 22 bp, Homo sapiens
tggccctcagtcttgctcctgc

SEQ ID NO: 8502186 - DNA, 22 bp, Homo sapiens
tggccctcagtcttgctcctgc

SEQ ID NO: 8502187 - DNA, 22 bp, Homo sapiens
tggccctcagcactgagacctt

SEQ ID NO: 8502188 - DNA, 22 bp, Homo sapiens
tggccctgaaggccttgagcat

SEQ ID NO: 8502189 - DNA, 22 bp, Homo sapiens
tggccctcgtccgacaggtggg

SEQ ID NO: 8502190 - DNA, 22 bp, Homo sapiens
tggccctcgtccgacaggtggg

SEQ ID NO: 8502191 - DNA, 23 bp, Homo sapiens
tggccctgaatctgtcctggagg

SEQ ID NO: 8502192 - DNA, 23 bp, Homo sapiens
tggccctgaatctgtcctggagg

SEQ ID NO: 8502193 - DNA, 22 bp, Homo sapiens
tggccctgaatcaaggccagca

SEQ ID NO: 8502194 - DNA, 22 bp, Homo sapiens
tggcccagccctgctctagggc

SEQ ID NO: 8502195 - DNA, 22 bp, Homo sapiens
tggcccagccctgctctagggc

SEQ ID NO: 8502196 - DNA, 22 bp, Homo sapiens
tggcccaaagcagcccagcagg

SEQ ID NO: 8502197 - DNA, 15 bp, Homo sapiens
tggcccacccgttga

SEQ ID NO: 8502198 - DNA, 22 bp, Homo sapiens
tggccatgggatagtgcagggg

SEQ ID NO: 8502199 - DNA, 22 bp, Homo sapiens
tggccagtggactaagttctga

SEQ ID NO: 8502200 - DNA, 22 bp, Homo sapiens
tggcccaggggctcttggtgtt

SEQ ID NO: 8502201 - DNA, 22 bp, Homo sapiens
tggcccaggggctcttggtgtt

SEQ ID NO: 8502202 - DNA, 22 bp, Homo sapiens
tggcccaggccaaagccctgga

SEQ ID NO: 8502203 - DNA, 22 bp, Homo sapiens
tggcccaggccaaagccctgga

SEQ ID NO: 8502204 - DNA, 22 bp, Homo sapiens
tggcccaggcgaggtgggcaga

SEQ ID NO: 8502205 - DNA, 22 bp, Homo sapiens
tggcagtgatgcttatggtttg

SEQ ID NO: 8502206 - DNA, 18 bp, Homo sapiens
tggcagtgccaccttctc

SEQ ID NO: 8502207 - DNA, 23 bp, Homo sapiens
tggcagtgcccagggagatgatc

SEQ ID NO: 8502208 - DNA, 23 bp, Homo sapiens
tggcagtgatcaaaagcttacat

SEQ ID NO: 8502209 - DNA, 22 bp, Homo sapiens
tggcagtgatgcggcaggacat

SEQ ID NO: 8502210 - DNA, 18 bp, Homo sapiens
tggcagtgaggtaggcat

SEQ ID NO: 8502211 - DNA, 23 bp, Homo sapiens
tggcagtgatcaaaagcttacat

SEQ ID NO: 8502212 - DNA, 22 bp, Homo sapiens
tggcagtgaagctgtctttagg

SEQ ID NO: 8502213 - DNA, 22 bp, Homo sapiens
tggcagtgaagctgtctttagg

SEQ ID NO: 8502214 - DNA, 22 bp, Homo sapiens
tggcagtcttgtaggcatctcc

SEQ ID NO: 8502215 - DNA, 22 bp, Homo sapiens
tggcagtgaaccaaggctccaa

SEQ ID NO: 8502216 - DNA, 22 bp, Homo sapiens
tggcagtgaaagacaattgggc

SEQ ID NO: 8502217 - DNA, 22 bp, Homo sapiens
tggcagtctgggttggcagtta

SEQ ID NO: 8502218 - DNA, 22 bp, Homo sapiens
tggcagtctgggttggcagtta

SEQ ID NO: 8502219 - DNA, 22 bp, Homo sapiens
tggcagtcccctgtgcctggaa

SEQ ID NO: 8502220 - DNA, 22 bp, Homo sapiens
tggcagtccagaccctggactc

SEQ ID NO: 8502221 - DNA, 22 bp, Homo sapiens
tggcagtcccctgtgcctggaa

SEQ ID NO: 8502222 - DNA, 22 bp, Homo sapiens
tggcagtaaagctggaaaagtg

SEQ ID NO: 8502223 - DNA, 22 bp, Homo sapiens
tggcagtaaagctggaaaagtg

SEQ ID NO: 8502224 - DNA, 22 bp, Homo sapiens
tggcagtagagctggaacttga

SEQ ID NO: 8502225 - DNA, 21 bp, Homo sapiens
tggcaggttcaaaggcctatc

SEQ ID NO: 8502226 - DNA, 22 bp, Homo sapiens
tggcagggtgccagttgcgagt

SEQ ID NO: 8502227 - DNA, 22 bp, Homo sapiens
tggcagggtcttgctgtgttgc

SEQ ID NO: 8502228 - DNA, 22 bp, Homo sapiens
tggcagggtcttgctgtgttgc

SEQ ID NO: 8502229 - DNA, 22 bp, Homo sapiens
tggcagggtgccagttgcgagt

SEQ ID NO: 8502230 - DNA, 22 bp, Homo sapiens
tggcagggtgccagttgcgagt

SEQ ID NO: 8502231 - DNA, 22 bp, Homo sapiens
tggcagggtgccagttgcgagt

SEQ ID NO: 8502232 - DNA, 22 bp, Homo sapiens
tggcaggttaacttacaactgt

SEQ ID NO: 8502233 - DNA, 22 bp, Homo sapiens
tggcaggtggctctggcattct

SEQ ID NO: 8502234 - DNA, 22 bp, Homo sapiens
tggcaggtggcacagcctggga

SEQ ID NO: 8502235 - DNA, 22 bp, Homo sapiens
tggcaggtggagacagcagagc

SEQ ID NO: 8502236 - DNA, 22 bp, Homo sapiens
tggcatcatagccaaggtgctt

SEQ ID NO: 8502237 - DNA, 22 bp, Homo sapiens
tggcagtggcgggactcagggc

SEQ ID NO: 8502238 - DNA, 22 bp, Homo sapiens
tggcagtggctcagagtgcaga

SEQ ID NO: 8502239 - DNA, 22 bp, Homo sapiens
tggcagtggcgggactcagggc

SEQ ID NO: 8502240 - DNA, 22 bp, Homo sapiens
tggcagtggcactgcccccata

SEQ ID NO: 8502241 - DNA, 22 bp, Homo sapiens
tggcagtggcatcaccccaata

SEQ ID NO: 8502242 - DNA, 22 bp, Homo sapiens
tggcagtgccccttgaccagtg

SEQ ID NO: 8502243 - DNA, 22 bp, Homo sapiens
tggcagtgccccttgaccagtg

SEQ ID NO: 8502244 - DNA, 22 bp, Homo sapiens
tggcagtggataggggagcggt

SEQ ID NO: 8502245 - DNA, 22 bp, Homo sapiens
tggcagtgctgcagtgccctta

SEQ ID NO: 8502246 - DNA, 19 bp, Homo sapiens
tggcagtgtggggtatgaa

SEQ ID NO: 8502247 - DNA, 19 bp, Homo sapiens
tggcagtgtggggtatgaa

SEQ ID NO: 8502248 - DNA, 22 bp, Homo sapiens
tggcagtgtgtgagctgttatt

SEQ ID NO: 8502249 - DNA, 22 bp, Homo sapiens
tggcagtgtgtgagctgttatt

SEQ ID NO: 8502250 - DNA, 22 bp, Homo sapiens
tggcagtgtttctaaggggctc

SEQ ID NO: 8502251 - DNA, 22 bp, Homo sapiens
tggcagtgttgtgccacattcc

SEQ ID NO: 8502252 - DNA, 22 bp, Homo sapiens
tggcagtggctcagagtgcaga

SEQ ID NO: 8502253 - DNA, 22 bp, Homo sapiens
tggcagtggctcagagtgcaga

SEQ ID NO: 8502254 - DNA, 22 bp, Homo sapiens
tggcagtggctcagagtgcaga

SEQ ID NO: 8502255 - DNA, 22 bp, Homo sapiens
tggcatgcaagaggaggctccc

SEQ ID NO: 8502256 - DNA, 22 bp, Homo sapiens
tggcatgataggaggtgcagaa

SEQ ID NO: 8502257 - DNA, 17 bp, Homo sapiens
tggcatgagggtgtggg

SEQ ID NO: 8502258 - DNA, 22 bp, Homo sapiens
tggcatgagtataggcttctca

SEQ ID NO: 8502259 - DNA, 22 bp, Homo sapiens
tggcatgaagtcagcagctggg

SEQ ID NO: 8502260 - DNA, 22 bp, Homo sapiens
tggcatctttgtcccagaagct

SEQ ID NO: 8502261 - DNA, 22 bp, Homo sapiens
tggcatctccgacagtcttgat

SEQ ID NO: 8502262 - DNA, 22 bp, Homo sapiens
tggcatggctactggaatggcg

SEQ ID NO: 8502263 - DNA, 22 bp, Homo sapiens
tggcatggcaaccctgcaggga

SEQ ID NO: 8502264 - DNA, 22 bp, Homo sapiens
tggcatgcacagccctgttcgg

SEQ ID NO: 8502265 - DNA, 21 bp, Homo sapiens
tggcatggaggtagcagtgtg

SEQ ID NO: 8502266 - DNA, 22 bp, Homo sapiens
tggcatttagttgcgtattgca

SEQ ID NO: 8502267 - DNA, 22 bp, Homo sapiens
tggccacagcctctgccagttc

SEQ ID NO: 8502268 - DNA, 22 bp, Homo sapiens
tggcatgtagtaggtgctataa

SEQ ID NO: 8502269 - DNA, 22 bp, Homo sapiens
tggcatgtatacttgagtagga

SEQ ID NO: 8502270 - DNA, 22 bp, Homo sapiens
tggcatgtacccaggaatggac

SEQ ID NO: 8502271 - DNA, 22 bp, Homo sapiens
tggcatgtggcagctggttcag

SEQ ID NO: 8502272 - DNA, 22 bp, Homo sapiens
tggcatgtggctttgagtcatc

SEQ ID NO: 8502273 - DNA, 22 bp, Homo sapiens
tggcatgtggctttgagtcatc

SEQ ID NO: 8502274 - DNA, 22 bp, Homo sapiens
tggcatgttaaagtagtattaa

SEQ ID NO: 8502275 - DNA, 22 bp, Homo sapiens
tggcatgtgtgtgtaggataca

SEQ ID NO: 8502276 - DNA, 22 bp, Homo sapiens
tggcatgtatttgtggtgaatt

SEQ ID NO: 8502277 - DNA, 22 bp, Homo sapiens
tggcatgtatttgtggtgaatt

SEQ ID NO: 8502278 - DNA, 22 bp, Homo sapiens
tggcatgtggcaatgttgggat

SEQ ID NO: 8502279 - DNA, 22 bp, Homo sapiens
tggcatgtttcatggctgcaaa

SEQ ID NO: 8502280 - DNA, 22 bp, Homo sapiens
tggcatgtttgcttgtgcatat

SEQ ID NO: 8502281 - DNA, 19 bp, Homo sapiens
tggcatgtttggctaagga

SEQ ID NO: 8502282 - DNA, 22 bp, Homo sapiens
tggcatgtttgcttgtgcatat

SEQ ID NO: 8502283 - DNA, 22 bp, Homo sapiens
tggcatgttctcttagcagctc

SEQ ID NO: 8502284 - DNA, 22 bp, Homo sapiens
tggcatgttgagaggcaagatt

SEQ ID NO: 8502285 - DNA, 22 bp, Homo sapiens
tggcatgtttaatgtactgtat

SEQ ID NO: 8502286 - DNA, 22 bp, Homo sapiens
tggcatgtttaaatggcaataa

SEQ ID NO: 8502287 - DNA, 22 bp, Homo sapiens
tggcatgttgataatggagaag

SEQ ID NO: 8502288 - DNA, 22 bp, Homo sapiens
tggcattgcttctgaagtggag

SEQ ID NO: 8502289 - DNA, 19 bp, Homo sapiens
tggcattggtccagataaa

SEQ ID NO: 8502290 - DNA, 22 bp, Homo sapiens
tggccacccagctgacgccttc

SEQ ID NO: 8502291 - DNA, 22 bp, Homo sapiens
tggccaccaccaatacttgcct

SEQ ID NO: 8502292 - DNA, 22 bp, Homo sapiens
tggccacccctttctctgcact

SEQ ID NO: 8502293 - DNA, 22 bp, Homo sapiens
tggccacccccaatgtcagtag

SEQ ID NO: 8502294 - DNA, 22 bp, Homo sapiens
tggccacagtgtccagcagcag

SEQ ID NO: 8502295 - DNA, 22 bp, Homo sapiens
tggccacatcctttccttgtca

SEQ ID NO: 8502296 - DNA, 22 bp, Homo sapiens
tggccaccttcccacttctgcc

SEQ ID NO: 8502297 - DNA, 22 bp, Homo sapiens
tggccagaacctgcagtaggcc

SEQ ID NO: 8502298 - DNA, 22 bp, Homo sapiens
tggccagaacctgcagtaggcc

SEQ ID NO: 8502299 - DNA, 22 bp, Homo sapiens
tggccagacagagaggctttgt

SEQ ID NO: 8502300 - DNA, 22 bp, Homo sapiens
tggccagaactcagacatgtgg

SEQ ID NO: 8502301 - DNA, 22 bp, Homo sapiens
tggccagaactcagacatgtgg

SEQ ID NO: 8502302 - DNA, 17 bp, Homo sapiens
tggccagagcaggcccc

SEQ ID NO: 8502303 - DNA, 22 bp, Homo sapiens
tggccagagtccagtgagcctt

SEQ ID NO: 8502304 - DNA, 21 bp, Homo sapiens
tggccagctgctcgtctcctc

SEQ ID NO: 8502305 - DNA, 22 bp, Homo sapiens
tggccaggcattcagataagac

SEQ ID NO: 8502306 - DNA, 21 bp, Homo sapiens
tggccagctggagtctccaca

SEQ ID NO: 8502307 - DNA, 21 bp, Homo sapiens
tggccagctggagtctccaca

SEQ ID NO: 8502308 - DNA, 22 bp, Homo sapiens
tggccagccttgtcatcgcttt

SEQ ID NO: 8502309 - DNA, 22 bp, Homo sapiens
tggccagccataaaagaaccca

SEQ ID NO: 8502310 - DNA, 22 bp, Homo sapiens
tggccagccataaaagaaccca

SEQ ID NO: 8502311 - DNA, 22 bp, Homo sapiens
tggccagccctcttcccacact

SEQ ID NO: 8502312 - DNA, 22 bp, Homo sapiens
tggccagcccttcagccatgcc

SEQ ID NO: 8502313 - DNA, 23 bp, Homo sapiens
tggccagcagaagcaaggggagc

SEQ ID NO: 8502314 - DNA, 22 bp, Homo sapiens
tggccagagtccagtgagcctt

SEQ ID NO: 8502315 - DNA, 22 bp, Homo sapiens
tggccagattcatgcatgtatc

SEQ ID NO: 8502316 - DNA, 22 bp, Homo sapiens
tggccagcagagttcactctct

SEQ ID NO: 8502317 - DNA, 22 bp, Homo sapiens
tggccagagttgagggggtttc

SEQ ID NO: 8502318 - DNA, 23 bp, Homo sapiens
tggccagggtactacacccaccc

SEQ ID NO: 8502319 - DNA, 22 bp, Homo sapiens
tggccaggggagttcccctcca

SEQ ID NO: 8502320 - DNA, 22 bp, Homo sapiens
tggccaggctggtctggaacgc

SEQ ID NO: 8502321 - DNA, 22 bp, Homo sapiens
tggccaggcctcttggtgccca

SEQ ID NO: 8502322 - DNA, 22 bp, Homo sapiens
tggccaggcctcttggtgccca

SEQ ID NO: 8502323 - DNA, 19 bp, Homo sapiens
tggccaggtactgtctgct

SEQ ID NO: 8502324 - DNA, 19 bp, Homo sapiens
tggccaggtactgtctgct

SEQ ID NO: 8502325 - DNA, 19 bp, Homo sapiens
tggccaggtactgtctgct

SEQ ID NO: 8502326 - DNA, 23 bp, Homo sapiens
tggccaggtagaggaggtagtga

SEQ ID NO: 8502327 - DNA, 23 bp, Homo sapiens
tggccaggtagaggaggtagtga

SEQ ID NO: 8502328 - DNA, 22 bp, Homo sapiens
tggccaggtgtgggttctcaga

SEQ ID NO: 8502329 - DNA, 22 bp, Homo sapiens
tggccaggttgggctttgcagc

SEQ ID NO: 8502330 - DNA, 22 bp, Homo sapiens
tggccaggtgtgggttctcaga

SEQ ID NO: 8502331 - DNA, 22 bp, Homo sapiens
tggcacatagcaggtactcagt

SEQ ID NO: 8502332 - DNA, 22 bp, Homo sapiens
tggcacagttaaagttgtagaa

SEQ ID NO: 8502333 - DNA, 22 bp, Homo sapiens
tggcacatggttaatcataatt

SEQ ID NO: 8502334 - DNA, 22 bp, Homo sapiens
tggcaccaaaagcagacgtatt

SEQ ID NO: 8502335 - DNA, 22 bp, Homo sapiens
tggcaccaccagacaccaggag

SEQ ID NO: 8502336 - DNA, 23 bp, Homo sapiens
tggcaccaggcattctaggggta

SEQ ID NO: 8502337 - DNA, 22 bp, Homo sapiens
tggcaccagcacctagatgggg

SEQ ID NO: 8502338 - DNA, 22 bp, Homo sapiens
tggcaccaccagacaccaggag

SEQ ID NO: 8502339 - DNA, 22 bp, Homo sapiens
tggcaccaggcggggtggctgt

SEQ ID NO: 8502340 - DNA, 23 bp, Homo sapiens
tggcaccaggcattctaggggta

SEQ ID NO: 8502341 - DNA, 22 bp, Homo sapiens
tggcaccagggaacaagcattt

SEQ ID NO: 8502342 - DNA, 20 bp, Homo sapiens
tggcaccaggtggtggcccc

SEQ ID NO: 8502343 - DNA, 22 bp, Homo sapiens
tggcaccatcaaggctgagaac

SEQ ID NO: 8502344 - DNA, 22 bp, Homo sapiens
tggcaccatcaaggctgagaac

SEQ ID NO: 8502345 - DNA, 22 bp, Homo sapiens
tggcactgacagggtgctcaag

SEQ ID NO: 8502346 - DNA, 22 bp, Homo sapiens
tggcactgacagggtgctcaag

SEQ ID NO: 8502347 - DNA, 22 bp, Homo sapiens
tggcactgaagctggaaagcct

SEQ ID NO: 8502348 - DNA, 22 bp, Homo sapiens
tggcacgacaattggcaccaat

SEQ ID NO: 8502349 - DNA, 22 bp, Homo sapiens
tggcaccatgttggcaaatgtt

SEQ ID NO: 8502350 - DNA, 22 bp, Homo sapiens
tggcacccagtggagctgtgct

SEQ ID NO: 8502351 - DNA, 22 bp, Homo sapiens
tggcaccctgaagttggtcact

SEQ ID NO: 8502352 - DNA, 22 bp, Homo sapiens
tggcacctgaacttagaggtgt

SEQ ID NO: 8502353 - DNA, 22 bp, Homo sapiens
tggcactgccaacctgctaggt

SEQ ID NO: 8502354 - DNA, 22 bp, Homo sapiens
tggcactgcctggcagggcccc

SEQ ID NO: 8502355 - DNA, 22 bp, Homo sapiens
tggcactgcctggcagggcccc

SEQ ID NO: 8502356 - DNA, 21 bp, Homo sapiens
tggcactgcttagcaggttcc

SEQ ID NO: 8502357 - DNA, 22 bp, Homo sapiens
tggcactgcctggcagggcccc

SEQ ID NO: 8502358 - DNA, 22 bp, Homo sapiens
tggcactggaatcgtagccttg

SEQ ID NO: 8502359 - DNA, 22 bp, Homo sapiens
tggcactggaatcgtagccttg

SEQ ID NO: 8502360 - DNA, 22 bp, Homo sapiens
tggcactgaccccaggcctgtg

SEQ ID NO: 8502361 - DNA, 22 bp, Homo sapiens
tggcactgaccccaggcctgtg

SEQ ID NO: 8502362 - DNA, 22 bp, Homo sapiens
tggcactgaccccaggcctgtg

SEQ ID NO: 8502363 - DNA, 22 bp, Homo sapiens
tggcactgagcagccgcggcag

SEQ ID NO: 8502364 - DNA, 22 bp, Homo sapiens
tggcactgccaacctgctaggt

SEQ ID NO: 8502365 - DNA, 22 bp, Homo sapiens
tggcactgccaacctgctaggt

SEQ ID NO: 8502366 - DNA, 22 bp, Homo sapiens
tggcactgagcagccgcggcag

SEQ ID NO: 8502367 - DNA, 22 bp, Homo sapiens
tggcactgtcaccaatgctgtc

SEQ ID NO: 8502368 - DNA, 22 bp, Homo sapiens
tggcactgggatgctactgtta

SEQ ID NO: 8502369 - DNA, 22 bp, Homo sapiens
tggcactgggacagatgctctc

SEQ ID NO: 8502370 - DNA, 22 bp, Homo sapiens
tggcactgggacagatgctctc

SEQ ID NO: 8502371 - DNA, 22 bp, Homo sapiens
tggcactggcgcaggatggcgg

SEQ ID NO: 8502372 - DNA, 22 bp, Homo sapiens
tggcacttccactgtggctgct

SEQ ID NO: 8502373 - DNA, 22 bp, Homo sapiens
tggcagagaacacggctgatct

SEQ ID NO: 8502374 - DNA, 22 bp, Homo sapiens
tggcactgtggatttcacaagt

SEQ ID NO: 8502375 - DNA, 22 bp, Homo sapiens
tggcagagacaaggccgggcct

SEQ ID NO: 8502376 - DNA, 22 bp, Homo sapiens
tggcagagacaaggccgggcct

SEQ ID NO: 8502377 - DNA, 22 bp, Homo sapiens
tggcagagacaaggccgggcct

SEQ ID NO: 8502378 - DNA, 23 bp, Homo sapiens
tggcagagacccagaatctacat

SEQ ID NO: 8502379 - DNA, 22 bp, Homo sapiens
tggcagagaataaatcttgact

SEQ ID NO: 8502380 - DNA, 22 bp, Homo sapiens
tggcagagaataaatcttgact

SEQ ID NO: 8502381 - DNA, 22 bp, Homo sapiens
tggcagagacaaggccgggcct

SEQ ID NO: 8502382 - DNA, 22 bp, Homo sapiens
tggcagagaacacggctgatct

SEQ ID NO: 8502383 - DNA, 22 bp, Homo sapiens
tggcagagaacacggctgatct

SEQ ID NO: 8502384 - DNA, 22 bp, Homo sapiens
tggcagagaacacggctgatct

SEQ ID NO: 8502385 - DNA, 22 bp, Homo sapiens
tggcagagaacctgggctttgt

SEQ ID NO: 8502386 - DNA, 22 bp, Homo sapiens
tggcagagaacctgggctttgt

SEQ ID NO: 8502387 - DNA, 22 bp, Homo sapiens
tggcagagaacctgggctttgt

SEQ ID NO: 8502388 - DNA, 22 bp, Homo sapiens
tggcagagagactctccttgat

SEQ ID NO: 8502389 - DNA, 22 bp, Homo sapiens
tggcagagagactctccttgat

SEQ ID NO: 8502390 - DNA, 22 bp, Homo sapiens
tggcagagagactctccttgat

SEQ ID NO: 8502391 - DNA, 22 bp, Homo sapiens
tggcagagagactctccttgat

SEQ ID NO: 8502392 - DNA, 22 bp, Homo sapiens
tggcagagagactctccttgat

SEQ ID NO: 8502393 - DNA, 22 bp, Homo sapiens
tggcagagagagtgcagtcgac

SEQ ID NO: 8502394 - DNA, 22 bp, Homo sapiens
tggcagagagagtgcagtcgac

SEQ ID NO: 8502395 - DNA, 22 bp, Homo sapiens
tggcagagactcctcctgggag

SEQ ID NO: 8502396 - DNA, 23 bp, Homo sapiens
tggcagagacccagaatctacat

SEQ ID NO: 8502397 - DNA, 22 bp, Homo sapiens
tggcagagactcctcctgggag

SEQ ID NO: 8502398 - DNA, 22 bp, Homo sapiens
tggcagagactcctcctgggag

SEQ ID NO: 8502399 - DNA, 22 bp, Homo sapiens
tggcagagcaaaaagatagaat

SEQ ID NO: 8502400 - DNA, 22 bp, Homo sapiens
tggcagagcaaaaagatagaat

SEQ ID NO: 8502401 - DNA, 22 bp, Homo sapiens
tggcagagcaaaaagatagaat

SEQ ID NO: 8502402 - DNA, 22 bp, Homo sapiens
tggcagagatgaagagttgttt

SEQ ID NO: 8502403 - DNA, 22 bp, Homo sapiens
tggcagagatgaagagttgttt

SEQ ID NO: 8502404 - DNA, 22 bp, Homo sapiens
tggcagagagagtgcagtcgac

SEQ ID NO: 8502405 - DNA, 22 bp, Homo sapiens
tggcagagatgaagagttgttt

SEQ ID NO: 8502406 - DNA, 22 bp, Homo sapiens
tggcagagcccagaactgagca

SEQ ID NO: 8502407 - DNA, 22 bp, Homo sapiens
tggcagagcccagaactgagca

SEQ ID NO: 8502408 - DNA, 22 bp, Homo sapiens
tggcagagcccagaactgagca

SEQ ID NO: 8502409 - DNA, 22 bp, Homo sapiens
tggcagagcccagaactgagca

SEQ ID NO: 8502410 - DNA, 22 bp, Homo sapiens
tggcagagcccagactccagtc

SEQ ID NO: 8502411 - DNA, 22 bp, Homo sapiens
tggcagagcccagactccagtc

SEQ ID NO: 8502412 - DNA, 22 bp, Homo sapiens
tggcagagcccagactccagtc

SEQ ID NO: 8502413 - DNA, 22 bp, Homo sapiens
tggcagagcccagactccagtc

SEQ ID NO: 8502414 - DNA, 22 bp, Homo sapiens
tggcagaggaaaaagtcactgg

SEQ ID NO: 8502415 - DNA, 22 bp, Homo sapiens
tggcagaggaaaaagtcactgg

SEQ ID NO: 8502416 - DNA, 22 bp, Homo sapiens
tggcagaggtatattgggagga

SEQ ID NO: 8502417 - DNA, 16 bp, Homo sapiens
tggcagaggttcagcc

SEQ ID NO: 8502418 - DNA, 22 bp, Homo sapiens
tggcagaggaaaaagtcactgg

SEQ ID NO: 8502419 - DNA, 22 bp, Homo sapiens
tggcagaggtatattgggagga

SEQ ID NO: 8502420 - DNA, 22 bp, Homo sapiens
tggcagaggtatattgggagga

SEQ ID NO: 8502421 - DNA, 22 bp, Homo sapiens
tggcagagccttgccaaactcc

SEQ ID NO: 8502422 - DNA, 22 bp, Homo sapiens
tggcagagccttgccaaactcc

SEQ ID NO: 8502423 - DNA, 22 bp, Homo sapiens
tggcagagcccagactccagtc

SEQ ID NO: 8502424 - DNA, 22 bp, Homo sapiens
tggcagagctggctgcggatga

SEQ ID NO: 8502425 - DNA, 22 bp, Homo sapiens
tggcagagctggctgcggatga

SEQ ID NO: 8502426 - DNA, 22 bp, Homo sapiens
tggcagagctggctgcggatga

SEQ ID NO: 8502427 - DNA, 22 bp, Homo sapiens
tggcaatgttagcaaagcattt

SEQ ID NO: 8502428 - DNA, 22 bp, Homo sapiens
tggcaattgtccactgtctgcc

SEQ ID NO: 8502429 - DNA, 22 bp, Homo sapiens
tggcacagacagcacagcaatg

SEQ ID NO: 8502430 - DNA, 22 bp, Homo sapiens
tggcacagacagcacagcaatg

SEQ ID NO: 8502431 - DNA, 22 bp, Homo sapiens
tggcacagacatttaatagcct

SEQ ID NO: 8502432 - DNA, 22 bp, Homo sapiens
tggcacagaccttatcttctct

SEQ ID NO: 8502433 - DNA, 22 bp, Homo sapiens
tggcacagacagatcaggagtc

SEQ ID NO: 8502434 - DNA, 22 bp, Homo sapiens
tggcacagaaaaatgctccatt

SEQ ID NO: 8502435 - DNA, 21 bp, Homo sapiens
tggcacagaaaggaaagttca

SEQ ID NO: 8502436 - DNA, 20 bp, Homo sapiens
tggcacagaacccttgccta

SEQ ID NO: 8502437 - DNA, 22 bp, Homo sapiens
tggcacagacagatcaggagtc

SEQ ID NO: 8502438 - DNA, 22 bp, Homo sapiens
tggcacagcccagagctcttga

SEQ ID NO: 8502439 - DNA, 23 bp, Homo sapiens
tggcacagcaggtgtgctttgtt

SEQ ID NO: 8502440 - DNA, 21 bp, Homo sapiens
tggcacagcaagtgggctcat

SEQ ID NO: 8502441 - DNA, 21 bp, Homo sapiens
tggcacagcaagtgggctcat

SEQ ID NO: 8502442 - DNA, 22 bp, Homo sapiens
tggcacagccactgaatcggga

SEQ ID NO: 8502443 - DNA, 23 bp, Homo sapiens
tggcacagaggaccatgctttgc

SEQ ID NO: 8502444 - DNA, 22 bp, Homo sapiens
tggcacagactgggccaaggaa

SEQ ID NO: 8502445 - DNA, 22 bp, Homo sapiens
tggcacagagggacccagcagc

SEQ ID NO: 8502446 - DNA, 17 bp, Homo sapiens
tggcacagaggtgctat

SEQ ID NO: 8502447 - DNA, 17 bp, Homo sapiens
tggcacagaggtgctat

SEQ ID NO: 8502448 - DNA, 22 bp, Homo sapiens
tggatgtgagaaggatcaggct

SEQ ID NO: 8502449 - DNA, 22 bp, Homo sapiens
tggatgtgagaaggatcaggct

SEQ ID NO: 8502450 - DNA, 22 bp, Homo sapiens
tggatgggttgaaatgtgagcc

SEQ ID NO: 8502451 - DNA, 22 bp, Homo sapiens
tggatgggttgaaatgtgagcc

SEQ ID NO: 8502452 - DNA, 22 bp, Homo sapiens
tggatgtgtcgccctggctctc

SEQ ID NO: 8502453 - DNA, 17 bp, Homo sapiens
tggatgtgggatctgga

SEQ ID NO: 8502454 - DNA, 22 bp, Homo sapiens
tggatatgttggaggtgaaggt

SEQ ID NO: 8502455 - DNA, 22 bp, Homo sapiens
tggattattgtaagacaaagta

SEQ ID NO: 8502456 - DNA, 22 bp, Homo sapiens
tggattagttaagaaatgttag

SEQ ID NO: 8502457 - DNA, 22 bp, Homo sapiens
tggattagtttaacaatgtggc

SEQ ID NO: 8502458 - DNA, 22 bp, Homo sapiens
tggattagtttcaaggcagcaa

SEQ ID NO: 8502459 - DNA, 22 bp, Homo sapiens
tggattcacaccattctcctgc

SEQ ID NO: 8502460 - DNA, 22 bp, Homo sapiens
tggattcaaatttcagctctgt

SEQ ID NO: 8502461 - DNA, 22 bp, Homo sapiens
tggattgataagagacaagtga

SEQ ID NO: 8502462 - DNA, 22 bp, Homo sapiens
tggattgataaaatgggatgtt

SEQ ID NO: 8502463 - DNA, 22 bp, Homo sapiens
tggattgcagcagctcctgtgg

SEQ ID NO: 8502464 - DNA, 22 bp, Homo sapiens
tggatttaacagaataccaggt

SEQ ID NO: 8502465 - DNA, 22 bp, Homo sapiens
tggatttagttcttcacaggcc

SEQ ID NO: 8502466 - DNA, 22 bp, Homo sapiens
tggcaaagaccgcaattacttt

SEQ ID NO: 8502467 - DNA, 22 bp, Homo sapiens
tggcaaagacgctagctaagat

SEQ ID NO: 8502468 - DNA, 22 bp, Homo sapiens
tggcaaagactgcaaggacttt

SEQ ID NO: 8502469 - DNA, 22 bp, Homo sapiens
tggcaaagatgaagcatttcgt

SEQ ID NO: 8502470 - DNA, 22 bp, Homo sapiens
tggcaaagatggttctcaccat

SEQ ID NO: 8502471 - DNA, 22 bp, Homo sapiens
tggcaaagattaccacatctac

SEQ ID NO: 8502472 - DNA, 22 bp, Homo sapiens
tggcaaaggcgctcacatgcct

SEQ ID NO: 8502473 - DNA, 22 bp, Homo sapiens
tggcaaaggcgctcacatgcct

SEQ ID NO: 8502474 - DNA, 22 bp, Homo sapiens
tggcaaaggaacctattttaaa

SEQ ID NO: 8502475 - DNA, 22 bp, Homo sapiens
tggcaaaggggaccatgttgaa

SEQ ID NO: 8502476 - DNA, 22 bp, Homo sapiens
tggcaaagtaattgggtttctc

SEQ ID NO: 8502477 - DNA, 22 bp, Homo sapiens
tggcaaaggaaatgatttaaga

SEQ ID NO: 8502478 - DNA, 22 bp, Homo sapiens
tggcaaaggaaatgatttaaga

SEQ ID NO: 8502479 - DNA, 22 bp, Homo sapiens
tggcaaagctagacattccctc

SEQ ID NO: 8502480 - DNA, 23 bp, Homo sapiens
tggcaaagcattcttataacagt

SEQ ID NO: 8502481 - DNA, 22 bp, Homo sapiens
tggcaaagattaccacatctac

SEQ ID NO: 8502482 - DNA, 22 bp, Homo sapiens
tggcaacacctggaagacatgg

SEQ ID NO: 8502483 - DNA, 22 bp, Homo sapiens
tggcaacatgtcgaagtgctgt

SEQ ID NO: 8502484 - DNA, 22 bp, Homo sapiens
tggcaaagtatctgtcccagct

SEQ ID NO: 8502485 - DNA, 22 bp, Homo sapiens
tggcaaagtatctgtcccagct

SEQ ID NO: 8502486 - DNA, 22 bp, Homo sapiens
tggcaaagtgactccttggggc

SEQ ID NO: 8502487 - DNA, 22 bp, Homo sapiens
tggcaaagtttatcaggaatat

SEQ ID NO: 8502488 - DNA, 19 bp, Homo sapiens
tggcagcctccacttttgc

SEQ ID NO: 8502489 - DNA, 22 bp, Homo sapiens
tggcagcctcagacaaggacct

SEQ ID NO: 8502490 - DNA, 22 bp, Homo sapiens
tggcagccatctgagggtgggg

SEQ ID NO: 8502491 - DNA, 22 bp, Homo sapiens
tggcagccatctgagggtgggg

SEQ ID NO: 8502492 - DNA, 22 bp, Homo sapiens
tggcagcctggaatctctcagc

SEQ ID NO: 8502493 - DNA, 22 bp, Homo sapiens
tggcagcattttttccagaaca

SEQ ID NO: 8502494 - DNA, 22 bp, Homo sapiens
tggcagcattttttccagaaca

SEQ ID NO: 8502495 - DNA, 19 bp, Homo sapiens
tggcagcattggtaccttg

SEQ ID NO: 8502496 - DNA, 19 bp, Homo sapiens
tggcagcattggtaccttg

SEQ ID NO: 8502497 - DNA, 22 bp, Homo sapiens
tggcagcattaattattcaggt

SEQ ID NO: 8502498 - DNA, 22 bp, Homo sapiens
tggcagcattttttccagaaca

SEQ ID NO: 8502499 - DNA, 22 bp, Homo sapiens
tggcagccacatctcgtggatt

SEQ ID NO: 8502500 - DNA, 22 bp, Homo sapiens
tggcagccatcagagcaggggt

SEQ ID NO: 8502501 - DNA, 22 bp, Homo sapiens
tggcagccatcagagcaggggt

SEQ ID NO: 8502502 - DNA, 22 bp, Homo sapiens
tggcagctccgggtaggggctg

SEQ ID NO: 8502503 - DNA, 22 bp, Homo sapiens
tggcagctcctggggccagcac

SEQ ID NO: 8502504 - DNA, 22 bp, Homo sapiens
tggcagctacagacagaggtga

SEQ ID NO: 8502505 - DNA, 22 bp, Homo sapiens
tggcagctacagacagaggtga

SEQ ID NO: 8502506 - DNA, 22 bp, Homo sapiens
tggcagccttctctgagaaggt

SEQ ID NO: 8502507 - DNA, 22 bp, Homo sapiens
tggcagcagggcccctggagga

SEQ ID NO: 8502508 - DNA, 22 bp, Homo sapiens
tggcagcagggcccctggagga

SEQ ID NO: 8502509 - DNA, 22 bp, Homo sapiens
tggcagcagggcccctggagga

SEQ ID NO: 8502510 - DNA, 22 bp, Homo sapiens
tggcagcagtagccaccccagc

SEQ ID NO: 8502511 - DNA, 22 bp, Homo sapiens
tggcagcagggaggccagtgtt

SEQ ID NO: 8502512 - DNA, 18 bp, Homo sapiens
tggcagcaggaagccatt

SEQ ID NO: 8502513 - DNA, 22 bp, Homo sapiens
tggcagcagggaggccagtgtt

SEQ ID NO: 8502514 - DNA, 22 bp, Homo sapiens
tggcagcagggaggccagtgtt

SEQ ID NO: 8502515 - DNA, 22 bp, Homo sapiens
tggcagcatgttatgtaaggaa

SEQ ID NO: 8502516 - DNA, 22 bp, Homo sapiens
tggcagcatgttatgtaaggaa

SEQ ID NO: 8502517 - DNA, 22 bp, Homo sapiens
tggcagcatgtcccggcctcag

SEQ ID NO: 8502518 - DNA, 22 bp, Homo sapiens
tggcagcagtggaggtagaaag

SEQ ID NO: 8502519 - DNA, 22 bp, Homo sapiens
tggcagcagacatctgaggtct

SEQ ID NO: 8502520 - DNA, 22 bp, Homo sapiens
tggcagcagacatctgaggtct

SEQ ID NO: 8502521 - DNA, 22 bp, Homo sapiens
tggcagcagacaaaaggccatt

SEQ ID NO: 8502522 - DNA, 22 bp, Homo sapiens
tggcagcagacaaaaggccatt

SEQ ID NO: 8502523 - DNA, 22 bp, Homo sapiens
tggcagcagacaaaaggccatt

SEQ ID NO: 8502524 - DNA, 23 bp, Homo sapiens
tggcagcagatcttaaagtgacc

SEQ ID NO: 8502525 - DNA, 22 bp, Homo sapiens
tggcagcagcaaatggcatatc

SEQ ID NO: 8502526 - DNA, 22 bp, Homo sapiens
tggcagcagctaacttaggcag

SEQ ID NO: 8502527 - DNA, 22 bp, Homo sapiens
tggcagcagctaacttaggcag

SEQ ID NO: 8502528 - DNA, 18 bp, Homo sapiens
tggcagcaggaagccatt

SEQ ID NO: 8502529 - DNA, 18 bp, Homo sapiens
tggcagcaggaagccatt

SEQ ID NO: 8502530 - DNA, 22 bp, Homo sapiens
tggcagcagccatggaaggccc

SEQ ID NO: 8502531 - DNA, 22 bp, Homo sapiens
tggcagcagccatggaaggccc

SEQ ID NO: 8502532 - DNA, 22 bp, Homo sapiens
tggcagagtgcagaagaggcat

SEQ ID NO: 8502533 - DNA, 22 bp, Homo sapiens
tggcagagtgcagaagaggcat

SEQ ID NO: 8502534 - DNA, 22 bp, Homo sapiens
tggcagagtctgggcttgggca

SEQ ID NO: 8502535 - DNA, 22 bp, Homo sapiens
tggcagagtctgggcttgggca

SEQ ID NO: 8502536 - DNA, 22 bp, Homo sapiens
tggcagagtctgggcttgggca

SEQ ID NO: 8502537 - DNA, 22 bp, Homo sapiens
tggcagagtgcggcatcccctg

SEQ ID NO: 8502538 - DNA, 21 bp, Homo sapiens
tggcagagtgcagtctataca

SEQ ID NO: 8502539 - DNA, 22 bp, Homo sapiens
tggcagagtggaccatactcaa

SEQ ID NO: 8502540 - DNA, 22 bp, Homo sapiens
tggcagagtaggatggccctgt

SEQ ID NO: 8502541 - DNA, 22 bp, Homo sapiens
tggcagagtaggatggccctgt

SEQ ID NO: 8502542 - DNA, 22 bp, Homo sapiens
tggcagagtaggatggccctgt

SEQ ID NO: 8502543 - DNA, 22 bp, Homo sapiens
tggcagagtcatcacatctgga

SEQ ID NO: 8502544 - DNA, 22 bp, Homo sapiens
tggcagagtcatcacatctgga

SEQ ID NO: 8502545 - DNA, 22 bp, Homo sapiens
tggcagagtcatcacatctgga

SEQ ID NO: 8502546 - DNA, 22 bp, Homo sapiens
tggcagagtctgggcttgggca

SEQ ID NO: 8502547 - DNA, 22 bp, Homo sapiens
tggcagagtctgggcttgggca

SEQ ID NO: 8502548 - DNA, 22 bp, Homo sapiens
tggcagagtctctcctttccag

SEQ ID NO: 8502549 - DNA, 22 bp, Homo sapiens
tggcagagtctctcctttccag

SEQ ID NO: 8502550 - DNA, 22 bp, Homo sapiens
tggcagagtctctcctttccag

SEQ ID NO: 8502551 - DNA, 22 bp, Homo sapiens
tggcagagtcatcacatctgga

SEQ ID NO: 8502552 - DNA, 22 bp, Homo sapiens
tggcagagttcgctgtgccttt

SEQ ID NO: 8502553 - DNA, 21 bp, Homo sapiens
tggcagagttgagtagttatg

SEQ ID NO: 8502554 - DNA, 22 bp, Homo sapiens
tggcagagttcgctgtgccttt

SEQ ID NO: 8502555 - DNA, 22 bp, Homo sapiens
tggcagagttcgctgtgccttt

SEQ ID NO: 8502556 - DNA, 22 bp, Homo sapiens
tggcagagttcgctgtgccttt

SEQ ID NO: 8502557 - DNA, 22 bp, Homo sapiens
tggcagagttcgctgtgccttt

SEQ ID NO: 8502558 - DNA, 22 bp, Homo sapiens
tggcagagttcgctcctattca

SEQ ID NO: 8502559 - DNA, 22 bp, Homo sapiens
tggcagagttcgctcctattca

SEQ ID NO: 8502560 - DNA, 22 bp, Homo sapiens
tggcagagttcgctcctattca

SEQ ID NO: 8502561 - DNA, 22 bp, Homo sapiens
tggcagagtggaccatactcaa

SEQ ID NO: 8502562 - DNA, 22 bp, Homo sapiens
tggcagagtggaccatactcaa

SEQ ID NO: 8502563 - DNA, 18 bp, Homo sapiens
tggcagagtgtctgttct

SEQ ID NO: 8502564 - DNA, 18 bp, Homo sapiens
tggcagagtgtctgttct

SEQ ID NO: 8502565 - DNA, 18 bp, Homo sapiens
tggcagagtgtctgttct

SEQ ID NO: 8502566 - DNA, 22 bp, Homo sapiens
tggcagagttatgggtatttat

SEQ ID NO: 8502567 - DNA, 18 bp, Homo sapiens
tggcagagtgtctgttct

SEQ ID NO: 8502568 - DNA, 18 bp, Homo sapiens
tggcagagtgtctgttct

SEQ ID NO: 8502569 - DNA, 22 bp, Homo sapiens
tggcagagttatgggtatttat

SEQ ID NO: 8502570 - DNA, 20 bp, Homo sapiens
tggcagagttgtcccaccca

SEQ ID NO: 8502571 - DNA, 22 bp, Homo sapiens
tggcagagttggaggtggaaga

SEQ ID NO: 8502572 - DNA, 22 bp, Homo sapiens
tggcagagttggaggtggaaga

SEQ ID NO: 8502573 - DNA, 22 bp, Homo sapiens
tggcagagttggaggtggaaga

SEQ ID NO: 8502574 - DNA, 21 bp, Homo sapiens
tggcagagttgagtagttatg

SEQ ID NO: 8502575 - DNA, 22 bp, Homo sapiens
tggcagcacttgaacttgagcc

SEQ ID NO: 8502576 - DNA, 22 bp, Homo sapiens
tggcagcacttgaacttgagcc

SEQ ID NO: 8502577 - DNA, 22 bp, Homo sapiens
tggcagcagacaaaaggccatt

SEQ ID NO: 8502578 - DNA, 22 bp, Homo sapiens
tggcagataaacatgtgataaa

SEQ ID NO: 8502579 - DNA, 22 bp, Homo sapiens
tggcagataacctgctgtgccc

SEQ ID NO: 8502580 - DNA, 20 bp, Homo sapiens
tggcagagttgtcccaccca

SEQ ID NO: 8502581 - DNA, 22 bp, Homo sapiens
tggcaggatctttgagagtgaa

SEQ ID NO: 8502582 - DNA, 22 bp, Homo sapiens
tggcaggatctttgagagtgaa

SEQ ID NO: 8502583 - DNA, 21 bp, Homo sapiens
tggcaggcagctggaagcttg

SEQ ID NO: 8502584 - DNA, 22 bp, Homo sapiens
tggcaggcagtgtgggagctgg

SEQ ID NO: 8502585 - DNA, 22 bp, Homo sapiens
tggcaggcaggcagccttctga

SEQ ID NO: 8502586 - DNA, 22 bp, Homo sapiens
tggcaggcaggcagccttctga

SEQ ID NO: 8502587 - DNA, 22 bp, Homo sapiens
tggcagggagccaccggtcatg

SEQ ID NO: 8502588 - DNA, 22 bp, Homo sapiens
tggcagggagccaccggtcatg

SEQ ID NO: 8502589 - DNA, 22 bp, Homo sapiens
tggcaggcattgatgcgagttc

SEQ ID NO: 8502590 - DNA, 22 bp, Homo sapiens
tggcaggcagtgtgggagctgg

SEQ ID NO: 8502591 - DNA, 22 bp, Homo sapiens
tggcaggcatccggcaccttct

SEQ ID NO: 8502592 - DNA, 18 bp, Homo sapiens
tggcagggaggaaatata

SEQ ID NO: 8502593 - DNA, 18 bp, Homo sapiens
tggcagggaggaaatata

SEQ ID NO: 8502594 - DNA, 22 bp, Homo sapiens
tggcagggagttcgttcacaac

SEQ ID NO: 8502595 - DNA, 19 bp, Homo sapiens
tggcagggagtgatattag

SEQ ID NO: 8502596 - DNA, 19 bp, Homo sapiens
tggcagggagtgatattag

SEQ ID NO: 8502597 - DNA, 21 bp, Homo sapiens
tggcaggggtagtagtacagc

SEQ ID NO: 8502598 - DNA, 21 bp, Homo sapiens
tggcaggggtagtagtacagc

SEQ ID NO: 8502599 - DNA, 21 bp, Homo sapiens
tggcaggggtagtagtacagc

SEQ ID NO: 8502600 - DNA, 21 bp, Homo sapiens
tggcaggggtagtagtacagc

SEQ ID NO: 8502601 - DNA, 21 bp, Homo sapiens
tggcaggggtagtagtacagc

SEQ ID NO: 8502602 - DNA, 22 bp, Homo sapiens
tggcaggggaggtgcttgctta

SEQ ID NO: 8502603 - DNA, 22 bp, Homo sapiens
tggcaggggaggtgcttgctta

SEQ ID NO: 8502604 - DNA, 22 bp, Homo sapiens
tggcaggggaggtgcttgctta

SEQ ID NO: 8502605 - DNA, 22 bp, Homo sapiens
tggcaggggaggtgcttgctta

SEQ ID NO: 8502606 - DNA, 22 bp, Homo sapiens
tggcagggcctgaatcttatac

SEQ ID NO: 8502607 - DNA, 22 bp, Homo sapiens
tggcagggcctgaatcttatac

SEQ ID NO: 8502608 - DNA, 22 bp, Homo sapiens
tggcagggcctgaatcttatac

SEQ ID NO: 8502609 - DNA, 22 bp, Homo sapiens
tggcagggcctaccccaatatc

SEQ ID NO: 8502610 - DNA, 22 bp, Homo sapiens
tggcagggcctgctcatcatcc

SEQ ID NO: 8502611 - DNA, 22 bp, Homo sapiens
tggcagggagttgcaggatttc

SEQ ID NO: 8502612 - DNA, 22 bp, Homo sapiens
tggcagggagttgcaggatttc

SEQ ID NO: 8502613 - DNA, 22 bp, Homo sapiens
tggcagggagttgcaggatttc

SEQ ID NO: 8502614 - DNA, 22 bp, Homo sapiens
tggcaggagcctgcggggaggt

SEQ ID NO: 8502615 - DNA, 22 bp, Homo sapiens
tggcaggaggatgaggcggcta

SEQ ID NO: 8502616 - DNA, 22 bp, Homo sapiens
tggcaggagcctgcggggaggt

SEQ ID NO: 8502617 - DNA, 22 bp, Homo sapiens
tggcaggatctttgagagtgaa

SEQ ID NO: 8502618 - DNA, 22 bp, Homo sapiens
tggcaggaggttttctccagga

SEQ ID NO: 8502619 - DNA, 22 bp, Homo sapiens
tggcaggaggttttctccagga

SEQ ID NO: 8502620 - DNA, 22 bp, Homo sapiens
tggcaggagacacatggcatag

SEQ ID NO: 8502621 - DNA, 20 bp, Homo sapiens
tggcaggaatagggccagag

SEQ ID NO: 8502622 - DNA, 22 bp, Homo sapiens
tggcagctgaggggaggctttg

SEQ ID NO: 8502623 - DNA, 22 bp, Homo sapiens
tggcagctgaggggaggctttg

SEQ ID NO: 8502624 - DNA, 22 bp, Homo sapiens
tggcagctgattagatggtgcc

SEQ ID NO: 8502625 - DNA, 22 bp, Homo sapiens
tggcagctgattagatggtgcc

SEQ ID NO: 8502626 - DNA, 17 bp, Homo sapiens
tggcagctgaaagctct

SEQ ID NO: 8502627 - DNA, 22 bp, Homo sapiens
tggcaggaaccttaaccacaaa

SEQ ID NO: 8502628 - DNA, 22 bp, Homo sapiens
tgctcagtgagtctgtgacagg

SEQ ID NO: 8502629 - DNA, 19 bp, Homo sapiens
tgctcagtggctaaaagca

SEQ ID NO: 8502630 - DNA, 22 bp, Homo sapiens
tgctcagttaagcagaggaaat

SEQ ID NO: 8502631 - DNA, 21 bp, Homo sapiens
tgctcatgcaatgcatgtcca

SEQ ID NO: 8502632 - DNA, 22 bp, Homo sapiens
tgctcatcaacatgatgatcat

SEQ ID NO: 8502633 - DNA, 19 bp, Homo sapiens
tgctcatggggacttctcc

SEQ ID NO: 8502634 - DNA, 22 bp, Homo sapiens
tgctcattaggactgcaaattc

SEQ ID NO: 8502635 - DNA, 22 bp, Homo sapiens
tgctcatgctggggacagatgt

SEQ ID NO: 8502636 - DNA, 21 bp, Homo sapiens
tgctcagtctgtctccagctt

SEQ ID NO: 8502637 - DNA, 22 bp, Homo sapiens
tgctcagtcctcctgcagtgcc

SEQ ID NO: 8502638 - DNA, 22 bp, Homo sapiens
tgctcagtcctcctgcagtgcc

SEQ ID NO: 8502639 - DNA, 22 bp, Homo sapiens
tgctcagtcctaccttggctcc

SEQ ID NO: 8502640 - DNA, 22 bp, Homo sapiens
tgctcagtagcagtgtgctgct

SEQ ID NO: 8502641 - DNA, 22 bp, Homo sapiens
tgctcagtcctaccttggctcc

SEQ ID NO: 8502642 - DNA, 22 bp, Homo sapiens
tgctccagcaccaagagctcca

SEQ ID NO: 8502643 - DNA, 22 bp, Homo sapiens
tgctccagcaacaggcttagct

SEQ ID NO: 8502644 - DNA, 22 bp, Homo sapiens
tgctccagcaacaggcttagct

SEQ ID NO: 8502645 - DNA, 22 bp, Homo sapiens
tgctccagaaaaacttgagact

SEQ ID NO: 8502646 - DNA, 16 bp, Homo sapiens
tgctccagaggaccca

SEQ ID NO: 8502647 - DNA, 22 bp, Homo sapiens
tgctccagaacctgaccatgct

SEQ ID NO: 8502648 - DNA, 22 bp, Homo sapiens
tgctcattgctgatttacatgt

SEQ ID NO: 8502649 - DNA, 22 bp, Homo sapiens
tgctcattggcgatctgaggga

SEQ ID NO: 8502650 - DNA, 22 bp, Homo sapiens
tgctcattggcgatctgaggga

SEQ ID NO: 8502651 - DNA, 22 bp, Homo sapiens
tgctccaccctcacactcttcc

SEQ ID NO: 8502652 - DNA, 22 bp, Homo sapiens
tgctccaccctcacactcttcc

SEQ ID NO: 8502653 - DNA, 22 bp, Homo sapiens
tgctccaccctcacactcttcc

SEQ ID NO: 8502654 - DNA, 22 bp, Homo sapiens
tgctccactaagccatcccatt

SEQ ID NO: 8502655 - DNA, 22 bp, Homo sapiens
tgctccactgtgcgtggccata

SEQ ID NO: 8502656 - DNA, 22 bp, Homo sapiens
tgctcagaaacgaggtgcagcc

SEQ ID NO: 8502657 - DNA, 22 bp, Homo sapiens
tgctcactgaactcttgctgtc

SEQ ID NO: 8502658 - DNA, 22 bp, Homo sapiens
tgctcactgaactcttgctgtc

SEQ ID NO: 8502659 - DNA, 19 bp, Homo sapiens
tgctcactctcagtccctc

SEQ ID NO: 8502660 - DNA, 17 bp, Homo sapiens
tgctcaaatacttttga

SEQ ID NO: 8502661 - DNA, 21 bp, Homo sapiens
tgctcacagatgtgctcagtg

SEQ ID NO: 8502662 - DNA, 22 bp, Homo sapiens
tgctcacagcccagaacataat

SEQ ID NO: 8502663 - DNA, 22 bp, Homo sapiens
tgctcagacaagctgaacagta

SEQ ID NO: 8502664 - DNA, 22 bp, Homo sapiens
tgctcagagctctggtgcaggt

SEQ ID NO: 8502665 - DNA, 22 bp, Homo sapiens
tgctaaataagtggaatagaca

SEQ ID NO: 8502666 - DNA, 22 bp, Homo sapiens
tgctaaattcattattgattta

SEQ ID NO: 8502667 - DNA, 22 bp, Homo sapiens
tgcgtttagtttcaagacacgt

SEQ ID NO: 8502668 - DNA, 22 bp, Homo sapiens
tgcgtttagtttcaagacacgt

SEQ ID NO: 8502669 - DNA, 22 bp, Homo sapiens
tgctaaataacttacatagtgg

SEQ ID NO: 8502670 - DNA, 22 bp, Homo sapiens
tgctaaataacttacatagtgg

SEQ ID NO: 8502671 - DNA, 22 bp, Homo sapiens
tgcgttgcgctcctgcagcagg

SEQ ID NO: 8502672 - DNA, 22 bp, Homo sapiens
tgcgtgtgtgtatatacacagg

SEQ ID NO: 8502673 - DNA, 23 bp, Homo sapiens
tgcgtgtgtgctgaggggcgtcc

SEQ ID NO: 8502674 - DNA, 20 bp, Homo sapiens
tgcgtgtgtatttattttct

SEQ ID NO: 8502675 - DNA, 20 bp, Homo sapiens
tgcgtgtgtatttattttct

SEQ ID NO: 8502676 - DNA, 23 bp, Homo sapiens
tgcgtgtgtgctgaggggcgtcc

SEQ ID NO: 8502677 - DNA, 22 bp, Homo sapiens
tgcgggtcccagggtcacaggc

SEQ ID NO: 8502678 - DNA, 22 bp, Homo sapiens
tgcgggttggtggcatatgcag

SEQ ID NO: 8502679 - DNA, 22 bp, Homo sapiens
tgcgggttggtggcatatgcag

SEQ ID NO: 8502680 - DNA, 23 bp, Homo sapiens
tgcgtacggctgccagtgtgact

SEQ ID NO: 8502681 - DNA, 22 bp, Homo sapiens
tgcgggttggtggcatatgcag

SEQ ID NO: 8502682 - DNA, 22 bp, Homo sapiens
tgcgtggcgcagcgtgtgggat

SEQ ID NO: 8502683 - DNA, 22 bp, Homo sapiens
tgcgtggctggtccctgtgacc

SEQ ID NO: 8502684 - DNA, 21 bp, Homo sapiens
tgcgtgtgcatggccttcggg

SEQ ID NO: 8502685 - DNA, 22 bp, Homo sapiens
tgcgtggcgcagcgtgtgggat

SEQ ID NO: 8502686 - DNA, 22 bp, Homo sapiens
tgcgtagtacgaatttgtgcct

SEQ ID NO: 8502687 - DNA, 22 bp, Homo sapiens
tgcgtctggagtggagtttgaa

SEQ ID NO: 8502688 - DNA, 22 bp, Homo sapiens
tgcggagggagcagtcggctgt

SEQ ID NO: 8502689 - DNA, 22 bp, Homo sapiens
tgcgcctctaatctcgggcgtc

SEQ ID NO: 8502690 - DNA, 22 bp, Homo sapiens
tgcgccatgtgctctcggccct

SEQ ID NO: 8502691 - DNA, 22 bp, Homo sapiens
tgcgccatgtgctctcggccct

SEQ ID NO: 8502692 - DNA, 17 bp, Homo sapiens
tgcgatgtctgtgtttg

SEQ ID NO: 8502693 - DNA, 22 bp, Homo sapiens
tgcgatgtatgcagtatttgtt

SEQ ID NO: 8502694 - DNA, 22 bp, Homo sapiens
tgctatttgggggctacatgat

SEQ ID NO: 8502695 - DNA, 22 bp, Homo sapiens
tgctatttctctgctgtaaaat

SEQ ID NO: 8502696 - DNA, 22 bp, Homo sapiens
tgctatttctctgctgtaaaat

SEQ ID NO: 8502697 - DNA, 19 bp, Homo sapiens
tgctatttgaagaagtgta

SEQ ID NO: 8502698 - DNA, 19 bp, Homo sapiens
tgctatttagaacgcctgg

SEQ ID NO: 8502699 - DNA, 22 bp, Homo sapiens
tgctatttttatcttgatcaaa

SEQ ID NO: 8502700 - DNA, 22 bp, Homo sapiens
tgctatttttatcttgatcaaa

SEQ ID NO: 8502701 - DNA, 22 bp, Homo sapiens
tgctatttttatcttgatcaaa

SEQ ID NO: 8502702 - DNA, 22 bp, Homo sapiens
tgctatttgtgagtgtcttcgt

SEQ ID NO: 8502703 - DNA, 22 bp, Homo sapiens
tgctatttgggggctacatgat

SEQ ID NO: 8502704 - DNA, 22 bp, Homo sapiens
tgctatgtgactgcttcagatt

SEQ ID NO: 8502705 - DNA, 22 bp, Homo sapiens
tgctagtgtgtgagatgttcaa

SEQ ID NO: 8502706 - DNA, 22 bp, Homo sapiens
tgctataagaattatattactc

SEQ ID NO: 8502707 - DNA, 22 bp, Homo sapiens
tgctataagtagacattcaaca

SEQ ID NO: 8502708 - DNA, 22 bp, Homo sapiens
tgctataagctccacgctgtag

SEQ ID NO: 8502709 - DNA, 22 bp, Homo sapiens
tgctatacatgtacatattagt

SEQ ID NO: 8502710 - DNA, 22 bp, Homo sapiens
tgcctgtctctgactgccatta

SEQ ID NO: 8502711 - DNA, 22 bp, Homo sapiens
tgcctgtctcctctgcagggtg

SEQ ID NO: 8502712 - DNA, 22 bp, Homo sapiens
tgcctgtcctgaggatgagggt

SEQ ID NO: 8502713 - DNA, 19 bp, Homo sapiens
tgcctgtcagtagatctca

SEQ ID NO: 8502714 - DNA, 22 bp, Homo sapiens
tgcctgtcttaatatctggaaa

SEQ ID NO: 8502715 - DNA, 22 bp, Homo sapiens
tgcctgtcttcaggagtgtcac

SEQ ID NO: 8502716 - DNA, 22 bp, Homo sapiens
tgcctgtcttcaggagtgtcac

SEQ ID NO: 8502717 - DNA, 22 bp, Homo sapiens
tgcctgtcttggagtcctggcc

SEQ ID NO: 8502718 - DNA, 22 bp, Homo sapiens
tgcctgtcttggagtcctggcc

SEQ ID NO: 8502719 - DNA, 22 bp, Homo sapiens
tgcctgtctttcctccctcgta

SEQ ID NO: 8502720 - DNA, 22 bp, Homo sapiens
tgcctgtctttcctccctcgta

SEQ ID NO: 8502721 - DNA, 22 bp, Homo sapiens
tgcctgggtgctggctggtcac

SEQ ID NO: 8502722 - DNA, 22 bp, Homo sapiens
tgcctgggtgtaaagggccaac

SEQ ID NO: 8502723 - DNA, 22 bp, Homo sapiens
tgcctgtcagggggagtgggaa

SEQ ID NO: 8502724 - DNA, 22 bp, Homo sapiens
tgcctgggttgactcttagctg

SEQ ID NO: 8502725 - DNA, 22 bp, Homo sapiens
tgcctgggttgactcttagctg

SEQ ID NO: 8502726 - DNA, 22 bp, Homo sapiens
tgcctgggttcccaccccaaag

SEQ ID NO: 8502727 - DNA, 22 bp, Homo sapiens
tgcctgggttcccaccccaaag

SEQ ID NO: 8502728 - DNA, 22 bp, Homo sapiens
tgcctgggtgtaaagggccaac

SEQ ID NO: 8502729 - DNA, 22 bp, Homo sapiens
tgcctgggtgtaaagggccaac

SEQ ID NO: 8502730 - DNA, 22 bp, Homo sapiens
tgcctgggtgtaaagggccaac

SEQ ID NO: 8502731 - DNA, 22 bp, Homo sapiens
tgcctgggtgtaaagggccaac

SEQ ID NO: 8502732 - DNA, 22 bp, Homo sapiens
tgcctgggggactaaggccaaa

SEQ ID NO: 8502733 - DNA, 22 bp, Homo sapiens
tgcctgggggactaaggccaaa

SEQ ID NO: 8502734 - DNA, 22 bp, Homo sapiens
tgcctgggggactaaggccaaa

SEQ ID NO: 8502735 - DNA, 22 bp, Homo sapiens
tgcctgggtccaggccaagcct

SEQ ID NO: 8502736 - DNA, 22 bp, Homo sapiens
tgcctggggttggcaaactgct

SEQ ID NO: 8502737 - DNA, 22 bp, Homo sapiens
tgcctggggattgctctgggcc

SEQ ID NO: 8502738 - DNA, 22 bp, Homo sapiens
tgcctgggctcggtagccatcg

SEQ ID NO: 8502739 - DNA, 22 bp, Homo sapiens
tgcctgggaaccaatcctggct

SEQ ID NO: 8502740 - DNA, 22 bp, Homo sapiens
tgcctgggaaccaatcctggct

SEQ ID NO: 8502741 - DNA, 22 bp, Homo sapiens
tgcctggctgggctgctcatgg

SEQ ID NO: 8502742 - DNA, 22 bp, Homo sapiens
tgcctggccctgacagccctgg

SEQ ID NO: 8502743 - DNA, 20 bp, Homo sapiens
tgcctggcctttctctgccc

SEQ ID NO: 8502744 - DNA, 22 bp, Homo sapiens
tgcctggccctgacagccctgg

SEQ ID NO: 8502745 - DNA, 22 bp, Homo sapiens
tgcctggctgaggtgacaggtt

SEQ ID NO: 8502746 - DNA, 21 bp, Homo sapiens
tgcctggcctttgcttttcct

SEQ ID NO: 8502747 - DNA, 22 bp, Homo sapiens
tgcctggctctatcagtggtgg

SEQ ID NO: 8502748 - DNA, 19 bp, Homo sapiens
tgcctgtggcgagcatctt

SEQ ID NO: 8502749 - DNA, 19 bp, Homo sapiens
tgcctgtggcgagcatctt

SEQ ID NO: 8502750 - DNA, 22 bp, Homo sapiens
tgcctgtgggtgatgatttgat

SEQ ID NO: 8502751 - DNA, 22 bp, Homo sapiens
tgcctgtggttccagttttttc

SEQ ID NO: 8502752 - DNA, 22 bp, Homo sapiens
tgcctgtgggtgatgatttgat

SEQ ID NO: 8502753 - DNA, 22 bp, Homo sapiens
tgcctgtgtatgtgcatgcaca

SEQ ID NO: 8502754 - DNA, 22 bp, Homo sapiens
tgcctgtgtatgtgcatgcaca

SEQ ID NO: 8502755 - DNA, 22 bp, Homo sapiens
tgcctgtgcccttcttggcatt

SEQ ID NO: 8502756 - DNA, 22 bp, Homo sapiens
tgcctgtgccctttgctgggag

SEQ ID NO: 8502757 - DNA, 22 bp, Homo sapiens
tgcctgtgccctttgctgggag

SEQ ID NO: 8502758 - DNA, 22 bp, Homo sapiens
tgcctgtgccctttgctgggag

SEQ ID NO: 8502759 - DNA, 22 bp, Homo sapiens
tgcctgtggaaaggctggtgct

SEQ ID NO: 8502760 - DNA, 22 bp, Homo sapiens
tgcctgtggaaaggctggtgct

SEQ ID NO: 8502761 - DNA, 22 bp, Homo sapiens
tgcctgtgtcacagtgatgttt

SEQ ID NO: 8502762 - DNA, 22 bp, Homo sapiens
tgcctgtgtatgtgcatgcaca

SEQ ID NO: 8502763 - DNA, 22 bp, Homo sapiens
tgcctgtgtcacagtgatgttt

SEQ ID NO: 8502764 - DNA, 22 bp, Homo sapiens
tgcctgtgtcacagtgatgttt

SEQ ID NO: 8502765 - DNA, 22 bp, Homo sapiens
tgcctgtgtcacagtgatgttt

SEQ ID NO: 8502766 - DNA, 22 bp, Homo sapiens
tgcctgtgtccccttcttggca

SEQ ID NO: 8502767 - DNA, 22 bp, Homo sapiens
tgccttcttctccctggctcag

SEQ ID NO: 8502768 - DNA, 22 bp, Homo sapiens
tgccttcttgaatatggttctt

SEQ ID NO: 8502769 - DNA, 22 bp, Homo sapiens
tgccttgcttcaatcaaaccgt

SEQ ID NO: 8502770 - DNA, 22 bp, Homo sapiens
tgccttgcgggcgtttctgttg

SEQ ID NO: 8502771 - DNA, 22 bp, Homo sapiens
tgccttggattgcagggaacct

SEQ ID NO: 8502772 - DNA, 22 bp, Homo sapiens
tgccttggattgcagggaacct

SEQ ID NO: 8502773 - DNA, 22 bp, Homo sapiens
tgccttgggatatatggacact

SEQ ID NO: 8502774 - DNA, 22 bp, Homo sapiens
tgccttggtgcttcttcatgtg

SEQ ID NO: 8502775 - DNA, 22 bp, Homo sapiens
tgccttggtttccccatctgta

SEQ ID NO: 8502776 - DNA, 22 bp, Homo sapiens
tgccttttatggctagcctcag

SEQ ID NO: 8502777 - DNA, 22 bp, Homo sapiens
tgccttttccagcttccaggag

SEQ ID NO: 8502778 - DNA, 22 bp, Homo sapiens
tgccttttccagtttctagggg

SEQ ID NO: 8502779 - DNA, 20 bp, Homo sapiens
tgcctttcctgtttcatctt

SEQ ID NO: 8502780 - DNA, 22 bp, Homo sapiens
tgcgatggcgtagacaaatccc

SEQ ID NO: 8502781 - DNA, 22 bp, Homo sapiens
tgcgatgtatgcagtatttgtt

SEQ ID NO: 8502782 - DNA, 17 bp, Homo sapiens
tgcgatgtctgtgtttg

SEQ ID NO: 8502783 - DNA, 22 bp, Homo sapiens
tgcgagagtggaaaggaagcct

SEQ ID NO: 8502784 - DNA, 22 bp, Homo sapiens
tgccttttgaagcctcacaggt

SEQ ID NO: 8502785 - DNA, 22 bp, Homo sapiens
tgccttttctgtagctctggaa

SEQ ID NO: 8502786 - DNA, 22 bp, Homo sapiens
tgctgaggagggcacccggggg

SEQ ID NO: 8502787 - DNA, 22 bp, Homo sapiens
tgctgaggactaaaggagatga

SEQ ID NO: 8502788 - DNA, 22 bp, Homo sapiens
tgctgaggaggtggctgtgctt

SEQ ID NO: 8502789 - DNA, 22 bp, Homo sapiens
tgctgaggaggtggctgtgctt

SEQ ID NO: 8502790 - DNA, 19 bp, Homo sapiens
tgctgaggatgcaagatcc

SEQ ID NO: 8502791 - DNA, 22 bp, Homo sapiens
tgctgaggaggtggctgtgctt

SEQ ID NO: 8502792 - DNA, 22 bp, Homo sapiens
tgctgaggacacctagccttct

SEQ ID NO: 8502793 - DNA, 22 bp, Homo sapiens
tgctgaggactaaaggagatga

SEQ ID NO: 8502794 - DNA, 22 bp, Homo sapiens
tgctgaggaatttggtttatgt

SEQ ID NO: 8502795 - DNA, 22 bp, Homo sapiens
tgctgaggaataattgttcctg

SEQ ID NO: 8502796 - DNA, 22 bp, Homo sapiens
tgctgaggaaaaatgtgactct

SEQ ID NO: 8502797 - DNA, 22 bp, Homo sapiens
tgctgaggaaagaggataaaag

SEQ ID NO: 8502798 - DNA, 22 bp, Homo sapiens
tgctgagcgcatccggcggccg

SEQ ID NO: 8502799 - DNA, 22 bp, Homo sapiens
tgctgagcgcatccggcggccg

SEQ ID NO: 8502800 - DNA, 22 bp, Homo sapiens
tgctgagatgaatagggctgtc

SEQ ID NO: 8502801 - DNA, 22 bp, Homo sapiens
tgctgagatgaatagagacctc

SEQ ID NO: 8502802 - DNA, 22 bp, Homo sapiens
tgctgaaaagtaaataggccta

SEQ ID NO: 8502803 - DNA, 22 bp, Homo sapiens
tgctgaaaatgcgtatcttcca

SEQ ID NO: 8502804 - DNA, 22 bp, Homo sapiens
tgctgaaacaataacatactgg

SEQ ID NO: 8502805 - DNA, 22 bp, Homo sapiens
tgctgaaagaccgtatttatct

SEQ ID NO: 8502806 - DNA, 22 bp, Homo sapiens
tgctgaagggaaggtcttgaat

SEQ ID NO: 8502807 - DNA, 22 bp, Homo sapiens
tgctgaaagtcccaaatctcat

SEQ ID NO: 8502808 - DNA, 22 bp, Homo sapiens
tgctctgggttcttgctgttac

SEQ ID NO: 8502809 - DNA, 22 bp, Homo sapiens
tgctctgggtcctgggcctcct

SEQ ID NO: 8502810 - DNA, 22 bp, Homo sapiens
tgctctgggtcctgggcctcct

SEQ ID NO: 8502811 - DNA, 20 bp, Homo sapiens
tgctctgggggtggagagac

SEQ ID NO: 8502812 - DNA, 20 bp, Homo sapiens
tgctctgggggtggagagac

SEQ ID NO: 8502813 - DNA, 22 bp, Homo sapiens
tgctctggtaactcacttccat

SEQ ID NO: 8502814 - DNA, 22 bp, Homo sapiens
tgctctggtaactcacttccat

SEQ ID NO: 8502815 - DNA, 22 bp, Homo sapiens
tgctctggtaactcacttccat

SEQ ID NO: 8502816 - DNA, 22 bp, Homo sapiens
tgctctggtcctccctcggcgc

SEQ ID NO: 8502817 - DNA, 18 bp, Homo sapiens
tgctctggtctcacttgg

SEQ ID NO: 8502818 - DNA, 18 bp, Homo sapiens
tgctctggtctcacttgg

SEQ ID NO: 8502819 - DNA, 18 bp, Homo sapiens
tgctctggtctcacttgg

SEQ ID NO: 8502820 - DNA, 22 bp, Homo sapiens
tgctctggtcctccctcggcgc

SEQ ID NO: 8502821 - DNA, 22 bp, Homo sapiens
tgctctgtcaagaaaagatgcc

SEQ ID NO: 8502822 - DNA, 22 bp, Homo sapiens
tgctctgtcaagaaaagatgcc

SEQ ID NO: 8502823 - DNA, 23 bp, Homo sapiens
tgctctgtgaatagttggtgact

SEQ ID NO: 8502824 - DNA, 22 bp, Homo sapiens
tgctctgtggtccaagatggct

SEQ ID NO: 8502825 - DNA, 22 bp, Homo sapiens
tgctctgtaggggaaagagagc

SEQ ID NO: 8502826 - DNA, 22 bp, Homo sapiens
tgctctgtaacaaattgacatg

SEQ ID NO: 8502827 - DNA, 22 bp, Homo sapiens
tgctctgtaacaaattgacatg

SEQ ID NO: 8502828 - DNA, 22 bp, Homo sapiens
tgctctgtaacaaattgacatg

SEQ ID NO: 8502829 - DNA, 22 bp, Homo sapiens
tgctctgtcaagaaaagatgcc

SEQ ID NO: 8502830 - DNA, 22 bp, Homo sapiens
tgctctgtattctatggcagtt

SEQ ID NO: 8502831 - DNA, 22 bp, Homo sapiens
tgctctgtattctatggcagtt

SEQ ID NO: 8502832 - DNA, 17 bp, Homo sapiens
tgctctgtggtctttta

SEQ ID NO: 8502833 - DNA, 22 bp, Homo sapiens
tgctctgttgtgcatgtgggat

SEQ ID NO: 8502834 - DNA, 22 bp, Homo sapiens
tgctctgttcagtgtatcttgt

SEQ ID NO: 8502835 - DNA, 18 bp, Homo sapiens
tgctctgtttaatgattt

SEQ ID NO: 8502836 - DNA, 18 bp, Homo sapiens
tgctctgtttaatgattt

SEQ ID NO: 8502837 - DNA, 22 bp, Homo sapiens
tgctcttcggggccactgcttg

SEQ ID NO: 8502838 - DNA, 22 bp, Homo sapiens
tgctcttcggggccactgcttg

SEQ ID NO: 8502839 - DNA, 22 bp, Homo sapiens
tgctgaggcagatgtctgtgac

SEQ ID NO: 8502840 - DNA, 22 bp, Homo sapiens
tgctgaggcagatgtctgtgac

SEQ ID NO: 8502841 - DNA, 22 bp, Homo sapiens
tgctgaggcagatgtctgtgac

SEQ ID NO: 8502842 - DNA, 22 bp, Homo sapiens
tgctgaggcatttggacagagt

SEQ ID NO: 8502843 - DNA, 22 bp, Homo sapiens
tgctgaggcagtcctaacagga

SEQ ID NO: 8502844 - DNA, 20 bp, Homo sapiens
tgctgaggcctgaggcctgg

SEQ ID NO: 8502845 - DNA, 20 bp, Homo sapiens
tgctgaggcctgaggcctgg

SEQ ID NO: 8502846 - DNA, 22 bp, Homo sapiens
tgctgaggctagacctggaagt

SEQ ID NO: 8502847 - DNA, 22 bp, Homo sapiens
tgctgaggcccaggagcacttt

SEQ ID NO: 8502848 - DNA, 22 bp, Homo sapiens
tgctgaggcccaggagcacttt

SEQ ID NO: 8502849 - DNA, 22 bp, Homo sapiens
tgctgaggcatttggacagagt

SEQ ID NO: 8502850 - DNA, 22 bp, Homo sapiens
tgctgagggctgttaaggaagc

SEQ ID NO: 8502851 - DNA, 22 bp, Homo sapiens
tgctgagggcagatgaattaga

SEQ ID NO: 8502852 - DNA, 22 bp, Homo sapiens
tgctgaggtaaccatatcctgc

SEQ ID NO: 8502853 - DNA, 22 bp, Homo sapiens
tgctgaggtcaccttgctgcta

SEQ ID NO: 8502854 - DNA, 22 bp, Homo sapiens
tgctgagggaggggttttccag

SEQ ID NO: 8502855 - DNA, 22 bp, Homo sapiens
tgctgagggagcatcaaagaaa

SEQ ID NO: 8502856 - DNA, 22 bp, Homo sapiens
tgctgaggctagacctggaagt

SEQ ID NO: 8502857 - DNA, 22 bp, Homo sapiens
tgctgaggtcacggcggccaga

SEQ ID NO: 8502858 - DNA, 22 bp, Homo sapiens
tgctgaggtcacggcggccaga

SEQ ID NO: 8502859 - DNA, 22 bp, Homo sapiens
tgctgaggtcaccttgctgcta

SEQ ID NO: 8502860 - DNA, 20 bp, Homo sapiens
tgctgaggttgacatgccca

SEQ ID NO: 8502861 - DNA, 22 bp, Homo sapiens
tgctgaggtcatttccaagtga

SEQ ID NO: 8502862 - DNA, 22 bp, Homo sapiens
tgctgaggtcatttccaagtga

SEQ ID NO: 8502863 - DNA, 22 bp, Homo sapiens
tgctgcagggatttcagagaca

SEQ ID NO: 8502864 - DNA, 22 bp, Homo sapiens
tgctgcaggcagcccctctact

SEQ ID NO: 8502865 - DNA, 22 bp, Homo sapiens
tgctgcaggccttggctgggaa

SEQ ID NO: 8502866 - DNA, 22 bp, Homo sapiens
tgctgcagtgtttgctgaagtt

SEQ ID NO: 8502867 - DNA, 22 bp, Homo sapiens
tgctgaggttgtggagtgcatt

SEQ ID NO: 8502868 - DNA, 22 bp, Homo sapiens
tgctgaggttgtggagtgcatt

SEQ ID NO: 8502869 - DNA, 22 bp, Homo sapiens
tgctgaggtttcgtctgcttgc

SEQ ID NO: 8502870 - DNA, 22 bp, Homo sapiens
tgctgaggtttctgactatgga

SEQ ID NO: 8502871 - DNA, 22 bp, Homo sapiens
tgctgagtatttgtttgaataa

SEQ ID NO: 8502872 - DNA, 21 bp, Homo sapiens
tgctgatgtcagagaagcaag

SEQ ID NO: 8502873 - DNA, 22 bp, Homo sapiens
tgctgatgctgttctgttagga

SEQ ID NO: 8502874 - DNA, 22 bp, Homo sapiens
tgctgatgagtccttctatcgc

SEQ ID NO: 8502875 - DNA, 22 bp, Homo sapiens
tgctctgggctatctgagaaag

SEQ ID NO: 8502876 - DNA, 22 bp, Homo sapiens
tgctctgggctcaatggcagct

SEQ ID NO: 8502877 - DNA, 22 bp, Homo sapiens
tgctctgggcaacagcctccct

SEQ ID NO: 8502878 - DNA, 22 bp, Homo sapiens
tgctctgggctatctgagaaag

SEQ ID NO: 8502879 - DNA, 22 bp, Homo sapiens
tgctctgggcaacagcctccct

SEQ ID NO: 8502880 - DNA, 22 bp, Homo sapiens
tgctctgggcaacagcctccct

SEQ ID NO: 8502881 - DNA, 22 bp, Homo sapiens
tgctctgggctcaatggcagct

SEQ ID NO: 8502882 - DNA, 22 bp, Homo sapiens
tgctctggggagctcctctgcg

SEQ ID NO: 8502883 - DNA, 22 bp, Homo sapiens
tgctctggggagctcctctgcg

SEQ ID NO: 8502884 - DNA, 22 bp, Homo sapiens
tgctctggggagctcctctgcg

SEQ ID NO: 8502885 - DNA, 22 bp, Homo sapiens
tgctctgggggaagccagctgt

SEQ ID NO: 8502886 - DNA, 22 bp, Homo sapiens
tgctctgggggaagccagctgt

SEQ ID NO: 8502887 - DNA, 22 bp, Homo sapiens
tgctctggggagctcctctgcg

SEQ ID NO: 8502888 - DNA, 22 bp, Homo sapiens
tgctctggggagctcctctgcg

SEQ ID NO: 8502889 - DNA, 22 bp, Homo sapiens
tgctctccggcttccgtggcct

SEQ ID NO: 8502890 - DNA, 19 bp, Homo sapiens
tgctctctggtgcttcatg

SEQ ID NO: 8502891 - DNA, 22 bp, Homo sapiens
tgctctctcaggcctggcccac

SEQ ID NO: 8502892 - DNA, 23 bp, Homo sapiens
tgctctgggaggccctggagagc

SEQ ID NO: 8502893 - DNA, 23 bp, Homo sapiens
tgctctgggaggccctggagagc

SEQ ID NO: 8502894 - DNA, 22 bp, Homo sapiens
tgctctgggaccgtcattaaaa

SEQ ID NO: 8502895 - DNA, 22 bp, Homo sapiens
tgctctggctgggatgagtgca

SEQ ID NO: 8502896 - DNA, 17 bp, Homo sapiens
tgctcctgtggcagcct

SEQ ID NO: 8502897 - DNA, 17 bp, Homo sapiens
tgctcctgtggcagcct

SEQ ID NO: 8502898 - DNA, 22 bp, Homo sapiens
tgctcctgtttcatcagctata

SEQ ID NO: 8502899 - DNA, 22 bp, Homo sapiens
tgctcctgtttcatcagctata

SEQ ID NO: 8502900 - DNA, 22 bp, Homo sapiens
tgctcctgtttcatcagctata

SEQ ID NO: 8502901 - DNA, 22 bp, Homo sapiens
tgctcctgtttcatcagctata

SEQ ID NO: 8502902 - DNA, 22 bp, Homo sapiens
tgctcctgtttcatcagctata

SEQ ID NO: 8502903 - DNA, 17 bp, Homo sapiens
tgctcctgggacaagga

SEQ ID NO: 8502904 - DNA, 22 bp, Homo sapiens
tgctcctggcatctctgcgtcc

SEQ ID NO: 8502905 - DNA, 22 bp, Homo sapiens
tgctcctggctccttccctaac

SEQ ID NO: 8502906 - DNA, 22 bp, Homo sapiens
tgctcctggcatctctgcgtcc

SEQ ID NO: 8502907 - DNA, 22 bp, Homo sapiens
tgctcctggatgaggtactcca

SEQ ID NO: 8502908 - DNA, 22 bp, Homo sapiens
tgctcctggactggtgtgagat

SEQ ID NO: 8502909 - DNA, 22 bp, Homo sapiens
tgctcctggatgaggtactcca

SEQ ID NO: 8502910 - DNA, 22 bp, Homo sapiens
tgctctagcctgtaaaacatga

SEQ ID NO: 8502911 - DNA, 22 bp, Homo sapiens
tgctctaagaactctaggaatt

SEQ ID NO: 8502912 - DNA, 22 bp, Homo sapiens
tgctctagctcataggactcat

SEQ ID NO: 8502913 - DNA, 22 bp, Homo sapiens
tgctctagtgggtagagcattg

SEQ ID NO: 8502914 - DNA, 22 bp, Homo sapiens
tgctctagtgggtagagcattg

SEQ ID NO: 8502915 - DNA, 22 bp, Homo sapiens
tgctcgaggtccccaccggctc

SEQ ID NO: 8502916 - DNA, 22 bp, Homo sapiens
tgctcgaggtccccaccggctc

SEQ ID NO: 8502917 - DNA, 22 bp, Homo sapiens
tgctcgccccacatgccctcat

SEQ ID NO: 8502918 - DNA, 22 bp, Homo sapiens
tgctccaggccgcctggggctg

SEQ ID NO: 8502919 - DNA, 22 bp, Homo sapiens
tgctccaggccgcctggggctg

SEQ ID NO: 8502920 - DNA, 22 bp, Homo sapiens
tgctccaggctgctgaagatct

SEQ ID NO: 8502921 - DNA, 19 bp, Homo sapiens
tgctccaggccttgccgca

SEQ ID NO: 8502922 - DNA, 19 bp, Homo sapiens
tgctccaggccttgccgca

SEQ ID NO: 8502923 - DNA, 19 bp, Homo sapiens
tgctccaggccttgccgca

SEQ ID NO: 8502924 - DNA, 21 bp, Homo sapiens
tgctccagggcagcttccagc

SEQ ID NO: 8502925 - DNA, 21 bp, Homo sapiens
tgctccagggcagcttccagc

SEQ ID NO: 8502926 - DNA, 21 bp, Homo sapiens
tgctccagggcagcttccagc

SEQ ID NO: 8502927 - DNA, 21 bp, Homo sapiens
tgctccaggagggggcagtcc

SEQ ID NO: 8502928 - DNA, 22 bp, Homo sapiens
tgctccaggagcactttccatt

SEQ ID NO: 8502929 - DNA, 22 bp, Homo sapiens
tgctccaggagcactttccatt

SEQ ID NO: 8502930 - DNA, 22 bp, Homo sapiens
tgctccaggagcactttccatt

SEQ ID NO: 8502931 - DNA, 21 bp, Homo sapiens
tgctccaggagggggcagtcc

SEQ ID NO: 8502932 - DNA, 22 bp, Homo sapiens
tgctccaggcaagctgagagtt

SEQ ID NO: 8502933 - DNA, 22 bp, Homo sapiens
tgctccaggcaagctgagagtt

SEQ ID NO: 8502934 - DNA, 18 bp, Homo sapiens
tgctccaggcccatgggc

SEQ ID NO: 8502935 - DNA, 22 bp, Homo sapiens
tgctccagcgctgccaccagtt

SEQ ID NO: 8502936 - DNA, 22 bp, Homo sapiens
tgctccagcgctgccaccagtt

SEQ ID NO: 8502937 - DNA, 22 bp, Homo sapiens
tgctccagctggagatgggggc

SEQ ID NO: 8502938 - DNA, 22 bp, Homo sapiens
tgctccagctggagatgggggc

SEQ ID NO: 8502939 - DNA, 20 bp, Homo sapiens
tgctccaggaacactggccg

SEQ ID NO: 8502940 - DNA, 20 bp, Homo sapiens
tgctccaggaacactggccg

SEQ ID NO: 8502941 - DNA, 22 bp, Homo sapiens
tgctccaggagcaacctttgag

SEQ ID NO: 8502942 - DNA, 22 bp, Homo sapiens
tgctccagcctatgctctccgg

SEQ ID NO: 8502943 - DNA, 22 bp, Homo sapiens
tgctccagcctatgctctccgg

SEQ ID NO: 8502944 - DNA, 22 bp, Homo sapiens
tgctccagcctatgctctccgg

SEQ ID NO: 8502945 - DNA, 23 bp, Homo sapiens
tgctccagcctctttgatagtgt

SEQ ID NO: 8502946 - DNA, 23 bp, Homo sapiens
tgctccagcctctttgatagtgt

SEQ ID NO: 8502947 - DNA, 22 bp, Homo sapiens
tgctccagcctatgctctccgg

SEQ ID NO: 8502948 - DNA, 22 bp, Homo sapiens
tgctccagcaccaagagctcca

SEQ ID NO: 8502949 - DNA, 22 bp, Homo sapiens
tgctccagcaccaagagctcca

SEQ ID NO: 8502950 - DNA, 22 bp, Homo sapiens
tgctccagcatgaccctcaatg

SEQ ID NO: 8502951 - DNA, 22 bp, Homo sapiens
tgctccagcatgaccctcaatg

SEQ ID NO: 8502952 - DNA, 22 bp, Homo sapiens
tgctcctgctgcatgcatctcc

SEQ ID NO: 8502953 - DNA, 22 bp, Homo sapiens
tgctcctgctgcatgcatctcc

SEQ ID NO: 8502954 - DNA, 22 bp, Homo sapiens
tgctcctgctgcatgcatctcc

SEQ ID NO: 8502955 - DNA, 22 bp, Homo sapiens
tgctcctgctgcatgcatctcc

SEQ ID NO: 8502956 - DNA, 22 bp, Homo sapiens
tgctcctgaacacagccctatg

SEQ ID NO: 8502957 - DNA, 22 bp, Homo sapiens
tgctcctgacagttttaggctc

SEQ ID NO: 8502958 - DNA, 22 bp, Homo sapiens
tgctcctgagcggtttccatga

SEQ ID NO: 8502959 - DNA, 22 bp, Homo sapiens
tgctcctgaggttggagatcca

SEQ ID NO: 8502960 - DNA, 22 bp, Homo sapiens
tgctcctgatatctaatgtgta

SEQ ID NO: 8502961 - DNA, 22 bp, Homo sapiens
tgctcctgatatctaatgtgta

SEQ ID NO: 8502962 - DNA, 22 bp, Homo sapiens
tgctcctgagtgtgcaggagat

SEQ ID NO: 8502963 - DNA, 22 bp, Homo sapiens
tgctcccaggcattctctgttg

SEQ ID NO: 8502964 - DNA, 22 bp, Homo sapiens
tgctcccaggctctgtggtctg

SEQ ID NO: 8502965 - DNA, 22 bp, Homo sapiens
tgctcccaggctctgtggtctg

SEQ ID NO: 8502966 - DNA, 22 bp, Homo sapiens
tgctcccagggactctggctgg

SEQ ID NO: 8502967 - DNA, 22 bp, Homo sapiens
tgctcccagggactctggctgg

SEQ ID NO: 8502968 - DNA, 22 bp, Homo sapiens
tgctccagggcctccagtgggg

SEQ ID NO: 8502969 - DNA, 22 bp, Homo sapiens
tgctccagggcctccagtgggg

SEQ ID NO: 8502970 - DNA, 22 bp, Homo sapiens
tgctcccaggcattctctgttg

SEQ ID NO: 8502971 - DNA, 22 bp, Homo sapiens
tgctcctatcctcctgctgaca

SEQ ID NO: 8502972 - DNA, 22 bp, Homo sapiens
tgctccgttcttctgcttcttg

SEQ ID NO: 8502973 - DNA, 20 bp, Homo sapiens
tgctcctaccacttctgccc

SEQ ID NO: 8502974 - DNA, 22 bp, Homo sapiens
tgctcccaggcattctctgttg

SEQ ID NO: 8502975 - DNA, 23 bp, Homo sapiens
tgctcccaggtgacgctgctgtt

SEQ ID NO: 8502976 - DNA, 22 bp, Homo sapiens
tgcttccaggaatccatctggc

SEQ ID NO: 8502977 - DNA, 22 bp, Homo sapiens
tgcttccactaatgagctgtgt

SEQ ID NO: 8502978 - DNA, 22 bp, Homo sapiens
tgcttcattaaaacaatatttt

SEQ ID NO: 8502979 - DNA, 22 bp, Homo sapiens
tgcttcagtgtgtcattattta

SEQ ID NO: 8502980 - DNA, 17 bp, Homo sapiens
tgcttcatcccgatcct

SEQ ID NO: 8502981 - DNA, 22 bp, Homo sapiens
tgcttcagtgctctgagcctgt

SEQ ID NO: 8502982 - DNA, 22 bp, Homo sapiens
tgcttcaggaagaaacgccagg

SEQ ID NO: 8502983 - DNA, 22 bp, Homo sapiens
tgcttcaggagatgtcaccatg

SEQ ID NO: 8502984 - DNA, 22 bp, Homo sapiens
tgcttcaaggacactgactttt

SEQ ID NO: 8502985 - DNA, 22 bp, Homo sapiens
tgcttattaaacatgcatattc

SEQ ID NO: 8502986 - DNA, 22 bp, Homo sapiens
tgcttattaaacatgcatattc

SEQ ID NO: 8502987 - DNA, 23 bp, Homo sapiens
tgcttattcaaaaggtgctttca

SEQ ID NO: 8502988 - DNA, 22 bp, Homo sapiens
tgcttattctttccacaattca

SEQ ID NO: 8502989 - DNA, 22 bp, Homo sapiens
tgcttattgctttcaagactgt

SEQ ID NO: 8502990 - DNA, 22 bp, Homo sapiens
tgcttcacaagaattcaggacc

SEQ ID NO: 8502991 - DNA, 22 bp, Homo sapiens
tgcttcacaagaattcaggacc

SEQ ID NO: 8502992 - DNA, 22 bp, Homo sapiens
tgcttcacaagaattcaggacc

SEQ ID NO: 8502993 - DNA, 22 bp, Homo sapiens
tgcttcaaggacactgactttt

SEQ ID NO: 8502994 - DNA, 22 bp, Homo sapiens
tgcttcaagttgaaatattctt

SEQ ID NO: 8502995 - DNA, 22 bp, Homo sapiens
tgcttcagcactttgagagcct

SEQ ID NO: 8502996 - DNA, 22 bp, Homo sapiens
tgcttcagaggaaaggcaaaag

SEQ ID NO: 8502997 - DNA, 22 bp, Homo sapiens
tgcttcagagacatcctactca

SEQ ID NO: 8502998 - DNA, 22 bp, Homo sapiens
tgcttctgactgggtcagttga

SEQ ID NO: 8502999 - DNA, 22 bp, Homo sapiens
tgcttctgagttgcaggacttg

SEQ ID NO: 8503000 - DNA, 22 bp, Homo sapiens
tgcttctgagttgcaggacttg

SEQ ID NO: 8503001 - DNA, 22 bp, Homo sapiens
tgcttctgacatgttcttggtt

SEQ ID NO: 8503002 - DNA, 22 bp, Homo sapiens
tgcttctgactaagctgcatga

SEQ ID NO: 8503003 - DNA, 22 bp, Homo sapiens
tgcttctgactaagctgcatga

SEQ ID NO: 8503004 - DNA, 22 bp, Homo sapiens
tgcttctgacatgttcttggtt

SEQ ID NO: 8503005 - DNA, 22 bp, Homo sapiens
tgcttctgaactcagcatgtgg

SEQ ID NO: 8503006 - DNA, 22 bp, Homo sapiens
tgcttctgaactcagcatgtgg

SEQ ID NO: 8503007 - DNA, 22 bp, Homo sapiens
tgcttctgaaatgcaggtcttc

SEQ ID NO: 8503008 - DNA, 22 bp, Homo sapiens
tgcttctgaactcagcatgtgg

SEQ ID NO: 8503009 - DNA, 22 bp, Homo sapiens
tgcttctgcaacttgaatgtac

SEQ ID NO: 8503010 - DNA, 22 bp, Homo sapiens
tgcttctgatgtgagcagcccc

SEQ ID NO: 8503011 - DNA, 22 bp, Homo sapiens
tgcttctgatgtgagcagcccc

SEQ ID NO: 8503012 - DNA, 22 bp, Homo sapiens
tgcttctgctcagcttcctact

SEQ ID NO: 8503013 - DNA, 22 bp, Homo sapiens
tgcttctgctcagcttcctact

SEQ ID NO: 8503014 - DNA, 22 bp, Homo sapiens
tgcttctgcaggagctcctgat

SEQ ID NO: 8503015 - DNA, 22 bp, Homo sapiens
tgcttctgcaggagctcctgat

SEQ ID NO: 8503016 - DNA, 22 bp, Homo sapiens
tgcttctgcaggagctcctgat

SEQ ID NO: 8503017 - DNA, 22 bp, Homo sapiens
tgcttctgcaggagctcctgat

SEQ ID NO: 8503018 - DNA, 22 bp, Homo sapiens
tgcttctcaaaaggaggtaggt

SEQ ID NO: 8503019 - DNA, 22 bp, Homo sapiens
tgcttctcaaagaagcataatg

SEQ ID NO: 8503020 - DNA, 22 bp, Homo sapiens
tgcttctccattgatgctaagt

SEQ ID NO: 8503021 - DNA, 22 bp, Homo sapiens
tgcttccttgatcattcccaaa

SEQ ID NO: 8503022 - DNA, 22 bp, Homo sapiens
tgcttctaatctactgcattag

SEQ ID NO: 8503023 - DNA, 22 bp, Homo sapiens
tgcttctcccaaccagggcctg

SEQ ID NO: 8503024 - DNA, 21 bp, Homo sapiens
tgcttctctagatcaactact

SEQ ID NO: 8503025 - DNA, 23 bp, Homo sapiens
tgcttctctgcttgacagttctg

SEQ ID NO: 8503026 - DNA, 21 bp, Homo sapiens
tgcttctctagatcaactact

SEQ ID NO: 8503027 - DNA, 22 bp, Homo sapiens
tgcttctgaaatgcaggtcttc

SEQ ID NO: 8503028 - DNA, 22 bp, Homo sapiens
tgcttctgaaatgcaggtcttc

SEQ ID NO: 8503029 - DNA, 22 bp, Homo sapiens
tgcttctgaaatgcaggtcttc

SEQ ID NO: 8503030 - DNA, 22 bp, Homo sapiens
tgcttctctttatttgtaggtt

SEQ ID NO: 8503031 - DNA, 22 bp, Homo sapiens
tgcttctctgttctaacccttg

SEQ ID NO: 8503032 - DNA, 23 bp, Homo sapiens
tgcttctctgcttgacagttctg

SEQ ID NO: 8503033 - DNA, 22 bp, Homo sapiens
tgctgtgaggttgagaaggaag

SEQ ID NO: 8503034 - DNA, 22 bp, Homo sapiens
tgctgtgcaaaggtgatgtgag

SEQ ID NO: 8503035 - DNA, 22 bp, Homo sapiens
tgctgtgcatcatagtgtttgg

SEQ ID NO: 8503036 - DNA, 22 bp, Homo sapiens
tgctgtgaggttgagaaggaag

SEQ ID NO: 8503037 - DNA, 22 bp, Homo sapiens
tgctgtgaggttgagaaggaag

SEQ ID NO: 8503038 - DNA, 22 bp, Homo sapiens
tgctgtgaggttgagaaggaag

SEQ ID NO: 8503039 - DNA, 22 bp, Homo sapiens
tgcttaaaatgatgattatttt

SEQ ID NO: 8503040 - DNA, 22 bp, Homo sapiens
tgcttaaaaagctccatcaata

SEQ ID NO: 8503041 - DNA, 22 bp, Homo sapiens
tgcttaaaaagtaactgctgat

SEQ ID NO: 8503042 - DNA, 20 bp, Homo sapiens
tgctgtcgtgttttctgctt

SEQ ID NO: 8503043 - DNA, 22 bp, Homo sapiens
tgctgtcctgttttggagtaat

SEQ ID NO: 8503044 - DNA, 22 bp, Homo sapiens
tgctgtctgattcagggtgatt

SEQ ID NO: 8503045 - DNA, 22 bp, Homo sapiens
tgctgtctgcaacagtactaca

SEQ ID NO: 8503046 - DNA, 22 bp, Homo sapiens
tgctgtccctaagtctcttcaa

SEQ ID NO: 8503047 - DNA, 22 bp, Homo sapiens
tgctgtccctaagtctcttcaa

SEQ ID NO: 8503048 - DNA, 17 bp, Homo sapiens
tgctgtctgcttcccta

SEQ ID NO: 8503049 - DNA, 22 bp, Homo sapiens
tgctgtcttccaggatggtgaa

SEQ ID NO: 8503050 - DNA, 22 bp, Homo sapiens
tgctgtcttctctgaggtccct

SEQ ID NO: 8503051 - DNA, 22 bp, Homo sapiens
tgctgtctttttcccttcctaa

SEQ ID NO: 8503052 - DNA, 22 bp, Homo sapiens
tgctgtgacagagtctcatgga

SEQ ID NO: 8503053 - DNA, 22 bp, Homo sapiens
tgctgtcttttcccaatcctgg

SEQ ID NO: 8503054 - DNA, 22 bp, Homo sapiens
tgctgtcttttcccaatcctgg

SEQ ID NO: 8503055 - DNA, 22 bp, Homo sapiens
tgctgtcttttcccaatcctgg

SEQ ID NO: 8503056 - DNA, 22 bp, Homo sapiens
tgcttagggctcctccaataga

SEQ ID NO: 8503057 - DNA, 22 bp, Homo sapiens
tgcttataatgttactgacaac

SEQ ID NO: 8503058 - DNA, 22 bp, Homo sapiens
tgcttaataggagttgaacatt

SEQ ID NO: 8503059 - DNA, 22 bp, Homo sapiens
tgcttaatagtgcactggtttc

SEQ ID NO: 8503060 - DNA, 22 bp, Homo sapiens
tgcttaatattgtgatgtaata

SEQ ID NO: 8503061 - DNA, 22 bp, Homo sapiens
tgcttaaatttcagcagcttaa

SEQ ID NO: 8503062 - DNA, 22 bp, Homo sapiens
tgcttaatgtacgtgagtgtac

SEQ ID NO: 8503063 - DNA, 22 bp, Homo sapiens
tgcttacaactttattgaggaa

SEQ ID NO: 8503064 - DNA, 22 bp, Homo sapiens
tgcttaaagtagtggattgtta

SEQ ID NO: 8503065 - DNA, 22 bp, Homo sapiens
tgcttaaaggatagtttaaact

SEQ ID NO: 8503066 - DNA, 22 bp, Homo sapiens
tgcttaaaggatagtttaaact

SEQ ID NO: 8503067 - DNA, 22 bp, Homo sapiens
tgcttaaagctgctcagttgta

SEQ ID NO: 8503068 - DNA, 22 bp, Homo sapiens
tgcttaaaccctgatcatgtgt

SEQ ID NO: 8503069 - DNA, 22 bp, Homo sapiens
tgcttaaaccctgatcatgtgt

SEQ ID NO: 8503070 - DNA, 22 bp, Homo sapiens
tgcttaaacatactatttatat

SEQ ID NO: 8503071 - DNA, 22 bp, Homo sapiens
tgcttaaacatccagacagtat

SEQ ID NO: 8503072 - DNA, 22 bp, Homo sapiens
tgcttaaacatccagacagtat

SEQ ID NO: 8503073 - DNA, 22 bp, Homo sapiens
tgcttaaacacatacatacata

SEQ ID NO: 8503074 - DNA, 22 bp, Homo sapiens
tgcttaaaattttccaaggatt

SEQ ID NO: 8503075 - DNA, 22 bp, Homo sapiens
tgcttaaacacatacatacata

SEQ ID NO: 8503076 - DNA, 22 bp, Homo sapiens
tgcttaaacacatacatacata

SEQ ID NO: 8503077 - DNA, 22 bp, Homo sapiens
tgcttaaacacatacatacata

SEQ ID NO: 8503078 - DNA, 22 bp, Homo sapiens
tgcttaaacacatacatacata

SEQ ID NO: 8503079 - DNA, 18 bp, Homo sapiens
tgctgggtaactgtatgg

SEQ ID NO: 8503080 - DNA, 22 bp, Homo sapiens
tgctgggtagaagtattagtct

SEQ ID NO: 8503081 - DNA, 22 bp, Homo sapiens
tgctggggtctctccggtgccc

SEQ ID NO: 8503082 - DNA, 23 bp, Homo sapiens
tgctggggtagtttgtggcacag

SEQ ID NO: 8503083 - DNA, 23 bp, Homo sapiens
tgctggggtagtttgtggcacag

SEQ ID NO: 8503084 - DNA, 22 bp, Homo sapiens
tgctggggtcatggggcgcccg

SEQ ID NO: 8503085 - DNA, 22 bp, Homo sapiens
tgctggggagtgattgaccatc

SEQ ID NO: 8503086 - DNA, 20 bp, Homo sapiens
tgctggggacatacagggtg

SEQ ID NO: 8503087 - DNA, 20 bp, Homo sapiens
tgctggggacatacagggtg

SEQ ID NO: 8503088 - DNA, 22 bp, Homo sapiens
tgctggggatccgtaccaaccc

SEQ ID NO: 8503089 - DNA, 22 bp, Homo sapiens
tgctgggtgttccgcacttgac

SEQ ID NO: 8503090 - DNA, 22 bp, Homo sapiens
tgctggtcccctgcagcctgtg

SEQ ID NO: 8503091 - DNA, 22 bp, Homo sapiens
tgctggtaccgcgcctccgcca

SEQ ID NO: 8503092 - DNA, 22 bp, Homo sapiens
tgctgggttacctaagcctaaa

SEQ ID NO: 8503093 - DNA, 22 bp, Homo sapiens
tgctggtaccgcgcctccgcca

SEQ ID NO: 8503094 - DNA, 22 bp, Homo sapiens
tgctggtcctggagctgggttc

SEQ ID NO: 8503095 - DNA, 22 bp, Homo sapiens
tgctggtcccctgcagcctgtg

SEQ ID NO: 8503096 - DNA, 22 bp, Homo sapiens
tgctggtcctggagctgggttc

SEQ ID NO: 8503097 - DNA, 22 bp, Homo sapiens
tgctggtggagaaagtggaggt

SEQ ID NO: 8503098 - DNA, 22 bp, Homo sapiens
tgctgtattacttttacaaact

SEQ ID NO: 8503099 - DNA, 22 bp, Homo sapiens
tgctgtatatattttgaagtga

SEQ ID NO: 8503100 - DNA, 22 bp, Homo sapiens
tgctgtatatattttgaagtga

SEQ ID NO: 8503101 - DNA, 22 bp, Homo sapiens
tgctgtcaagaaaacaagcaat

SEQ ID NO: 8503102 - DNA, 22 bp, Homo sapiens
tgctgtcagacagcagtggtaa

SEQ ID NO: 8503103 - DNA, 22 bp, Homo sapiens
tgctgtcagttggcaggatgag

SEQ ID NO: 8503104 - DNA, 22 bp, Homo sapiens
tgctgtcccccgtgtctgggct

SEQ ID NO: 8503105 - DNA, 22 bp, Homo sapiens
tgctgtagccctgcacagtgca

SEQ ID NO: 8503106 - DNA, 23 bp, Homo sapiens
tgctggtgtttttgggaccaggg

SEQ ID NO: 8503107 - DNA, 22 bp, Homo sapiens
tgctgggcactgtctctgggga

SEQ ID NO: 8503108 - DNA, 23 bp, Homo sapiens
tgctgggcagagctggtgctgag

SEQ ID NO: 8503109 - DNA, 23 bp, Homo sapiens
tgctgggcagagctggtgctgag

SEQ ID NO: 8503110 - DNA, 20 bp, Homo sapiens
tgctgggcatgcagtggaaa

SEQ ID NO: 8503111 - DNA, 20 bp, Homo sapiens
tgctgggcatgcagtggaaa

SEQ ID NO: 8503112 - DNA, 22 bp, Homo sapiens
tgctgggcatcgtaggaggtac

SEQ ID NO: 8503113 - DNA, 22 bp, Homo sapiens
tgctgggcagtgtgccctcgag

SEQ ID NO: 8503114 - DNA, 22 bp, Homo sapiens
tgctgggcctgcccctgtcagc

SEQ ID NO: 8503115 - DNA, 22 bp, Homo sapiens
tgctgggcccccagtgaccttc

SEQ ID NO: 8503116 - DNA, 22 bp, Homo sapiens
tgctgggcccagggagcctctg

SEQ ID NO: 8503117 - DNA, 22 bp, Homo sapiens
tgctgggcatttatgcagatgg

SEQ ID NO: 8503118 - DNA, 18 bp, Homo sapiens
tgctgggcattaggctta

SEQ ID NO: 8503119 - DNA, 22 bp, Homo sapiens
tgctgggccaaagcagggtttt

SEQ ID NO: 8503120 - DNA, 22 bp, Homo sapiens
tgctgggccaaagcagggtttt

SEQ ID NO: 8503121 - DNA, 22 bp, Homo sapiens
tgctgggctgttcctgtccatg

SEQ ID NO: 8503122 - DNA, 22 bp, Homo sapiens
tgctgggcttgaaagctgctaa

SEQ ID NO: 8503123 - DNA, 22 bp, Homo sapiens
tgctgggcttgaaagctgctaa

SEQ ID NO: 8503124 - DNA, 22 bp, Homo sapiens
tgctgggcttcacccccacagt

SEQ ID NO: 8503125 - DNA, 22 bp, Homo sapiens
tgctgggctgttcctgtccatg

SEQ ID NO: 8503126 - DNA, 22 bp, Homo sapiens
tgctgggctggggcctcagacc

SEQ ID NO: 8503127 - DNA, 21 bp, Homo sapiens
tgctgggctgcaggggatgca

SEQ ID NO: 8503128 - DNA, 22 bp, Homo sapiens
tgctgggctggagctgccaggg

SEQ ID NO: 8503129 - DNA, 22 bp, Homo sapiens
tgctgggctcaacctccagagc

SEQ ID NO: 8503130 - DNA, 22 bp, Homo sapiens
tgctgggctgcacccccagagt

SEQ ID NO: 8503131 - DNA, 22 bp, Homo sapiens
tgctgggctagggtggagctct

SEQ ID NO: 8503132 - DNA, 22 bp, Homo sapiens
tgctgggcggtgggctcatccc

SEQ ID NO: 8503133 - DNA, 22 bp, Homo sapiens
tgctgggcctttacctccaggg

SEQ ID NO: 8503134 - DNA, 22 bp, Homo sapiens
tgctgggctagaagctgaggcc

SEQ ID NO: 8503135 - DNA, 22 bp, Homo sapiens
tgctgggctagaagctgaggcc

SEQ ID NO: 8503136 - DNA, 22 bp, Homo sapiens
tgctgggctagaagctgaggcc

SEQ ID NO: 8503137 - DNA, 22 bp, Homo sapiens
tgctggcttagatatcactgcc

SEQ ID NO: 8503138 - DNA, 22 bp, Homo sapiens
tgctggctgttctagggaggcc

SEQ ID NO: 8503139 - DNA, 22 bp, Homo sapiens
tgctggctgttctagggaggcc

SEQ ID NO: 8503140 - DNA, 22 bp, Homo sapiens
tgctggcttatttagtaaatgt

SEQ ID NO: 8503141 - DNA, 23 bp, Homo sapiens
tgctggctgtgttattgccaaca

SEQ ID NO: 8503142 - DNA, 23 bp, Homo sapiens
tgctggctgtgttattgccaaca

SEQ ID NO: 8503143 - DNA, 22 bp, Homo sapiens
tgctggctgcagtgctgtcaaa

SEQ ID NO: 8503144 - DNA, 22 bp, Homo sapiens
tgctggctgtatatgtgagagt

SEQ ID NO: 8503145 - DNA, 22 bp, Homo sapiens
tgctggctgtatatgtgagagt

SEQ ID NO: 8503146 - DNA, 22 bp, Homo sapiens
tgctggctgtatatgtgagagt

SEQ ID NO: 8503147 - DNA, 22 bp, Homo sapiens
tgctggctggcctggcctggac

SEQ ID NO: 8503148 - DNA, 22 bp, Homo sapiens
tgctggctggcctggcctggac

SEQ ID NO: 8503149 - DNA, 22 bp, Homo sapiens
tgctggctgggctgctggagac

SEQ ID NO: 8503150 - DNA, 21 bp, Homo sapiens
tgctggctgaaaggcacagag

SEQ ID NO: 8503151 - DNA, 21 bp, Homo sapiens
tgctggctgaaaggcacagag

SEQ ID NO: 8503152 - DNA, 21 bp, Homo sapiens
tgctggctgaaaggcacagag

SEQ ID NO: 8503153 - DNA, 23 bp, Homo sapiens
tgctggctgaaacagccaaagga

SEQ ID NO: 8503154 - DNA, 22 bp, Homo sapiens
tgctggccaacaaggctccaag

SEQ ID NO: 8503155 - DNA, 22 bp, Homo sapiens
tgctggctactgatggcaggcc

SEQ ID NO: 8503156 - DNA, 22 bp, Homo sapiens
tgctggctactgatggcaggcc

SEQ ID NO: 8503157 - DNA, 22 bp, Homo sapiens
tgctggccaacaaggctccaag

SEQ ID NO: 8503158 - DNA, 22 bp, Homo sapiens
tgctggccaagcagaggtcaat

SEQ ID NO: 8503159 - DNA, 22 bp, Homo sapiens
tgctggctcagtttgcagactc

SEQ ID NO: 8503160 - DNA, 22 bp, Homo sapiens
tgctggcaggcacctcctgggg

SEQ ID NO: 8503161 - DNA, 22 bp, Homo sapiens
tgctggcataccacctagttca

SEQ ID NO: 8503162 - DNA, 23 bp, Homo sapiens
tgctggagtttactcaggccagc

SEQ ID NO: 8503163 - DNA, 23 bp, Homo sapiens
tgctggagtttactcaggccagc

SEQ ID NO: 8503164 - DNA, 23 bp, Homo sapiens
tgctggagtttactcaggccagc

SEQ ID NO: 8503165 - DNA, 22 bp, Homo sapiens
tgctggagtggcactgtgtggc

SEQ ID NO: 8503166 - DNA, 22 bp, Homo sapiens
tgctggagttcgacattgcaaa

SEQ ID NO: 8503167 - DNA, 22 bp, Homo sapiens
tgctggagtggcactgtgtggc

SEQ ID NO: 8503168 - DNA, 22 bp, Homo sapiens
tgctggagtggcactgtgtggc

SEQ ID NO: 8503169 - DNA, 22 bp, Homo sapiens
tgctggaggagtttactgtggc

SEQ ID NO: 8503170 - DNA, 22 bp, Homo sapiens
tgctggaggagtttactgtggc

SEQ ID NO: 8503171 - DNA, 22 bp, Homo sapiens
tgctggaggattaaacaagtca

SEQ ID NO: 8503172 - DNA, 22 bp, Homo sapiens
tgctggaggccagaagtctgag

SEQ ID NO: 8503173 - DNA, 22 bp, Homo sapiens
tgctggaggcagtggaggtgcc

SEQ ID NO: 8503174 - DNA, 22 bp, Homo sapiens
tgctggaggcagtggaggtgcc

SEQ ID NO: 8503175 - DNA, 22 bp, Homo sapiens
tgctggaggcagtggaggtgcc

SEQ ID NO: 8503176 - DNA, 22 bp, Homo sapiens
tgctggaggcctgactgtgttt

SEQ ID NO: 8503177 - DNA, 20 bp, Homo sapiens
tgctggaggcgccggcgctc

SEQ ID NO: 8503178 - DNA, 22 bp, Homo sapiens
tgctggaggccgagaagcagca

SEQ ID NO: 8503179 - DNA, 22 bp, Homo sapiens
tgctggaggccgagaagcagca

SEQ ID NO: 8503180 - DNA, 22 bp, Homo sapiens
tgctggaggccagaagtctgag

SEQ ID NO: 8503181 - DNA, 22 bp, Homo sapiens
tgctggaggcctgactgtgttt

SEQ ID NO: 8503182 - DNA, 22 bp, Homo sapiens
tgctggagtaacaagacactca

SEQ ID NO: 8503183 - DNA, 19 bp, Homo sapiens
tgctggaggttgacagggt

SEQ ID NO: 8503184 - DNA, 19 bp, Homo sapiens
tgctggaggttgacagggt

SEQ ID NO: 8503185 - DNA, 19 bp, Homo sapiens
tgctggaggttgacagggt

SEQ ID NO: 8503186 - DNA, 19 bp, Homo sapiens
tgctggaggttgacagggt

SEQ ID NO: 8503187 - DNA, 19 bp, Homo sapiens
tgctggagggtagtgagtc

SEQ ID NO: 8503188 - DNA, 22 bp, Homo sapiens
tgctggaggggcctgaccagga

SEQ ID NO: 8503189 - DNA, 22 bp, Homo sapiens
tgctggaggggcctgaccagga

SEQ ID NO: 8503190 - DNA, 22 bp, Homo sapiens
tgctggaggggatgccttcact

SEQ ID NO: 8503191 - DNA, 22 bp, Homo sapiens
tgctgccacatttaaagagggg

SEQ ID NO: 8503192 - DNA, 22 bp, Homo sapiens
tgctgccacccctcaccagagc

SEQ ID NO: 8503193 - DNA, 22 bp, Homo sapiens
tgctgccacccctcaccagagc

SEQ ID NO: 8503194 - DNA, 22 bp, Homo sapiens
tgctgccacctggtggctgaag

SEQ ID NO: 8503195 - DNA, 22 bp, Homo sapiens
tgctgccacaaattcagctgcc

SEQ ID NO: 8503196 - DNA, 22 bp, Homo sapiens
tgctgccacaaattcagctgcc

SEQ ID NO: 8503197 - DNA, 17 bp, Homo sapiens
tgctgccaagtcccaac

SEQ ID NO: 8503198 - DNA, 17 bp, Homo sapiens
tgctgccaagtcccaac

SEQ ID NO: 8503199 - DNA, 20 bp, Homo sapiens
tgctgcagtttcatgggact

SEQ ID NO: 8503200 - DNA, 20 bp, Homo sapiens
tgctgcagtttcatgggact

SEQ ID NO: 8503201 - DNA, 22 bp, Homo sapiens
tgctgcatagcagctcctgaaa

SEQ ID NO: 8503202 - DNA, 22 bp, Homo sapiens
tgctgcatagcagctcctgaaa

SEQ ID NO: 8503203 - DNA, 22 bp, Homo sapiens
tgctgcatttgcagtcctttaa

SEQ ID NO: 8503204 - DNA, 22 bp, Homo sapiens
tgctgcatttatcttctcaaac

SEQ ID NO: 8503205 - DNA, 22 bp, Homo sapiens
tgctgcatttgcagtcctttaa

SEQ ID NO: 8503206 - DNA, 22 bp, Homo sapiens
tgctgccaaatgcgagctctgt

SEQ ID NO: 8503207 - DNA, 22 bp, Homo sapiens
tgctgccaagcccgtgctcctg

SEQ ID NO: 8503208 - DNA, 22 bp, Homo sapiens
tgctgccaagcccgtgctcctg

SEQ ID NO: 8503209 - DNA, 22 bp, Homo sapiens
tgctgccagggctctgcccaca

SEQ ID NO: 8503210 - DNA, 22 bp, Homo sapiens
tgctgccagggctctgcccaca

SEQ ID NO: 8503211 - DNA, 22 bp, Homo sapiens
tgctgccagggctctgcccaca

SEQ ID NO: 8503212 - DNA, 22 bp, Homo sapiens
tgctgccaggtcttgctgtcca

SEQ ID NO: 8503213 - DNA, 22 bp, Homo sapiens
tgctgccaggtcttgctgtcca

SEQ ID NO: 8503214 - DNA, 21 bp, Homo sapiens
tgctgccatagacctgaggga

SEQ ID NO: 8503215 - DNA, 21 bp, Homo sapiens
tgctgccatcatgcagagatg

SEQ ID NO: 8503216 - DNA, 22 bp, Homo sapiens
tgctgccagccaggccatggag

SEQ ID NO: 8503217 - DNA, 22 bp, Homo sapiens
tgctgccacctggtggctgaag

SEQ ID NO: 8503218 - DNA, 22 bp, Homo sapiens
tgctgccactggtagtctcatt

SEQ ID NO: 8503219 - DNA, 22 bp, Homo sapiens
tgctgccagagagacagggact

SEQ ID NO: 8503220 - DNA, 22 bp, Homo sapiens
tgctgccactggtagtctcatt

SEQ ID NO: 8503221 - DNA, 23 bp, Homo sapiens
tgctgcccactcttccagccctc

SEQ ID NO: 8503222 - DNA, 18 bp, Homo sapiens
tgctgcccaactctcccc

SEQ ID NO: 8503223 - DNA, 22 bp, Homo sapiens
tgctgccatggtcgctggtgtc

SEQ ID NO: 8503224 - DNA, 22 bp, Homo sapiens
tgctgccatgcagagcaacaga

SEQ ID NO: 8503225 - DNA, 22 bp, Homo sapiens
tgctgccatctcaactgccctt

SEQ ID NO: 8503226 - DNA, 23 bp, Homo sapiens
tgctgccctgccttcagctctcc

SEQ ID NO: 8503227 - DNA, 22 bp, Homo sapiens
tgctgcccgtacctgtgcactt

SEQ ID NO: 8503228 - DNA, 23 bp, Homo sapiens
tgctgcccgcttggcacgctccc

SEQ ID NO: 8503229 - DNA, 22 bp, Homo sapiens
tgctgcccactgtatttctcca

SEQ ID NO: 8503230 - DNA, 22 bp, Homo sapiens
tgctgcctaataagtcgagggt

SEQ ID NO: 8503231 - DNA, 22 bp, Homo sapiens
tgctgcctcaactgtcaggaac

SEQ ID NO: 8503232 - DNA, 22 bp, Homo sapiens
tgctgcctcaactgtcaggaac

SEQ ID NO: 8503233 - DNA, 22 bp, Homo sapiens
tgctgcctcaactgtcaggaac

SEQ ID NO: 8503234 - DNA, 22 bp, Homo sapiens
tgctgcctccttcctgccagga

SEQ ID NO: 8503235 - DNA, 22 bp, Homo sapiens
tgctgctccccagcacacagca

SEQ ID NO: 8503236 - DNA, 22 bp, Homo sapiens
tgctgcctccttcctgccagga

SEQ ID NO: 8503237 - DNA, 22 bp, Homo sapiens
tgctgcctccttcctgccagga

SEQ ID NO: 8503238 - DNA, 22 bp, Homo sapiens
tgctgctcctgcctggctccca

SEQ ID NO: 8503239 - DNA, 22 bp, Homo sapiens
tgctgctctgtaaagtgatgag

SEQ ID NO: 8503240 - DNA, 22 bp, Homo sapiens
tgctgctctcagccaccaggaa

SEQ ID NO: 8503241 - DNA, 22 bp, Homo sapiens
tgctgctcgccacggcccaggg

SEQ ID NO: 8503242 - DNA, 22 bp, Homo sapiens
tgctgctcttcaccatggcctc

SEQ ID NO: 8503243 - DNA, 22 bp, Homo sapiens
tgctgctgatcatttatagtct

SEQ ID NO: 8503244 - DNA, 21 bp, Homo sapiens
tgctgctgatcggggttggct

SEQ ID NO: 8503245 - DNA, 22 bp, Homo sapiens
tgctgctgatgcatagtctgct

SEQ ID NO: 8503246 - DNA, 22 bp, Homo sapiens
tgctgctgatgcatagtctgct

SEQ ID NO: 8503247 - DNA, 22 bp, Homo sapiens
tgctgctgacatttggggcttg

SEQ ID NO: 8503248 - DNA, 22 bp, Homo sapiens
tgctgctgacatttggggcttg

SEQ ID NO: 8503249 - DNA, 22 bp, Homo sapiens
tgctgctgaggctaaagtatag

SEQ ID NO: 8503250 - DNA, 22 bp, Homo sapiens
tgctgctgatcatttatagtct

SEQ ID NO: 8503251 - DNA, 22 bp, Homo sapiens
tgctgctgtatcatgccttcat

SEQ ID NO: 8503252 - DNA, 22 bp, Homo sapiens
tgctgctgtatcatgccttcat

SEQ ID NO: 8503253 - DNA, 22 bp, Homo sapiens
tgctgctgtatcatgccttcat

SEQ ID NO: 8503254 - DNA, 22 bp, Homo sapiens
tgctgctgggtttgacagtcac

SEQ ID NO: 8503255 - DNA, 22 bp, Homo sapiens
tgctgctgggtttgacagtcac

SEQ ID NO: 8503256 - DNA, 22 bp, Homo sapiens
tgctgctgggtttgacagtcac

SEQ ID NO: 8503257 - DNA, 22 bp, Homo sapiens
tgctgctgggtttgacagtcac

SEQ ID NO: 8503258 - DNA, 22 bp, Homo sapiens
tgctgctgtatccttagtgtca

SEQ ID NO: 8503259 - DNA, 22 bp, Homo sapiens
tgctgctgtatccttagtgtca

SEQ ID NO: 8503260 - DNA, 19 bp, Homo sapiens
tgctgctgtccttgcaggg

SEQ ID NO: 8503261 - DNA, 19 bp, Homo sapiens
tgctgctgtccttgcaggg

SEQ ID NO: 8503262 - DNA, 19 bp, Homo sapiens
tgctgctgtccttgcaggg

SEQ ID NO: 8503263 - DNA, 19 bp, Homo sapiens
tgctgctgtccttgcaggg

SEQ ID NO: 8503264 - DNA, 20 bp, Homo sapiens
tgctgctgcctccgcctctg

SEQ ID NO: 8503265 - DNA, 20 bp, Homo sapiens
tgctgctgcctccgcctctg

SEQ ID NO: 8503266 - DNA, 22 bp, Homo sapiens
tgctgctgatggcacctaggca

SEQ ID NO: 8503267 - DNA, 22 bp, Homo sapiens
tgctgctgatggatgcctggac

SEQ ID NO: 8503268 - DNA, 22 bp, Homo sapiens
tgctgctgatggcacctaggca

SEQ ID NO: 8503269 - DNA, 22 bp, Homo sapiens
tgctgctgatggcacctaggca

SEQ ID NO: 8503270 - DNA, 20 bp, Homo sapiens
tgctgctgcttcacccccat

SEQ ID NO: 8503271 - DNA, 22 bp, Homo sapiens
tgctgctgcttctgtacagcct

SEQ ID NO: 8503272 - DNA, 22 bp, Homo sapiens
tgctgctgcttctgtacagcct

SEQ ID NO: 8503273 - DNA, 22 bp, Homo sapiens
tgctgctggatcttactcatct

SEQ ID NO: 8503274 - DNA, 20 bp, Homo sapiens
tgctgctgcttcacccccat

SEQ ID NO: 8503275 - DNA, 20 bp, Homo sapiens
tgctgctgtgagcgtccctg

SEQ ID NO: 8503276 - DNA, 20 bp, Homo sapiens
tgctgctgtgagcgtccctg

SEQ ID NO: 8503277 - DNA, 22 bp, Homo sapiens
tgctgctgttgacggctgtcca

SEQ ID NO: 8503278 - DNA, 22 bp, Homo sapiens
tgctgctgttgacggctgtcca

SEQ ID NO: 8503279 - DNA, 20 bp, Homo sapiens
tgctgctgtgagcgtccctg

SEQ ID NO: 8503280 - DNA, 22 bp, Homo sapiens
tgctgctgttgacggctgtcca

SEQ ID NO: 8503281 - DNA, 22 bp, Homo sapiens
tgctgcttcctggtagatagga

SEQ ID NO: 8503282 - DNA, 22 bp, Homo sapiens
tgctgcttcacctgttgtacag

SEQ ID NO: 8503283 - DNA, 22 bp, Homo sapiens
tgctgctgtttcctacatctca

SEQ ID NO: 8503284 - DNA, 22 bp, Homo sapiens
tgctgctttgatgtgtaaatca

SEQ ID NO: 8503285 - DNA, 22 bp, Homo sapiens
tgctgctttgatgtgtaaatca

SEQ ID NO: 8503286 - DNA, 20 bp, Homo sapiens
tgctgctttgccactagttg

SEQ ID NO: 8503287 - DNA, 20 bp, Homo sapiens
tgctgctttgccactagttg

SEQ ID NO: 8503288 - DNA, 22 bp, Homo sapiens
tgctggaaaaagattgtgtttt

SEQ ID NO: 8503289 - DNA, 22 bp, Homo sapiens
tgctgcttttgtatatcagaga

SEQ ID NO: 8503290 - DNA, 22 bp, Homo sapiens
tgctgcttttagttggatagaa

SEQ ID NO: 8503291 - DNA, 22 bp, Homo sapiens
tgctggagaactgctctgtgtt

SEQ ID NO: 8503292 - DNA, 22 bp, Homo sapiens
tgctggagaactgctctgtgtt

SEQ ID NO: 8503293 - DNA, 22 bp, Homo sapiens
tgctggagaactgctctgtgtt

SEQ ID NO: 8503294 - DNA, 22 bp, Homo sapiens
tgctggagaactgctctgtgtt

SEQ ID NO: 8503295 - DNA, 22 bp, Homo sapiens
tgctggagaactgctctgtgtt

SEQ ID NO: 8503296 - DNA, 22 bp, Homo sapiens
tgctggagaagctcctgggact

SEQ ID NO: 8503297 - DNA, 23 bp, Homo sapiens
tgctggagaagcaaagttctgag

SEQ ID NO: 8503298 - DNA, 23 bp, Homo sapiens
tgctggagaagcaaagttctgag

SEQ ID NO: 8503299 - DNA, 22 bp, Homo sapiens
tgctggagaagctcctgggact

SEQ ID NO: 8503300 - DNA, 23 bp, Homo sapiens
tgctggagacaagtgtgagaagg

SEQ ID NO: 8503301 - DNA, 22 bp, Homo sapiens
tgctggagaagctcctgggact

SEQ ID NO: 8503302 - DNA, 22 bp, Homo sapiens
tgctggagcggaggtgagccag

SEQ ID NO: 8503303 - DNA, 22 bp, Homo sapiens
tgctggagcggaggtgagccag

SEQ ID NO: 8503304 - DNA, 22 bp, Homo sapiens
tgctggaggagaaggttgctca

SEQ ID NO: 8503305 - DNA, 22 bp, Homo sapiens
tgctggaggagaaggttgctca

SEQ ID NO: 8503306 - DNA, 22 bp, Homo sapiens
tgctggagctccgggctgtagg

SEQ ID NO: 8503307 - DNA, 22 bp, Homo sapiens
tgctggaataatttcatgttaa

SEQ ID NO: 8503308 - DNA, 22 bp, Homo sapiens
tgctggaagggtagtattaact

SEQ ID NO: 8503309 - DNA, 22 bp, Homo sapiens
tgctggaagggtcggcgtgggc

SEQ ID NO: 8503310 - DNA, 23 bp, Homo sapiens
tgctggaaggtccaatttgctca

SEQ ID NO: 8503311 - DNA, 22 bp, Homo sapiens
tgctggaagaattccatgctgg

SEQ ID NO: 8503312 - DNA, 22 bp, Homo sapiens
tgctggaagagaatactggtgg

SEQ ID NO: 8503313 - DNA, 22 bp, Homo sapiens
tgctggaagagattggagcctc

SEQ ID NO: 8503314 - DNA, 22 bp, Homo sapiens
tgctggaagctcctgcatgtct

SEQ ID NO: 8503315 - DNA, 22 bp, Homo sapiens
tgctggaatttttctaggattt

SEQ ID NO: 8503316 - DNA, 22 bp, Homo sapiens
tgctggaattttgctcttgcaa

SEQ ID NO: 8503317 - DNA, 22 bp, Homo sapiens
tgctggaatgagtcggggaggg

SEQ ID NO: 8503318 - DNA, 22 bp, Homo sapiens
tgctggaattatagaaaaatag

SEQ ID NO: 8503319 - DNA, 22 bp, Homo sapiens
tgctggaattgacctagaagga

SEQ ID NO: 8503320 - DNA, 22 bp, Homo sapiens
tgctggaatttgccttctggaa

SEQ ID NO: 8503321 - DNA, 23 bp, Homo sapiens
tgctggaatttgtaccctggcag

SEQ ID NO: 8503322 - DNA, 22 bp, Homo sapiens
tgctggaactcagtgaatcatt

SEQ ID NO: 8503323 - DNA, 23 bp, Homo sapiens
tgctggaacccagggcctaacac

SEQ ID NO: 8503324 - DNA, 22 bp, Homo sapiens
tgctggaacttagcatgctctc

SEQ ID NO: 8503325 - DNA, 22 bp, Homo sapiens
tgctggaagaaaattctttaac

SEQ ID NO: 8503326 - DNA, 20 bp, Homo sapiens
tgctggaaattgttctagga

SEQ ID NO: 8503327 - DNA, 19 bp, Homo sapiens
tgctggaacatcagtagct

SEQ ID NO: 8503328 - DNA, 22 bp, Homo sapiens
tgctggaaccaggaatttgaag

SEQ ID NO: 8503329 - DNA, 20 bp, Homo sapiens
tgctggaaattgttctagga

SEQ ID NO: 8503330 - DNA, 22 bp, Homo sapiens
tgctggaaatatatttgtttat

SEQ ID NO: 8503331 - DNA, 20 bp, Homo sapiens
tgctggaaaaagtcactcat

SEQ ID NO: 8503332 - DNA, 21 bp, Homo sapiens
tgctggaaaaagtggttctag

SEQ ID NO: 8503333 - DNA, 22 bp, Homo sapiens
tgctggaaagagagtttcaatg

SEQ ID NO: 8503334 - DNA, 22 bp, Homo sapiens
tgctggaaagaattttctgtta

SEQ ID NO: 8503335 - DNA, 22 bp, Homo sapiens
tgctggaaaaatcatttgcttt

SEQ ID NO: 8503336 - DNA, 22 bp, Homo sapiens
tgctggaaataggcattgtagc

SEQ ID NO: 8503337 - DNA, 22 bp, Homo sapiens
tgctggaaattcctaggaggta

SEQ ID NO: 8503338 - DNA, 22 bp, Homo sapiens
tgctggaaagttaaattttgga

SEQ ID NO: 8503339 - DNA, 22 bp, Homo sapiens
tgctggaaagtgaggtgaatga

SEQ ID NO: 8503340 - DNA, 22 bp, Homo sapiens
tggacaacatagtgagacctca

SEQ ID NO: 8503341 - DNA, 22 bp, Homo sapiens
tggacaactggtttttgacaaa

SEQ ID NO: 8503342 - DNA, 20 bp, Homo sapiens
tggacagaattagacacttt

SEQ ID NO: 8503343 - DNA, 22 bp, Homo sapiens
tggacaggcaagcaagacatac

SEQ ID NO: 8503344 - DNA, 22 bp, Homo sapiens
tggacaggatctgagactgaga

SEQ ID NO: 8503345 - DNA, 22 bp, Homo sapiens
tggacaggatctgagactgaga

SEQ ID NO: 8503346 - DNA, 22 bp, Homo sapiens
tggacaggatctgagactgaga

SEQ ID NO: 8503347 - DNA, 22 bp, Homo sapiens
tggacaggatagtgcagtacgc

SEQ ID NO: 8503348 - DNA, 22 bp, Homo sapiens
tggacaggatagtgcagtacgc

SEQ ID NO: 8503349 - DNA, 22 bp, Homo sapiens
tggacaggatctgagactgaga

SEQ ID NO: 8503350 - DNA, 22 bp, Homo sapiens
tggacagcaaacatggagagaa

SEQ ID NO: 8503351 - DNA, 23 bp, Homo sapiens
tggacaggacccccttcggaccc

SEQ ID NO: 8503352 - DNA, 22 bp, Homo sapiens
tggacaggatagtgcagtacgc

SEQ ID NO: 8503353 - DNA, 22 bp, Homo sapiens
tggaattaataggggatataca

SEQ ID NO: 8503354 - DNA, 22 bp, Homo sapiens
tggaatgttttcctaaatcaga

SEQ ID NO: 8503355 - DNA, 22 bp, Homo sapiens
tggaatttagttaattccattt

SEQ ID NO: 8503356 - DNA, 22 bp, Homo sapiens
tggaattcttattctgacttca

SEQ ID NO: 8503357 - DNA, 22 bp, Homo sapiens
tggaattcccaagtaactttta

SEQ ID NO: 8503358 - DNA, 22 bp, Homo sapiens
tggaattatctgaagtgatttg

SEQ ID NO: 8503359 - DNA, 22 bp, Homo sapiens
tggacaaatagcatgacacttg

SEQ ID NO: 8503360 - DNA, 22 bp, Homo sapiens
tggacaacatagtgagacctca

SEQ ID NO: 8503361 - DNA, 22 bp, Homo sapiens
tggacaacatagtgagacctca

SEQ ID NO: 8503362 - DNA, 22 bp, Homo sapiens
tggaatgttgtgtataggtcag

SEQ ID NO: 8503363 - DNA, 22 bp, Homo sapiens
tggaatgtttccccagcctgca

SEQ ID NO: 8503364 - DNA, 23 bp, Homo sapiens
tggaatgtttcttgtactgaatg

SEQ ID NO: 8503365 - DNA, 22 bp, Homo sapiens
tggaatggaaacaaactgagga

SEQ ID NO: 8503366 - DNA, 22 bp, Homo sapiens
tggaatgttgataaacataggc

SEQ ID NO: 8503367 - DNA, 22 bp, Homo sapiens
tggaatgacagagagtctgaat

SEQ ID NO: 8503368 - DNA, 22 bp, Homo sapiens
tggaatgagctggctaataacc

SEQ ID NO: 8503369 - DNA, 22 bp, Homo sapiens
tggaatgagctggctaataacc

SEQ ID NO: 8503370 - DNA, 22 bp, Homo sapiens
tggaatgacagagagtctgaat

SEQ ID NO: 8503371 - DNA, 22 bp, Homo sapiens
tggaatgacagagagtctgaat

SEQ ID NO: 8503372 - DNA, 22 bp, Homo sapiens
tggaatgacaagttgttcagag

SEQ ID NO: 8503373 - DNA, 22 bp, Homo sapiens
tggaatgaatttggcttcctcc

SEQ ID NO: 8503374 - DNA, 22 bp, Homo sapiens
tggaatgaaaagtacttcagaa

SEQ ID NO: 8503375 - DNA, 22 bp, Homo sapiens
tggaatgaaaagtacttcagaa

SEQ ID NO: 8503376 - DNA, 22 bp, Homo sapiens
tggaatgaaggagatggccttt

SEQ ID NO: 8503377 - DNA, 22 bp, Homo sapiens
tggaatgaatatgttttaagga

SEQ ID NO: 8503378 - DNA, 21 bp, Homo sapiens
tggaatgaggctgagcagtgc

SEQ ID NO: 8503379 - DNA, 22 bp, Homo sapiens
tggaatggaaacaaactgagga

SEQ ID NO: 8503380 - DNA, 22 bp, Homo sapiens
tggaatgccgggccaggctccg

SEQ ID NO: 8503381 - DNA, 22 bp, Homo sapiens
tggaatggaaacaaactgagga

SEQ ID NO: 8503382 - DNA, 22 bp, Homo sapiens
tggaatgccgggccaggctccg

SEQ ID NO: 8503383 - DNA, 22 bp, Homo sapiens
tggaatgcatggctctgtgacg

SEQ ID NO: 8503384 - DNA, 22 bp, Homo sapiens
tggaatgcagtgggagcttacc

SEQ ID NO: 8503385 - DNA, 21 bp, Homo sapiens
tggaccaggaaggtggtggtg

SEQ ID NO: 8503386 - DNA, 22 bp, Homo sapiens
tggaccagcagccccagtgcct

SEQ ID NO: 8503387 - DNA, 22 bp, Homo sapiens
tggaccatgagctgcaggtgtt

SEQ ID NO: 8503388 - DNA, 20 bp, Homo sapiens
tggaccataaacaccaggta

SEQ ID NO: 8503389 - DNA, 22 bp, Homo sapiens
tggaccagggtcccagagtatg

SEQ ID NO: 8503390 - DNA, 18 bp, Homo sapiens
tggacagggtggagaaaa

SEQ ID NO: 8503391 - DNA, 22 bp, Homo sapiens
tggacaggtgagtgactcaggg

SEQ ID NO: 8503392 - DNA, 22 bp, Homo sapiens
tggacaggtgagtgactcaggg

SEQ ID NO: 8503393 - DNA, 22 bp, Homo sapiens
tggacaggtgagtgactcaggg

SEQ ID NO: 8503394 - DNA, 22 bp, Homo sapiens
tggacaggtgagtgactcaggg

SEQ ID NO: 8503395 - DNA, 18 bp, Homo sapiens
tggacagggtggagaaaa

SEQ ID NO: 8503396 - DNA, 18 bp, Homo sapiens
tggacagggtggagaaaa

SEQ ID NO: 8503397 - DNA, 18 bp, Homo sapiens
tggacagggtggagaaaa

SEQ ID NO: 8503398 - DNA, 18 bp, Homo sapiens
tggacagggtggagaaaa

SEQ ID NO: 8503399 - DNA, 22 bp, Homo sapiens
tggacaggggctgctgttgtca

SEQ ID NO: 8503400 - DNA, 22 bp, Homo sapiens
tggacaggggctgctgttgtca

SEQ ID NO: 8503401 - DNA, 23 bp, Homo sapiens
tggacagggtaactggtggtttt

SEQ ID NO: 8503402 - DNA, 23 bp, Homo sapiens
tggacagggtaactggtggtttt

SEQ ID NO: 8503403 - DNA, 20 bp, Homo sapiens
tggacaggggcataggttgc

SEQ ID NO: 8503404 - DNA, 20 bp, Homo sapiens
tggacaggggcataggttgc

SEQ ID NO: 8503405 - DNA, 22 bp, Homo sapiens
tggacagggcagagaccgagtc

SEQ ID NO: 8503406 - DNA, 22 bp, Homo sapiens
tggacaggctcctaggggttcc

SEQ ID NO: 8503407 - DNA, 22 bp, Homo sapiens
tggacaggctcctaggggttcc

SEQ ID NO: 8503408 - DNA, 22 bp, Homo sapiens
tggacaggctcctaggggttcc

SEQ ID NO: 8503409 - DNA, 22 bp, Homo sapiens
tggacaggctcctaggggttcc

SEQ ID NO: 8503410 - DNA, 22 bp, Homo sapiens
tggacagggcagagaccgagtc

SEQ ID NO: 8503411 - DNA, 22 bp, Homo sapiens
tggacaggctcctaggggttcc

SEQ ID NO: 8503412 - DNA, 17 bp, Homo sapiens
tggacccttgggcctcc

SEQ ID NO: 8503413 - DNA, 22 bp, Homo sapiens
tggacctgagcctggccctgcc

SEQ ID NO: 8503414 - DNA, 22 bp, Homo sapiens
tggacctgctggatgggcaggt

SEQ ID NO: 8503415 - DNA, 23 bp, Homo sapiens
tggacctgaaccagtgcctctgt

SEQ ID NO: 8503416 - DNA, 22 bp, Homo sapiens
tggaccgcagggatgcccggca

SEQ ID NO: 8503417 - DNA, 22 bp, Homo sapiens
tggactggaatgctgatcctct

SEQ ID NO: 8503418 - DNA, 22 bp, Homo sapiens
tggactgattttcattttaaat

SEQ ID NO: 8503419 - DNA, 22 bp, Homo sapiens
tggactctaagcagaggatcta

SEQ ID NO: 8503420 - DNA, 22 bp, Homo sapiens
tggactccagtgtctgtgttct

SEQ ID NO: 8503421 - DNA, 22 bp, Homo sapiens
tggactcagtgctgccattccc

SEQ ID NO: 8503422 - DNA, 22 bp, Homo sapiens
tggactcagagttggtggcagt

SEQ ID NO: 8503423 - DNA, 22 bp, Homo sapiens
tggactcaccttgagttagcca

SEQ ID NO: 8503424 - DNA, 22 bp, Homo sapiens
tggactcagaagtgttctttta

SEQ ID NO: 8503425 - DNA, 22 bp, Homo sapiens
tggaagaggtggaagtggcttc

SEQ ID NO: 8503426 - DNA, 22 bp, Homo sapiens
tggaagataagagattgggaag

SEQ ID NO: 8503427 - DNA, 22 bp, Homo sapiens
tggaagaggtggaagtggcttc

SEQ ID NO: 8503428 - DNA, 22 bp, Homo sapiens
tggaagaggtggaagtggcttc

SEQ ID NO: 8503429 - DNA, 22 bp, Homo sapiens
tggaagaggccagaaagtggga

SEQ ID NO: 8503430 - DNA, 22 bp, Homo sapiens
tggaagaggccagaaagtggga

SEQ ID NO: 8503431 - DNA, 22 bp, Homo sapiens
tggaagagggagctgggtggcc

SEQ ID NO: 8503432 - DNA, 22 bp, Homo sapiens
tggaagagggagctgggtggcc

SEQ ID NO: 8503433 - DNA, 22 bp, Homo sapiens
tggaagagcaggcagacaatgc

SEQ ID NO: 8503434 - DNA, 19 bp, Homo sapiens
tggaagaggaagggaaata

SEQ ID NO: 8503435 - DNA, 19 bp, Homo sapiens
tggaagaggaagggaaata

SEQ ID NO: 8503436 - DNA, 22 bp, Homo sapiens
tggaagagaaaggagtggatct

SEQ ID NO: 8503437 - DNA, 22 bp, Homo sapiens
tggaagagacacttacattcag

SEQ ID NO: 8503438 - DNA, 22 bp, Homo sapiens
tggaagagaaaggagtggatct

SEQ ID NO: 8503439 - DNA, 22 bp, Homo sapiens
tggaagagaaaatccaccctta

SEQ ID NO: 8503440 - DNA, 23 bp, Homo sapiens
tggaagactcctctcttggctgc

SEQ ID NO: 8503441 - DNA, 22 bp, Homo sapiens
tggaagacggaaatctgtagat

SEQ ID NO: 8503442 - DNA, 22 bp, Homo sapiens
tggaagacattttggaccttgg

SEQ ID NO: 8503443 - DNA, 22 bp, Homo sapiens
tggaagaccagacttcccgaac

SEQ ID NO: 8503444 - DNA, 22 bp, Homo sapiens
tggaagcctcagtttgccttct

SEQ ID NO: 8503445 - DNA, 22 bp, Homo sapiens
tggaagctcaaggcagggtgag

SEQ ID NO: 8503446 - DNA, 22 bp, Homo sapiens
tggaagctcaaggcagggtgag

SEQ ID NO: 8503447 - DNA, 18 bp, Homo sapiens
tggaagctggtgagcaga

SEQ ID NO: 8503448 - DNA, 17 bp, Homo sapiens
tggaagcttcatgttgg

SEQ ID NO: 8503449 - DNA, 22 bp, Homo sapiens
tggaagccaggcccgctcctaa

SEQ ID NO: 8503450 - DNA, 22 bp, Homo sapiens
tggaagccaggcccgctcctaa

SEQ ID NO: 8503451 - DNA, 22 bp, Homo sapiens
tggaagccaaggtcagaaggag

SEQ ID NO: 8503452 - DNA, 22 bp, Homo sapiens
tggaagcagtgattcttgtctg

SEQ ID NO: 8503453 - DNA, 22 bp, Homo sapiens
tggaagcatcacttcttgcctg

SEQ ID NO: 8503454 - DNA, 22 bp, Homo sapiens
tggaagcacttgggttttgttg

SEQ ID NO: 8503455 - DNA, 22 bp, Homo sapiens
tggaaggagctaaggacctggg

SEQ ID NO: 8503456 - DNA, 22 bp, Homo sapiens
tggaaggagctaaggacctggg

SEQ ID NO: 8503457 - DNA, 22 bp, Homo sapiens
tggaaggagctaaggacctggg

SEQ ID NO: 8503458 - DNA, 22 bp, Homo sapiens
tggaaggaagccaaggaaggtt

SEQ ID NO: 8503459 - DNA, 22 bp, Homo sapiens
tggaaggagactgggaagtgtg

SEQ ID NO: 8503460 - DNA, 22 bp, Homo sapiens
tggaaggcaacggagtgagctg

SEQ ID NO: 8503461 - DNA, 22 bp, Homo sapiens
tggaagggagtgacagtcagag

SEQ ID NO: 8503462 - DNA, 22 bp, Homo sapiens
tggaagggagtgacagtcagag

SEQ ID NO: 8503463 - DNA, 22 bp, Homo sapiens
tggaagggagtgacagtcagag

SEQ ID NO: 8503464 - DNA, 22 bp, Homo sapiens
tggaagggagtgacagtcagag

SEQ ID NO: 8503465 - DNA, 22 bp, Homo sapiens
tggaagggagtgacagtcagag

SEQ ID NO: 8503466 - DNA, 22 bp, Homo sapiens
tggaaggggagctggaaagggg

SEQ ID NO: 8503467 - DNA, 22 bp, Homo sapiens
tggaaggggagctggaaagggg

SEQ ID NO: 8503468 - DNA, 22 bp, Homo sapiens
tggaaggggagctggaaagggg

SEQ ID NO: 8503469 - DNA, 22 bp, Homo sapiens
tggaaggggttacgcagcagga

SEQ ID NO: 8503470 - DNA, 22 bp, Homo sapiens
tggaaggggttacgcagcagga

SEQ ID NO: 8503471 - DNA, 16 bp, Homo sapiens
tggaaggggtctccgg

SEQ ID NO: 8503472 - DNA, 22 bp, Homo sapiens
tggaagggggaagacagctctg

SEQ ID NO: 8503473 - DNA, 22 bp, Homo sapiens
tggaagggggaagacagctctg

SEQ ID NO: 8503474 - DNA, 20 bp, Homo sapiens
tggaaggtcccagaggaatt

SEQ ID NO: 8503475 - DNA, 22 bp, Homo sapiens
tggaaggggccaggcgcggagt

SEQ ID NO: 8503476 - DNA, 22 bp, Homo sapiens
tggaaggggccaggcgcggagt

SEQ ID NO: 8503477 - DNA, 22 bp, Homo sapiens
tggaaggggccaggcgcggagt

SEQ ID NO: 8503478 - DNA, 22 bp, Homo sapiens
tggaaggggccaggcgcggagt

SEQ ID NO: 8503479 - DNA, 22 bp, Homo sapiens
tggaagggggaagacagctctg

SEQ ID NO: 8503480 - DNA, 22 bp, Homo sapiens
tggaagtggcagaggaagtggt

SEQ ID NO: 8503481 - DNA, 22 bp, Homo sapiens
tggaataactcaccaaggtcat

SEQ ID NO: 8503482 - DNA, 22 bp, Homo sapiens
tggaataactcaccaaggtcat

SEQ ID NO: 8503483 - DNA, 22 bp, Homo sapiens
tggaagttgaatctcagtcatg

SEQ ID NO: 8503484 - DNA, 17 bp, Homo sapiens
tggaagtgaggacactg

SEQ ID NO: 8503485 - DNA, 22 bp, Homo sapiens
tggaagtgccttgctggctgtg

SEQ ID NO: 8503486 - DNA, 22 bp, Homo sapiens
tggaagtgccttgctggctgtg

SEQ ID NO: 8503487 - DNA, 22 bp, Homo sapiens
tggaagtggcagaaaatgaaca

SEQ ID NO: 8503488 - DNA, 22 bp, Homo sapiens
tggaagtggcagaaaatgaaca

SEQ ID NO: 8503489 - DNA, 22 bp, Homo sapiens
tggaagtgctcttctgaccaac

SEQ ID NO: 8503490 - DNA, 22 bp, Homo sapiens
tggaatcccgcaatggaggatt

SEQ ID NO: 8503491 - DNA, 22 bp, Homo sapiens
tggaatctgtatgtatgtataa

SEQ ID NO: 8503492 - DNA, 22 bp, Homo sapiens
tggaatagaggtgctgatatta

SEQ ID NO: 8503493 - DNA, 23 bp, Homo sapiens
tggaatcagccttttttccaagg

SEQ ID NO: 8503494 - DNA, 22 bp, Homo sapiens
tggaataatgaccacagaaaca

SEQ ID NO: 8503495 - DNA, 23 bp, Homo sapiens
tggaataataaggtacattaaca

SEQ ID NO: 8503496 - DNA, 23 bp, Homo sapiens
tggaataataaggtacattaaca

SEQ ID NO: 8503497 - DNA, 20 bp, Homo sapiens
tggaataagttaagttgttt

SEQ ID NO: 8503498 - DNA, 22 bp, Homo sapiens
tggaataactcaccaaggtcat

SEQ ID NO: 8503499 - DNA, 21 bp, Homo sapiens
tgctttatgggaaaaatgtca

SEQ ID NO: 8503500 - DNA, 18 bp, Homo sapiens
tgctttatgcttatataa

SEQ ID NO: 8503501 - DNA, 22 bp, Homo sapiens
tgctttatgttatcagaagggt

SEQ ID NO: 8503502 - DNA, 19 bp, Homo sapiens
tgctttctaaacacatgca

SEQ ID NO: 8503503 - DNA, 22 bp, Homo sapiens
tgctttctgctcttgtccacac

SEQ ID NO: 8503504 - DNA, 22 bp, Homo sapiens
tgctttctgtttttcatataat

SEQ ID NO: 8503505 - DNA, 22 bp, Homo sapiens
tgctttctttagctcctgagtc

SEQ ID NO: 8503506 - DNA, 22 bp, Homo sapiens
tgctttctttagctcctgagtc

SEQ ID NO: 8503507 - DNA, 22 bp, Homo sapiens
tgctttgaaagataatactgtc

SEQ ID NO: 8503508 - DNA, 20 bp, Homo sapiens
tgctttgatggaaatacagc

SEQ ID NO: 8503509 - DNA, 20 bp, Homo sapiens
tgctttgatggaaatacagc

SEQ ID NO: 8503510 - DNA, 21 bp, Homo sapiens
tgctttgctcgttcccagagt

SEQ ID NO: 8503511 - DNA, 22 bp, Homo sapiens
tgctttgccagacagttccctt

SEQ ID NO: 8503512 - DNA, 22 bp, Homo sapiens
tgctttgcaaataatagaatgt

SEQ ID NO: 8503513 - DNA, 22 bp, Homo sapiens
tgcttctggagtaacagggtga

SEQ ID NO: 8503514 - DNA, 19 bp, Homo sapiens
tgcttctggaatgcaaggc

SEQ ID NO: 8503515 - DNA, 19 bp, Homo sapiens
tgcttctggaatgcaaggc

SEQ ID NO: 8503516 - DNA, 19 bp, Homo sapiens
tgcttctggaatgcaaggc

SEQ ID NO: 8503517 - DNA, 22 bp, Homo sapiens
tgcttctggagtaacagggtga

SEQ ID NO: 8503518 - DNA, 22 bp, Homo sapiens
tgcttctggcttatctcgtgcc

SEQ ID NO: 8503519 - DNA, 22 bp, Homo sapiens
tgcttctggaaacagtggctgt

SEQ ID NO: 8503520 - DNA, 22 bp, Homo sapiens
tgcttctggaaacagtggctgt

SEQ ID NO: 8503521 - DNA, 19 bp, Homo sapiens
tgcttctggaaccatgatc

SEQ ID NO: 8503522 - DNA, 22 bp, Homo sapiens
tgcttctgctttacttggttca

SEQ ID NO: 8503523 - DNA, 22 bp, Homo sapiens
tgcttctggaaacagtggctgt

SEQ ID NO: 8503524 - DNA, 22 bp, Homo sapiens
tgcttctgggcctggtgttccc

SEQ ID NO: 8503525 - DNA, 22 bp, Homo sapiens
tgcttctggcttatctcgtgcc

SEQ ID NO: 8503526 - DNA, 22 bp, Homo sapiens
tgcttctgggcaaatgtgtgtg

SEQ ID NO: 8503527 - DNA, 22 bp, Homo sapiens
tgcttctggggacaggctgcct

SEQ ID NO: 8503528 - DNA, 22 bp, Homo sapiens
tgcttctgggcctggtgttccc

SEQ ID NO: 8503529 - DNA, 22 bp, Homo sapiens
tgcttctggggacaggctgcct

SEQ ID NO: 8503530 - DNA, 22 bp, Homo sapiens
tgcttctggggacaggctgcct

SEQ ID NO: 8503531 - DNA, 19 bp, Homo sapiens
tgcttctggggcttctcca

SEQ ID NO: 8503532 - DNA, 19 bp, Homo sapiens
tgcttctggggcttctcca

SEQ ID NO: 8503533 - DNA, 19 bp, Homo sapiens
tgcttctggggcttctcca

SEQ ID NO: 8503534 - DNA, 19 bp, Homo sapiens
tgcttctggggcttctcca

SEQ ID NO: 8503535 - DNA, 22 bp, Homo sapiens
tgcttctgggtaggcctcagga

SEQ ID NO: 8503536 - DNA, 22 bp, Homo sapiens
tgcttctgggtaggcctcagga

SEQ ID NO: 8503537 - DNA, 22 bp, Homo sapiens
tgcttctgttctttcacctacg

SEQ ID NO: 8503538 - DNA, 22 bp, Homo sapiens
tgcttctgttacataccagaac

SEQ ID NO: 8503539 - DNA, 22 bp, Homo sapiens
tgcttctgttctttcacctacg

SEQ ID NO: 8503540 - DNA, 22 bp, Homo sapiens
tgcttctgttctttcacctacg

SEQ ID NO: 8503541 - DNA, 22 bp, Homo sapiens
tgcttctgtctcttatgccttg

SEQ ID NO: 8503542 - DNA, 22 bp, Homo sapiens
tgcttctgtctcttatgccttg

SEQ ID NO: 8503543 - DNA, 22 bp, Homo sapiens
tgcttctgtctcttatgccttg

SEQ ID NO: 8503544 - DNA, 22 bp, Homo sapiens
tgcttctgttacataccagaac

SEQ ID NO: 8503545 - DNA, 22 bp, Homo sapiens
tgcttctgtattttgggcttga

SEQ ID NO: 8503546 - DNA, 17 bp, Homo sapiens
tgcttctgtattgctgg

SEQ ID NO: 8503547 - DNA, 22 bp, Homo sapiens
tgcttctgggtaggcctcagga

SEQ ID NO: 8503548 - DNA, 22 bp, Homo sapiens
tgcttctgggtcccagcctggc

SEQ ID NO: 8503549 - DNA, 22 bp, Homo sapiens
tgcttctgggtcccagcctggc

SEQ ID NO: 8503550 - DNA, 22 bp, Homo sapiens
tgcttctttactataggcaatt

SEQ ID NO: 8503551 - DNA, 22 bp, Homo sapiens
tgcttctttaaatgatagtcaa

SEQ ID NO: 8503552 - DNA, 22 bp, Homo sapiens
tgcttctttactataggcaatt

SEQ ID NO: 8503553 - DNA, 22 bp, Homo sapiens
tgcttctttatgatgtatgatt

SEQ ID NO: 8503554 - DNA, 22 bp, Homo sapiens
tgcttctgtttcattgatctta

SEQ ID NO: 8503555 - DNA, 22 bp, Homo sapiens
tgcttctgtttgtttctgtcat

SEQ ID NO: 8503556 - DNA, 22 bp, Homo sapiens
tgcttctgtttcattgatctta

SEQ ID NO: 8503557 - DNA, 22 bp, Homo sapiens
tgcttcttactcatatgctgat

SEQ ID NO: 8503558 - DNA, 22 bp, Homo sapiens
tgctttaaaccatggatgtgag

SEQ ID NO: 8503559 - DNA, 22 bp, Homo sapiens
tgcttgtgacagaactgtgtcc

SEQ ID NO: 8503560 - DNA, 22 bp, Homo sapiens
tgcttgtgagagttttttcaga

SEQ ID NO: 8503561 - DNA, 22 bp, Homo sapiens
tgcttgtgtgagggcctgggag

SEQ ID NO: 8503562 - DNA, 22 bp, Homo sapiens
tgctttaaaatggactgttttg

SEQ ID NO: 8503563 - DNA, 22 bp, Homo sapiens
tgctttaacgctgagggtctca

SEQ ID NO: 8503564 - DNA, 22 bp, Homo sapiens
tgctttaaccatcttgtttgga

SEQ ID NO: 8503565 - DNA, 22 bp, Homo sapiens
tgctttaccttcccagaaacca

SEQ ID NO: 8503566 - DNA, 22 bp, Homo sapiens
tgcttgacttagtttctcattt

SEQ ID NO: 8503567 - DNA, 22 bp, Homo sapiens
tgcttgacttagtttctcattt

SEQ ID NO: 8503568 - DNA, 17 bp, Homo sapiens
tgcttgactctcttgtt

SEQ ID NO: 8503569 - DNA, 22 bp, Homo sapiens
tgcttgaaaggggtttcccagt

SEQ ID NO: 8503570 - DNA, 22 bp, Homo sapiens
tgcttgactttgtcacagcatg

SEQ ID NO: 8503571 - DNA, 22 bp, Homo sapiens
tgcttgcaagagatgcaatgac

SEQ ID NO: 8503572 - DNA, 19 bp, Homo sapiens
tgcttgcctgcctttccca

SEQ ID NO: 8503573 - DNA, 22 bp, Homo sapiens
tgcttgctatgcatcctgaact

SEQ ID NO: 8503574 - DNA, 22 bp, Homo sapiens
tgcttgtgacagaactgtgtcc

SEQ ID NO: 8503575 - DNA, 22 bp, Homo sapiens
tgcttgtcttcaggattatggt

SEQ ID NO: 8503576 - DNA, 22 bp, Homo sapiens
tgcttgtcttcaggaatgctga

SEQ ID NO: 8503577 - DNA, 21 bp, Homo sapiens
tgcttgtctgcctagaggctt

SEQ ID NO: 8503578 - DNA, 22 bp, Homo sapiens
tggaacacaggactatcagctg

SEQ ID NO: 8503579 - DNA, 22 bp, Homo sapiens
tggaacacagtgattgatagcg

SEQ ID NO: 8503580 - DNA, 22 bp, Homo sapiens
tggaacacatctaaggaagcag

SEQ ID NO: 8503581 - DNA, 22 bp, Homo sapiens
tggaacacatctaaggaagcag

SEQ ID NO: 8503582 - DNA, 22 bp, Homo sapiens
tggaacacacttcaaggagaaa

SEQ ID NO: 8503583 - DNA, 22 bp, Homo sapiens
tggaacaattcttgaagggaat

SEQ ID NO: 8503584 - DNA, 22 bp, Homo sapiens
tggaacactttgttgaaatgca

SEQ ID NO: 8503585 - DNA, 22 bp, Homo sapiens
tggaacactgtggatgagaaga

SEQ ID NO: 8503586 - DNA, 19 bp, Homo sapiens
tggaacactcaaactgggt

SEQ ID NO: 8503587 - DNA, 22 bp, Homo sapiens
tggaacactgatcattgccttt

SEQ ID NO: 8503588 - DNA, 22 bp, Homo sapiens
tggaacaccttgctccagaaag

SEQ ID NO: 8503589 - DNA, 22 bp, Homo sapiens
tggaacaccttgctccagaaag

SEQ ID NO: 8503590 - DNA, 22 bp, Homo sapiens
tggaacacatctcgctgcaggg

SEQ ID NO: 8503591 - DNA, 22 bp, Homo sapiens
tggaacctggcctgagctacca

SEQ ID NO: 8503592 - DNA, 22 bp, Homo sapiens
tggaacctaaaaatgtcattgc

SEQ ID NO: 8503593 - DNA, 20 bp, Homo sapiens
tggaacctaggcagagctgg

SEQ ID NO: 8503594 - DNA, 22 bp, Homo sapiens
tggaagaaaattcaatcgagtt

SEQ ID NO: 8503595 - DNA, 23 bp, Homo sapiens
tggaagaaaatggtttggctgtg

SEQ ID NO: 8503596 - DNA, 22 bp, Homo sapiens
tggaaatgtttcttgagctcag

SEQ ID NO: 8503597 - DNA, 22 bp, Homo sapiens
tggaacaaaatatttatgtttg

SEQ ID NO: 8503598 - DNA, 22 bp, Homo sapiens
tggaacaaacatggtgatggct

SEQ ID NO: 8503599 - DNA, 19 bp, Homo sapiens
tggaacaaactgcaatgac

SEQ ID NO: 8503600 - DNA, 22 bp, Homo sapiens
tggaacaaattacaattaactt

SEQ ID NO: 8503601 - DNA, 22 bp, Homo sapiens
tggaacaacatgctggaaaatt

SEQ ID NO: 8503602 - DNA, 22 bp, Homo sapiens
tggaacaaattttggggacctt

SEQ ID NO: 8503603 - DNA, 22 bp, Homo sapiens
tggaacaagggcgtggcggtcg

SEQ ID NO: 8503604 - DNA, 22 bp, Homo sapiens
tggaacaatcccggtttagctc

SEQ ID NO: 8503605 - DNA, 22 bp, Homo sapiens
tggaacaagggttcatttaaat

SEQ ID NO: 8503606 - DNA, 22 bp, Homo sapiens
tggaacaactccctcggagcct

SEQ ID NO: 8503607 - DNA, 22 bp, Homo sapiens
tggaacaagacagcatagagct

SEQ ID NO: 8503608 - DNA, 22 bp, Homo sapiens
tggaacaagaagcaggtcgctt

SEQ ID NO: 8503609 - DNA, 22 bp, Homo sapiens
tggaaatacttgccataaaact

SEQ ID NO: 8503610 - DNA, 22 bp, Homo sapiens
tggaaatagctccagtttcatt

SEQ ID NO: 8503611 - DNA, 22 bp, Homo sapiens
tggaaatggatctgatgagtct

SEQ ID NO: 8503612 - DNA, 22 bp, Homo sapiens
tggaaaggtaggatttcaagac

SEQ ID NO: 8503613 - DNA, 22 bp, Homo sapiens
tggaaagtgctctagactttct

SEQ ID NO: 8503614 - DNA, 22 bp, Homo sapiens
tggaaaggacagttgctgatag

SEQ ID NO: 8503615 - DNA, 22 bp, Homo sapiens
tggaaagcagttcttagaatcg

SEQ ID NO: 8503616 - DNA, 22 bp, Homo sapiens
tggaaagagaaactcttgctaa

SEQ ID NO: 8503617 - DNA, 22 bp, Homo sapiens
tggaaagaggaagtgcccagca

SEQ ID NO: 8503618 - DNA, 22 bp, Homo sapiens
tggaaagaggtagaggatctgg

SEQ ID NO: 8503619 - DNA, 22 bp, Homo sapiens
tggaaagaggtagaggatctgg

SEQ ID NO: 8503620 - DNA, 21 bp, Homo sapiens
tggaaagattcaaagaccagg

SEQ ID NO: 8503621 - DNA, 22 bp, Homo sapiens
tggaaacactcaagcttatatt

SEQ ID NO: 8503622 - DNA, 21 bp, Homo sapiens
tggaaacagcgccatctgccg

SEQ ID NO: 8503623 - DNA, 22 bp, Homo sapiens
tggaaaactttggtggtgaggg

SEQ ID NO: 8503624 - DNA, 22 bp, Homo sapiens
tggaaaacaaagctctcattat

SEQ ID NO: 8503625 - DNA, 22 bp, Homo sapiens
tggaaaacattgagataccaag

SEQ ID NO: 8503626 - DNA, 22 bp, Homo sapiens
tggaaaacatgcacattggatt

SEQ ID NO: 8503627 - DNA, 22 bp, Homo sapiens
tggaaaatcaggggacattgat

SEQ ID NO: 8503628 - DNA, 19 bp, Homo sapiens
tggaaaatggattgaatca

SEQ ID NO: 8503629 - DNA, 22 bp, Homo sapiens
tggaaaattagtagtgaaaggc

SEQ ID NO: 8503630 - DNA, 22 bp, Homo sapiens
tgctttgtgtttgaatagataa

SEQ ID NO: 8503631 - DNA, 22 bp, Homo sapiens
tgcttttaggagattaaaatta

SEQ ID NO: 8503632 - DNA, 22 bp, Homo sapiens
tgcttttagctagtaactagta

SEQ ID NO: 8503633 - DNA, 22 bp, Homo sapiens
tgcttttaagaacaatgctgct

SEQ ID NO: 8503634 - DNA, 22 bp, Homo sapiens
tgcttttaggagattaaaatta

SEQ ID NO: 8503635 - DNA, 19 bp, Homo sapiens
tgctttgctcttggactca

SEQ ID NO: 8503636 - DNA, 22 bp, Homo sapiens
tgctttggatctatttgctgag

SEQ ID NO: 8503637 - DNA, 22 bp, Homo sapiens
tgctttggccactagaattcag

SEQ ID NO: 8503638 - DNA, 22 bp, Homo sapiens
tgctttgtgacagattagtttt

SEQ ID NO: 8503639 - DNA, 22 bp, Homo sapiens
tgctttgggtctctctagtttc

SEQ ID NO: 8503640 - DNA, 22 bp, Homo sapiens
tggaaaaactgagacttagaca

SEQ ID NO: 8503641 - DNA, 22 bp, Homo sapiens
tggaaaaaaattggctagcttc

SEQ ID NO: 8503642 - DNA, 22 bp, Homo sapiens
tggaaaaaacccagactctaga

SEQ ID NO: 8503643 - DNA, 20 bp, Homo sapiens
tgcttttatacctataatga

SEQ ID NO: 8503644 - DNA, 22 bp, Homo sapiens
tgcttttatttaatatcttgca

SEQ ID NO: 8503645 - DNA, 22 bp, Homo sapiens
tgcttttatttaatatcttgca

SEQ ID NO: 8503646 - DNA, 22 bp, Homo sapiens
tgcttttatttaatatcttgca

SEQ ID NO: 8503647 - DNA, 22 bp, Homo sapiens
tgctttttagtactgtcttatt

SEQ ID NO: 8503648 - DNA, 22 bp, Homo sapiens
tgcttttgcacaggtgagttcc

SEQ ID NO: 8503649 - DNA, 22 bp, Homo sapiens
tgctttttagtactgtcttatt

SEQ ID NO: 8503650 - DNA, 22 bp, Homo sapiens
tgctttttagtactgtcttatt

SEQ ID NO: 8503651 - DNA, 22 bp, Homo sapiens
tggagctggtaaacagtgacat

SEQ ID NO: 8503652 - DNA, 22 bp, Homo sapiens
tggagctggtaaacagtgacat

SEQ ID NO: 8503653 - DNA, 22 bp, Homo sapiens
tggagctggggtttgaatctgg

SEQ ID NO: 8503654 - DNA, 22 bp, Homo sapiens
tggagctggggtttgaatctgg

SEQ ID NO: 8503655 - DNA, 22 bp, Homo sapiens
tggagctggtaaacagtgacat

SEQ ID NO: 8503656 - DNA, 22 bp, Homo sapiens
tggagctggggtttgaatctgg

SEQ ID NO: 8503657 - DNA, 23 bp, Homo sapiens
tggagctgggctcagaccctggg

SEQ ID NO: 8503658 - DNA, 23 bp, Homo sapiens
tggagctgggctcagaccctggg

SEQ ID NO: 8503659 - DNA, 22 bp, Homo sapiens
tggagctgggagtcctgggctg

SEQ ID NO: 8503660 - DNA, 23 bp, Homo sapiens
tggagctgggcagctgggaaagt

SEQ ID NO: 8503661 - DNA, 23 bp, Homo sapiens
tggagctgggctcagaccctggg

SEQ ID NO: 8503662 - DNA, 20 bp, Homo sapiens
tggagctgtaatcttgtctg

SEQ ID NO: 8503663 - DNA, 22 bp, Homo sapiens
tggagctggttctggggaagct

SEQ ID NO: 8503664 - DNA, 22 bp, Homo sapiens
tggagctggttctggggaagct

SEQ ID NO: 8503665 - DNA, 22 bp, Homo sapiens
tggagctggtaaacagtgacat

SEQ ID NO: 8503666 - DNA, 22 bp, Homo sapiens
tggagctggtaaacagtgacat

SEQ ID NO: 8503667 - DNA, 22 bp, Homo sapiens
tggagctgtcactcagaaccaa

SEQ ID NO: 8503668 - DNA, 22 bp, Homo sapiens
tggagctgtcactcagaaccaa

SEQ ID NO: 8503669 - DNA, 20 bp, Homo sapiens
tggagctgtggtaaggagca

SEQ ID NO: 8503670 - DNA, 18 bp, Homo sapiens
tggaggaaaaatctcatg

SEQ ID NO: 8503671 - DNA, 22 bp, Homo sapiens
tggagcttgggactcttggtag

SEQ ID NO: 8503672 - DNA, 20 bp, Homo sapiens
tggagctgtggtaaggagca

SEQ ID NO: 8503673 - DNA, 22 bp, Homo sapiens
tggaggagggctggtgtctgta

SEQ ID NO: 8503674 - DNA, 22 bp, Homo sapiens
tggaggagggctggtgtctgta

SEQ ID NO: 8503675 - DNA, 22 bp, Homo sapiens
tggaggagggctggtgtctgta

SEQ ID NO: 8503676 - DNA, 22 bp, Homo sapiens
tggaggagtgtgattgtctgcc

SEQ ID NO: 8503677 - DNA, 22 bp, Homo sapiens
tggaggattaatctggaaagat

SEQ ID NO: 8503678 - DNA, 22 bp, Homo sapiens
tggaggattaatctggaaagat

SEQ ID NO: 8503679 - DNA, 22 bp, Homo sapiens
tggaggattccacttacatgag

SEQ ID NO: 8503680 - DNA, 22 bp, Homo sapiens
tggaggatgagtgtgggctctg

SEQ ID NO: 8503681 - DNA, 22 bp, Homo sapiens
tggaggatgagtgtgggctctg

SEQ ID NO: 8503682 - DNA, 22 bp, Homo sapiens
tggaggatgccatccaggatac

SEQ ID NO: 8503683 - DNA, 22 bp, Homo sapiens
tggaggatgccatccaggatac

SEQ ID NO: 8503684 - DNA, 22 bp, Homo sapiens
tggaggatgccatccaggatac

SEQ ID NO: 8503685 - DNA, 22 bp, Homo sapiens
tggaggatgcctggggaggcct

SEQ ID NO: 8503686 - DNA, 22 bp, Homo sapiens
tggaggagggctggtgtctgta

SEQ ID NO: 8503687 - DNA, 19 bp, Homo sapiens
tggaggagaggaaaagtca

SEQ ID NO: 8503688 - DNA, 19 bp, Homo sapiens
tggaggagaggaaaagtca

SEQ ID NO: 8503689 - DNA, 19 bp, Homo sapiens
tggaggagaggaaaagtca

SEQ ID NO: 8503690 - DNA, 22 bp, Homo sapiens
tggaggagaccattccactcag

SEQ ID NO: 8503691 - DNA, 22 bp, Homo sapiens
tggaggagaatttatggtcgaa

SEQ ID NO: 8503692 - DNA, 22 bp, Homo sapiens
tggaggagaatttatggtcgaa

SEQ ID NO: 8503693 - DNA, 22 bp, Homo sapiens
tggaggagaactccctggctac

SEQ ID NO: 8503694 - DNA, 22 bp, Homo sapiens
tggaggaaaattactggggtct

SEQ ID NO: 8503695 - DNA, 22 bp, Homo sapiens
tggaggcagtaactgagcaaca

SEQ ID NO: 8503696 - DNA, 22 bp, Homo sapiens
tggaggcagtcaaatgactgac

SEQ ID NO: 8503697 - DNA, 22 bp, Homo sapiens
tggaggcagtcaaatgactgac

SEQ ID NO: 8503698 - DNA, 19 bp, Homo sapiens
tggaggccaggacacaggt

SEQ ID NO: 8503699 - DNA, 22 bp, Homo sapiens
tggaggccagtgaaagtagatt

SEQ ID NO: 8503700 - DNA, 22 bp, Homo sapiens
tggaggcagtcacctgaagtca

SEQ ID NO: 8503701 - DNA, 19 bp, Homo sapiens
tggaggccaggacacaggt

SEQ ID NO: 8503702 - DNA, 22 bp, Homo sapiens
tggaggccatgccagagcccta

SEQ ID NO: 8503703 - DNA, 22 bp, Homo sapiens
tggaggccatgccagagcccta

SEQ ID NO: 8503704 - DNA, 22 bp, Homo sapiens
tggaggcccacactgggtagat

SEQ ID NO: 8503705 - DNA, 22 bp, Homo sapiens
tggaggcccacactgggtagat

SEQ ID NO: 8503706 - DNA, 22 bp, Homo sapiens
tggaggctggagtgcagtggcg

SEQ ID NO: 8503707 - DNA, 22 bp, Homo sapiens
tggaggctggagtgcagtggcg

SEQ ID NO: 8503708 - DNA, 19 bp, Homo sapiens
tggaggcctcaggaaaaga

SEQ ID NO: 8503709 - DNA, 22 bp, Homo sapiens
tggaggcctaggttgatgtgtg

SEQ ID NO: 8503710 - DNA, 22 bp, Homo sapiens
tggaggccggactgagaggcat

SEQ ID NO: 8503711 - DNA, 22 bp, Homo sapiens
tggaggccggactgagaggcat

SEQ ID NO: 8503712 - DNA, 22 bp, Homo sapiens
tggaggccgaattagagcgttg

SEQ ID NO: 8503713 - DNA, 22 bp, Homo sapiens
tggaggccgaattagagcgttg

SEQ ID NO: 8503714 - DNA, 22 bp, Homo sapiens
tggaggcccccaggcaacagca

SEQ ID NO: 8503715 - DNA, 22 bp, Homo sapiens
tggaggccgcgtagtctgagca

SEQ ID NO: 8503716 - DNA, 20 bp, Homo sapiens
tggaggcacctgtggagatc

SEQ ID NO: 8503717 - DNA, 22 bp, Homo sapiens
tggaggcaccactggctgcccg

SEQ ID NO: 8503718 - DNA, 22 bp, Homo sapiens
tggaggcaccactggctgcccg

SEQ ID NO: 8503719 - DNA, 19 bp, Homo sapiens
tggaggcaagacatggagg

SEQ ID NO: 8503720 - DNA, 22 bp, Homo sapiens
tggaggcaactgaagatgtagt

SEQ ID NO: 8503721 - DNA, 23 bp, Homo sapiens
tggaggcaggatgctaaggagtc

SEQ ID NO: 8503722 - DNA, 22 bp, Homo sapiens
tggaggcaggtggaggagtgaa

SEQ ID NO: 8503723 - DNA, 22 bp, Homo sapiens
tggaggtgggagggactgtcct

SEQ ID NO: 8503724 - DNA, 22 bp, Homo sapiens
tggaggtggcatctgacagctg

SEQ ID NO: 8503725 - DNA, 22 bp, Homo sapiens
tggaggtggcacaagggaggtc

SEQ ID NO: 8503726 - DNA, 22 bp, Homo sapiens
tggaggtggcacaagggaggtc

SEQ ID NO: 8503727 - DNA, 20 bp, Homo sapiens
tggaggtggtctgctgtcct

SEQ ID NO: 8503728 - DNA, 22 bp, Homo sapiens
tggaggtggggctcaggaatct

SEQ ID NO: 8503729 - DNA, 22 bp, Homo sapiens
tggagggctctttcacctggta

SEQ ID NO: 8503730 - DNA, 22 bp, Homo sapiens
tggagggctctttcacctggta

SEQ ID NO: 8503731 - DNA, 18 bp, Homo sapiens
tggagggcttgctgcagc

SEQ ID NO: 8503732 - DNA, 22 bp, Homo sapiens
tggagggctaagctgagggata

SEQ ID NO: 8503733 - DNA, 22 bp, Homo sapiens
tggagggctaagctgagggata

SEQ ID NO: 8503734 - DNA, 22 bp, Homo sapiens
tggagggctaagctgagggata

SEQ ID NO: 8503735 - DNA, 22 bp, Homo sapiens
tggagggcgcttagatggaggg

SEQ ID NO: 8503736 - DNA, 22 bp, Homo sapiens
tggagggcgcttagatggaggg

SEQ ID NO: 8503737 - DNA, 22 bp, Homo sapiens
tggagggcgcttagatggaggg

SEQ ID NO: 8503738 - DNA, 22 bp, Homo sapiens
tggagggcatgctgtccatggg

SEQ ID NO: 8503739 - DNA, 22 bp, Homo sapiens
tggagggcatgctgtccatggg

SEQ ID NO: 8503740 - DNA, 22 bp, Homo sapiens
tggagggcatctgtggtcaggc

SEQ ID NO: 8503741 - DNA, 22 bp, Homo sapiens
tggagggcatagctgttctttc

SEQ ID NO: 8503742 - DNA, 23 bp, Homo sapiens
tggagggcagaataacagactac

SEQ ID NO: 8503743 - DNA, 23 bp, Homo sapiens
tggagggcagaataacagactac

SEQ ID NO: 8503744 - DNA, 22 bp, Homo sapiens
tggaggctgtgtgcatgagacc

SEQ ID NO: 8503745 - DNA, 22 bp, Homo sapiens
tggaggctgtgtgcatgagacc

SEQ ID NO: 8503746 - DNA, 22 bp, Homo sapiens
tggaggctggtttctgctgagg

SEQ ID NO: 8503747 - DNA, 22 bp, Homo sapiens
tggaggctggagtgcagtggcg

SEQ ID NO: 8503748 - DNA, 22 bp, Homo sapiens
tggaggctggagtgcagtggcg

SEQ ID NO: 8503749 - DNA, 22 bp, Homo sapiens
tggagggaacccaggctgctct

SEQ ID NO: 8503750 - DNA, 22 bp, Homo sapiens
tggagggaacccaggctgctct

SEQ ID NO: 8503751 - DNA, 22 bp, Homo sapiens
tggagggaacccaggctgctct

SEQ ID NO: 8503752 - DNA, 22 bp, Homo sapiens
tggagggaacaaaggagtccca

SEQ ID NO: 8503753 - DNA, 22 bp, Homo sapiens
tggaggctgtgtgcatgagacc

SEQ ID NO: 8503754 - DNA, 22 bp, Homo sapiens
tggaggtgtggagtcaaaggga

SEQ ID NO: 8503755 - DNA, 22 bp, Homo sapiens
tggaggtgtccaactcgtgggt

SEQ ID NO: 8503756 - DNA, 22 bp, Homo sapiens
tggaggtgtataaggtagcttc

SEQ ID NO: 8503757 - DNA, 22 bp, Homo sapiens
tggagtcagctagacctgtgtt

SEQ ID NO: 8503758 - DNA, 22 bp, Homo sapiens
tggagtcatcttaatctaggca

SEQ ID NO: 8503759 - DNA, 22 bp, Homo sapiens
tggagtcagtggctattgggca

SEQ ID NO: 8503760 - DNA, 18 bp, Homo sapiens
tggagtcagtgacaccag

SEQ ID NO: 8503761 - DNA, 23 bp, Homo sapiens
tggaggttttactgagttgagga

SEQ ID NO: 8503762 - DNA, 22 bp, Homo sapiens
tggaggttgggatgcttgtgat

SEQ ID NO: 8503763 - DNA, 22 bp, Homo sapiens
tggagtcacagtgacctgagtc

SEQ ID NO: 8503764 - DNA, 22 bp, Homo sapiens
tggagtcagaatgcgacaggcc

SEQ ID NO: 8503765 - DNA, 22 bp, Homo sapiens
tggagtcactttctcttccagt

SEQ ID NO: 8503766 - DNA, 22 bp, Homo sapiens
tggagtcacttccatatgggaa

SEQ ID NO: 8503767 - DNA, 22 bp, Homo sapiens
tggagtcacttccatatgggaa

SEQ ID NO: 8503768 - DNA, 22 bp, Homo sapiens
tggagtctgtgatgctctgggt

SEQ ID NO: 8503769 - DNA, 22 bp, Homo sapiens
tggagtccttgttggaagtgaa

SEQ ID NO: 8503770 - DNA, 22 bp, Homo sapiens
tggagtccgctccaagttctct

SEQ ID NO: 8503771 - DNA, 22 bp, Homo sapiens
tggagtcctagtattggaaaca

SEQ ID NO: 8503772 - DNA, 20 bp, Homo sapiens
tggagtcatgggacactcac

SEQ ID NO: 8503773 - DNA, 22 bp, Homo sapiens
tggagtcatgatggctgctgat

SEQ ID NO: 8503774 - DNA, 22 bp, Homo sapiens
tggagtcatgatggctgctgat

SEQ ID NO: 8503775 - DNA, 20 bp, Homo sapiens
tggagtgctgtgttgagaag

SEQ ID NO: 8503776 - DNA, 22 bp, Homo sapiens
tggagtgaagtaaagaggacaa

SEQ ID NO: 8503777 - DNA, 22 bp, Homo sapiens
tggagtgaagtaaagaggacaa

SEQ ID NO: 8503778 - DNA, 22 bp, Homo sapiens
tggagttgcagctaccagacat

SEQ ID NO: 8503779 - DNA, 22 bp, Homo sapiens
tggagttagataaacctgggta

SEQ ID NO: 8503780 - DNA, 22 bp, Homo sapiens
tggagtgggcaatgtaggcaag

SEQ ID NO: 8503781 - DNA, 22 bp, Homo sapiens
tggagttaaaaacaggatgcac

SEQ ID NO: 8503782 - DNA, 22 bp, Homo sapiens
tggagtggacttcatgaggcca

SEQ ID NO: 8503783 - DNA, 23 bp, Homo sapiens
tggataaaatacttacattcaac

SEQ ID NO: 8503784 - DNA, 22 bp, Homo sapiens
tggataaactcactgtaagttg

SEQ ID NO: 8503785 - DNA, 22 bp, Homo sapiens
tggataaactcactgtaagttg

SEQ ID NO: 8503786 - DNA, 23 bp, Homo sapiens
tggataaagctgtgctgcatagg

SEQ ID NO: 8503787 - DNA, 21 bp, Homo sapiens
tggataaaggcacttttcatc

SEQ ID NO: 8503788 - DNA, 22 bp, Homo sapiens
tggatacctggtttttatttac

SEQ ID NO: 8503789 - DNA, 22 bp, Homo sapiens
tggatatgggccatggaaaaaa

SEQ ID NO: 8503790 - DNA, 22 bp, Homo sapiens
tggatggattgacgaaggcagc

SEQ ID NO: 8503791 - DNA, 22 bp, Homo sapiens
tggatggattgacgaaggcagc

SEQ ID NO: 8503792 - DNA, 22 bp, Homo sapiens
tggatggctggggaagagcagg

SEQ ID NO: 8503793 - DNA, 22 bp, Homo sapiens
tggatggggcagcttaggtgtg

SEQ ID NO: 8503794 - DNA, 22 bp, Homo sapiens
tggatggctgtggtctttgccc

SEQ ID NO: 8503795 - DNA, 22 bp, Homo sapiens
tggatggagactgatatgggta

SEQ ID NO: 8503796 - DNA, 22 bp, Homo sapiens
tggatgctgtaggacacgctct

SEQ ID NO: 8503797 - DNA, 17 bp, Homo sapiens
tggagctgcgtgtgttc

SEQ ID NO: 8503798 - DNA, 22 bp, Homo sapiens
tggagctggaagaatgtagacg

SEQ ID NO: 8503799 - DNA, 17 bp, Homo sapiens
tggagctgcgtgtgttc

SEQ ID NO: 8503800 - DNA, 21 bp, Homo sapiens
tggagctgccacttgtcctcc

SEQ ID NO: 8503801 - DNA, 21 bp, Homo sapiens
tggagctgccacttgtcctcc

SEQ ID NO: 8503802 - DNA, 18 bp, Homo sapiens
tggagctgagtgctgtgc

SEQ ID NO: 8503803 - DNA, 18 bp, Homo sapiens
tggagctgagtgctgtgc

SEQ ID NO: 8503804 - DNA, 22 bp, Homo sapiens
tggagctgatacagctggcttt

SEQ ID NO: 8503805 - DNA, 22 bp, Homo sapiens
tggagctgatacagctggcttt

SEQ ID NO: 8503806 - DNA, 22 bp, Homo sapiens
tggagctgatacagctggcttt

SEQ ID NO: 8503807 - DNA, 22 bp, Homo sapiens
tggagctggaagacagtgatat

SEQ ID NO: 8503808 - DNA, 22 bp, Homo sapiens
tggagctggaatttctgggcct

SEQ ID NO: 8503809 - DNA, 22 bp, Homo sapiens
tggagctggaatttctgggcct

SEQ ID NO: 8503810 - DNA, 22 bp, Homo sapiens
tggagctggaatttctgggcct

SEQ ID NO: 8503811 - DNA, 22 bp, Homo sapiens
tggagctggaatttgagctgga

SEQ ID NO: 8503812 - DNA, 22 bp, Homo sapiens
tggagctggaatttgagctgga

SEQ ID NO: 8503813 - DNA, 22 bp, Homo sapiens
tggagctggaatttgagctgga

SEQ ID NO: 8503814 - DNA, 22 bp, Homo sapiens
tggagctggaatttgagctgga

SEQ ID NO: 8503815 - DNA, 22 bp, Homo sapiens
tggagctggcagcggaaaaggg

SEQ ID NO: 8503816 - DNA, 22 bp, Homo sapiens
tggagctggcttgtggaagttg

SEQ ID NO: 8503817 - DNA, 22 bp, Homo sapiens
tggagctggcttgtggaagttg

SEQ ID NO: 8503818 - DNA, 22 bp, Homo sapiens
tggagctggcttgtggaagttg

SEQ ID NO: 8503819 - DNA, 22 bp, Homo sapiens
tggagctgggagtcctgggctg

SEQ ID NO: 8503820 - DNA, 22 bp, Homo sapiens
tggagctgaactttgaggccag

SEQ ID NO: 8503821 - DNA, 21 bp, Homo sapiens
tggagctgaatttttggcatc

SEQ ID NO: 8503822 - DNA, 21 bp, Homo sapiens
tggagctgaatttttggcatc

SEQ ID NO: 8503823 - DNA, 18 bp, Homo sapiens
tggagctgagtgctgtgc

SEQ ID NO: 8503824 - DNA, 23 bp, Homo sapiens
tggagctgacagtcagagggagg

SEQ ID NO: 8503825 - DNA, 18 bp, Homo sapiens
tggagctgagtgctgtgc

SEQ ID NO: 8503826 - DNA, 23 bp, Homo sapiens
tggagctgacagtcagagggagg

SEQ ID NO: 8503827 - DNA, 23 bp, Homo sapiens
tggagctgacagtcagagggagg

SEQ ID NO: 8503828 - DNA, 22 bp, Homo sapiens
tggagcctgtgtttctgcccag

SEQ ID NO: 8503829 - DNA, 22 bp, Homo sapiens
tggagctgaactttgaggccag

SEQ ID NO: 8503830 - DNA, 22 bp, Homo sapiens
tggagctgaactttgaggccag

SEQ ID NO: 8503831 - DNA, 20 bp, Homo sapiens
tggagctccagcgtccatgt

SEQ ID NO: 8503832 - DNA, 22 bp, Homo sapiens
tggagccataaccctttcgtac

SEQ ID NO: 8503833 - DNA, 22 bp, Homo sapiens
tggagccatgcctggcctttcc

SEQ ID NO: 8503834 - DNA, 18 bp, Homo sapiens
tggagccattgccaccat

SEQ ID NO: 8503835 - DNA, 22 bp, Homo sapiens
tggagcccagacactggcattg

SEQ ID NO: 8503836 - DNA, 22 bp, Homo sapiens
tggagcccacggatgtcgcttt

SEQ ID NO: 8503837 - DNA, 22 bp, Homo sapiens
tggagcccagggtgagaaggag

SEQ ID NO: 8503838 - DNA, 22 bp, Homo sapiens
tggagcccagggtgagaaggag

SEQ ID NO: 8503839 - DNA, 22 bp, Homo sapiens
tggagcccaggagaggataaac

SEQ ID NO: 8503840 - DNA, 22 bp, Homo sapiens
tggagcccagacactggcattg

SEQ ID NO: 8503841 - DNA, 22 bp, Homo sapiens
tggagcccagacactggcattg

SEQ ID NO: 8503842 - DNA, 22 bp, Homo sapiens
tggagcctgagtcagcggaggc

SEQ ID NO: 8503843 - DNA, 22 bp, Homo sapiens
tggagcaggaaacatctagagg

SEQ ID NO: 8503844 - DNA, 18 bp, Homo sapiens
tggagcaggaagcctggc

SEQ ID NO: 8503845 - DNA, 22 bp, Homo sapiens
tggagcaggaagtctatggctg

SEQ ID NO: 8503846 - DNA, 22 bp, Homo sapiens
tggagcaggaagtctatggctg

SEQ ID NO: 8503847 - DNA, 18 bp, Homo sapiens
tggagcaggaagcctggc

SEQ ID NO: 8503848 - DNA, 22 bp, Homo sapiens
tggagcagctaagcctctgaga

SEQ ID NO: 8503849 - DNA, 22 bp, Homo sapiens
tggagcagctgaacagagttga

SEQ ID NO: 8503850 - DNA, 22 bp, Homo sapiens
tggagcagctctagcgggcgcc

SEQ ID NO: 8503851 - DNA, 18 bp, Homo sapiens
tggagcaggtaggcatga

SEQ ID NO: 8503852 - DNA, 18 bp, Homo sapiens
tggagcaggtaggcatga

SEQ ID NO: 8503853 - DNA, 18 bp, Homo sapiens
tggagcaggtaggcatga

SEQ ID NO: 8503854 - DNA, 22 bp, Homo sapiens
tggagcaggaagtctatggctg

SEQ ID NO: 8503855 - DNA, 22 bp, Homo sapiens
tggagcaggaagtctatggctg

SEQ ID NO: 8503856 - DNA, 22 bp, Homo sapiens
tggagcaggaagtctatggctg

SEQ ID NO: 8503857 - DNA, 22 bp, Homo sapiens
tggagcaggtgccaggtgtgtg

SEQ ID NO: 8503858 - DNA, 22 bp, Homo sapiens
tggagcaggtgccaggtgtgtg

SEQ ID NO: 8503859 - DNA, 22 bp, Homo sapiens
tggagcaggtgccaggtgtgtg

SEQ ID NO: 8503860 - DNA, 22 bp, Homo sapiens
tggagcaggtgccaggtgtgtg

SEQ ID NO: 8503861 - DNA, 22 bp, Homo sapiens
tggagcaggtcggcaccatttg

SEQ ID NO: 8503862 - DNA, 22 bp, Homo sapiens
tggagcaggtgctcagggtaat

SEQ ID NO: 8503863 - DNA, 22 bp, Homo sapiens
tggagcaggtgctcagggtaat

SEQ ID NO: 8503864 - DNA, 22 bp, Homo sapiens
tggagcaggtgctcagggtaat

SEQ ID NO: 8503865 - DNA, 22 bp, Homo sapiens
tggagcaggtgctcagggtaat

SEQ ID NO: 8503866 - DNA, 22 bp, Homo sapiens
tggagcaggtgctcagggtaat

SEQ ID NO: 8503867 - DNA, 22 bp, Homo sapiens
tggagcagtggtcctggagatg

SEQ ID NO: 8503868 - DNA, 22 bp, Homo sapiens
tggagcaggtgggatgtcgtga

SEQ ID NO: 8503869 - DNA, 22 bp, Homo sapiens
tggagcaggtgggatgtcgtga

SEQ ID NO: 8503870 - DNA, 22 bp, Homo sapiens
tggagccaaaaagggaaggaga

SEQ ID NO: 8503871 - DNA, 22 bp, Homo sapiens
tggagcatattctggagcttgg

SEQ ID NO: 8503872 - DNA, 22 bp, Homo sapiens
tggagcatgagagtctttagct

SEQ ID NO: 8503873 - DNA, 22 bp, Homo sapiens
tggagcatactaacccactctg

SEQ ID NO: 8503874 - DNA, 22 bp, Homo sapiens
tggagcagtggtcctggagatg

SEQ ID NO: 8503875 - DNA, 22 bp, Homo sapiens
tggagcagtggtcctggagatg

SEQ ID NO: 8503876 - DNA, 20 bp, Homo sapiens
tggagccaaggtgtgtctgg

SEQ ID NO: 8503877 - DNA, 22 bp, Homo sapiens
tggagccaatgaacatttgctg

SEQ ID NO: 8503878 - DNA, 22 bp, Homo sapiens
tggagccaaggccagttctcag

SEQ ID NO: 8503879 - DNA, 18 bp, Homo sapiens
tggagccagctctaggat

SEQ ID NO: 8503880 - DNA, 18 bp, Homo sapiens
tggagccagctctaggat

SEQ ID NO: 8503881 - DNA, 18 bp, Homo sapiens
tggagccagctctaggat

SEQ ID NO: 8503882 - DNA, 22 bp, Homo sapiens
tggagccaggagcctgggagtc

SEQ ID NO: 8503883 - DNA, 22 bp, Homo sapiens
tggagccagcccaggcccctct

SEQ ID NO: 8503884 - DNA, 22 bp, Homo sapiens
tggagccagcaggactcagagg

SEQ ID NO: 8503885 - DNA, 22 bp, Homo sapiens
tggagccagagcgcagcctggg

SEQ ID NO: 8503886 - DNA, 22 bp, Homo sapiens
tggagccactcactatctgagt

SEQ ID NO: 8503887 - DNA, 20 bp, Homo sapiens
tggagccacagtcaggttcc

SEQ ID NO: 8503888 - DNA, 20 bp, Homo sapiens
tggagccacagtcaggttcc

SEQ ID NO: 8503889 - DNA, 22 bp, Homo sapiens
tggagcagcattcatccagcag

SEQ ID NO: 8503890 - DNA, 22 bp, Homo sapiens
tggagcagcattcatccagcag

SEQ ID NO: 8503891 - DNA, 22 bp, Homo sapiens
tggagcagcatcactttgagct

SEQ ID NO: 8503892 - DNA, 22 bp, Homo sapiens
tggagcagcacaagaaagggga

SEQ ID NO: 8503893 - DNA, 22 bp, Homo sapiens
tggagcagcacaagaaagggga

SEQ ID NO: 8503894 - DNA, 22 bp, Homo sapiens
tggagcagcatcactttgagct

SEQ ID NO: 8503895 - DNA, 22 bp, Homo sapiens
tggagcagccatgatgacagag

SEQ ID NO: 8503896 - DNA, 22 bp, Homo sapiens
tggagcagctaagcctctgaga

SEQ ID NO: 8503897 - DNA, 22 bp, Homo sapiens
tggagcagccttttctaagcaa

SEQ ID NO: 8503898 - DNA, 22 bp, Homo sapiens
tggagcagccttttctaagcaa

SEQ ID NO: 8503899 - DNA, 22 bp, Homo sapiens
tggagcagccatgatgacagag

SEQ ID NO: 8503900 - DNA, 22 bp, Homo sapiens
tggagcagccatgatgacagag

SEQ ID NO: 8503901 - DNA, 22 bp, Homo sapiens
tggagcagccatgatgacagag

SEQ ID NO: 8503902 - DNA, 22 bp, Homo sapiens
tggagcagccatgatgacagag

SEQ ID NO: 8503903 - DNA, 22 bp, Homo sapiens
tggagcagagatggtggccttc

SEQ ID NO: 8503904 - DNA, 22 bp, Homo sapiens
tggagcagagatggtggccttc

SEQ ID NO: 8503905 - DNA, 22 bp, Homo sapiens
tggagcagagatggtggccttc

SEQ ID NO: 8503906 - DNA, 22 bp, Homo sapiens
tggagcagaggaagaaggcttt

SEQ ID NO: 8503907 - DNA, 22 bp, Homo sapiens
tggagcagaggaagaaggcttt

SEQ ID NO: 8503908 - DNA, 22 bp, Homo sapiens
tggagcagaggaagaaggcttt

SEQ ID NO: 8503909 - DNA, 22 bp, Homo sapiens
tggagcagaggctgaggttggg

SEQ ID NO: 8503910 - DNA, 22 bp, Homo sapiens
tggagcagagttcagcggggag

SEQ ID NO: 8503911 - DNA, 22 bp, Homo sapiens
tggagcagagttcagcggggag

SEQ ID NO: 8503912 - DNA, 22 bp, Homo sapiens
tggagagtggatatgggagcaa

SEQ ID NO: 8503913 - DNA, 22 bp, Homo sapiens
tggagagtgtagacttcagagt

SEQ ID NO: 8503914 - DNA, 22 bp, Homo sapiens
tggagagtggatatgggagcaa

SEQ ID NO: 8503915 - DNA, 22 bp, Homo sapiens
tggagagtctctgagccagggc

SEQ ID NO: 8503916 - DNA, 22 bp, Homo sapiens
tggagagtctctgagccagggc

SEQ ID NO: 8503917 - DNA, 22 bp, Homo sapiens
tggagagtctctgagccagggc

SEQ ID NO: 8503918 - DNA, 22 bp, Homo sapiens
tggagcagagatgggagcccaa

SEQ ID NO: 8503919 - DNA, 22 bp, Homo sapiens
tggagcagagatgggagcccaa

SEQ ID NO: 8503920 - DNA, 22 bp, Homo sapiens
tggagcagagatgggagcccaa

SEQ ID NO: 8503921 - DNA, 22 bp, Homo sapiens
tggagcagaaatttgaagccat

SEQ ID NO: 8503922 - DNA, 22 bp, Homo sapiens
tggagcagaaatggcctcttgt

SEQ ID NO: 8503923 - DNA, 22 bp, Homo sapiens
tggagaggtttaaacaaaagtt

SEQ ID NO: 8503924 - DNA, 22 bp, Homo sapiens
tggagaggtttaaacaaaagtt

SEQ ID NO: 8503925 - DNA, 22 bp, Homo sapiens
tggagaggttgaataacttgtc

SEQ ID NO: 8503926 - DNA, 22 bp, Homo sapiens
tggagaggtttaaacaaaagtt

SEQ ID NO: 8503927 - DNA, 22 bp, Homo sapiens
tggagagtctcaaggcaggaaa

SEQ ID NO: 8503928 - DNA, 22 bp, Homo sapiens
tggagagtaaatggcagaatca

SEQ ID NO: 8503929 - DNA, 22 bp, Homo sapiens
tggagaggagcaccatggccat

SEQ ID NO: 8503930 - DNA, 22 bp, Homo sapiens
tggagaggttgaataacttgtc

SEQ ID NO: 8503931 - DNA, 22 bp, Homo sapiens
tggagaggagcaccatggccat

SEQ ID NO: 8503932 - DNA, 22 bp, Homo sapiens
tggagaggagcaccatggccat

SEQ ID NO: 8503933 - DNA, 19 bp, Homo sapiens
tggagaggaaatgctgctc

SEQ ID NO: 8503934 - DNA, 19 bp, Homo sapiens
tggagaggaaatgctgctc

SEQ ID NO: 8503935 - DNA, 22 bp, Homo sapiens
tggagagctggttcaaagcaga

SEQ ID NO: 8503936 - DNA, 22 bp, Homo sapiens
tggagagctgttgaaatgcaga

SEQ ID NO: 8503937 - DNA, 22 bp, Homo sapiens
tggagaggaaagtgcagttttg

SEQ ID NO: 8503938 - DNA, 22 bp, Homo sapiens
tggagaggaaagtgcagttttg

SEQ ID NO: 8503939 - DNA, 22 bp, Homo sapiens
tggagaggaaagtgcagttttg

SEQ ID NO: 8503940 - DNA, 22 bp, Homo sapiens
tggagagccttcccggcatcgc

SEQ ID NO: 8503941 - DNA, 22 bp, Homo sapiens
tggagagcctggagtccctgat

SEQ ID NO: 8503942 - DNA, 22 bp, Homo sapiens
tggagagccttcccggcatcgc

SEQ ID NO: 8503943 - DNA, 22 bp, Homo sapiens
tggagagcgcgacgggaggaag

SEQ ID NO: 8503944 - DNA, 22 bp, Homo sapiens
tggagagcgcgacgggaggaag

SEQ ID NO: 8503945 - DNA, 22 bp, Homo sapiens
tggagagcgtgcttagcactct

SEQ ID NO: 8503946 - DNA, 22 bp, Homo sapiens
tggagagcgcgacgggaggaag

SEQ ID NO: 8503947 - DNA, 22 bp, Homo sapiens
tggagagctatttggacctcca

SEQ ID NO: 8503948 - DNA, 22 bp, Homo sapiens
tggagagctcctatttgctgtc

SEQ ID NO: 8503949 - DNA, 22 bp, Homo sapiens
tggagagcgtgcttagcactct

SEQ ID NO: 8503950 - DNA, 22 bp, Homo sapiens
tggagagctatttggacctcca

SEQ ID NO: 8503951 - DNA, 22 bp, Homo sapiens
tggagagcgtgcttagcactct

SEQ ID NO: 8503952 - DNA, 22 bp, Homo sapiens
tggagagcagggctggagttca

SEQ ID NO: 8503953 - DNA, 22 bp, Homo sapiens
tggagagcaggggatgcgggcg

SEQ ID NO: 8503954 - DNA, 22 bp, Homo sapiens
tggagagcagggctggagttca

SEQ ID NO: 8503955 - DNA, 18 bp, Homo sapiens
tggagagcagcagtgggg

SEQ ID NO: 8503956 - DNA, 18 bp, Homo sapiens
tggagagcagcagtgggg

SEQ ID NO: 8503957 - DNA, 22 bp, Homo sapiens
tggagagcccgagacatcctgt

SEQ ID NO: 8503958 - DNA, 22 bp, Homo sapiens
tggagagcccgagacatcctgt

SEQ ID NO: 8503959 - DNA, 20 bp, Homo sapiens
tggagagcctctggactgtg

SEQ ID NO: 8503960 - DNA, 20 bp, Homo sapiens
tggagagcctctggactgtg

SEQ ID NO: 8503961 - DNA, 22 bp, Homo sapiens
tggagagcaatgaggggcaggc

SEQ ID NO: 8503962 - DNA, 22 bp, Homo sapiens
tggagagcactgtctcattttg

SEQ ID NO: 8503963 - DNA, 22 bp, Homo sapiens
tggagagcactgtctcattttg

SEQ ID NO: 8503964 - DNA, 22 bp, Homo sapiens
tggagagcacagttcctgcttc

SEQ ID NO: 8503965 - DNA, 22 bp, Homo sapiens
tggagagcacagttcctgcttc

SEQ ID NO: 8503966 - DNA, 22 bp, Homo sapiens
tggagagcaagtcgcagacatg

SEQ ID NO: 8503967 - DNA, 22 bp, Homo sapiens
tggagagcaagtcgcagacatg

SEQ ID NO: 8503968 - DNA, 22 bp, Homo sapiens
tggagagcaagtcgcagacatg

SEQ ID NO: 8503969 - DNA, 22 bp, Homo sapiens
tggagagcaagtcgcagacatg

SEQ ID NO: 8503970 - DNA, 22 bp, Homo sapiens
tggagagaaagttgaatggagg

SEQ ID NO: 8503971 - DNA, 22 bp, Homo sapiens
tggagaagtcaaagtgaacagg

SEQ ID NO: 8503972 - DNA, 22 bp, Homo sapiens
tggagaataggggccactggtg

SEQ ID NO: 8503973 - DNA, 22 bp, Homo sapiens
tggagagaagaggcagtgtgct

SEQ ID NO: 8503974 - DNA, 22 bp, Homo sapiens
tggagagaagaggcagtgtgct

SEQ ID NO: 8503975 - DNA, 22 bp, Homo sapiens
tggagagaagaggcagtgtgct

SEQ ID NO: 8503976 - DNA, 22 bp, Homo sapiens
tggagagagtcgggatagtaca

SEQ ID NO: 8503977 - DNA, 22 bp, Homo sapiens
tggagagaacagtgtctgaaag

SEQ ID NO: 8503978 - DNA, 22 bp, Homo sapiens
tggagagaacagtgtctgaaag

SEQ ID NO: 8503979 - DNA, 22 bp, Homo sapiens
tggagagaagaggcagtgtgct

SEQ ID NO: 8503980 - DNA, 22 bp, Homo sapiens
tggagaagctgtaggtggactc

SEQ ID NO: 8503981 - DNA, 22 bp, Homo sapiens
tggagaaaaggttgaatccatc

SEQ ID NO: 8503982 - DNA, 22 bp, Homo sapiens
tggagaaggccggccaggagtg

SEQ ID NO: 8503983 - DNA, 22 bp, Homo sapiens
tggagaaggggcagggtctcca

SEQ ID NO: 8503984 - DNA, 22 bp, Homo sapiens
tggagaaggggcagggtctcca

SEQ ID NO: 8503985 - DNA, 22 bp, Homo sapiens
tggagaaggacagcctgagaaa

SEQ ID NO: 8503986 - DNA, 22 bp, Homo sapiens
tggttccttctgcattttcagc

SEQ ID NO: 8503987 - DNA, 22 bp, Homo sapiens
tggttaaatgggaagagcaaca

SEQ ID NO: 8503988 - DNA, 22 bp, Homo sapiens
tggttaaatgctccgatcttgg

SEQ ID NO: 8503989 - DNA, 22 bp, Homo sapiens
tggttcctcagggcagctgtac

SEQ ID NO: 8503990 - DNA, 22 bp, Homo sapiens
tggttaagtccagaaaggaagc

SEQ ID NO: 8503991 - DNA, 22 bp, Homo sapiens
tggttgcctctcagagattccg

SEQ ID NO: 8503992 - DNA, 22 bp, Homo sapiens
tggttgcattaactgagagggg

SEQ ID NO: 8503993 - DNA, 22 bp, Homo sapiens
tggttggatggctcttgtggct

SEQ ID NO: 8503994 - DNA, 22 bp, Homo sapiens
tggttgtgctgagtttagtgca

SEQ ID NO: 8503995 - DNA, 22 bp, Homo sapiens
tggtttctgccctcagagctca

SEQ ID NO: 8503996 - DNA, 22 bp, Homo sapiens
tggtttctgggtttgtctagga

SEQ ID NO: 8503997 - DNA, 22 bp, Homo sapiens
tggtttcatgagatgagaattt

SEQ ID NO: 8503998 - DNA, 22 bp, Homo sapiens
tggtttctcagactctttgcag

SEQ ID NO: 8503999 - DNA, 22 bp, Homo sapiens
tggtttctctgaactctacgac

SEQ ID NO: 8504000 - DNA, 22 bp, Homo sapiens
tggtttactctgtaaaccagga

SEQ ID NO: 8504001 - DNA, 22 bp, Homo sapiens
tggttgtggtcctccacatcgc

SEQ ID NO: 8504002 - DNA, 22 bp, Homo sapiens
tggtttatttctctgaaaggtt

SEQ ID NO: 8504003 - DNA, 22 bp, Homo sapiens
tggtttcacggagtgccttgct

SEQ ID NO: 8504004 - DNA, 22 bp, Homo sapiens
tggtttcacactgcatggtgta

SEQ ID NO: 8504005 - DNA, 22 bp, Homo sapiens
tggttaaaatgcagattcagta

SEQ ID NO: 8504006 - DNA, 21 bp, Homo sapiens
tggttaaagttgtgtcatccc

SEQ ID NO: 8504007 - DNA, 22 bp, Homo sapiens
tggttaaaatgcagattcagta

SEQ ID NO: 8504008 - DNA, 22 bp, Homo sapiens
tggtgtgtacatttttgcttct

SEQ ID NO: 8504009 - DNA, 22 bp, Homo sapiens
tggtgtgtacatttttgcttct

SEQ ID NO: 8504010 - DNA, 22 bp, Homo sapiens
tggtgtggggataagcactctg

SEQ ID NO: 8504011 - DNA, 22 bp, Homo sapiens
tggtgtgttagagctcagggca

SEQ ID NO: 8504012 - DNA, 22 bp, Homo sapiens
tggtgtgaggcgggagtgtagt

SEQ ID NO: 8504013 - DNA, 22 bp, Homo sapiens
tggtgtcttggaagtaggtgct

SEQ ID NO: 8504014 - DNA, 22 bp, Homo sapiens
tggtgtctcttagtacatagat

SEQ ID NO: 8504015 - DNA, 22 bp, Homo sapiens
tggtgtctgcactccctggcgt

SEQ ID NO: 8504016 - DNA, 22 bp, Homo sapiens
tggtgtgggcgtggcaggcaag

SEQ ID NO: 8504017 - DNA, 22 bp, Homo sapiens
tggtgtggggataagcactctg

SEQ ID NO: 8504018 - DNA, 22 bp, Homo sapiens
tggtgtgggcgtggcaggcaag

SEQ ID NO: 8504019 - DNA, 23 bp, Homo sapiens
tggtggggtcttggagacagcac

SEQ ID NO: 8504020 - DNA, 22 bp, Homo sapiens
tggtggggtcatcgtcagatgc

SEQ ID NO: 8504021 - DNA, 22 bp, Homo sapiens
tggtggggtcatcgtcagatgc

SEQ ID NO: 8504022 - DNA, 22 bp, Homo sapiens
tggtgtctccatcctgccctgc

SEQ ID NO: 8504023 - DNA, 22 bp, Homo sapiens
tggtggttatgcgctttgtggg

SEQ ID NO: 8504024 - DNA, 22 bp, Homo sapiens
tggtggtcatagcagaggccgt

SEQ ID NO: 8504025 - DNA, 22 bp, Homo sapiens
tggttttgctccagtataaata

SEQ ID NO: 8504026 - DNA, 22 bp, Homo sapiens
tggttttgctaaaatagaaaga

SEQ ID NO: 8504027 - DNA, 22 bp, Homo sapiens
tggttttctggtggtggcagtg

SEQ ID NO: 8504028 - DNA, 22 bp, Homo sapiens
tggttttatttatgttgagtca

SEQ ID NO: 8504029 - DNA, 22 bp, Homo sapiens
tggttttagggaatcaatctat

SEQ ID NO: 8504030 - DNA, 22 bp, Homo sapiens
tggttttagagtatattcaggg

SEQ ID NO: 8504031 - DNA, 22 bp, Homo sapiens
tggttttagatgcctttactgc

SEQ ID NO: 8504032 - DNA, 22 bp, Homo sapiens
tggtttgagagtgtgagctttt

SEQ ID NO: 8504033 - DNA, 22 bp, Homo sapiens
tggtttctttccactctccacc

SEQ ID NO: 8504034 - DNA, 22 bp, Homo sapiens
tggtttgacaatgaggactggt

SEQ ID NO: 8504035 - DNA, 22 bp, Homo sapiens
tggtttgacaatgaggactggt

SEQ ID NO: 8504036 - DNA, 22 bp, Homo sapiens
tggttttaaaaacatgctgcat

SEQ ID NO: 8504037 - DNA, 22 bp, Homo sapiens
tggttttaaaagatgtttgaga

SEQ ID NO: 8504038 - DNA, 22 bp, Homo sapiens
tggttttaaaaacatgctgcat

SEQ ID NO: 8504039 - DNA, 22 bp, Homo sapiens
tgtaaaataattctccatgttt

SEQ ID NO: 8504040 - DNA, 22 bp, Homo sapiens
tgtaaaaggttgttctttcgtt

SEQ ID NO: 8504041 - DNA, 22 bp, Homo sapiens
tgtaaaataccattccttgtca

SEQ ID NO: 8504042 - DNA, 23 bp, Homo sapiens
tgtaaaatggggtagtgttacca

SEQ ID NO: 8504043 - DNA, 23 bp, Homo sapiens
tgtaaaatggggtagtgttacca

SEQ ID NO: 8504044 - DNA, 22 bp, Homo sapiens
tgtaaaacaaaatttgtggaga

SEQ ID NO: 8504045 - DNA, 22 bp, Homo sapiens
tgtaaaaagcccagccgctgag

SEQ ID NO: 8504046 - DNA, 22 bp, Homo sapiens
tgtaaaacaaaatttgtggaga

SEQ ID NO: 8504047 - DNA, 22 bp, Homo sapiens
tgtaaacagccccatggagagc

SEQ ID NO: 8504048 - DNA, 18 bp, Homo sapiens
tgtaaacactttcattct

SEQ ID NO: 8504049 - DNA, 22 bp, Homo sapiens
tgtaaacagccccatggagagc

SEQ ID NO: 8504050 - DNA, 23 bp, Homo sapiens
tgtaaagatcaagtgactgattt

SEQ ID NO: 8504051 - DNA, 22 bp, Homo sapiens
tgtaaagtccaagatcaaagag

SEQ ID NO: 8504052 - DNA, 22 bp, Homo sapiens
tgtaaagtatctgtgagctctc

SEQ ID NO: 8504053 - DNA, 20 bp, Homo sapiens
tgtaaataggcattgtagtt

SEQ ID NO: 8504054 - DNA, 22 bp, Homo sapiens
tgtaaatcactgaactaaatga

SEQ ID NO: 8504055 - DNA, 22 bp, Homo sapiens
tgtaaatggtcagataaaccta

SEQ ID NO: 8504056 - DNA, 22 bp, Homo sapiens
tgtaaatgaagtatgctttact

SEQ ID NO: 8504057 - DNA, 22 bp, Homo sapiens
tgtaaataatgcatgtaaatca

SEQ ID NO: 8504058 - DNA, 22 bp, Homo sapiens
tgtaaataatgcatgtaaatca

SEQ ID NO: 8504059 - DNA, 22 bp, Homo sapiens
tgtaaataatgcatgtaaatca

SEQ ID NO: 8504060 - DNA, 22 bp, Homo sapiens
tgtaaataatgcatgtaaatca

SEQ ID NO: 8504061 - DNA, 22 bp, Homo sapiens
tgtaaataattcctaggctttt

SEQ ID NO: 8504062 - DNA, 22 bp, Homo sapiens
tgtaaataatgcatgtaaatca

SEQ ID NO: 8504063 - DNA, 22 bp, Homo sapiens
tgtaaataatgcatgtaaatca

SEQ ID NO: 8504064 - DNA, 22 bp, Homo sapiens
tgtaacaaaataccttggattg

SEQ ID NO: 8504065 - DNA, 22 bp, Homo sapiens
tgtaacaaaataccttggattg

SEQ ID NO: 8504066 - DNA, 21 bp, Homo sapiens
tgtaacaaaatactgcagatt

SEQ ID NO: 8504067 - DNA, 21 bp, Homo sapiens
tgtaacaaaatactgcagatt

SEQ ID NO: 8504068 - DNA, 22 bp, Homo sapiens
tgtaacaagtaatccatgggag

SEQ ID NO: 8504069 - DNA, 17 bp, Homo sapiens
tgtaacaactcctatta

SEQ ID NO: 8504070 - DNA, 21 bp, Homo sapiens
tgtaacaagttccctaggtga

SEQ ID NO: 8504071 - DNA, 22 bp, Homo sapiens
tgtaacaatgaatatagtgact

SEQ ID NO: 8504072 - DNA, 22 bp, Homo sapiens
tgtaacaatttcttactattgt

SEQ ID NO: 8504073 - DNA, 23 bp, Homo sapiens
tgtaacaatttcatatacatgca

SEQ ID NO: 8504074 - DNA, 23 bp, Homo sapiens
tgtaacaatttcatatacatgca

SEQ ID NO: 8504075 - DNA, 23 bp, Homo sapiens
tgtaacaatttcatatacatgca

SEQ ID NO: 8504076 - DNA, 22 bp, Homo sapiens
tgtaacatatagcatgttcttg

SEQ ID NO: 8504077 - DNA, 22 bp, Homo sapiens
tgtaacagagcttttttatagc

SEQ ID NO: 8504078 - DNA, 22 bp, Homo sapiens
tgtaacagtaagcctgtgagct

SEQ ID NO: 8504079 - DNA, 22 bp, Homo sapiens
tgtaacagctctccatgtgggg

SEQ ID NO: 8504080 - DNA, 22 bp, Homo sapiens
tgtacaaagagtatagctttga

SEQ ID NO: 8504081 - DNA, 22 bp, Homo sapiens
tgtacaaagagtatagctttga

SEQ ID NO: 8504082 - DNA, 22 bp, Homo sapiens
tgtacaaaacaagatgggggta

SEQ ID NO: 8504083 - DNA, 22 bp, Homo sapiens
tgtacaaaacaagatgggggta

SEQ ID NO: 8504084 - DNA, 22 bp, Homo sapiens
tgtaaggtgctcatgtatttct

SEQ ID NO: 8504085 - DNA, 22 bp, Homo sapiens
tgtaattttacgtgacacagtt

SEQ ID NO: 8504086 - DNA, 22 bp, Homo sapiens
tgtacaaagagtatagctttga

SEQ ID NO: 8504087 - DNA, 22 bp, Homo sapiens
tgtacaaagagtatagctttga

SEQ ID NO: 8504088 - DNA, 22 bp, Homo sapiens
tgtacaaagccagaactcccaa

SEQ ID NO: 8504089 - DNA, 22 bp, Homo sapiens
tgtacaaagagtatagctttga

SEQ ID NO: 8504090 - DNA, 22 bp, Homo sapiens
tgtacaaagccagaactcccaa

SEQ ID NO: 8504091 - DNA, 22 bp, Homo sapiens
tgtacaaagccagaactcccaa

SEQ ID NO: 8504092 - DNA, 22 bp, Homo sapiens
tgtacaaaggtactttgatgtt

SEQ ID NO: 8504093 - DNA, 22 bp, Homo sapiens
tgtacaaagttaaacctatata

SEQ ID NO: 8504094 - DNA, 22 bp, Homo sapiens
tgtacaaagttaaacctatata

SEQ ID NO: 8504095 - DNA, 22 bp, Homo sapiens
tgtacaaaggtactttgatgtt

SEQ ID NO: 8504096 - DNA, 22 bp, Homo sapiens
tgtacaaaggtactttgatgtt

SEQ ID NO: 8504097 - DNA, 22 bp, Homo sapiens
tgtacaaaggtactttgatgtt

SEQ ID NO: 8504098 - DNA, 22 bp, Homo sapiens
tgtacaaagttaaacctatata

SEQ ID NO: 8504099 - DNA, 22 bp, Homo sapiens
tgtaagaagggccagagctcca

SEQ ID NO: 8504100 - DNA, 22 bp, Homo sapiens
tgtaagaataatgatttctaag

SEQ ID NO: 8504101 - DNA, 17 bp, Homo sapiens
tgtaagcaggtgagaga

SEQ ID NO: 8504102 - DNA, 22 bp, Homo sapiens
tgtaagatatgagtacatgtaa

SEQ ID NO: 8504103 - DNA, 22 bp, Homo sapiens
tgtaagatattcagcttattga

SEQ ID NO: 8504104 - DNA, 22 bp, Homo sapiens
tgtaactgccatgtagcctgtc

SEQ ID NO: 8504105 - DNA, 22 bp, Homo sapiens
tgtaactgcttagaaggtttta

SEQ ID NO: 8504106 - DNA, 22 bp, Homo sapiens
tgtaactggacaagatattcat

SEQ ID NO: 8504107 - DNA, 22 bp, Homo sapiens
tgtaactggttataatttttga

SEQ ID NO: 8504108 - DNA, 22 bp, Homo sapiens
tgtaactgtggtctagggactg

SEQ ID NO: 8504109 - DNA, 22 bp, Homo sapiens
tgtaactgtggtctagggactg

SEQ ID NO: 8504110 - DNA, 23 bp, Homo sapiens
tgtaacttcttaaattcttcact

SEQ ID NO: 8504111 - DNA, 23 bp, Homo sapiens
tgtaactttgggcatgttgcttc

SEQ ID NO: 8504112 - DNA, 23 bp, Homo sapiens
tgtaacttgatggaatgagctat

SEQ ID NO: 8504113 - DNA, 22 bp, Homo sapiens
tgtacagataaagactgtaaat

SEQ ID NO: 8504114 - DNA, 22 bp, Homo sapiens
tgtacagataaagactgtaaat

SEQ ID NO: 8504115 - DNA, 22 bp, Homo sapiens
tgtacagctgccttttttactt

SEQ ID NO: 8504116 - DNA, 22 bp, Homo sapiens
tgtacagtacatgtgtagtgat

SEQ ID NO: 8504117 - DNA, 22 bp, Homo sapiens
tgtacagtatatttcaaagcca

SEQ ID NO: 8504118 - DNA, 22 bp, Homo sapiens
tgtacagtaggaacttgttatt

SEQ ID NO: 8504119 - DNA, 22 bp, Homo sapiens
tgtacctttttctgtgcatgct

SEQ ID NO: 8504120 - DNA, 22 bp, Homo sapiens
tgtacagtcatgctttctgttc

SEQ ID NO: 8504121 - DNA, 22 bp, Homo sapiens
tgtacagtcatgctttctgttc

SEQ ID NO: 8504122 - DNA, 22 bp, Homo sapiens
tgtacagtattggtgttagtag

SEQ ID NO: 8504123 - DNA, 22 bp, Homo sapiens
tgtacagaaggcactaaggtca

SEQ ID NO: 8504124 - DNA, 22 bp, Homo sapiens
tgtacagactgtatttacaagt

SEQ ID NO: 8504125 - DNA, 22 bp, Homo sapiens
tgtacagaaattcctactacat

SEQ ID NO: 8504126 - DNA, 22 bp, Homo sapiens
tgtacactgcaggatgcattgc

SEQ ID NO: 8504127 - DNA, 22 bp, Homo sapiens
tgtacactgcaggatgcattgc

SEQ ID NO: 8504128 - DNA, 22 bp, Homo sapiens
tgtacagagactaccattaata

SEQ ID NO: 8504129 - DNA, 22 bp, Homo sapiens
tgtacagactttgcagtgtgca

SEQ ID NO: 8504130 - DNA, 22 bp, Homo sapiens
tgtacacattaagctctttaga

SEQ ID NO: 8504131 - DNA, 22 bp, Homo sapiens
tgtacacattaagctctttaga

SEQ ID NO: 8504132 - DNA, 22 bp, Homo sapiens
tgtacacatttttatgttaaca

SEQ ID NO: 8504133 - DNA, 22 bp, Homo sapiens
tgtacacctgtctttacacata

SEQ ID NO: 8504134 - DNA, 22 bp, Homo sapiens
tgtacacatgcccacttgaagc

SEQ ID NO: 8504135 - DNA, 22 bp, Homo sapiens
tgtacacatgcccacttgaagc

SEQ ID NO: 8504136 - DNA, 22 bp, Homo sapiens
tgtacacatggtgtacactccc

SEQ ID NO: 8504137 - DNA, 22 bp, Homo sapiens
tgtacacatggtgtacactccc

SEQ ID NO: 8504138 - DNA, 22 bp, Homo sapiens
tgtacaaattcattgaactgta

SEQ ID NO: 8504139 - DNA, 22 bp, Homo sapiens
tgtacaaattcattgaactgta

SEQ ID NO: 8504140 - DNA, 22 bp, Homo sapiens
tgtacaaattcagttctagggt

SEQ ID NO: 8504141 - DNA, 22 bp, Homo sapiens
tgtacaaagttaaacctatata

SEQ ID NO: 8504142 - DNA, 22 bp, Homo sapiens
tgtacaaattcagttctagggt

SEQ ID NO: 8504143 - DNA, 22 bp, Homo sapiens
tgtacaagcaaatagaccttca

SEQ ID NO: 8504144 - DNA, 19 bp, Homo sapiens
tgtacaaggattatgcagg

SEQ ID NO: 8504145 - DNA, 22 bp, Homo sapiens
tgtacaatagctattatctcca

SEQ ID NO: 8504146 - DNA, 22 bp, Homo sapiens
tgtacaatctgatgatgtatgg

SEQ ID NO: 8504147 - DNA, 22 bp, Homo sapiens
tgtacaatgccagggaacacca

SEQ ID NO: 8504148 - DNA, 22 bp, Homo sapiens
tgtacaatgccagggaacacca

SEQ ID NO: 8504149 - DNA, 22 bp, Homo sapiens
tgtacaatcttggtccctttat

SEQ ID NO: 8504150 - DNA, 22 bp, Homo sapiens
tgtacaatagctattatctcca

SEQ ID NO: 8504151 - DNA, 22 bp, Homo sapiens
tgtacaatagctattatctcca

SEQ ID NO: 8504152 - DNA, 23 bp, Homo sapiens
tgtacaagtacgacctctccctc

SEQ ID NO: 8504153 - DNA, 22 bp, Homo sapiens
tgtacaaggccatctacatgct

SEQ ID NO: 8504154 - DNA, 22 bp, Homo sapiens
tgtacacaacctacagtctgct

SEQ ID NO: 8504155 - DNA, 22 bp, Homo sapiens
tgtacaatgtgtttgttggctt

SEQ ID NO: 8504156 - DNA, 22 bp, Homo sapiens
tgtacacaatgataaattatta

SEQ ID NO: 8504157 - DNA, 22 bp, Homo sapiens
tgtacacaatgataaattatta

SEQ ID NO: 8504158 - DNA, 22 bp, Homo sapiens
tgtacacaatgataaattatta

SEQ ID NO: 8504159 - DNA, 22 bp, Homo sapiens
tgtacaatggctataataccct

SEQ ID NO: 8504160 - DNA, 22 bp, Homo sapiens
tgtacaatgtggccagtgttaa

SEQ ID NO: 8504161 - DNA, 22 bp, Homo sapiens
tgtacaatgccgagactaactc

SEQ ID NO: 8504162 - DNA, 22 bp, Homo sapiens
tgtacaatgctgaggtttgggg

SEQ ID NO: 8504163 - DNA, 22 bp, Homo sapiens
tgtacaatgccagggaacacca

SEQ ID NO: 8504164 - DNA, 22 bp, Homo sapiens
tgtacacaattcttaacataca

SEQ ID NO: 8504165 - DNA, 22 bp, Homo sapiens
tgtacacaattcttaacataca

SEQ ID NO: 8504166 - DNA, 20 bp, Homo sapiens
tgtacacagtactttacaat

SEQ ID NO: 8504167 - DNA, 22 bp, Homo sapiens
tgtacacacacgtgtgtatcta

SEQ ID NO: 8504168 - DNA, 22 bp, Homo sapiens
tgtacacacacgtgtgtatcta

SEQ ID NO: 8504169 - DNA, 20 bp, Homo sapiens
tgtacacagtactttacaat

SEQ ID NO: 8504170 - DNA, 22 bp, Homo sapiens
tgtacacatatcatttgtggga

SEQ ID NO: 8504171 - DNA, 22 bp, Homo sapiens
tggtcctgccccgtgcacagag

SEQ ID NO: 8504172 - DNA, 22 bp, Homo sapiens
tggtcctgccccgtgcacagag

SEQ ID NO: 8504173 - DNA, 22 bp, Homo sapiens
tggtcctggaaggtcctgaggg

SEQ ID NO: 8504174 - DNA, 22 bp, Homo sapiens
tggtcctggggatctgcagtga

SEQ ID NO: 8504175 - DNA, 22 bp, Homo sapiens
tggtcctggccttgaccccagg

SEQ ID NO: 8504176 - DNA, 22 bp, Homo sapiens
tggtcctcaggttctctgtgcg

SEQ ID NO: 8504177 - DNA, 22 bp, Homo sapiens
tggtcctgagcaccagcctgac

SEQ ID NO: 8504178 - DNA, 22 bp, Homo sapiens
tggtcctgatcaccgctgggca

SEQ ID NO: 8504179 - DNA, 22 bp, Homo sapiens
tggtcctgagcaccagcctgac

SEQ ID NO: 8504180 - DNA, 19 bp, Homo sapiens
tggtccagcttcttctcct

SEQ ID NO: 8504181 - DNA, 22 bp, Homo sapiens
tggtccagcttgattctcttct

SEQ ID NO: 8504182 - DNA, 20 bp, Homo sapiens
tggtccaggacctggtgtcc

SEQ ID NO: 8504183 - DNA, 22 bp, Homo sapiens
tggtccagggtgtagtacagag

SEQ ID NO: 8504184 - DNA, 22 bp, Homo sapiens
tggtcctcaggttctctgtgcg

SEQ ID NO: 8504185 - DNA, 17 bp, Homo sapiens
tggtccaggtggagcca

SEQ ID NO: 8504186 - DNA, 22 bp, Homo sapiens
tggtccaagtgaggtggcctct

SEQ ID NO: 8504187 - DNA, 22 bp, Homo sapiens
tggtccagaagatattcaacca

SEQ ID NO: 8504188 - DNA, 22 bp, Homo sapiens
tggtcatttttatttcagttgc

SEQ ID NO: 8504189 - DNA, 22 bp, Homo sapiens
tggtccacagggagtccgtgct

SEQ ID NO: 8504190 - DNA, 22 bp, Homo sapiens
tggtccagatgccttggcttta

SEQ ID NO: 8504191 - DNA, 22 bp, Homo sapiens
tggtccagatgccttggcttta

SEQ ID NO: 8504192 - DNA, 22 bp, Homo sapiens
tggtccagactttgacctctca

SEQ ID NO: 8504193 - DNA, 22 bp, Homo sapiens
tggtccagacatttctgaggta

SEQ ID NO: 8504194 - DNA, 22 bp, Homo sapiens
tggtccagaagatattcaacca

SEQ ID NO: 8504195 - DNA, 22 bp, Homo sapiens
tggtcagttgtgactagaacac

SEQ ID NO: 8504196 - DNA, 22 bp, Homo sapiens
tggtcagttgcatcagagaagt

SEQ ID NO: 8504197 - DNA, 22 bp, Homo sapiens
tggtcaggtacctctggctgtc

SEQ ID NO: 8504198 - DNA, 22 bp, Homo sapiens
tggtcagtgtgacattttttaa

SEQ ID NO: 8504199 - DNA, 22 bp, Homo sapiens
tggtcacccactgggactgcgg

SEQ ID NO: 8504200 - DNA, 22 bp, Homo sapiens
tggtcagacaaaggagaatgtt

SEQ ID NO: 8504201 - DNA, 22 bp, Homo sapiens
tggtcaggattctcagcccttc

SEQ ID NO: 8504202 - DNA, 22 bp, Homo sapiens
tggtcaggctgctctgcggcgt

SEQ ID NO: 8504203 - DNA, 22 bp, Homo sapiens
tggtcagcgtttgtcagagcag

SEQ ID NO: 8504204 - DNA, 22 bp, Homo sapiens
tggtcagcttcagagtgttcca

SEQ ID NO: 8504205 - DNA, 22 bp, Homo sapiens
tggtcaggctgctctgcggcgt

SEQ ID NO: 8504206 - DNA, 22 bp, Homo sapiens
tggtcaggctgctctgcggcgt

SEQ ID NO: 8504207 - DNA, 22 bp, Homo sapiens
tggtcaggggcttctgagctgt

SEQ ID NO: 8504208 - DNA, 22 bp, Homo sapiens
tggtgagataactttcggcaag

SEQ ID NO: 8504209 - DNA, 22 bp, Homo sapiens
tggtgactgggactggatatga

SEQ ID NO: 8504210 - DNA, 22 bp, Homo sapiens
tggtgacagcatggaagaagtg

SEQ ID NO: 8504211 - DNA, 18 bp, Homo sapiens
tggtgaagggtggaggag

SEQ ID NO: 8504212 - DNA, 22 bp, Homo sapiens
tggtgaagtcagcggagcccgg

SEQ ID NO: 8504213 - DNA, 22 bp, Homo sapiens
tggtgaatagtagcttcagact

SEQ ID NO: 8504214 - DNA, 22 bp, Homo sapiens
tggtctctgctgcagcttctca

SEQ ID NO: 8504215 - DNA, 22 bp, Homo sapiens
tggtctctgcaggccaggctca

SEQ ID NO: 8504216 - DNA, 19 bp, Homo sapiens
tggtctctgtctctttgca

SEQ ID NO: 8504217 - DNA, 22 bp, Homo sapiens
tggtctctgtaggctaccccat

SEQ ID NO: 8504218 - DNA, 22 bp, Homo sapiens
tggtgagatgcagcaacagaca

SEQ ID NO: 8504219 - DNA, 22 bp, Homo sapiens
tggtgagctctttagactggga

SEQ ID NO: 8504220 - DNA, 22 bp, Homo sapiens
tggtgaggaagacctgctcctg

SEQ ID NO: 8504221 - DNA, 22 bp, Homo sapiens
tggtgaggaagacctgctcctg

SEQ ID NO: 8504222 - DNA, 22 bp, Homo sapiens
tggtgatcagtcaactgtcttc

SEQ ID NO: 8504223 - DNA, 22 bp, Homo sapiens
tggtgcaaaactaattgcggtt

SEQ ID NO: 8504224 - DNA, 22 bp, Homo sapiens
tggtgcaagtctctgaggaggg

SEQ ID NO: 8504225 - DNA, 22 bp, Homo sapiens
tggtccttcgtggtgcagttct

SEQ ID NO: 8504226 - DNA, 22 bp, Homo sapiens
tggtcctgtagctctctaagtt

SEQ ID NO: 8504227 - DNA, 22 bp, Homo sapiens
tggtcctggtcatctgggctgg

SEQ ID NO: 8504228 - DNA, 22 bp, Homo sapiens
tggtccttgtaggcatttgagc

SEQ ID NO: 8504229 - DNA, 23 bp, Homo sapiens
tggtctcacttggtaagatgaag

SEQ ID NO: 8504230 - DNA, 23 bp, Homo sapiens
tggtctcacttggtaagatgaag

SEQ ID NO: 8504231 - DNA, 19 bp, Homo sapiens
tggtctaaatgtgtgcccc

SEQ ID NO: 8504232 - DNA, 22 bp, Homo sapiens
tggtctaagagcctaactgctg

SEQ ID NO: 8504233 - DNA, 22 bp, Homo sapiens
tggtcgaccagttggaaagtaa

SEQ ID NO: 8504234 - DNA, 22 bp, Homo sapiens
tggtcgaccagttggaaagtaa

SEQ ID NO: 8504235 - DNA, 22 bp, Homo sapiens
tggtctctgactctgaagaccc

SEQ ID NO: 8504236 - DNA, 22 bp, Homo sapiens
tggtctctgagccttcctgtgg

SEQ ID NO: 8504237 - DNA, 22 bp, Homo sapiens
tggtctctccatgccctccacc

SEQ ID NO: 8504238 - DNA, 23 bp, Homo sapiens
tggtctcagcctgtgagagctga

SEQ ID NO: 8504239 - DNA, 23 bp, Homo sapiens
tggtgcctcagaagcagtgggct

SEQ ID NO: 8504240 - DNA, 22 bp, Homo sapiens
tggtgcctccagctgcttctcc

SEQ ID NO: 8504241 - DNA, 22 bp, Homo sapiens
tggtggaaataaacatccaatt

SEQ ID NO: 8504242 - DNA, 21 bp, Homo sapiens
tggtgccttcagctgtctttt

SEQ ID NO: 8504243 - DNA, 20 bp, Homo sapiens
tggtggactttggcatggct

SEQ ID NO: 8504244 - DNA, 21 bp, Homo sapiens
tggtggaccagtgctgggaga

SEQ ID NO: 8504245 - DNA, 22 bp, Homo sapiens
tggtggacattctggatgtgct

SEQ ID NO: 8504246 - DNA, 22 bp, Homo sapiens
tggtggacaccgcagccatgaa

SEQ ID NO: 8504247 - DNA, 22 bp, Homo sapiens
tggtggagctgtggccacgacc

SEQ ID NO: 8504248 - DNA, 21 bp, Homo sapiens
tggtggagtgtgctgagcatg

SEQ ID NO: 8504249 - DNA, 21 bp, Homo sapiens
tggtggagtgtgctgagcatg

SEQ ID NO: 8504250 - DNA, 21 bp, Homo sapiens
tggtggagtgtgctgagcatg

SEQ ID NO: 8504251 - DNA, 21 bp, Homo sapiens
tggtggagtgtgctgagcatg

SEQ ID NO: 8504252 - DNA, 19 bp, Homo sapiens
tggtggaggtgcacctgac

SEQ ID NO: 8504253 - DNA, 19 bp, Homo sapiens
tggtggaggtgcacctgac

SEQ ID NO: 8504254 - DNA, 22 bp, Homo sapiens
tggtggcaaatcaggacacttc

SEQ ID NO: 8504255 - DNA, 22 bp, Homo sapiens
tggtggcaaagtacaaagtgac

SEQ ID NO: 8504256 - DNA, 22 bp, Homo sapiens
tggtggcaacattgctggagtg

SEQ ID NO: 8504257 - DNA, 22 bp, Homo sapiens
tggtggcaacattgctggagtg

SEQ ID NO: 8504258 - DNA, 22 bp, Homo sapiens
tggtggcaacattgctggagtg

SEQ ID NO: 8504259 - DNA, 22 bp, Homo sapiens
tggtgccaagcatgaggactct

SEQ ID NO: 8504260 - DNA, 22 bp, Homo sapiens
tggtgccaagcatgaggactct

SEQ ID NO: 8504261 - DNA, 22 bp, Homo sapiens
tggtgcagtccaaagggagcag

SEQ ID NO: 8504262 - DNA, 22 bp, Homo sapiens
tggtgcagtccaaagggagcag

SEQ ID NO: 8504263 - DNA, 22 bp, Homo sapiens
tggtgcagatgcaggtcactgg

SEQ ID NO: 8504264 - DNA, 22 bp, Homo sapiens
tggtgcagatagtggtgtagta

SEQ ID NO: 8504265 - DNA, 22 bp, Homo sapiens
tggtgcaggagttggcagggac

SEQ ID NO: 8504266 - DNA, 22 bp, Homo sapiens
tggtgcaggagttggcagggac

SEQ ID NO: 8504267 - DNA, 22 bp, Homo sapiens
tggtgcaggccaagctgcgagc

SEQ ID NO: 8504268 - DNA, 22 bp, Homo sapiens
tggtgcaggtgttgatgcagga

SEQ ID NO: 8504269 - DNA, 22 bp, Homo sapiens
tggtgcagtagagctgtctggg

SEQ ID NO: 8504270 - DNA, 22 bp, Homo sapiens
tggtgcagtagagctgtctggg

SEQ ID NO: 8504271 - DNA, 22 bp, Homo sapiens
tggtgcagtcattggcccaggg

SEQ ID NO: 8504272 - DNA, 22 bp, Homo sapiens
tggtgggagtgagggcatgcca

SEQ ID NO: 8504273 - DNA, 22 bp, Homo sapiens
tggtgggagtgagggcatgcca

SEQ ID NO: 8504274 - DNA, 22 bp, Homo sapiens
tggtgggagtccgctgtgctgc

SEQ ID NO: 8504275 - DNA, 22 bp, Homo sapiens
tggtgggcacagtgcccaggct

SEQ ID NO: 8504276 - DNA, 16 bp, Homo sapiens
tggtggggaggacagc

SEQ ID NO: 8504277 - DNA, 16 bp, Homo sapiens
tggtggggaggacagc

SEQ ID NO: 8504278 - DNA, 22 bp, Homo sapiens
tggtggggattccctccctggc

SEQ ID NO: 8504279 - DNA, 22 bp, Homo sapiens
tggtggggccagacttcagctc

SEQ ID NO: 8504280 - DNA, 22 bp, Homo sapiens
tggtgggggaggctgtctagca

SEQ ID NO: 8504281 - DNA, 22 bp, Homo sapiens
tggtggggctttccttctgctt

SEQ ID NO: 8504282 - DNA, 22 bp, Homo sapiens
tggtgggggaggctgtctagca

SEQ ID NO: 8504283 - DNA, 22 bp, Homo sapiens
tggtggcacaagggagagaatc

SEQ ID NO: 8504284 - DNA, 22 bp, Homo sapiens
tggtggcaattcaaagacagca

SEQ ID NO: 8504285 - DNA, 22 bp, Homo sapiens
tggtggcaatgtcctggagaag

SEQ ID NO: 8504286 - DNA, 22 bp, Homo sapiens
tggtggcaatgtcctggagaag

SEQ ID NO: 8504287 - DNA, 22 bp, Homo sapiens
tggtggcaatgtcctggagaag

SEQ ID NO: 8504288 - DNA, 22 bp, Homo sapiens
tggtggcaatgtcctggagaag

SEQ ID NO: 8504289 - DNA, 22 bp, Homo sapiens
tggtggcagagcaagagctgga

SEQ ID NO: 8504290 - DNA, 22 bp, Homo sapiens
tggtggcagagcaagagctgga

SEQ ID NO: 8504291 - DNA, 23 bp, Homo sapiens
tggtggcagaagtagcagatgac

SEQ ID NO: 8504292 - DNA, 23 bp, Homo sapiens
tggtggcagaagtagcagatgac

SEQ ID NO: 8504293 - DNA, 23 bp, Homo sapiens
tggtggcagaagtagcagatgac

SEQ ID NO: 8504294 - DNA, 22 bp, Homo sapiens
tggtggcacaagggagagaatc

SEQ ID NO: 8504295 - DNA, 22 bp, Homo sapiens
tggtggcagctgggacagaggt

SEQ ID NO: 8504296 - DNA, 22 bp, Homo sapiens
tggtggcagtctcctggctgtg

SEQ ID NO: 8504297 - DNA, 22 bp, Homo sapiens
tggtggcagtgagaaggagagg

SEQ ID NO: 8504298 - DNA, 22 bp, Homo sapiens
tggtggcatcagtgaagtacac

SEQ ID NO: 8504299 - DNA, 22 bp, Homo sapiens
tggtggcatgatagtgtgaatg

SEQ ID NO: 8504300 - DNA, 20 bp, Homo sapiens
tggtggccagtgctgcaggc

SEQ ID NO: 8504301 - DNA, 22 bp, Homo sapiens
tggtggccaattcacagggctc

SEQ ID NO: 8504302 - DNA, 22 bp, Homo sapiens
tgtcctcaaggagcttcagtct

SEQ ID NO: 8504303 - DNA, 22 bp, Homo sapiens
tgtcctcacaggaatgaacttt

SEQ ID NO: 8504304 - DNA, 22 bp, Homo sapiens
tgtcctcacaggaatgaacttt

SEQ ID NO: 8504305 - DNA, 19 bp, Homo sapiens
tgtcctcacagagcataac

SEQ ID NO: 8504306 - DNA, 22 bp, Homo sapiens
tgtcctcaggacctggcacagt

SEQ ID NO: 8504307 - DNA, 22 bp, Homo sapiens
tgtcctggccaaggccttgctt

SEQ ID NO: 8504308 - DNA, 22 bp, Homo sapiens
tgtcctgggaaatcccttaggc

SEQ ID NO: 8504309 - DNA, 22 bp, Homo sapiens
tgtcctggcctccagaaagtcg

SEQ ID NO: 8504310 - DNA, 22 bp, Homo sapiens
tgtcctggcctccagaaagtcg

SEQ ID NO: 8504311 - DNA, 22 bp, Homo sapiens
tgtcctcagatatgtctactct

SEQ ID NO: 8504312 - DNA, 22 bp, Homo sapiens
tgtcctcagatatgtctactct

SEQ ID NO: 8504313 - DNA, 22 bp, Homo sapiens
tgtcctggggcgacttggggcc

SEQ ID NO: 8504314 - DNA, 22 bp, Homo sapiens
tgtcctgggtcaaatcctggtc

SEQ ID NO: 8504315 - DNA, 22 bp, Homo sapiens
tgtcctgggtcaaccaggtcga

SEQ ID NO: 8504316 - DNA, 22 bp, Homo sapiens
tgtcctggggacaagaggccct

SEQ ID NO: 8504317 - DNA, 22 bp, Homo sapiens
tgtcctggggacaagaggccct

SEQ ID NO: 8504318 - DNA, 22 bp, Homo sapiens
tgtcctgggaatgggatgcagt

SEQ ID NO: 8504319 - DNA, 22 bp, Homo sapiens
tgtcctgggaactcacagtcca

SEQ ID NO: 8504320 - DNA, 22 bp, Homo sapiens
tgtcctgggaatgggatgcagt

SEQ ID NO: 8504321 - DNA, 22 bp, Homo sapiens
tgtcctgggaatgggatgcagt

SEQ ID NO: 8504322 - DNA, 22 bp, Homo sapiens
tgtcctgggccggcgactggtc

SEQ ID NO: 8504323 - DNA, 22 bp, Homo sapiens
tgtcctgggaggcggggtccag

SEQ ID NO: 8504324 - DNA, 22 bp, Homo sapiens
tgtccttgttcctaatgtaaaa

SEQ ID NO: 8504325 - DNA, 22 bp, Homo sapiens
tgtccttgttcctaatgtaaaa

SEQ ID NO: 8504326 - DNA, 21 bp, Homo sapiens
tgtccttaatgcaatgtcctt

SEQ ID NO: 8504327 - DNA, 22 bp, Homo sapiens
tgtccttataagaaaaggaaat

SEQ ID NO: 8504328 - DNA, 22 bp, Homo sapiens
tgtccttcttgtcttgcccaaa

SEQ ID NO: 8504329 - DNA, 22 bp, Homo sapiens
tgtccttgatgaatatgaaatt

SEQ ID NO: 8504330 - DNA, 22 bp, Homo sapiens
tgtccttgtgacattctggctt

SEQ ID NO: 8504331 - DNA, 22 bp, Homo sapiens
tgtcctgtgccaccttcctgag

SEQ ID NO: 8504332 - DNA, 22 bp, Homo sapiens
tgtcctgtaggaggcagaacaa

SEQ ID NO: 8504333 - DNA, 22 bp, Homo sapiens
tgtcctggtgcttcttgggatt

SEQ ID NO: 8504334 - DNA, 22 bp, Homo sapiens
tgtcctggtgctccaggtggct

SEQ ID NO: 8504335 - DNA, 22 bp, Homo sapiens
tgtcctgggtccctgctagaag

SEQ ID NO: 8504336 - DNA, 22 bp, Homo sapiens
tgtcctgggtccctgctagaag

SEQ ID NO: 8504337 - DNA, 21 bp, Homo sapiens
tgtcctggtcactgctctccc

SEQ ID NO: 8504338 - DNA, 22 bp, Homo sapiens
tgtcctgggtggatgcttcatt

SEQ ID NO: 8504339 - DNA, 22 bp, Homo sapiens
tgtcctggtgctccaggtggct

SEQ ID NO: 8504340 - DNA, 22 bp, Homo sapiens
tgtccctggagcttctgtcccc

SEQ ID NO: 8504341 - DNA, 22 bp, Homo sapiens
tgtccctggaactatggctcca

SEQ ID NO: 8504342 - DNA, 20 bp, Homo sapiens
tgtcctaatagacaagcaga

SEQ ID NO: 8504343 - DNA, 18 bp, Homo sapiens
tgtccctgcaaataacat

SEQ ID NO: 8504344 - DNA, 18 bp, Homo sapiens
tgtccctgcaaataacat

SEQ ID NO: 8504345 - DNA, 22 bp, Homo sapiens
tgtccctctgaggcttccctgg

SEQ ID NO: 8504346 - DNA, 22 bp, Homo sapiens
tgtccctctgaggcttccctgg

SEQ ID NO: 8504347 - DNA, 18 bp, Homo sapiens
tgtccctgcaaataacat

SEQ ID NO: 8504348 - DNA, 18 bp, Homo sapiens
tgtccctgcaaataacat

SEQ ID NO: 8504349 - DNA, 18 bp, Homo sapiens
tgtccctgcaaataacat

SEQ ID NO: 8504350 - DNA, 18 bp, Homo sapiens
tgtccctgcaaataacat

SEQ ID NO: 8504351 - DNA, 18 bp, Homo sapiens
tgtccctgcaaataacat

SEQ ID NO: 8504352 - DNA, 22 bp, Homo sapiens
tgtccctgcctgcccactctgt

SEQ ID NO: 8504353 - DNA, 22 bp, Homo sapiens
tgtccctcattgacgctgtgcc

SEQ ID NO: 8504354 - DNA, 22 bp, Homo sapiens
tgtccctaaagaaacagacatt

SEQ ID NO: 8504355 - DNA, 20 bp, Homo sapiens
tgtcccctagatcccagctc

SEQ ID NO: 8504356 - DNA, 22 bp, Homo sapiens
tgtcccctttacctccgcagcc

SEQ ID NO: 8504357 - DNA, 22 bp, Homo sapiens
tgtcccctttacctccgcagcc

SEQ ID NO: 8504358 - DNA, 22 bp, Homo sapiens
tgtcccctttctttccttcgta

SEQ ID NO: 8504359 - DNA, 22 bp, Homo sapiens
tgtcccctgcccagggatggga

SEQ ID NO: 8504360 - DNA, 22 bp, Homo sapiens
tgtccccaggtcctctgccgtc

SEQ ID NO: 8504361 - DNA, 20 bp, Homo sapiens
tgtcccctagatcccagctc

SEQ ID NO: 8504362 - DNA, 22 bp, Homo sapiens
tgtccccaaggttcagcccaca

SEQ ID NO: 8504363 - DNA, 20 bp, Homo sapiens
tgtccccaccaaaatttcat

SEQ ID NO: 8504364 - DNA, 20 bp, Homo sapiens
tgtccccaccaaaatttcat

SEQ ID NO: 8504365 - DNA, 22 bp, Homo sapiens
tgtcccatggataccaggctat

SEQ ID NO: 8504366 - DNA, 22 bp, Homo sapiens
tgtccccacccaaatctcatct

SEQ ID NO: 8504367 - DNA, 22 bp, Homo sapiens
tgtccccacccaaatctcatct

SEQ ID NO: 8504368 - DNA, 22 bp, Homo sapiens
tgtccccagcactcactctcca

SEQ ID NO: 8504369 - DNA, 22 bp, Homo sapiens
tgtccccaggtcctctgccgtc

SEQ ID NO: 8504370 - DNA, 22 bp, Homo sapiens
tgtccccagagcctgttcctgc

SEQ ID NO: 8504371 - DNA, 22 bp, Homo sapiens
tgtcccaggtcctagatgacca

SEQ ID NO: 8504372 - DNA, 22 bp, Homo sapiens
tgtcccagggaaggcccagcac

SEQ ID NO: 8504373 - DNA, 22 bp, Homo sapiens
tgtcccagcagctgggttctct

SEQ ID NO: 8504374 - DNA, 22 bp, Homo sapiens
tgtcccaggctgaagtacagtg

SEQ ID NO: 8504375 - DNA, 22 bp, Homo sapiens
tgtcccaggcctcatgttgcca

SEQ ID NO: 8504376 - DNA, 22 bp, Homo sapiens
tgtcccagtttatctgggactg

SEQ ID NO: 8504377 - DNA, 22 bp, Homo sapiens
tgtcccagttttgcaggttaga

SEQ ID NO: 8504378 - DNA, 22 bp, Homo sapiens
tgtcccagttttgcaggttaga

SEQ ID NO: 8504379 - DNA, 22 bp, Homo sapiens
tgtcccatggacacaacttctt

SEQ ID NO: 8504380 - DNA, 22 bp, Homo sapiens
tgtcccatggacacaacttctt

SEQ ID NO: 8504381 - DNA, 22 bp, Homo sapiens
tgtcccagtcaaggctgtcatc

SEQ ID NO: 8504382 - DNA, 22 bp, Homo sapiens
tgtcccagttcccagggttgct

SEQ ID NO: 8504383 - DNA, 22 bp, Homo sapiens
tgtcccagttgggtattgaatt

SEQ ID NO: 8504384 - DNA, 22 bp, Homo sapiens
tgtccaggtcagcagcagggac

SEQ ID NO: 8504385 - DNA, 22 bp, Homo sapiens
tgtccaggtggcctctgctgct

SEQ ID NO: 8504386 - DNA, 22 bp, Homo sapiens
tgtcccagcagctgggttctct

SEQ ID NO: 8504387 - DNA, 22 bp, Homo sapiens
tgtccaggcggccttgcctgtt

SEQ ID NO: 8504388 - DNA, 22 bp, Homo sapiens
tgtccaggctaaagtgcagtgg

SEQ ID NO: 8504389 - DNA, 22 bp, Homo sapiens
tgtccaggctggagtgcagtgg

SEQ ID NO: 8504390 - DNA, 22 bp, Homo sapiens
tgtcatgatgtgcacaccacag

SEQ ID NO: 8504391 - DNA, 22 bp, Homo sapiens
tgtcatgagttatttcatagga

SEQ ID NO: 8504392 - DNA, 22 bp, Homo sapiens
tgtcattccttcaatgtagata

SEQ ID NO: 8504393 - DNA, 22 bp, Homo sapiens
tgtcatctgatattacttatag

SEQ ID NO: 8504394 - DNA, 23 bp, Homo sapiens
tgtcatctccagactcccagtgc

SEQ ID NO: 8504395 - DNA, 22 bp, Homo sapiens
tgtcatctgtgttttgctggag

SEQ ID NO: 8504396 - DNA, 22 bp, Homo sapiens
tgtcatctgcgggtggcactgc

SEQ ID NO: 8504397 - DNA, 22 bp, Homo sapiens
tgtcatctcactgatatagatg

SEQ ID NO: 8504398 - DNA, 22 bp, Homo sapiens
tgtcatctacccgttaggcttt

SEQ ID NO: 8504399 - DNA, 22 bp, Homo sapiens
tgtcatatgctgtcatagccat

SEQ ID NO: 8504400 - DNA, 22 bp, Homo sapiens
tgtcatatgtaatatgttcatt

SEQ ID NO: 8504401 - DNA, 22 bp, Homo sapiens
tgtcatttagtcctctgtgtgt

SEQ ID NO: 8504402 - DNA, 22 bp, Homo sapiens
tgtcatttatcttatagtaatc

SEQ ID NO: 8504403 - DNA, 22 bp, Homo sapiens
tgtcatttattctcttattcta

SEQ ID NO: 8504404 - DNA, 22 bp, Homo sapiens
tgtcatttatgcttcttcagtg

SEQ ID NO: 8504405 - DNA, 20 bp, Homo sapiens
tgtcatttatttatcaaatg

SEQ ID NO: 8504406 - DNA, 22 bp, Homo sapiens
tgtcatttattctcttattcta

SEQ ID NO: 8504407 - DNA, 20 bp, Homo sapiens
tgtcatttatttatcaaatg

SEQ ID NO: 8504408 - DNA, 22 bp, Homo sapiens
tgtcatttattttgctgtctgt

SEQ ID NO: 8504409 - DNA, 22 bp, Homo sapiens
tgtcatttaatagatatgatgg

SEQ ID NO: 8504410 - DNA, 22 bp, Homo sapiens
tgtcatttaatagatatgatgg

SEQ ID NO: 8504411 - DNA, 22 bp, Homo sapiens
tgtcatttagtcctctgtgtgt

SEQ ID NO: 8504412 - DNA, 20 bp, Homo sapiens
tgtcattcttctttcacagg

SEQ ID NO: 8504413 - DNA, 22 bp, Homo sapiens
tgtcattgaggaaaactaggtg

SEQ ID NO: 8504414 - DNA, 18 bp, Homo sapiens
tgtcattgccagggaagc

SEQ ID NO: 8504415 - DNA, 22 bp, Homo sapiens
tgtcattggtacaaattgattg

SEQ ID NO: 8504416 - DNA, 22 bp, Homo sapiens
tgtcatttaaagctttccagat

SEQ ID NO: 8504417 - DNA, 22 bp, Homo sapiens
tgtcattggtacaaattgattg

SEQ ID NO: 8504418 - DNA, 22 bp, Homo sapiens
tgtccacatcactcacttgtca

SEQ ID NO: 8504419 - DNA, 22 bp, Homo sapiens
tgtccacatcactcacttgtca

SEQ ID NO: 8504420 - DNA, 22 bp, Homo sapiens
tgtccaccgttcagcaccagag

SEQ ID NO: 8504421 - DNA, 22 bp, Homo sapiens
tgtccaccggtcctgtgatggg

SEQ ID NO: 8504422 - DNA, 22 bp, Homo sapiens
tgtcattttctaatctgttgtc

SEQ ID NO: 8504423 - DNA, 22 bp, Homo sapiens
tgtcattttgtctcactgctat

SEQ ID NO: 8504424 - DNA, 22 bp, Homo sapiens
tgtccaggaattgaccctgcaa

SEQ ID NO: 8504425 - DNA, 22 bp, Homo sapiens
tgtccaggaccctattctcact

SEQ ID NO: 8504426 - DNA, 22 bp, Homo sapiens
tgtccagctcgagacactatct

SEQ ID NO: 8504427 - DNA, 22 bp, Homo sapiens
tgtccagcggcctggctgctga

SEQ ID NO: 8504428 - DNA, 22 bp, Homo sapiens
tgtcattttctaatctgttgtc

SEQ ID NO: 8504429 - DNA, 22 bp, Homo sapiens
tgtcattttctaatctgttgtc

SEQ ID NO: 8504430 - DNA, 22 bp, Homo sapiens
tgtcattttcatcctaaggagc

SEQ ID NO: 8504431 - DNA, 22 bp, Homo sapiens
tgtcattttcagcttatgcttc

SEQ ID NO: 8504432 - DNA, 22 bp, Homo sapiens
tgtcattttcagcttatgcttc

SEQ ID NO: 8504433 - DNA, 22 bp, Homo sapiens
tgtcatttggactttggtatta

SEQ ID NO: 8504434 - DNA, 22 bp, Homo sapiens
tgtcatttcctgaatgctgagt

SEQ ID NO: 8504435 - DNA, 22 bp, Homo sapiens
tgtcatttcacaatatcactca

SEQ ID NO: 8504436 - DNA, 22 bp, Homo sapiens
tgtcatttcacaatatcactca

SEQ ID NO: 8504437 - DNA, 20 bp, Homo sapiens
tgtcatttatttatcaaatg

SEQ ID NO: 8504438 - DNA, 22 bp, Homo sapiens
tgtcatttattttgctgtctgt

SEQ ID NO: 8504439 - DNA, 22 bp, Homo sapiens
tgtcagtgtctatgaagaattt

SEQ ID NO: 8504440 - DNA, 22 bp, Homo sapiens
tgtcagtgtatacatacagtat

SEQ ID NO: 8504441 - DNA, 22 bp, Homo sapiens
tgtcagtggtagacccagaggt

SEQ ID NO: 8504442 - DNA, 22 bp, Homo sapiens
tgtcagtggtcatagtagaaaa

SEQ ID NO: 8504443 - DNA, 20 bp, Homo sapiens
tgtcagtgcctgaggcacag

SEQ ID NO: 8504444 - DNA, 22 bp, Homo sapiens
tgtcagtgagttagttgcaagt

SEQ ID NO: 8504445 - DNA, 22 bp, Homo sapiens
tgtcagtgagttgggtcctgag

SEQ ID NO: 8504446 - DNA, 22 bp, Homo sapiens
tgtcagtagattattacaataa

SEQ ID NO: 8504447 - DNA, 22 bp, Homo sapiens
tgtcatagtgtggtagcagtgg

SEQ ID NO: 8504448 - DNA, 22 bp, Homo sapiens
tgtcataaaacacaagctgttg

SEQ ID NO: 8504449 - DNA, 22 bp, Homo sapiens
tgtcagtttcctgtgccctgct

SEQ ID NO: 8504450 - DNA, 22 bp, Homo sapiens
tgtcagtttggctctaaagttt

SEQ ID NO: 8504451 - DNA, 22 bp, Homo sapiens
tgtcagtttagttgaagaaaga

SEQ ID NO: 8504452 - DNA, 22 bp, Homo sapiens
tgtcagttacctagcacaagaa

SEQ ID NO: 8504453 - DNA, 21 bp, Homo sapiens
tgtcagttataatcaccacag

SEQ ID NO: 8504454 - DNA, 22 bp, Homo sapiens
tgtcactttgccttctggactt

SEQ ID NO: 8504455 - DNA, 21 bp, Homo sapiens
tgtcactttaagctagctcta

SEQ ID NO: 8504456 - DNA, 22 bp, Homo sapiens
tgtcacttcagttttgaaacaa

SEQ ID NO: 8504457 - DNA, 22 bp, Homo sapiens
tgtcagaactctattgatgtcc

SEQ ID NO: 8504458 - DNA, 22 bp, Homo sapiens
tgtcaggagggtccagagaaaa

SEQ ID NO: 8504459 - DNA, 21 bp, Homo sapiens
tgtcagaaataagcatgtgat

SEQ ID NO: 8504460 - DNA, 22 bp, Homo sapiens
tgtcactttggggagagttttg

SEQ ID NO: 8504461 - DNA, 22 bp, Homo sapiens
tgtcactttttataggtgttga

SEQ ID NO: 8504462 - DNA, 22 bp, Homo sapiens
tgtcactttggggagagttttg

SEQ ID NO: 8504463 - DNA, 22 bp, Homo sapiens
tgtcactcaagttccaatttac

SEQ ID NO: 8504464 - DNA, 22 bp, Homo sapiens
tgtcactacatcataaatatat

SEQ ID NO: 8504465 - DNA, 22 bp, Homo sapiens
tgtcaccttgctcatcctcgga

SEQ ID NO: 8504466 - DNA, 22 bp, Homo sapiens
tgtcaccttgcagggctggggc

SEQ ID NO: 8504467 - DNA, 22 bp, Homo sapiens
tgtcacctttacccttttatag

SEQ ID NO: 8504468 - DNA, 22 bp, Homo sapiens
tgtcaccttgatgatggcctag

SEQ ID NO: 8504469 - DNA, 19 bp, Homo sapiens
tgtcaccttctgtcagttt

SEQ ID NO: 8504470 - DNA, 22 bp, Homo sapiens
tgtcacctggaaatcactctaa

SEQ ID NO: 8504471 - DNA, 22 bp, Homo sapiens
tgtcacctggaaatcactctaa

SEQ ID NO: 8504472 - DNA, 22 bp, Homo sapiens
tgtcacttcaggaatgcaggga

SEQ ID NO: 8504473 - DNA, 19 bp, Homo sapiens
tgtcactgtcatggcccag

SEQ ID NO: 8504474 - DNA, 19 bp, Homo sapiens
tgtcaggggtgtgctgtgc

SEQ ID NO: 8504475 - DNA, 22 bp, Homo sapiens
tgtcagggatttaaagacacaa

SEQ ID NO: 8504476 - DNA, 22 bp, Homo sapiens
tgtcagggcatgcggtccagcc

SEQ ID NO: 8504477 - DNA, 18 bp, Homo sapiens
tgtcagtaaagtgacaga

SEQ ID NO: 8504478 - DNA, 22 bp, Homo sapiens
tgtatttattcaggatgtaact

SEQ ID NO: 8504479 - DNA, 22 bp, Homo sapiens
tgtatttattcaggatgtaact

SEQ ID NO: 8504480 - DNA, 17 bp, Homo sapiens
tgtatttatcatgtcag

SEQ ID NO: 8504481 - DNA, 22 bp, Homo sapiens
tgtatttattcaggatgtaact

SEQ ID NO: 8504482 - DNA, 22 bp, Homo sapiens
tgtatttattcttctggtgttt

SEQ ID NO: 8504483 - DNA, 22 bp, Homo sapiens
tgtatttgaaacagtgcatggg

SEQ ID NO: 8504484 - DNA, 22 bp, Homo sapiens
tgtatttcgctaggtactccct

SEQ ID NO: 8504485 - DNA, 22 bp, Homo sapiens
tgtatttcgctaggtactccct

SEQ ID NO: 8504486 - DNA, 22 bp, Homo sapiens
tgtatttcctggtttagatcaa

SEQ ID NO: 8504487 - DNA, 22 bp, Homo sapiens
tgtatttcctggtttagatcaa

SEQ ID NO: 8504488 - DNA, 17 bp, Homo sapiens
tgtatttgtaccacagc

SEQ ID NO: 8504489 - DNA, 22 bp, Homo sapiens
tgtatttgtgataacgacctga

SEQ ID NO: 8504490 - DNA, 22 bp, Homo sapiens
tgtatttggtgtatttaatgag

SEQ ID NO: 8504491 - DNA, 22 bp, Homo sapiens
tgtatttgggtcacaagatggg

SEQ ID NO: 8504492 - DNA, 22 bp, Homo sapiens
tgtatttgagttatgaaagaga

SEQ ID NO: 8504493 - DNA, 22 bp, Homo sapiens
tgtattttcagagtggcatttc

SEQ ID NO: 8504494 - DNA, 22 bp, Homo sapiens
tgtattttcagagtggcatttc

SEQ ID NO: 8504495 - DNA, 22 bp, Homo sapiens
tgtattttctgaggagcattag

SEQ ID NO: 8504496 - DNA, 22 bp, Homo sapiens
tgtattttctgaggagcattag

SEQ ID NO: 8504497 - DNA, 22 bp, Homo sapiens
tgtattttctgaagataatcaa

SEQ ID NO: 8504498 - DNA, 22 bp, Homo sapiens
tgtattttctgaagataatcaa

SEQ ID NO: 8504499 - DNA, 22 bp, Homo sapiens
tgtattttcttctggaagctta

SEQ ID NO: 8504500 - DNA, 22 bp, Homo sapiens
tgtattttctgaggagcattag

SEQ ID NO: 8504501 - DNA, 22 bp, Homo sapiens
tgtattttcttctggaagctta

SEQ ID NO: 8504502 - DNA, 22 bp, Homo sapiens
tgtattttgagtccaatctcct

SEQ ID NO: 8504503 - DNA, 22 bp, Homo sapiens
tgtattttgtgaggatcactct

SEQ ID NO: 8504504 - DNA, 22 bp, Homo sapiens
tgtatttatattagaatggttg

SEQ ID NO: 8504505 - DNA, 22 bp, Homo sapiens
tgtatttagtccagtctctcat

SEQ ID NO: 8504506 - DNA, 22 bp, Homo sapiens
tgtatttaattgtatcatcaca

SEQ ID NO: 8504507 - DNA, 22 bp, Homo sapiens
tgtatttaattgtatcatcaca

SEQ ID NO: 8504508 - DNA, 22 bp, Homo sapiens
tgtatttaattgtatcatcaca

SEQ ID NO: 8504509 - DNA, 20 bp, Homo sapiens
tgtatttaatgaaggctttt

SEQ ID NO: 8504510 - DNA, 20 bp, Homo sapiens
tgtatttaatgaaggctttt

SEQ ID NO: 8504511 - DNA, 22 bp, Homo sapiens
tgtatttaagctttacctaaaa

SEQ ID NO: 8504512 - DNA, 22 bp, Homo sapiens
tgtatttaagctttacctaaaa

SEQ ID NO: 8504513 - DNA, 22 bp, Homo sapiens
tgtattgaattgtgttatatct

SEQ ID NO: 8504514 - DNA, 22 bp, Homo sapiens
tgtatgcaccattgtattacct

SEQ ID NO: 8504515 - DNA, 21 bp, Homo sapiens
tgtatgcacgcacatgcacac

SEQ ID NO: 8504516 - DNA, 22 bp, Homo sapiens
tgtatgcagggcttgtatgcag

SEQ ID NO: 8504517 - DNA, 22 bp, Homo sapiens
tgtatgcagggcttgtatgcag

SEQ ID NO: 8504518 - DNA, 22 bp, Homo sapiens
tgtatgcagcaaaacaattagt

SEQ ID NO: 8504519 - DNA, 22 bp, Homo sapiens
tgtatgcctttttctgttgtaa

SEQ ID NO: 8504520 - DNA, 22 bp, Homo sapiens
tgtatgcttgtgtataatataa

SEQ ID NO: 8504521 - DNA, 22 bp, Homo sapiens
tgtatgcttgagtgtgtatact

SEQ ID NO: 8504522 - DNA, 22 bp, Homo sapiens
tgtattcttagttttaatcaga

SEQ ID NO: 8504523 - DNA, 22 bp, Homo sapiens
tgtattcttagttttaatcaga

SEQ ID NO: 8504524 - DNA, 22 bp, Homo sapiens
tgtatgtaaagtttgtaataga

SEQ ID NO: 8504525 - DNA, 22 bp, Homo sapiens
tgtatgctttccaaaaatgctg

SEQ ID NO: 8504526 - DNA, 22 bp, Homo sapiens
tgtatgctttccttctttctgg

SEQ ID NO: 8504527 - DNA, 22 bp, Homo sapiens
tgtatgctttggttgtttctct

SEQ ID NO: 8504528 - DNA, 22 bp, Homo sapiens
tgtatgtaaaggtcttcatgtt

SEQ ID NO: 8504529 - DNA, 23 bp, Homo sapiens
tgtcacatttagttggcattgtt

SEQ ID NO: 8504530 - DNA, 22 bp, Homo sapiens
tgtcacattgaatatgatttat

SEQ ID NO: 8504531 - DNA, 22 bp, Homo sapiens
tgtcacattgaatatgatttat

SEQ ID NO: 8504532 - DNA, 22 bp, Homo sapiens
tgtcacatgtgtggcatttttc

SEQ ID NO: 8504533 - DNA, 22 bp, Homo sapiens
tgtcaccaagttgatgaatgca

SEQ ID NO: 8504534 - DNA, 22 bp, Homo sapiens
tgtcaccactggctgaaacacc

SEQ ID NO: 8504535 - DNA, 22 bp, Homo sapiens
tgtcaccagttccaggaaataa

SEQ ID NO: 8504536 - DNA, 22 bp, Homo sapiens
tgtcaccagctgctcctcagga

SEQ ID NO: 8504537 - DNA, 22 bp, Homo sapiens
tgtcacctctttggctgcagct

SEQ ID NO: 8504538 - DNA, 22 bp, Homo sapiens
tgtcaccatgcgaggctaattt

SEQ ID NO: 8504539 - DNA, 22 bp, Homo sapiens
tgtcaccatgccagcttctgcc

SEQ ID NO: 8504540 - DNA, 22 bp, Homo sapiens
tgtcaccatgccagcttctgcc

SEQ ID NO: 8504541 - DNA, 22 bp, Homo sapiens
tgtcacagtttgtactttatag

SEQ ID NO: 8504542 - DNA, 22 bp, Homo sapiens
tgtcacagtctcgtgagcatct

SEQ ID NO: 8504543 - DNA, 22 bp, Homo sapiens
tgtcacagggataccatggggc

SEQ ID NO: 8504544 - DNA, 21 bp, Homo sapiens
tgtcacagattctcagcttgc

SEQ ID NO: 8504545 - DNA, 22 bp, Homo sapiens
tgtcacagggataccatggggc

SEQ ID NO: 8504546 - DNA, 21 bp, Homo sapiens
tgtcacagattctcagcttgc

SEQ ID NO: 8504547 - DNA, 22 bp, Homo sapiens
tgtcacataatttatctgtagg

SEQ ID NO: 8504548 - DNA, 22 bp, Homo sapiens
tgtcacataatttatctgtagg

SEQ ID NO: 8504549 - DNA, 22 bp, Homo sapiens
tgtcacataggcaaaatgtttt

SEQ ID NO: 8504550 - DNA, 22 bp, Homo sapiens
tgtcacagagcaactatttctt

SEQ ID NO: 8504551 - DNA, 22 bp, Homo sapiens
tgtcacacctcgtttagcattc

SEQ ID NO: 8504552 - DNA, 22 bp, Homo sapiens
tgtcacaaacatacattataga

SEQ ID NO: 8504553 - DNA, 22 bp, Homo sapiens
tgtcacaacagaggaactgaat

SEQ ID NO: 8504554 - DNA, 22 bp, Homo sapiens
tgtcacaaggccatgaaaagaa

SEQ ID NO: 8504555 - DNA, 22 bp, Homo sapiens
tgtcacaagtaactggcaatgc

SEQ ID NO: 8504556 - DNA, 22 bp, Homo sapiens
tgtcacaaggccatgaaaagaa

SEQ ID NO: 8504557 - DNA, 22 bp, Homo sapiens
tgtcacaagtaactggcaatgc

SEQ ID NO: 8504558 - DNA, 22 bp, Homo sapiens
tgtcacaatatcccaatctgcc

SEQ ID NO: 8504559 - DNA, 22 bp, Homo sapiens
tgtcacaatttatttctcttga

SEQ ID NO: 8504560 - DNA, 22 bp, Homo sapiens
tgtcacaatttatttctcttga

SEQ ID NO: 8504561 - DNA, 22 bp, Homo sapiens
tgtcacaatatcccaatctgcc

SEQ ID NO: 8504562 - DNA, 22 bp, Homo sapiens
tgtcacaaaaatcagtaattgc

SEQ ID NO: 8504563 - DNA, 22 bp, Homo sapiens
tgtcacaaacatacattataga

SEQ ID NO: 8504564 - DNA, 22 bp, Homo sapiens
tgtcacaaacatacattataga

SEQ ID NO: 8504565 - DNA, 22 bp, Homo sapiens
tgtcaatgaagatatgaataat

SEQ ID NO: 8504566 - DNA, 22 bp, Homo sapiens
tgtcaatgtgtacaggagctca

SEQ ID NO: 8504567 - DNA, 22 bp, Homo sapiens
tgtcaaaaataagagagattgt

SEQ ID NO: 8504568 - DNA, 22 bp, Homo sapiens
tgtcaaaaataagagagattgt

SEQ ID NO: 8504569 - DNA, 22 bp, Homo sapiens
tgtcaaaaccagcaattttgtt

SEQ ID NO: 8504570 - DNA, 22 bp, Homo sapiens
tgtcaaagcaaggattaaatgt

SEQ ID NO: 8504571 - DNA, 22 bp, Homo sapiens
tgtcaaagacagaaggaaatgg

SEQ ID NO: 8504572 - DNA, 22 bp, Homo sapiens
tgtcaaaatgactttactacag

SEQ ID NO: 8504573 - DNA, 22 bp, Homo sapiens
tgtcaaaaataagagagattgt

SEQ ID NO: 8504574 - DNA, 22 bp, Homo sapiens
tgtatttttaggaatgcgctat

SEQ ID NO: 8504575 - DNA, 22 bp, Homo sapiens
tgtatttttaggaatgcgctat

SEQ ID NO: 8504576 - DNA, 22 bp, Homo sapiens
tgtatttttagacctttagacc

SEQ ID NO: 8504577 - DNA, 22 bp, Homo sapiens
tgtatttttagacctttagacc

SEQ ID NO: 8504578 - DNA, 22 bp, Homo sapiens
tgtatttttagacctttagacc

SEQ ID NO: 8504579 - DNA, 22 bp, Homo sapiens
tgtattttgtgaggatcactct

SEQ ID NO: 8504580 - DNA, 22 bp, Homo sapiens
tgtatttttagacctttagacc

SEQ ID NO: 8504581 - DNA, 22 bp, Homo sapiens
tgtataagcctagtgaaatttc

SEQ ID NO: 8504582 - DNA, 22 bp, Homo sapiens
tgtatacaagtcgtgtaaactt

SEQ ID NO: 8504583 - DNA, 22 bp, Homo sapiens
tgtataaatttaaattcctgct

SEQ ID NO: 8504584 - DNA, 22 bp, Homo sapiens
tgtatacaagtcgtgtaaactt

SEQ ID NO: 8504585 - DNA, 22 bp, Homo sapiens
tgtatacaagtcgtgtaaactt

SEQ ID NO: 8504586 - DNA, 23 bp, Homo sapiens
tgtatacaccctgtgcatctggg

SEQ ID NO: 8504587 - DNA, 21 bp, Homo sapiens
tgtatacacacatatatgtac

SEQ ID NO: 8504588 - DNA, 21 bp, Homo sapiens
tgtatacacacatatatgtac

SEQ ID NO: 8504589 - DNA, 22 bp, Homo sapiens
tgtatataagcatttacttgtt

SEQ ID NO: 8504590 - DNA, 22 bp, Homo sapiens
tgtatagagttggaagatgact

SEQ ID NO: 8504591 - DNA, 22 bp, Homo sapiens
tgtatacatttaactagataga

SEQ ID NO: 8504592 - DNA, 22 bp, Homo sapiens
tgtatacaggcataagagatac

SEQ ID NO: 8504593 - DNA, 22 bp, Homo sapiens
tgtatacatacatatgtgtgtg

SEQ ID NO: 8504594 - DNA, 22 bp, Homo sapiens
tgtatacatacatatgtgtgtg

SEQ ID NO: 8504595 - DNA, 22 bp, Homo sapiens
tgtatacatttaactagataga

SEQ ID NO: 8504596 - DNA, 22 bp, Homo sapiens
tgtatacatttaactagataga

SEQ ID NO: 8504597 - DNA, 22 bp, Homo sapiens
tgtatacattctcttgggtttg

SEQ ID NO: 8504598 - DNA, 22 bp, Homo sapiens
tgtatacatgtgttcatgcatg

SEQ ID NO: 8504599 - DNA, 22 bp, Homo sapiens
tgtatacatgtctgtgtgcaca

SEQ ID NO: 8504600 - DNA, 22 bp, Homo sapiens
tgtatcttcagtttgtctttcc

SEQ ID NO: 8504601 - DNA, 22 bp, Homo sapiens
tgtatctgtttagcacccagcc

SEQ ID NO: 8504602 - DNA, 22 bp, Homo sapiens
tgtatcttagtgtgaaaatatt

SEQ ID NO: 8504603 - DNA, 22 bp, Homo sapiens
tgtatctgtgatgtaggggttt

SEQ ID NO: 8504604 - DNA, 22 bp, Homo sapiens
tgtatctgtaatcccagatcaa

SEQ ID NO: 8504605 - DNA, 22 bp, Homo sapiens
tgtatgaggcatacatcaggca

SEQ ID NO: 8504606 - DNA, 22 bp, Homo sapiens
tgtatgaggcatacatcaggca

SEQ ID NO: 8504607 - DNA, 22 bp, Homo sapiens
tgtatgcaaatttattagcaca

SEQ ID NO: 8504608 - DNA, 22 bp, Homo sapiens
tgtatgaggcatacatcaggca

SEQ ID NO: 8504609 - DNA, 22 bp, Homo sapiens
tgtatatgagtctgagtgtaca

SEQ ID NO: 8504610 - DNA, 22 bp, Homo sapiens
tgtatatatttctttcattcta

SEQ ID NO: 8504611 - DNA, 22 bp, Homo sapiens
tgtatattcactgagcaagggg

SEQ ID NO: 8504612 - DNA, 22 bp, Homo sapiens
tgtatatgtgcacatgtgcttc

SEQ ID NO: 8504613 - DNA, 22 bp, Homo sapiens
tgtatattgcctgagtctttcc

SEQ ID NO: 8504614 - DNA, 22 bp, Homo sapiens
tgtatattctgcctaaaagctt

SEQ ID NO: 8504615 - DNA, 22 bp, Homo sapiens
tgtatattctgcctaaaagctt

SEQ ID NO: 8504616 - DNA, 22 bp, Homo sapiens
tgtatattctgcctaaaagctt

SEQ ID NO: 8504617 - DNA, 20 bp, Homo sapiens
tgtatattttctggtgtaaa

SEQ ID NO: 8504618 - DNA, 20 bp, Homo sapiens
tgtatattttctggtgtaaa

SEQ ID NO: 8504619 - DNA, 22 bp, Homo sapiens
tgtatattgttctgtctcttca

SEQ ID NO: 8504620 - DNA, 22 bp, Homo sapiens
tgtatcaagggtttatgtaagc

SEQ ID NO: 8504621 - DNA, 22 bp, Homo sapiens
tgtatcaagggtttatgtaagc

SEQ ID NO: 8504622 - DNA, 22 bp, Homo sapiens
tgtatcaaaccaaattaattct

SEQ ID NO: 8504623 - DNA, 22 bp, Homo sapiens
tgtatcaaaccaaattaattct

SEQ ID NO: 8504624 - DNA, 22 bp, Homo sapiens
tgtatcaaaccaaattaattct

SEQ ID NO: 8504625 - DNA, 22 bp, Homo sapiens
tgtacttgcttattagaaatct

SEQ ID NO: 8504626 - DNA, 22 bp, Homo sapiens
tgtagaaaattggagcattcat

SEQ ID NO: 8504627 - DNA, 22 bp, Homo sapiens
tgtagaaactacacatgcaaca

SEQ ID NO: 8504628 - DNA, 22 bp, Homo sapiens
tgtagaaagaatatgtttcata

SEQ ID NO: 8504629 - DNA, 22 bp, Homo sapiens
tgtacttgaacttgactgtaga

SEQ ID NO: 8504630 - DNA, 22 bp, Homo sapiens
tgtacttccccaatgacagcac

SEQ ID NO: 8504631 - DNA, 22 bp, Homo sapiens
tgtacttattttatgtcagcac

SEQ ID NO: 8504632 - DNA, 19 bp, Homo sapiens
tgtacgtgtgggtgtttaa

SEQ ID NO: 8504633 - DNA, 22 bp, Homo sapiens
tgtactcagctcagatctcagg

SEQ ID NO: 8504634 - DNA, 22 bp, Homo sapiens
tgtagaactgacattttggact

SEQ ID NO: 8504635 - DNA, 22 bp, Homo sapiens
tgtagaagctagcctggagcca

SEQ ID NO: 8504636 - DNA, 22 bp, Homo sapiens
tgtagaaggctatagactagga

SEQ ID NO: 8504637 - DNA, 22 bp, Homo sapiens
tgtagaagtaggagtcatctca

SEQ ID NO: 8504638 - DNA, 22 bp, Homo sapiens
tgtagaagttcttcaggagaat

SEQ ID NO: 8504639 - DNA, 22 bp, Homo sapiens
tgtagaaattagtaagatcaac

SEQ ID NO: 8504640 - DNA, 22 bp, Homo sapiens
tgtagaaattagtaagatcaac

SEQ ID NO: 8504641 - DNA, 22 bp, Homo sapiens
tgtagaaattagtaagatcaac

SEQ ID NO: 8504642 - DNA, 22 bp, Homo sapiens
tgtagaaattagtaagatcaac

SEQ ID NO: 8504643 - DNA, 22 bp, Homo sapiens
tgtagaaattagtaagatcaac

SEQ ID NO: 8504644 - DNA, 22 bp, Homo sapiens
tgtagaacctgtttattataga

SEQ ID NO: 8504645 - DNA, 22 bp, Homo sapiens
tgtagaaagctcttctgaaatc

SEQ ID NO: 8504646 - DNA, 22 bp, Homo sapiens
tgtagaaagaatatgtttcata

SEQ ID NO: 8504647 - DNA, 22 bp, Homo sapiens
tgtagaaagaatatgtttcata

SEQ ID NO: 8504648 - DNA, 22 bp, Homo sapiens
tgtagaaagaatatgtttcata

SEQ ID NO: 8504649 - DNA, 23 bp, Homo sapiens
tgtagcatctcttatttctcagc

SEQ ID NO: 8504650 - DNA, 22 bp, Homo sapiens
tgtagcatgtaaattggttatt

SEQ ID NO: 8504651 - DNA, 22 bp, Homo sapiens
tgtagcagtttttcattatcca

SEQ ID NO: 8504652 - DNA, 22 bp, Homo sapiens
tgtagctctccagccagcaagg

SEQ ID NO: 8504653 - DNA, 18 bp, Homo sapiens
tgtagctggaggccaggc

SEQ ID NO: 8504654 - DNA, 23 bp, Homo sapiens
tgtagctgtctgagcagacactg

SEQ ID NO: 8504655 - DNA, 22 bp, Homo sapiens
tgtagcttcagtctgatctcat

SEQ ID NO: 8504656 - DNA, 22 bp, Homo sapiens
tgtaggaaaaacaatgatctgc

SEQ ID NO: 8504657 - DNA, 22 bp, Homo sapiens
tgtagctttatattgtgttggg

SEQ ID NO: 8504658 - DNA, 22 bp, Homo sapiens
tgtaggaaaaacaatgatctgc

SEQ ID NO: 8504659 - DNA, 22 bp, Homo sapiens
tgtaggaaaaacaatgatctgc

SEQ ID NO: 8504660 - DNA, 22 bp, Homo sapiens
tgtaggaatggattctagaagg

SEQ ID NO: 8504661 - DNA, 22 bp, Homo sapiens
tgtaggaagatataaaatatct

SEQ ID NO: 8504662 - DNA, 22 bp, Homo sapiens
tgtagcacagagctttgacact

SEQ ID NO: 8504663 - DNA, 22 bp, Homo sapiens
tgtagcacgttagtgttagagc

SEQ ID NO: 8504664 - DNA, 19 bp, Homo sapiens
tgtagcagtttaaaacaac

SEQ ID NO: 8504665 - DNA, 22 bp, Homo sapiens
tgtagcagtgtctaccacatta

SEQ ID NO: 8504666 - DNA, 22 bp, Homo sapiens
tgtagatgagtcagggtgcatg

SEQ ID NO: 8504667 - DNA, 22 bp, Homo sapiens
tgtagatgagtcagggtgcacc

SEQ ID NO: 8504668 - DNA, 18 bp, Homo sapiens
tgtagagccaggtttgcc

SEQ ID NO: 8504669 - DNA, 18 bp, Homo sapiens
tgtagagccaggtttgcc

SEQ ID NO: 8504670 - DNA, 22 bp, Homo sapiens
tggtcaacaggcagggatgaaa

SEQ ID NO: 8504671 - DNA, 22 bp, Homo sapiens
tggtatttcagcttttgtatct

SEQ ID NO: 8504672 - DNA, 22 bp, Homo sapiens
tggtatgtaaattgtaactcaa

SEQ ID NO: 8504673 - DNA, 22 bp, Homo sapiens
tggtattacagcattccatatt

SEQ ID NO: 8504674 - DNA, 22 bp, Homo sapiens
tggtatttaagacttcactcct

SEQ ID NO: 8504675 - DNA, 22 bp, Homo sapiens
tggtattctttctgtagatcat

SEQ ID NO: 8504676 - DNA, 22 bp, Homo sapiens
tggtatcagagccatctgtatt

SEQ ID NO: 8504677 - DNA, 22 bp, Homo sapiens
tggtagtgactcccccagggct

SEQ ID NO: 8504678 - DNA, 19 bp, Homo sapiens
tgggttggaagggaatgaa

SEQ ID NO: 8504679 - DNA, 22 bp, Homo sapiens
tgggttctttcacttctcagtt

SEQ ID NO: 8504680 - DNA, 22 bp, Homo sapiens
tgggttctttcacttctcagtt

SEQ ID NO: 8504681 - DNA, 22 bp, Homo sapiens
tgggttcagatcccagctctgt

SEQ ID NO: 8504682 - DNA, 22 bp, Homo sapiens
tggtaaaaaccgcaattacatt

SEQ ID NO: 8504683 - DNA, 22 bp, Homo sapiens
tggtaaaaaccgcaattacatt

SEQ ID NO: 8504684 - DNA, 22 bp, Homo sapiens
tgggtttaaactcaactctaaa

SEQ ID NO: 8504685 - DNA, 22 bp, Homo sapiens
tggtaaggattgtagaaacgaa

SEQ ID NO: 8504686 - DNA, 22 bp, Homo sapiens
tggtaaggggtggaaccagagc

SEQ ID NO: 8504687 - DNA, 22 bp, Homo sapiens
tggtaaggtcttcactcagatt

SEQ ID NO: 8504688 - DNA, 22 bp, Homo sapiens
tggtaaaatattacaaggcact

SEQ ID NO: 8504689 - DNA, 22 bp, Homo sapiens
tggtaaaaactgcaattacttt

SEQ ID NO: 8504690 - DNA, 22 bp, Homo sapiens
tggtaaagaaggctagatctga

SEQ ID NO: 8504691 - DNA, 22 bp, Homo sapiens
tggtaaagaaatgtcagggcag

SEQ ID NO: 8504692 - DNA, 22 bp, Homo sapiens
tggtaaagaaatgtcagggcag

SEQ ID NO: 8504693 - DNA, 22 bp, Homo sapiens
tggtaaaaactgcaattacttt

SEQ ID NO: 8504694 - DNA, 22 bp, Homo sapiens
tggtaaagtggcttcacagtgt

SEQ ID NO: 8504695 - DNA, 22 bp, Homo sapiens
tggtaaagtgtactgaatatga

SEQ ID NO: 8504696 - DNA, 22 bp, Homo sapiens
tggtaaagtggcttcacagtgt

SEQ ID NO: 8504697 - DNA, 22 bp, Homo sapiens
tggtaaagttgattggtgctct

SEQ ID NO: 8504698 - DNA, 22 bp, Homo sapiens
tggtaaatatgtccattctctt

SEQ ID NO: 8504699 - DNA, 16 bp, Homo sapiens
tgggtgggaggagcgg

SEQ ID NO: 8504700 - DNA, 16 bp, Homo sapiens
tgggtgggaggagcgg

SEQ ID NO: 8504701 - DNA, 16 bp, Homo sapiens
tgggtgggaggagcgg

SEQ ID NO: 8504702 - DNA, 22 bp, Homo sapiens
tgggtgggagcgccctgtctgg

SEQ ID NO: 8504703 - DNA, 22 bp, Homo sapiens
tgggtgggagcgccctgtctgg

SEQ ID NO: 8504704 - DNA, 22 bp, Homo sapiens
tgggtgggagcgccctgtctgg

SEQ ID NO: 8504705 - DNA, 22 bp, Homo sapiens
tgggtgggagcgccctgtctgg

SEQ ID NO: 8504706 - DNA, 22 bp, Homo sapiens
tgggtgggagcgccctgtctgg

SEQ ID NO: 8504707 - DNA, 22 bp, Homo sapiens
tgggtgggagcgccctgtctgg

SEQ ID NO: 8504708 - DNA, 21 bp, Homo sapiens
tgggtgggcagagtctcttca

SEQ ID NO: 8504709 - DNA, 21 bp, Homo sapiens
tgggtgggcagagtctcttca

SEQ ID NO: 8504710 - DNA, 21 bp, Homo sapiens
tgggtgggcagagtctcttca

SEQ ID NO: 8504711 - DNA, 21 bp, Homo sapiens
tgggtgggcagagtctcttca

SEQ ID NO: 8504712 - DNA, 17 bp, Homo sapiens
tgggtggtagggagagg

SEQ ID NO: 8504713 - DNA, 17 bp, Homo sapiens
tgggtggtagggagagg

SEQ ID NO: 8504714 - DNA, 22 bp, Homo sapiens
tgggttaaaatgataccttgca

SEQ ID NO: 8504715 - DNA, 22 bp, Homo sapiens
tgggttaaaagttgaatgaatt

SEQ ID NO: 8504716 - DNA, 22 bp, Homo sapiens
tgggttaaaagttgaatgaatt

SEQ ID NO: 8504717 - DNA, 22 bp, Homo sapiens
tgggttaatagaatcattaact

SEQ ID NO: 8504718 - DNA, 22 bp, Homo sapiens
tgggttaatagaatcattaact

SEQ ID NO: 8504719 - DNA, 22 bp, Homo sapiens
tgggttaagcctcattcatagc

SEQ ID NO: 8504720 - DNA, 22 bp, Homo sapiens
tgggttaagcctcattcatagc

SEQ ID NO: 8504721 - DNA, 22 bp, Homo sapiens
tgggttaacagtttataccaga

SEQ ID NO: 8504722 - DNA, 22 bp, Homo sapiens
tgggttaacagtttataccaga

SEQ ID NO: 8504723 - DNA, 22 bp, Homo sapiens
tgggtgtgcccagatggtgtcc

SEQ ID NO: 8504724 - DNA, 22 bp, Homo sapiens
tgggtgtgaagtctgttggcct

SEQ ID NO: 8504725 - DNA, 19 bp, Homo sapiens
tgggtgtgaccatctctgc

SEQ ID NO: 8504726 - DNA, 22 bp, Homo sapiens
tgggtgtgcccagatggtgtcc

SEQ ID NO: 8504727 - DNA, 22 bp, Homo sapiens
tgggtgtgccatattccatttc

SEQ ID NO: 8504728 - DNA, 22 bp, Homo sapiens
tgggtgtgaagtctgttggcct

SEQ ID NO: 8504729 - DNA, 22 bp, Homo sapiens
tgggtggtttatgagtgggttt

SEQ ID NO: 8504730 - DNA, 22 bp, Homo sapiens
tgggtggttgctgaggctcctt

SEQ ID NO: 8504731 - DNA, 22 bp, Homo sapiens
tgggtggttgctgaggctcctt

SEQ ID NO: 8504732 - DNA, 22 bp, Homo sapiens
tgggtggtccaggctcagcaga

SEQ ID NO: 8504733 - DNA, 22 bp, Homo sapiens
tgggtgctctgcgaccgtaggg

SEQ ID NO: 8504734 - DNA, 22 bp, Homo sapiens
tgggtgcttcgtcagctctgag

SEQ ID NO: 8504735 - DNA, 21 bp, Homo sapiens
tgggtggaagcgggaggccgc

SEQ ID NO: 8504736 - DNA, 21 bp, Homo sapiens
tgggtggaagcgggaggccgc

SEQ ID NO: 8504737 - DNA, 22 bp, Homo sapiens
tgggtgggagcgccctgtctgg

SEQ ID NO: 8504738 - DNA, 22 bp, Homo sapiens
tgggtggaataaatcagttctg

SEQ ID NO: 8504739 - DNA, 22 bp, Homo sapiens
tgggtgccaacctctggtggcc

SEQ ID NO: 8504740 - DNA, 22 bp, Homo sapiens
tgggtgctctgcgaccgtaggg

SEQ ID NO: 8504741 - DNA, 22 bp, Homo sapiens
tgggtgcaggatgagtgctggc

SEQ ID NO: 8504742 - DNA, 22 bp, Homo sapiens
tgggtgagtgggaaaagcccag

SEQ ID NO: 8504743 - DNA, 22 bp, Homo sapiens
tgggtgcaggatgagtgctggc

SEQ ID NO: 8504744 - DNA, 22 bp, Homo sapiens
tgggtgaggagaggctgtctaa

SEQ ID NO: 8504745 - DNA, 22 bp, Homo sapiens
tgggtgaggagaggctgtctaa

SEQ ID NO: 8504746 - DNA, 22 bp, Homo sapiens
tgggtgagccacaggagttgtc

SEQ ID NO: 8504747 - DNA, 22 bp, Homo sapiens
tgggtgagccacaggagttgtc

SEQ ID NO: 8504748 - DNA, 22 bp, Homo sapiens
tgggtgaggatgatgaggcagc

SEQ ID NO: 8504749 - DNA, 22 bp, Homo sapiens
tgggtgaggatgatgaggcagc

SEQ ID NO: 8504750 - DNA, 22 bp, Homo sapiens
tgggtgagtggagggcattcta

SEQ ID NO: 8504751 - DNA, 22 bp, Homo sapiens
tggggtggtaatacaccgttct

SEQ ID NO: 8504752 - DNA, 22 bp, Homo sapiens
tggggtggggttactcattctg

SEQ ID NO: 8504753 - DNA, 22 bp, Homo sapiens
tggggtggggttactcattctg

SEQ ID NO: 8504754 - DNA, 22 bp, Homo sapiens
tggggtggggttactcattctg

SEQ ID NO: 8504755 - DNA, 22 bp, Homo sapiens
tggggtgggcatgcgctgtcct

SEQ ID NO: 8504756 - DNA, 22 bp, Homo sapiens
tggggtgggcatgcgctgtcct

SEQ ID NO: 8504757 - DNA, 22 bp, Homo sapiens
tggggtgggcatgcgctgtcct

SEQ ID NO: 8504758 - DNA, 22 bp, Homo sapiens
tggggtggatagaaagtgatgt

SEQ ID NO: 8504759 - DNA, 22 bp, Homo sapiens
tggggtggatagaaagtgatgt

SEQ ID NO: 8504760 - DNA, 22 bp, Homo sapiens
tggggtggaacccttctgctgg

SEQ ID NO: 8504761 - DNA, 22 bp, Homo sapiens
tggggtggaacccttctgctgg

SEQ ID NO: 8504762 - DNA, 22 bp, Homo sapiens
tggggtggaacccttctgctgg

SEQ ID NO: 8504763 - DNA, 22 bp, Homo sapiens
tggggtggaacccttctgctgg

SEQ ID NO: 8504764 - DNA, 22 bp, Homo sapiens
tggggtgccgacagggagggca

SEQ ID NO: 8504765 - DNA, 22 bp, Homo sapiens
tggggtgccgacagggagggca

SEQ ID NO: 8504766 - DNA, 22 bp, Homo sapiens
tggggtctggagttgcccatga

SEQ ID NO: 8504767 - DNA, 22 bp, Homo sapiens
tggggtctgagtatctgcattt

SEQ ID NO: 8504768 - DNA, 18 bp, Homo sapiens
tggggtctctcaggtaag

SEQ ID NO: 8504769 - DNA, 20 bp, Homo sapiens
tggggtctagttggcctggg

SEQ ID NO: 8504770 - DNA, 22 bp, Homo sapiens
tgggggtgctgagaagacagga

SEQ ID NO: 8504771 - DNA, 21 bp, Homo sapiens
tgggggtgaggcctaggaatc

SEQ ID NO: 8504772 - DNA, 21 bp, Homo sapiens
tgggggtgaggcctaggaatc

SEQ ID NO: 8504773 - DNA, 23 bp, Homo sapiens
tgggggtgcacgggccacatctt

SEQ ID NO: 8504774 - DNA, 23 bp, Homo sapiens
tgggggtgcacgggccacatctt

SEQ ID NO: 8504775 - DNA, 22 bp, Homo sapiens
tgggggtgccctatgaggaagc

SEQ ID NO: 8504776 - DNA, 22 bp, Homo sapiens
tgggggtgccctatgaggaagc

SEQ ID NO: 8504777 - DNA, 22 bp, Homo sapiens
tgggggtgccctatgaggaagc

SEQ ID NO: 8504778 - DNA, 22 bp, Homo sapiens
tgggggtgaaagtctggacagt

SEQ ID NO: 8504779 - DNA, 22 bp, Homo sapiens
tgggggtgaaagtctggacagt

SEQ ID NO: 8504780 - DNA, 22 bp, Homo sapiens
tgggggtcctcctctgcttaag

SEQ ID NO: 8504781 - DNA, 22 bp, Homo sapiens
tgggggtgactatctcgggaat

SEQ ID NO: 8504782 - DNA, 22 bp, Homo sapiens
tgggggtgactatctcgggaat

SEQ ID NO: 8504783 - DNA, 22 bp, Homo sapiens
tgggggtgaaagtctggacagt

SEQ ID NO: 8504784 - DNA, 22 bp, Homo sapiens
tggggggcacttcagcacaatg

SEQ ID NO: 8504785 - DNA, 22 bp, Homo sapiens
tggggggcacttcagcacaatg

SEQ ID NO: 8504786 - DNA, 22 bp, Homo sapiens
tgggtccatggaacagaggtgc

SEQ ID NO: 8504787 - DNA, 22 bp, Homo sapiens
tgggtccatggaacagaggtgc

SEQ ID NO: 8504788 - DNA, 22 bp, Homo sapiens
tgggtctgtagggctgtccaat

SEQ ID NO: 8504789 - DNA, 22 bp, Homo sapiens
tgggtgaaaattttggtggcac

SEQ ID NO: 8504790 - DNA, 20 bp, Homo sapiens
tgggtctgcttggcttcagt

SEQ ID NO: 8504791 - DNA, 23 bp, Homo sapiens
tgggtctctagtacaggcaggca

SEQ ID NO: 8504792 - DNA, 22 bp, Homo sapiens
tgggtctcctgtgcctgggagg

SEQ ID NO: 8504793 - DNA, 22 bp, Homo sapiens
tgggtagagtgctgacaatgcc

SEQ ID NO: 8504794 - DNA, 22 bp, Homo sapiens
tgggtaggaccagaaatgcact

SEQ ID NO: 8504795 - DNA, 22 bp, Homo sapiens
tgggtccacttctgcactgtgg

SEQ ID NO: 8504796 - DNA, 22 bp, Homo sapiens
tgggtccacggaagacttaggg

SEQ ID NO: 8504797 - DNA, 22 bp, Homo sapiens
tgggtccagtgcagctgcgcgt

SEQ ID NO: 8504798 - DNA, 22 bp, Homo sapiens
tgggtccacttctgcactgtgg

SEQ ID NO: 8504799 - DNA, 22 bp, Homo sapiens
tgggtccagtgtcctggctatg

SEQ ID NO: 8504800 - DNA, 22 bp, Homo sapiens
tgggtccagtgcagctgcgcgt

SEQ ID NO: 8504801 - DNA, 22 bp, Homo sapiens
tgggtccacggaagacttaggg

SEQ ID NO: 8504802 - DNA, 22 bp, Homo sapiens
tgggtaggggacgtggaagaaa

SEQ ID NO: 8504803 - DNA, 22 bp, Homo sapiens
tgggtaggggacgtggaagaaa

SEQ ID NO: 8504804 - DNA, 22 bp, Homo sapiens
tgggtaggggacgtggaagaaa

SEQ ID NO: 8504805 - DNA, 22 bp, Homo sapiens
tggggttctttgtttcctgcct

SEQ ID NO: 8504806 - DNA, 23 bp, Homo sapiens
tggggttgaattgtagctgtgcc

SEQ ID NO: 8504807 - DNA, 22 bp, Homo sapiens
tgggtaaactgggtctggagag

SEQ ID NO: 8504808 - DNA, 22 bp, Homo sapiens
tgggtaaaatgagttaggagaa

SEQ ID NO: 8504809 - DNA, 22 bp, Homo sapiens
tgggtaaacaatgtttgcctaa

SEQ ID NO: 8504810 - DNA, 22 bp, Homo sapiens
tgggtaaatatcctttgtgaaa

SEQ ID NO: 8504811 - DNA, 22 bp, Homo sapiens
tgggtaggaatcgagtgtatgg

SEQ ID NO: 8504812 - DNA, 22 bp, Homo sapiens
tgggtagaggaattgggctacc

SEQ ID NO: 8504813 - DNA, 23 bp, Homo sapiens
tgggtagagctgcaaggacactg

SEQ ID NO: 8504814 - DNA, 22 bp, Homo sapiens
tgggtagagcaggctggggctt

SEQ ID NO: 8504815 - DNA, 22 bp, Homo sapiens
tgggtagagacacagtctgggg

SEQ ID NO: 8504816 - DNA, 22 bp, Homo sapiens
tgggtagagacacagtctgggg

SEQ ID NO: 8504817 - DNA, 22 bp, Homo sapiens
tgggtagacattcctgaaactc

SEQ ID NO: 8504818 - DNA, 20 bp, Homo sapiens
tggggcctgtttctgtggtt

SEQ ID NO: 8504819 - DNA, 20 bp, Homo sapiens
tggggcctgtttctgtggtt

SEQ ID NO: 8504820 - DNA, 20 bp, Homo sapiens
tggggcctgtttctgtggtt

SEQ ID NO: 8504821 - DNA, 22 bp, Homo sapiens
tggggccttggcctcattagat

SEQ ID NO: 8504822 - DNA, 22 bp, Homo sapiens
tggggctaacgagagagcagag

SEQ ID NO: 8504823 - DNA, 22 bp, Homo sapiens
tggggctaaacacgcctggcct

SEQ ID NO: 8504824 - DNA, 22 bp, Homo sapiens
tggggctaaacacgcctggcct

SEQ ID NO: 8504825 - DNA, 22 bp, Homo sapiens
tggggctcacctaggctggaag

SEQ ID NO: 8504826 - DNA, 22 bp, Homo sapiens
tggggcctggtcagagctgcac

SEQ ID NO: 8504827 - DNA, 22 bp, Homo sapiens
tggggcctggtcagagctgcac

SEQ ID NO: 8504828 - DNA, 22 bp, Homo sapiens
tggggcctgtgacgggtccaga

SEQ ID NO: 8504829 - DNA, 22 bp, Homo sapiens
tggggcctgtgacgggtccaga

SEQ ID NO: 8504830 - DNA, 22 bp, Homo sapiens
tggggcctgaggtggagctgca

SEQ ID NO: 8504831 - DNA, 22 bp, Homo sapiens
tggggcctgaggtggagctgca

SEQ ID NO: 8504832 - DNA, 22 bp, Homo sapiens
tggggcctgaggtggagctgca

SEQ ID NO: 8504833 - DNA, 22 bp, Homo sapiens
tggggcctgcacaggctgaatg

SEQ ID NO: 8504834 - DNA, 22 bp, Homo sapiens
tggggcctgaggtggagctgca

SEQ ID NO: 8504835 - DNA, 22 bp, Homo sapiens
tggggcctgaggtggagctgca

SEQ ID NO: 8504836 - DNA, 22 bp, Homo sapiens
tggggctcctcctggcaggagg

SEQ ID NO: 8504837 - DNA, 22 bp, Homo sapiens
tggggctcctcctggcaggagg

SEQ ID NO: 8504838 - DNA, 22 bp, Homo sapiens
tggggctcatgcctgctggaac

SEQ ID NO: 8504839 - DNA, 23 bp, Homo sapiens
tggggctctggcaggcctgaggt

SEQ ID NO: 8504840 - DNA, 22 bp, Homo sapiens
tggggctctccacagtgtctca

SEQ ID NO: 8504841 - DNA, 22 bp, Homo sapiens
tggggctgaggagcctcactct

SEQ ID NO: 8504842 - DNA, 23 bp, Homo sapiens
tggggctgatggagacggaccag

SEQ ID NO: 8504843 - DNA, 22 bp, Homo sapiens
tggggctggcacagtctctatt

SEQ ID NO: 8504844 - DNA, 19 bp, Homo sapiens
tggggcctcctgtccctgg

SEQ ID NO: 8504845 - DNA, 19 bp, Homo sapiens
tggggcctcctgtccctgg

SEQ ID NO: 8504846 - DNA, 22 bp, Homo sapiens
tggggccatctcacccactgtt

SEQ ID NO: 8504847 - DNA, 22 bp, Homo sapiens
tggggccaggtggctgcaggtc

SEQ ID NO: 8504848 - DNA, 22 bp, Homo sapiens
tggggcagcagacctttcttgg

SEQ ID NO: 8504849 - DNA, 22 bp, Homo sapiens
tggggcagagtaggattttggc

SEQ ID NO: 8504850 - DNA, 22 bp, Homo sapiens
tggggcagagtaggattttggc

SEQ ID NO: 8504851 - DNA, 22 bp, Homo sapiens
tggggcaagaagtgccctgaag

SEQ ID NO: 8504852 - DNA, 22 bp, Homo sapiens
tggggcacttatgatgtgccac

SEQ ID NO: 8504853 - DNA, 22 bp, Homo sapiens
tggggccacagcctcctagctt

SEQ ID NO: 8504854 - DNA, 22 bp, Homo sapiens
tggggcagcagacctttcttgg

SEQ ID NO: 8504855 - DNA, 22 bp, Homo sapiens
tgggggctccaggctccaggga

SEQ ID NO: 8504856 - DNA, 17 bp, Homo sapiens
tgggggcgccagggtct

SEQ ID NO: 8504857 - DNA, 22 bp, Homo sapiens
tgggggctccaggctccaggga

SEQ ID NO: 8504858 - DNA, 22 bp, Homo sapiens
tgggggcagaggattcaggaat

SEQ ID NO: 8504859 - DNA, 22 bp, Homo sapiens
tgggggcagaggattcaggaat

SEQ ID NO: 8504860 - DNA, 22 bp, Homo sapiens
tgggggcacttcgaggtcgcct

SEQ ID NO: 8504861 - DNA, 22 bp, Homo sapiens
tgggggcagccaggctgtcaag

SEQ ID NO: 8504862 - DNA, 22 bp, Homo sapiens
tgggggcatggaccagcctggc

SEQ ID NO: 8504863 - DNA, 22 bp, Homo sapiens
tgggggagtatagtctggcctc

SEQ ID NO: 8504864 - DNA, 22 bp, Homo sapiens
tgggggattgttttaatgaata

SEQ ID NO: 8504865 - DNA, 22 bp, Homo sapiens
tgggggagtatagtctggcctc

SEQ ID NO: 8504866 - DNA, 22 bp, Homo sapiens
tgggggcacttcgaggtcgcct

SEQ ID NO: 8504867 - DNA, 22 bp, Homo sapiens
tgggggagccttcacagtagct

SEQ ID NO: 8504868 - DNA, 22 bp, Homo sapiens
tgggggagccttcacagtagct

SEQ ID NO: 8504869 - DNA, 22 bp, Homo sapiens
tgggggagattgtgcatctcta

SEQ ID NO: 8504870 - DNA, 22 bp, Homo sapiens
tgggggagattgtgcatctcta

SEQ ID NO: 8504871 - DNA, 22 bp, Homo sapiens
tgggggagattagagcttctta

SEQ ID NO: 8504872 - DNA, 22 bp, Homo sapiens
tgggggagattagagcttctta

SEQ ID NO: 8504873 - DNA, 22 bp, Homo sapiens
tggggctgtccttagtctgaga

SEQ ID NO: 8504874 - DNA, 22 bp, Homo sapiens
tggggctgtccttagtctgaga

SEQ ID NO: 8504875 - DNA, 22 bp, Homo sapiens
tgggggagagtgcaagcatgaa

SEQ ID NO: 8504876 - DNA, 22 bp, Homo sapiens
tgggggagagtttagatgattt

SEQ ID NO: 8504877 - DNA, 22 bp, Homo sapiens
tgggggagagtttagatgattt

SEQ ID NO: 8504878 - DNA, 22 bp, Homo sapiens
tggggctggcacagtctctatt

SEQ ID NO: 8504879 - DNA, 22 bp, Homo sapiens
tggggctggcacagtctctatt

SEQ ID NO: 8504880 - DNA, 22 bp, Homo sapiens
tggggctggcacagtctctatt

SEQ ID NO: 8504881 - DNA, 22 bp, Homo sapiens
tggggctggcacagtctctatt

SEQ ID NO: 8504882 - DNA, 22 bp, Homo sapiens
tggggctggctattgtctccct

SEQ ID NO: 8504883 - DNA, 22 bp, Homo sapiens
tggggctggctattgtctccct

SEQ ID NO: 8504884 - DNA, 22 bp, Homo sapiens
tggggctggctattgtctccct

SEQ ID NO: 8504885 - DNA, 22 bp, Homo sapiens
tggggctggctattgtctccct

SEQ ID NO: 8504886 - DNA, 22 bp, Homo sapiens
tggggctggctattgtctccct

SEQ ID NO: 8504887 - DNA, 22 bp, Homo sapiens
tggggctgtcccggtttggcga

SEQ ID NO: 8504888 - DNA, 22 bp, Homo sapiens
tggggctggggatcttgagcct

SEQ ID NO: 8504889 - DNA, 22 bp, Homo sapiens
tggggctggggatcttgagcct

SEQ ID NO: 8504890 - DNA, 22 bp, Homo sapiens
tggggctggggatcttgagcct

SEQ ID NO: 8504891 - DNA, 22 bp, Homo sapiens
tggggctggggatcttgagcct

SEQ ID NO: 8504892 - DNA, 23 bp, Homo sapiens
tggggagggaagtcatttctgta

SEQ ID NO: 8504893 - DNA, 22 bp, Homo sapiens
tggggaggatatgtgagttatt

SEQ ID NO: 8504894 - DNA, 22 bp, Homo sapiens
tggggaggatatgtgagttatt

SEQ ID NO: 8504895 - DNA, 23 bp, Homo sapiens
tggggagggaagtcatttctgta

SEQ ID NO: 8504896 - DNA, 23 bp, Homo sapiens
tggggagggaagtcatttctgta

SEQ ID NO: 8504897 - DNA, 23 bp, Homo sapiens
tggggagggaagtcatttctgta

SEQ ID NO: 8504898 - DNA, 22 bp, Homo sapiens
tggggaggatatgtgagttatt

SEQ ID NO: 8504899 - DNA, 22 bp, Homo sapiens
tggggaggatatgtgagttatt

SEQ ID NO: 8504900 - DNA, 22 bp, Homo sapiens
tggggaggacgggcgccttcct

SEQ ID NO: 8504901 - DNA, 22 bp, Homo sapiens
tggggaggacgggcgccttcct

SEQ ID NO: 8504902 - DNA, 22 bp, Homo sapiens
tggggaggacgggcgccttcct

SEQ ID NO: 8504903 - DNA, 22 bp, Homo sapiens
tggggaggaagtcagatttcag

SEQ ID NO: 8504904 - DNA, 22 bp, Homo sapiens
tggggaggaagtcagatttcag

SEQ ID NO: 8504905 - DNA, 22 bp, Homo sapiens
tggggactgacagccaggcctc

SEQ ID NO: 8504906 - DNA, 22 bp, Homo sapiens
tggggaggaagtcagatttcag

SEQ ID NO: 8504907 - DNA, 22 bp, Homo sapiens
tggggacattcatgcaggttgt

SEQ ID NO: 8504908 - DNA, 22 bp, Homo sapiens
tggggacatagccagtctggct

SEQ ID NO: 8504909 - DNA, 22 bp, Homo sapiens
tggggacatagccagtctggct

SEQ ID NO: 8504910 - DNA, 22 bp, Homo sapiens
tggggacagggctcagcaattt

SEQ ID NO: 8504911 - DNA, 22 bp, Homo sapiens
tggggacaggagacttacagct

SEQ ID NO: 8504912 - DNA, 22 bp, Homo sapiens
tggggacaggagacttacagct

SEQ ID NO: 8504913 - DNA, 22 bp, Homo sapiens
tggggaggttcgggaatcttgt

SEQ ID NO: 8504914 - DNA, 22 bp, Homo sapiens
tggggaggttcgggaatcttgt

SEQ ID NO: 8504915 - DNA, 22 bp, Homo sapiens
tggggagtgatgcctcggataa

SEQ ID NO: 8504916 - DNA, 22 bp, Homo sapiens
tggggaggttcgggaatcttgt

SEQ ID NO: 8504917 - DNA, 22 bp, Homo sapiens
tggggaggttcgggaatcttgt

SEQ ID NO: 8504918 - DNA, 21 bp, Homo sapiens
tggggaggggacctgattatg

SEQ ID NO: 8504919 - DNA, 22 bp, Homo sapiens
tggggaggtaacaatttcaggc

SEQ ID NO: 8504920 - DNA, 21 bp, Homo sapiens
tggggaggggacctgattatg

SEQ ID NO: 8504921 - DNA, 22 bp, Homo sapiens
tggggaggtaacaatttcaggc

SEQ ID NO: 8504922 - DNA, 22 bp, Homo sapiens
tggggaggtaacaatttcaggc

SEQ ID NO: 8504923 - DNA, 22 bp, Homo sapiens
tggggagtgatgcctcggataa

SEQ ID NO: 8504924 - DNA, 20 bp, Homo sapiens
tggggagttgagcacgagca

SEQ ID NO: 8504925 - DNA, 22 bp, Homo sapiens
tggggatcataaattgatggag

SEQ ID NO: 8504926 - DNA, 22 bp, Homo sapiens
tggggatgtaaatgaggtgata

SEQ ID NO: 8504927 - DNA, 22 bp, Homo sapiens
tggggatgtaaatgaggtgata

SEQ ID NO: 8504928 - DNA, 17 bp, Homo sapiens
tggggatggttcatgag

SEQ ID NO: 8504929 - DNA, 22 bp, Homo sapiens
tggggaaggcggagcttgcagc

SEQ ID NO: 8504930 - DNA, 22 bp, Homo sapiens
tggggaaggcggagcttgcagc

SEQ ID NO: 8504931 - DNA, 16 bp, Homo sapiens
tggggaagctcgtgag

SEQ ID NO: 8504932 - DNA, 16 bp, Homo sapiens
tggggaagctcgtgag

SEQ ID NO: 8504933 - DNA, 22 bp, Homo sapiens
tggggaaggatcaccacaatct

SEQ ID NO: 8504934 - DNA, 17 bp, Homo sapiens
tggggaagctcagattt

SEQ ID NO: 8504935 - DNA, 22 bp, Homo sapiens
tggggacaggagacttacagct

SEQ ID NO: 8504936 - DNA, 22 bp, Homo sapiens
tggggacacagaggttcgttgg

SEQ ID NO: 8504937 - DNA, 22 bp, Homo sapiens
tggggacacagaggttcgttgg

SEQ ID NO: 8504938 - DNA, 22 bp, Homo sapiens
tggggacacagagccaaactat

SEQ ID NO: 8504939 - DNA, 22 bp, Homo sapiens
tggggaagggcaccctggagac

SEQ ID NO: 8504940 - DNA, 22 bp, Homo sapiens
tggggaagggcaccctggagac

SEQ ID NO: 8504941 - DNA, 22 bp, Homo sapiens
tggggaagggcaccctggagac

SEQ ID NO: 8504942 - DNA, 22 bp, Homo sapiens
tggggaagacagcagacactgt

SEQ ID NO: 8504943 - DNA, 22 bp, Homo sapiens
tggggaagcactttgaacttaa

SEQ ID NO: 8504944 - DNA, 22 bp, Homo sapiens
tggggaagaataatgtatgtac

SEQ ID NO: 8504945 - DNA, 22 bp, Homo sapiens
tggggaagaataatgtatgtac

SEQ ID NO: 8504946 - DNA, 22 bp, Homo sapiens
tggggaagacagcagacactgt

SEQ ID NO: 8504947 - DNA, 22 bp, Homo sapiens
tgggctgtggagcacctttgca

SEQ ID NO: 8504948 - DNA, 22 bp, Homo sapiens
tgggcttaggtcggaggcggcc

SEQ ID NO: 8504949 - DNA, 22 bp, Homo sapiens
tgggcttcctggagcctgtgct

SEQ ID NO: 8504950 - DNA, 19 bp, Homo sapiens
tgggcttccccagggcaga

SEQ ID NO: 8504951 - DNA, 22 bp, Homo sapiens
tgggcttaggtcggaggcggcc

SEQ ID NO: 8504952 - DNA, 22 bp, Homo sapiens
tgggctggcccaccacacctcg

SEQ ID NO: 8504953 - DNA, 22 bp, Homo sapiens
tgggctggcgtggagagtttag

SEQ ID NO: 8504954 - DNA, 22 bp, Homo sapiens
tgggctggctgaacttcaacct

SEQ ID NO: 8504955 - DNA, 22 bp, Homo sapiens
tgggctggctgaacttcaacct

SEQ ID NO: 8504956 - DNA, 22 bp, Homo sapiens
tgggctggctgaggcattcact

SEQ ID NO: 8504957 - DNA, 22 bp, Homo sapiens
tgggctgtccagcacctgggct

SEQ ID NO: 8504958 - DNA, 22 bp, Homo sapiens
tgggctggtgagggatcattta

SEQ ID NO: 8504959 - DNA, 22 bp, Homo sapiens
tgggctggtgagggatcattta

SEQ ID NO: 8504960 - DNA, 22 bp, Homo sapiens
tgggctggctgaacttcaacct

SEQ ID NO: 8504961 - DNA, 22 bp, Homo sapiens
tgggctggctgaggcattcact

SEQ ID NO: 8504962 - DNA, 22 bp, Homo sapiens
tgggctggctgaggcattcact

SEQ ID NO: 8504963 - DNA, 22 bp, Homo sapiens
tgggctggctgaggcattcact

SEQ ID NO: 8504964 - DNA, 22 bp, Homo sapiens
tgggcagagtcatacaggagac

SEQ ID NO: 8504965 - DNA, 22 bp, Homo sapiens
tgggcagagtcatacaggagac

SEQ ID NO: 8504966 - DNA, 22 bp, Homo sapiens
tgggcagagtcatacaggagac

SEQ ID NO: 8504967 - DNA, 22 bp, Homo sapiens
tgggcagagtcgtggggaatag

SEQ ID NO: 8504968 - DNA, 22 bp, Homo sapiens
tgggcagagtcatacaggagac

SEQ ID NO: 8504969 - DNA, 22 bp, Homo sapiens
tgggcagagtcgtggggaatag

SEQ ID NO: 8504970 - DNA, 22 bp, Homo sapiens
tgggcagaggctctgaagtcca

SEQ ID NO: 8504971 - DNA, 22 bp, Homo sapiens
tgggcagaggctctgaagtcca

SEQ ID NO: 8504972 - DNA, 22 bp, Homo sapiens
tgggcagagtagctcagaagaa

SEQ ID NO: 8504973 - DNA, 22 bp, Homo sapiens
tgggcagaggcagcagaaacct

SEQ ID NO: 8504974 - DNA, 22 bp, Homo sapiens
tgggcagaggacagggaagatc

SEQ ID NO: 8504975 - DNA, 22 bp, Homo sapiens
tgggcagaggacagggaagatc

SEQ ID NO: 8504976 - DNA, 22 bp, Homo sapiens
tgggcagagagtagaggcaacg

SEQ ID NO: 8504977 - DNA, 22 bp, Homo sapiens
tgggcagagatctggatcaaac

SEQ ID NO: 8504978 - DNA, 22 bp, Homo sapiens
tgggcagagatctggatcaaac

SEQ ID NO: 8504979 - DNA, 22 bp, Homo sapiens
tgggcagaggacagggaagatc

SEQ ID NO: 8504980 - DNA, 22 bp, Homo sapiens
tgggcacaggggaatggatgaa

SEQ ID NO: 8504981 - DNA, 20 bp, Homo sapiens
tgggcaccagatgggatgcc

SEQ ID NO: 8504982 - DNA, 22 bp, Homo sapiens
tgggcacctagcaacccttctc

SEQ ID NO: 8504983 - DNA, 21 bp, Homo sapiens
tgggcaccaaaacctaggagt

SEQ ID NO: 8504984 - DNA, 22 bp, Homo sapiens
tgggcacatagttttatggtca

SEQ ID NO: 8504985 - DNA, 22 bp, Homo sapiens
tgggcacctgaggcctggcagg

SEQ ID NO: 8504986 - DNA, 22 bp, Homo sapiens
tgggcactatggctctgtgcac

SEQ ID NO: 8504987 - DNA, 22 bp, Homo sapiens
tgggcagactgagccctgtccc

SEQ ID NO: 8504988 - DNA, 22 bp, Homo sapiens
tgggcagagagtagaggcaacg

SEQ ID NO: 8504989 - DNA, 22 bp, Homo sapiens
tgggcagagagtagaggcaacg

SEQ ID NO: 8504990 - DNA, 22 bp, Homo sapiens
tgggcagagagtagaggcaacg

SEQ ID NO: 8504991 - DNA, 18 bp, Homo sapiens
tgggcacaatgaacagca

SEQ ID NO: 8504992 - DNA, 22 bp, Homo sapiens
tgggcacagaatagatggccca

SEQ ID NO: 8504993 - DNA, 22 bp, Homo sapiens
tgggcacaaacatctgcctgtt

SEQ ID NO: 8504994 - DNA, 22 bp, Homo sapiens
tgggcacaaacatctgcctgtt

SEQ ID NO: 8504995 - DNA, 22 bp, Homo sapiens
tgggcacagagtcccatctgcc

SEQ ID NO: 8504996 - DNA, 22 bp, Homo sapiens
tgggcacagaatagatggccca

SEQ ID NO: 8504997 - DNA, 22 bp, Homo sapiens
tgggcacagagtcccatctgcc

SEQ ID NO: 8504998 - DNA, 22 bp, Homo sapiens
tgggcacagagtcccatctgcc

SEQ ID NO: 8504999 - DNA, 22 bp, Homo sapiens
tgggcacagagtcccatctgcc

SEQ ID NO: 8505000 - DNA, 22 bp, Homo sapiens
tgggcaagtcacttctgtcttt

SEQ ID NO: 8505001 - DNA, 21 bp, Homo sapiens
tgggcaagtttgggggtcctc

SEQ ID NO: 8505002 - DNA, 22 bp, Homo sapiens
tgggcaagtatcggactctgag

SEQ ID NO: 8505003 - DNA, 22 bp, Homo sapiens
tgggcaagtatcggactctgag

SEQ ID NO: 8505004 - DNA, 22 bp, Homo sapiens
tgggcaagctctgggtggacac

SEQ ID NO: 8505005 - DNA, 22 bp, Homo sapiens
tgggatgtggccatggttctct

SEQ ID NO: 8505006 - DNA, 22 bp, Homo sapiens
tgggattcaccatgggcttcag

SEQ ID NO: 8505007 - DNA, 22 bp, Homo sapiens
tgggattcaccatgggcttcag

SEQ ID NO: 8505008 - DNA, 22 bp, Homo sapiens
tgggattcaccatgggcttcag

SEQ ID NO: 8505009 - DNA, 20 bp, Homo sapiens
tgggattgttttttagcttc

SEQ ID NO: 8505010 - DNA, 21 bp, Homo sapiens
tgggatgggtctgggaccagc

SEQ ID NO: 8505011 - DNA, 22 bp, Homo sapiens
tgggatgggatctcgctgtgtc

SEQ ID NO: 8505012 - DNA, 21 bp, Homo sapiens
tgggatgggtctgggaccagc

SEQ ID NO: 8505013 - DNA, 22 bp, Homo sapiens
tgggatggcctttgaaagccag

SEQ ID NO: 8505014 - DNA, 22 bp, Homo sapiens
tgggatgggatctcgctgtgtc

SEQ ID NO: 8505015 - DNA, 23 bp, Homo sapiens
tgggatggattcaccagtgtgct

SEQ ID NO: 8505016 - DNA, 23 bp, Homo sapiens
tgggatggattcaccagtgtgct

SEQ ID NO: 8505017 - DNA, 23 bp, Homo sapiens
tgggatggattcaccagtgtgct

SEQ ID NO: 8505018 - DNA, 23 bp, Homo sapiens
tgggatggattcaccagtgtgct

SEQ ID NO: 8505019 - DNA, 22 bp, Homo sapiens
tgggatggcatcctgggccttg

SEQ ID NO: 8505020 - DNA, 22 bp, Homo sapiens
tgggatggcatcctgggccttg

SEQ ID NO: 8505021 - DNA, 19 bp, Homo sapiens
tgggatgatgcagaaggta

SEQ ID NO: 8505022 - DNA, 22 bp, Homo sapiens
tgggatgataggtaagtaatta

SEQ ID NO: 8505023 - DNA, 22 bp, Homo sapiens
tgggatgataggtaagtaatta

SEQ ID NO: 8505024 - DNA, 22 bp, Homo sapiens
tgggatgagggtgagccacatg

SEQ ID NO: 8505025 - DNA, 22 bp, Homo sapiens
tgggatggagcctgagtatagt

SEQ ID NO: 8505026 - DNA, 18 bp, Homo sapiens
tgggatggagagtaactg

SEQ ID NO: 8505027 - DNA, 22 bp, Homo sapiens
tgggatgccctgaccctctgga

SEQ ID NO: 8505028 - DNA, 22 bp, Homo sapiens
tgggagtgcacctgggacacga

SEQ ID NO: 8505029 - DNA, 22 bp, Homo sapiens
tgggatagggctattgctcaca

SEQ ID NO: 8505030 - DNA, 22 bp, Homo sapiens
tgggagtgcacctgggacacga

SEQ ID NO: 8505031 - DNA, 22 bp, Homo sapiens
tgggagtgcacctgggacacga

SEQ ID NO: 8505032 - DNA, 22 bp, Homo sapiens
tgggatgagctatatagaaagt

SEQ ID NO: 8505033 - DNA, 22 bp, Homo sapiens
tgggatgagctatatagaaagt

SEQ ID NO: 8505034 - DNA, 22 bp, Homo sapiens
tgggatattttgagctttcctc

SEQ ID NO: 8505035 - DNA, 22 bp, Homo sapiens
tgggatatctgtcagcagcttc

SEQ ID NO: 8505036 - DNA, 22 bp, Homo sapiens
tgggatatctgtcagcagcttc

SEQ ID NO: 8505037 - DNA, 22 bp, Homo sapiens
tgggatataatctgaaaagtat

SEQ ID NO: 8505038 - DNA, 22 bp, Homo sapiens
tgggatatagtaaaacatgaat

SEQ ID NO: 8505039 - DNA, 22 bp, Homo sapiens
tgggatatacctatcctagaag

SEQ ID NO: 8505040 - DNA, 22 bp, Homo sapiens
tgggatagtggccaggaccccc

SEQ ID NO: 8505041 - DNA, 22 bp, Homo sapiens
tgggatagtagctgagagacaa

SEQ ID NO: 8505042 - DNA, 22 bp, Homo sapiens
tgggaggccaaggcaggcggat

SEQ ID NO: 8505043 - DNA, 22 bp, Homo sapiens
tgggaggccgaggcaggtggat

SEQ ID NO: 8505044 - DNA, 22 bp, Homo sapiens
tgggaggcccaggcctggcagg

SEQ ID NO: 8505045 - DNA, 22 bp, Homo sapiens
tgggaggcaggtaggtgatgat

SEQ ID NO: 8505046 - DNA, 22 bp, Homo sapiens
tgggaggcagaagttgactgga

SEQ ID NO: 8505047 - DNA, 22 bp, Homo sapiens
tgggaggccgaggcaggtggat

SEQ ID NO: 8505048 - DNA, 22 bp, Homo sapiens
tgggaggcttccagaccttgct

SEQ ID NO: 8505049 - DNA, 22 bp, Homo sapiens
tgggaggcttccagaccttgct

SEQ ID NO: 8505050 - DNA, 20 bp, Homo sapiens
tgggagtacaatcatgagca

SEQ ID NO: 8505051 - DNA, 22 bp, Homo sapiens
tgggagtagatgaggagtgggc

SEQ ID NO: 8505052 - DNA, 23 bp, Homo sapiens
tgggcatctcctctgtgccaggc

SEQ ID NO: 8505053 - DNA, 22 bp, Homo sapiens
tgggcatcatggacagcagagg

SEQ ID NO: 8505054 - DNA, 22 bp, Homo sapiens
tgggcagttgctcctcagaccc

SEQ ID NO: 8505055 - DNA, 19 bp, Homo sapiens
tgggcagtgccagggctta

SEQ ID NO: 8505056 - DNA, 22 bp, Homo sapiens
tgggcaggttgttatttgacat

SEQ ID NO: 8505057 - DNA, 22 bp, Homo sapiens
tgggcagggtctctgttatcag

SEQ ID NO: 8505058 - DNA, 22 bp, Homo sapiens
tgggcaggggccctgcttccgt

SEQ ID NO: 8505059 - DNA, 22 bp, Homo sapiens
tgggcaggggccctgcttccgt

SEQ ID NO: 8505060 - DNA, 22 bp, Homo sapiens
tgggcaggggccctgcttccgt

SEQ ID NO: 8505061 - DNA, 22 bp, Homo sapiens
tgggcaggggccctgcttccgt

SEQ ID NO: 8505062 - DNA, 22 bp, Homo sapiens
tgggcaggtgctattttccatg

SEQ ID NO: 8505063 - DNA, 19 bp, Homo sapiens
tgggcaggttcagtaatgg

SEQ ID NO: 8505064 - DNA, 22 bp, Homo sapiens
tgggccagctccctgcccctgg

SEQ ID NO: 8505065 - DNA, 22 bp, Homo sapiens
tgggccagcactgggtgctcat

SEQ ID NO: 8505066 - DNA, 22 bp, Homo sapiens
tgggccagcactgggtgctcat

SEQ ID NO: 8505067 - DNA, 22 bp, Homo sapiens
tgggccagcactgggtgctcat

SEQ ID NO: 8505068 - DNA, 22 bp, Homo sapiens
tgggccagctgaagtgccgccc

SEQ ID NO: 8505069 - DNA, 22 bp, Homo sapiens
tgggccaggatttcaagaccct

SEQ ID NO: 8505070 - DNA, 22 bp, Homo sapiens
tgggccaggcatgtgatcagca

SEQ ID NO: 8505071 - DNA, 22 bp, Homo sapiens
tgggccaggatttcaagaccct

SEQ ID NO: 8505072 - DNA, 22 bp, Homo sapiens
tgggccagctgaagtgccgccc

SEQ ID NO: 8505073 - DNA, 22 bp, Homo sapiens
tgggccagctgaagtgccgccc

SEQ ID NO: 8505074 - DNA, 22 bp, Homo sapiens
tgggccagctccctgcccctgg

SEQ ID NO: 8505075 - DNA, 22 bp, Homo sapiens
tgggccacaagccatgggacca

SEQ ID NO: 8505076 - DNA, 22 bp, Homo sapiens
tgggccacaagccatgggacca

SEQ ID NO: 8505077 - DNA, 22 bp, Homo sapiens
tgggccacctgctctgtttcta

SEQ ID NO: 8505078 - DNA, 22 bp, Homo sapiens
tgggccacagctcacacatcca

SEQ ID NO: 8505079 - DNA, 22 bp, Homo sapiens
tgggccagcaattgctgctcag

SEQ ID NO: 8505080 - DNA, 22 bp, Homo sapiens
tgggccagcaattgctgctcag

SEQ ID NO: 8505081 - DNA, 22 bp, Homo sapiens
tgggccacgggggtggagagct

SEQ ID NO: 8505082 - DNA, 22 bp, Homo sapiens
tgggccacgtcatctcccacaa

SEQ ID NO: 8505083 - DNA, 22 bp, Homo sapiens
tgggcagagttgtgatgaactg

SEQ ID NO: 8505084 - DNA, 22 bp, Homo sapiens
tgggcagatctttggtggctag

SEQ ID NO: 8505085 - DNA, 15 bp, Homo sapiens
tgggcagatcacttg

SEQ ID NO: 8505086 - DNA, 16 bp, Homo sapiens
tgggcagatgagaaga

SEQ ID NO: 8505087 - DNA, 22 bp, Homo sapiens
tgggcagatctttggtggctag

SEQ ID NO: 8505088 - DNA, 21 bp, Homo sapiens
tgggcagatggcagtgtggct

SEQ ID NO: 8505089 - DNA, 21 bp, Homo sapiens
tgggcagatggcagtgtggct

SEQ ID NO: 8505090 - DNA, 21 bp, Homo sapiens
tgggcagatggcagtgtggct

SEQ ID NO: 8505091 - DNA, 22 bp, Homo sapiens
tgggcagatgtcctctgaagtg

SEQ ID NO: 8505092 - DNA, 22 bp, Homo sapiens
tgggcagatgtcctctgaagtg

SEQ ID NO: 8505093 - DNA, 22 bp, Homo sapiens
tgggcagattaatgcagtggct

SEQ ID NO: 8505094 - DNA, 22 bp, Homo sapiens
tgggcagattaatgcagtggct

SEQ ID NO: 8505095 - DNA, 22 bp, Homo sapiens
tgggcagattaatgcagtggct

SEQ ID NO: 8505096 - DNA, 22 bp, Homo sapiens
tgggcagatgtggctctccttg

SEQ ID NO: 8505097 - DNA, 22 bp, Homo sapiens
tgggcagcagcaaagccagact

SEQ ID NO: 8505098 - DNA, 22 bp, Homo sapiens
tgggcagcagaaccaggccgac

SEQ ID NO: 8505099 - DNA, 22 bp, Homo sapiens
tgggcagcagaaccaggccgac

SEQ ID NO: 8505100 - DNA, 22 bp, Homo sapiens
tgggcagcagaaccaggccgac

SEQ ID NO: 8505101 - DNA, 20 bp, Homo sapiens
tgggcagcactgctggctgg

SEQ ID NO: 8505102 - DNA, 20 bp, Homo sapiens
tgggcagcactgctggctgg

SEQ ID NO: 8505103 - DNA, 22 bp, Homo sapiens
tgggcagcaaagactgtgtgct

SEQ ID NO: 8505104 - DNA, 22 bp, Homo sapiens
tgggcagattaatgcagtggct

SEQ ID NO: 8505105 - DNA, 22 bp, Homo sapiens
tgggcagattaatgcagtggct

SEQ ID NO: 8505106 - DNA, 22 bp, Homo sapiens
tgggcagattaatgcagtggct

SEQ ID NO: 8505107 - DNA, 22 bp, Homo sapiens
tgggcagattaatgcagtggct

SEQ ID NO: 8505108 - DNA, 22 bp, Homo sapiens
tgggcagccatcccagcctctc

SEQ ID NO: 8505109 - DNA, 22 bp, Homo sapiens
tgggcagggagctggaaccaca

SEQ ID NO: 8505110 - DNA, 22 bp, Homo sapiens
tgggcagggagctggaaccaca

SEQ ID NO: 8505111 - DNA, 22 bp, Homo sapiens
tgggcagggagctggaaccaca

SEQ ID NO: 8505112 - DNA, 22 bp, Homo sapiens
tgggcagggagctggaaccaca

SEQ ID NO: 8505113 - DNA, 22 bp, Homo sapiens
tgggcagggagctggaaccaca

SEQ ID NO: 8505114 - DNA, 22 bp, Homo sapiens
tgggcaggggccctgcttccgt

SEQ ID NO: 8505115 - DNA, 22 bp, Homo sapiens
tgggcaggggccctgcttccgt

SEQ ID NO: 8505116 - DNA, 22 bp, Homo sapiens
tgggcaggggccctgcttccgt

SEQ ID NO: 8505117 - DNA, 22 bp, Homo sapiens
tgggcagggatctcttttgcaa

SEQ ID NO: 8505118 - DNA, 22 bp, Homo sapiens
tgggcagggatctcttttgcaa

SEQ ID NO: 8505119 - DNA, 22 bp, Homo sapiens
tgggcctgggctcctgtcctct

SEQ ID NO: 8505120 - DNA, 22 bp, Homo sapiens
tgggcctgggtctttgctgcca

SEQ ID NO: 8505121 - DNA, 22 bp, Homo sapiens
tgggcctggggcagcccaaatc

SEQ ID NO: 8505122 - DNA, 22 bp, Homo sapiens
tgggcctgccccaggcttcagc

SEQ ID NO: 8505123 - DNA, 23 bp, Homo sapiens
tgggcctggaaagccttagagag

SEQ ID NO: 8505124 - DNA, 23 bp, Homo sapiens
tgggcctggaaagccttagagag

SEQ ID NO: 8505125 - DNA, 22 bp, Homo sapiens
tgggcctgggctcctgtcctct

SEQ ID NO: 8505126 - DNA, 22 bp, Homo sapiens
tgggcctgggctcctgtcctct

SEQ ID NO: 8505127 - DNA, 22 bp, Homo sapiens
tgggcctgggctcctgtcctct

SEQ ID NO: 8505128 - DNA, 22 bp, Homo sapiens
tgggcctggacaaggccactag

SEQ ID NO: 8505129 - DNA, 22 bp, Homo sapiens
tgggcctgggagggcagacgct

SEQ ID NO: 8505130 - DNA, 22 bp, Homo sapiens
tgggcctgccccaggcttcagc

SEQ ID NO: 8505131 - DNA, 22 bp, Homo sapiens
tgggcctgccccaggcttcagc

SEQ ID NO: 8505132 - DNA, 22 bp, Homo sapiens
tgggcctgccccaggcttcagc

SEQ ID NO: 8505133 - DNA, 19 bp, Homo sapiens
tgggcctgcatctgggtct

SEQ ID NO: 8505134 - DNA, 19 bp, Homo sapiens
tgggcctgcatctgggtct

SEQ ID NO: 8505135 - DNA, 22 bp, Homo sapiens
tgggcctgatttatcatcttca

SEQ ID NO: 8505136 - DNA, 21 bp, Homo sapiens
tgggcctgattcccagggtca

SEQ ID NO: 8505137 - DNA, 22 bp, Homo sapiens
tgggcctgattcttgaatcctg

SEQ ID NO: 8505138 - DNA, 21 bp, Homo sapiens
tgggcctgattcccagggtca

SEQ ID NO: 8505139 - DNA, 22 bp, Homo sapiens
tgggcctgagtttgggaactgg

SEQ ID NO: 8505140 - DNA, 20 bp, Homo sapiens
tgggcctgagcctgtgggct

SEQ ID NO: 8505141 - DNA, 22 bp, Homo sapiens
tgggcctgactcacctgcctcc

SEQ ID NO: 8505142 - DNA, 22 bp, Homo sapiens
tgggcctgactcacctgcctcc

SEQ ID NO: 8505143 - DNA, 22 bp, Homo sapiens
tgggcctgactcacctgcctcc

SEQ ID NO: 8505144 - DNA, 20 bp, Homo sapiens
tgggcctgagcctgtgggct

SEQ ID NO: 8505145 - DNA, 22 bp, Homo sapiens
tgggcctgactcacctgcctcc

SEQ ID NO: 8505146 - DNA, 22 bp, Homo sapiens
tgggcctgacacttactaggga

SEQ ID NO: 8505147 - DNA, 22 bp, Homo sapiens
tgggcctgactcacctgcctcc

SEQ ID NO: 8505148 - DNA, 23 bp, Homo sapiens
tgggcctctccacccttttctgt

SEQ ID NO: 8505149 - DNA, 22 bp, Homo sapiens
tgggcctcctttccattcagag

SEQ ID NO: 8505150 - DNA, 22 bp, Homo sapiens
tgggcctcggagcacaggagac

SEQ ID NO: 8505151 - DNA, 20 bp, Homo sapiens
tgggcctctggtgcctctgg

SEQ ID NO: 8505152 - DNA, 22 bp, Homo sapiens
tgggcctctgtttcctcatctg

SEQ ID NO: 8505153 - DNA, 22 bp, Homo sapiens
tgggcctctgtttcctcatctg

SEQ ID NO: 8505154 - DNA, 22 bp, Homo sapiens
tgggcctgaaggagctgcgccc

SEQ ID NO: 8505155 - DNA, 22 bp, Homo sapiens
tgggcctgaaattcccatttta

SEQ ID NO: 8505156 - DNA, 22 bp, Homo sapiens
tgggccagggcacccagtccag

SEQ ID NO: 8505157 - DNA, 23 bp, Homo sapiens
tgggccagggagtccggtttctt

SEQ ID NO: 8505158 - DNA, 22 bp, Homo sapiens
tgggccaggcatgtgatcagca

SEQ ID NO: 8505159 - DNA, 22 bp, Homo sapiens
tgggccaggcatgtgatcagca

SEQ ID NO: 8505160 - DNA, 22 bp, Homo sapiens
tgggccaggggcctcttctgat

SEQ ID NO: 8505161 - DNA, 22 bp, Homo sapiens
tgggccaggtctgtgtcagctg

SEQ ID NO: 8505162 - DNA, 22 bp, Homo sapiens
tgggccaggtctgtgtcagctg

SEQ ID NO: 8505163 - DNA, 22 bp, Homo sapiens
tgggccaggtctgtgtcagctg

SEQ ID NO: 8505164 - DNA, 22 bp, Homo sapiens
tgggccagtccagccccaggga

SEQ ID NO: 8505165 - DNA, 22 bp, Homo sapiens
tgggccagtccagccccaggga

SEQ ID NO: 8505166 - DNA, 22 bp, Homo sapiens
tgggccagtagctactcgcaag

SEQ ID NO: 8505167 - DNA, 17 bp, Homo sapiens
tgggccagtagaaggga

SEQ ID NO: 8505168 - DNA, 21 bp, Homo sapiens
tgggccagtagaaaggaaggc

SEQ ID NO: 8505169 - DNA, 17 bp, Homo sapiens
tgggccagtagaaggga

SEQ ID NO: 8505170 - DNA, 21 bp, Homo sapiens
tgggccagtagaaaggaaggc

SEQ ID NO: 8505171 - DNA, 22 bp, Homo sapiens
tgggcctcatgcccagccaccc

SEQ ID NO: 8505172 - DNA, 22 bp, Homo sapiens
tgggcctccaattccagcggga

SEQ ID NO: 8505173 - DNA, 22 bp, Homo sapiens
tgggcctcatcttcaatgagtc

SEQ ID NO: 8505174 - DNA, 22 bp, Homo sapiens
tgggcctcatcttcaatgagtc

SEQ ID NO: 8505175 - DNA, 22 bp, Homo sapiens
tgggcctcctgccctggcctag

SEQ ID NO: 8505176 - DNA, 22 bp, Homo sapiens
tgggcctcctgccctggcctag

SEQ ID NO: 8505177 - DNA, 22 bp, Homo sapiens
tgggcctcctggaagaatgtgg

SEQ ID NO: 8505178 - DNA, 22 bp, Homo sapiens
tgggcctccgcatggcccagcg

SEQ ID NO: 8505179 - DNA, 22 bp, Homo sapiens
tgggcctccgcatggcccagcg

SEQ ID NO: 8505180 - DNA, 22 bp, Homo sapiens
tgggcctcccatgtcttaggga

SEQ ID NO: 8505181 - DNA, 23 bp, Homo sapiens
tgggccagttctgttgaaagcca

SEQ ID NO: 8505182 - DNA, 23 bp, Homo sapiens
tgggccagttctgttgaaagcca

SEQ ID NO: 8505183 - DNA, 23 bp, Homo sapiens
tgggccagttctgttgaaagcca

SEQ ID NO: 8505184 - DNA, 22 bp, Homo sapiens
tgggccagtcctgcctaaggtg

SEQ ID NO: 8505185 - DNA, 22 bp, Homo sapiens
tgggccagtcctgcctaaggtg

SEQ ID NO: 8505186 - DNA, 22 bp, Homo sapiens
tgggccagtccagccccaggga

SEQ ID NO: 8505187 - DNA, 19 bp, Homo sapiens
tgggcctcacaatgctccc

SEQ ID NO: 8505188 - DNA, 22 bp, Homo sapiens
tgggccagtttctcattgaaat

SEQ ID NO: 8505189 - DNA, 22 bp, Homo sapiens
tgggcctcaccttcttggcagc

SEQ ID NO: 8505190 - DNA, 22 bp, Homo sapiens
tgggccagttggtgactacaaa

SEQ ID NO: 8505191 - DNA, 23 bp, Homo sapiens
tgggcggggcttttcactctgcc

SEQ ID NO: 8505192 - DNA, 22 bp, Homo sapiens
tgggcgggcaggagcgcacctg

SEQ ID NO: 8505193 - DNA, 22 bp, Homo sapiens
tgggctactctgggagcctaac

SEQ ID NO: 8505194 - DNA, 21 bp, Homo sapiens
tgggcgcttgacctctgcact

SEQ ID NO: 8505195 - DNA, 22 bp, Homo sapiens
tgggctcaagtgatgctcctgt

SEQ ID NO: 8505196 - DNA, 22 bp, Homo sapiens
tgggctcagccttcatgtggcc

SEQ ID NO: 8505197 - DNA, 22 bp, Homo sapiens
tgggctcagccatgacctccac

SEQ ID NO: 8505198 - DNA, 21 bp, Homo sapiens
tgggctcagccccagccctgc

SEQ ID NO: 8505199 - DNA, 22 bp, Homo sapiens
tgggctcagtctgcacctgcgg

SEQ ID NO: 8505200 - DNA, 22 bp, Homo sapiens
tgggcctgtggcttggctctag

SEQ ID NO: 8505201 - DNA, 22 bp, Homo sapiens
tgggcctgtggcttggctctag

SEQ ID NO: 8505202 - DNA, 22 bp, Homo sapiens
tgggcctgtggcttggctctag

SEQ ID NO: 8505203 - DNA, 20 bp, Homo sapiens
tgggcctgtggcagaagtct

SEQ ID NO: 8505204 - DNA, 22 bp, Homo sapiens
tgggcctgtgatgctgggctat

SEQ ID NO: 8505205 - DNA, 22 bp, Homo sapiens
tgggcctgtgatgctgggctat

SEQ ID NO: 8505206 - DNA, 22 bp, Homo sapiens
tgggcctgtgatgctgggctat

SEQ ID NO: 8505207 - DNA, 22 bp, Homo sapiens
tgggcctgggttcctcctgggc

SEQ ID NO: 8505208 - DNA, 22 bp, Homo sapiens
tgggcctgggttcctcctgggc

SEQ ID NO: 8505209 - DNA, 22 bp, Homo sapiens
tgggcctgtttcccttcagggc

SEQ ID NO: 8505210 - DNA, 22 bp, Homo sapiens
tgggcctgttgcctgagtccat

SEQ ID NO: 8505211 - DNA, 22 bp, Homo sapiens
tgggcctgttgcctgagtccat

SEQ ID NO: 8505212 - DNA, 22 bp, Homo sapiens
tgggcctgttggggttgagtta

SEQ ID NO: 8505213 - DNA, 22 bp, Homo sapiens
tgggcgacagagcaagactccg

SEQ ID NO: 8505214 - DNA, 22 bp, Homo sapiens
tgggcgacagagcaagactccg

SEQ ID NO: 8505215 - DNA, 22 bp, Homo sapiens
tgggcgaggagaatgctgtgaa

SEQ ID NO: 8505216 - DNA, 22 bp, Homo sapiens
tgggccttgctgagctatggag

SEQ ID NO: 8505217 - DNA, 20 bp, Homo sapiens
tgggctctgcttcctggagt

SEQ ID NO: 8505218 - DNA, 22 bp, Homo sapiens
tgggctctgctgcgtaccagtt

SEQ ID NO: 8505219 - DNA, 22 bp, Homo sapiens
tgggctctgctgcgtaccagtt

SEQ ID NO: 8505220 - DNA, 22 bp, Homo sapiens
tgggctctgaagtcagtctgct

SEQ ID NO: 8505221 - DNA, 22 bp, Homo sapiens
tgggctctgaagtcagtctgct

SEQ ID NO: 8505222 - DNA, 22 bp, Homo sapiens
tgggctctgcatcagtgcccat

SEQ ID NO: 8505223 - DNA, 22 bp, Homo sapiens
tgggctctctggcaggaaggct

SEQ ID NO: 8505224 - DNA, 22 bp, Homo sapiens
tgggctctcgtccctgcagaag

SEQ ID NO: 8505225 - DNA, 22 bp, Homo sapiens
tgggctctctggcaggaaggct

SEQ ID NO: 8505226 - DNA, 22 bp, Homo sapiens
tgggctctcctggaggacaaca

SEQ ID NO: 8505227 - DNA, 22 bp, Homo sapiens
tgggctgccctgatggtcctca

SEQ ID NO: 8505228 - DNA, 22 bp, Homo sapiens
tgggctgccctgatggtcctca

SEQ ID NO: 8505229 - DNA, 22 bp, Homo sapiens
tgggctgccggcaggctctgcc

SEQ ID NO: 8505230 - DNA, 22 bp, Homo sapiens
tgggctgccggcaggctctgcc

SEQ ID NO: 8505231 - DNA, 22 bp, Homo sapiens
tgggctgcccaaggtggccatg

SEQ ID NO: 8505232 - DNA, 22 bp, Homo sapiens
tgggctgccagctctccagatg

SEQ ID NO: 8505233 - DNA, 22 bp, Homo sapiens
tgggctgccagctctccagatg

SEQ ID NO: 8505234 - DNA, 22 bp, Homo sapiens
tgggctgcccaaggtggccatg

SEQ ID NO: 8505235 - DNA, 22 bp, Homo sapiens
tgggctgcactgctctttatcg

SEQ ID NO: 8505236 - DNA, 22 bp, Homo sapiens
tgggctgcactccattttctgc

SEQ ID NO: 8505237 - DNA, 22 bp, Homo sapiens
tgggctgcagagcccggccttc

SEQ ID NO: 8505238 - DNA, 22 bp, Homo sapiens
tgggctgcaccctcagcctctg

SEQ ID NO: 8505239 - DNA, 22 bp, Homo sapiens
tgggctgcaccctcagcctctg

SEQ ID NO: 8505240 - DNA, 22 bp, Homo sapiens
tgggctgcaccctcagcctctg

SEQ ID NO: 8505241 - DNA, 22 bp, Homo sapiens
tgggctctggtttcctggctgg

SEQ ID NO: 8505242 - DNA, 22 bp, Homo sapiens
tgggctctggtttcctggctgg

SEQ ID NO: 8505243 - DNA, 22 bp, Homo sapiens
tgggctctgtgccaggttggtg

SEQ ID NO: 8505244 - DNA, 22 bp, Homo sapiens
tgggctcttcctatagtttata

SEQ ID NO: 8505245 - DNA, 22 bp, Homo sapiens
tgggctgaaatgctgtggacta

SEQ ID NO: 8505246 - DNA, 21 bp, Homo sapiens
tgtttatggaaaagagacaaa

SEQ ID NO: 8505247 - DNA, 22 bp, Homo sapiens
tgtttatgcatcgttaatacca

SEQ ID NO: 8505248 - DNA, 22 bp, Homo sapiens
tgtttataccttggtataacca

SEQ ID NO: 8505249 - DNA, 22 bp, Homo sapiens
tgtttatagatggccacaatga

SEQ ID NO: 8505250 - DNA, 22 bp, Homo sapiens
tgtttatagggtctgtcacttg

SEQ ID NO: 8505251 - DNA, 22 bp, Homo sapiens
tgtttattacagttcttggaat

SEQ ID NO: 8505252 - DNA, 22 bp, Homo sapiens
tgtttattacagttcttggaat

SEQ ID NO: 8505253 - DNA, 22 bp, Homo sapiens
tgtttatgtgtgtgcatatata

SEQ ID NO: 8505254 - DNA, 22 bp, Homo sapiens
tgtttattgagtgcctactata

SEQ ID NO: 8505255 - DNA, 18 bp, Homo sapiens
tgtttattctcctgacag

SEQ ID NO: 8505256 - DNA, 18 bp, Homo sapiens
tgtttattctcctgacag

SEQ ID NO: 8505257 - DNA, 18 bp, Homo sapiens
tgtttattctcctgacag

SEQ ID NO: 8505258 - DNA, 22 bp, Homo sapiens
tgtttattgctgcaattgtgcc

SEQ ID NO: 8505259 - DNA, 22 bp, Homo sapiens
tgttgagtatatacctacaagt

SEQ ID NO: 8505260 - DNA, 18 bp, Homo sapiens
tgttgaaacttcaggtaa

SEQ ID NO: 8505261 - DNA, 22 bp, Homo sapiens
tgttcttttctctaaactgata

SEQ ID NO: 8505262 - DNA, 22 bp, Homo sapiens
tgttcttttctctaaactgata

SEQ ID NO: 8505263 - DNA, 22 bp, Homo sapiens
tgttgtaaaatttgagatgtca

SEQ ID NO: 8505264 - DNA, 19 bp, Homo sapiens
tgttggtgcggatgtggag

SEQ ID NO: 8505265 - DNA, 22 bp, Homo sapiens
tgttggtaggatttgcttcagc

SEQ ID NO: 8505266 - DNA, 22 bp, Homo sapiens
tgttggtaaatagcttagcaat

SEQ ID NO: 8505267 - DNA, 22 bp, Homo sapiens
tgttgggatcgaatggtggaac

SEQ ID NO: 8505268 - DNA, 22 bp, Homo sapiens
tgtttaaatagaacatactgca

SEQ ID NO: 8505269 - DNA, 22 bp, Homo sapiens
tgtttaaatagaacatactgca

SEQ ID NO: 8505270 - DNA, 22 bp, Homo sapiens
tgtttaaatagaacatactgca

SEQ ID NO: 8505271 - DNA, 22 bp, Homo sapiens
tgttgttttctcatggagaata

SEQ ID NO: 8505272 - DNA, 22 bp, Homo sapiens
tgttgtgacccagaccaagaag

SEQ ID NO: 8505273 - DNA, 22 bp, Homo sapiens
tgttgtgacccagaccaagaag

SEQ ID NO: 8505274 - DNA, 22 bp, Homo sapiens
tgttgtagcttgacagcagcca

SEQ ID NO: 8505275 - DNA, 22 bp, Homo sapiens
tgtttaaatagaacatactgca

SEQ ID NO: 8505276 - DNA, 22 bp, Homo sapiens
tgtttaagatccgtcagtcact

SEQ ID NO: 8505277 - DNA, 22 bp, Homo sapiens
tgtttaactagttttcacactt

SEQ ID NO: 8505278 - DNA, 15 bp, Homo sapiens
tgtttaagccacatt

SEQ ID NO: 8505279 - DNA, 22 bp, Homo sapiens
tgtttaagcctgtggtgtcatc

SEQ ID NO: 8505280 - DNA, 21 bp, Homo sapiens
tgtttactccctgcaagcacg

SEQ ID NO: 8505281 - DNA, 22 bp, Homo sapiens
tgtttaagctgatgaggtatcg

SEQ ID NO: 8505282 - DNA, 22 bp, Homo sapiens
tgtttaagctgatgaggtatcg

SEQ ID NO: 8505283 - DNA, 22 bp, Homo sapiens
tgtttactcctgatatattttt

SEQ ID NO: 8505284 - DNA, 22 bp, Homo sapiens
tgtttactcctgatatattttt

SEQ ID NO: 8505285 - DNA, 20 bp, Homo sapiens
tgtttactctagagggtaga

SEQ ID NO: 8505286 - DNA, 22 bp, Homo sapiens
tgtttactgcattctatttgct

SEQ ID NO: 8505287 - DNA, 22 bp, Homo sapiens
tgttaaatgttttgctagtgtc

SEQ ID NO: 8505288 - DNA, 22 bp, Homo sapiens
tgttaaatgttcctttactgga

SEQ ID NO: 8505289 - DNA, 22 bp, Homo sapiens
tgttaaatgttcctttactgga

SEQ ID NO: 8505290 - DNA, 22 bp, Homo sapiens
tgttaaattgattcacctttct

SEQ ID NO: 8505291 - DNA, 22 bp, Homo sapiens
tgttaacatagtggcgcatctg

SEQ ID NO: 8505292 - DNA, 22 bp, Homo sapiens
tgttaacatcttggactcgtga

SEQ ID NO: 8505293 - DNA, 22 bp, Homo sapiens
tgttaacatgtgtattgtatga

SEQ ID NO: 8505294 - DNA, 22 bp, Homo sapiens
tgttaacatactgctttctaat

SEQ ID NO: 8505295 - DNA, 22 bp, Homo sapiens
tgttaaatgagattggaatttg

SEQ ID NO: 8505296 - DNA, 18 bp, Homo sapiens
tgttaaatgaagatttgc

SEQ ID NO: 8505297 - DNA, 22 bp, Homo sapiens
tgttactgatttgatatacagt

SEQ ID NO: 8505298 - DNA, 22 bp, Homo sapiens
tgttacttggtgtctctggctg

SEQ ID NO: 8505299 - DNA, 22 bp, Homo sapiens
tgttacttatctcacgtgatgc

SEQ ID NO: 8505300 - DNA, 22 bp, Homo sapiens
tgttacagtggctttttaaaca

SEQ ID NO: 8505301 - DNA, 22 bp, Homo sapiens
tgttaactaatggtctaacatt

SEQ ID NO: 8505302 - DNA, 22 bp, Homo sapiens
tgttaacttcctcctcctctgc

SEQ ID NO: 8505303 - DNA, 22 bp, Homo sapiens
tgttaaggagacacatgaaaaa

SEQ ID NO: 8505304 - DNA, 22 bp, Homo sapiens
tgttctttcagttagacacagt

SEQ ID NO: 8505305 - DNA, 22 bp, Homo sapiens
tgttctttcagttagacacagt

SEQ ID NO: 8505306 - DNA, 22 bp, Homo sapiens
tgttcttgggaatcttacagtt

SEQ ID NO: 8505307 - DNA, 22 bp, Homo sapiens
tgttctttagcagaccatgttg

SEQ ID NO: 8505308 - DNA, 22 bp, Homo sapiens
tgttcttgagcctttagaccta

SEQ ID NO: 8505309 - DNA, 22 bp, Homo sapiens
tgttcttttctctaaactgata

SEQ ID NO: 8505310 - DNA, 22 bp, Homo sapiens
tgttctttggcttcacagctct

SEQ ID NO: 8505311 - DNA, 22 bp, Homo sapiens
tgttctttggcttcacagctct

SEQ ID NO: 8505312 - DNA, 22 bp, Homo sapiens
tgttctttgccagtgatttaat

SEQ ID NO: 8505313 - DNA, 22 bp, Homo sapiens
tgttctttgctgttgatgtaga

SEQ ID NO: 8505314 - DNA, 22 bp, Homo sapiens
tgttcttagcaggagcatctat

SEQ ID NO: 8505315 - DNA, 22 bp, Homo sapiens
tgttcttacggaacttatcttt

SEQ ID NO: 8505316 - DNA, 22 bp, Homo sapiens
tgttcttaacttttgtgtatat

SEQ ID NO: 8505317 - DNA, 22 bp, Homo sapiens
tgttagtgtaattccagttttc

SEQ ID NO: 8505318 - DNA, 22 bp, Homo sapiens
tgtttttccatgtgcagaacaa

SEQ ID NO: 8505319 - DNA, 22 bp, Homo sapiens
tgttttatttctccaagaggga

SEQ ID NO: 8505320 - DNA, 22 bp, Homo sapiens
tgttttcaagtcaaggccaaat

SEQ ID NO: 8505321 - DNA, 22 bp, Homo sapiens
tgttttatgagccatataacct

SEQ ID NO: 8505322 - DNA, 22 bp, Homo sapiens
tgttttatgagccatataacct

SEQ ID NO: 8505323 - DNA, 22 bp, Homo sapiens
tgttttatgagccatataacct

SEQ ID NO: 8505324 - DNA, 22 bp, Homo sapiens
tgttttatttctccaagaggga

SEQ ID NO: 8505325 - DNA, 22 bp, Homo sapiens
tgttttatttctccaagaggga

SEQ ID NO: 8505326 - DNA, 22 bp, Homo sapiens
tgttttatataagcagagcggt

SEQ ID NO: 8505327 - DNA, 22 bp, Homo sapiens
tgttttatcaagatggcatgtc

SEQ ID NO: 8505328 - DNA, 22 bp, Homo sapiens
tgttttatgagccatataacct

SEQ ID NO: 8505329 - DNA, 22 bp, Homo sapiens
tgttttatgagccatataacct

SEQ ID NO: 8505330 - DNA, 22 bp, Homo sapiens
tgttttaagctctagaagggga

SEQ ID NO: 8505331 - DNA, 22 bp, Homo sapiens
tgttttaagctctagaagggga

SEQ ID NO: 8505332 - DNA, 22 bp, Homo sapiens
tgttttaagctctagaagggga

SEQ ID NO: 8505333 - DNA, 23 bp, Homo sapiens
tgtttgtttctatgagagatagc

SEQ ID NO: 8505334 - DNA, 22 bp, Homo sapiens
tgttttaaagccattgcctttc

SEQ ID NO: 8505335 - DNA, 22 bp, Homo sapiens
tgttttaagagcgcactttata

SEQ ID NO: 8505336 - DNA, 22 bp, Homo sapiens
tgttttaagggtcaactgtcac

SEQ ID NO: 8505337 - DNA, 22 bp, Homo sapiens
tgttttaagggtcaactgtcac

SEQ ID NO: 8505338 - DNA, 22 bp, Homo sapiens
tgttttaatctcccattgctct

SEQ ID NO: 8505339 - DNA, 22 bp, Homo sapiens
tgttttaatctcccattgctct

SEQ ID NO: 8505340 - DNA, 22 bp, Homo sapiens
tgttttaatctcccattgctct

SEQ ID NO: 8505341 - DNA, 22 bp, Homo sapiens
tgttttaatctcccattgctct

SEQ ID NO: 8505342 - DNA, 22 bp, Homo sapiens
tgtttgtactcaaagccatgag

SEQ ID NO: 8505343 - DNA, 22 bp, Homo sapiens
tgtttgtagagacagctgatgc

SEQ ID NO: 8505344 - DNA, 22 bp, Homo sapiens
tgtttgtatctctctctgtggc

SEQ ID NO: 8505345 - DNA, 20 bp, Homo sapiens
tgtttgtgccagctttgtca

SEQ ID NO: 8505346 - DNA, 22 bp, Homo sapiens
tgtttggttccagagggcctct

SEQ ID NO: 8505347 - DNA, 17 bp, Homo sapiens
tgtttggttgattggtg

SEQ ID NO: 8505348 - DNA, 22 bp, Homo sapiens
tgtttgtgctgcctggtgggca

SEQ ID NO: 8505349 - DNA, 22 bp, Homo sapiens
tgtttgtgctgcctggtgggca

SEQ ID NO: 8505350 - DNA, 22 bp, Homo sapiens
tgtttgtggaatattctttaag

SEQ ID NO: 8505351 - DNA, 22 bp, Homo sapiens
tgtttgtgagatgtgaggtacg

SEQ ID NO: 8505352 - DNA, 22 bp, Homo sapiens
tgtttgtgctgcctggtgggca

SEQ ID NO: 8505353 - DNA, 20 bp, Homo sapiens
tgtttgtgccagctttgtca

SEQ ID NO: 8505354 - DNA, 20 bp, Homo sapiens
tgtttgtgtggggccttggc

SEQ ID NO: 8505355 - DNA, 22 bp, Homo sapiens
tgtttgtggttataataagtat

SEQ ID NO: 8505356 - DNA, 22 bp, Homo sapiens
tgtttgtggttataataagtat

SEQ ID NO: 8505357 - DNA, 20 bp, Homo sapiens
tgtttgtgtggggccttggc

SEQ ID NO: 8505358 - DNA, 20 bp, Homo sapiens
tgtttgtgtggggccttggc

SEQ ID NO: 8505359 - DNA, 20 bp, Homo sapiens
tgtttgtgtggggccttggc

SEQ ID NO: 8505360 - DNA, 18 bp, Homo sapiens
tgtttatttttctcttac

SEQ ID NO: 8505361 - DNA, 18 bp, Homo sapiens
tgtttatttttctcttac

SEQ ID NO: 8505362 - DNA, 18 bp, Homo sapiens
tgtttatttttctcttac

SEQ ID NO: 8505363 - DNA, 22 bp, Homo sapiens
tgtttgctagggttggtattta

SEQ ID NO: 8505364 - DNA, 22 bp, Homo sapiens
tgtttgctctgactatcttgcg

SEQ ID NO: 8505365 - DNA, 22 bp, Homo sapiens
tgtttgctctgactatcttgcg

SEQ ID NO: 8505366 - DNA, 22 bp, Homo sapiens
tgttttttccttatgcaatctg

SEQ ID NO: 8505367 - DNA, 22 bp, Homo sapiens
tgttttttccttatgcaatctg

SEQ ID NO: 8505368 - DNA, 22 bp, Homo sapiens
tgtttttgttcaatgctaggtc

SEQ ID NO: 8505369 - DNA, 22 bp, Homo sapiens
tgtttttttatatacctgaagt

SEQ ID NO: 8505370 - DNA, 22 bp, Homo sapiens
ttaaaaaccatcttcctttcct

SEQ ID NO: 8505371 - DNA, 22 bp, Homo sapiens
ttaaaaaccatcttcctttcct

SEQ ID NO: 8505372 - DNA, 20 bp, Homo sapiens
ttaaaaagagtcacaggaga

SEQ ID NO: 8505373 - DNA, 22 bp, Homo sapiens
ttaaaacagcgtgaatctggca

SEQ ID NO: 8505374 - DNA, 22 bp, Homo sapiens
ttaaaacagcgtgaatctggca

SEQ ID NO: 8505375 - DNA, 20 bp, Homo sapiens
ttaaaaagagtcacaggaga

SEQ ID NO: 8505376 - DNA, 22 bp, Homo sapiens
ttaaaaatatgtagggcccgat

SEQ ID NO: 8505377 - DNA, 22 bp, Homo sapiens
ttaaaatgcagattatgactca

SEQ ID NO: 8505378 - DNA, 22 bp, Homo sapiens
ttaaaatgcagattctgattca

SEQ ID NO: 8505379 - DNA, 22 bp, Homo sapiens
ttaaaaccatcagctgtaagat

SEQ ID NO: 8505380 - DNA, 22 bp, Homo sapiens
ttaaaacagcgtgaatctggca

SEQ ID NO: 8505381 - DNA, 22 bp, Homo sapiens
ttaaaagaatcctgttatcctc

SEQ ID NO: 8505382 - DNA, 22 bp, Homo sapiens
ttaaaagaatcctgttatcctc

SEQ ID NO: 8505383 - DNA, 22 bp, Homo sapiens
ttaaaatttccccaccatgtat

SEQ ID NO: 8505384 - DNA, 22 bp, Homo sapiens
ttaaaatttccccaccatgtat

SEQ ID NO: 8505385 - DNA, 22 bp, Homo sapiens
ttaaaattatggcccatttgga

SEQ ID NO: 8505386 - DNA, 22 bp, Homo sapiens
ttaaaatttccccaccatgtat

SEQ ID NO: 8505387 - DNA, 22 bp, Homo sapiens
ttaaaatgtacaggggaaagtg

SEQ ID NO: 8505388 - DNA, 23 bp, Homo sapiens
ttaaaatgtggtctctccctagt

SEQ ID NO: 8505389 - DNA, 22 bp, Homo sapiens
ttaaaatttccccaccatgtat

SEQ ID NO: 8505390 - DNA, 22 bp, Homo sapiens
ttaaacacactgagatttatgt

SEQ ID NO: 8505391 - DNA, 22 bp, Homo sapiens
ttaaacacactgagatttatgt

SEQ ID NO: 8505392 - DNA, 22 bp, Homo sapiens
ttaaacacctgtctagtgtagc

SEQ ID NO: 8505393 - DNA, 22 bp, Homo sapiens
ttaaacacctgtctagtgtagc

SEQ ID NO: 8505394 - DNA, 22 bp, Homo sapiens
ttaaacactggagctgggtgtt

SEQ ID NO: 8505395 - DNA, 23 bp, Homo sapiens
ttaaacactagttcgagtagcat

SEQ ID NO: 8505396 - DNA, 22 bp, Homo sapiens
ttaaacaccaagtgcaaaccac

SEQ ID NO: 8505397 - DNA, 22 bp, Homo sapiens
ttaaacaccaagtgcaaaccac

SEQ ID NO: 8505398 - DNA, 22 bp, Homo sapiens
ttaaacacctgtctagtgtagc

SEQ ID NO: 8505399 - DNA, 22 bp, Homo sapiens
ttaaacaccacagcagtcccta

SEQ ID NO: 8505400 - DNA, 22 bp, Homo sapiens
ttaaacacctgtctagtgtagc

SEQ ID NO: 8505401 - DNA, 22 bp, Homo sapiens
ttaaacatttatggaggcagca

SEQ ID NO: 8505402 - DNA, 22 bp, Homo sapiens
ttaaacatttttgatgatcgat

SEQ ID NO: 8505403 - DNA, 22 bp, Homo sapiens
ttaaaccactttgttgcaagta

SEQ ID NO: 8505404 - DNA, 22 bp, Homo sapiens
ttaaaccactgagtggagacta

SEQ ID NO: 8505405 - DNA, 22 bp, Homo sapiens
ttaaaccaccagaagccattat

SEQ ID NO: 8505406 - DNA, 22 bp, Homo sapiens
ttaaaccatagtttaacataag

SEQ ID NO: 8505407 - DNA, 22 bp, Homo sapiens
ttaaaccatagtttaacataag

SEQ ID NO: 8505408 - DNA, 22 bp, Homo sapiens
ttaaaccatagtttaacataag

SEQ ID NO: 8505409 - DNA, 17 bp, Homo sapiens
ttaaaccataaagaagg

SEQ ID NO: 8505410 - DNA, 22 bp, Homo sapiens
ttaaacagacagtaaatgaaac

SEQ ID NO: 8505411 - DNA, 22 bp, Homo sapiens
ttaaacactgggggttaatgca

SEQ ID NO: 8505412 - DNA, 22 bp, Homo sapiens
ttaaacagacagtaaatgaaac

SEQ ID NO: 8505413 - DNA, 22 bp, Homo sapiens
ttaaacaggtttttgaatggcc

SEQ ID NO: 8505414 - DNA, 22 bp, Homo sapiens
ttaaacagagtctgaaatgtaa

SEQ ID NO: 8505415 - DNA, 22 bp, Homo sapiens
ttaaacagagtctgaaatgtaa

SEQ ID NO: 8505416 - DNA, 22 bp, Homo sapiens
ttaaacagtgtttcatgtgggg

SEQ ID NO: 8505417 - DNA, 22 bp, Homo sapiens
ttaaacagtcccagaggctgac

SEQ ID NO: 8505418 - DNA, 22 bp, Homo sapiens
tgtgtgtgagtcctggctttcc

SEQ ID NO: 8505419 - DNA, 22 bp, Homo sapiens
tgtgtgtgagtcctggctttcc

SEQ ID NO: 8505420 - DNA, 22 bp, Homo sapiens
tgtgtgtgcacatgcatataca

SEQ ID NO: 8505421 - DNA, 22 bp, Homo sapiens
tgtgtgtgcacatgcatataca

SEQ ID NO: 8505422 - DNA, 22 bp, Homo sapiens
tgtgtgtgcacatgcatataca

SEQ ID NO: 8505423 - DNA, 22 bp, Homo sapiens
tgtgtgtgactcatactagaac

SEQ ID NO: 8505424 - DNA, 22 bp, Homo sapiens
tgtgtgtgactcatactagaac

SEQ ID NO: 8505425 - DNA, 22 bp, Homo sapiens
tgtgtgtgagtcctggctttcc

SEQ ID NO: 8505426 - DNA, 22 bp, Homo sapiens
tgtgtgtgaaccattgagggct

SEQ ID NO: 8505427 - DNA, 22 bp, Homo sapiens
tgtgtgtgacaacctagttcag

SEQ ID NO: 8505428 - DNA, 22 bp, Homo sapiens
tgtgtgtgacaacctagttcag

SEQ ID NO: 8505429 - DNA, 22 bp, Homo sapiens
tgtgtgtgactcatactagaac

SEQ ID NO: 8505430 - DNA, 22 bp, Homo sapiens
tgtgtgtctggaagctcaggga

SEQ ID NO: 8505431 - DNA, 22 bp, Homo sapiens
tgtgtgtctttgcctcctctca

SEQ ID NO: 8505432 - DNA, 22 bp, Homo sapiens
tgtgtgtgaaccattgagggct

SEQ ID NO: 8505433 - DNA, 22 bp, Homo sapiens
tgtgtgtgaaccattgagggct

SEQ ID NO: 8505434 - DNA, 22 bp, Homo sapiens
tgtgtgtgaaccattgagggct

SEQ ID NO: 8505435 - DNA, 22 bp, Homo sapiens
tgtgtgggagcacgggctgttg

SEQ ID NO: 8505436 - DNA, 22 bp, Homo sapiens
tgtgtgggagcacgggctgttg

SEQ ID NO: 8505437 - DNA, 22 bp, Homo sapiens
tgtgtgggagcacgggctgttg

SEQ ID NO: 8505438 - DNA, 21 bp, Homo sapiens
tgtgtgggcatatctgctgca

SEQ ID NO: 8505439 - DNA, 22 bp, Homo sapiens
tgtgtggcaagctgtatgctag

SEQ ID NO: 8505440 - DNA, 22 bp, Homo sapiens
tgtgtggcaagctgtatgctag

SEQ ID NO: 8505441 - DNA, 22 bp, Homo sapiens
tgtgtggcctccatagggtact

SEQ ID NO: 8505442 - DNA, 22 bp, Homo sapiens
tgtgtggcaagctgtatgctag

SEQ ID NO: 8505443 - DNA, 22 bp, Homo sapiens
tgtgtgggagcacgggctgttg

SEQ ID NO: 8505444 - DNA, 22 bp, Homo sapiens
tgtgtggcgttgcgtggctagg

SEQ ID NO: 8505445 - DNA, 22 bp, Homo sapiens
tgtgtggcgttgcgtggctagg

SEQ ID NO: 8505446 - DNA, 22 bp, Homo sapiens
tgtgtgctctaatgcctagtac

SEQ ID NO: 8505447 - DNA, 22 bp, Homo sapiens
tgtgtgctctaatgcctagtac

SEQ ID NO: 8505448 - DNA, 22 bp, Homo sapiens
tgtgtgctcgatggccctgcag

SEQ ID NO: 8505449 - DNA, 22 bp, Homo sapiens
tgtgtggattcatctcaaagag

SEQ ID NO: 8505450 - DNA, 22 bp, Homo sapiens
tgtgtggattcatctcaaagag

SEQ ID NO: 8505451 - DNA, 22 bp, Homo sapiens
tgtgtgcttatagtctagtagt

SEQ ID NO: 8505452 - DNA, 22 bp, Homo sapiens
tgtgtggatgcagcgtgggtct

SEQ ID NO: 8505453 - DNA, 22 bp, Homo sapiens
tgtgtgcattagcattctaggg

SEQ ID NO: 8505454 - DNA, 19 bp, Homo sapiens
tgtgtgcatgcgcacgtgt

SEQ ID NO: 8505455 - DNA, 22 bp, Homo sapiens
tgtgtcagaggtagagatggca

SEQ ID NO: 8505456 - DNA, 22 bp, Homo sapiens
tgtgtgcattcacatgcatgcc

SEQ ID NO: 8505457 - DNA, 22 bp, Homo sapiens
tgtgtgcattcacatgcatgcc

SEQ ID NO: 8505458 - DNA, 22 bp, Homo sapiens
tgtgtgccagatacaagcactg

SEQ ID NO: 8505459 - DNA, 22 bp, Homo sapiens
tgtgtgcattcacatgcatgcc

SEQ ID NO: 8505460 - DNA, 22 bp, Homo sapiens
tgtgtgcattcacatgcatgcc

SEQ ID NO: 8505461 - DNA, 19 bp, Homo sapiens
tgtgtgccctcaccacata

SEQ ID NO: 8505462 - DNA, 22 bp, Homo sapiens
tgtgtgccccagatgagtagct

SEQ ID NO: 8505463 - DNA, 22 bp, Homo sapiens
tgtgtgccagcctacgaggagc

SEQ ID NO: 8505464 - DNA, 22 bp, Homo sapiens
tgtgtgccccagatgagtagct

SEQ ID NO: 8505465 - DNA, 22 bp, Homo sapiens
tgtgtgcctgagccgtgcctgg

SEQ ID NO: 8505466 - DNA, 22 bp, Homo sapiens
tgtgtgcctgagccgtgcctgg

SEQ ID NO: 8505467 - DNA, 22 bp, Homo sapiens
tgtgtgctaatgtatgctctaa

SEQ ID NO: 8505468 - DNA, 22 bp, Homo sapiens
tgtgtgctaatgtatgctctaa

SEQ ID NO: 8505469 - DNA, 22 bp, Homo sapiens
tgtgtgctaatgtatgctctaa

SEQ ID NO: 8505470 - DNA, 20 bp, Homo sapiens
tgtgtgctaggactacagtg

SEQ ID NO: 8505471 - DNA, 21 bp, Homo sapiens
tgtgtcactaactagaggcta

SEQ ID NO: 8505472 - DNA, 22 bp, Homo sapiens
tgtgtcagaaggcaatggggat

SEQ ID NO: 8505473 - DNA, 21 bp, Homo sapiens
tgtgtcactaactagaggcta

SEQ ID NO: 8505474 - DNA, 22 bp, Homo sapiens
tgtgtacttgaaagggcaggtc

SEQ ID NO: 8505475 - DNA, 20 bp, Homo sapiens
tgtgtagcaggtgctgtgcc

SEQ ID NO: 8505476 - DNA, 22 bp, Homo sapiens
tgtgtagctcatattagtgtta

SEQ ID NO: 8505477 - DNA, 22 bp, Homo sapiens
tgtgtattaccattttacagct

SEQ ID NO: 8505478 - DNA, 22 bp, Homo sapiens
tgtgtagctcatattagtgtta

SEQ ID NO: 8505479 - DNA, 22 bp, Homo sapiens
tgtgtattaccattttacagct

SEQ ID NO: 8505480 - DNA, 20 bp, Homo sapiens
tgtgtagcaggtgctgtgcc

SEQ ID NO: 8505481 - DNA, 22 bp, Homo sapiens
tgtgtattcagcaagcgaaaca

SEQ ID NO: 8505482 - DNA, 22 bp, Homo sapiens
tgtgtatttctggaacagacta

SEQ ID NO: 8505483 - DNA, 22 bp, Homo sapiens
tgtgtatttctggaacagacta

SEQ ID NO: 8505484 - DNA, 22 bp, Homo sapiens
tgtgtgtgttcctcctcagcta

SEQ ID NO: 8505485 - DNA, 22 bp, Homo sapiens
tgtgtgtgttcctcctcagcta

SEQ ID NO: 8505486 - DNA, 22 bp, Homo sapiens
tgtgtgtgtgcgcgcacgcata

SEQ ID NO: 8505487 - DNA, 22 bp, Homo sapiens
tgtgtgtgtgcgcgcacgcata

SEQ ID NO: 8505488 - DNA, 22 bp, Homo sapiens
tgtgtgtgtcctcatttgcaga

SEQ ID NO: 8505489 - DNA, 22 bp, Homo sapiens
tgtgtgtgtcctcatttgcaga

SEQ ID NO: 8505490 - DNA, 22 bp, Homo sapiens
tgtgtgtgtcctcatttgcaga

SEQ ID NO: 8505491 - DNA, 22 bp, Homo sapiens
tgtgtgtgtgcgcgcacgcata

SEQ ID NO: 8505492 - DNA, 22 bp, Homo sapiens
tgtgtgtgtgcgcgcacgcata

SEQ ID NO: 8505493 - DNA, 23 bp, Homo sapiens
tgtgtgtgtattctacgcaaggt

SEQ ID NO: 8505494 - DNA, 22 bp, Homo sapiens
tgtgtgtgtcctcatttgcaga

SEQ ID NO: 8505495 - DNA, 23 bp, Homo sapiens
tgtgtgtgtattctacgcaaggt

SEQ ID NO: 8505496 - DNA, 23 bp, Homo sapiens
tgtgtgtgtattctacgcaaggt

SEQ ID NO: 8505497 - DNA, 20 bp, Homo sapiens
tgtgtgtgtacttctaaata

SEQ ID NO: 8505498 - DNA, 22 bp, Homo sapiens
tgtgtgtgtaaaagcatttata

SEQ ID NO: 8505499 - DNA, 20 bp, Homo sapiens
tgtgtgtgtacttctaaata

SEQ ID NO: 8505500 - DNA, 20 bp, Homo sapiens
tgtgtgtgtacttctaaata

SEQ ID NO: 8505501 - DNA, 22 bp, Homo sapiens
tgtgtgtggggaggcagcagat

SEQ ID NO: 8505502 - DNA, 22 bp, Homo sapiens
tgtgtgtggggaggcagcagat

SEQ ID NO: 8505503 - DNA, 22 bp, Homo sapiens
tgtgtgtggggaggcagcagat

SEQ ID NO: 8505504 - DNA, 22 bp, Homo sapiens
tgtgtgtgtaaaagcatttata

SEQ ID NO: 8505505 - DNA, 22 bp, Homo sapiens
tgtgtgtgtaaaagcatttata

SEQ ID NO: 8505506 - DNA, 22 bp, Homo sapiens
tgtgtgtgggcggaacggcccc

SEQ ID NO: 8505507 - DNA, 22 bp, Homo sapiens
tgtgtgtgggcggaacggcccc

SEQ ID NO: 8505508 - DNA, 22 bp, Homo sapiens
tgtgtgtggggaggcagcagat

SEQ ID NO: 8505509 - DNA, 22 bp, Homo sapiens
tgtgtgtgcaggagagcaggtg

SEQ ID NO: 8505510 - DNA, 22 bp, Homo sapiens
tgtgtgtgcacgtgcgcgcgag

SEQ ID NO: 8505511 - DNA, 22 bp, Homo sapiens
tgtgtgtgcacgtgcgcgcgag

SEQ ID NO: 8505512 - DNA, 22 bp, Homo sapiens
tgtgtgtgcacgtgcgcgcgag

SEQ ID NO: 8505513 - DNA, 21 bp, Homo sapiens
tgtgtgtgcaggcacacacac

SEQ ID NO: 8505514 - DNA, 21 bp, Homo sapiens
tgtgtgtgcaggcacacacac

SEQ ID NO: 8505515 - DNA, 22 bp, Homo sapiens
tgtgtgtgcaggagagcaggtg

SEQ ID NO: 8505516 - DNA, 22 bp, Homo sapiens
tgtgtgtgcaggagagcaggtg

SEQ ID NO: 8505517 - DNA, 22 bp, Homo sapiens
tgtgtgtgcaggagagcaggtg

SEQ ID NO: 8505518 - DNA, 22 bp, Homo sapiens
tgtgtgtgcaggagagcaggtg

SEQ ID NO: 8505519 - DNA, 22 bp, Homo sapiens
tgtgtgtgtttctgctcataca

SEQ ID NO: 8505520 - DNA, 22 bp, Homo sapiens
tgtgtgtgtttctgctcataca

SEQ ID NO: 8505521 - DNA, 22 bp, Homo sapiens
tgtgtgttaacttatttaatgt

SEQ ID NO: 8505522 - DNA, 22 bp, Homo sapiens
tgtgtgttatcttagttcatct

SEQ ID NO: 8505523 - DNA, 22 bp, Homo sapiens
tgtgtgttatcttagttcatct

SEQ ID NO: 8505524 - DNA, 22 bp, Homo sapiens
tgtgtgttggctggagagggct

SEQ ID NO: 8505525 - DNA, 19 bp, Homo sapiens
tgtgtgtttatatatgtat

SEQ ID NO: 8505526 - DNA, 22 bp, Homo sapiens
tgtgtgttctcaattattgatg

SEQ ID NO: 8505527 - DNA, 22 bp, Homo sapiens
tgtgtgtgtttacagtttctca

SEQ ID NO: 8505528 - DNA, 22 bp, Homo sapiens
tgtgtgtgtttacagtttctca

SEQ ID NO: 8505529 - DNA, 22 bp, Homo sapiens
tgtgtgtgtttacagtttctca

SEQ ID NO: 8505530 - DNA, 22 bp, Homo sapiens
tgtgtgtgtttacagtttctca

SEQ ID NO: 8505531 - DNA, 22 bp, Homo sapiens
tgtgtgtgtttataaatctaaa

SEQ ID NO: 8505532 - DNA, 22 bp, Homo sapiens
tgtgtgtgtttctgctcataca

SEQ ID NO: 8505533 - DNA, 22 bp, Homo sapiens
tgtgtgtgtttataaatctaaa

SEQ ID NO: 8505534 - DNA, 22 bp, Homo sapiens
tgtgtgtgtttataaatctaaa

SEQ ID NO: 8505535 - DNA, 22 bp, Homo sapiens
tgttaaaaccacaggtgaggac

SEQ ID NO: 8505536 - DNA, 22 bp, Homo sapiens
tgttaaacagctgtcttcttca

SEQ ID NO: 8505537 - DNA, 22 bp, Homo sapiens
tgttaaacagatattgcccaca

SEQ ID NO: 8505538 - DNA, 22 bp, Homo sapiens
tgttaaaaattcagctctagat

SEQ ID NO: 8505539 - DNA, 22 bp, Homo sapiens
tgttaaaaattcagctctagat

SEQ ID NO: 8505540 - DNA, 22 bp, Homo sapiens
tgttaaactcgtaggttaggct

SEQ ID NO: 8505541 - DNA, 22 bp, Homo sapiens
tgttaaacctagtacaggtcct

SEQ ID NO: 8505542 - DNA, 22 bp, Homo sapiens
tgttaaaccagttttgcatcat

SEQ ID NO: 8505543 - DNA, 22 bp, Homo sapiens
tgttaaacctagtacaggtcct

SEQ ID NO: 8505544 - DNA, 22 bp, Homo sapiens
tgttaaactgtattgcataagg

SEQ ID NO: 8505545 - DNA, 18 bp, Homo sapiens
tgttaaatgaagatttgc

SEQ ID NO: 8505546 - DNA, 22 bp, Homo sapiens
tgtgttaagtatttgatacact

SEQ ID NO: 8505547 - DNA, 22 bp, Homo sapiens
tgttaaaaattcagctctagat

SEQ ID NO: 8505548 - DNA, 22 bp, Homo sapiens
tgtgttaagtatttgatacact

SEQ ID NO: 8505549 - DNA, 22 bp, Homo sapiens
tgtgttaaggcactgatatctg

SEQ ID NO: 8505550 - DNA, 22 bp, Homo sapiens
tgtgttaaggtgcatctagtgc

SEQ ID NO: 8505551 - DNA, 22 bp, Homo sapiens
tgtgttaacactgcatgataat

SEQ ID NO: 8505552 - DNA, 19 bp, Homo sapiens
tgtgtgtttatatatgtat

SEQ ID NO: 8505553 - DNA, 19 bp, Homo sapiens
tgtgtgtttatatatgtat

SEQ ID NO: 8505554 - DNA, 19 bp, Homo sapiens
tgtgtgtttatatatgtat

SEQ ID NO: 8505555 - DNA, 22 bp, Homo sapiens
tgtgtacagcaggatttctcaa

SEQ ID NO: 8505556 - DNA, 22 bp, Homo sapiens
tgtgtacagcatggtccagcag

SEQ ID NO: 8505557 - DNA, 22 bp, Homo sapiens
tgtgtacagcaggatttctcaa

SEQ ID NO: 8505558 - DNA, 22 bp, Homo sapiens
tgtgtacagcatggtccagcag

SEQ ID NO: 8505559 - DNA, 22 bp, Homo sapiens
tgtgtacaggccttgctagact

SEQ ID NO: 8505560 - DNA, 22 bp, Homo sapiens
tgtgtacacacagatatataca

SEQ ID NO: 8505561 - DNA, 22 bp, Homo sapiens
tgtgtacacacagatatataca

SEQ ID NO: 8505562 - DNA, 22 bp, Homo sapiens
tgtgtacacacagatatataca

SEQ ID NO: 8505563 - DNA, 22 bp, Homo sapiens
tgtgtacacaatgattgcagag

SEQ ID NO: 8505564 - DNA, 22 bp, Homo sapiens
tgtgtacacatgacaggcaccc

SEQ ID NO: 8505565 - DNA, 22 bp, Homo sapiens
tgtgtacacacagatatataca

SEQ ID NO: 8505566 - DNA, 22 bp, Homo sapiens
tgtgtacatctcttctcacatt

SEQ ID NO: 8505567 - DNA, 22 bp, Homo sapiens
tgtgtacatctcttctcacatt

SEQ ID NO: 8505568 - DNA, 22 bp, Homo sapiens
tgtgtacatatctatcctagat

SEQ ID NO: 8505569 - DNA, 22 bp, Homo sapiens
tgtgtacatctcttctcacatt

SEQ ID NO: 8505570 - DNA, 22 bp, Homo sapiens
tgtgtactcaattgagccattt

SEQ ID NO: 8505571 - DNA, 22 bp, Homo sapiens
tgtgtacatatacacaaataca

SEQ ID NO: 8505572 - DNA, 22 bp, Homo sapiens
tgtgtacatatacacaaataca

SEQ ID NO: 8505573 - DNA, 22 bp, Homo sapiens
tgtgtacatatctatcctagat

SEQ ID NO: 8505574 - DNA, 23 bp, Homo sapiens
tgtgtacatacatatgtacacac

SEQ ID NO: 8505575 - DNA, 22 bp, Homo sapiens
tgtgtacaggccttgctagact

SEQ ID NO: 8505576 - DNA, 23 bp, Homo sapiens
tgtgtacatacatatgtacacac

SEQ ID NO: 8505577 - DNA, 22 bp, Homo sapiens
tgtggggacccatgccatgggc

SEQ ID NO: 8505578 - DNA, 22 bp, Homo sapiens
tgtggggacctggctgccaccc

SEQ ID NO: 8505579 - DNA, 22 bp, Homo sapiens
tgtggggaagagtatgacttgg

SEQ ID NO: 8505580 - DNA, 22 bp, Homo sapiens
tgtggggaagagtatgacttgg

SEQ ID NO: 8505581 - DNA, 23 bp, Homo sapiens
tgtgtacacaatagatgaggttt

SEQ ID NO: 8505582 - DNA, 23 bp, Homo sapiens
tgtgtacacaatagatgaggttt

SEQ ID NO: 8505583 - DNA, 22 bp, Homo sapiens
tgtgtacacaagtatatataca

SEQ ID NO: 8505584 - DNA, 22 bp, Homo sapiens
tgtgtacacaagtatatataca

SEQ ID NO: 8505585 - DNA, 22 bp, Homo sapiens
tgtgtacacaagtatatataca

SEQ ID NO: 8505586 - DNA, 22 bp, Homo sapiens
tgtgtacacaagtatatataca

SEQ ID NO: 8505587 - DNA, 22 bp, Homo sapiens
tgtggggactgagtggaggctt

SEQ ID NO: 8505588 - DNA, 22 bp, Homo sapiens
tgtgtacaagcctgagtacaga

SEQ ID NO: 8505589 - DNA, 22 bp, Homo sapiens
tgtgtacaagcctgagtacaga

SEQ ID NO: 8505590 - DNA, 22 bp, Homo sapiens
tgtgtacaagcctgagtacaga

SEQ ID NO: 8505591 - DNA, 22 bp, Homo sapiens
tgtgtacaagagtgtttactgt

SEQ ID NO: 8505592 - DNA, 22 bp, Homo sapiens
tgtgggctccccctcactctgt

SEQ ID NO: 8505593 - DNA, 23 bp, Homo sapiens
tgtgggcgcattgtaagggtagc

SEQ ID NO: 8505594 - DNA, 20 bp, Homo sapiens
tgtgggccttcggcgtgctc

SEQ ID NO: 8505595 - DNA, 22 bp, Homo sapiens
tgtgggcctcagcaggactcca

SEQ ID NO: 8505596 - DNA, 22 bp, Homo sapiens
tgtgggcaggcccgggtctgag

SEQ ID NO: 8505597 - DNA, 22 bp, Homo sapiens
tgtgggaggattcagaattggg

SEQ ID NO: 8505598 - DNA, 22 bp, Homo sapiens
tgtgggaggattcagaattggg

SEQ ID NO: 8505599 - DNA, 22 bp, Homo sapiens
tgtgggaggattcagaattggg

SEQ ID NO: 8505600 - DNA, 22 bp, Homo sapiens
tgtgggaggaattagaatggga

SEQ ID NO: 8505601 - DNA, 22 bp, Homo sapiens
tgtgggaggaattagaatggga

SEQ ID NO: 8505602 - DNA, 22 bp, Homo sapiens
tgtgggaggaattagaatggga

SEQ ID NO: 8505603 - DNA, 22 bp, Homo sapiens
tgtgggaggaattagaatggga

SEQ ID NO: 8505604 - DNA, 22 bp, Homo sapiens
tgtgggaggtctggaaggctcc

SEQ ID NO: 8505605 - DNA, 22 bp, Homo sapiens
tgtgggaggattcagaattggg

SEQ ID NO: 8505606 - DNA, 22 bp, Homo sapiens
tgtgggatggttttgccagaat

SEQ ID NO: 8505607 - DNA, 22 bp, Homo sapiens
tgtgggaggtctggaaggctcc

SEQ ID NO: 8505608 - DNA, 22 bp, Homo sapiens
tgtgggaggtctggaaggctcc

SEQ ID NO: 8505609 - DNA, 22 bp, Homo sapiens
tgtgggcaggagcacaagtcag

SEQ ID NO: 8505610 - DNA, 19 bp, Homo sapiens
tgtgggcaagggatggcag

SEQ ID NO: 8505611 - DNA, 22 bp, Homo sapiens
tgtggctgatcaaagcgctcag

SEQ ID NO: 8505612 - DNA, 19 bp, Homo sapiens
tgtggctgagcactcctta

SEQ ID NO: 8505613 - DNA, 22 bp, Homo sapiens
tgtggctgactcctggtcccca

SEQ ID NO: 8505614 - DNA, 22 bp, Homo sapiens
tgtggctgactcctggtcccca

SEQ ID NO: 8505615 - DNA, 23 bp, Homo sapiens
tgtggctgagaaattgacaactt

SEQ ID NO: 8505616 - DNA, 21 bp, Homo sapiens
tgtggctgacaccctttggga

SEQ ID NO: 8505617 - DNA, 22 bp, Homo sapiens
tgtggctccactccacattaat

SEQ ID NO: 8505618 - DNA, 22 bp, Homo sapiens
tgtggctcggccagctgctgaa

SEQ ID NO: 8505619 - DNA, 22 bp, Homo sapiens
tgtggctctcagatcctccaat

SEQ ID NO: 8505620 - DNA, 22 bp, Homo sapiens
tgtggaagaaacaagacacttt

SEQ ID NO: 8505621 - DNA, 22 bp, Homo sapiens
tgtggaagaacttcttgcttgg

SEQ ID NO: 8505622 - DNA, 22 bp, Homo sapiens
tgtggccttgcagcctggaggt

SEQ ID NO: 8505623 - DNA, 22 bp, Homo sapiens
tgtggccttgcagcctggaggt

SEQ ID NO: 8505624 - DNA, 22 bp, Homo sapiens
tgtggcctttcaaggatggaat

SEQ ID NO: 8505625 - DNA, 22 bp, Homo sapiens
tgtggaatgggagtgagaagac

SEQ ID NO: 8505626 - DNA, 22 bp, Homo sapiens
tgtggaatgtcctcagcatcct

SEQ ID NO: 8505627 - DNA, 22 bp, Homo sapiens
tgtgggagaaggaagcaagctg

SEQ ID NO: 8505628 - DNA, 22 bp, Homo sapiens
tgtgggagaaggaagcaagctg

SEQ ID NO: 8505629 - DNA, 22 bp, Homo sapiens
tgtgggagaaggaagcaagctg

SEQ ID NO: 8505630 - DNA, 22 bp, Homo sapiens
tgtgggaggaacacagccagaa

SEQ ID NO: 8505631 - DNA, 22 bp, Homo sapiens
tgtgggaatgacgaggaagagg

SEQ ID NO: 8505632 - DNA, 22 bp, Homo sapiens
tgtgggaatcagccaggggggc

SEQ ID NO: 8505633 - DNA, 23 bp, Homo sapiens
tgtgggaatgttggagaggaaac

SEQ ID NO: 8505634 - DNA, 22 bp, Homo sapiens
tgtgggacagggacagtgatat

SEQ ID NO: 8505635 - DNA, 22 bp, Homo sapiens
tgtgggacagggacagcaagag

SEQ ID NO: 8505636 - DNA, 22 bp, Homo sapiens
tgtgggaagatgttgcaggaga

SEQ ID NO: 8505637 - DNA, 22 bp, Homo sapiens
tgtggctgccaccctgaagccg

SEQ ID NO: 8505638 - DNA, 22 bp, Homo sapiens
tgtgggaagatgttgcaggaga

SEQ ID NO: 8505639 - DNA, 22 bp, Homo sapiens
tgtgggaagagcagtggcagca

SEQ ID NO: 8505640 - DNA, 22 bp, Homo sapiens
tgtgggaaatgggagtggaaga

SEQ ID NO: 8505641 - DNA, 22 bp, Homo sapiens
tgtggctgcaggcgatggagga

SEQ ID NO: 8505642 - DNA, 22 bp, Homo sapiens
tgtggctgcaggcgatggagga

SEQ ID NO: 8505643 - DNA, 22 bp, Homo sapiens
tgtggctgcagacactggagcc

SEQ ID NO: 8505644 - DNA, 22 bp, Homo sapiens
tgtggctgcaaaggaaggctgc

SEQ ID NO: 8505645 - DNA, 22 bp, Homo sapiens
tgtgcctgagttggctgagtac

SEQ ID NO: 8505646 - DNA, 22 bp, Homo sapiens
tgtgcctgagttggctgagtac

SEQ ID NO: 8505647 - DNA, 22 bp, Homo sapiens
tgtgcctgagttggctgagtac

SEQ ID NO: 8505648 - DNA, 22 bp, Homo sapiens
tgtgcctgagttggctgagtac

SEQ ID NO: 8505649 - DNA, 22 bp, Homo sapiens
tgtgcctgctagatggttgtcg

SEQ ID NO: 8505650 - DNA, 22 bp, Homo sapiens
tgtgcctgctagatggttgtcg

SEQ ID NO: 8505651 - DNA, 22 bp, Homo sapiens
tgtgcctggcattctgggcttc

SEQ ID NO: 8505652 - DNA, 22 bp, Homo sapiens
tgtgcctggcattctgggcttc

SEQ ID NO: 8505653 - DNA, 22 bp, Homo sapiens
tgtgcctggcccagtggtgtca

SEQ ID NO: 8505654 - DNA, 22 bp, Homo sapiens
tgtgcctggtccctgagtcgag

SEQ ID NO: 8505655 - DNA, 22 bp, Homo sapiens
tgtgcctggcccagtggtgtca

SEQ ID NO: 8505656 - DNA, 22 bp, Homo sapiens
tgtgcctggatctctgtgacaa

SEQ ID NO: 8505657 - DNA, 22 bp, Homo sapiens
tgtgcctggatctctgtgacaa

SEQ ID NO: 8505658 - DNA, 22 bp, Homo sapiens
tgtgcctgttcccactttgcct

SEQ ID NO: 8505659 - DNA, 22 bp, Homo sapiens
tgtgccttatgaattctttctg

SEQ ID NO: 8505660 - DNA, 22 bp, Homo sapiens
tgtgccttatgaattctttctg

SEQ ID NO: 8505661 - DNA, 22 bp, Homo sapiens
tgtgcctggtccctgagtcgag

SEQ ID NO: 8505662 - DNA, 22 bp, Homo sapiens
tgtgcctggtccctgagtcgag

SEQ ID NO: 8505663 - DNA, 22 bp, Homo sapiens
tgtgcctgtcaccctcagagag

SEQ ID NO: 8505664 - DNA, 22 bp, Homo sapiens
tgtgcctgtcccgcattctggt

SEQ ID NO: 8505665 - DNA, 23 bp, Homo sapiens
tgtgcgtgatgctttgttgaagg

SEQ ID NO: 8505666 - DNA, 17 bp, Homo sapiens
tgtgcgcttgtgtgagg

SEQ ID NO: 8505667 - DNA, 17 bp, Homo sapiens
tgtgcgcttgtgtgagg

SEQ ID NO: 8505668 - DNA, 23 bp, Homo sapiens
tgtgcgtgatgctttgttgaagg

SEQ ID NO: 8505669 - DNA, 22 bp, Homo sapiens
tgtgcgtgatggaccgggcctg

SEQ ID NO: 8505670 - DNA, 22 bp, Homo sapiens
tgtgcgtggattcctgtactca

SEQ ID NO: 8505671 - DNA, 22 bp, Homo sapiens
tgtgcgtgggcacacacatatg

SEQ ID NO: 8505672 - DNA, 22 bp, Homo sapiens
tgtgcctttaaggggagctgag

SEQ ID NO: 8505673 - DNA, 22 bp, Homo sapiens
tgtgccttccctctgctgattt

SEQ ID NO: 8505674 - DNA, 22 bp, Homo sapiens
tgtgcctttcatcatgcttttg

SEQ ID NO: 8505675 - DNA, 22 bp, Homo sapiens
tgtgcgcgtgcagcggagtgtt

SEQ ID NO: 8505676 - DNA, 22 bp, Homo sapiens
tgtgcgctccggcgagtcagcg

SEQ ID NO: 8505677 - DNA, 22 bp, Homo sapiens
tgtgctaagtattttcttattt

SEQ ID NO: 8505678 - DNA, 22 bp, Homo sapiens
tgtgctaaggcagtctatcaca

SEQ ID NO: 8505679 - DNA, 22 bp, Homo sapiens
tgtgcgtggattcctgtactca

SEQ ID NO: 8505680 - DNA, 22 bp, Homo sapiens
tgtgcgtggttcccggggccat

SEQ ID NO: 8505681 - DNA, 22 bp, Homo sapiens
tgtgctatttgactgtttgcta

SEQ ID NO: 8505682 - DNA, 22 bp, Homo sapiens
tgtgctcactctaaattaagat

SEQ ID NO: 8505683 - DNA, 22 bp, Homo sapiens
tgtgctattacacatttattta

SEQ ID NO: 8505684 - DNA, 22 bp, Homo sapiens
tgtgctatttttgcatatgtgt

SEQ ID NO: 8505685 - DNA, 22 bp, Homo sapiens
tgtgctctgaagagtgcatgtc

SEQ ID NO: 8505686 - DNA, 22 bp, Homo sapiens
tgtgctctacctcagtgtcatt

SEQ ID NO: 8505687 - DNA, 23 bp, Homo sapiens
tgtgctcccaaatgtaggtctat

SEQ ID NO: 8505688 - DNA, 22 bp, Homo sapiens
tgtgctccatcatccataatct

SEQ ID NO: 8505689 - DNA, 22 bp, Homo sapiens
tgtgctctgactttctcctggt

SEQ ID NO: 8505690 - DNA, 22 bp, Homo sapiens
tgtgctctgactttctcctggt

SEQ ID NO: 8505691 - DNA, 22 bp, Homo sapiens
tgtgctctgactttctcctggt

SEQ ID NO: 8505692 - DNA, 22 bp, Homo sapiens
tgtgctctgcaatcagttcttt

SEQ ID NO: 8505693 - DNA, 22 bp, Homo sapiens
tgtgctctggagttgccttcac

SEQ ID NO: 8505694 - DNA, 22 bp, Homo sapiens
tgtggaaaattggaacgttcct

SEQ ID NO: 8505695 - DNA, 22 bp, Homo sapiens
tgtggaaagtcaagttccagga

SEQ ID NO: 8505696 - DNA, 22 bp, Homo sapiens
tgtggaaagtggtctaagcaca

SEQ ID NO: 8505697 - DNA, 22 bp, Homo sapiens
tgtgctgctctcagtgacagcc

SEQ ID NO: 8505698 - DNA, 22 bp, Homo sapiens
tgtgctgacaagatcagaaggt

SEQ ID NO: 8505699 - DNA, 22 bp, Homo sapiens
tgtgctcttgggcaatagctgc

SEQ ID NO: 8505700 - DNA, 22 bp, Homo sapiens
tgtgctcttctgttacttgtag

SEQ ID NO: 8505701 - DNA, 22 bp, Homo sapiens
tgtgctcttctgttacttgtag

SEQ ID NO: 8505702 - DNA, 22 bp, Homo sapiens
tgtgctcttctgttacttgtag

SEQ ID NO: 8505703 - DNA, 22 bp, Homo sapiens
tgtgctctgtggatctgagcaa

SEQ ID NO: 8505704 - DNA, 22 bp, Homo sapiens
tgtgctctggagttgccttcac

SEQ ID NO: 8505705 - DNA, 22 bp, Homo sapiens
tgtgctctggagttgccttcac

SEQ ID NO: 8505706 - DNA, 22 bp, Homo sapiens
tgtgcctactgatagagccaag

SEQ ID NO: 8505707 - DNA, 22 bp, Homo sapiens
tgtgcctactgatagagccaag

SEQ ID NO: 8505708 - DNA, 22 bp, Homo sapiens
tgtgcctcatgtatctggatga

SEQ ID NO: 8505709 - DNA, 19 bp, Homo sapiens
tgtgcctctatagcatgtg

SEQ ID NO: 8505710 - DNA, 22 bp, Homo sapiens
tgtgcctgactaggtgaatcaa

SEQ ID NO: 8505711 - DNA, 22 bp, Homo sapiens
tgtgccctttcctgctcctcca

SEQ ID NO: 8505712 - DNA, 22 bp, Homo sapiens
tgtgccctgcctacatcacctt

SEQ ID NO: 8505713 - DNA, 22 bp, Homo sapiens
tgtgccctcagaagagtacatc

SEQ ID NO: 8505714 - DNA, 22 bp, Homo sapiens
tgtgcatgtaccttattctgga

SEQ ID NO: 8505715 - DNA, 22 bp, Homo sapiens
tgtgcagtttctatgttgtcca

SEQ ID NO: 8505716 - DNA, 22 bp, Homo sapiens
tgtgcagttttaagtggtctaa

SEQ ID NO: 8505717 - DNA, 22 bp, Homo sapiens
tgtgcatagactttcaccacct

SEQ ID NO: 8505718 - DNA, 22 bp, Homo sapiens
tgtgcatgtctgggcctgtaag

SEQ ID NO: 8505719 - DNA, 16 bp, Homo sapiens
tgtgcatgttctgtgt

SEQ ID NO: 8505720 - DNA, 22 bp, Homo sapiens
tgtgccaagactatattgtgct

SEQ ID NO: 8505721 - DNA, 22 bp, Homo sapiens
tgtgccaagatcaaacttttct

SEQ ID NO: 8505722 - DNA, 22 bp, Homo sapiens
tgtgcagagcggggaagagcac

SEQ ID NO: 8505723 - DNA, 22 bp, Homo sapiens
tgtgcagagcccacaggcagct

SEQ ID NO: 8505724 - DNA, 22 bp, Homo sapiens
tgtgcagagcccacaggcagct

SEQ ID NO: 8505725 - DNA, 22 bp, Homo sapiens
tgtgcagagcccacaggcagct

SEQ ID NO: 8505726 - DNA, 22 bp, Homo sapiens
tgtgcagatagtgatttcagaa

SEQ ID NO: 8505727 - DNA, 22 bp, Homo sapiens
tgtgcagagttgaagacaggag

SEQ ID NO: 8505728 - DNA, 22 bp, Homo sapiens
tgtgcagagtaaggcagctgtt

SEQ ID NO: 8505729 - DNA, 22 bp, Homo sapiens
tgtgcagagcccacaggcagct

SEQ ID NO: 8505730 - DNA, 22 bp, Homo sapiens
tgtgcagggaagggcatgctat

SEQ ID NO: 8505731 - DNA, 21 bp, Homo sapiens
tgtgcagtccaatgtgctagc

SEQ ID NO: 8505732 - DNA, 22 bp, Homo sapiens
tgtgcagttcaaacccgtgttg

SEQ ID NO: 8505733 - DNA, 22 bp, Homo sapiens
tgtgcagtttctatgttgtcca

SEQ ID NO: 8505734 - DNA, 23 bp, Homo sapiens
tgtgcacatctgacgggtgaagg

SEQ ID NO: 8505735 - DNA, 22 bp, Homo sapiens
tgtgcacatatactcatattcc

SEQ ID NO: 8505736 - DNA, 22 bp, Homo sapiens
tgtgcacaatgtgcaggtttgt

SEQ ID NO: 8505737 - DNA, 22 bp, Homo sapiens
tgtgcacaggaagctattctct

SEQ ID NO: 8505738 - DNA, 22 bp, Homo sapiens
tgtgcacataaaacagtactag

SEQ ID NO: 8505739 - DNA, 22 bp, Homo sapiens
tgtgcacattctaggactagta

SEQ ID NO: 8505740 - DNA, 22 bp, Homo sapiens
tgtgcacattctaggactagta

SEQ ID NO: 8505741 - DNA, 22 bp, Homo sapiens
tgtgcacattctaggactagta

SEQ ID NO: 8505742 - DNA, 22 bp, Homo sapiens
tgtgcagagaagccactggggg

SEQ ID NO: 8505743 - DNA, 22 bp, Homo sapiens
tgtgcagaaactgggaaggaag

SEQ ID NO: 8505744 - DNA, 22 bp, Homo sapiens
tgtgcaaagtgtacaaattaat

SEQ ID NO: 8505745 - DNA, 22 bp, Homo sapiens
tgtgcaaagtgtacaaattaat

SEQ ID NO: 8505746 - DNA, 22 bp, Homo sapiens
tgtgcaaattaagtagattttc

SEQ ID NO: 8505747 - DNA, 22 bp, Homo sapiens
tgtgcaatcatattttaaaatg

SEQ ID NO: 8505748 - DNA, 22 bp, Homo sapiens
tgtgatggttcactgggcatga

SEQ ID NO: 8505749 - DNA, 22 bp, Homo sapiens
tgtgatgtcagtggtatcaaag

SEQ ID NO: 8505750 - DNA, 22 bp, Homo sapiens
tgtgatcttagacaactcactg

SEQ ID NO: 8505751 - DNA, 22 bp, Homo sapiens
tgtgatggttcactgggcatga

SEQ ID NO: 8505752 - DNA, 22 bp, Homo sapiens
tgtgatctgccttggatctgca

SEQ ID NO: 8505753 - DNA, 22 bp, Homo sapiens
tgtgatgctggagtgcgaatat

SEQ ID NO: 8505754 - DNA, 22 bp, Homo sapiens
tgtgatctctataggattcaat

SEQ ID NO: 8505755 - DNA, 22 bp, Homo sapiens
tgtgatttcatctgaggccagg

SEQ ID NO: 8505756 - DNA, 22 bp, Homo sapiens
tgtgatttccagccattaaaaa

SEQ ID NO: 8505757 - DNA, 22 bp, Homo sapiens
tgtgcaaagtgtacaaattaat

SEQ ID NO: 8505758 - DNA, 22 bp, Homo sapiens
tgtgattatattgtagtacatt

SEQ ID NO: 8505759 - DNA, 22 bp, Homo sapiens
tgtgattagctgaatacactgg

SEQ ID NO: 8505760 - DNA, 22 bp, Homo sapiens
tgtgattactgaatagaaaata

SEQ ID NO: 8505761 - DNA, 22 bp, Homo sapiens
tgtgagttattttcaggagttt

SEQ ID NO: 8505762 - DNA, 22 bp, Homo sapiens
tgtgagttcttagaaagtcagt

SEQ ID NO: 8505763 - DNA, 22 bp, Homo sapiens
tgtgagtgacagttcccttggt

SEQ ID NO: 8505764 - DNA, 19 bp, Homo sapiens
tgtgataagcagaattcca

SEQ ID NO: 8505765 - DNA, 19 bp, Homo sapiens
tgtgataagcagaattcca

SEQ ID NO: 8505766 - DNA, 22 bp, Homo sapiens
tgtgataacttttacattttcg

SEQ ID NO: 8505767 - DNA, 22 bp, Homo sapiens
tgtgagtaataaagtcattttt

SEQ ID NO: 8505768 - DNA, 22 bp, Homo sapiens
tgtgagtgaatgggtctgaagt

SEQ ID NO: 8505769 - DNA, 22 bp, Homo sapiens
tgtgagtgaatgggtctgaagt

SEQ ID NO: 8505770 - DNA, 19 bp, Homo sapiens
tgtgagaggctagctgccc

SEQ ID NO: 8505771 - DNA, 22 bp, Homo sapiens
tgtgagagtataatctctctgt

SEQ ID NO: 8505772 - DNA, 22 bp, Homo sapiens
tgtgagcactggctgggaaagt

SEQ ID NO: 8505773 - DNA, 22 bp, Homo sapiens
tgtgagcactatggctaggctc

SEQ ID NO: 8505774 - DNA, 22 bp, Homo sapiens
tgtgagcactatggctaggctc

SEQ ID NO: 8505775 - DNA, 22 bp, Homo sapiens
tgtgactggagtccagcccact

SEQ ID NO: 8505776 - DNA, 22 bp, Homo sapiens
tgtgactggcagaggtgtctgg

SEQ ID NO: 8505777 - DNA, 22 bp, Homo sapiens
tgtgactgagctgcagagtgtc

SEQ ID NO: 8505778 - DNA, 22 bp, Homo sapiens
tgtgactgaagtgtctagacct

SEQ ID NO: 8505779 - DNA, 22 bp, Homo sapiens
tgtgacgttcctgctggcgacc

SEQ ID NO: 8505780 - DNA, 22 bp, Homo sapiens
tgtgacatcgctgtgtctgttt

SEQ ID NO: 8505781 - DNA, 22 bp, Homo sapiens
tgtgacatgtgtcatcttttct

SEQ ID NO: 8505782 - DNA, 17 bp, Homo sapiens
tgtgacattgggacatt

SEQ ID NO: 8505783 - DNA, 22 bp, Homo sapiens
tgtgacttagggcaggtgagat

SEQ ID NO: 8505784 - DNA, 22 bp, Homo sapiens
tgtgacttgatgtttgcaccag

SEQ ID NO: 8505785 - DNA, 22 bp, Homo sapiens
tgtgacttctttttgagttcaa

SEQ ID NO: 8505786 - DNA, 22 bp, Homo sapiens
tgtgacttctttttgagttcaa

SEQ ID NO: 8505787 - DNA, 22 bp, Homo sapiens
tgtgagaaaatgattgcacagt

SEQ ID NO: 8505788 - DNA, 19 bp, Homo sapiens
tgtgactggttgtctcgct

SEQ ID NO: 8505789 - DNA, 22 bp, Homo sapiens
tgtgactggttgtcccgctttc

SEQ ID NO: 8505790 - DNA, 22 bp, Homo sapiens
tgtgactgtggacttttgtggg

SEQ ID NO: 8505791 - DNA, 22 bp, Homo sapiens
tgtgactgtggacttttgtggg

SEQ ID NO: 8505792 - DNA, 21 bp, Homo sapiens
tgtgagaagagtactgaggtc

SEQ ID NO: 8505793 - DNA, 22 bp, Homo sapiens
tgtgagaagggtgaggctttta

SEQ ID NO: 8505794 - DNA, 22 bp, Homo sapiens
tgtgagacaattgcatcagggc

SEQ ID NO: 8505795 - DNA, 22 bp, Homo sapiens
tgtgagagagtgcatttgcata

SEQ ID NO: 8505796 - DNA, 22 bp, Homo sapiens
tgtgagagcagaagacacatag

SEQ ID NO: 8505797 - DNA, 22 bp, Homo sapiens
tgtgagacaggacctgttgact

SEQ ID NO: 8505798 - DNA, 22 bp, Homo sapiens
tgtgagacgtgttagaacagtg

SEQ ID NO: 8505799 - DNA, 22 bp, Homo sapiens
tgtgaaagatactaggcagagg

SEQ ID NO: 8505800 - DNA, 22 bp, Homo sapiens
tgtgaaagagtcttatagtttc

SEQ ID NO: 8505801 - DNA, 22 bp, Homo sapiens
tgtgaaacggagtcagggaagg

SEQ ID NO: 8505802 - DNA, 22 bp, Homo sapiens
tgtgaaagagtcttatagtttc

SEQ ID NO: 8505803 - DNA, 22 bp, Homo sapiens
tgtgaaagatactaggcagagg

SEQ ID NO: 8505804 - DNA, 22 bp, Homo sapiens
tgtgaaagcaagtctagttctc

SEQ ID NO: 8505805 - DNA, 22 bp, Homo sapiens
tgtgaaagcaagtctagttctc

SEQ ID NO: 8505806 - DNA, 22 bp, Homo sapiens
tgtgaaaggagccatagacagt

SEQ ID NO: 8505807 - DNA, 22 bp, Homo sapiens
tgtgaaaggggtcacagggaaa

SEQ ID NO: 8505808 - DNA, 22 bp, Homo sapiens
tgtgaaagtcaaattaattgaa

SEQ ID NO: 8505809 - DNA, 21 bp, Homo sapiens
tgtgaaatagctatgctacat

SEQ ID NO: 8505810 - DNA, 22 bp, Homo sapiens
tgtgaaagtcaaattaattgaa

SEQ ID NO: 8505811 - DNA, 22 bp, Homo sapiens
tgtgaaatcaattagctgcaga

SEQ ID NO: 8505812 - DNA, 22 bp, Homo sapiens
tgtgaaatatttatatactcaa

SEQ ID NO: 8505813 - DNA, 22 bp, Homo sapiens
tgtgaaagtcaaattaattgaa

SEQ ID NO: 8505814 - DNA, 22 bp, Homo sapiens
tgtgaaatattggcaatttcat

SEQ ID NO: 8505815 - DNA, 22 bp, Homo sapiens
tgtgaaatcacaggctatttag

SEQ ID NO: 8505816 - DNA, 22 bp, Homo sapiens
tgtgaaatctgaactcaaagat

SEQ ID NO: 8505817 - DNA, 22 bp, Homo sapiens
tgtgaaatctgatgaattgacc

SEQ ID NO: 8505818 - DNA, 22 bp, Homo sapiens
tgtgaaatctgatgaattgacc

SEQ ID NO: 8505819 - DNA, 23 bp, Homo sapiens
tgtgaaatttgaggtcagtgctt

SEQ ID NO: 8505820 - DNA, 18 bp, Homo sapiens
tgtgaacacatttttctg

SEQ ID NO: 8505821 - DNA, 22 bp, Homo sapiens
tgtgaaattgaatgcccattgc

SEQ ID NO: 8505822 - DNA, 22 bp, Homo sapiens
tgtgaaattgagaaactttcac

SEQ ID NO: 8505823 - DNA, 22 bp, Homo sapiens
tgtgaaatgtgtgtataattaa

SEQ ID NO: 8505824 - DNA, 22 bp, Homo sapiens
tgtgaaattacttaaaggaaat

SEQ ID NO: 8505825 - DNA, 22 bp, Homo sapiens
tgtgaaattcttgaaatgcaca

SEQ ID NO: 8505826 - DNA, 22 bp, Homo sapiens
tgtgaaatgaagataattcttg

SEQ ID NO: 8505827 - DNA, 22 bp, Homo sapiens
tgtgaaatgagtatatttgaat

SEQ ID NO: 8505828 - DNA, 22 bp, Homo sapiens
tgtgaaatgagtatatttgaat

SEQ ID NO: 8505829 - DNA, 22 bp, Homo sapiens
tgtgaaatgctattgtgacaaa

SEQ ID NO: 8505830 - DNA, 22 bp, Homo sapiens
tgtgaaatgctatttccatgag

SEQ ID NO: 8505831 - DNA, 22 bp, Homo sapiens
tgtgaaatgtgtgtataattaa

SEQ ID NO: 8505832 - DNA, 22 bp, Homo sapiens
tgtgaaatgtggatgttaatag

SEQ ID NO: 8505833 - DNA, 23 bp, Homo sapiens
tgtgacagggtcattgaaaaggg

SEQ ID NO: 8505834 - DNA, 22 bp, Homo sapiens
tgtgacagtcgttaggagctca

SEQ ID NO: 8505835 - DNA, 22 bp, Homo sapiens
tgtgacaggaactatgtggatg

SEQ ID NO: 8505836 - DNA, 22 bp, Homo sapiens
tgtgacagccagtaaagtaagc

SEQ ID NO: 8505837 - DNA, 19 bp, Homo sapiens
tgtgacatcactgggcagc

SEQ ID NO: 8505838 - DNA, 23 bp, Homo sapiens
tgtgacagtgacaatactgactt

SEQ ID NO: 8505839 - DNA, 22 bp, Homo sapiens
tgtgacagatctctatacatga

SEQ ID NO: 8505840 - DNA, 22 bp, Homo sapiens
tgtgacagatctttaaataatg

SEQ ID NO: 8505841 - DNA, 20 bp, Homo sapiens
tgtgacaaaggcatatttta

SEQ ID NO: 8505842 - DNA, 22 bp, Homo sapiens
tgtgacaagcattgtatattgg

SEQ ID NO: 8505843 - DNA, 22 bp, Homo sapiens
tgtgaaggtttttatgggatat

SEQ ID NO: 8505844 - DNA, 22 bp, Homo sapiens
tgtgaacatttctggttatttg

SEQ ID NO: 8505845 - DNA, 22 bp, Homo sapiens
tgtgaatagattgaagctttgg

SEQ ID NO: 8505846 - DNA, 22 bp, Homo sapiens
tgtgaataccttgaattcatca

SEQ ID NO: 8505847 - DNA, 22 bp, Homo sapiens
tgtgaataccttgaattcatca

SEQ ID NO: 8505848 - DNA, 22 bp, Homo sapiens
tgtgaatatccatttgtttcag

SEQ ID NO: 8505849 - DNA, 22 bp, Homo sapiens
tgtgaatatttccttctttgga

SEQ ID NO: 8505850 - DNA, 22 bp, Homo sapiens
tgtgaatgtatagtttgtatat

SEQ ID NO: 8505851 - DNA, 22 bp, Homo sapiens
tgtgaatggacaattaaatcta

SEQ ID NO: 8505852 - DNA, 22 bp, Homo sapiens
tgtctgtgacctctttggagcc

SEQ ID NO: 8505853 - DNA, 22 bp, Homo sapiens
tgtctgtgacctctttggagcc

SEQ ID NO: 8505854 - DNA, 22 bp, Homo sapiens
tgtctgtgacctctttggagcc

SEQ ID NO: 8505855 - DNA, 22 bp, Homo sapiens
tgtctgtgatttaggccagggc

SEQ ID NO: 8505856 - DNA, 22 bp, Homo sapiens
tgtctgtgacctcttaggcaag

SEQ ID NO: 8505857 - DNA, 22 bp, Homo sapiens
tgtctgtgacctcttaggcaag

SEQ ID NO: 8505858 - DNA, 22 bp, Homo sapiens
tgtctgtgacctcttaggcaag

SEQ ID NO: 8505859 - DNA, 22 bp, Homo sapiens
tgtctgggatgtaattcctgcc

SEQ ID NO: 8505860 - DNA, 22 bp, Homo sapiens
tgtctgggagggacagggctac

SEQ ID NO: 8505861 - DNA, 22 bp, Homo sapiens
tgtctgggatgttggcagccac

SEQ ID NO: 8505862 - DNA, 22 bp, Homo sapiens
tgtctgtgacagacctttgcta

SEQ ID NO: 8505863 - DNA, 22 bp, Homo sapiens
tgtctggatgtctggagcatcg

SEQ ID NO: 8505864 - DNA, 23 bp, Homo sapiens
tgtctggctcatggtgggtctca

SEQ ID NO: 8505865 - DNA, 22 bp, Homo sapiens
tgtctgggagggacagggctac

SEQ ID NO: 8505866 - DNA, 19 bp, Homo sapiens
tgtctggaagagctgcagg

SEQ ID NO: 8505867 - DNA, 22 bp, Homo sapiens
tgtctggacagagattctcaat

SEQ ID NO: 8505868 - DNA, 22 bp, Homo sapiens
tgtctggacattgacaatcatg

SEQ ID NO: 8505869 - DNA, 23 bp, Homo sapiens
tgtctggagcctgagcaggtgct

SEQ ID NO: 8505870 - DNA, 22 bp, Homo sapiens
tgtctgttattggtgtataaga

SEQ ID NO: 8505871 - DNA, 22 bp, Homo sapiens
tgtcttaaacttgtgggacttc

SEQ ID NO: 8505872 - DNA, 22 bp, Homo sapiens
tgtcttaagtagattacagcct

SEQ ID NO: 8505873 - DNA, 22 bp, Homo sapiens
tgtcttaagtagattacagcct

SEQ ID NO: 8505874 - DNA, 22 bp, Homo sapiens
tgtcttaatttggatgatgttt

SEQ ID NO: 8505875 - DNA, 22 bp, Homo sapiens
tgtcttaatttggatgatgttt

SEQ ID NO: 8505876 - DNA, 22 bp, Homo sapiens
tgtcttaatatgtgcattctgt

SEQ ID NO: 8505877 - DNA, 19 bp, Homo sapiens
tgtcttaattaactcagag

SEQ ID NO: 8505878 - DNA, 22 bp, Homo sapiens
tgtctgtggcaattgtgggtaa

SEQ ID NO: 8505879 - DNA, 22 bp, Homo sapiens
tgtctgtgggcaacgcctccca

SEQ ID NO: 8505880 - DNA, 22 bp, Homo sapiens
tgtctgtggcaattgtgggtaa

SEQ ID NO: 8505881 - DNA, 22 bp, Homo sapiens
tgtctgtggcaattgtgggtaa

SEQ ID NO: 8505882 - DNA, 22 bp, Homo sapiens
tgtctgtgtccaaatttcctct

SEQ ID NO: 8505883 - DNA, 22 bp, Homo sapiens
tgtctgtgtccaaatttcctct

SEQ ID NO: 8505884 - DNA, 22 bp, Homo sapiens
tgtctgtgtgagcaaatgactt

SEQ ID NO: 8505885 - DNA, 22 bp, Homo sapiens
tgtctgttattggtgtataaga

SEQ ID NO: 8505886 - DNA, 22 bp, Homo sapiens
tgtctgtgacctctttggagcc

SEQ ID NO: 8505887 - DNA, 20 bp, Homo sapiens
tgtctgtgccacggcactcc

SEQ ID NO: 8505888 - DNA, 22 bp, Homo sapiens
tgtctgtgcccaaggctcccgg

SEQ ID NO: 8505889 - DNA, 22 bp, Homo sapiens
tgtctgtggcaattgtgggtaa

SEQ ID NO: 8505890 - DNA, 22 bp, Homo sapiens
tgtcttattaagaccagtgact

SEQ ID NO: 8505891 - DNA, 22 bp, Homo sapiens
tgtcttattccttctgttcagc

SEQ ID NO: 8505892 - DNA, 22 bp, Homo sapiens
tgtcttatggcatgtccactgg

SEQ ID NO: 8505893 - DNA, 22 bp, Homo sapiens
tgtcttatgctgcatagactat

SEQ ID NO: 8505894 - DNA, 22 bp, Homo sapiens
tgtcttatgtagatactgagaa

SEQ ID NO: 8505895 - DNA, 22 bp, Homo sapiens
tgtcttacatgagtcaccccaa

SEQ ID NO: 8505896 - DNA, 17 bp, Homo sapiens
tgtcttatctgtcctgt

SEQ ID NO: 8505897 - DNA, 22 bp, Homo sapiens
tgtcttcacatgataagccatt

SEQ ID NO: 8505898 - DNA, 22 bp, Homo sapiens
tgtcttcactcaagtctcttgg

SEQ ID NO: 8505899 - DNA, 22 bp, Homo sapiens
tgtcttcaaatattgaaatcct

SEQ ID NO: 8505900 - DNA, 22 bp, Homo sapiens
tgtcttcagcaaatgcctttct

SEQ ID NO: 8505901 - DNA, 22 bp, Homo sapiens
tgtcttcagataggcattcttc

SEQ ID NO: 8505902 - DNA, 22 bp, Homo sapiens
tgtcttcagataggcattcttc

SEQ ID NO: 8505903 - DNA, 22 bp, Homo sapiens
tgtcttcagataggcattcttc

SEQ ID NO: 8505904 - DNA, 22 bp, Homo sapiens
tgtcttcaggagtaaatatcat

SEQ ID NO: 8505905 - DNA, 22 bp, Homo sapiens
tgtcttcagcagtcatctgggg

SEQ ID NO: 8505906 - DNA, 22 bp, Homo sapiens
tgtcttcagcagtcatctgggg

SEQ ID NO: 8505907 - DNA, 22 bp, Homo sapiens
tgtctttttacctgtgatgagt

SEQ ID NO: 8505908 - DNA, 22 bp, Homo sapiens
tgtcttttggagcatctttctt

SEQ ID NO: 8505909 - DNA, 22 bp, Homo sapiens
tgtcttttggagcatctttctt

SEQ ID NO: 8505910 - DNA, 22 bp, Homo sapiens
tgtgaaaaaagttctagaagga

SEQ ID NO: 8505911 - DNA, 22 bp, Homo sapiens
tgtgaaaaaagttctagaagga

SEQ ID NO: 8505912 - DNA, 22 bp, Homo sapiens
tgtgaaaaaagttctagaagga

SEQ ID NO: 8505913 - DNA, 22 bp, Homo sapiens
tgtgaaaaaagttctagaagga

SEQ ID NO: 8505914 - DNA, 22 bp, Homo sapiens
tgtgaaaagggctttgtacaaa

SEQ ID NO: 8505915 - DNA, 22 bp, Homo sapiens
tgtgaaaagggctttgtacaaa

SEQ ID NO: 8505916 - DNA, 22 bp, Homo sapiens
tgtgaaacggagtcagggaagg

SEQ ID NO: 8505917 - DNA, 22 bp, Homo sapiens
tgtgaaaagcgtgtgttctagg

SEQ ID NO: 8505918 - DNA, 22 bp, Homo sapiens
tgtgaaaagcgtgtgttctagg

SEQ ID NO: 8505919 - DNA, 22 bp, Homo sapiens
tgtgaaaagcgtgtgttctagg

SEQ ID NO: 8505920 - DNA, 22 bp, Homo sapiens
tgtgaaaagcgtgtgttctagg

SEQ ID NO: 8505921 - DNA, 22 bp, Homo sapiens
tgtgaaaagcaggctactttct

SEQ ID NO: 8505922 - DNA, 22 bp, Homo sapiens
tgtcttttacctaatgagctgg

SEQ ID NO: 8505923 - DNA, 22 bp, Homo sapiens
tgtctttgttattgtggacagg

SEQ ID NO: 8505924 - DNA, 22 bp, Homo sapiens
tgtctttgtgtacaggatcgcc

SEQ ID NO: 8505925 - DNA, 23 bp, Homo sapiens
tgtctttgttaggactgtgttta

SEQ ID NO: 8505926 - DNA, 22 bp, Homo sapiens
tgtctttggggctgtacctgtt

SEQ ID NO: 8505927 - DNA, 19 bp, Homo sapiens
tgtctttggtctgagtttc

SEQ ID NO: 8505928 - DNA, 22 bp, Homo sapiens
tgtctttaattctacatatctc

SEQ ID NO: 8505929 - DNA, 22 bp, Homo sapiens
tgtcttttataactgacatata

SEQ ID NO: 8505930 - DNA, 22 bp, Homo sapiens
tgtcttttagtttgtgagatct

SEQ ID NO: 8505931 - DNA, 22 bp, Homo sapiens
tgtcttttacctaatgagctgg

SEQ ID NO: 8505932 - DNA, 22 bp, Homo sapiens
tgtcttttacctaatgagctgg

SEQ ID NO: 8505933 - DNA, 22 bp, Homo sapiens
tgtcttttctactgtaagcata

SEQ ID NO: 8505934 - DNA, 22 bp, Homo sapiens
tgtcttttgccaaagatcagtt

SEQ ID NO: 8505935 - DNA, 22 bp, Homo sapiens
tgtcttttgccaaagatcagtt

SEQ ID NO: 8505936 - DNA, 22 bp, Homo sapiens
tgtcttctaccttgacagcatt

SEQ ID NO: 8505937 - DNA, 22 bp, Homo sapiens
tgtcttcgctacaatgaaaagg

SEQ ID NO: 8505938 - DNA, 22 bp, Homo sapiens
tgtcttctaccttgacagcatt

SEQ ID NO: 8505939 - DNA, 22 bp, Homo sapiens
tgtcttctaccttgacagcatt

SEQ ID NO: 8505940 - DNA, 22 bp, Homo sapiens
tgtcttctaccttgacagcatt

SEQ ID NO: 8505941 - DNA, 22 bp, Homo sapiens
tgtcttcttcataaggagagtg

SEQ ID NO: 8505942 - DNA, 22 bp, Homo sapiens
tgtcttctgtattcaagtctat

SEQ ID NO: 8505943 - DNA, 22 bp, Homo sapiens
tgtcttctgtattcaagtctat

SEQ ID NO: 8505944 - DNA, 17 bp, Homo sapiens
tgtcttctgaagagagc

SEQ ID NO: 8505945 - DNA, 22 bp, Homo sapiens
tgtcttctgtattcaagtctat

SEQ ID NO: 8505946 - DNA, 17 bp, Homo sapiens
tgtcttctgaagagagc

SEQ ID NO: 8505947 - DNA, 22 bp, Homo sapiens
tgtctttaagcaaacagtgttt

SEQ ID NO: 8505948 - DNA, 22 bp, Homo sapiens
tgtctttaagcaaacagtgttt

SEQ ID NO: 8505949 - DNA, 22 bp, Homo sapiens
tgtcttgtctgtgagggcattg

SEQ ID NO: 8505950 - DNA, 22 bp, Homo sapiens
tgtcttgattagaatgatgggc

SEQ ID NO: 8505951 - DNA, 22 bp, Homo sapiens
tgtcttcatctccatgcacaga

SEQ ID NO: 8505952 - DNA, 22 bp, Homo sapiens
tgtcttcagtaaaatacactat

SEQ ID NO: 8505953 - DNA, 22 bp, Homo sapiens
tgtcttcagtaaaatacactat

SEQ ID NO: 8505954 - DNA, 22 bp, Homo sapiens
tgtcttcagtaaaatacactat

SEQ ID NO: 8505955 - DNA, 22 bp, Homo sapiens
tgtcttcatctccatgcacaga

SEQ ID NO: 8505956 - DNA, 22 bp, Homo sapiens
tgtcttcatctccatgcacaga

SEQ ID NO: 8505957 - DNA, 20 bp, Homo sapiens
tgtcttcattatggtgccct

SEQ ID NO: 8505958 - DNA, 20 bp, Homo sapiens
tgtcttcattatggtgccct

SEQ ID NO: 8505959 - DNA, 22 bp, Homo sapiens
tgtcttcattctgtatgtccag

SEQ ID NO: 8505960 - DNA, 22 bp, Homo sapiens
tgtctctgctgcaccttctggg

SEQ ID NO: 8505961 - DNA, 22 bp, Homo sapiens
tgtctctgctgcaccttctggg

SEQ ID NO: 8505962 - DNA, 22 bp, Homo sapiens
tgtctctgctttccttgcaggg

SEQ ID NO: 8505963 - DNA, 22 bp, Homo sapiens
tgtctctgctttccttgcaggg

SEQ ID NO: 8505964 - DNA, 22 bp, Homo sapiens
tgtctcttggctctatcactta

SEQ ID NO: 8505965 - DNA, 22 bp, Homo sapiens
tgtctctttgggttcctcttgg

SEQ ID NO: 8505966 - DNA, 22 bp, Homo sapiens
tgtctctttggcctcccatatg

SEQ ID NO: 8505967 - DNA, 22 bp, Homo sapiens
tgtctcttttcaagctaccctt

SEQ ID NO: 8505968 - DNA, 22 bp, Homo sapiens
tgtctcttttcaagctaccctt

SEQ ID NO: 8505969 - DNA, 22 bp, Homo sapiens
tgtctgaaagaggacgagctgg

SEQ ID NO: 8505970 - DNA, 22 bp, Homo sapiens
tgtctgaaaggctttttctcac

SEQ ID NO: 8505971 - DNA, 22 bp, Homo sapiens
tgtctgaacaaactctgcctcc

SEQ ID NO: 8505972 - DNA, 22 bp, Homo sapiens
tgtctgaaagaggacgagctgg

SEQ ID NO: 8505973 - DNA, 22 bp, Homo sapiens
tgtctgaaacttggtcctatgc

SEQ ID NO: 8505974 - DNA, 20 bp, Homo sapiens
tgtctgaaaaggaagctatc

SEQ ID NO: 8505975 - DNA, 22 bp, Homo sapiens
tgtctgaaacttatgatatact

SEQ ID NO: 8505976 - DNA, 22 bp, Homo sapiens
tgtctctgaggtgagggtcagc

SEQ ID NO: 8505977 - DNA, 22 bp, Homo sapiens
tgtctctgagatgactcccacc

SEQ ID NO: 8505978 - DNA, 18 bp, Homo sapiens
tgtctctgaattccagtg

SEQ ID NO: 8505979 - DNA, 22 bp, Homo sapiens
tgtctctgataagtagttcagt

SEQ ID NO: 8505980 - DNA, 22 bp, Homo sapiens
tgtctctgccagctagcagaat

SEQ ID NO: 8505981 - DNA, 19 bp, Homo sapiens
tgtctctgaaagatgagct

SEQ ID NO: 8505982 - DNA, 22 bp, Homo sapiens
tgtctctctgcccccattgctc

SEQ ID NO: 8505983 - DNA, 22 bp, Homo sapiens
tgtctctgaagccccctccttt

SEQ ID NO: 8505984 - DNA, 22 bp, Homo sapiens
tgtctctgaacagcttactaaa

SEQ ID NO: 8505985 - DNA, 22 bp, Homo sapiens
tgtctctgaaatatgtggctcc

SEQ ID NO: 8505986 - DNA, 22 bp, Homo sapiens
tgtctctgaaatatgtggctcc

SEQ ID NO: 8505987 - DNA, 18 bp, Homo sapiens
tgtctgaagccacttttt

SEQ ID NO: 8505988 - DNA, 22 bp, Homo sapiens
tgtctgaagcagccagtgctgt

SEQ ID NO: 8505989 - DNA, 22 bp, Homo sapiens
tgtctgaagcactgggcgttgc

SEQ ID NO: 8505990 - DNA, 22 bp, Homo sapiens
tgtctgaactgcatttgctcct

SEQ ID NO: 8505991 - DNA, 22 bp, Homo sapiens
tgtctgaactgcactgaaagac

SEQ ID NO: 8505992 - DNA, 22 bp, Homo sapiens
tgtctgaacgaagtaggtccac

SEQ ID NO: 8505993 - DNA, 22 bp, Homo sapiens
tgtctgaaccctggccctgcct

SEQ ID NO: 8505994 - DNA, 22 bp, Homo sapiens
tgtctgaattcaagaaattcaa

SEQ ID NO: 8505995 - DNA, 22 bp, Homo sapiens
tgtctgaatctcggtttcctca

SEQ ID NO: 8505996 - DNA, 22 bp, Homo sapiens
tgtctgaatcgcttcctagagg

SEQ ID NO: 8505997 - DNA, 22 bp, Homo sapiens
tgtctgaaggcaggtggagaac

SEQ ID NO: 8505998 - DNA, 22 bp, Homo sapiens
tgtctgaaggcctgacctacat

SEQ ID NO: 8505999 - DNA, 22 bp, Homo sapiens
tgtctgaatcgcttcctagagg

SEQ ID NO: 8506000 - DNA, 22 bp, Homo sapiens
tgtctgaaggcctgacctacat

SEQ ID NO: 8506001 - DNA, 22 bp, Homo sapiens
tgtctgagtcatgcagagatat

SEQ ID NO: 8506002 - DNA, 22 bp, Homo sapiens
tgtctgagctggggcagacaga

SEQ ID NO: 8506003 - DNA, 22 bp, Homo sapiens
tgtctgaattccacatcgttct

SEQ ID NO: 8506004 - DNA, 22 bp, Homo sapiens
tgtctgaattttggaatcaagt

SEQ ID NO: 8506005 - DNA, 22 bp, Homo sapiens
tgtctgagcacctgtgctgaac

SEQ ID NO: 8506006 - DNA, 22 bp, Homo sapiens
tgtctgagtgtgcctgggcatt

SEQ ID NO: 8506007 - DNA, 22 bp, Homo sapiens
tgtctgatgatagtgtctctcc

SEQ ID NO: 8506008 - DNA, 22 bp, Homo sapiens
tgtctgcagaagatggcatggg

SEQ ID NO: 8506009 - DNA, 22 bp, Homo sapiens
tgtctgccattagcccagtcca

SEQ ID NO: 8506010 - DNA, 21 bp, Homo sapiens
tgtctgcctgcttcttcactc

SEQ ID NO: 8506011 - DNA, 22 bp, Homo sapiens
tgtctgcctgcgggccggcaca

SEQ ID NO: 8506012 - DNA, 23 bp, Homo sapiens
tgtctccatctcattacttgggg

SEQ ID NO: 8506013 - DNA, 22 bp, Homo sapiens
tgtctccatgtgatagtggcct

SEQ ID NO: 8506014 - DNA, 22 bp, Homo sapiens
tgtctccattttcaagtagcag

SEQ ID NO: 8506015 - DNA, 22 bp, Homo sapiens
tgtctcctcaactcatgctcga

SEQ ID NO: 8506016 - DNA, 22 bp, Homo sapiens
tgtctcctatttcctgctaagg

SEQ ID NO: 8506017 - DNA, 19 bp, Homo sapiens
tgtctcctcatgcaagtgt

SEQ ID NO: 8506018 - DNA, 22 bp, Homo sapiens
tgtctctccacacagccagtgc

SEQ ID NO: 8506019 - DNA, 18 bp, Homo sapiens
tgtctctcctttctgtgt

SEQ ID NO: 8506020 - DNA, 18 bp, Homo sapiens
tgtctctcctttctgtgt

SEQ ID NO: 8506021 - DNA, 21 bp, Homo sapiens
tgtctcctgttggcacatggc

SEQ ID NO: 8506022 - DNA, 22 bp, Homo sapiens
tgtctcctgggtcccttccacc

SEQ ID NO: 8506023 - DNA, 22 bp, Homo sapiens
tgtctcctgagagctggacaga

SEQ ID NO: 8506024 - DNA, 22 bp, Homo sapiens
tgtctccaaaacaatctcagat

SEQ ID NO: 8506025 - DNA, 22 bp, Homo sapiens
tgtctccaaaacaatctcagat

SEQ ID NO: 8506026 - DNA, 22 bp, Homo sapiens
tgtctccaaaacaatctcagat

SEQ ID NO: 8506027 - DNA, 22 bp, Homo sapiens
tgtctccaactcactgtatact

SEQ ID NO: 8506028 - DNA, 22 bp, Homo sapiens
tgtctccaactcactgtatact

SEQ ID NO: 8506029 - DNA, 22 bp, Homo sapiens
tgtctccaactcactgtatact

SEQ ID NO: 8506030 - DNA, 22 bp, Homo sapiens
tgtctccaactcactgtatact

SEQ ID NO: 8506031 - DNA, 22 bp, Homo sapiens
tgtctccaaaacaatctcagat

SEQ ID NO: 8506032 - DNA, 22 bp, Homo sapiens
tgtctatagcctgatttgttgg

SEQ ID NO: 8506033 - DNA, 22 bp, Homo sapiens
tgtctccatagaagagactgca

SEQ ID NO: 8506034 - DNA, 22 bp, Homo sapiens
tgtctccatagaagagactgca

SEQ ID NO: 8506035 - DNA, 22 bp, Homo sapiens
tgtctccatagagtagcttgat

SEQ ID NO: 8506036 - DNA, 22 bp, Homo sapiens
tgtctccagaaagcaccaggag

SEQ ID NO: 8506037 - DNA, 22 bp, Homo sapiens
tgtctccaccatcatcttacca

SEQ ID NO: 8506038 - DNA, 20 bp, Homo sapiens
tgtctccagggctgagtgga

SEQ ID NO: 8506039 - DNA, 22 bp, Homo sapiens
tgtctccacaggtgtcagctca

SEQ ID NO: 8506040 - DNA, 22 bp, Homo sapiens
tgtctccaccatcatcttacca

SEQ ID NO: 8506041 - DNA, 22 bp, Homo sapiens
tgtctccacaggtgtcagctca

SEQ ID NO: 8506042 - DNA, 22 bp, Homo sapiens
tgtctaatggcaatttcatgtg

SEQ ID NO: 8506043 - DNA, 22 bp, Homo sapiens
tgtctacaaacgtgtacacatt

SEQ ID NO: 8506044 - DNA, 22 bp, Homo sapiens
tgtcgattcagctcttcagaga

SEQ ID NO: 8506045 - DNA, 22 bp, Homo sapiens
tgtctaaatgcaatggatttcc

SEQ ID NO: 8506046 - DNA, 22 bp, Homo sapiens
tgtctaaacttgttttatctca

SEQ ID NO: 8506047 - DNA, 22 bp, Homo sapiens
tgtctacttgggctctacagca

SEQ ID NO: 8506048 - DNA, 22 bp, Homo sapiens
tgtctacttgggctctacagca

SEQ ID NO: 8506049 - DNA, 22 bp, Homo sapiens
tgtctactgctgacactaacag

SEQ ID NO: 8506050 - DNA, 22 bp, Homo sapiens
tgtctactcctgtgctagctcc

SEQ ID NO: 8506051 - DNA, 17 bp, Homo sapiens
tgtctactctgactaaa

SEQ ID NO: 8506052 - DNA, 22 bp, Homo sapiens
tgtctactgagaagctatgcaa

SEQ ID NO: 8506053 - DNA, 22 bp, Homo sapiens
tgtctagggagctgctcaggct

SEQ ID NO: 8506054 - DNA, 22 bp, Homo sapiens
ttagtaatgtgttaatatgaat

SEQ ID NO: 8506055 - DNA, 22 bp, Homo sapiens
ttagtaatgtgttaatatgaat

SEQ ID NO: 8506056 - DNA, 22 bp, Homo sapiens
ttagtaaataaagtctactttc

SEQ ID NO: 8506057 - DNA, 22 bp, Homo sapiens
ttaggtaagtaggatcaaaaaa

SEQ ID NO: 8506058 - DNA, 22 bp, Homo sapiens
ttaggtaaggatggtgacagta

SEQ ID NO: 8506059 - DNA, 22 bp, Homo sapiens
ttagggttacaccagcctcctg

SEQ ID NO: 8506060 - DNA, 22 bp, Homo sapiens
ttaggtaaggatggtgacagta

SEQ ID NO: 8506061 - DNA, 22 bp, Homo sapiens
ttaggtaaggatggtgacagta

SEQ ID NO: 8506062 - DNA, 22 bp, Homo sapiens
ttaggtctgtttataaaacagt

SEQ ID NO: 8506063 - DNA, 22 bp, Homo sapiens
ttaggtcattccctgagcagat

SEQ ID NO: 8506064 - DNA, 22 bp, Homo sapiens
ttagggaaggacagtgaagaaa

SEQ ID NO: 8506065 - DNA, 22 bp, Homo sapiens
ttagggaagtgttattctcagg

SEQ ID NO: 8506066 - DNA, 22 bp, Homo sapiens
ttagggaaatatttatatactt

SEQ ID NO: 8506067 - DNA, 22 bp, Homo sapiens
ttagggaaatatttatatactt

SEQ ID NO: 8506068 - DNA, 22 bp, Homo sapiens
ttagggaagtgttattctcagg

SEQ ID NO: 8506069 - DNA, 22 bp, Homo sapiens
ttagggagctcagtcctcagat

SEQ ID NO: 8506070 - DNA, 22 bp, Homo sapiens
ttagcatttcagtacacatgtt

SEQ ID NO: 8506071 - DNA, 22 bp, Homo sapiens
ttagcatttctggaatcacaag

SEQ ID NO: 8506072 - DNA, 22 bp, Homo sapiens
ttaggaaattatggtttcagat

SEQ ID NO: 8506073 - DNA, 22 bp, Homo sapiens
ttaggaaattccacctgtattc

SEQ ID NO: 8506074 - DNA, 22 bp, Homo sapiens
ttaggaagaaggaggcagtatt

SEQ ID NO: 8506075 - DNA, 22 bp, Homo sapiens
ttaggaagagctttcaatcact

SEQ ID NO: 8506076 - DNA, 22 bp, Homo sapiens
ttagatttacaagcactgttta

SEQ ID NO: 8506077 - DNA, 22 bp, Homo sapiens
ttagatttatatgtgagaatgg

SEQ ID NO: 8506078 - DNA, 22 bp, Homo sapiens
ttagcaaacaaatgaaatggtt

SEQ ID NO: 8506079 - DNA, 17 bp, Homo sapiens
ttagcaaaatagcactt

SEQ ID NO: 8506080 - DNA, 22 bp, Homo sapiens
ttagcaaaaatatctcatatta

SEQ ID NO: 8506081 - DNA, 20 bp, Homo sapiens
ttagcagtagagtgtgcttc

SEQ ID NO: 8506082 - DNA, 22 bp, Homo sapiens
ttagcagttcattgattatcgt

SEQ ID NO: 8506083 - DNA, 21 bp, Homo sapiens
ttagcagttgttgatttccag

SEQ ID NO: 8506084 - DNA, 22 bp, Homo sapiens
ttagcagtttccattttggtca

SEQ ID NO: 8506085 - DNA, 22 bp, Homo sapiens
ttagcactggatttcatcagaa

SEQ ID NO: 8506086 - DNA, 22 bp, Homo sapiens
ttagcactgtctggttatcttg

SEQ ID NO: 8506087 - DNA, 22 bp, Homo sapiens
ttagcactttgattcatgcaga

SEQ ID NO: 8506088 - DNA, 22 bp, Homo sapiens
ttagatcttaggcaaatgtgtt

SEQ ID NO: 8506089 - DNA, 22 bp, Homo sapiens
ttagatcattttagctaaatgg

SEQ ID NO: 8506090 - DNA, 22 bp, Homo sapiens
ttagatacctttgtgttgtaga

SEQ ID NO: 8506091 - DNA, 22 bp, Homo sapiens
ttagatatgtttttgctaatgc

SEQ ID NO: 8506092 - DNA, 22 bp, Homo sapiens
ttagataatgtagagatatgag

SEQ ID NO: 8506093 - DNA, 22 bp, Homo sapiens
ttagataacagtagaatatcaa

SEQ ID NO: 8506094 - DNA, 22 bp, Homo sapiens
ttagataatgttattgtaattt

SEQ ID NO: 8506095 - DNA, 22 bp, Homo sapiens
ttagataacagtagaatatcaa

SEQ ID NO: 8506096 - DNA, 22 bp, Homo sapiens
ttagataaattgcaacttgatt

SEQ ID NO: 8506097 - DNA, 22 bp, Homo sapiens
ttagaaccagcatttgtcctgg

SEQ ID NO: 8506098 - DNA, 22 bp, Homo sapiens
ttagaaccagcatttgtcctgg

SEQ ID NO: 8506099 - DNA, 22 bp, Homo sapiens
ttagaaccaggaactctaatat

SEQ ID NO: 8506100 - DNA, 22 bp, Homo sapiens
ttagaaccagggttacgattct

SEQ ID NO: 8506101 - DNA, 22 bp, Homo sapiens
ttagaaccagggttacgattct

SEQ ID NO: 8506102 - DNA, 22 bp, Homo sapiens
ttagaaccataatgaatcaatg

SEQ ID NO: 8506103 - DNA, 22 bp, Homo sapiens
ttagaaccataatgaatcaatg

SEQ ID NO: 8506104 - DNA, 22 bp, Homo sapiens
ttagaacattccatcactgggt

SEQ ID NO: 8506105 - DNA, 22 bp, Homo sapiens
ttagaacatttttagaccaata

SEQ ID NO: 8506106 - DNA, 22 bp, Homo sapiens
ttagaaccactgaagactcaca

SEQ ID NO: 8506107 - DNA, 22 bp, Homo sapiens
ttagaaccacctggagagcttt

SEQ ID NO: 8506108 - DNA, 22 bp, Homo sapiens
ttagaacactgagaaagtgatg

SEQ ID NO: 8506109 - DNA, 22 bp, Homo sapiens
ttagaaatgatttcacctcttt

SEQ ID NO: 8506110 - DNA, 22 bp, Homo sapiens
ttagaaatctgctgccatgcaa

SEQ ID NO: 8506111 - DNA, 22 bp, Homo sapiens
ttagaaatctgctgccatgcaa

SEQ ID NO: 8506112 - DNA, 22 bp, Homo sapiens
ttagaaatgatttcacctcttt

SEQ ID NO: 8506113 - DNA, 22 bp, Homo sapiens
ttagaaatcacctctgaagatc

SEQ ID NO: 8506114 - DNA, 22 bp, Homo sapiens
ttagaaatcacctctgaagatc

SEQ ID NO: 8506115 - DNA, 22 bp, Homo sapiens
ttagaacaaagccaccaggtga

SEQ ID NO: 8506116 - DNA, 22 bp, Homo sapiens
ttagaaatgtcacagatctgat

SEQ ID NO: 8506117 - DNA, 22 bp, Homo sapiens
ttagaaatgtcacagatctgat

SEQ ID NO: 8506118 - DNA, 22 bp, Homo sapiens
ttagaaaggaatcttcatttca

SEQ ID NO: 8506119 - DNA, 22 bp, Homo sapiens
ttagaaagctttccatagtcaa

SEQ ID NO: 8506120 - DNA, 22 bp, Homo sapiens
ttagaaaggagcttatttcttt

SEQ ID NO: 8506121 - DNA, 22 bp, Homo sapiens
ttagaaaggagcttatttcttt

SEQ ID NO: 8506122 - DNA, 22 bp, Homo sapiens
ttagaaagctttccatagtcaa

SEQ ID NO: 8506123 - DNA, 22 bp, Homo sapiens
ttacattttggggtaaggataa

SEQ ID NO: 8506124 - DNA, 22 bp, Homo sapiens
ttacattttgcacagatgtccc

SEQ ID NO: 8506125 - DNA, 22 bp, Homo sapiens
ttagaaaggttttgctctgaaa

SEQ ID NO: 8506126 - DNA, 22 bp, Homo sapiens
ttagaaagggtgtctgaatctg

SEQ ID NO: 8506127 - DNA, 22 bp, Homo sapiens
ttagaaatacaagtgaggttga

SEQ ID NO: 8506128 - DNA, 22 bp, Homo sapiens
ttagaaatacaagtgaggttga

SEQ ID NO: 8506129 - DNA, 22 bp, Homo sapiens
ttatctgtctatcaagactagc

SEQ ID NO: 8506130 - DNA, 22 bp, Homo sapiens
ttatctgtctatcaagactagc

SEQ ID NO: 8506131 - DNA, 22 bp, Homo sapiens
ttatctgtgatcctaaatgtct

SEQ ID NO: 8506132 - DNA, 20 bp, Homo sapiens
ttatctgtcaatctgtctca

SEQ ID NO: 8506133 - DNA, 22 bp, Homo sapiens
ttatctgttgttttagtacaat

SEQ ID NO: 8506134 - DNA, 22 bp, Homo sapiens
ttatctgtttaacaaagtatct

SEQ ID NO: 8506135 - DNA, 22 bp, Homo sapiens
ttatcttagaggtgattgtatt

SEQ ID NO: 8506136 - DNA, 22 bp, Homo sapiens
ttatctgttgttttagtacaat

SEQ ID NO: 8506137 - DNA, 19 bp, Homo sapiens
ttatctgtgttgcagtggt

SEQ ID NO: 8506138 - DNA, 19 bp, Homo sapiens
ttatctgtgttgcagtggt

SEQ ID NO: 8506139 - DNA, 22 bp, Homo sapiens
ttagtgctcacgtgttagaaag

SEQ ID NO: 8506140 - DNA, 22 bp, Homo sapiens
ttatatgtatgcttataaacca

SEQ ID NO: 8506141 - DNA, 22 bp, Homo sapiens
ttatatgtatgcttataaacca

SEQ ID NO: 8506142 - DNA, 22 bp, Homo sapiens
ttatatgattgagcatcttggt

SEQ ID NO: 8506143 - DNA, 22 bp, Homo sapiens
ttatatgtatgcttataaacca

SEQ ID NO: 8506144 - DNA, 22 bp, Homo sapiens
ttatctgaaaacctcaaaatat

SEQ ID NO: 8506145 - DNA, 22 bp, Homo sapiens
ttatctgaaaacctcaaaatat

SEQ ID NO: 8506146 - DNA, 22 bp, Homo sapiens
ttatctgaaacttttgggacca

SEQ ID NO: 8506147 - DNA, 22 bp, Homo sapiens
ttagtgatcaaaatcaaaattg

SEQ ID NO: 8506148 - DNA, 22 bp, Homo sapiens
ttagtctctttgcattgccata

SEQ ID NO: 8506149 - DNA, 22 bp, Homo sapiens
ttagtcttcttccttatatgtt

SEQ ID NO: 8506150 - DNA, 22 bp, Homo sapiens
ttagtgaaaagaaaatgagtgg

SEQ ID NO: 8506151 - DNA, 22 bp, Homo sapiens
ttagtcccattatatgacttct

SEQ ID NO: 8506152 - DNA, 22 bp, Homo sapiens
ttagtcaatagtgaatatagag

SEQ ID NO: 8506153 - DNA, 22 bp, Homo sapiens
ttagtcaggaccttttggtttc

SEQ ID NO: 8506154 - DNA, 22 bp, Homo sapiens
ttagtcaatagtgaatatagag

SEQ ID NO: 8506155 - DNA, 22 bp, Homo sapiens
ttagtagtaagagtcatatgta

SEQ ID NO: 8506156 - DNA, 22 bp, Homo sapiens
ttattattgattcgctctcaaa

SEQ ID NO: 8506157 - DNA, 22 bp, Homo sapiens
ttattattccccaagtcattat

SEQ ID NO: 8506158 - DNA, 22 bp, Homo sapiens
ttatgcaaaggggcctcttcct

SEQ ID NO: 8506159 - DNA, 22 bp, Homo sapiens
ttatgcaaagaaatagactaat

SEQ ID NO: 8506160 - DNA, 22 bp, Homo sapiens
ttatgcaaagaaatagactaat

SEQ ID NO: 8506161 - DNA, 22 bp, Homo sapiens
ttatgatttgccacagattggt

SEQ ID NO: 8506162 - DNA, 22 bp, Homo sapiens
ttatgacatatgagtacaagta

SEQ ID NO: 8506163 - DNA, 22 bp, Homo sapiens
ttatgatttagaaagattcact

SEQ ID NO: 8506164 - DNA, 22 bp, Homo sapiens
ttatgagactgttttacacact

SEQ ID NO: 8506165 - DNA, 22 bp, Homo sapiens
ttatgatttagaaagattcact

SEQ ID NO: 8506166 - DNA, 22 bp, Homo sapiens
ttatgatttgccacagattggt

SEQ ID NO: 8506167 - DNA, 22 bp, Homo sapiens
ttatgatttgccacagattggt

SEQ ID NO: 8506168 - DNA, 22 bp, Homo sapiens
ttatcttgtagagatattttcg

SEQ ID NO: 8506169 - DNA, 22 bp, Homo sapiens
ttatgaaaacaatcagtaggca

SEQ ID NO: 8506170 - DNA, 17 bp, Homo sapiens
ttatcttgctgtttcta

SEQ ID NO: 8506171 - DNA, 22 bp, Homo sapiens
ttatctgttttctgtgcgtttc

SEQ ID NO: 8506172 - DNA, 22 bp, Homo sapiens
ttatcttggtgttttagtaatt

SEQ ID NO: 8506173 - DNA, 22 bp, Homo sapiens
ttatcttgggtaactttgtgca

SEQ ID NO: 8506174 - DNA, 22 bp, Homo sapiens
ttatgaaagacatttctgttgg

SEQ ID NO: 8506175 - DNA, 22 bp, Homo sapiens
ttatgaaagacatttctgttgg

SEQ ID NO: 8506176 - DNA, 22 bp, Homo sapiens
ttatgaaggatcaggtacttgg

SEQ ID NO: 8506177 - DNA, 22 bp, Homo sapiens
ttatgaagttcctgttacagtg

SEQ ID NO: 8506178 - DNA, 19 bp, Homo sapiens
ttatgaatagcttcatcca

SEQ ID NO: 8506179 - DNA, 22 bp, Homo sapiens
ttatgacaggaaaatcacagaa

SEQ ID NO: 8506180 - DNA, 22 bp, Homo sapiens
ttatgacagaaatgaaaagctg

SEQ ID NO: 8506181 - DNA, 22 bp, Homo sapiens
ttatttatggcactgttggtgg

SEQ ID NO: 8506182 - DNA, 22 bp, Homo sapiens
ttattcttggatctgagtctct

SEQ ID NO: 8506183 - DNA, 22 bp, Homo sapiens
ttatttatggccctcacctgat

SEQ ID NO: 8506184 - DNA, 22 bp, Homo sapiens
ttatttatgttaacagtcgaga

SEQ ID NO: 8506185 - DNA, 22 bp, Homo sapiens
ttatttatgttaacagtcgaga

SEQ ID NO: 8506186 - DNA, 22 bp, Homo sapiens
ttatttatggccctcacctgat

SEQ ID NO: 8506187 - DNA, 22 bp, Homo sapiens
ttatttccctgagggttgcagg

SEQ ID NO: 8506188 - DNA, 22 bp, Homo sapiens
ttatttcctaaatctctttgtt

SEQ ID NO: 8506189 - DNA, 20 bp, Homo sapiens
ttatttccagtccaggtcct

SEQ ID NO: 8506190 - DNA, 22 bp, Homo sapiens
ttatttccagtccagaaattta

SEQ ID NO: 8506191 - DNA, 22 bp, Homo sapiens
ttatttccaaactggatatacc

SEQ ID NO: 8506192 - DNA, 22 bp, Homo sapiens
ttatttccacaatgtggtaggg

SEQ ID NO: 8506193 - DNA, 22 bp, Homo sapiens
ttatttcattgatttctaagac

SEQ ID NO: 8506194 - DNA, 22 bp, Homo sapiens
ttatttcattgatttctaagac

SEQ ID NO: 8506195 - DNA, 22 bp, Homo sapiens
ttattcttcttctcttgccagg

SEQ ID NO: 8506196 - DNA, 22 bp, Homo sapiens
ttattcttggatctgagtctct

SEQ ID NO: 8506197 - DNA, 22 bp, Homo sapiens
ttattctgttgttcagggttgg

SEQ ID NO: 8506198 - DNA, 22 bp, Homo sapiens
ttattctgtttgccgaccagta

SEQ ID NO: 8506199 - DNA, 22 bp, Homo sapiens
ttattctgtttgccgaccagta

SEQ ID NO: 8506200 - DNA, 22 bp, Homo sapiens
ttattctgttgcttttacagta

SEQ ID NO: 8506201 - DNA, 22 bp, Homo sapiens
ttattctgttggccctctcatc

SEQ ID NO: 8506202 - DNA, 22 bp, Homo sapiens
ttattctgtgaacatggttaat

SEQ ID NO: 8506203 - DNA, 19 bp, Homo sapiens
ttattctgtcagagcacac

SEQ ID NO: 8506204 - DNA, 22 bp, Homo sapiens
ttattctgtctttggtctcaat

SEQ ID NO: 8506205 - DNA, 22 bp, Homo sapiens
ttattctgtcaaacttatacat

SEQ ID NO: 8506206 - DNA, 22 bp, Homo sapiens
ttattctggaggaagcaaatgg

SEQ ID NO: 8506207 - DNA, 17 bp, Homo sapiens
ttattctggcatatgtg

SEQ ID NO: 8506208 - DNA, 22 bp, Homo sapiens
ttattctgtcaaacttatacat

SEQ ID NO: 8506209 - DNA, 22 bp, Homo sapiens
ttattctgtatttcaggtatgt

SEQ ID NO: 8506210 - DNA, 22 bp, Homo sapiens
ttattctgtagaacctagtaca

SEQ ID NO: 8506211 - DNA, 22 bp, Homo sapiens
ttattctgtatttcaggtatgt

SEQ ID NO: 8506212 - DNA, 22 bp, Homo sapiens
ttattctgtatttcaggtatgt

SEQ ID NO: 8506213 - DNA, 22 bp, Homo sapiens
ttattcatcagtgcattaattt

SEQ ID NO: 8506214 - DNA, 22 bp, Homo sapiens
ttattcatcagtgcattaattt

SEQ ID NO: 8506215 - DNA, 22 bp, Homo sapiens
ttattccaaatcatggttgcat

SEQ ID NO: 8506216 - DNA, 22 bp, Homo sapiens
ttattcatcagtgcattaattt

SEQ ID NO: 8506217 - DNA, 22 bp, Homo sapiens
ttattccacctccattttccta

SEQ ID NO: 8506218 - DNA, 22 bp, Homo sapiens
ttattccacagctcagaatttt

SEQ ID NO: 8506219 - DNA, 22 bp, Homo sapiens
ttattccaaatcatggttgcat

SEQ ID NO: 8506220 - DNA, 22 bp, Homo sapiens
ttattccaatttctcctacaaa

SEQ ID NO: 8506221 - DNA, 22 bp, Homo sapiens
ttattcagggataacatccagg

SEQ ID NO: 8506222 - DNA, 22 bp, Homo sapiens
ttattcagggataacatccagg

SEQ ID NO: 8506223 - DNA, 22 bp, Homo sapiens
ttattattggtgagttaaggaa

SEQ ID NO: 8506224 - DNA, 22 bp, Homo sapiens
ttattcaggaaggtgttactta

SEQ ID NO: 8506225 - DNA, 22 bp, Homo sapiens
ttattcaggaggtgctcgaagg

SEQ ID NO: 8506226 - DNA, 22 bp, Homo sapiens
ttattcaggctctctttggcta

SEQ ID NO: 8506227 - DNA, 22 bp, Homo sapiens
ttattattgattcgctctcaaa

SEQ ID NO: 8506228 - DNA, 22 bp, Homo sapiens
ttattattgattcgctctcaaa

SEQ ID NO: 8506229 - DNA, 22 bp, Homo sapiens
ttattattgattcgctctcaaa

SEQ ID NO: 8506230 - DNA, 22 bp, Homo sapiens
ttattcagtctgtctagggagt

SEQ ID NO: 8506231 - DNA, 22 bp, Homo sapiens
ttattcagtgcatatattaaaa

SEQ ID NO: 8506232 - DNA, 22 bp, Homo sapiens
ttattcaggtcatggactgtca

SEQ ID NO: 8506233 - DNA, 22 bp, Homo sapiens
ttattcagtgcatatattaaaa

SEQ ID NO: 8506234 - DNA, 22 bp, Homo sapiens
ttattcagtgcctttgaaagaa

SEQ ID NO: 8506235 - DNA, 22 bp, Homo sapiens
ttattcagttcccttcactctc

SEQ ID NO: 8506236 - DNA, 22 bp, Homo sapiens
ttattcagttcccttcactctc

SEQ ID NO: 8506237 - DNA, 22 bp, Homo sapiens
ttattcagtttgtgtagaggtg

SEQ ID NO: 8506238 - DNA, 22 bp, Homo sapiens
ttattccagtaatctctgtaat

SEQ ID NO: 8506239 - DNA, 22 bp, Homo sapiens
ttattccagtgggtggtttctc

SEQ ID NO: 8506240 - DNA, 22 bp, Homo sapiens
ttattccaggtacttggtttct

SEQ ID NO: 8506241 - DNA, 22 bp, Homo sapiens
ttattccattcagttcaacaag

SEQ ID NO: 8506242 - DNA, 22 bp, Homo sapiens
ttattccattgtcttttgactt

SEQ ID NO: 8506243 - DNA, 22 bp, Homo sapiens
ttattccattatttcacttagg

SEQ ID NO: 8506244 - DNA, 22 bp, Homo sapiens
ttattctgcacttttaaaatat

SEQ ID NO: 8506245 - DNA, 21 bp, Homo sapiens
ttattctgagatgagattctt

SEQ ID NO: 8506246 - DNA, 22 bp, Homo sapiens
ttattctgccaggagcgtcagt

SEQ ID NO: 8506247 - DNA, 22 bp, Homo sapiens
ttattctgagagttgaagtaat

SEQ ID NO: 8506248 - DNA, 22 bp, Homo sapiens
ttattctgactaatgtataact

SEQ ID NO: 8506249 - DNA, 22 bp, Homo sapiens
ttattctgactaatgtataact

SEQ ID NO: 8506250 - DNA, 22 bp, Homo sapiens
ttattctcatctccctacttag

SEQ ID NO: 8506251 - DNA, 22 bp, Homo sapiens
ttattctgaactagactctcat

SEQ ID NO: 8506252 - DNA, 22 bp, Homo sapiens
ttattctgaactagactctcat

SEQ ID NO: 8506253 - DNA, 22 bp, Homo sapiens
ttaataaagtatgaattggaaa

SEQ ID NO: 8506254 - DNA, 22 bp, Homo sapiens
ttaataacattgtgtatcaccc

SEQ ID NO: 8506255 - DNA, 22 bp, Homo sapiens
ttaataaagtatgaattggaaa

SEQ ID NO: 8506256 - DNA, 22 bp, Homo sapiens
ttaataacattgtgtatcaccc

SEQ ID NO: 8506257 - DNA, 22 bp, Homo sapiens
ttaatacaactgttgtcactgg

SEQ ID NO: 8506258 - DNA, 22 bp, Homo sapiens
ttaatacaactgttgtcactgg

SEQ ID NO: 8506259 - DNA, 22 bp, Homo sapiens
ttaatacaactgttgtcactgg

SEQ ID NO: 8506260 - DNA, 22 bp, Homo sapiens
ttaatacaagcatatgcacaca

SEQ ID NO: 8506261 - DNA, 22 bp, Homo sapiens
ttaatggatgcggctgcgtgac

SEQ ID NO: 8506262 - DNA, 18 bp, Homo sapiens
ttaatgtggcttactatg

SEQ ID NO: 8506263 - DNA, 22 bp, Homo sapiens
ttaatgtggaaagctcttgagt

SEQ ID NO: 8506264 - DNA, 22 bp, Homo sapiens
ttaatgtcaacatttctgaaga

SEQ ID NO: 8506265 - DNA, 22 bp, Homo sapiens
ttaatacagaagcaagacactg

SEQ ID NO: 8506266 - DNA, 22 bp, Homo sapiens
ttaatacactatatgatcacat

SEQ ID NO: 8506267 - DNA, 22 bp, Homo sapiens
ttaatacactatatgatcacat

SEQ ID NO: 8506268 - DNA, 22 bp, Homo sapiens
ttaatacagtctccagaagtaa

SEQ ID NO: 8506269 - DNA, 22 bp, Homo sapiens
ttaatacagtctccagaagtaa

SEQ ID NO: 8506270 - DNA, 22 bp, Homo sapiens
ttaatacagtctccagaagtaa

SEQ ID NO: 8506271 - DNA, 22 bp, Homo sapiens
ttaaagaatagtgcccctattg

SEQ ID NO: 8506272 - DNA, 22 bp, Homo sapiens
ttaaagaatagtgcccctattg

SEQ ID NO: 8506273 - DNA, 22 bp, Homo sapiens
ttaaagagaactcaatgaatga

SEQ ID NO: 8506274 - DNA, 22 bp, Homo sapiens
ttaaactatagcttgatgtgaa

SEQ ID NO: 8506275 - DNA, 22 bp, Homo sapiens
ttaaaccatagtttaacataag

SEQ ID NO: 8506276 - DNA, 22 bp, Homo sapiens
ttaaactgcagactcagtgttc

SEQ ID NO: 8506277 - DNA, 22 bp, Homo sapiens
ttaaagaggcatgggaatgtat

SEQ ID NO: 8506278 - DNA, 22 bp, Homo sapiens
ttaaagaggcatgggaatgtat

SEQ ID NO: 8506279 - DNA, 22 bp, Homo sapiens
ttaaagagtctactgcacatcc

SEQ ID NO: 8506280 - DNA, 22 bp, Homo sapiens
ttaataaagtatgaattggaaa

SEQ ID NO: 8506281 - DNA, 22 bp, Homo sapiens
ttaataaagtatgaattggaaa

SEQ ID NO: 8506282 - DNA, 22 bp, Homo sapiens
ttaataaagtatgaattggaaa

SEQ ID NO: 8506283 - DNA, 22 bp, Homo sapiens
ttaataaagtatgaattggaaa

SEQ ID NO: 8506284 - DNA, 22 bp, Homo sapiens
ttaaagcagtttgtatacatgg

SEQ ID NO: 8506285 - DNA, 22 bp, Homo sapiens
ttaaagcagtttgtatacatgg

SEQ ID NO: 8506286 - DNA, 22 bp, Homo sapiens
ttaaagcacctccttggatgtg

SEQ ID NO: 8506287 - DNA, 22 bp, Homo sapiens
ttaaagagtttattacttgtaa

SEQ ID NO: 8506288 - DNA, 22 bp, Homo sapiens
ttacaactttcctgtgtcaaat

SEQ ID NO: 8506289 - DNA, 22 bp, Homo sapiens
ttacaactggtgaattttatgg

SEQ ID NO: 8506290 - DNA, 22 bp, Homo sapiens
ttacaacttgcagaggatgttg

SEQ ID NO: 8506291 - DNA, 23 bp, Homo sapiens
ttacaactatttgccatgttgtt

SEQ ID NO: 8506292 - DNA, 23 bp, Homo sapiens
ttacaactatttgccatgttgtt

SEQ ID NO: 8506293 - DNA, 22 bp, Homo sapiens
ttacaactgaagctaatgtgct

SEQ ID NO: 8506294 - DNA, 22 bp, Homo sapiens
ttacaactgaagctaatgtgct

SEQ ID NO: 8506295 - DNA, 22 bp, Homo sapiens
ttacaactgaagctaatgtgct

SEQ ID NO: 8506296 - DNA, 22 bp, Homo sapiens
ttacaactgggcttgtcagctt

SEQ ID NO: 8506297 - DNA, 22 bp, Homo sapiens
ttacaacatatttagcttgatt

SEQ ID NO: 8506298 - DNA, 17 bp, Homo sapiens
ttacaacgtcatctctg

SEQ ID NO: 8506299 - DNA, 23 bp, Homo sapiens
ttacaactatttgccatgttgtt

SEQ ID NO: 8506300 - DNA, 21 bp, Homo sapiens
ttacaacatttgtgttctatg

SEQ ID NO: 8506301 - DNA, 22 bp, Homo sapiens
ttacaacactacttatccttga

SEQ ID NO: 8506302 - DNA, 22 bp, Homo sapiens
ttacaacagacacatattctaa

SEQ ID NO: 8506303 - DNA, 22 bp, Homo sapiens
ttacaacagcgatttacctgtc

SEQ ID NO: 8506304 - DNA, 22 bp, Homo sapiens
ttacaacagacacatattctaa

SEQ ID NO: 8506305 - DNA, 22 bp, Homo sapiens
ttacaacaccaggcagtatcct

SEQ ID NO: 8506306 - DNA, 22 bp, Homo sapiens
ttacaacaccaggcagtatcct

SEQ ID NO: 8506307 - DNA, 17 bp, Homo sapiens
ttacaacaattcatgag

SEQ ID NO: 8506308 - DNA, 17 bp, Homo sapiens
ttacaacaattcatgag

SEQ ID NO: 8506309 - DNA, 17 bp, Homo sapiens
ttacaacaattcatgag

SEQ ID NO: 8506310 - DNA, 22 bp, Homo sapiens
ttacaaagttctgagttcaaac

SEQ ID NO: 8506311 - DNA, 22 bp, Homo sapiens
ttacaaagttctgagttcaaac

SEQ ID NO: 8506312 - DNA, 22 bp, Homo sapiens
ttacaaagttctgagttcaaac

SEQ ID NO: 8506313 - DNA, 22 bp, Homo sapiens
ttacaaagtgttatgataaaca

SEQ ID NO: 8506314 - DNA, 22 bp, Homo sapiens
ttacaaagtgttatgataaaca

SEQ ID NO: 8506315 - DNA, 22 bp, Homo sapiens
ttacaaagtgttatgataaaca

SEQ ID NO: 8506316 - DNA, 22 bp, Homo sapiens
ttacaaagtgctgcaccatttt

SEQ ID NO: 8506317 - DNA, 22 bp, Homo sapiens
ttacaaaggtagttttgtctat

SEQ ID NO: 8506318 - DNA, 22 bp, Homo sapiens
ttacaaagtgctgcaccatttt

SEQ ID NO: 8506319 - DNA, 21 bp, Homo sapiens
ttacaaagctacagatgttgc

SEQ ID NO: 8506320 - DNA, 20 bp, Homo sapiens
ttacaaagaggcatcgcttt

SEQ ID NO: 8506321 - DNA, 20 bp, Homo sapiens
ttacaaagaggcatcgcttt

SEQ ID NO: 8506322 - DNA, 20 bp, Homo sapiens
ttacaaagaggcatcgcttt

SEQ ID NO: 8506323 - DNA, 22 bp, Homo sapiens
ttacaaagagaagttgtagaat

SEQ ID NO: 8506324 - DNA, 22 bp, Homo sapiens
ttaattaagagatactgcagta

SEQ ID NO: 8506325 - DNA, 22 bp, Homo sapiens
ttaattaattagttaagcatgt

SEQ ID NO: 8506326 - DNA, 22 bp, Homo sapiens
ttaattaattagttaagcatgt

SEQ ID NO: 8506327 - DNA, 22 bp, Homo sapiens
ttacaaagaaaattaggcattt

SEQ ID NO: 8506328 - DNA, 22 bp, Homo sapiens
ttaattaaattcatgagcattg

SEQ ID NO: 8506329 - DNA, 22 bp, Homo sapiens
ttaattaaattcatgagcattg

SEQ ID NO: 8506330 - DNA, 22 bp, Homo sapiens
ttaattaaattcatgagcattg

SEQ ID NO: 8506331 - DNA, 22 bp, Homo sapiens
ttaatgttttaagttatagaga

SEQ ID NO: 8506332 - DNA, 22 bp, Homo sapiens
ttaattaaattcatgagcattg

SEQ ID NO: 8506333 - DNA, 22 bp, Homo sapiens
ttaattaactagccaaccacta

SEQ ID NO: 8506334 - DNA, 22 bp, Homo sapiens
ttaattaactagccaaccacta

SEQ ID NO: 8506335 - DNA, 22 bp, Homo sapiens
ttaattaagagatactgcagta

SEQ ID NO: 8506336 - DNA, 22 bp, Homo sapiens
ttaattaaattcatgagcattg

SEQ ID NO: 8506337 - DNA, 22 bp, Homo sapiens
ttacaaggaggatagcatttcc

SEQ ID NO: 8506338 - DNA, 23 bp, Homo sapiens
ttacaaggaagtgcacagatggg

SEQ ID NO: 8506339 - DNA, 22 bp, Homo sapiens
ttacaaggaggatagcatttcc

SEQ ID NO: 8506340 - DNA, 22 bp, Homo sapiens
ttacaatgcactcacctttaga

SEQ ID NO: 8506341 - DNA, 22 bp, Homo sapiens
ttacaatgggagcccttggact

SEQ ID NO: 8506342 - DNA, 22 bp, Homo sapiens
ttacaatgatgggattcagcca

SEQ ID NO: 8506343 - DNA, 22 bp, Homo sapiens
ttacaagtactgaatatgattt

SEQ ID NO: 8506344 - DNA, 22 bp, Homo sapiens
ttacaattgagtctattgtatg

SEQ ID NO: 8506345 - DNA, 22 bp, Homo sapiens
ttacaatgggtatacttccatt

SEQ ID NO: 8506346 - DNA, 22 bp, Homo sapiens
ttacaatgggtatacttccatt

SEQ ID NO: 8506347 - DNA, 22 bp, Homo sapiens
ttacaatgtaaggcatggttct

SEQ ID NO: 8506348 - DNA, 19 bp, Homo sapiens
ttacaatggtgattaggtt

SEQ ID NO: 8506349 - DNA, 19 bp, Homo sapiens
ttacaatggtgattaggtt

SEQ ID NO: 8506350 - DNA, 22 bp, Homo sapiens
ttacaatgtaaggcatggttct

SEQ ID NO: 8506351 - DNA, 22 bp, Homo sapiens
ttacaattacttgatctcagct

SEQ ID NO: 8506352 - DNA, 22 bp, Homo sapiens
ttacaattgagtctattgtatg

SEQ ID NO: 8506353 - DNA, 22 bp, Homo sapiens
ttacaagcagctacatatcaca

SEQ ID NO: 8506354 - DNA, 22 bp, Homo sapiens
ttacaagattaattattggagt

SEQ ID NO: 8506355 - DNA, 22 bp, Homo sapiens
ttacaagattaattattggagt

SEQ ID NO: 8506356 - DNA, 22 bp, Homo sapiens
ttacagatactttgtaggcaag

SEQ ID NO: 8506357 - DNA, 22 bp, Homo sapiens
ttacagagttcgcacctggtgg

SEQ ID NO: 8506358 - DNA, 22 bp, Homo sapiens
ttacagatacatttcttttgtt

SEQ ID NO: 8506359 - DNA, 22 bp, Homo sapiens
ttacagatacatttcttttgtt

SEQ ID NO: 8506360 - DNA, 22 bp, Homo sapiens
ttacagagtggtctggctatgt

SEQ ID NO: 8506361 - DNA, 22 bp, Homo sapiens
ttacagagtagtgcagaactca

SEQ ID NO: 8506362 - DNA, 22 bp, Homo sapiens
ttacagagtagggaattgaagt

SEQ ID NO: 8506363 - DNA, 22 bp, Homo sapiens
ttacagaggtatgtatgtctct

SEQ ID NO: 8506364 - DNA, 17 bp, Homo sapiens
ttacagaggtaattaag

SEQ ID NO: 8506365 - DNA, 22 bp, Homo sapiens
ttacagagggcttctctgaact

SEQ ID NO: 8506366 - DNA, 22 bp, Homo sapiens
ttacagaggcttccagggccca

SEQ ID NO: 8506367 - DNA, 22 bp, Homo sapiens
ttacagagctgggtggagagag

SEQ ID NO: 8506368 - DNA, 22 bp, Homo sapiens
ttacagagctcatttctaaggg

SEQ ID NO: 8506369 - DNA, 22 bp, Homo sapiens
ttacagagctcatttctaaggg

SEQ ID NO: 8506370 - DNA, 22 bp, Homo sapiens
ttacagagcctcattttagaga

SEQ ID NO: 8506371 - DNA, 22 bp, Homo sapiens
ttacagagcctcattttagaga

SEQ ID NO: 8506372 - DNA, 22 bp, Homo sapiens
ttacagagataaactgtaagtg

SEQ ID NO: 8506373 - DNA, 22 bp, Homo sapiens
ttacagagaggtgattgtgaag

SEQ ID NO: 8506374 - DNA, 22 bp, Homo sapiens
ttacagacaaactgtgttaagt

SEQ ID NO: 8506375 - DNA, 22 bp, Homo sapiens
ttacagaatgttcttccaacag

SEQ ID NO: 8506376 - DNA, 22 bp, Homo sapiens
ttacagaatctactcgtggtga

SEQ ID NO: 8506377 - DNA, 22 bp, Homo sapiens
ttacagaatgtgccatttggtc

SEQ ID NO: 8506378 - DNA, 22 bp, Homo sapiens
ttacagaatgtgccatttggtc

SEQ ID NO: 8506379 - DNA, 22 bp, Homo sapiens
ttacagaaaagggctttaagag

SEQ ID NO: 8506380 - DNA, 22 bp, Homo sapiens
ttacagaaaagggctttaagag

SEQ ID NO: 8506381 - DNA, 22 bp, Homo sapiens
ttacagaaaatgtgttttaact

SEQ ID NO: 8506382 - DNA, 22 bp, Homo sapiens
ttacacaaaaataagatatggc

SEQ ID NO: 8506383 - DNA, 22 bp, Homo sapiens
ttacacaaaaataagatatggc

SEQ ID NO: 8506384 - DNA, 22 bp, Homo sapiens
ttacacaaacacattccagata

SEQ ID NO: 8506385 - DNA, 22 bp, Homo sapiens
ttacacaaaagcaagtgtgtgt

SEQ ID NO: 8506386 - DNA, 22 bp, Homo sapiens
ttacattagacccactttcatg

SEQ ID NO: 8506387 - DNA, 22 bp, Homo sapiens
ttacatgtttatgggggtacat

SEQ ID NO: 8506388 - DNA, 23 bp, Homo sapiens
ttacatgtgtgcacacattctgg

SEQ ID NO: 8506389 - DNA, 22 bp, Homo sapiens
ttacatgttctcatacacagag

SEQ ID NO: 8506390 - DNA, 22 bp, Homo sapiens
ttacatgtttatgggggtacat

SEQ ID NO: 8506391 - DNA, 21 bp, Homo sapiens
ttacatggtttatcatatgga

SEQ ID NO: 8506392 - DNA, 21 bp, Homo sapiens
ttacatggtttatcatatgga

SEQ ID NO: 8506393 - DNA, 22 bp, Homo sapiens
ttacatggttgttggaaatgct

SEQ ID NO: 8506394 - DNA, 22 bp, Homo sapiens
ttacatgtaatctaaaataatt

SEQ ID NO: 8506395 - DNA, 22 bp, Homo sapiens
ttacatgtactggtttgactta

SEQ ID NO: 8506396 - DNA, 22 bp, Homo sapiens
ttacatgtattttggaaaaagt

SEQ ID NO: 8506397 - DNA, 22 bp, Homo sapiens
ttacatgtggagtctgattgca

SEQ ID NO: 8506398 - DNA, 22 bp, Homo sapiens
ttacattttgcacagatgtccc

SEQ ID NO: 8506399 - DNA, 22 bp, Homo sapiens
ttacattttagttaacctgtga

SEQ ID NO: 8506400 - DNA, 22 bp, Homo sapiens
ttacatttggctatgtcctcta

SEQ ID NO: 8506401 - DNA, 22 bp, Homo sapiens
ttacatttggctatgtcctcta

SEQ ID NO: 8506402 - DNA, 22 bp, Homo sapiens
ttacattgtccagaaattattg

SEQ ID NO: 8506403 - DNA, 22 bp, Homo sapiens
ttacattagacccactttcatg

SEQ ID NO: 8506404 - DNA, 21 bp, Homo sapiens
ttacattcagaggagtggaag

SEQ ID NO: 8506405 - DNA, 22 bp, Homo sapiens
ttacatggatgtaaaaaagtta

SEQ ID NO: 8506406 - DNA, 22 bp, Homo sapiens
ttacatgggcttgtgagtcctt

SEQ ID NO: 8506407 - DNA, 22 bp, Homo sapiens
ttacatggtaaacactctttta

SEQ ID NO: 8506408 - DNA, 22 bp, Homo sapiens
ttacatgggccatttagacatg

SEQ ID NO: 8506409 - DNA, 22 bp, Homo sapiens
ttacatgatgatttcataaaca

SEQ ID NO: 8506410 - DNA, 22 bp, Homo sapiens
ttacatgaggttaattaagcat

SEQ ID NO: 8506411 - DNA, 22 bp, Homo sapiens
ttacagcatttaatgagatctg

SEQ ID NO: 8506412 - DNA, 22 bp, Homo sapiens
ttacagcagcagggacagacta

SEQ ID NO: 8506413 - DNA, 22 bp, Homo sapiens
ttacatgactgcccttgtcagg

SEQ ID NO: 8506414 - DNA, 22 bp, Homo sapiens
ttacatgactcaatagaagggc

SEQ ID NO: 8506415 - DNA, 23 bp, Homo sapiens
ttacagctaactgctgttattag

SEQ ID NO: 8506416 - DNA, 22 bp, Homo sapiens
ttacagctagccaattatttag

SEQ ID NO: 8506417 - DNA, 19 bp, Homo sapiens
ttacatgacatatgaagga

SEQ ID NO: 8506418 - DNA, 22 bp, Homo sapiens
ttacagcacagtgcttttactg

SEQ ID NO: 8506419 - DNA, 22 bp, Homo sapiens
ttacagcacagtgcttttactg

SEQ ID NO: 8506420 - DNA, 21 bp, Homo sapiens
ttacagcaatgttagcaggaa

SEQ ID NO: 8506421 - DNA, 22 bp, Homo sapiens
ttacagatgtttcaggaatact

SEQ ID NO: 8506422 - DNA, 22 bp, Homo sapiens
ttacagattcaagctctttgaa

SEQ ID NO: 8506423 - DNA, 22 bp, Homo sapiens
ttacagattaaaatgctgaggt

SEQ ID NO: 8506424 - DNA, 22 bp, Homo sapiens
ttacagatcatcaaggtataat

SEQ ID NO: 8506425 - DNA, 22 bp, Homo sapiens
ttacagatggcagtttcttgag

SEQ ID NO: 8506426 - DNA, 22 bp, Homo sapiens
ttacagatggatctagcaaaat

SEQ ID NO: 8506427 - DNA, 22 bp, Homo sapiens
ttacagatggggttgcaataaa

SEQ ID NO: 8506428 - DNA, 22 bp, Homo sapiens
ttacagatggcagtttcttgag

SEQ ID NO: 8506429 - DNA, 22 bp, Homo sapiens
ttacagatgtaggaactgaagt

SEQ ID NO: 8506430 - DNA, 22 bp, Homo sapiens
ttccagctaactcacatccctt

SEQ ID NO: 8506431 - DNA, 22 bp, Homo sapiens
ttccagctaactcacatccctt

SEQ ID NO: 8506432 - DNA, 22 bp, Homo sapiens
ttccagcttagagcatcatgtt

SEQ ID NO: 8506433 - DNA, 17 bp, Homo sapiens
ttccagcatgttactaa

SEQ ID NO: 8506434 - DNA, 22 bp, Homo sapiens
ttccagatttctacacaagacc

SEQ ID NO: 8506435 - DNA, 22 bp, Homo sapiens
ttccagcacagaagtatacatt

SEQ ID NO: 8506436 - DNA, 22 bp, Homo sapiens
ttccagcacagaagtatacatt

SEQ ID NO: 8506437 - DNA, 22 bp, Homo sapiens
ttccagatgtttaagttctgct

SEQ ID NO: 8506438 - DNA, 22 bp, Homo sapiens
ttccagatttctacacaagacc

SEQ ID NO: 8506439 - DNA, 22 bp, Homo sapiens
ttccagcagggtacttgtaatt

SEQ ID NO: 8506440 - DNA, 22 bp, Homo sapiens
ttccagcaggcagacaggagat

SEQ ID NO: 8506441 - DNA, 22 bp, Homo sapiens
ttccagcagggtacttgtaatt

SEQ ID NO: 8506442 - DNA, 22 bp, Homo sapiens
ttccagcccgcgacttgttcag

SEQ ID NO: 8506443 - DNA, 22 bp, Homo sapiens
ttccagccagatttgctgggtt

SEQ ID NO: 8506444 - DNA, 22 bp, Homo sapiens
ttccagccatggtttccctatg

SEQ ID NO: 8506445 - DNA, 22 bp, Homo sapiens
ttccagctaactcacatccctt

SEQ ID NO: 8506446 - DNA, 22 bp, Homo sapiens
ttccagctaactcacatccctt

SEQ ID NO: 8506447 - DNA, 22 bp, Homo sapiens
ttccagctaactcacatccctt

SEQ ID NO: 8506448 - DNA, 22 bp, Homo sapiens
ttccagctaactcacatccctt

SEQ ID NO: 8506449 - DNA, 22 bp, Homo sapiens
ttccagagtctggttccatggt

SEQ ID NO: 8506450 - DNA, 22 bp, Homo sapiens
ttccagagtgactgtgccactt

SEQ ID NO: 8506451 - DNA, 22 bp, Homo sapiens
ttccagaggttctcagccctgt

SEQ ID NO: 8506452 - DNA, 22 bp, Homo sapiens
ttccagaggttctcagccctgt

SEQ ID NO: 8506453 - DNA, 21 bp, Homo sapiens
ttcattcatggcataatatag

SEQ ID NO: 8506454 - DNA, 22 bp, Homo sapiens
ttcattcatctctaaaatgcct

SEQ ID NO: 8506455 - DNA, 22 bp, Homo sapiens
ttcattcatctctaaaatgcct

SEQ ID NO: 8506456 - DNA, 22 bp, Homo sapiens
ttcattcatcacatgcagctgg

SEQ ID NO: 8506457 - DNA, 22 bp, Homo sapiens
ttcattcatcacatgcagctgg

SEQ ID NO: 8506458 - DNA, 22 bp, Homo sapiens
ttcattcagtgagactaggacg

SEQ ID NO: 8506459 - DNA, 22 bp, Homo sapiens
ttcattcaggtgtatttatggg

SEQ ID NO: 8506460 - DNA, 22 bp, Homo sapiens
ttcattcaggtgtatttatggg

SEQ ID NO: 8506461 - DNA, 22 bp, Homo sapiens
ttcattcagcacatatttattg

SEQ ID NO: 8506462 - DNA, 23 bp, Homo sapiens
ttcattcaaaaggaaaagtcatg

SEQ ID NO: 8506463 - DNA, 22 bp, Homo sapiens
ttcattcaaagaggcatccaag

SEQ ID NO: 8506464 - DNA, 22 bp, Homo sapiens
ttcaggaatcaaccaagtcatt

SEQ ID NO: 8506465 - DNA, 21 bp, Homo sapiens
ttcaggacaggaaaaacaggg

SEQ ID NO: 8506466 - DNA, 22 bp, Homo sapiens
ttcaggaatataggcattgaca

SEQ ID NO: 8506467 - DNA, 22 bp, Homo sapiens
ttcaggaatcaaccaagtcatt

SEQ ID NO: 8506468 - DNA, 22 bp, Homo sapiens
ttcatgtttgtaggactgaggc

SEQ ID NO: 8506469 - DNA, 17 bp, Homo sapiens
ttcattaataaaagcaa

SEQ ID NO: 8506470 - DNA, 22 bp, Homo sapiens
ttcattactgcggtagtcacac

SEQ ID NO: 8506471 - DNA, 23 bp, Homo sapiens
ttcattcaaaaggaaaagtcatg

SEQ ID NO: 8506472 - DNA, 22 bp, Homo sapiens
ttcattagttctgaagatgtct

SEQ ID NO: 8506473 - DNA, 23 bp, Homo sapiens
ttcattgattgcaaggagattgg

SEQ ID NO: 8506474 - DNA, 23 bp, Homo sapiens
ttcattgattgcaaggagattgg

SEQ ID NO: 8506475 - DNA, 22 bp, Homo sapiens
ttcattgattccaggctcttct

SEQ ID NO: 8506476 - DNA, 22 bp, Homo sapiens
ttcattgatagttttatgtatg

SEQ ID NO: 8506477 - DNA, 22 bp, Homo sapiens
ttcattgatgtggtttaatgta

SEQ ID NO: 8506478 - DNA, 22 bp, Homo sapiens
ttcattgagtggtttattctaa

SEQ ID NO: 8506479 - DNA, 22 bp, Homo sapiens
ttcattgagttactgcctgggc

SEQ ID NO: 8506480 - DNA, 22 bp, Homo sapiens
ttcattgagttactgcctgggc

SEQ ID NO: 8506481 - DNA, 22 bp, Homo sapiens
ttcattgaagcacaagtgatct

SEQ ID NO: 8506482 - DNA, 22 bp, Homo sapiens
ttcattgaaggagggacttgct

SEQ ID NO: 8506483 - DNA, 22 bp, Homo sapiens
ttcattgactggttcgttaagt

SEQ ID NO: 8506484 - DNA, 21 bp, Homo sapiens
ttcattgaactatttgtggag

SEQ ID NO: 8506485 - DNA, 22 bp, Homo sapiens
ttcattgaaccactttattctt

SEQ ID NO: 8506486 - DNA, 22 bp, Homo sapiens
ttcattgaagcacaagtgatct

SEQ ID NO: 8506487 - DNA, 22 bp, Homo sapiens
ttcattgagtggtttattctaa

SEQ ID NO: 8506488 - DNA, 22 bp, Homo sapiens
ttcattgagtataggggtatac

SEQ ID NO: 8506489 - DNA, 22 bp, Homo sapiens
ttcattgagtataggggtatac

SEQ ID NO: 8506490 - DNA, 22 bp, Homo sapiens
ttcattgagctgtacacttagg

SEQ ID NO: 8506491 - DNA, 22 bp, Homo sapiens
ttcattgagctgtacacttagg

SEQ ID NO: 8506492 - DNA, 23 bp, Homo sapiens
ttcattgagctgttcttgaggat

SEQ ID NO: 8506493 - DNA, 23 bp, Homo sapiens
ttcattgagctgttcttgaggat

SEQ ID NO: 8506494 - DNA, 22 bp, Homo sapiens
ttcattgatttaacaaacaagt

SEQ ID NO: 8506495 - DNA, 23 bp, Homo sapiens
ttccagaggaagaagtcatgact

SEQ ID NO: 8506496 - DNA, 22 bp, Homo sapiens
ttccagaggagtgattcagagg

SEQ ID NO: 8506497 - DNA, 22 bp, Homo sapiens
ttccagaggagtgattcagagg

SEQ ID NO: 8506498 - DNA, 22 bp, Homo sapiens
ttccagaggagtgattcagagg

SEQ ID NO: 8506499 - DNA, 22 bp, Homo sapiens
ttcattgaaatgtttctagctg

SEQ ID NO: 8506500 - DNA, 22 bp, Homo sapiens
ttcattgaaattaagcccaact

SEQ ID NO: 8506501 - DNA, 22 bp, Homo sapiens
ttcattgaaatacagtcttgac

SEQ ID NO: 8506502 - DNA, 22 bp, Homo sapiens
ttcattgaaatacagtcttgac

SEQ ID NO: 8506503 - DNA, 22 bp, Homo sapiens
ttcattcttttacatgtgaata

SEQ ID NO: 8506504 - DNA, 19 bp, Homo sapiens
ttcattctttctacttacc

SEQ ID NO: 8506505 - DNA, 22 bp, Homo sapiens
ttcattcttttacatgtgaata

SEQ ID NO: 8506506 - DNA, 19 bp, Homo sapiens
ttcattctttctacttacc

SEQ ID NO: 8506507 - DNA, 22 bp, Homo sapiens
ttcattcatgtattgtctatgg

SEQ ID NO: 8506508 - DNA, 22 bp, Homo sapiens
ttcattcattacgtgccaggca

SEQ ID NO: 8506509 - DNA, 22 bp, Homo sapiens
ttcattcttgtctttgtatagt

SEQ ID NO: 8506510 - DNA, 22 bp, Homo sapiens
ttcagccagtcatcagtcttgt

SEQ ID NO: 8506511 - DNA, 19 bp, Homo sapiens
ttcagcattatattctagc

SEQ ID NO: 8506512 - DNA, 22 bp, Homo sapiens
ttcagcatttctgttgttggct

SEQ ID NO: 8506513 - DNA, 22 bp, Homo sapiens
ttcagccaattagaagccccac

SEQ ID NO: 8506514 - DNA, 23 bp, Homo sapiens
ttcagcatgaagagtgaaggctg

SEQ ID NO: 8506515 - DNA, 22 bp, Homo sapiens
ttcagcatgaaaggatttgagt

SEQ ID NO: 8506516 - DNA, 22 bp, Homo sapiens
ttcagcatctacatatttagaa

SEQ ID NO: 8506517 - DNA, 22 bp, Homo sapiens
ttcagcctgttcatgctgttgc

SEQ ID NO: 8506518 - DNA, 22 bp, Homo sapiens
ttcagctatggagtcttagtta

SEQ ID NO: 8506519 - DNA, 22 bp, Homo sapiens
ttcagctatggagtcttagtta

SEQ ID NO: 8506520 - DNA, 22 bp, Homo sapiens
ttcagcgatattattcatgagc

SEQ ID NO: 8506521 - DNA, 22 bp, Homo sapiens
ttcagcttcatttgtctttatg

SEQ ID NO: 8506522 - DNA, 21 bp, Homo sapiens
ttcagcttatgtgtcacttgc

SEQ ID NO: 8506523 - DNA, 22 bp, Homo sapiens
ttcaggaaggtcctatagcaga

SEQ ID NO: 8506524 - DNA, 22 bp, Homo sapiens
ttcaggaaggtcctatagcaga

SEQ ID NO: 8506525 - DNA, 22 bp, Homo sapiens
ttcaggaagcctttcttggtct

SEQ ID NO: 8506526 - DNA, 22 bp, Homo sapiens
ttcaggaagcctttcttggtct

SEQ ID NO: 8506527 - DNA, 22 bp, Homo sapiens
ttcaggaaggtcctatagcaga

SEQ ID NO: 8506528 - DNA, 22 bp, Homo sapiens
ttcaggaataattatcatatga

SEQ ID NO: 8506529 - DNA, 22 bp, Homo sapiens
ttcaggaataattatcatatga

SEQ ID NO: 8506530 - DNA, 20 bp, Homo sapiens
ttcaggaataagatagcagc

SEQ ID NO: 8506531 - DNA, 22 bp, Homo sapiens
ttcaggaataattatcatatga

SEQ ID NO: 8506532 - DNA, 22 bp, Homo sapiens
ttcagcttgctgactgcggcag

SEQ ID NO: 8506533 - DNA, 22 bp, Homo sapiens
ttcagcttgctgactgcggcag

SEQ ID NO: 8506534 - DNA, 22 bp, Homo sapiens
ttcagcttgaatctggctttga

SEQ ID NO: 8506535 - DNA, 22 bp, Homo sapiens
ttcagcttgcttagtctccttc

SEQ ID NO: 8506536 - DNA, 22 bp, Homo sapiens
ttcagcttcatttgtctttatg

SEQ ID NO: 8506537 - DNA, 23 bp, Homo sapiens
ttcaggaaatgaatacagacaca

SEQ ID NO: 8506538 - DNA, 23 bp, Homo sapiens
ttcaggaaatgaatacagacaca

SEQ ID NO: 8506539 - DNA, 23 bp, Homo sapiens
ttcaggaaatgaatacagacaca

SEQ ID NO: 8506540 - DNA, 22 bp, Homo sapiens
ttcacccactagagaactcagg

SEQ ID NO: 8506541 - DNA, 22 bp, Homo sapiens
ttcacccactagagaactcagg

SEQ ID NO: 8506542 - DNA, 22 bp, Homo sapiens
ttcacccaatataactagagga

SEQ ID NO: 8506543 - DNA, 22 bp, Homo sapiens
ttcaccctgagccccacctctg

SEQ ID NO: 8506544 - DNA, 22 bp, Homo sapiens
ttcaccccaaattcccagtgga

SEQ ID NO: 8506545 - DNA, 22 bp, Homo sapiens
ttcaccctggaccagaaattgg

SEQ ID NO: 8506546 - DNA, 22 bp, Homo sapiens
ttcacctggcacatgtgagcct

SEQ ID NO: 8506547 - DNA, 22 bp, Homo sapiens
ttcaccctggaccagaaattgg

SEQ ID NO: 8506548 - DNA, 22 bp, Homo sapiens
ttcaccctggaccagaaattgg

SEQ ID NO: 8506549 - DNA, 22 bp, Homo sapiens
ttcaccctggaccagaaattgg

SEQ ID NO: 8506550 - DNA, 22 bp, Homo sapiens
ttcactatgcttggaaacttct

SEQ ID NO: 8506551 - DNA, 22 bp, Homo sapiens
ttcactataaagtttcaacttt

SEQ ID NO: 8506552 - DNA, 22 bp, Homo sapiens
ttcagcagtgcagacacccagt

SEQ ID NO: 8506553 - DNA, 22 bp, Homo sapiens
ttcagcagtcgtccaggaaaag

SEQ ID NO: 8506554 - DNA, 17 bp, Homo sapiens
ttcagcagtgtttctcc

SEQ ID NO: 8506555 - DNA, 22 bp, Homo sapiens
ttcagcagtttctgagaagcaa

SEQ ID NO: 8506556 - DNA, 22 bp, Homo sapiens
ttcagcatagcagcttcaggac

SEQ ID NO: 8506557 - DNA, 21 bp, Homo sapiens
ttcagcagtcctctagagata

SEQ ID NO: 8506558 - DNA, 21 bp, Homo sapiens
ttcagcagtcctctagagata

SEQ ID NO: 8506559 - DNA, 22 bp, Homo sapiens
ttcagcaggtggtgagttctgc

SEQ ID NO: 8506560 - DNA, 19 bp, Homo sapiens
ttcagcaggctgaagcttc

SEQ ID NO: 8506561 - DNA, 22 bp, Homo sapiens
ttcagcagcttttagtacattg

SEQ ID NO: 8506562 - DNA, 22 bp, Homo sapiens
ttcagcaggcggtagctgccac

SEQ ID NO: 8506563 - DNA, 22 bp, Homo sapiens
ttatttgacttcttgctatgct

SEQ ID NO: 8506564 - DNA, 22 bp, Homo sapiens
ttatttgaaaagaaggttacgt

SEQ ID NO: 8506565 - DNA, 22 bp, Homo sapiens
ttatttgaatgatggcacaatt

SEQ ID NO: 8506566 - DNA, 22 bp, Homo sapiens
ttatttgaatctggctagagaa

SEQ ID NO: 8506567 - DNA, 22 bp, Homo sapiens
ttatttcttgtctatgtagcca

SEQ ID NO: 8506568 - DNA, 22 bp, Homo sapiens
ttatttctactattttgcctga

SEQ ID NO: 8506569 - DNA, 22 bp, Homo sapiens
ttatttctactattttgcctga

SEQ ID NO: 8506570 - DNA, 22 bp, Homo sapiens
ttatttctactattttgcctga

SEQ ID NO: 8506571 - DNA, 20 bp, Homo sapiens
ttatttctcattctcctact

SEQ ID NO: 8506572 - DNA, 20 bp, Homo sapiens
ttatttctcattctcctact

SEQ ID NO: 8506573 - DNA, 22 bp, Homo sapiens
ttatttcctgacacagctgatt

SEQ ID NO: 8506574 - DNA, 22 bp, Homo sapiens
ttatttcctctctaatagggta

SEQ ID NO: 8506575 - DNA, 22 bp, Homo sapiens
ttatttcctagggaatttgcct

SEQ ID NO: 8506576 - DNA, 22 bp, Homo sapiens
ttatttcctaaatctctttgtt

SEQ ID NO: 8506577 - DNA, 22 bp, Homo sapiens
ttatttggttgctgacttggaa

SEQ ID NO: 8506578 - DNA, 22 bp, Homo sapiens
ttatttgtaaaggtccatagta

SEQ ID NO: 8506579 - DNA, 22 bp, Homo sapiens
ttatttgtaaaggtccatagta

SEQ ID NO: 8506580 - DNA, 22 bp, Homo sapiens
ttatttggttattgtaattggg

SEQ ID NO: 8506581 - DNA, 23 bp, Homo sapiens
ttatttggattttagtggaaaga

SEQ ID NO: 8506582 - DNA, 22 bp, Homo sapiens
ttatttggcaatgcttcaccat

SEQ ID NO: 8506583 - DNA, 22 bp, Homo sapiens
ttatttgggtttgagtgtggca

SEQ ID NO: 8506584 - DNA, 22 bp, Homo sapiens
ttatttgtaaggcagggccagt

SEQ ID NO: 8506585 - DNA, 22 bp, Homo sapiens
ttatttgtatcaaggacggttg

SEQ ID NO: 8506586 - DNA, 22 bp, Homo sapiens
ttatttgtgaatcatttatcta

SEQ ID NO: 8506587 - DNA, 22 bp, Homo sapiens
ttatttgtgaatcatttatcta

SEQ ID NO: 8506588 - DNA, 22 bp, Homo sapiens
ttatttgtgaatcatttatcta

SEQ ID NO: 8506589 - DNA, 22 bp, Homo sapiens
ttatttgcccatgtttagcaga

SEQ ID NO: 8506590 - DNA, 20 bp, Homo sapiens
ttatttgctctttatctgca

SEQ ID NO: 8506591 - DNA, 22 bp, Homo sapiens
ttatttgctgatttcagtttca

SEQ ID NO: 8506592 - DNA, 22 bp, Homo sapiens
ttatttgctgatttcagtttca

SEQ ID NO: 8506593 - DNA, 22 bp, Homo sapiens
ttatttgcccatgtttagcaga

SEQ ID NO: 8506594 - DNA, 22 bp, Homo sapiens
ttatttgccagaatttctcttg

SEQ ID NO: 8506595 - DNA, 22 bp, Homo sapiens
ttatttgattagtaaacctgta

SEQ ID NO: 8506596 - DNA, 22 bp, Homo sapiens
ttatttggaaatatggcttctg

SEQ ID NO: 8506597 - DNA, 22 bp, Homo sapiens
ttatttggaaatatggcttctg

SEQ ID NO: 8506598 - DNA, 22 bp, Homo sapiens
ttatttggatttagcttatcaa

SEQ ID NO: 8506599 - DNA, 22 bp, Homo sapiens
ttatttggatttagcttatcaa

SEQ ID NO: 8506600 - DNA, 22 bp, Homo sapiens
ttcacattggttcttgatagct

SEQ ID NO: 8506601 - DNA, 22 bp, Homo sapiens
ttcacattggttcttgatagct

SEQ ID NO: 8506602 - DNA, 22 bp, Homo sapiens
ttcacattggttcttgatagct

SEQ ID NO: 8506603 - DNA, 22 bp, Homo sapiens
ttcacattgtgcagattatggt

SEQ ID NO: 8506604 - DNA, 22 bp, Homo sapiens
ttcacattgtgcagattatggt

SEQ ID NO: 8506605 - DNA, 22 bp, Homo sapiens
ttcacattgtgcagattatggt

SEQ ID NO: 8506606 - DNA, 19 bp, Homo sapiens
ttcacattggaagaagtag

SEQ ID NO: 8506607 - DNA, 22 bp, Homo sapiens
ttcacattggtgatatgtttct

SEQ ID NO: 8506608 - DNA, 22 bp, Homo sapiens
ttcacattggtgatatgtttct

SEQ ID NO: 8506609 - DNA, 22 bp, Homo sapiens
ttcacattggtgatatgtttct

SEQ ID NO: 8506610 - DNA, 22 bp, Homo sapiens
ttcacattggtgatatgtttct

SEQ ID NO: 8506611 - DNA, 22 bp, Homo sapiens
ttcacattgtgcagattatggt

SEQ ID NO: 8506612 - DNA, 22 bp, Homo sapiens
ttcacattgtggttcatgtgaa

SEQ ID NO: 8506613 - DNA, 22 bp, Homo sapiens
ttcacattgtggttcatgtgaa

SEQ ID NO: 8506614 - DNA, 22 bp, Homo sapiens
ttcacatttactggtttgtccg

SEQ ID NO: 8506615 - DNA, 22 bp, Homo sapiens
ttcacatttcataccacagctt

SEQ ID NO: 8506616 - DNA, 22 bp, Homo sapiens
ttcacatttactggtttgtccg

SEQ ID NO: 8506617 - DNA, 22 bp, Homo sapiens
ttcacattgttttaatgtgaat

SEQ ID NO: 8506618 - DNA, 22 bp, Homo sapiens
ttcacattgttttaatgtgaat

SEQ ID NO: 8506619 - DNA, 22 bp, Homo sapiens
ttcacatttgaaaggaaagata

SEQ ID NO: 8506620 - DNA, 22 bp, Homo sapiens
ttcacatttctctgctgtttga

SEQ ID NO: 8506621 - DNA, 20 bp, Homo sapiens
ttcacatttctgtagtgatt

SEQ ID NO: 8506622 - DNA, 22 bp, Homo sapiens
ttcacatttctctgctgtttga

SEQ ID NO: 8506623 - DNA, 19 bp, Homo sapiens
ttcacatttttgtggcact

SEQ ID NO: 8506624 - DNA, 19 bp, Homo sapiens
ttcacattttgctctgagg

SEQ ID NO: 8506625 - DNA, 22 bp, Homo sapiens
ttcacatttgcccttatgtgtg

SEQ ID NO: 8506626 - DNA, 22 bp, Homo sapiens
ttcacatttgcccttatgtgtg

SEQ ID NO: 8506627 - DNA, 22 bp, Homo sapiens
ttcacatttgcccttatgtgtg

SEQ ID NO: 8506628 - DNA, 18 bp, Homo sapiens
ttcaccagtgtgatgggt

SEQ ID NO: 8506629 - DNA, 22 bp, Homo sapiens
ttccaggaaaacagttggaagt

SEQ ID NO: 8506630 - DNA, 22 bp, Homo sapiens
ttccaggaacaaactcacctta

SEQ ID NO: 8506631 - DNA, 22 bp, Homo sapiens
aataacaggctcatcagatgct

SEQ ID NO: 8506632 - DNA, 22 bp, Homo sapiens
aataacaggctcatcagatgct

SEQ ID NO: 8506633 - DNA, 22 bp, Homo sapiens
aataacagattttcaagctgtg

SEQ ID NO: 8506634 - DNA, 22 bp, Homo sapiens
aataacagattttcaagctgtg

SEQ ID NO: 8506635 - DNA, 22 bp, Homo sapiens
aataacaggctcatcagatgct

SEQ ID NO: 8506636 - DNA, 22 bp, Homo sapiens
aataacagggttgatttgcaat

SEQ ID NO: 8506637 - DNA, 22 bp, Homo sapiens
aataacagggttgatttgcaat

SEQ ID NO: 8506638 - DNA, 21 bp, Homo sapiens
aataaccactaatatagtggc

SEQ ID NO: 8506639 - DNA, 22 bp, Homo sapiens
aataaccttacttattacatgg

SEQ ID NO: 8506640 - DNA, 22 bp, Homo sapiens
aataactgcacttgttgaatgc

SEQ ID NO: 8506641 - DNA, 21 bp, Homo sapiens
aataaccactaatatagtggc

SEQ ID NO: 8506642 - DNA, 22 bp, Homo sapiens
aataacagtgccatgaaattga

SEQ ID NO: 8506643 - DNA, 22 bp, Homo sapiens
aataacagtgccatgaaattga

SEQ ID NO: 8506644 - DNA, 22 bp, Homo sapiens
aataactggcacatatcacata

SEQ ID NO: 8506645 - DNA, 23 bp, Homo sapiens
actgtctgatatgttttccatca

SEQ ID NO: 8506646 - DNA, 22 bp, Homo sapiens
actgtctgcaaaactcatactc

SEQ ID NO: 8506647 - DNA, 22 bp, Homo sapiens
actgtgctatctactgaattat

SEQ ID NO: 8506648 - DNA, 22 bp, Homo sapiens
actgtctgccctgagatgccag

SEQ ID NO: 8506649 - DNA, 22 bp, Homo sapiens
actgtggccaaagcctctggga

SEQ ID NO: 8506650 - DNA, 22 bp, Homo sapiens
actgtggcgtcaggaagaaatt

SEQ ID NO: 8506651 - DNA, 22 bp, Homo sapiens
actgtggctcatcaggctggtg

SEQ ID NO: 8506652 - DNA, 22 bp, Homo sapiens
actgtggcaaaagaacattgga

SEQ ID NO: 8506653 - DNA, 22 bp, Homo sapiens
actgtggagcagtggctaggga

SEQ ID NO: 8506654 - DNA, 22 bp, Homo sapiens
actgtgctttctctggaggcat

SEQ ID NO: 8506655 - DNA, 22 bp, Homo sapiens
aatagaaaggaggggctcttgt

SEQ ID NO: 8506656 - DNA, 22 bp, Homo sapiens
aatacttttgaactgaaaggca

SEQ ID NO: 8506657 - DNA, 22 bp, Homo sapiens
aatacttttgaactgaaaggca

SEQ ID NO: 8506658 - DNA, 22 bp, Homo sapiens
aatactttgccaagttcgaaga

SEQ ID NO: 8506659 - DNA, 22 bp, Homo sapiens
aatactttcctatataaggtgc

SEQ ID NO: 8506660 - DNA, 17 bp, Homo sapiens
aatacttccaactagtg

SEQ ID NO: 8506661 - DNA, 22 bp, Homo sapiens
aatacttatgtgacctcatttt

SEQ ID NO: 8506662 - DNA, 17 bp, Homo sapiens
aatacttccaactagtg

SEQ ID NO: 8506663 - DNA, 22 bp, Homo sapiens
acttcccaggtggtgtggagtt

SEQ ID NO: 8506664 - DNA, 21 bp, Homo sapiens
acttcccaggacctactcaga

SEQ ID NO: 8506665 - DNA, 21 bp, Homo sapiens
acttcccaggacctactcaga

SEQ ID NO: 8506666 - DNA, 18 bp, Homo sapiens
acttcccagatgagggga

SEQ ID NO: 8506667 - DNA, 22 bp, Homo sapiens
acttcctgacttctgggttgga

SEQ ID NO: 8506668 - DNA, 22 bp, Homo sapiens
acttcctgaatggggctaatta

SEQ ID NO: 8506669 - DNA, 22 bp, Homo sapiens
acttcctgaatggggctaatta

SEQ ID NO: 8506670 - DNA, 22 bp, Homo sapiens
acttccctgtgggcaggtagtg

SEQ ID NO: 8506671 - DNA, 22 bp, Homo sapiens
acttcccacaccctgttttctc

SEQ ID NO: 8506672 - DNA, 17 bp, Homo sapiens
acttcccacccctccag

SEQ ID NO: 8506673 - DNA, 22 bp, Homo sapiens
acttccagtgtctgctgctagc

SEQ ID NO: 8506674 - DNA, 23 bp, Homo sapiens
acttccagttataggaactcttc

SEQ ID NO: 8506675 - DNA, 22 bp, Homo sapiens
aatatcagcacttttgtggtat

SEQ ID NO: 8506676 - DNA, 19 bp, Homo sapiens
acttcctgcccgctccttt

SEQ ID NO: 8506677 - DNA, 22 bp, Homo sapiens
aatatcagctctgtcacttact

SEQ ID NO: 8506678 - DNA, 22 bp, Homo sapiens
aatatcagctctgtcacttact

SEQ ID NO: 8506679 - DNA, 22 bp, Homo sapiens
aatatcttctaaggatagaact

SEQ ID NO: 8506680 - DNA, 22 bp, Homo sapiens
aatatcttctaaggatagaact

SEQ ID NO: 8506681 - DNA, 22 bp, Homo sapiens
aatatgaattattgttacaagt

SEQ ID NO: 8506682 - DNA, 22 bp, Homo sapiens
aatatgaattattgttacaagt

SEQ ID NO: 8506683 - DNA, 22 bp, Homo sapiens
aatatgaattattgttacaagt

SEQ ID NO: 8506684 - DNA, 22 bp, Homo sapiens
aatatgaattattgttacaagt

SEQ ID NO: 8506685 - DNA, 22 bp, Homo sapiens
aatatcttctaaggatagaact

SEQ ID NO: 8506686 - DNA, 22 bp, Homo sapiens
aatatcttctaaggatagaact

SEQ ID NO: 8506687 - DNA, 22 bp, Homo sapiens
acttccagctaggttctgctaa

SEQ ID NO: 8506688 - DNA, 22 bp, Homo sapiens
acttccagctgccctgtgtgct

SEQ ID NO: 8506689 - DNA, 22 bp, Homo sapiens
acttatatttgctttatgcttc

SEQ ID NO: 8506690 - DNA, 22 bp, Homo sapiens
acttatcagttgtctctaatgt

SEQ ID NO: 8506691 - DNA, 22 bp, Homo sapiens
acttattagacatcttcattgt

SEQ ID NO: 8506692 - DNA, 22 bp, Homo sapiens
acttatttattcattcagctca

SEQ ID NO: 8506693 - DNA, 22 bp, Homo sapiens
acttatttattcattcagctca

SEQ ID NO: 8506694 - DNA, 23 bp, Homo sapiens
actgttggtgcagaagtgccttg

SEQ ID NO: 8506695 - DNA, 20 bp, Homo sapiens
actgttggaagtggagaatg

SEQ ID NO: 8506696 - DNA, 22 bp, Homo sapiens
actgttggtcagggatattgtg

SEQ ID NO: 8506697 - DNA, 22 bp, Homo sapiens
actgttgaagtgccagcttgat

SEQ ID NO: 8506698 - DNA, 22 bp, Homo sapiens
acttagtatttttcagctttga

SEQ ID NO: 8506699 - DNA, 22 bp, Homo sapiens
acttagtgccctggcccttaca

SEQ ID NO: 8506700 - DNA, 22 bp, Homo sapiens
acttataagagtgctatgggga

SEQ ID NO: 8506701 - DNA, 20 bp, Homo sapiens
acttagtttttctcacagga

SEQ ID NO: 8506702 - DNA, 22 bp, Homo sapiens
acttagttaagtattttggaaa

SEQ ID NO: 8506703 - DNA, 22 bp, Homo sapiens
aatatgttcaaaatagatcact

SEQ ID NO: 8506704 - DNA, 22 bp, Homo sapiens
aatatgttcaaaatagatcact

SEQ ID NO: 8506705 - DNA, 22 bp, Homo sapiens
aatatgttcaaaatagatcact

SEQ ID NO: 8506706 - DNA, 22 bp, Homo sapiens
aatatgttcaaaatagatcact

SEQ ID NO: 8506707 - DNA, 22 bp, Homo sapiens
aatatgttcaaaatagatcact

SEQ ID NO: 8506708 - DNA, 22 bp, Homo sapiens
aatatgttccacttaaagctgg

SEQ ID NO: 8506709 - DNA, 22 bp, Homo sapiens
aatattaatagaaggggttcta

SEQ ID NO: 8506710 - DNA, 22 bp, Homo sapiens
aatattagtttctcaagagaga

SEQ ID NO: 8506711 - DNA, 22 bp, Homo sapiens
aatattagtttctcaagagaga

SEQ ID NO: 8506712 - DNA, 22 bp, Homo sapiens
aatattcaagttattctttctt

SEQ ID NO: 8506713 - DNA, 22 bp, Homo sapiens
aatatgtgaggtatgttcagtg

SEQ ID NO: 8506714 - DNA, 22 bp, Homo sapiens
aatatgcatgtatacatgtgta

SEQ ID NO: 8506715 - DNA, 22 bp, Homo sapiens
aatatgcattaactgtgtacat

SEQ ID NO: 8506716 - DNA, 22 bp, Homo sapiens
agaaacctccatttattcactc

SEQ ID NO: 8506717 - DNA, 22 bp, Homo sapiens
agaaaccagggcttaccagtgc

SEQ ID NO: 8506718 - DNA, 22 bp, Homo sapiens
agaaaccagacttggcccattt

SEQ ID NO: 8506719 - DNA, 23 bp, Homo sapiens
agaaaccactgaagagatccagt

SEQ ID NO: 8506720 - DNA, 22 bp, Homo sapiens
agaaaattactccagagacaag

SEQ ID NO: 8506721 - DNA, 22 bp, Homo sapiens
agaaaattactccagagacaag

SEQ ID NO: 8506722 - DNA, 20 bp, Homo sapiens
agaaaatgttttcagctgga

SEQ ID NO: 8506723 - DNA, 22 bp, Homo sapiens
agaaaatgtgaacttgtgaatt

SEQ ID NO: 8506724 - DNA, 22 bp, Homo sapiens
agaaaattactccagagacaag

SEQ ID NO: 8506725 - DNA, 22 bp, Homo sapiens
agaaaatgtgaacttgtgaatt

SEQ ID NO: 8506726 - DNA, 21 bp, Homo sapiens
agaaaatggcgttttagattt

SEQ ID NO: 8506727 - DNA, 22 bp, Homo sapiens
agaaaatattcattgagaggct

SEQ ID NO: 8506728 - DNA, 21 bp, Homo sapiens
agaaaatggcgttttagattt

SEQ ID NO: 8506729 - DNA, 22 bp, Homo sapiens
agaaaatattcattgagaggct

SEQ ID NO: 8506730 - DNA, 22 bp, Homo sapiens
agaaaatattcattgagaggct

SEQ ID NO: 8506731 - DNA, 22 bp, Homo sapiens
agaaaatattcattgagaggct

SEQ ID NO: 8506732 - DNA, 22 bp, Homo sapiens
aatattcaagttattctttctt

SEQ ID NO: 8506733 - DNA, 22 bp, Homo sapiens
aatattcatttgcagaagaagt

SEQ ID NO: 8506734 - DNA, 22 bp, Homo sapiens
agaaaactggagcctggggttg

SEQ ID NO: 8506735 - DNA, 22 bp, Homo sapiens
agaaaataatttcttggctggt

SEQ ID NO: 8506736 - DNA, 22 bp, Homo sapiens
agaaaataatttcttggctggt

SEQ ID NO: 8506737 - DNA, 22 bp, Homo sapiens
agaaaataatttcttggctggt

SEQ ID NO: 8506738 - DNA, 22 bp, Homo sapiens
agaaaataatttcttggctggt

SEQ ID NO: 8506739 - DNA, 22 bp, Homo sapiens
agaaaataatttcttggctggt

SEQ ID NO: 8506740 - DNA, 22 bp, Homo sapiens
agaaaactgggaggagagcttc

SEQ ID NO: 8506741 - DNA, 22 bp, Homo sapiens
agaaaactgggaggagagcttc

SEQ ID NO: 8506742 - DNA, 22 bp, Homo sapiens
agaaaataatttcttggctggt

SEQ ID NO: 8506743 - DNA, 22 bp, Homo sapiens
aatctttaaggactcagtctct

SEQ ID NO: 8506744 - DNA, 22 bp, Homo sapiens
aatctttaaggactcagtctct

SEQ ID NO: 8506745 - DNA, 22 bp, Homo sapiens
aatcttggaagtgtccactggt

SEQ ID NO: 8506746 - DNA, 22 bp, Homo sapiens
aatcttggcaaatgtagcttcc

SEQ ID NO: 8506747 - DNA, 22 bp, Homo sapiens
aatcttgagtgttactctcatt

SEQ ID NO: 8506748 - DNA, 22 bp, Homo sapiens
aatcttgagtgttactctcatt

SEQ ID NO: 8506749 - DNA, 22 bp, Homo sapiens
aatcttgagggactcatgaggt

SEQ ID NO: 8506750 - DNA, 22 bp, Homo sapiens
aatcttctttcttaacagtaca

SEQ ID NO: 8506751 - DNA, 22 bp, Homo sapiens
aatcttctttcttaacagtaca

SEQ ID NO: 8506752 - DNA, 22 bp, Homo sapiens
aatcttctacttgacagttctc

SEQ ID NO: 8506753 - DNA, 22 bp, Homo sapiens
aatctttttcacaagaaagcac

SEQ ID NO: 8506754 - DNA, 22 bp, Homo sapiens
aatcttttaggggatcctgagg

SEQ ID NO: 8506755 - DNA, 22 bp, Homo sapiens
aatctttcaaatttctttgggt

SEQ ID NO: 8506756 - DNA, 22 bp, Homo sapiens
aatctttcattcattcatacat

SEQ ID NO: 8506757 - DNA, 22 bp, Homo sapiens
aatctttccctattaaatgtgg

SEQ ID NO: 8506758 - DNA, 22 bp, Homo sapiens
aatctttcgtttctcctgtctg

SEQ ID NO: 8506759 - DNA, 22 bp, Homo sapiens
aatcttcactcattcagagttg

SEQ ID NO: 8506760 - DNA, 22 bp, Homo sapiens
aatcttcactcattcagagttg

SEQ ID NO: 8506761 - DNA, 22 bp, Homo sapiens
aatcttcactcttaactgtgca

SEQ ID NO: 8506762 - DNA, 22 bp, Homo sapiens
aatcttcactcttaactgtgca

SEQ ID NO: 8506763 - DNA, 22 bp, Homo sapiens
aatcttcagtgtctaaaaagca

SEQ ID NO: 8506764 - DNA, 22 bp, Homo sapiens
aatcttcataaaaatctagtag

SEQ ID NO: 8506765 - DNA, 22 bp, Homo sapiens
aatcttcaacagaatggtagga

SEQ ID NO: 8506766 - DNA, 22 bp, Homo sapiens
aatcttaagctgaattctctcc

SEQ ID NO: 8506767 - DNA, 22 bp, Homo sapiens
aatcttacttatgatttttcgg

SEQ ID NO: 8506768 - DNA, 22 bp, Homo sapiens
aatcttaaagaatattctacca

SEQ ID NO: 8506769 - DNA, 22 bp, Homo sapiens
aatcttaagctgaattctctcc

SEQ ID NO: 8506770 - DNA, 22 bp, Homo sapiens
aatctgtttttgaaactttgta

SEQ ID NO: 8506771 - DNA, 22 bp, Homo sapiens
aatctgttttatcatttgttac

SEQ ID NO: 8506772 - DNA, 22 bp, Homo sapiens
aatcttaaagaatattctacca

SEQ ID NO: 8506773 - DNA, 22 bp, Homo sapiens
aatctgtttttgaaactttgta

SEQ ID NO: 8506774 - DNA, 22 bp, Homo sapiens
aatctgtttgtttacacctttt

SEQ ID NO: 8506775 - DNA, 22 bp, Homo sapiens
aatctgtttgtttacacctttt

SEQ ID NO: 8506776 - DNA, 22 bp, Homo sapiens
aatctgtttccattagagtcat

SEQ ID NO: 8506777 - DNA, 22 bp, Homo sapiens
aatctgtttccattagagtcat

SEQ ID NO: 8506778 - DNA, 22 bp, Homo sapiens
aatctgtttgatgcttgtgata

SEQ ID NO: 8506779 - DNA, 22 bp, Homo sapiens
aatctgtttccaatacttgcta

SEQ ID NO: 8506780 - DNA, 22 bp, Homo sapiens
aatctgtttagttctgcgtatg

SEQ ID NO: 8506781 - DNA, 22 bp, Homo sapiens
aatctgtttccatgttttattg

SEQ ID NO: 8506782 - DNA, 22 bp, Homo sapiens
aatctgtttccaatacttgcta

SEQ ID NO: 8506783 - DNA, 22 bp, Homo sapiens
aatctgttctactctattcaga

SEQ ID NO: 8506784 - DNA, 22 bp, Homo sapiens
aatctgttctactctattcaga

SEQ ID NO: 8506785 - DNA, 22 bp, Homo sapiens
aatctgttctactctattcaga

SEQ ID NO: 8506786 - DNA, 22 bp, Homo sapiens
aatctgttgatgcaaacctccc

SEQ ID NO: 8506787 - DNA, 22 bp, Homo sapiens
aatctgttgtcaggaatccaca

SEQ ID NO: 8506788 - DNA, 22 bp, Homo sapiens
aatctgtcttcttttgtggttt

SEQ ID NO: 8506789 - DNA, 22 bp, Homo sapiens
aatctgttcctgaggcaccaga

SEQ ID NO: 8506790 - DNA, 22 bp, Homo sapiens
aatctgtttaacagatttctgt

SEQ ID NO: 8506791 - DNA, 17 bp, Homo sapiens
aatctgtttacagtcag

SEQ ID NO: 8506792 - DNA, 17 bp, Homo sapiens
aatctgtttacagtcag

SEQ ID NO: 8506793 - DNA, 22 bp, Homo sapiens
agaaactaagtcataactcttt

SEQ ID NO: 8506794 - DNA, 22 bp, Homo sapiens
agaaactatcctgagtagcaaa

SEQ ID NO: 8506795 - DNA, 22 bp, Homo sapiens
agaaacctccatttattcactc

SEQ ID NO: 8506796 - DNA, 22 bp, Homo sapiens
agaaactaaagccaagggctct

SEQ ID NO: 8506797 - DNA, 22 bp, Homo sapiens
agaaactattatggtaaacaaa

SEQ ID NO: 8506798 - DNA, 22 bp, Homo sapiens
agaaactctggaagaactttta

SEQ ID NO: 8506799 - DNA, 22 bp, Homo sapiens
agaaactgaacacaagagtcgg

SEQ ID NO: 8506800 - DNA, 22 bp, Homo sapiens
aatctatatgcttttcacatac

SEQ ID NO: 8506801 - DNA, 22 bp, Homo sapiens
acctgggaaaaggagtggccat

SEQ ID NO: 8506802 - DNA, 20 bp, Homo sapiens
acctgggaaaaccttttcct

SEQ ID NO: 8506803 - DNA, 22 bp, Homo sapiens
acctgggaacgctttgtggagg

SEQ ID NO: 8506804 - DNA, 22 bp, Homo sapiens
acctgggaaagccgtggaaagg

SEQ ID NO: 8506805 - DNA, 22 bp, Homo sapiens
acctgggaggcagaggttgcag

SEQ ID NO: 8506806 - DNA, 22 bp, Homo sapiens
acctgggaggcagaggttgcag

SEQ ID NO: 8506807 - DNA, 22 bp, Homo sapiens
acctgggaggcggaggttgcag

SEQ ID NO: 8506808 - DNA, 22 bp, Homo sapiens
acctgggaggcggaggttgcag

SEQ ID NO: 8506809 - DNA, 22 bp, Homo sapiens
acctgggagtcacacctgagaa

SEQ ID NO: 8506810 - DNA, 22 bp, Homo sapiens
acctgggagtatgcagtggtga

SEQ ID NO: 8506811 - DNA, 22 bp, Homo sapiens
acctgggatggggccaggttta

SEQ ID NO: 8506812 - DNA, 22 bp, Homo sapiens
accttcttccaccaaaaacgtc

SEQ ID NO: 8506813 - DNA, 22 bp, Homo sapiens
accttctggtctgcctgacagc

SEQ ID NO: 8506814 - DNA, 22 bp, Homo sapiens
accttctgaccagttatcttga

SEQ ID NO: 8506815 - DNA, 22 bp, Homo sapiens
accttctgaccagttatcttga

SEQ ID NO: 8506816 - DNA, 20 bp, Homo sapiens
acctggggttgcctgtgctc

SEQ ID NO: 8506817 - DNA, 22 bp, Homo sapiens
acctgggcattttggatgatta

SEQ ID NO: 8506818 - DNA, 22 bp, Homo sapiens
accttggaaatgcccattgcct

SEQ ID NO: 8506819 - DNA, 22 bp, Homo sapiens
accttggaaatgcccattgcct

SEQ ID NO: 8506820 - DNA, 23 bp, Homo sapiens
accttggacttcccagcttccag

SEQ ID NO: 8506821 - DNA, 22 bp, Homo sapiens
accttggaactgaagtgttttt

SEQ ID NO: 8506822 - DNA, 23 bp, Homo sapiens
accttggacttcccagcttccag

SEQ ID NO: 8506823 - DNA, 22 bp, Homo sapiens
accttgggcaacctgctcctgc

SEQ ID NO: 8506824 - DNA, 22 bp, Homo sapiens
aagtaacaatgctgttgaattg

SEQ ID NO: 8506825 - DNA, 22 bp, Homo sapiens
aagtaacacatgttacttctgc

SEQ ID NO: 8506826 - DNA, 18 bp, Homo sapiens
aagtaacagaagagcaca

SEQ ID NO: 8506827 - DNA, 22 bp, Homo sapiens
aagtaacacggaacttgaagca

SEQ ID NO: 8506828 - DNA, 18 bp, Homo sapiens
aagtaacagaagagcaca

SEQ ID NO: 8506829 - DNA, 18 bp, Homo sapiens
aagtaacagaagagcaca

SEQ ID NO: 8506830 - DNA, 20 bp, Homo sapiens
acctggcttcctcttggcat

SEQ ID NO: 8506831 - DNA, 18 bp, Homo sapiens
acctgcctgttcttctct

SEQ ID NO: 8506832 - DNA, 18 bp, Homo sapiens
acctgcctgttcttctct

SEQ ID NO: 8506833 - DNA, 22 bp, Homo sapiens
aagtaaaccacagagaagccac

SEQ ID NO: 8506834 - DNA, 22 bp, Homo sapiens
aagtaaatatctgtttatagca

SEQ ID NO: 8506835 - DNA, 22 bp, Homo sapiens
aagtaaatatctgtttatagca

SEQ ID NO: 8506836 - DNA, 22 bp, Homo sapiens
aagtaaatatctgtagtcttta

SEQ ID NO: 8506837 - DNA, 21 bp, Homo sapiens
aagtaaatcagagaaataacc

SEQ ID NO: 8506838 - DNA, 21 bp, Homo sapiens
aagtaaatcagagaaataacc

SEQ ID NO: 8506839 - DNA, 21 bp, Homo sapiens
aagtaaatcagagaaataacc

SEQ ID NO: 8506840 - DNA, 22 bp, Homo sapiens
aagtaaatgttggagctcaaat

SEQ ID NO: 8506841 - DNA, 22 bp, Homo sapiens
aagtaaatgttggagctcaaat

SEQ ID NO: 8506842 - DNA, 22 bp, Homo sapiens
aagtaaatgttggagctcaaat

SEQ ID NO: 8506843 - DNA, 22 bp, Homo sapiens
acctttatagctgattatgaca

SEQ ID NO: 8506844 - DNA, 22 bp, Homo sapiens
acctttatatgaaagatgacat

SEQ ID NO: 8506845 - DNA, 22 bp, Homo sapiens
aagtgaagaaatacatgagaat

SEQ ID NO: 8506846 - DNA, 22 bp, Homo sapiens
aagtctcttttcttcctgtatt

SEQ ID NO: 8506847 - DNA, 22 bp, Homo sapiens
acctttatcgccatcattgtgc

SEQ ID NO: 8506848 - DNA, 22 bp, Homo sapiens
aagtctgactagaatctctccc

SEQ ID NO: 8506849 - DNA, 22 bp, Homo sapiens
aagtgaatgatgtgaagtgtaa

SEQ ID NO: 8506850 - DNA, 22 bp, Homo sapiens
aagtgaatctcctttctttatt

SEQ ID NO: 8506851 - DNA, 22 bp, Homo sapiens
aagtgaatttcattccaattct

SEQ ID NO: 8506852 - DNA, 22 bp, Homo sapiens
aagtgaatgtagcaaacttgaa

SEQ ID NO: 8506853 - DNA, 22 bp, Homo sapiens
aagtgactatttgagtacatca

SEQ ID NO: 8506854 - DNA, 22 bp, Homo sapiens
aagtgacctcatggtttctcct

SEQ ID NO: 8506855 - DNA, 22 bp, Homo sapiens
aagtgcaatgaatagctgcaat

SEQ ID NO: 8506856 - DNA, 22 bp, Homo sapiens
aagtgcaatgaatagctgcaat

SEQ ID NO: 8506857 - DNA, 22 bp, Homo sapiens
aagtgcaatgaatagctgcaat

SEQ ID NO: 8506858 - DNA, 22 bp, Homo sapiens
aagtgcaatttgaaattctgca

SEQ ID NO: 8506859 - DNA, 22 bp, Homo sapiens
aagtgcaatttgaaattctgca

SEQ ID NO: 8506860 - DNA, 22 bp, Homo sapiens
aagtgcaaatctgtggctgaaa

SEQ ID NO: 8506861 - DNA, 22 bp, Homo sapiens
aagtgatttgtacaaaatgtcg

SEQ ID NO: 8506862 - DNA, 22 bp, Homo sapiens
aagtgattctagtcatgattct

SEQ ID NO: 8506863 - DNA, 22 bp, Homo sapiens
aagtgatttagtcttataaagg

SEQ ID NO: 8506864 - DNA, 22 bp, Homo sapiens
aagtgatttagtcttataaagg

SEQ ID NO: 8506865 - DNA, 22 bp, Homo sapiens
aagtgattctagtcatgattct

SEQ ID NO: 8506866 - DNA, 22 bp, Homo sapiens
aagtgatgctacgactttgaca

SEQ ID NO: 8506867 - DNA, 22 bp, Homo sapiens
aagtgatgctacgactttgaca

SEQ ID NO: 8506868 - DNA, 22 bp, Homo sapiens
aagtgagattatatgtacggga

SEQ ID NO: 8506869 - DNA, 18 bp, Homo sapiens
aagtgactggcaggccaa

SEQ ID NO: 8506870 - DNA, 22 bp, Homo sapiens
aagtgactatttgagtacatca

SEQ ID NO: 8506871 - DNA, 22 bp, Homo sapiens
aagtgaggtttctgctttcaga

SEQ ID NO: 8506872 - DNA, 22 bp, Homo sapiens
aagtgagtggcctggagaggtg

SEQ ID NO: 8506873 - DNA, 23 bp, Homo sapiens
actcagagaccccgggaagtgac

SEQ ID NO: 8506874 - DNA, 22 bp, Homo sapiens
aagtgcataagtatgattattt

SEQ ID NO: 8506875 - DNA, 22 bp, Homo sapiens
actcagtacatctggagttggc

SEQ ID NO: 8506876 - DNA, 23 bp, Homo sapiens
actcagtgagggccttgggctgc

SEQ ID NO: 8506877 - DNA, 22 bp, Homo sapiens
actcagtgaattttcatcaaat

SEQ ID NO: 8506878 - DNA, 22 bp, Homo sapiens
actcatctgaaaaatgaggaga

SEQ ID NO: 8506879 - DNA, 22 bp, Homo sapiens
actcatctattagatatctgtt

SEQ ID NO: 8506880 - DNA, 22 bp, Homo sapiens
actcatcaactgttacaaatgt

SEQ ID NO: 8506881 - DNA, 22 bp, Homo sapiens
actcagtgggcttgatgtcgaa

SEQ ID NO: 8506882 - DNA, 22 bp, Homo sapiens
actcagtggcactttggaattt

SEQ ID NO: 8506883 - DNA, 22 bp, Homo sapiens
actcatcttccctcctggaggg

SEQ ID NO: 8506884 - DNA, 22 bp, Homo sapiens
actcatctgccattcctgtacc

SEQ ID NO: 8506885 - DNA, 21 bp, Homo sapiens
actcatctttttggagaccag

SEQ ID NO: 8506886 - DNA, 22 bp, Homo sapiens
actcatgtcctaggagtaaagc

SEQ ID NO: 8506887 - DNA, 22 bp, Homo sapiens
actcatgtcatgtgttctttac

SEQ ID NO: 8506888 - DNA, 22 bp, Homo sapiens
actcatgtaagcggaatgtagt

SEQ ID NO: 8506889 - DNA, 22 bp, Homo sapiens
actcatgatatgcctataagat

SEQ ID NO: 8506890 - DNA, 22 bp, Homo sapiens
actcatggtagcacaggctgtg

SEQ ID NO: 8506891 - DNA, 22 bp, Homo sapiens
aagtggcacgctttttggagtt

SEQ ID NO: 8506892 - DNA, 22 bp, Homo sapiens
aagtttgttcattcattcatcc

SEQ ID NO: 8506893 - DNA, 22 bp, Homo sapiens
aagttttactgaggacacatgt

SEQ ID NO: 8506894 - DNA, 22 bp, Homo sapiens
aagttttaacaagtacttacta

SEQ ID NO: 8506895 - DNA, 22 bp, Homo sapiens
aagttttaacaagtacttacta

SEQ ID NO: 8506896 - DNA, 22 bp, Homo sapiens
aagttttaacaagtacttacta

SEQ ID NO: 8506897 - DNA, 22 bp, Homo sapiens
aagtggctttgagcttctgcca

SEQ ID NO: 8506898 - DNA, 22 bp, Homo sapiens
aagtttggtccttctaagaaga

SEQ ID NO: 8506899 - DNA, 22 bp, Homo sapiens
aagtttgtagctggatgtctgt

SEQ ID NO: 8506900 - DNA, 22 bp, Homo sapiens
aagtggctcatgtggcttctgc

SEQ ID NO: 8506901 - DNA, 22 bp, Homo sapiens
aagtggcatgtataagaaagaa

SEQ ID NO: 8506902 - DNA, 22 bp, Homo sapiens
aagtggccctaggccaagggga

SEQ ID NO: 8506903 - DNA, 22 bp, Homo sapiens
aagtggcagccttagaaggaga

SEQ ID NO: 8506904 - DNA, 22 bp, Homo sapiens
aagtggcagttcaggaagcaga

SEQ ID NO: 8506905 - DNA, 22 bp, Homo sapiens
aataaatcaatcctattggtag

SEQ ID NO: 8506906 - DNA, 22 bp, Homo sapiens
aataaatgttaagattgtctca

SEQ ID NO: 8506907 - DNA, 22 bp, Homo sapiens
aataaatgttaagattgtctca

SEQ ID NO: 8506908 - DNA, 22 bp, Homo sapiens
aataaatgttaagattgtctca

SEQ ID NO: 8506909 - DNA, 22 bp, Homo sapiens
aataaatgtttgttggatgttt

SEQ ID NO: 8506910 - DNA, 22 bp, Homo sapiens
aataaatgttaagattgtctca

SEQ ID NO: 8506911 - DNA, 22 bp, Homo sapiens
aataacagagtcttcaagatag

SEQ ID NO: 8506912 - DNA, 22 bp, Homo sapiens
aataacagagtcttcaagatag

SEQ ID NO: 8506913 - DNA, 22 bp, Homo sapiens
aataacagagtcttcaagatag

SEQ ID NO: 8506914 - DNA, 22 bp, Homo sapiens
aataacagagtcttcaagatag

SEQ ID NO: 8506915 - DNA, 22 bp, Homo sapiens
aataacagattttcaagctgtg

SEQ ID NO: 8506916 - DNA, 22 bp, Homo sapiens
aataacagagtcttcaagatag

SEQ ID NO: 8506917 - DNA, 22 bp, Homo sapiens
aataacagagaagggtggcttc

SEQ ID NO: 8506918 - DNA, 22 bp, Homo sapiens
aataacagagaagggtggcttc

SEQ ID NO: 8506919 - DNA, 22 bp, Homo sapiens
aataacagaaacttgagcatca

SEQ ID NO: 8506920 - DNA, 22 bp, Homo sapiens
aataacagaaacttgagcatca

SEQ ID NO: 8506921 - DNA, 22 bp, Homo sapiens
aataaatgtttgttggatgttt

SEQ ID NO: 8506922 - DNA, 22 bp, Homo sapiens
aataaagacaaacaggggagcc

SEQ ID NO: 8506923 - DNA, 22 bp, Homo sapiens
aataaagacaaacaggggagcc

SEQ ID NO: 8506924 - DNA, 22 bp, Homo sapiens
aataaagcatgaggcatttatc

SEQ ID NO: 8506925 - DNA, 22 bp, Homo sapiens
aataaagcatgaggcatttatc

SEQ ID NO: 8506926 - DNA, 22 bp, Homo sapiens
aataaagcagggtccttgcact

SEQ ID NO: 8506927 - DNA, 22 bp, Homo sapiens
aataaaggcaccataaggcaaa

SEQ ID NO: 8506928 - DNA, 22 bp, Homo sapiens
aataaagtgtattctttgtcat

SEQ ID NO: 8506929 - DNA, 22 bp, Homo sapiens
aataaatcaatcctattggtag

SEQ ID NO: 8506930 - DNA, 22 bp, Homo sapiens
aataaagtgtattctttgtcat

SEQ ID NO: 8506931 - DNA, 19 bp, Homo sapiens
actgagaccacagacaagt

SEQ ID NO: 8506932 - DNA, 22 bp, Homo sapiens
actgagactgcccctgtaacaa

SEQ ID NO: 8506933 - DNA, 22 bp, Homo sapiens
aataaaatggtcagttttctca

SEQ ID NO: 8506934 - DNA, 22 bp, Homo sapiens
aataaacttccactgtgttttt

SEQ ID NO: 8506935 - DNA, 22 bp, Homo sapiens
aataaagaatggatgagatcgt

SEQ ID NO: 8506936 - DNA, 22 bp, Homo sapiens
actgagaagctcgcagtgatgc

SEQ ID NO: 8506937 - DNA, 22 bp, Homo sapiens
actgagaagattctcactctta

SEQ ID NO: 8506938 - DNA, 22 bp, Homo sapiens
actgagaagattctcactctta

SEQ ID NO: 8506939 - DNA, 22 bp, Homo sapiens
actgagaactcaagagaaaagg

SEQ ID NO: 8506940 - DNA, 19 bp, Homo sapiens
actgagaacctgacccagg

SEQ ID NO: 8506941 - DNA, 22 bp, Homo sapiens
actgagaacttgccaaggactg

SEQ ID NO: 8506942 - DNA, 22 bp, Homo sapiens
actgagaacttggggacagagg

SEQ ID NO: 8506943 - DNA, 22 bp, Homo sapiens
actgagaaatttccagacttgc

SEQ ID NO: 8506944 - DNA, 22 bp, Homo sapiens
actgagaacttggggacagagg

SEQ ID NO: 8506945 - DNA, 22 bp, Homo sapiens
actgagaagattctcactctta

SEQ ID NO: 8506946 - DNA, 22 bp, Homo sapiens
aagttttatgggaagatgtgca

SEQ ID NO: 8506947 - DNA, 21 bp, Homo sapiens
aagttttatgttgccatttgt

SEQ ID NO: 8506948 - DNA, 22 bp, Homo sapiens
aagttttattggaacatagcca

SEQ ID NO: 8506949 - DNA, 22 bp, Homo sapiens
aagttttattggctatagcact

SEQ ID NO: 8506950 - DNA, 22 bp, Homo sapiens
aagttttattggctatagcact

SEQ ID NO: 8506951 - DNA, 22 bp, Homo sapiens
actgacatttttccctaagcat

SEQ ID NO: 8506952 - DNA, 21 bp, Homo sapiens
actgaccacttctgcctgtct

SEQ ID NO: 8506953 - DNA, 22 bp, Homo sapiens
actgaccagatatgtcatacct

SEQ ID NO: 8506954 - DNA, 22 bp, Homo sapiens
actgactcttgttaacttcagc

SEQ ID NO: 8506955 - DNA, 22 bp, Homo sapiens
actgactttggaatatttctag

SEQ ID NO: 8506956 - DNA, 22 bp, Homo sapiens
actgagaaagaccacatggaga

SEQ ID NO: 8506957 - DNA, 22 bp, Homo sapiens
actgagaaatttccagacttgc

SEQ ID NO: 8506958 - DNA, 22 bp, Homo sapiens
acaggtccttataagagcactc

SEQ ID NO: 8506959 - DNA, 22 bp, Homo sapiens
acaggtccttataagagcactc

SEQ ID NO: 8506960 - DNA, 22 bp, Homo sapiens
acaggtctccagagtgagagga

SEQ ID NO: 8506961 - DNA, 22 bp, Homo sapiens
acaggtagtctgaacactgggt

SEQ ID NO: 8506962 - DNA, 22 bp, Homo sapiens
acaggtcaacgagagcaggcaa

SEQ ID NO: 8506963 - DNA, 22 bp, Homo sapiens
acaggtcagataaaggctggtg

SEQ ID NO: 8506964 - DNA, 22 bp, Homo sapiens
acaggtcaacgagagcaggcaa

SEQ ID NO: 8506965 - DNA, 22 bp, Homo sapiens
acaggtcctcaagtcagctggg

SEQ ID NO: 8506966 - DNA, 22 bp, Homo sapiens
acaggtcctcaagtcagctggg

SEQ ID NO: 8506967 - DNA, 22 bp, Homo sapiens
acaggtgacctgctcatatgaa

SEQ ID NO: 8506968 - DNA, 22 bp, Homo sapiens
acaggtgacctgctcatatgaa

SEQ ID NO: 8506969 - DNA, 23 bp, Homo sapiens
acagggaaaagtcatcagtgtga

SEQ ID NO: 8506970 - DNA, 23 bp, Homo sapiens
acagggcttatctgtcactcatc

SEQ ID NO: 8506971 - DNA, 22 bp, Homo sapiens
acaggtacatacttgggatcca

SEQ ID NO: 8506972 - DNA, 22 bp, Homo sapiens
acaggcttttttagaatgacat

SEQ ID NO: 8506973 - DNA, 21 bp, Homo sapiens
acaggctttagaaaatgactc

SEQ ID NO: 8506974 - DNA, 21 bp, Homo sapiens
acaggctttagaaaatgactc

SEQ ID NO: 8506975 - DNA, 22 bp, Homo sapiens
acaggcttctcacagaaaaggg

SEQ ID NO: 8506976 - DNA, 22 bp, Homo sapiens
acaggcttcagatgtattaact

SEQ ID NO: 8506977 - DNA, 22 bp, Homo sapiens
acaggcttactgtttcataggg

SEQ ID NO: 8506978 - DNA, 22 bp, Homo sapiens
acaggctgccacttgcatccaa

SEQ ID NO: 8506979 - DNA, 22 bp, Homo sapiens
acaggctgatagaccataaata

SEQ ID NO: 8506980 - DNA, 22 bp, Homo sapiens
acaggctgccacttgcatccaa

SEQ ID NO: 8506981 - DNA, 22 bp, Homo sapiens
acaggctgttggggtccagggt

SEQ ID NO: 8506982 - DNA, 22 bp, Homo sapiens
acaggctgttggggtccagggt

SEQ ID NO: 8506983 - DNA, 22 bp, Homo sapiens
acaggcttacaggctgcaagta

SEQ ID NO: 8506984 - DNA, 22 bp, Homo sapiens
acaggctgaaagttaagttctg

SEQ ID NO: 8506985 - DNA, 22 bp, Homo sapiens
acaggctgacttcctgccatgt

SEQ ID NO: 8506986 - DNA, 22 bp, Homo sapiens
acaggctgacttcctgccatgt

SEQ ID NO: 8506987 - DNA, 22 bp, Homo sapiens
acaggctgacttcctgccatgt

SEQ ID NO: 8506988 - DNA, 22 bp, Homo sapiens
acaggctgacttcctgccatgt

SEQ ID NO: 8506989 - DNA, 22 bp, Homo sapiens
acaggctgagcgtccatcttca

SEQ ID NO: 8506990 - DNA, 22 bp, Homo sapiens
acaggctgaggatgattgcatc

SEQ ID NO: 8506991 - DNA, 22 bp, Homo sapiens
acaggtgtgagaacatgccttg

SEQ ID NO: 8506992 - DNA, 22 bp, Homo sapiens
acaggtgtctaaggcagacagc

SEQ ID NO: 8506993 - DNA, 22 bp, Homo sapiens
acaggtgattcaggctctggga

SEQ ID NO: 8506994 - DNA, 22 bp, Homo sapiens
acaggtgtagcaggagcatcaa

SEQ ID NO: 8506995 - DNA, 22 bp, Homo sapiens
acagtgcagtgtgatgagtatt

SEQ ID NO: 8506996 - DNA, 22 bp, Homo sapiens
acagtgcaggtctcaacaatta

SEQ ID NO: 8506997 - DNA, 19 bp, Homo sapiens
acagtgcatgggacctggt

SEQ ID NO: 8506998 - DNA, 22 bp, Homo sapiens
acagtgctaaacacttcttgaa

SEQ ID NO: 8506999 - DNA, 22 bp, Homo sapiens
acagtgctaaacacttcttgaa

SEQ ID NO: 8507000 - DNA, 22 bp, Homo sapiens
acagtgctgtctatctcactaa

SEQ ID NO: 8507001 - DNA, 20 bp, Homo sapiens
acagtgggtggggagcactg

SEQ ID NO: 8507002 - DNA, 18 bp, Homo sapiens
acagtgctgtcactgctt

SEQ ID NO: 8507003 - DNA, 22 bp, Homo sapiens
acagtggtgagtgactgatagg

SEQ ID NO: 8507004 - DNA, 22 bp, Homo sapiens
acagtgtaatatgggagtcagt

SEQ ID NO: 8507005 - DNA, 22 bp, Homo sapiens
acagtgctggctacaaccctgg

SEQ ID NO: 8507006 - DNA, 22 bp, Homo sapiens
acagtgctcatgtgacatggtg

SEQ ID NO: 8507007 - DNA, 22 bp, Homo sapiens
acagtttactggccttgccgtt

SEQ ID NO: 8507008 - DNA, 22 bp, Homo sapiens
acagtttacagggatttgagct

SEQ ID NO: 8507009 - DNA, 22 bp, Homo sapiens
acagtgtccttgtggtccctgt

SEQ ID NO: 8507010 - DNA, 22 bp, Homo sapiens
acagtgtcatgtcgtgttcccc

SEQ ID NO: 8507011 - DNA, 22 bp, Homo sapiens
acagtgtagtgtgatgtcaaaa

SEQ ID NO: 8507012 - DNA, 22 bp, Homo sapiens
acagtgtatattgtttatctgg

SEQ ID NO: 8507013 - DNA, 22 bp, Homo sapiens
acagtgtagaatcctgtactta

SEQ ID NO: 8507014 - DNA, 22 bp, Homo sapiens
acagtgtactaggtacatgttc

SEQ ID NO: 8507015 - DNA, 22 bp, Homo sapiens
acaggcagagaactcagccaga

SEQ ID NO: 8507016 - DNA, 22 bp, Homo sapiens
acaggcagagaactcagccaga

SEQ ID NO: 8507017 - DNA, 22 bp, Homo sapiens
acaggcagagaactcagccaga

SEQ ID NO: 8507018 - DNA, 22 bp, Homo sapiens
aagccctgagcactgcagagaa

SEQ ID NO: 8507019 - DNA, 22 bp, Homo sapiens
aagccctgagcactgcagagaa

SEQ ID NO: 8507020 - DNA, 22 bp, Homo sapiens
aagccctgactatgaagacata

SEQ ID NO: 8507021 - DNA, 22 bp, Homo sapiens
aagccctgacctgagagtccgt

SEQ ID NO: 8507022 - DNA, 22 bp, Homo sapiens
aagccctgacctgagagtccgt

SEQ ID NO: 8507023 - DNA, 22 bp, Homo sapiens
aagccctgcagtctctgccaca

SEQ ID NO: 8507024 - DNA, 22 bp, Homo sapiens
aagccctgataggaaaatgctg

SEQ ID NO: 8507025 - DNA, 22 bp, Homo sapiens
aagccctgataggaaaatgctg

SEQ ID NO: 8507026 - DNA, 22 bp, Homo sapiens
aagccctggcaatgtcagatga

SEQ ID NO: 8507027 - DNA, 22 bp, Homo sapiens
aagccctggcaatgtcagatga

SEQ ID NO: 8507028 - DNA, 22 bp, Homo sapiens
aagccctggattaaagatgcca

SEQ ID NO: 8507029 - DNA, 22 bp, Homo sapiens
aagccctggattaaagatgcca

SEQ ID NO: 8507030 - DNA, 22 bp, Homo sapiens
aagccctggatagagagaactg

SEQ ID NO: 8507031 - DNA, 22 bp, Homo sapiens
aagccctggattaaagatgcca

SEQ ID NO: 8507032 - DNA, 22 bp, Homo sapiens
aagccctggatagagagaactg

SEQ ID NO: 8507033 - DNA, 22 bp, Homo sapiens
aagccctggaactttcctagcc

SEQ ID NO: 8507034 - DNA, 22 bp, Homo sapiens
aagccctggacggcccttcccc

SEQ ID NO: 8507035 - DNA, 22 bp, Homo sapiens
aagccctgccacccattcactg

SEQ ID NO: 8507036 - DNA, 22 bp, Homo sapiens
aagccctggcgggtggagggcc

SEQ ID NO: 8507037 - DNA, 22 bp, Homo sapiens
aagccctggcgggtggagggcc

SEQ ID NO: 8507038 - DNA, 22 bp, Homo sapiens
aagccctggcaatgtcagatga

SEQ ID NO: 8507039 - DNA, 22 bp, Homo sapiens
aagccctggcccaaccttgatt

SEQ ID NO: 8507040 - DNA, 22 bp, Homo sapiens
acaggccagaggtggggcagcc

SEQ ID NO: 8507041 - DNA, 22 bp, Homo sapiens
aagccctggctcagctcaccag

SEQ ID NO: 8507042 - DNA, 22 bp, Homo sapiens
acaggccagaggtggggcagcc

SEQ ID NO: 8507043 - DNA, 20 bp, Homo sapiens
acaggagatctgaggaaagg

SEQ ID NO: 8507044 - DNA, 20 bp, Homo sapiens
acaggagatctgaggaaagg

SEQ ID NO: 8507045 - DNA, 22 bp, Homo sapiens
acaggagcaacagactaagaca

SEQ ID NO: 8507046 - DNA, 22 bp, Homo sapiens
acaggagccaaacacatgccag

SEQ ID NO: 8507047 - DNA, 22 bp, Homo sapiens
acaggagcccaggatgggcgga

SEQ ID NO: 8507048 - DNA, 22 bp, Homo sapiens
acaggaggagcagctgtgtgcc

SEQ ID NO: 8507049 - DNA, 22 bp, Homo sapiens
acaggaggagcagctgtgtgcc

SEQ ID NO: 8507050 - DNA, 22 bp, Homo sapiens
acaggaggagcagctgtgtgcc

SEQ ID NO: 8507051 - DNA, 22 bp, Homo sapiens
acaggcactgtcaagtcatgaa

SEQ ID NO: 8507052 - DNA, 22 bp, Homo sapiens
acaggcactctcattaaaatag

SEQ ID NO: 8507053 - DNA, 22 bp, Homo sapiens
acaggcactgtcaagtcatgaa

SEQ ID NO: 8507054 - DNA, 22 bp, Homo sapiens
acaggaggagctgtttcaggga

SEQ ID NO: 8507055 - DNA, 22 bp, Homo sapiens
acaggcacctgccaccacatct

SEQ ID NO: 8507056 - DNA, 22 bp, Homo sapiens
acaggcacctgccaccacatct

SEQ ID NO: 8507057 - DNA, 22 bp, Homo sapiens
acaggcactttgacatgccatc

SEQ ID NO: 8507058 - DNA, 22 bp, Homo sapiens
acaggcactttgacatgccatc

SEQ ID NO: 8507059 - DNA, 22 bp, Homo sapiens
acaggcactgtcaagtcatgaa

SEQ ID NO: 8507060 - DNA, 19 bp, Homo sapiens
acaggcagaattgggtgtg

SEQ ID NO: 8507061 - DNA, 19 bp, Homo sapiens
acaggcagaattgggtgtg

SEQ ID NO: 8507062 - DNA, 20 bp, Homo sapiens
acagatgaggaaaatgaagt

SEQ ID NO: 8507063 - DNA, 22 bp, Homo sapiens
acagatgagagacaatgtgcta

SEQ ID NO: 8507064 - DNA, 22 bp, Homo sapiens
acagatgagactccaggacctt

SEQ ID NO: 8507065 - DNA, 22 bp, Homo sapiens
acagatgagagacaatgtgcta

SEQ ID NO: 8507066 - DNA, 20 bp, Homo sapiens
acagatgaggaaaatgaagt

SEQ ID NO: 8507067 - DNA, 20 bp, Homo sapiens
acagatgaggaaaatgaagt

SEQ ID NO: 8507068 - DNA, 22 bp, Homo sapiens
acagatgaggaagagtcagcca

SEQ ID NO: 8507069 - DNA, 22 bp, Homo sapiens
acagatgaggaagagtcagcca

SEQ ID NO: 8507070 - DNA, 22 bp, Homo sapiens
acagatgaggaagagtcagcca

SEQ ID NO: 8507071 - DNA, 22 bp, Homo sapiens
acagatttgatctgagaacaaa

SEQ ID NO: 8507072 - DNA, 22 bp, Homo sapiens
acagatttgatctgagaacaaa

SEQ ID NO: 8507073 - DNA, 22 bp, Homo sapiens
acagctggagtgttggtgaggt

SEQ ID NO: 8507074 - DNA, 22 bp, Homo sapiens
acagctggagtgttggtgaggt

SEQ ID NO: 8507075 - DNA, 22 bp, Homo sapiens
acagcttgcatgcagaggcact

SEQ ID NO: 8507076 - DNA, 22 bp, Homo sapiens
acagcttgaatcttaagctctt

SEQ ID NO: 8507077 - DNA, 22 bp, Homo sapiens
acagcttgcaatggctttcaac

SEQ ID NO: 8507078 - DNA, 22 bp, Homo sapiens
acagctggagtgttggtgaggt

SEQ ID NO: 8507079 - DNA, 22 bp, Homo sapiens
acagctggagtgttggtgaggt

SEQ ID NO: 8507080 - DNA, 22 bp, Homo sapiens
acagatttttggtaaataattt

SEQ ID NO: 8507081 - DNA, 22 bp, Homo sapiens
acagattttattattcaggtat

SEQ ID NO: 8507082 - DNA, 22 bp, Homo sapiens
acaggagaccctgctggttctg

SEQ ID NO: 8507083 - DNA, 21 bp, Homo sapiens
acaggagaccgcctggcagtc

SEQ ID NO: 8507084 - DNA, 21 bp, Homo sapiens
acaggagaccgcctggcagtc

SEQ ID NO: 8507085 - DNA, 21 bp, Homo sapiens
acaggagaccgcctggcagtc

SEQ ID NO: 8507086 - DNA, 21 bp, Homo sapiens
acaggagaccgcctggcagtc

SEQ ID NO: 8507087 - DNA, 22 bp, Homo sapiens
acaggaaagagctaggcatagg

SEQ ID NO: 8507088 - DNA, 22 bp, Homo sapiens
acaggaacagcttgatggcatc

SEQ ID NO: 8507089 - DNA, 22 bp, Homo sapiens
acaggaaccaggcaggtcgatt

SEQ ID NO: 8507090 - DNA, 22 bp, Homo sapiens
acaggaaattggcatatcagtt

SEQ ID NO: 8507091 - DNA, 22 bp, Homo sapiens
acaggaaattggcatatcagtt

SEQ ID NO: 8507092 - DNA, 22 bp, Homo sapiens
acaggaaagagctaggcatagg

SEQ ID NO: 8507093 - DNA, 22 bp, Homo sapiens
acagcttttgaaaaattactgg

SEQ ID NO: 8507094 - DNA, 22 bp, Homo sapiens
acagcttgggatgctttatttc

SEQ ID NO: 8507095 - DNA, 22 bp, Homo sapiens
acagcttgtctggtttcaggtc

SEQ ID NO: 8507096 - DNA, 22 bp, Homo sapiens
acagcttgtatcccaatggagc

SEQ ID NO: 8507097 - DNA, 22 bp, Homo sapiens
acagctttgggcaatgctatga

SEQ ID NO: 8507098 - DNA, 22 bp, Homo sapiens
acagcttttatgggaccagcca

SEQ ID NO: 8507099 - DNA, 22 bp, Homo sapiens
accagcacggattagaatgctt

SEQ ID NO: 8507100 - DNA, 22 bp, Homo sapiens
accagcacttccagaggtcagg

SEQ ID NO: 8507101 - DNA, 22 bp, Homo sapiens
aagggcagcttaaattggtagc

SEQ ID NO: 8507102 - DNA, 22 bp, Homo sapiens
aagggcaggaaaagatggatgt

SEQ ID NO: 8507103 - DNA, 22 bp, Homo sapiens
aagggcagctgacagatgctta

SEQ ID NO: 8507104 - DNA, 22 bp, Homo sapiens
accagctgccttttcttagtag

SEQ ID NO: 8507105 - DNA, 22 bp, Homo sapiens
accagctgccttttcttagtag

SEQ ID NO: 8507106 - DNA, 22 bp, Homo sapiens
accagctgctgattgctaaatg

SEQ ID NO: 8507107 - DNA, 23 bp, Homo sapiens
accagctgccctgaactttgtgc

SEQ ID NO: 8507108 - DNA, 23 bp, Homo sapiens
accagctgccctgaactttgtgc

SEQ ID NO: 8507109 - DNA, 22 bp, Homo sapiens
accagctgcctggtctatctgc

SEQ ID NO: 8507110 - DNA, 22 bp, Homo sapiens
accagctgagtaggggagggcc

SEQ ID NO: 8507111 - DNA, 22 bp, Homo sapiens
accagctgagttctcggatggt

SEQ ID NO: 8507112 - DNA, 22 bp, Homo sapiens
accagctgatttaagaataaag

SEQ ID NO: 8507113 - DNA, 22 bp, Homo sapiens
accagctgccaagggctacact

SEQ ID NO: 8507114 - DNA, 22 bp, Homo sapiens
accagctgccaagggctacact

SEQ ID NO: 8507115 - DNA, 22 bp, Homo sapiens
aagggcagcctgactcacggtc

SEQ ID NO: 8507116 - DNA, 22 bp, Homo sapiens
aagggcagcctgactcacggtc

SEQ ID NO: 8507117 - DNA, 22 bp, Homo sapiens
aagggcagctgacagatgctta

SEQ ID NO: 8507118 - DNA, 22 bp, Homo sapiens
aagggcagctattatcgtcatc

SEQ ID NO: 8507119 - DNA, 22 bp, Homo sapiens
aagggcagctattatcgtcatc

SEQ ID NO: 8507120 - DNA, 17 bp, Homo sapiens
accacctctcaccagca

SEQ ID NO: 8507121 - DNA, 17 bp, Homo sapiens
accacctctcaccagca

SEQ ID NO: 8507122 - DNA, 22 bp, Homo sapiens
aagggcagcctgactcacggtc

SEQ ID NO: 8507123 - DNA, 22 bp, Homo sapiens
aagggcagagggaatcccacat

SEQ ID NO: 8507124 - DNA, 22 bp, Homo sapiens
aagggcagagggaatcccacat

SEQ ID NO: 8507125 - DNA, 22 bp, Homo sapiens
accacagggtaaagttagatat

SEQ ID NO: 8507126 - DNA, 22 bp, Homo sapiens
accacaggggaggaatgatgcc

SEQ ID NO: 8507127 - DNA, 18 bp, Homo sapiens
accacatgatatcttgcc

SEQ ID NO: 8507128 - DNA, 22 bp, Homo sapiens
accacagtttagtccaatgaca

SEQ ID NO: 8507129 - DNA, 22 bp, Homo sapiens
accacccacctcacagcatagt

SEQ ID NO: 8507130 - DNA, 22 bp, Homo sapiens
accaccaggggattttcagaac

SEQ ID NO: 8507131 - DNA, 22 bp, Homo sapiens
accaccaggggattttcagaac

SEQ ID NO: 8507132 - DNA, 22 bp, Homo sapiens
accacatttctgaatagcataa

SEQ ID NO: 8507133 - DNA, 22 bp, Homo sapiens
accacccattcagaaacactga

SEQ ID NO: 8507134 - DNA, 22 bp, Homo sapiens
accacaggaggatggctgctgg

SEQ ID NO: 8507135 - DNA, 22 bp, Homo sapiens
accacaggggaggaatgatgcc

SEQ ID NO: 8507136 - DNA, 22 bp, Homo sapiens
accacaggacccatgagtcagt

SEQ ID NO: 8507137 - DNA, 22 bp, Homo sapiens
acattcttcagctttgtcaggc

SEQ ID NO: 8507138 - DNA, 22 bp, Homo sapiens
acattcttaacagttaaaaact

SEQ ID NO: 8507139 - DNA, 22 bp, Homo sapiens
acattctgtttccccaaagaga

SEQ ID NO: 8507140 - DNA, 22 bp, Homo sapiens
acattctgtcaacagtgagcag

SEQ ID NO: 8507141 - DNA, 22 bp, Homo sapiens
accaggagttttgaccaggggc

SEQ ID NO: 8507142 - DNA, 22 bp, Homo sapiens
accaggagttttgaccaggggc

SEQ ID NO: 8507143 - DNA, 22 bp, Homo sapiens
accaggaaatttggcaacaaag

SEQ ID NO: 8507144 - DNA, 22 bp, Homo sapiens
accagctgttatctgtagtatc

SEQ ID NO: 8507145 - DNA, 22 bp, Homo sapiens
accagctgttaggcttggtgct

SEQ ID NO: 8507146 - DNA, 22 bp, Homo sapiens
accagctgttaggcttggtgct

SEQ ID NO: 8507147 - DNA, 22 bp, Homo sapiens
accagctgtgtgacctgaggca

SEQ ID NO: 8507148 - DNA, 22 bp, Homo sapiens
accagctgtgtgacttttaatg

SEQ ID NO: 8507149 - DNA, 22 bp, Homo sapiens
accagctggtcacctgggcact

SEQ ID NO: 8507150 - DNA, 22 bp, Homo sapiens
accagctggtcacctgggcact

SEQ ID NO: 8507151 - DNA, 22 bp, Homo sapiens
accagctggcccatgagcacgt

SEQ ID NO: 8507152 - DNA, 22 bp, Homo sapiens
accagctggcccatgagcacgt

SEQ ID NO: 8507153 - DNA, 22 bp, Homo sapiens
accagctgtgtcctggctgcag

SEQ ID NO: 8507154 - DNA, 22 bp, Homo sapiens
accagctgtgtcctggctgcag

SEQ ID NO: 8507155 - DNA, 22 bp, Homo sapiens
accagctggtcagttgaagatt

SEQ ID NO: 8507156 - DNA, 22 bp, Homo sapiens
accagctggtcagggcttttct

SEQ ID NO: 8507157 - DNA, 22 bp, Homo sapiens
accaggcactcttgtggcagtg

SEQ ID NO: 8507158 - DNA, 22 bp, Homo sapiens
accaggcactcctgaggtctga

SEQ ID NO: 8507159 - DNA, 22 bp, Homo sapiens
accaggcaactgtgaatgggct

SEQ ID NO: 8507160 - DNA, 17 bp, Homo sapiens
accaggcaacacgccca

SEQ ID NO: 8507161 - DNA, 17 bp, Homo sapiens
accaggcaacacgccca

SEQ ID NO: 8507162 - DNA, 22 bp, Homo sapiens
accaggcaaaaccacaggagca

SEQ ID NO: 8507163 - DNA, 22 bp, Homo sapiens
accaggcagtcaccgtccagga

SEQ ID NO: 8507164 - DNA, 22 bp, Homo sapiens
accaggcactcttgtggcagtg

SEQ ID NO: 8507165 - DNA, 22 bp, Homo sapiens
accaggcagagctgggccttaa

SEQ ID NO: 8507166 - DNA, 22 bp, Homo sapiens
aaggttagtaatatttctatat

SEQ ID NO: 8507167 - DNA, 22 bp, Homo sapiens
aaggttagtgcatcttttgttt

SEQ ID NO: 8507168 - DNA, 22 bp, Homo sapiens
aaggttagtaagtatcttatgt

SEQ ID NO: 8507169 - DNA, 22 bp, Homo sapiens
aaggtgtcactgggacaggaaa

SEQ ID NO: 8507170 - DNA, 21 bp, Homo sapiens
accaggccaggaggctggcac

SEQ ID NO: 8507171 - DNA, 22 bp, Homo sapiens
accaggccaacagctaagttaa

SEQ ID NO: 8507172 - DNA, 22 bp, Homo sapiens
accaggccaaaatcatatttac

SEQ ID NO: 8507173 - DNA, 22 bp, Homo sapiens
aagtaaaacacacagtccaccg

SEQ ID NO: 8507174 - DNA, 22 bp, Homo sapiens
aaggtttccagtgatattgtgg

SEQ ID NO: 8507175 - DNA, 22 bp, Homo sapiens
aaggtttctccgaggctatttt

SEQ ID NO: 8507176 - DNA, 22 bp, Homo sapiens
aaggtttttttccagtatctct

SEQ ID NO: 8507177 - DNA, 22 bp, Homo sapiens
aagtaaaattcaatcttcactg

SEQ ID NO: 8507178 - DNA, 22 bp, Homo sapiens
aagtaaaattcaatcttcactg

SEQ ID NO: 8507179 - DNA, 22 bp, Homo sapiens
aagtaaaatgtttcctttatta

SEQ ID NO: 8507180 - DNA, 22 bp, Homo sapiens
aagtaaaatgtttcctttatta

SEQ ID NO: 8507181 - DNA, 22 bp, Homo sapiens
aagtaaaagctttaccatgcgc

SEQ ID NO: 8507182 - DNA, 22 bp, Homo sapiens
aagtaaaatgtttcctttatta

SEQ ID NO: 8507183 - DNA, 22 bp, Homo sapiens
acattctgaatgcctgacagta

SEQ ID NO: 8507184 - DNA, 22 bp, Homo sapiens
acattctggatgtctgatgaga

SEQ ID NO: 8507185 - DNA, 22 bp, Homo sapiens
acattctcttcctaaatatact

SEQ ID NO: 8507186 - DNA, 22 bp, Homo sapiens
acattcaagatgcattcactta

SEQ ID NO: 8507187 - DNA, 22 bp, Homo sapiens
acattctattctgcaggacaag

SEQ ID NO: 8507188 - DNA, 22 bp, Homo sapiens
acattcaaaaagcatctgtcac

SEQ ID NO: 8507189 - DNA, 22 bp, Homo sapiens
acattacataagattgtaacct

SEQ ID NO: 8507190 - DNA, 22 bp, Homo sapiens
acattatgagcccactggtgaa

SEQ ID NO: 8507191 - DNA, 22 bp, Homo sapiens
acattatccctggcacaactgc

SEQ ID NO: 8507192 - DNA, 22 bp, Homo sapiens
acattatagttgctacagagta

SEQ ID NO: 8507193 - DNA, 22 bp, Homo sapiens
acattatagttgctacagagta

SEQ ID NO: 8507194 - DNA, 22 bp, Homo sapiens
acattatagttgctacagagta

SEQ ID NO: 8507195 - DNA, 22 bp, Homo sapiens
acattatagttgctacagagta

SEQ ID NO: 8507196 - DNA, 21 bp, Homo sapiens
acattataattcatattccac

SEQ ID NO: 8507197 - DNA, 22 bp, Homo sapiens
acattagtttctcagatcattt

SEQ ID NO: 8507198 - DNA, 22 bp, Homo sapiens
acattatagctttgagtttgga

SEQ ID NO: 8507199 - DNA, 22 bp, Homo sapiens
acattatagttgctacagagta

SEQ ID NO: 8507200 - DNA, 21 bp, Homo sapiens
acattataattcatattccac

SEQ ID NO: 8507201 - DNA, 22 bp, Homo sapiens
aaggccaggccagatgacagtc

SEQ ID NO: 8507202 - DNA, 22 bp, Homo sapiens
aaggccaggcagggagctgtga

SEQ ID NO: 8507203 - DNA, 22 bp, Homo sapiens
acattacctggcatttgatctt

SEQ ID NO: 8507204 - DNA, 22 bp, Homo sapiens
acattacataagattgtaacct

SEQ ID NO: 8507205 - DNA, 22 bp, Homo sapiens
aaggccagcttgtagggctggt

SEQ ID NO: 8507206 - DNA, 22 bp, Homo sapiens
aaggccagctggagggatgagg

SEQ ID NO: 8507207 - DNA, 22 bp, Homo sapiens
aaggccaggacaccaggggact

SEQ ID NO: 8507208 - DNA, 22 bp, Homo sapiens
aaggccagcttgtagggctggt

SEQ ID NO: 8507209 - DNA, 22 bp, Homo sapiens
acatggtgtgctgagaatgaca

SEQ ID NO: 8507210 - DNA, 22 bp, Homo sapiens
acatgtaaaaattaaggtaaga

SEQ ID NO: 8507211 - DNA, 23 bp, Homo sapiens
acatgggagggacatggaggctg

SEQ ID NO: 8507212 - DNA, 23 bp, Homo sapiens
acatgggagggacatggaggctg

SEQ ID NO: 8507213 - DNA, 23 bp, Homo sapiens
acatgggagggacatggaggctg

SEQ ID NO: 8507214 - DNA, 21 bp, Homo sapiens
acatgggacctgcgaaaggaa

SEQ ID NO: 8507215 - DNA, 22 bp, Homo sapiens
acatggctcagtctcatgacag

SEQ ID NO: 8507216 - DNA, 22 bp, Homo sapiens
acatggctcagtctcatgacag

SEQ ID NO: 8507217 - DNA, 23 bp, Homo sapiens
acatgggaaatgcaaagagaagt

SEQ ID NO: 8507218 - DNA, 22 bp, Homo sapiens
acatgggacagagaaagaggcc

SEQ ID NO: 8507219 - DNA, 22 bp, Homo sapiens
acatgggatcaatgaggcaggc

SEQ ID NO: 8507220 - DNA, 22 bp, Homo sapiens
acatgggatcaatgaggcaggc

SEQ ID NO: 8507221 - DNA, 23 bp, Homo sapiens
acatgggagggacatggaggctg

SEQ ID NO: 8507222 - DNA, 22 bp, Homo sapiens
acatgggatcaatgaggcaggc

SEQ ID NO: 8507223 - DNA, 22 bp, Homo sapiens
acatggggcccaaagagaggtc

SEQ ID NO: 8507224 - DNA, 22 bp, Homo sapiens
acatggggcccaaagagaggtc

SEQ ID NO: 8507225 - DNA, 22 bp, Homo sapiens
acatgggggctgctgccagcga

SEQ ID NO: 8507226 - DNA, 22 bp, Homo sapiens
acatgggttattgtgaggttaa

SEQ ID NO: 8507227 - DNA, 22 bp, Homo sapiens
acatgggggctgctgccagcga

SEQ ID NO: 8507228 - DNA, 22 bp, Homo sapiens
acatacttatgctaaaaatata

SEQ ID NO: 8507229 - DNA, 22 bp, Homo sapiens
acatgcattctctaaaagcaaa

SEQ ID NO: 8507230 - DNA, 22 bp, Homo sapiens
acatgcattctctaaaagcaaa

SEQ ID NO: 8507231 - DNA, 22 bp, Homo sapiens
acatgcattaaaaatacttgtg

SEQ ID NO: 8507232 - DNA, 22 bp, Homo sapiens
acataatgagctctttataaat

SEQ ID NO: 8507233 - DNA, 22 bp, Homo sapiens
acataataggtgcctgaatatt

SEQ ID NO: 8507234 - DNA, 22 bp, Homo sapiens
acataataggtgcctgaatatt

SEQ ID NO: 8507235 - DNA, 18 bp, Homo sapiens
acatacattctgtctgca

SEQ ID NO: 8507236 - DNA, 22 bp, Homo sapiens
acatacaaatagagctgtagta

SEQ ID NO: 8507237 - DNA, 22 bp, Homo sapiens
acatactatgaatacatgtgtc

SEQ ID NO: 8507238 - DNA, 22 bp, Homo sapiens
acatactatgaatacatgtgtc

SEQ ID NO: 8507239 - DNA, 22 bp, Homo sapiens
acataccatacatggtgagatg

SEQ ID NO: 8507240 - DNA, 22 bp, Homo sapiens
acataataggtacctgaataat

SEQ ID NO: 8507241 - DNA, 22 bp, Homo sapiens
acataataggtacctgaataat

SEQ ID NO: 8507242 - DNA, 22 bp, Homo sapiens
acataacatgtcaatcacccga

SEQ ID NO: 8507243 - DNA, 22 bp, Homo sapiens
acataacactcttctctagtga

SEQ ID NO: 8507244 - DNA, 22 bp, Homo sapiens
acataacaatcataggacatag

SEQ ID NO: 8507245 - DNA, 22 bp, Homo sapiens
acataagttatggataaaatgt

SEQ ID NO: 8507246 - DNA, 22 bp, Homo sapiens
acagaactgcagacagtgccaa

SEQ ID NO: 8507247 - DNA, 22 bp, Homo sapiens
acagaactgcaggaggaaaagc

SEQ ID NO: 8507248 - DNA, 22 bp, Homo sapiens
acagaacaggctgagaaaaaca

SEQ ID NO: 8507249 - DNA, 22 bp, Homo sapiens
acagaacaggctgagaaaaaca

SEQ ID NO: 8507250 - DNA, 22 bp, Homo sapiens
acagaacatattgcttctctca

SEQ ID NO: 8507251 - DNA, 22 bp, Homo sapiens
acagaacatattgcttctctca

SEQ ID NO: 8507252 - DNA, 22 bp, Homo sapiens
agcccagctttgaaccatatca

SEQ ID NO: 8507253 - DNA, 22 bp, Homo sapiens
agcccagggctaataggaacca

SEQ ID NO: 8507254 - DNA, 22 bp, Homo sapiens
agcccaggtccagttcactgca

SEQ ID NO: 8507255 - DNA, 22 bp, Homo sapiens
agcccaggtccagttcactgca

SEQ ID NO: 8507256 - DNA, 22 bp, Homo sapiens
agcccagggctaataggaacca

SEQ ID NO: 8507257 - DNA, 22 bp, Homo sapiens
acagaactgggaaatgcacata

SEQ ID NO: 8507258 - DNA, 22 bp, Homo sapiens
acagaactgggggcacagatag

SEQ ID NO: 8507259 - DNA, 22 bp, Homo sapiens
acagaactgggaaatgcacata

SEQ ID NO: 8507260 - DNA, 22 bp, Homo sapiens
agcccagctttcacccctctgg

SEQ ID NO: 8507261 - DNA, 22 bp, Homo sapiens
agcccaggtctcaaagtacagg

SEQ ID NO: 8507262 - DNA, 22 bp, Homo sapiens
agcccaggtctggcccagcctg

SEQ ID NO: 8507263 - DNA, 22 bp, Homo sapiens
agcccaggtctggcccagcctg

SEQ ID NO: 8507264 - DNA, 22 bp, Homo sapiens
agcccaggtctggcccagcctg

SEQ ID NO: 8507265 - DNA, 22 bp, Homo sapiens
agcccaggtgactcatacaccc

SEQ ID NO: 8507266 - DNA, 22 bp, Homo sapiens
agcccaggtggagtgtgtgggg

SEQ ID NO: 8507267 - DNA, 22 bp, Homo sapiens
acagacatcatcaacatcttcc

SEQ ID NO: 8507268 - DNA, 22 bp, Homo sapiens
acagacatcatcaacatcttcc

SEQ ID NO: 8507269 - DNA, 22 bp, Homo sapiens
acagacatatttggcccatagc

SEQ ID NO: 8507270 - DNA, 21 bp, Homo sapiens
acagacagtccagagaaaaga

SEQ ID NO: 8507271 - DNA, 22 bp, Homo sapiens
acagacagtaaatagtgtggct

SEQ ID NO: 8507272 - DNA, 22 bp, Homo sapiens
acagacagtatggtggggctga

SEQ ID NO: 8507273 - DNA, 21 bp, Homo sapiens
acagacagggccagtgtcccc

SEQ ID NO: 8507274 - DNA, 21 bp, Homo sapiens
acagacagggccagtgtcccc

SEQ ID NO: 8507275 - DNA, 21 bp, Homo sapiens
acagacagggccagtgtcccc

SEQ ID NO: 8507276 - DNA, 22 bp, Homo sapiens
agcatttaagcttctgcaaagc

SEQ ID NO: 8507277 - DNA, 22 bp, Homo sapiens
agcatttaatcctacatagatc

SEQ ID NO: 8507278 - DNA, 22 bp, Homo sapiens
agcatttaatcctacatagatc

SEQ ID NO: 8507279 - DNA, 22 bp, Homo sapiens
agccaggaatgcatgctctgct

SEQ ID NO: 8507280 - DNA, 22 bp, Homo sapiens
agccaggaattggacaacacat

SEQ ID NO: 8507281 - DNA, 22 bp, Homo sapiens
agccaggcgcagtggcttatgc

SEQ ID NO: 8507282 - DNA, 22 bp, Homo sapiens
agccaggcgcagtggcttatgc

SEQ ID NO: 8507283 - DNA, 20 bp, Homo sapiens
agccaggctcaagctccccc

SEQ ID NO: 8507284 - DNA, 20 bp, Homo sapiens
agccaggctcaagctccccc

SEQ ID NO: 8507285 - DNA, 22 bp, Homo sapiens
agccaggctactccttgctgac

SEQ ID NO: 8507286 - DNA, 22 bp, Homo sapiens
agccaggctactccttgctgac

SEQ ID NO: 8507287 - DNA, 22 bp, Homo sapiens
agccaggctaaatgagccatga

SEQ ID NO: 8507288 - DNA, 22 bp, Homo sapiens
agccaggctaaatgagccatga

SEQ ID NO: 8507289 - DNA, 22 bp, Homo sapiens
agccaggcggggcaggtttcct

SEQ ID NO: 8507290 - DNA, 22 bp, Homo sapiens
agccaggcgggtctttgctcct

SEQ ID NO: 8507291 - DNA, 22 bp, Homo sapiens
agccaggcgggtctttgctcct

SEQ ID NO: 8507292 - DNA, 22 bp, Homo sapiens
agcattccacactgaagtctgc

SEQ ID NO: 8507293 - DNA, 22 bp, Homo sapiens
agcattccacactgaagtctgc

SEQ ID NO: 8507294 - DNA, 22 bp, Homo sapiens
agcattccacactgaagtctgc

SEQ ID NO: 8507295 - DNA, 22 bp, Homo sapiens
agcattccagtgcacagtagaa

SEQ ID NO: 8507296 - DNA, 20 bp, Homo sapiens
agcattctactagacttttc

SEQ ID NO: 8507297 - DNA, 21 bp, Homo sapiens
agcattctgcttctttcctgg

SEQ ID NO: 8507298 - DNA, 23 bp, Homo sapiens
agcattctctccaacatttaaca

SEQ ID NO: 8507299 - DNA, 22 bp, Homo sapiens
agcattctgtggtcttctatgg

SEQ ID NO: 8507300 - DNA, 21 bp, Homo sapiens
agcattcttggccagtccacc

SEQ ID NO: 8507301 - DNA, 22 bp, Homo sapiens
agcattcatgatgacaacagga

SEQ ID NO: 8507302 - DNA, 22 bp, Homo sapiens
agcattcaatgattggacttgc

SEQ ID NO: 8507303 - DNA, 22 bp, Homo sapiens
agcattcatgatgacaacagga

SEQ ID NO: 8507304 - DNA, 22 bp, Homo sapiens
agcattcattgctagaatgtaa

SEQ ID NO: 8507305 - DNA, 22 bp, Homo sapiens
agcattcattgctagaatgtaa

SEQ ID NO: 8507306 - DNA, 22 bp, Homo sapiens
agcatgaaaacatgaaacagca

SEQ ID NO: 8507307 - DNA, 22 bp, Homo sapiens
agcattcaatgattggacttgc

SEQ ID NO: 8507308 - DNA, 22 bp, Homo sapiens
agcattcaagtaattcacttgg

SEQ ID NO: 8507309 - DNA, 22 bp, Homo sapiens
agcatcttcaacaggcatttta

SEQ ID NO: 8507310 - DNA, 22 bp, Homo sapiens
agcatctgttgaatataatatt

SEQ ID NO: 8507311 - DNA, 22 bp, Homo sapiens
agcatctgtgatattttgttat

SEQ ID NO: 8507312 - DNA, 22 bp, Homo sapiens
agcatctggatggaaagcaagg

SEQ ID NO: 8507313 - DNA, 22 bp, Homo sapiens
agcatctgcttaatggcttaac

SEQ ID NO: 8507314 - DNA, 22 bp, Homo sapiens
agcatctggtcatgagtgagaa

SEQ ID NO: 8507315 - DNA, 21 bp, Homo sapiens
agcatctgaggcagtttccta

SEQ ID NO: 8507316 - DNA, 22 bp, Homo sapiens
agcatctctaaatccagtaagt

SEQ ID NO: 8507317 - DNA, 22 bp, Homo sapiens
agcatcccatgactctggagga

SEQ ID NO: 8507318 - DNA, 22 bp, Homo sapiens
agcatcctccttcccagagatg

SEQ ID NO: 8507319 - DNA, 22 bp, Homo sapiens
agcatctaaactatcagtttga

SEQ ID NO: 8507320 - DNA, 22 bp, Homo sapiens
agcctgtggatccctgcactgg

SEQ ID NO: 8507321 - DNA, 22 bp, Homo sapiens
agcctgtgtgaagccctcagag

SEQ ID NO: 8507322 - DNA, 21 bp, Homo sapiens
agcctgttggtttactgctca

SEQ ID NO: 8507323 - DNA, 22 bp, Homo sapiens
agcctggctaaattctcccatg

SEQ ID NO: 8507324 - DNA, 22 bp, Homo sapiens
agcctggctaaattctcccatg

SEQ ID NO: 8507325 - DNA, 22 bp, Homo sapiens
agcctggctgtaacctcatggt

SEQ ID NO: 8507326 - DNA, 22 bp, Homo sapiens
agcctggctgtaacctcatggt

SEQ ID NO: 8507327 - DNA, 22 bp, Homo sapiens
agcctgtctgtctccaaagctg

SEQ ID NO: 8507328 - DNA, 22 bp, Homo sapiens
agcctggcttaatcctcctttt

SEQ ID NO: 8507329 - DNA, 22 bp, Homo sapiens
agcctggctgtaacctcatggt

SEQ ID NO: 8507330 - DNA, 22 bp, Homo sapiens
agcctgtgagggatgctgcagt

SEQ ID NO: 8507331 - DNA, 22 bp, Homo sapiens
agctccaggtcagtgcacccct

SEQ ID NO: 8507332 - DNA, 23 bp, Homo sapiens
agctccaggtgattgtaatgtgt

SEQ ID NO: 8507333 - DNA, 22 bp, Homo sapiens
agctccaggtcagtgcacccct

SEQ ID NO: 8507334 - DNA, 22 bp, Homo sapiens
agctccagaaaggtacacacag

SEQ ID NO: 8507335 - DNA, 23 bp, Homo sapiens
agctccagggaacaggcagtagg

SEQ ID NO: 8507336 - DNA, 22 bp, Homo sapiens
agctcattgcaacctccgcctc

SEQ ID NO: 8507337 - DNA, 22 bp, Homo sapiens
agctcaggtcattccagggatg

SEQ ID NO: 8507338 - DNA, 22 bp, Homo sapiens
agctcaggtctcaggaggtgtc

SEQ ID NO: 8507339 - DNA, 22 bp, Homo sapiens
agctcatggtgctatctcaggg

SEQ ID NO: 8507340 - DNA, 22 bp, Homo sapiens
agctcaggccggagctacaggc

SEQ ID NO: 8507341 - DNA, 22 bp, Homo sapiens
agctcaggccggagctacaggc

SEQ ID NO: 8507342 - DNA, 22 bp, Homo sapiens
agctcagggcgatctgtctcgg

SEQ ID NO: 8507343 - DNA, 22 bp, Homo sapiens
agctcagggcgatctgtctcgg

SEQ ID NO: 8507344 - DNA, 22 bp, Homo sapiens
agctcagggcgatctgtctcgg

SEQ ID NO: 8507345 - DNA, 22 bp, Homo sapiens
agctcaggctctgcagggacta

SEQ ID NO: 8507346 - DNA, 22 bp, Homo sapiens
agccctgcaggatgagggaggt

SEQ ID NO: 8507347 - DNA, 22 bp, Homo sapiens
agccctgcaggaggtgggagag

SEQ ID NO: 8507348 - DNA, 22 bp, Homo sapiens
agccctgcaggaggtgggagag

SEQ ID NO: 8507349 - DNA, 22 bp, Homo sapiens
agccctgcacagttcgggagga

SEQ ID NO: 8507350 - DNA, 22 bp, Homo sapiens
agccctgcacaggtctgtggct

SEQ ID NO: 8507351 - DNA, 22 bp, Homo sapiens
acagacatgggccgctcttgag

SEQ ID NO: 8507352 - DNA, 22 bp, Homo sapiens
agccctgccattctctggagct

SEQ ID NO: 8507353 - DNA, 22 bp, Homo sapiens
agccctgccattctctggagct

SEQ ID NO: 8507354 - DNA, 22 bp, Homo sapiens
agccctgccctgccatgtggca

SEQ ID NO: 8507355 - DNA, 22 bp, Homo sapiens
agccctgccctgccatgtggca

SEQ ID NO: 8507356 - DNA, 22 bp, Homo sapiens
agccctggggctggtgcttacc

SEQ ID NO: 8507357 - DNA, 22 bp, Homo sapiens
agccctggggctggtcttggaa

SEQ ID NO: 8507358 - DNA, 22 bp, Homo sapiens
agcctgcttccctttgtgcccc

SEQ ID NO: 8507359 - DNA, 22 bp, Homo sapiens
agcctgctggaccaagctcatg

SEQ ID NO: 8507360 - DNA, 22 bp, Homo sapiens
agcctgctggaccaagctcatg

SEQ ID NO: 8507361 - DNA, 22 bp, Homo sapiens
agcctggccaggcctgcccagg

SEQ ID NO: 8507362 - DNA, 22 bp, Homo sapiens
agcctggccaggcctgcccagg

SEQ ID NO: 8507363 - DNA, 22 bp, Homo sapiens
agcctggccaggcctgcccagg

SEQ ID NO: 8507364 - DNA, 22 bp, Homo sapiens
agcctggcctgggcaggcacat

SEQ ID NO: 8507365 - DNA, 22 bp, Homo sapiens
agcctggcctgggcaggcacat

SEQ ID NO: 8507366 - DNA, 22 bp, Homo sapiens
agcctggcctgggcaggcacat

SEQ ID NO: 8507367 - DNA, 22 bp, Homo sapiens
agcctggcctgggcaggcacat

SEQ ID NO: 8507368 - DNA, 22 bp, Homo sapiens
agcctggcggtcgtcggtcagg

SEQ ID NO: 8507369 - DNA, 22 bp, Homo sapiens
agcctggcctgggcaggcacat

SEQ ID NO: 8507370 - DNA, 22 bp, Homo sapiens
agcctggccctgctgaactctg

SEQ ID NO: 8507371 - DNA, 22 bp, Homo sapiens
agcctggccctgctgaactctg

SEQ ID NO: 8507372 - DNA, 22 bp, Homo sapiens
agcctggccctgctgaactctg

SEQ ID NO: 8507373 - DNA, 21 bp, Homo sapiens
agcctggcccagggggaggct

SEQ ID NO: 8507374 - DNA, 21 bp, Homo sapiens
agcctggcccagggggaggct

SEQ ID NO: 8507375 - DNA, 22 bp, Homo sapiens
agccctggtagcctgctgccat

SEQ ID NO: 8507376 - DNA, 22 bp, Homo sapiens
agccctggtttgcagcatttgc

SEQ ID NO: 8507377 - DNA, 22 bp, Homo sapiens
agccctgggttagggtgggagc

SEQ ID NO: 8507378 - DNA, 22 bp, Homo sapiens
agccctgggttagggtgggagc

SEQ ID NO: 8507379 - DNA, 22 bp, Homo sapiens
agccctgggtcccagtcctggc

SEQ ID NO: 8507380 - DNA, 22 bp, Homo sapiens
agccctgggtcccagtcctggc

SEQ ID NO: 8507381 - DNA, 22 bp, Homo sapiens
acacacatggtattgttcagaa

SEQ ID NO: 8507382 - DNA, 22 bp, Homo sapiens
acacacatggtattgttcagaa

SEQ ID NO: 8507383 - DNA, 22 bp, Homo sapiens
acacacatggtattgttcagaa

SEQ ID NO: 8507384 - DNA, 22 bp, Homo sapiens
acacacatgcctttcctaagta

SEQ ID NO: 8507385 - DNA, 22 bp, Homo sapiens
acacacagaaggaagccccact

SEQ ID NO: 8507386 - DNA, 22 bp, Homo sapiens
acacacagaaggaagccccact

SEQ ID NO: 8507387 - DNA, 21 bp, Homo sapiens
agatttgtcccttcccattta

SEQ ID NO: 8507388 - DNA, 22 bp, Homo sapiens
agattttagtgtagaggacttg

SEQ ID NO: 8507389 - DNA, 22 bp, Homo sapiens
agattttagtttggggaggtgc

SEQ ID NO: 8507390 - DNA, 22 bp, Homo sapiens
agattttatagataatttccca

SEQ ID NO: 8507391 - DNA, 18 bp, Homo sapiens
agattttgagaaatacaa

SEQ ID NO: 8507392 - DNA, 22 bp, Homo sapiens
agatttctgtggtcatgtaatg

SEQ ID NO: 8507393 - DNA, 22 bp, Homo sapiens
agatttctctttccctggctga

SEQ ID NO: 8507394 - DNA, 22 bp, Homo sapiens
agatttctgggcttcaccacct

SEQ ID NO: 8507395 - DNA, 22 bp, Homo sapiens
agatttctgtcaccttctatgc

SEQ ID NO: 8507396 - DNA, 22 bp, Homo sapiens
agatttctgtggtcatgtaatg

SEQ ID NO: 8507397 - DNA, 22 bp, Homo sapiens
agcagaaagcttattttgactg

SEQ ID NO: 8507398 - DNA, 22 bp, Homo sapiens
agcagaaaattggaaatgacaa

SEQ ID NO: 8507399 - DNA, 22 bp, Homo sapiens
agcagaaaattggaaatgacaa

SEQ ID NO: 8507400 - DNA, 22 bp, Homo sapiens
agcactttgtgcatttctgaag

SEQ ID NO: 8507401 - DNA, 22 bp, Homo sapiens
agcactttgggagataaagctg

SEQ ID NO: 8507402 - DNA, 22 bp, Homo sapiens
agcactttcctggcaaatgtgg

SEQ ID NO: 8507403 - DNA, 22 bp, Homo sapiens
agcactttaagcaacagatcaa

SEQ ID NO: 8507404 - DNA, 22 bp, Homo sapiens
agcacttgtagactagaatttt

SEQ ID NO: 8507405 - DNA, 23 bp, Homo sapiens
agcacttgtatcttactaaaatg

SEQ ID NO: 8507406 - DNA, 21 bp, Homo sapiens
acacactacacattcctagtt

SEQ ID NO: 8507407 - DNA, 22 bp, Homo sapiens
acacacatggtattgttcagaa

SEQ ID NO: 8507408 - DNA, 22 bp, Homo sapiens
acacaccatgatttatttaccc

SEQ ID NO: 8507409 - DNA, 22 bp, Homo sapiens
acacaccatgatttatttaccc

SEQ ID NO: 8507410 - DNA, 22 bp, Homo sapiens
acacactcaattgcataagcac

SEQ ID NO: 8507411 - DNA, 22 bp, Homo sapiens
acacactgagtgccataggacc

SEQ ID NO: 8507412 - DNA, 22 bp, Homo sapiens
acacactgaattttgtggaaac

SEQ ID NO: 8507413 - DNA, 21 bp, Homo sapiens
acacactctgagtcttctatt

SEQ ID NO: 8507414 - DNA, 21 bp, Homo sapiens
acacactgagttttccactgt

SEQ ID NO: 8507415 - DNA, 21 bp, Homo sapiens
acacactgagttttccactgt

SEQ ID NO: 8507416 - DNA, 22 bp, Homo sapiens
acacactgagtgccataggacc

SEQ ID NO: 8507417 - DNA, 21 bp, Homo sapiens
acacactgagttttccactgt

SEQ ID NO: 8507418 - DNA, 17 bp, Homo sapiens
agcacttgaaaatttct

SEQ ID NO: 8507419 - DNA, 22 bp, Homo sapiens
acacactggcaggagctataaa

SEQ ID NO: 8507420 - DNA, 22 bp, Homo sapiens
acacactgctcgctcagattaa

SEQ ID NO: 8507421 - DNA, 22 bp, Homo sapiens
acacactggaggtaaatggggt

SEQ ID NO: 8507422 - DNA, 22 bp, Homo sapiens
agcagcaactgctagagtggca

SEQ ID NO: 8507423 - DNA, 22 bp, Homo sapiens
agcagaaccacagcactgttga

SEQ ID NO: 8507424 - DNA, 21 bp, Homo sapiens
agcagaacagtcgagcactgc

SEQ ID NO: 8507425 - DNA, 22 bp, Homo sapiens
agcagaacattttcagggctgt

SEQ ID NO: 8507426 - DNA, 22 bp, Homo sapiens
agcagcagattatggtctacat

SEQ ID NO: 8507427 - DNA, 22 bp, Homo sapiens
agcagcagattatggtctacat

SEQ ID NO: 8507428 - DNA, 22 bp, Homo sapiens
agcagcagattatggtctacat

SEQ ID NO: 8507429 - DNA, 22 bp, Homo sapiens
agcagcagattcagcaggaatg

SEQ ID NO: 8507430 - DNA, 22 bp, Homo sapiens
agcagcagattcagcaggaatg

SEQ ID NO: 8507431 - DNA, 22 bp, Homo sapiens
agcagcagattcagcaggaatg

SEQ ID NO: 8507432 - DNA, 21 bp, Homo sapiens
agcagcagcagtggggcttct

SEQ ID NO: 8507433 - DNA, 21 bp, Homo sapiens
agcagcagcagtggggcttct

SEQ ID NO: 8507434 - DNA, 19 bp, Homo sapiens
agcagcagcaccagggatt

SEQ ID NO: 8507435 - DNA, 19 bp, Homo sapiens
agcagcagcaccagggatt

SEQ ID NO: 8507436 - DNA, 19 bp, Homo sapiens
agcagcagcaccagggatt

SEQ ID NO: 8507437 - DNA, 23 bp, Homo sapiens
agcagcagcaattaagtggatat

SEQ ID NO: 8507438 - DNA, 23 bp, Homo sapiens
agcagcagcaattaagtggatat

SEQ ID NO: 8507439 - DNA, 22 bp, Homo sapiens
agcagcagctcagttctcagct

SEQ ID NO: 8507440 - DNA, 22 bp, Homo sapiens
agcagcagctcagttctcagct

SEQ ID NO: 8507441 - DNA, 19 bp, Homo sapiens
agcagcagctaccacttgt

SEQ ID NO: 8507442 - DNA, 22 bp, Homo sapiens
agcagcagcattgagcgcttgt

SEQ ID NO: 8507443 - DNA, 22 bp, Homo sapiens
agcagcagcattgagcgcttgt

SEQ ID NO: 8507444 - DNA, 22 bp, Homo sapiens
agcagcagccgtagccttatta

SEQ ID NO: 8507445 - DNA, 22 bp, Homo sapiens
agcagcagccgtagccttatta

SEQ ID NO: 8507446 - DNA, 23 bp, Homo sapiens
acacagaagaagacccaaggaag

SEQ ID NO: 8507447 - DNA, 22 bp, Homo sapiens
agcagcagttgctgacgttcta

SEQ ID NO: 8507448 - DNA, 23 bp, Homo sapiens
acacagaagaagacccaaggaag

SEQ ID NO: 8507449 - DNA, 23 bp, Homo sapiens
acacagaagaagacccaaggaag

SEQ ID NO: 8507450 - DNA, 22 bp, Homo sapiens
acacagaacctcatagcctctc

SEQ ID NO: 8507451 - DNA, 22 bp, Homo sapiens
acacagaacctcatagcctctc

SEQ ID NO: 8507452 - DNA, 22 bp, Homo sapiens
acacagaacctcatagcctctc

SEQ ID NO: 8507453 - DNA, 22 bp, Homo sapiens
acacacttttgctaaaaattgt

SEQ ID NO: 8507454 - DNA, 22 bp, Homo sapiens
agcagccaggaatctgcagagc

SEQ ID NO: 8507455 - DNA, 22 bp, Homo sapiens
agcagcagctcattcttcctgt

SEQ ID NO: 8507456 - DNA, 22 bp, Homo sapiens
acacactggcaggagctataaa

SEQ ID NO: 8507457 - DNA, 22 bp, Homo sapiens
acacactgtaaggactatcact

SEQ ID NO: 8507458 - DNA, 22 bp, Homo sapiens
acacactgtaaggactatcact

SEQ ID NO: 8507459 - DNA, 22 bp, Homo sapiens
acacactggcccccagtactga

SEQ ID NO: 8507460 - DNA, 22 bp, Homo sapiens
acacactggcccccagtactga

SEQ ID NO: 8507461 - DNA, 22 bp, Homo sapiens
acacactggcccccagtactga

SEQ ID NO: 8507462 - DNA, 22 bp, Homo sapiens
acacacttcacccttgagctaa

SEQ ID NO: 8507463 - DNA, 22 bp, Homo sapiens
acacactgttgctcatccaggc

SEQ ID NO: 8507464 - DNA, 22 bp, Homo sapiens
acacactgtaaggactatcact

SEQ ID NO: 8507465 - DNA, 22 bp, Homo sapiens
acacactgtaaggactatcact

SEQ ID NO: 8507466 - DNA, 22 bp, Homo sapiens
acacactttaaattaaacctct

SEQ ID NO: 8507467 - DNA, 20 bp, Homo sapiens
acacactttgatcttgagcc

SEQ ID NO: 8507468 - DNA, 22 bp, Homo sapiens
acacacttttgctaaaaattgt

SEQ ID NO: 8507469 - DNA, 22 bp, Homo sapiens
acacactttaaattaaacctct

SEQ ID NO: 8507470 - DNA, 22 bp, Homo sapiens
acacacttgcagagaggaggga

SEQ ID NO: 8507471 - DNA, 22 bp, Homo sapiens
acacacttcagatgtaatttgt

SEQ ID NO: 8507472 - DNA, 22 bp, Homo sapiens
acacacttcagatgtaatttgt

SEQ ID NO: 8507473 - DNA, 19 bp, Homo sapiens
agcaggcaggtggcccagg

SEQ ID NO: 8507474 - DNA, 22 bp, Homo sapiens
agcaggcatagagtagcactca

SEQ ID NO: 8507475 - DNA, 23 bp, Homo sapiens
agcaggcatctgtggcacaaggc

SEQ ID NO: 8507476 - DNA, 23 bp, Homo sapiens
agcaggcatctgtggcacaaggc

SEQ ID NO: 8507477 - DNA, 22 bp, Homo sapiens
agcagggctttgcagacttggg

SEQ ID NO: 8507478 - DNA, 22 bp, Homo sapiens
agcagggctttgcagacttggg

SEQ ID NO: 8507479 - DNA, 22 bp, Homo sapiens
agcagggctttgcagacttggg

SEQ ID NO: 8507480 - DNA, 22 bp, Homo sapiens
agcagggcttgccgcttgtcct

SEQ ID NO: 8507481 - DNA, 22 bp, Homo sapiens
agcagggcttgccgcttgtcct

SEQ ID NO: 8507482 - DNA, 22 bp, Homo sapiens
agcagggcttctgtgcctgtgc

SEQ ID NO: 8507483 - DNA, 22 bp, Homo sapiens
agcagggctgtgtaggtaatga

SEQ ID NO: 8507484 - DNA, 22 bp, Homo sapiens
agcaggtcttgctctcaacagg

SEQ ID NO: 8507485 - DNA, 22 bp, Homo sapiens
agcaggtgacccaagcaggctg

SEQ ID NO: 8507486 - DNA, 22 bp, Homo sapiens
agcaggtgacagggctgtggtg

SEQ ID NO: 8507487 - DNA, 22 bp, Homo sapiens
agcatccagatgcctgatgtca

SEQ ID NO: 8507488 - DNA, 22 bp, Homo sapiens
agcatccagcatcctatagaaa

SEQ ID NO: 8507489 - DNA, 19 bp, Homo sapiens
agcatccagtcatgggatc

SEQ ID NO: 8507490 - DNA, 19 bp, Homo sapiens
agcatccagtcatgggatc

SEQ ID NO: 8507491 - DNA, 22 bp, Homo sapiens
agcatcagcctctgtcctggag

SEQ ID NO: 8507492 - DNA, 22 bp, Homo sapiens
agcatcagcctctgtcctggag

SEQ ID NO: 8507493 - DNA, 22 bp, Homo sapiens
agcatcagcctctgtcctggag

SEQ ID NO: 8507494 - DNA, 22 bp, Homo sapiens
agcatccaacaggagggaaggg

SEQ ID NO: 8507495 - DNA, 22 bp, Homo sapiens
agcatcagtactaatctggcca

SEQ ID NO: 8507496 - DNA, 22 bp, Homo sapiens
agcatccaacaggagggaaggg

SEQ ID NO: 8507497 - DNA, 22 bp, Homo sapiens
agcatccactcactgggagagg

SEQ ID NO: 8507498 - DNA, 22 bp, Homo sapiens
agcagttatgtgtctcttgact

SEQ ID NO: 8507499 - DNA, 22 bp, Homo sapiens
agcagttatcgaagaatcaggt

SEQ ID NO: 8507500 - DNA, 22 bp, Homo sapiens
agcagttatattgaaataaaaa

SEQ ID NO: 8507501 - DNA, 19 bp, Homo sapiens
agcagttatatgcatggga

SEQ ID NO: 8507502 - DNA, 20 bp, Homo sapiens
agcaggtgacggggcctgct

SEQ ID NO: 8507503 - DNA, 22 bp, Homo sapiens
agcagctgagatggtaagattc

SEQ ID NO: 8507504 - DNA, 22 bp, Homo sapiens
agcagctgagatggtaagattc

SEQ ID NO: 8507505 - DNA, 22 bp, Homo sapiens
agcaggagcccttatcaccagg

SEQ ID NO: 8507506 - DNA, 22 bp, Homo sapiens
agcaggagcccttatcaccagg

SEQ ID NO: 8507507 - DNA, 22 bp, Homo sapiens
agcaggagctgtgggaagatgg

SEQ ID NO: 8507508 - DNA, 22 bp, Homo sapiens
agcaggagctgtgggaagatgg

SEQ ID NO: 8507509 - DNA, 21 bp, Homo sapiens
agcaggaggcagtcacagctc

SEQ ID NO: 8507510 - DNA, 22 bp, Homo sapiens
agcaggagggttttgtagagtc

SEQ ID NO: 8507511 - DNA, 22 bp, Homo sapiens
agcaggcaggctgccagtgaat

SEQ ID NO: 8507512 - DNA, 22 bp, Homo sapiens
agcaggagtgtcccctggctgt

SEQ ID NO: 8507513 - DNA, 22 bp, Homo sapiens
agcaggagggttttgtagagtc

SEQ ID NO: 8507514 - DNA, 22 bp, Homo sapiens
agcaggagggttttgtagagtc

SEQ ID NO: 8507515 - DNA, 22 bp, Homo sapiens
agcaggagggttttgtagagtc

SEQ ID NO: 8507516 - DNA, 21 bp, Homo sapiens
agcaggaggcagtcacagctc

SEQ ID NO: 8507517 - DNA, 22 bp, Homo sapiens
agcagccagtgggagtgataca

SEQ ID NO: 8507518 - DNA, 22 bp, Homo sapiens
agcagccatagatagcatgcaa

SEQ ID NO: 8507519 - DNA, 22 bp, Homo sapiens
agcagccatagatagcatgcaa

SEQ ID NO: 8507520 - DNA, 21 bp, Homo sapiens
agcagccatttcacagagact

SEQ ID NO: 8507521 - DNA, 19 bp, Homo sapiens
agcagccatcgaccatgga

SEQ ID NO: 8507522 - DNA, 22 bp, Homo sapiens
agcagctctggcactgtagcat

SEQ ID NO: 8507523 - DNA, 17 bp, Homo sapiens
agcagctgaagcagcca

SEQ ID NO: 8507524 - DNA, 22 bp, Homo sapiens
agcagctgaaaggcaaacttct

SEQ ID NO: 8507525 - DNA, 17 bp, Homo sapiens
agcagctgaagcagcca

SEQ ID NO: 8507526 - DNA, 17 bp, Homo sapiens
agcagctgaagcagcca

SEQ ID NO: 8507527 - DNA, 22 bp, Homo sapiens
agcagctgaccagtgagtcctg

SEQ ID NO: 8507528 - DNA, 22 bp, Homo sapiens
aatgtacatctcagtgtagtac

SEQ ID NO: 8507529 - DNA, 22 bp, Homo sapiens
aatgtacagctgctgctgaagg

SEQ ID NO: 8507530 - DNA, 22 bp, Homo sapiens
aatgtacagctgtctttcctcc

SEQ ID NO: 8507531 - DNA, 22 bp, Homo sapiens
aatgtacagctgtctttcctcc

SEQ ID NO: 8507532 - DNA, 22 bp, Homo sapiens
aatgtataaagtgttaataact

SEQ ID NO: 8507533 - DNA, 19 bp, Homo sapiens
aatgtagtgttatgtcaac

SEQ ID NO: 8507534 - DNA, 22 bp, Homo sapiens
aatgtagatgagatattttttg

SEQ ID NO: 8507535 - DNA, 22 bp, Homo sapiens
aatgtataaagtgttaataact

SEQ ID NO: 8507536 - DNA, 22 bp, Homo sapiens
aatgtataaagtgttaataact

SEQ ID NO: 8507537 - DNA, 22 bp, Homo sapiens
aatgtataaagtgttaataact

SEQ ID NO: 8507538 - DNA, 22 bp, Homo sapiens
agaatttgtaaaagataagaca

SEQ ID NO: 8507539 - DNA, 22 bp, Homo sapiens
agaatttttgattatctactcg

SEQ ID NO: 8507540 - DNA, 23 bp, Homo sapiens
agaatttctaactctagctctgt

SEQ ID NO: 8507541 - DNA, 22 bp, Homo sapiens
aatgtacactgaaagcctatca

SEQ ID NO: 8507542 - DNA, 22 bp, Homo sapiens
aatgtacaccgtgggtttttta

SEQ ID NO: 8507543 - DNA, 22 bp, Homo sapiens
aatgtaaacagcaagagaaggg

SEQ ID NO: 8507544 - DNA, 22 bp, Homo sapiens
agaattgtaagcaatttgatta

SEQ ID NO: 8507545 - DNA, 22 bp, Homo sapiens
agaattgtaataataatagcat

SEQ ID NO: 8507546 - DNA, 22 bp, Homo sapiens
agaattgttctgtagcttggct

SEQ ID NO: 8507547 - DNA, 22 bp, Homo sapiens
agaattgttggggtaataaaag

SEQ ID NO: 8507548 - DNA, 22 bp, Homo sapiens
agaattgttggggtaataaaag

SEQ ID NO: 8507549 - DNA, 23 bp, Homo sapiens
agaattgttgttagggaaaagta

SEQ ID NO: 8507550 - DNA, 19 bp, Homo sapiens
agaattgttttatgtcttc

SEQ ID NO: 8507551 - DNA, 22 bp, Homo sapiens
agaattggttggggaatgtgga

SEQ ID NO: 8507552 - DNA, 23 bp, Homo sapiens
agaattgtaaatagaatatacct

SEQ ID NO: 8507553 - DNA, 23 bp, Homo sapiens
agaattgtaaatagaatatacct

SEQ ID NO: 8507554 - DNA, 22 bp, Homo sapiens
agaattgtaagcaatttgatta

SEQ ID NO: 8507555 - DNA, 22 bp, Homo sapiens
agaattgtaagcaatttgatta

SEQ ID NO: 8507556 - DNA, 19 bp, Homo sapiens
agaattgttttgagacccc

SEQ ID NO: 8507557 - DNA, 21 bp, Homo sapiens
agaatcatttttcccttctct

SEQ ID NO: 8507558 - DNA, 22 bp, Homo sapiens
agaatccgcttgactttgaagt

SEQ ID NO: 8507559 - DNA, 22 bp, Homo sapiens
agaatctaagtacacagacaga

SEQ ID NO: 8507560 - DNA, 20 bp, Homo sapiens
agaatctgacccagagagac

SEQ ID NO: 8507561 - DNA, 20 bp, Homo sapiens
agaatctgacccagagagac

SEQ ID NO: 8507562 - DNA, 22 bp, Homo sapiens
aatgctgtaaagatgctatctg

SEQ ID NO: 8507563 - DNA, 23 bp, Homo sapiens
aatgctggaaattcaggcatgat

SEQ ID NO: 8507564 - DNA, 23 bp, Homo sapiens
aatgctggaaattcaggcatgat

SEQ ID NO: 8507565 - DNA, 22 bp, Homo sapiens
aatgaaaattggaccctagaac

SEQ ID NO: 8507566 - DNA, 22 bp, Homo sapiens
aatgaaaattggaccctagaac

SEQ ID NO: 8507567 - DNA, 22 bp, Homo sapiens
aatgctttgactatatctataa

SEQ ID NO: 8507568 - DNA, 22 bp, Homo sapiens
aatgctttgagggaagatgaaa

SEQ ID NO: 8507569 - DNA, 22 bp, Homo sapiens
aatgctttgattgattaaaaca

SEQ ID NO: 8507570 - DNA, 22 bp, Homo sapiens
aatgctttgattgattaaaaca

SEQ ID NO: 8507571 - DNA, 22 bp, Homo sapiens
aatgctttgattgattaaaaca

SEQ ID NO: 8507572 - DNA, 22 bp, Homo sapiens
aatggaatacctaggtggccca

SEQ ID NO: 8507573 - DNA, 22 bp, Homo sapiens
aatggaatacctaggtggccca

SEQ ID NO: 8507574 - DNA, 22 bp, Homo sapiens
aatgcttttacgacatgtacct

SEQ ID NO: 8507575 - DNA, 22 bp, Homo sapiens
aatgcttttgctgtcattgctt

SEQ ID NO: 8507576 - DNA, 22 bp, Homo sapiens
aatgctttttgcgaaatgtgca

SEQ ID NO: 8507577 - DNA, 22 bp, Homo sapiens
aatggaacctagttatccacat

SEQ ID NO: 8507578 - DNA, 21 bp, Homo sapiens
aatggaagtttaaaggtatcc

SEQ ID NO: 8507579 - DNA, 18 bp, Homo sapiens
aatggaaggggtgctgtt

SEQ ID NO: 8507580 - DNA, 22 bp, Homo sapiens
agaagttttgggaaatactgat

SEQ ID NO: 8507581 - DNA, 22 bp, Homo sapiens
agaataaaatagtctgaagatg

SEQ ID NO: 8507582 - DNA, 22 bp, Homo sapiens
agaataaaatagtctgaagatg

SEQ ID NO: 8507583 - DNA, 22 bp, Homo sapiens
agaataaaatagtctgaagatg

SEQ ID NO: 8507584 - DNA, 22 bp, Homo sapiens
agaataaaatagtctgaagatg

SEQ ID NO: 8507585 - DNA, 22 bp, Homo sapiens
agaataaaatagtctgaagatg

SEQ ID NO: 8507586 - DNA, 22 bp, Homo sapiens
agaataaatgctacctatcaca

SEQ ID NO: 8507587 - DNA, 22 bp, Homo sapiens
agaataaatgctacctatcaca

SEQ ID NO: 8507588 - DNA, 22 bp, Homo sapiens
agaataaatcaaatgtcctgag

SEQ ID NO: 8507589 - DNA, 22 bp, Homo sapiens
agaataaatcaaatgtcctgag

SEQ ID NO: 8507590 - DNA, 22 bp, Homo sapiens
agaataaatcaaatgtcctgag

SEQ ID NO: 8507591 - DNA, 22 bp, Homo sapiens
agaatcagtgagcagttgtgat

SEQ ID NO: 8507592 - DNA, 22 bp, Homo sapiens
agaatcaggacctgtggctgtc

SEQ ID NO: 8507593 - DNA, 22 bp, Homo sapiens
agaataatcactgaagttcaaa

SEQ ID NO: 8507594 - DNA, 22 bp, Homo sapiens
agaatcattatatttattaagc

SEQ ID NO: 8507595 - DNA, 22 bp, Homo sapiens
agaatcattatatttattaagc

SEQ ID NO: 8507596 - DNA, 19 bp, Homo sapiens
agaatcatcttgaagtgat

SEQ ID NO: 8507597 - DNA, 22 bp, Homo sapiens
agaataaatgttggacttagga

SEQ ID NO: 8507598 - DNA, 22 bp, Homo sapiens
agaataatactgaaatgctgaa

SEQ ID NO: 8507599 - DNA, 22 bp, Homo sapiens
agaataagcctgacgaaaccta

SEQ ID NO: 8507600 - DNA, 22 bp, Homo sapiens
agaataaccagtgtttcacagt

SEQ ID NO: 8507601 - DNA, 22 bp, Homo sapiens
agaataatcactgaagttcaaa

SEQ ID NO: 8507602 - DNA, 22 bp, Homo sapiens
agaataatactgaaatgctgaa

SEQ ID NO: 8507603 - DNA, 22 bp, Homo sapiens
agaataatcactgaagttcaaa

SEQ ID NO: 8507604 - DNA, 22 bp, Homo sapiens
agaataatcactgaagttcaaa

SEQ ID NO: 8507605 - DNA, 22 bp, Homo sapiens
agactctggaggggctggtcct

SEQ ID NO: 8507606 - DNA, 19 bp, Homo sapiens
agactctgccactcttctc

SEQ ID NO: 8507607 - DNA, 21 bp, Homo sapiens
agacctcttcccttcatgcac

SEQ ID NO: 8507608 - DNA, 22 bp, Homo sapiens
agacctctggatagatgtgagg

SEQ ID NO: 8507609 - DNA, 22 bp, Homo sapiens
agacactggcactggggaagcc

SEQ ID NO: 8507610 - DNA, 22 bp, Homo sapiens
agacactggcactggggaagcc

SEQ ID NO: 8507611 - DNA, 22 bp, Homo sapiens
agacactggtgaagaaatcagg

SEQ ID NO: 8507612 - DNA, 22 bp, Homo sapiens
agacactgaaatgtattgaaga

SEQ ID NO: 8507613 - DNA, 22 bp, Homo sapiens
agacactgaaatgtattgaaga

SEQ ID NO: 8507614 - DNA, 22 bp, Homo sapiens
agacactgaatcagagggacat

SEQ ID NO: 8507615 - DNA, 22 bp, Homo sapiens
agacactgaatgtttggtggtc

SEQ ID NO: 8507616 - DNA, 22 bp, Homo sapiens
agacactgaatcagagggacat

SEQ ID NO: 8507617 - DNA, 22 bp, Homo sapiens
agacactgaatcagagggacat

SEQ ID NO: 8507618 - DNA, 22 bp, Homo sapiens
aatgtataaccataggaaattt

SEQ ID NO: 8507619 - DNA, 22 bp, Homo sapiens
aatgtataaccataggaaattt

SEQ ID NO: 8507620 - DNA, 17 bp, Homo sapiens
agacactgagccaagta

SEQ ID NO: 8507621 - DNA, 17 bp, Homo sapiens
agacactgagccaagta

SEQ ID NO: 8507622 - DNA, 17 bp, Homo sapiens
agacactgagccaagta

SEQ ID NO: 8507623 - DNA, 22 bp, Homo sapiens
agacactgatgttcagctcaat

SEQ ID NO: 8507624 - DNA, 22 bp, Homo sapiens
agacactgagcattttcctagc

SEQ ID NO: 8507625 - DNA, 22 bp, Homo sapiens
agacactgatgttcagctcaat

SEQ ID NO: 8507626 - DNA, 22 bp, Homo sapiens
agacactgatgttcagctcaat

SEQ ID NO: 8507627 - DNA, 22 bp, Homo sapiens
agacactgccacttctgttccc

SEQ ID NO: 8507628 - DNA, 22 bp, Homo sapiens
agacactgccacttctgttccc

SEQ ID NO: 8507629 - DNA, 22 bp, Homo sapiens
agacactgcggaggtcgggtgg

SEQ ID NO: 8507630 - DNA, 19 bp, Homo sapiens
agacactggatggaaaatg

SEQ ID NO: 8507631 - DNA, 22 bp, Homo sapiens
agacactgcggaggtcgggtgg

SEQ ID NO: 8507632 - DNA, 19 bp, Homo sapiens
agactctgtgtgagacttt

SEQ ID NO: 8507633 - DNA, 19 bp, Homo sapiens
agactctgtgtgagacttt

SEQ ID NO: 8507634 - DNA, 22 bp, Homo sapiens
agactgaaacaatctgcaggca

SEQ ID NO: 8507635 - DNA, 22 bp, Homo sapiens
agactgaaatagtgcacaccaa

SEQ ID NO: 8507636 - DNA, 22 bp, Homo sapiens
agactgaataacaagcaaataa

SEQ ID NO: 8507637 - DNA, 22 bp, Homo sapiens
agactgaagtaagaatgcagct

SEQ ID NO: 8507638 - DNA, 23 bp, Homo sapiens
agactgaggctgccagggtcaga

SEQ ID NO: 8507639 - DNA, 17 bp, Homo sapiens
agactgaggacacagga

SEQ ID NO: 8507640 - DNA, 23 bp, Homo sapiens
agactgaggctgccagggtcaga

SEQ ID NO: 8507641 - DNA, 22 bp, Homo sapiens
agactgggccatttccccagct

SEQ ID NO: 8507642 - DNA, 21 bp, Homo sapiens
agactgccattgttcttttgg

SEQ ID NO: 8507643 - DNA, 22 bp, Homo sapiens
agactggatagctttggacttg

SEQ ID NO: 8507644 - DNA, 22 bp, Homo sapiens
agactggaagcctgccaagcaa

SEQ ID NO: 8507645 - DNA, 22 bp, Homo sapiens
agactggggttctggcaaggag

SEQ ID NO: 8507646 - DNA, 23 bp, Homo sapiens
agactggggcataagaagatggc

SEQ ID NO: 8507647 - DNA, 22 bp, Homo sapiens
agagaaacccttcagtgttttg

SEQ ID NO: 8507648 - DNA, 22 bp, Homo sapiens
agagaaacaggtcagctgggag

SEQ ID NO: 8507649 - DNA, 22 bp, Homo sapiens
agagaaacccttcagtgttttg

SEQ ID NO: 8507650 - DNA, 18 bp, Homo sapiens
agagaaagaccaaagcat

SEQ ID NO: 8507651 - DNA, 22 bp, Homo sapiens
agagaaactgatgtcctttgaa

SEQ ID NO: 8507652 - DNA, 23 bp, Homo sapiens
agagaaagggataacacgttgaa

SEQ ID NO: 8507653 - DNA, 18 bp, Homo sapiens
agagaaagaccaaagcat

SEQ ID NO: 8507654 - DNA, 20 bp, Homo sapiens
agagagcacaggcaggaaag

SEQ ID NO: 8507655 - DNA, 23 bp, Homo sapiens
agagagagtttgtgtcaggtacc

SEQ ID NO: 8507656 - DNA, 22 bp, Homo sapiens
agagagcaggacttcactgagc

SEQ ID NO: 8507657 - DNA, 22 bp, Homo sapiens
agagagcaggacttcactgagc

SEQ ID NO: 8507658 - DNA, 22 bp, Homo sapiens
agagataattaggttaaatgag

SEQ ID NO: 8507659 - DNA, 22 bp, Homo sapiens
agagatatgagtagttgtgaca

SEQ ID NO: 8507660 - DNA, 22 bp, Homo sapiens
aattatgtagccatatgaaaca

SEQ ID NO: 8507661 - DNA, 22 bp, Homo sapiens
agagatcccttctgcctgggga

SEQ ID NO: 8507662 - DNA, 19 bp, Homo sapiens
agagatccagcttctagct

SEQ ID NO: 8507663 - DNA, 22 bp, Homo sapiens
agagatctctgaagctgctgct

SEQ ID NO: 8507664 - DNA, 22 bp, Homo sapiens
agagatccttcaatctagtttt

SEQ ID NO: 8507665 - DNA, 22 bp, Homo sapiens
agagatctagcacctgctggtc

SEQ ID NO: 8507666 - DNA, 22 bp, Homo sapiens
agagagagaaatgaaatgtgct

SEQ ID NO: 8507667 - DNA, 17 bp, Homo sapiens
agagagagcatgccacc

SEQ ID NO: 8507668 - DNA, 17 bp, Homo sapiens
agagagagcatgccacc

SEQ ID NO: 8507669 - DNA, 17 bp, Homo sapiens
agagagagcatgccacc

SEQ ID NO: 8507670 - DNA, 22 bp, Homo sapiens
agagagaggggcgagcaaacac

SEQ ID NO: 8507671 - DNA, 22 bp, Homo sapiens
agagagaggggcgagcaaacac

SEQ ID NO: 8507672 - DNA, 22 bp, Homo sapiens
agagagaggcagcagtgctcac

SEQ ID NO: 8507673 - DNA, 20 bp, Homo sapiens
agagagaggtaaattgagca

SEQ ID NO: 8507674 - DNA, 22 bp, Homo sapiens
agagacagggttttgccatgtt

SEQ ID NO: 8507675 - DNA, 22 bp, Homo sapiens
agagacagggttttgccatgtt

SEQ ID NO: 8507676 - DNA, 22 bp, Homo sapiens
agagacagggttttgccatgtt

SEQ ID NO: 8507677 - DNA, 22 bp, Homo sapiens
agagacagggttttgccatgtt

SEQ ID NO: 8507678 - DNA, 22 bp, Homo sapiens
agagagaattggataaattggt

SEQ ID NO: 8507679 - DNA, 18 bp, Homo sapiens
agagagaattccagtagg

SEQ ID NO: 8507680 - DNA, 22 bp, Homo sapiens
agagaaagtcctgatctctcta

SEQ ID NO: 8507681 - DNA, 22 bp, Homo sapiens
agatgttttggagacactaacc

SEQ ID NO: 8507682 - DNA, 22 bp, Homo sapiens
agatcttgttaaatgctgcctc

SEQ ID NO: 8507683 - DNA, 22 bp, Homo sapiens
agatctttaaaagttattatta

SEQ ID NO: 8507684 - DNA, 22 bp, Homo sapiens
agattacagcatgggaatggga

SEQ ID NO: 8507685 - DNA, 22 bp, Homo sapiens
agattacagaagaataagtaga

SEQ ID NO: 8507686 - DNA, 22 bp, Homo sapiens
agattacagaagaataagtaga

SEQ ID NO: 8507687 - DNA, 22 bp, Homo sapiens
agattatttccagactaatgaa

SEQ ID NO: 8507688 - DNA, 21 bp, Homo sapiens
agattcaggacagcagtcact

SEQ ID NO: 8507689 - DNA, 22 bp, Homo sapiens
agattatgctggctgctacaag

SEQ ID NO: 8507690 - DNA, 20 bp, Homo sapiens
agattattcctaagatttct

SEQ ID NO: 8507691 - DNA, 22 bp, Homo sapiens
agatccatgtgatttggagttc

SEQ ID NO: 8507692 - DNA, 23 bp, Homo sapiens
agatccatgtgggctggaaactg

SEQ ID NO: 8507693 - DNA, 22 bp, Homo sapiens
agatccatccagcactcttgcc

SEQ ID NO: 8507694 - DNA, 22 bp, Homo sapiens
agatccatcatcatattttcta

SEQ ID NO: 8507695 - DNA, 22 bp, Homo sapiens
agatccagttaatagcttcatt

SEQ ID NO: 8507696 - DNA, 22 bp, Homo sapiens
agatccagttaatagcttcatt

SEQ ID NO: 8507697 - DNA, 22 bp, Homo sapiens
agatccagttaatagcttcatt

SEQ ID NO: 8507698 - DNA, 22 bp, Homo sapiens
agatcctgccaatggaagcagg

SEQ ID NO: 8507699 - DNA, 21 bp, Homo sapiens
agatccctgaggagagcatcc

SEQ ID NO: 8507700 - DNA, 21 bp, Homo sapiens
agatcctggggtctggggagg

SEQ ID NO: 8507701 - DNA, 22 bp, Homo sapiens
agatccattttggtgtcaactc

SEQ ID NO: 8507702 - DNA, 22 bp, Homo sapiens
agatccgtggattataatttag

SEQ ID NO: 8507703 - DNA, 22 bp, Homo sapiens
agatctgagtggctgcatgtaa

SEQ ID NO: 8507704 - DNA, 22 bp, Homo sapiens
agatctgagtatgatttgcctg

SEQ ID NO: 8507705 - DNA, 22 bp, Homo sapiens
agatctattagcaaactgccat

SEQ ID NO: 8507706 - DNA, 22 bp, Homo sapiens
agatcggctttgcagacctcat

SEQ ID NO: 8507707 - DNA, 22 bp, Homo sapiens
agatcgatttcatatcctctta

SEQ ID NO: 8507708 - DNA, 22 bp, Homo sapiens
agatcggctttgcagacctcat

SEQ ID NO: 8507709 - DNA, 22 bp, Homo sapiens
agatatctggaaaaaatgtatg

SEQ ID NO: 8507710 - DNA, 22 bp, Homo sapiens
agatatctgcaatataatttaa

SEQ ID NO: 8507711 - DNA, 22 bp, Homo sapiens
agatatgactagaagctcattt

SEQ ID NO: 8507712 - DNA, 22 bp, Homo sapiens
agatatggcctcatacagacat

SEQ ID NO: 8507713 - DNA, 22 bp, Homo sapiens
agatatgtccctgtctaatatt

SEQ ID NO: 8507714 - DNA, 22 bp, Homo sapiens
agatatggtttgcataaataag

SEQ ID NO: 8507715 - DNA, 22 bp, Homo sapiens
agatatatttaaggtaataagt

SEQ ID NO: 8507716 - DNA, 22 bp, Homo sapiens
agatatagttgttgagaagaac

SEQ ID NO: 8507717 - DNA, 22 bp, Homo sapiens
agatatacagagaattattcac

SEQ ID NO: 8507718 - DNA, 22 bp, Homo sapiens
agatatcacctctaggctggtg

SEQ ID NO: 8507719 - DNA, 22 bp, Homo sapiens
agatatcaccagttttacatac

SEQ ID NO: 8507720 - DNA, 22 bp, Homo sapiens
agatatatttaaggtaataagt

SEQ ID NO: 8507721 - DNA, 22 bp, Homo sapiens
acaaaaagctccattactgtcc

SEQ ID NO: 8507722 - DNA, 22 bp, Homo sapiens
acaaaaagctccattactgtcc

SEQ ID NO: 8507723 - DNA, 22 bp, Homo sapiens
agaggtggccatgggcgctgga

SEQ ID NO: 8507724 - DNA, 22 bp, Homo sapiens
acaaaaaccgtggattcagcat

SEQ ID NO: 8507725 - DNA, 22 bp, Homo sapiens
aattttgtttaagtgatctgct

SEQ ID NO: 8507726 - DNA, 22 bp, Homo sapiens
agaggtgggagcctggtcacat

SEQ ID NO: 8507727 - DNA, 22 bp, Homo sapiens
agaggtgtggccaggactcaag

SEQ ID NO: 8507728 - DNA, 22 bp, Homo sapiens
agaggtgtggccaggactcaag

SEQ ID NO: 8507729 - DNA, 22 bp, Homo sapiens
agaggtggccatgggcgctgga

SEQ ID NO: 8507730 - DNA, 22 bp, Homo sapiens
agaggtggccatgggcgctgga

SEQ ID NO: 8507731 - DNA, 22 bp, Homo sapiens
agaggtggccatgggcgctgga

SEQ ID NO: 8507732 - DNA, 22 bp, Homo sapiens
agagtaaataggagatgacagc

SEQ ID NO: 8507733 - DNA, 22 bp, Homo sapiens
agagtaacttttaactttacgt

SEQ ID NO: 8507734 - DNA, 20 bp, Homo sapiens
agagtaactggcacataggg

SEQ ID NO: 8507735 - DNA, 22 bp, Homo sapiens
agaggtttcttaggggcttcct

SEQ ID NO: 8507736 - DNA, 22 bp, Homo sapiens
agaggttcagagaaggcgatct

SEQ ID NO: 8507737 - DNA, 22 bp, Homo sapiens
agaggttcaaacttcataattt

SEQ ID NO: 8507738 - DNA, 20 bp, Homo sapiens
agaggttcagtctggagaag

SEQ ID NO: 8507739 - DNA, 22 bp, Homo sapiens
agagtacattcagagctaccta

SEQ ID NO: 8507740 - DNA, 22 bp, Homo sapiens
agagtacactgtacacacaatt

SEQ ID NO: 8507741 - DNA, 22 bp, Homo sapiens
agagtaatttctgctgaaaagg

SEQ ID NO: 8507742 - DNA, 22 bp, Homo sapiens
agagtactgcctcagttatgaa

SEQ ID NO: 8507743 - DNA, 21 bp, Homo sapiens
agagtctgcatttctgacaag

SEQ ID NO: 8507744 - DNA, 19 bp, Homo sapiens
agagtctgtgctcttccta

SEQ ID NO: 8507745 - DNA, 22 bp, Homo sapiens
agagtctgtgctggggccagct

SEQ ID NO: 8507746 - DNA, 22 bp, Homo sapiens
agagtctggtgcatgataagca

SEQ ID NO: 8507747 - DNA, 22 bp, Homo sapiens
agagtctgcctttttctcctgc

SEQ ID NO: 8507748 - DNA, 22 bp, Homo sapiens
agagtcttccaggcagcctgag

SEQ ID NO: 8507749 - DNA, 22 bp, Homo sapiens
agagtgaaaagctagagcagta

SEQ ID NO: 8507750 - DNA, 22 bp, Homo sapiens
agagtctgtgctttcatcagga

SEQ ID NO: 8507751 - DNA, 22 bp, Homo sapiens
agataatgttctgatccatttc

SEQ ID NO: 8507752 - DNA, 22 bp, Homo sapiens
agataatgtcaaattctgtctg

SEQ ID NO: 8507753 - DNA, 22 bp, Homo sapiens
agagtgaaggttgacacttcac

SEQ ID NO: 8507754 - DNA, 22 bp, Homo sapiens
agatataataatttacaagtgt

SEQ ID NO: 8507755 - DNA, 22 bp, Homo sapiens
agatataataatttacaagtgt

SEQ ID NO: 8507756 - DNA, 20 bp, Homo sapiens
agaggctttcttgtagtcag

SEQ ID NO: 8507757 - DNA, 22 bp, Homo sapiens
agaggcttggcctcagttctgt

SEQ ID NO: 8507758 - DNA, 22 bp, Homo sapiens
aatttcaaactaataggaacca

SEQ ID NO: 8507759 - DNA, 22 bp, Homo sapiens
aatttcaagtcttgaagaagta

SEQ ID NO: 8507760 - DNA, 22 bp, Homo sapiens
aatttcaaagctcactggcata

SEQ ID NO: 8507761 - DNA, 21 bp, Homo sapiens
agaggccaagtcatcatttcc

SEQ ID NO: 8507762 - DNA, 22 bp, Homo sapiens
agaggccaatagtaggtggcat

SEQ ID NO: 8507763 - DNA, 22 bp, Homo sapiens
agaggccaatagtaggtggcat

SEQ ID NO: 8507764 - DNA, 22 bp, Homo sapiens
aatttatatgtaattaggcaca

SEQ ID NO: 8507765 - DNA, 22 bp, Homo sapiens
agaggccaatagtaggtggcat

SEQ ID NO: 8507766 - DNA, 22 bp, Homo sapiens
agaggccacaccagcctcccgt

SEQ ID NO: 8507767 - DNA, 22 bp, Homo sapiens
aatttattatatcctaggggaa

SEQ ID NO: 8507768 - DNA, 22 bp, Homo sapiens
aatttattcccgtctctgggct

SEQ ID NO: 8507769 - DNA, 22 bp, Homo sapiens
aatttatttcctgccagtacac

SEQ ID NO: 8507770 - DNA, 22 bp, Homo sapiens
aatttatttcctgccagtacac

SEQ ID NO: 8507771 - DNA, 22 bp, Homo sapiens
agagggctaactgggaagcagg

SEQ ID NO: 8507772 - DNA, 22 bp, Homo sapiens
agagggcccatgttgggctgct

SEQ ID NO: 8507773 - DNA, 22 bp, Homo sapiens
agagggcccatgttgggctgct

SEQ ID NO: 8507774 - DNA, 22 bp, Homo sapiens
agagggcccatgttgggctgct

SEQ ID NO: 8507775 - DNA, 22 bp, Homo sapiens
agagggcccatgttgggctgct

SEQ ID NO: 8507776 - DNA, 22 bp, Homo sapiens
agagggcccatgttgggctgct

SEQ ID NO: 8507777 - DNA, 22 bp, Homo sapiens
agagggccataggtgcatagtt

SEQ ID NO: 8507778 - DNA, 22 bp, Homo sapiens
agagggcataaaatagagcacg

SEQ ID NO: 8507779 - DNA, 21 bp, Homo sapiens
aattttgaaggaagattaagg

SEQ ID NO: 8507780 - DNA, 22 bp, Homo sapiens
agagggctgcctcagtcagcta

SEQ ID NO: 8507781 - DNA, 22 bp, Homo sapiens
agagggctgcctcagtcagcta

SEQ ID NO: 8507782 - DNA, 22 bp, Homo sapiens
aattttctggtgtgtaatgaag

SEQ ID NO: 8507783 - DNA, 22 bp, Homo sapiens
agagcagctggggcagagacca

SEQ ID NO: 8507784 - DNA, 22 bp, Homo sapiens
agaggcaacatggggaacagat

SEQ ID NO: 8507785 - DNA, 22 bp, Homo sapiens
agagcaggcataaagctttgaa

SEQ ID NO: 8507786 - DNA, 22 bp, Homo sapiens
agagcaggcataaagctttgaa

SEQ ID NO: 8507787 - DNA, 22 bp, Homo sapiens
agagcaggcataaagctttgaa

SEQ ID NO: 8507788 - DNA, 22 bp, Homo sapiens
agagcaggggcaatgtgttgca

SEQ ID NO: 8507789 - DNA, 22 bp, Homo sapiens
agagcaggggcaatgtgttgca

SEQ ID NO: 8507790 - DNA, 22 bp, Homo sapiens
agagcaggggcaatgtgttgca

SEQ ID NO: 8507791 - DNA, 21 bp, Homo sapiens
agaggcaggcattaagtacac

SEQ ID NO: 8507792 - DNA, 21 bp, Homo sapiens
agaggcaggcattaagtacac

SEQ ID NO: 8507793 - DNA, 21 bp, Homo sapiens
agaggcaggcattaagtacac

SEQ ID NO: 8507794 - DNA, 21 bp, Homo sapiens
agaggcaggcattaagtacac

SEQ ID NO: 8507795 - DNA, 22 bp, Homo sapiens
agaggccaagccagactgtgca

SEQ ID NO: 8507796 - DNA, 22 bp, Homo sapiens
agaggccaagccagactgtgca

SEQ ID NO: 8507797 - DNA, 23 bp, Homo sapiens
agaggccaacttcttgcccctcc

SEQ ID NO: 8507798 - DNA, 23 bp, Homo sapiens
agaggccaacttcttgcccctcc

SEQ ID NO: 8507799 - DNA, 22 bp, Homo sapiens
agaggccaaagaatctacaaga

SEQ ID NO: 8507800 - DNA, 22 bp, Homo sapiens
aattcagagactcattctggag

SEQ ID NO: 8507801 - DNA, 22 bp, Homo sapiens
aattcagagacatgaagtgaca

SEQ ID NO: 8507802 - DNA, 22 bp, Homo sapiens
aattcagaagcacaaaacctag

SEQ ID NO: 8507803 - DNA, 22 bp, Homo sapiens
aattcagtaatcattaatgatg

SEQ ID NO: 8507804 - DNA, 22 bp, Homo sapiens
aattcagtggtttctgcaacaa

SEQ ID NO: 8507805 - DNA, 22 bp, Homo sapiens
aattcagtgtctggcactgctg

SEQ ID NO: 8507806 - DNA, 22 bp, Homo sapiens
aattcagttatatgtccacttc

SEQ ID NO: 8507807 - DNA, 22 bp, Homo sapiens
aattcagttgacagctaatgcc

SEQ ID NO: 8507808 - DNA, 22 bp, Homo sapiens
aattcagttgtgtctgacctcg

SEQ ID NO: 8507809 - DNA, 22 bp, Homo sapiens
aattcagttggcaaacatgctg

SEQ ID NO: 8507810 - DNA, 22 bp, Homo sapiens
aattcatactctatattgcttt

SEQ ID NO: 8507811 - DNA, 22 bp, Homo sapiens
agagcagctgacagcctgccat

SEQ ID NO: 8507812 - DNA, 22 bp, Homo sapiens
aattcatactctatattgcttt

SEQ ID NO: 8507813 - DNA, 18 bp, Homo sapiens
agagcagcggcatcacac

SEQ ID NO: 8507814 - DNA, 22 bp, Homo sapiens
agagcagcgtttgtggaacact

SEQ ID NO: 8507815 - DNA, 22 bp, Homo sapiens
aattcacagcatttgcccatct

SEQ ID NO: 8507816 - DNA, 22 bp, Homo sapiens
aattcacatgttgaagtcctaa

SEQ ID NO: 8507817 - DNA, 22 bp, Homo sapiens
aattcacatgcatgtctgtgca

SEQ ID NO: 8507818 - DNA, 22 bp, Homo sapiens
aatgttacgatcaacaacacat

SEQ ID NO: 8507819 - DNA, 22 bp, Homo sapiens
aatgttacgatcaacaacacat

SEQ ID NO: 8507820 - DNA, 22 bp, Homo sapiens
aatgttacagttttaattctga

SEQ ID NO: 8507821 - DNA, 22 bp, Homo sapiens
aatgttacacaggtataatcag

SEQ ID NO: 8507822 - DNA, 22 bp, Homo sapiens
aatgttacgatcaacaacacat

SEQ ID NO: 8507823 - DNA, 22 bp, Homo sapiens
aatgttaattcacagccaaata

SEQ ID NO: 8507824 - DNA, 21 bp, Homo sapiens
aatgtctttgtccatgctctg

SEQ ID NO: 8507825 - DNA, 22 bp, Homo sapiens
aatgtctttctgttctatgaga

SEQ ID NO: 8507826 - DNA, 21 bp, Homo sapiens
aatgtctttgtccatgctctg

SEQ ID NO: 8507827 - DNA, 22 bp, Homo sapiens
aatgtcttttgatacaagttac

SEQ ID NO: 8507828 - DNA, 22 bp, Homo sapiens
aatgtcttttaacctctggact

SEQ ID NO: 8507829 - DNA, 22 bp, Homo sapiens
aatgtcttttcccttactttcc

SEQ ID NO: 8507830 - DNA, 22 bp, Homo sapiens
aatgtcttttgatacaagttac

SEQ ID NO: 8507831 - DNA, 22 bp, Homo sapiens
aatgtcttttcccttactttcc

SEQ ID NO: 8507832 - DNA, 22 bp, Homo sapiens
aatgttaaaaccttcagtgctt

SEQ ID NO: 8507833 - DNA, 22 bp, Homo sapiens
aatgttaaaaccttcagtgctt

SEQ ID NO: 8507834 - DNA, 22 bp, Homo sapiens
aatgtgttttatgagagaatat

SEQ ID NO: 8507835 - DNA, 22 bp, Homo sapiens
aatgtgttttcactgaagattc

SEQ ID NO: 8507836 - DNA, 22 bp, Homo sapiens
aatgtgaaaccgcacagaataa

SEQ ID NO: 8507837 - DNA, 22 bp, Homo sapiens
aatgtgaaaccgcacagaataa

SEQ ID NO: 8507838 - DNA, 22 bp, Homo sapiens
aatgttatgtggttcaacttaa

SEQ ID NO: 8507839 - DNA, 22 bp, Homo sapiens
aactttatcggaacaggtactc

SEQ ID NO: 8507840 - DNA, 22 bp, Homo sapiens
aactttatcggaacaggtactc

SEQ ID NO: 8507841 - DNA, 22 bp, Homo sapiens
aactttattgttaggggctaaa

SEQ ID NO: 8507842 - DNA, 22 bp, Homo sapiens
aactttcagaatcctatgcatt

SEQ ID NO: 8507843 - DNA, 22 bp, Homo sapiens
aactttcaggcaatgaatattt

SEQ ID NO: 8507844 - DNA, 22 bp, Homo sapiens
aactttctataggttgggattt

SEQ ID NO: 8507845 - DNA, 22 bp, Homo sapiens
aattagaaccagaagccatatt

SEQ ID NO: 8507846 - DNA, 22 bp, Homo sapiens
aattagaaccagaagccatatt

SEQ ID NO: 8507847 - DNA, 22 bp, Homo sapiens
aattagaaccagaagccatatt

SEQ ID NO: 8507848 - DNA, 22 bp, Homo sapiens
aattagaaccagaagccatatt

SEQ ID NO: 8507849 - DNA, 22 bp, Homo sapiens
aattacttaagagaaactttga

SEQ ID NO: 8507850 - DNA, 22 bp, Homo sapiens
aactttctctggatggcttcct

SEQ ID NO: 8507851 - DNA, 22 bp, Homo sapiens
aactttctgaaaagcttgatca

SEQ ID NO: 8507852 - DNA, 22 bp, Homo sapiens
aatgttttgtatgcctctgagc

SEQ ID NO: 8507853 - DNA, 22 bp, Homo sapiens
aatgtctttatttcaggtttac

SEQ ID NO: 8507854 - DNA, 22 bp, Homo sapiens
aatgtctttctcataacagata

SEQ ID NO: 8507855 - DNA, 22 bp, Homo sapiens
aatgtctttctcataacagata

SEQ ID NO: 8507856 - DNA, 22 bp, Homo sapiens
aatgtctttaaagtgcaataga

SEQ ID NO: 8507857 - DNA, 22 bp, Homo sapiens
aatgtctttaaagtgcaataga

SEQ ID NO: 8507858 - DNA, 22 bp, Homo sapiens
aatgtctttaaagtgcaataga

SEQ ID NO: 8507859 - DNA, 22 bp, Homo sapiens
aatgtctttaaagtgcaataga

SEQ ID NO: 8507860 - DNA, 22 bp, Homo sapiens
aatgtcttgagaagagaaatct

SEQ ID NO: 8507861 - DNA, 20 bp, Homo sapiens
aatgtcttgagacatttcag

SEQ ID NO: 8507862 - DNA, 20 bp, Homo sapiens
aatgtcttgagacatttcag

SEQ ID NO: 8507863 - DNA, 22 bp, Homo sapiens
aatgtcttgagaagagaaatct

SEQ ID NO: 8507864 - DNA, 22 bp, Homo sapiens
aatgtcttgagaagagaaatct

SEQ ID NO: 8507865 - DNA, 20 bp, Homo sapiens
aatgtcttgagacatttcag

SEQ ID NO: 8507866 - DNA, 22 bp, Homo sapiens
aatgtcaacacaagagaaatgc

SEQ ID NO: 8507867 - DNA, 22 bp, Homo sapiens
aatgtcaaaatggaatgagact

SEQ ID NO: 8507868 - DNA, 22 bp, Homo sapiens
aactctttgtggacattaaatt

SEQ ID NO: 8507869 - DNA, 22 bp, Homo sapiens
aactctttggtctcaggaaagg

SEQ ID NO: 8507870 - DNA, 22 bp, Homo sapiens
aactctttggtctcaggaaagg

SEQ ID NO: 8507871 - DNA, 22 bp, Homo sapiens
aactcttaattttcatgaaatg

SEQ ID NO: 8507872 - DNA, 22 bp, Homo sapiens
aactctggtttcagactcactt

SEQ ID NO: 8507873 - DNA, 22 bp, Homo sapiens
aatgtacaataagacaaagagg

SEQ ID NO: 8507874 - DNA, 22 bp, Homo sapiens
aactgaaacggtgatcttttaa

SEQ ID NO: 8507875 - DNA, 22 bp, Homo sapiens
aatgtacaataagacaaagagg

SEQ ID NO: 8507876 - DNA, 22 bp, Homo sapiens
aatgtattctgggaaaatgtta

SEQ ID NO: 8507877 - DNA, 22 bp, Homo sapiens
aactcctcactgcctctggcac

SEQ ID NO: 8507878 - DNA, 23 bp, Homo sapiens
aactcctgaatcgtgagccatct

SEQ ID NO: 8507879 - DNA, 22 bp, Homo sapiens
aactcctctctggtggttcgtc

SEQ ID NO: 8507880 - DNA, 20 bp, Homo sapiens
aactcctagcctcaagtgat

SEQ ID NO: 8507881 - DNA, 22 bp, Homo sapiens
aactctacttgggactcctctg

SEQ ID NO: 8507882 - DNA, 23 bp, Homo sapiens
aactctggctagcatagaataga

SEQ ID NO: 8507883 - DNA, 22 bp, Homo sapiens
aactctctttagagagggacaa

SEQ ID NO: 8507884 - DNA, 22 bp, Homo sapiens
aactctcttgggagtacctgga

SEQ ID NO: 8507885 - DNA, 22 bp, Homo sapiens
aactctctctggctcccagcaa

SEQ ID NO: 8507886 - DNA, 22 bp, Homo sapiens
aactctatttaccctactaaac

SEQ ID NO: 8507887 - DNA, 22 bp, Homo sapiens
acaactgtcagtaaagaatatt

SEQ ID NO: 8507888 - DNA, 22 bp, Homo sapiens
acaactgtcagtaaagaatatt

SEQ ID NO: 8507889 - DNA, 22 bp, Homo sapiens
acaactgtcttcttcatgctcc

SEQ ID NO: 8507890 - DNA, 22 bp, Homo sapiens
acaactgttagacacttctaag

SEQ ID NO: 8507891 - DNA, 22 bp, Homo sapiens
acaactgttggaggaacacagg

SEQ ID NO: 8507892 - DNA, 22 bp, Homo sapiens
acaactgtcagtaaagaatatt

SEQ ID NO: 8507893 - DNA, 22 bp, Homo sapiens
acaactgggggcattactggca

SEQ ID NO: 8507894 - DNA, 22 bp, Homo sapiens
acaactgatgggtcatgtggga

SEQ ID NO: 8507895 - DNA, 22 bp, Homo sapiens
acaactggctttttagcttgtt

SEQ ID NO: 8507896 - DNA, 22 bp, Homo sapiens
aagacacacacatatgctgagt

SEQ ID NO: 8507897 - DNA, 22 bp, Homo sapiens
aagacacacacatatgctgagt

SEQ ID NO: 8507898 - DNA, 22 bp, Homo sapiens
aagacaatttgatactagttgc

SEQ ID NO: 8507899 - DNA, 22 bp, Homo sapiens
aagacaatttatgttagggtca

SEQ ID NO: 8507900 - DNA, 22 bp, Homo sapiens
aagacaatttatgttagggtca

SEQ ID NO: 8507901 - DNA, 22 bp, Homo sapiens
aagacacaatgtagcccagcac

SEQ ID NO: 8507902 - DNA, 22 bp, Homo sapiens
aagacacaaagcttcccttttc

SEQ ID NO: 8507903 - DNA, 22 bp, Homo sapiens
aagacacaaagcttcccttttc

SEQ ID NO: 8507904 - DNA, 22 bp, Homo sapiens
aagacaattttgagtatgcaca

SEQ ID NO: 8507905 - DNA, 22 bp, Homo sapiens
aagacaatgtttctgatagata

SEQ ID NO: 8507906 - DNA, 22 bp, Homo sapiens
acaactttgtagcaattccacg

SEQ ID NO: 8507907 - DNA, 22 bp, Homo sapiens
acaactttgtagcaattccacg

SEQ ID NO: 8507908 - DNA, 22 bp, Homo sapiens
acaacttttctatcatgtggaa

SEQ ID NO: 8507909 - DNA, 22 bp, Homo sapiens
acaactttgacccttgttctta

SEQ ID NO: 8507910 - DNA, 22 bp, Homo sapiens
acaactttctgggttatctgat

SEQ ID NO: 8507911 - DNA, 23 bp, Homo sapiens
acaactttacagatacattttgt

SEQ ID NO: 8507912 - DNA, 22 bp, Homo sapiens
acaactttctgggttatctgat

SEQ ID NO: 8507913 - DNA, 23 bp, Homo sapiens
acaactttacagatacattttgt

SEQ ID NO: 8507914 - DNA, 23 bp, Homo sapiens
acaactttacagatacattttgt

SEQ ID NO: 8507915 - DNA, 22 bp, Homo sapiens
acaactttaatgggtttcagct

SEQ ID NO: 8507916 - DNA, 22 bp, Homo sapiens
acaactgttggaggaacacagg

SEQ ID NO: 8507917 - DNA, 22 bp, Homo sapiens
aagacattccaaagtggctaat

SEQ ID NO: 8507918 - DNA, 22 bp, Homo sapiens
aagacattcatgaagaagggat

SEQ ID NO: 8507919 - DNA, 22 bp, Homo sapiens
aagacattcatgaagaagggat

SEQ ID NO: 8507920 - DNA, 22 bp, Homo sapiens
acaagaataaggataagagatt

SEQ ID NO: 8507921 - DNA, 22 bp, Homo sapiens
aagacattagaatcagcctgtt

SEQ ID NO: 8507922 - DNA, 22 bp, Homo sapiens
aagacattgtggagatgttgct

SEQ ID NO: 8507923 - DNA, 22 bp, Homo sapiens
aagacattgtcattttataatt

SEQ ID NO: 8507924 - DNA, 22 bp, Homo sapiens
aagacattggcattgactgtaa

SEQ ID NO: 8507925 - DNA, 22 bp, Homo sapiens
aagaattttccagcatgtcagt

SEQ ID NO: 8507926 - DNA, 22 bp, Homo sapiens
aagacaacagagatgacagact

SEQ ID NO: 8507927 - DNA, 17 bp, Homo sapiens
aagacaagacaaatgca

SEQ ID NO: 8507928 - DNA, 17 bp, Homo sapiens
aagacaagacaaatgca

SEQ ID NO: 8507929 - DNA, 17 bp, Homo sapiens
aagacaagacaaatgca

SEQ ID NO: 8507930 - DNA, 22 bp, Homo sapiens
aagacaagcatcaaatcaggca

SEQ ID NO: 8507931 - DNA, 22 bp, Homo sapiens
aagacaatcctggacagtcagc

SEQ ID NO: 8507932 - DNA, 22 bp, Homo sapiens
aattcacaatgtgtagtcatgc

SEQ ID NO: 8507933 - DNA, 22 bp, Homo sapiens
aagaattatctgaaagctgtgt

SEQ ID NO: 8507934 - DNA, 22 bp, Homo sapiens
aagaattattgcaatactagat

SEQ ID NO: 8507935 - DNA, 22 bp, Homo sapiens
aagaattcactggtagagtcaa

SEQ ID NO: 8507936 - DNA, 22 bp, Homo sapiens
aagaattattgcaatactagat

SEQ ID NO: 8507937 - DNA, 22 bp, Homo sapiens
aagaattattgcaatactagat

SEQ ID NO: 8507938 - DNA, 22 bp, Homo sapiens
aagaattggtttcctctgtcat

SEQ ID NO: 8507939 - DNA, 22 bp, Homo sapiens
aagaattggtttcctctgtcat

SEQ ID NO: 8507940 - DNA, 22 bp, Homo sapiens
aagaattggtcacatgctacaa

SEQ ID NO: 8507941 - DNA, 22 bp, Homo sapiens
aagaattgatgtgaattgcagc

SEQ ID NO: 8507942 - DNA, 22 bp, Homo sapiens
aattcaaattacaatagttgtt

SEQ ID NO: 8507943 - DNA, 22 bp, Homo sapiens
aattcaaagactagaattttgc

SEQ ID NO: 8507944 - DNA, 22 bp, Homo sapiens
aattcaaattacaatagttgtt

SEQ ID NO: 8507945 - DNA, 22 bp, Homo sapiens
aattcaaattacaatagttgtt

SEQ ID NO: 8507946 - DNA, 22 bp, Homo sapiens
aattcaaattacaatagttgtt

SEQ ID NO: 8507947 - DNA, 22 bp, Homo sapiens
aattcaaattacaatagttgtt

SEQ ID NO: 8507948 - DNA, 22 bp, Homo sapiens
aattcaatctaagaaatgatca

SEQ ID NO: 8507949 - DNA, 22 bp, Homo sapiens
aattcaatctaagaaatgatca

SEQ ID NO: 8507950 - DNA, 22 bp, Homo sapiens
aattcaatggtttttaggatat

SEQ ID NO: 8507951 - DNA, 22 bp, Homo sapiens
aattcaatctgtagattgtgat

SEQ ID NO: 8507952 - DNA, 22 bp, Homo sapiens
aattcaatctaagaaatgatca

SEQ ID NO: 8507953 - DNA, 23 bp, Homo sapiens
aattcaaattcagtgtgactagg

SEQ ID NO: 8507954 - DNA, 23 bp, Homo sapiens
aattcaaattcagtgtgactagg

SEQ ID NO: 8507955 - DNA, 22 bp, Homo sapiens
aattcaaatttgagtttgtgat

SEQ ID NO: 8507956 - DNA, 22 bp, Homo sapiens
aattagcatttcccatataaat

SEQ ID NO: 8507957 - DNA, 22 bp, Homo sapiens
aattagcatttcccatataaat

SEQ ID NO: 8507958 - DNA, 22 bp, Homo sapiens
aattagaagctgttagcaaaat

SEQ ID NO: 8507959 - DNA, 22 bp, Homo sapiens
aattagaagctgttagcaaaat

SEQ ID NO: 8507960 - DNA, 22 bp, Homo sapiens
aattagaagctgttagcaaaat

SEQ ID NO: 8507961 - DNA, 22 bp, Homo sapiens
aattagaagctgttagcaaaat

SEQ ID NO: 8507962 - DNA, 22 bp, Homo sapiens
aattagagatcagttctttgac

SEQ ID NO: 8507963 - DNA, 22 bp, Homo sapiens
aattagaatcttatttggggaa

SEQ ID NO: 8507964 - DNA, 22 bp, Homo sapiens
aattagaagggagttattgata

SEQ ID NO: 8507965 - DNA, 22 bp, Homo sapiens
aattagaagggagttattgata

SEQ ID NO: 8507966 - DNA, 22 bp, Homo sapiens
acagatcctggttacagccatt

SEQ ID NO: 8507967 - DNA, 22 bp, Homo sapiens
acagatcctggttacagccatt

SEQ ID NO: 8507968 - DNA, 22 bp, Homo sapiens
acagatcctggttacagccatt

SEQ ID NO: 8507969 - DNA, 22 bp, Homo sapiens
acagatctacattgtctgaccc

SEQ ID NO: 8507970 - DNA, 22 bp, Homo sapiens
acagatgaaacccagctagttg

SEQ ID NO: 8507971 - DNA, 23 bp, Homo sapiens
acagatcatctcgaaacaactat

SEQ ID NO: 8507972 - DNA, 22 bp, Homo sapiens
acagatcacttgactaaaatga

SEQ ID NO: 8507973 - DNA, 22 bp, Homo sapiens
acagatcacttgactaaaatga

SEQ ID NO: 8507974 - DNA, 22 bp, Homo sapiens
acagatcacctgttagccaaaa

SEQ ID NO: 8507975 - DNA, 22 bp, Homo sapiens
acagagtcattcactgatgaag

SEQ ID NO: 8507976 - DNA, 22 bp, Homo sapiens
acagatatttggggaaagacgt

SEQ ID NO: 8507977 - DNA, 22 bp, Homo sapiens
aagcacatttggaaaacatgga

SEQ ID NO: 8507978 - DNA, 22 bp, Homo sapiens
acagagtcatggtagtcaaagg

SEQ ID NO: 8507979 - DNA, 22 bp, Homo sapiens
acagagtcattcactgatgaag

SEQ ID NO: 8507980 - DNA, 22 bp, Homo sapiens
acagatgagaagctgcattcaa

SEQ ID NO: 8507981 - DNA, 22 bp, Homo sapiens
acagatgaattttaattgtgtt

SEQ ID NO: 8507982 - DNA, 22 bp, Homo sapiens
acagatgaattttaattgtgtt

SEQ ID NO: 8507983 - DNA, 22 bp, Homo sapiens
acagatgagaaggctgaccagt

SEQ ID NO: 8507984 - DNA, 22 bp, Homo sapiens
acagatgaaacccagctagttg

SEQ ID NO: 8507985 - DNA, 23 bp, Homo sapiens
acagatgaaagtgtggctcagag

SEQ ID NO: 8507986 - DNA, 22 bp, Homo sapiens
aagcacatctcctgtgcagaac

SEQ ID NO: 8507987 - DNA, 22 bp, Homo sapiens
aagcacatctcctgtgcagaac

SEQ ID NO: 8507988 - DNA, 22 bp, Homo sapiens
aagcacatcatgttgttcagac

SEQ ID NO: 8507989 - DNA, 22 bp, Homo sapiens
aagcacatctcctgtgcagaac

SEQ ID NO: 8507990 - DNA, 22 bp, Homo sapiens
aagcacatctcaaacttcatct

SEQ ID NO: 8507991 - DNA, 22 bp, Homo sapiens
aagcacatgaaaatgtgaagct

SEQ ID NO: 8507992 - DNA, 22 bp, Homo sapiens
aagcacatgagctattcatgct

SEQ ID NO: 8507993 - DNA, 22 bp, Homo sapiens
aagcacatgagctattcatgct

SEQ ID NO: 8507994 - DNA, 22 bp, Homo sapiens
aagcacatgagctattcatgct

SEQ ID NO: 8507995 - DNA, 22 bp, Homo sapiens
aagcacattaaggaacattgaa

SEQ ID NO: 8507996 - DNA, 22 bp, Homo sapiens
aagcacattaaggaacattgaa

SEQ ID NO: 8507997 - DNA, 22 bp, Homo sapiens
aagcacattaaggaacattgaa

SEQ ID NO: 8507998 - DNA, 22 bp, Homo sapiens
aagcacatttggaaaacatgga

SEQ ID NO: 8507999 - DNA, 22 bp, Homo sapiens
aagcacatttggaaaacatgga

SEQ ID NO: 8508000 - DNA, 20 bp, Homo sapiens
aagcacatttctacaataat

SEQ ID NO: 8508001 - DNA, 20 bp, Homo sapiens
aagcacatttctacaataat

SEQ ID NO: 8508002 - DNA, 22 bp, Homo sapiens
aagcacattgtacatttgtgct

SEQ ID NO: 8508003 - DNA, 20 bp, Homo sapiens
aagcacatttctacaataat

SEQ ID NO: 8508004 - DNA, 22 bp, Homo sapiens
aagcacattgtacatttgtgct

SEQ ID NO: 8508005 - DNA, 20 bp, Homo sapiens
aagcacatttctacaataat

SEQ ID NO: 8508006 - DNA, 22 bp, Homo sapiens
aagcacattgtacatttgtgct

SEQ ID NO: 8508007 - DNA, 22 bp, Homo sapiens
aagcacattgtacatttgtgct

SEQ ID NO: 8508008 - DNA, 22 bp, Homo sapiens
aagcacattgcctggcacatag

SEQ ID NO: 8508009 - DNA, 22 bp, Homo sapiens
aagcacattgcctggcacatag

SEQ ID NO: 8508010 - DNA, 22 bp, Homo sapiens
aagcacattgcctggcacatag

SEQ ID NO: 8508011 - DNA, 22 bp, Homo sapiens
acagaggaaggctgagctgccc

SEQ ID NO: 8508012 - DNA, 22 bp, Homo sapiens
acagaggaaggctgagctgccc

SEQ ID NO: 8508013 - DNA, 22 bp, Homo sapiens
acagaggaagcatatagcacaa

SEQ ID NO: 8508014 - DNA, 22 bp, Homo sapiens
acagaggacaactaggcgctca

SEQ ID NO: 8508015 - DNA, 18 bp, Homo sapiens
acagaggcagacatgtat

SEQ ID NO: 8508016 - DNA, 18 bp, Homo sapiens
acagaggcagacatgtat

SEQ ID NO: 8508017 - DNA, 22 bp, Homo sapiens
acagaggacaactaggcgctca

SEQ ID NO: 8508018 - DNA, 18 bp, Homo sapiens
acagaggcagacatgtat

SEQ ID NO: 8508019 - DNA, 18 bp, Homo sapiens
acagaggcagacatgtat

SEQ ID NO: 8508020 - DNA, 22 bp, Homo sapiens
aagcacatacataataaagtcc

SEQ ID NO: 8508021 - DNA, 22 bp, Homo sapiens
aagcacatacataataaagtcc

SEQ ID NO: 8508022 - DNA, 22 bp, Homo sapiens
aagcacagttcttagagttaca

SEQ ID NO: 8508023 - DNA, 22 bp, Homo sapiens
aagcaaagacagtttgagtgga

SEQ ID NO: 8508024 - DNA, 22 bp, Homo sapiens
aagcaaaaggttacacttctgg

SEQ ID NO: 8508025 - DNA, 17 bp, Homo sapiens
acagagcacatcaagat

SEQ ID NO: 8508026 - DNA, 22 bp, Homo sapiens
acagagctgtacatgtgccatg

SEQ ID NO: 8508027 - DNA, 22 bp, Homo sapiens
acagagcacatagattggagtt

SEQ ID NO: 8508028 - DNA, 22 bp, Homo sapiens
acagaggaagcatatagcacaa

SEQ ID NO: 8508029 - DNA, 22 bp, Homo sapiens
acagagcttaggatgactccca

SEQ ID NO: 8508030 - DNA, 22 bp, Homo sapiens
acagagcttcccagcctgagca

SEQ ID NO: 8508031 - DNA, 22 bp, Homo sapiens
acagagcttaggatgactccca

SEQ ID NO: 8508032 - DNA, 22 bp, Homo sapiens
acagagcttaattcaggagctt

SEQ ID NO: 8508033 - DNA, 22 bp, Homo sapiens
acagagctgtactacttactga

SEQ ID NO: 8508034 - DNA, 22 bp, Homo sapiens
acagaagcaaaagcaggatctt

SEQ ID NO: 8508035 - DNA, 22 bp, Homo sapiens
acagaagaccagagagctaact

SEQ ID NO: 8508036 - DNA, 22 bp, Homo sapiens
acagaagaccagagagctaact

SEQ ID NO: 8508037 - DNA, 22 bp, Homo sapiens
acagaagagcacatttagtatg

SEQ ID NO: 8508038 - DNA, 22 bp, Homo sapiens
aagcaaaaggttacacttctgg

SEQ ID NO: 8508039 - DNA, 22 bp, Homo sapiens
aagatttttttccacagactca

SEQ ID NO: 8508040 - DNA, 22 bp, Homo sapiens
aagattttctcaactgtatttg

SEQ ID NO: 8508041 - DNA, 22 bp, Homo sapiens
aagattttctcaactgtatttg

SEQ ID NO: 8508042 - DNA, 22 bp, Homo sapiens
aagattttcagtgcctaaaaca

SEQ ID NO: 8508043 - DNA, 22 bp, Homo sapiens
aagattttcagctaatggtgca

SEQ ID NO: 8508044 - DNA, 22 bp, Homo sapiens
acagaagaccaagaaagcttcc

SEQ ID NO: 8508045 - DNA, 22 bp, Homo sapiens
acagaagaccaagaaagcttcc

SEQ ID NO: 8508046 - DNA, 22 bp, Homo sapiens
acagaagaagttcaaggtgaag

SEQ ID NO: 8508047 - DNA, 22 bp, Homo sapiens
acagaagaagttcaaggtgaag

SEQ ID NO: 8508048 - DNA, 19 bp, Homo sapiens
acagaaatgtaagtgagac

SEQ ID NO: 8508049 - DNA, 22 bp, Homo sapiens
aagatatagataaaactatgca

SEQ ID NO: 8508050 - DNA, 22 bp, Homo sapiens
aagatatactattaagtaccat

SEQ ID NO: 8508051 - DNA, 22 bp, Homo sapiens
aagatatactattaagtaccat

SEQ ID NO: 8508052 - DNA, 22 bp, Homo sapiens
aagatataataactgttgtcat

SEQ ID NO: 8508053 - DNA, 22 bp, Homo sapiens
aagatatactattaagtaccat

SEQ ID NO: 8508054 - DNA, 22 bp, Homo sapiens
aagatatagataaaactatgca

SEQ ID NO: 8508055 - DNA, 22 bp, Homo sapiens
aagatacattttcttcagagaa

SEQ ID NO: 8508056 - DNA, 22 bp, Homo sapiens
aagatacatcattcaggagtga

SEQ ID NO: 8508057 - DNA, 22 bp, Homo sapiens
acactagctaaatgctgattaa

SEQ ID NO: 8508058 - DNA, 22 bp, Homo sapiens
aagatactgatgatgtaggcta

SEQ ID NO: 8508059 - DNA, 22 bp, Homo sapiens
aagatagatgtcatcagcatat

SEQ ID NO: 8508060 - DNA, 22 bp, Homo sapiens
aagatacttcacttgccgaaat

SEQ ID NO: 8508061 - DNA, 22 bp, Homo sapiens
acactacaatctcagaactata

SEQ ID NO: 8508062 - DNA, 22 bp, Homo sapiens
acactacaatctcagaactata

SEQ ID NO: 8508063 - DNA, 22 bp, Homo sapiens
acactacaatctcagaactata

SEQ ID NO: 8508064 - DNA, 22 bp, Homo sapiens
acactagagagcaggcattccc

SEQ ID NO: 8508065 - DNA, 22 bp, Homo sapiens
acacggcactttaggaaggggc

SEQ ID NO: 8508066 - DNA, 22 bp, Homo sapiens
acacggcactttaggaaggggc

SEQ ID NO: 8508067 - DNA, 22 bp, Homo sapiens
acactaaatgagtctacagtac

SEQ ID NO: 8508068 - DNA, 22 bp, Homo sapiens
acactaaatgagtctacagtac

SEQ ID NO: 8508069 - DNA, 22 bp, Homo sapiens
acactaaggttggagtcacagt

SEQ ID NO: 8508070 - DNA, 22 bp, Homo sapiens
aagagtttatgatataacatgt

SEQ ID NO: 8508071 - DNA, 22 bp, Homo sapiens
acacccaggctggcgtgcagtg

SEQ ID NO: 8508072 - DNA, 22 bp, Homo sapiens
acacatttctctttttgtaagt

SEQ ID NO: 8508073 - DNA, 22 bp, Homo sapiens
acacatttctctttttgtaagt

SEQ ID NO: 8508074 - DNA, 22 bp, Homo sapiens
acacatttctctttttgtaagt

SEQ ID NO: 8508075 - DNA, 22 bp, Homo sapiens
acacctggtctttgcatgagca

SEQ ID NO: 8508076 - DNA, 23 bp, Homo sapiens
acacctgtgctgtagtcactaca

SEQ ID NO: 8508077 - DNA, 22 bp, Homo sapiens
acacctttgtgaagtgatgatg

SEQ ID NO: 8508078 - DNA, 22 bp, Homo sapiens
acacctttgccccaagtcatag

SEQ ID NO: 8508079 - DNA, 22 bp, Homo sapiens
aagaggttgtctgtgatgagtt

SEQ ID NO: 8508080 - DNA, 22 bp, Homo sapiens
aagaggttgtctgtgatgagtt

SEQ ID NO: 8508081 - DNA, 22 bp, Homo sapiens
aagaggttctccttggagtggg

SEQ ID NO: 8508082 - DNA, 22 bp, Homo sapiens
aagaggttgtctgtgatgagtt

SEQ ID NO: 8508083 - DNA, 22 bp, Homo sapiens
aagagtaaatgtctaattagga

SEQ ID NO: 8508084 - DNA, 22 bp, Homo sapiens
aagagtaaatgtctaattagga

SEQ ID NO: 8508085 - DNA, 22 bp, Homo sapiens
aagaggtttcatgattttctta

SEQ ID NO: 8508086 - DNA, 22 bp, Homo sapiens
aagaggtttaactgactcacag

SEQ ID NO: 8508087 - DNA, 22 bp, Homo sapiens
aagagtatagctttaggattga

SEQ ID NO: 8508088 - DNA, 22 bp, Homo sapiens
aagagtatagctttaggattga

SEQ ID NO: 8508089 - DNA, 22 bp, Homo sapiens
aagagtatgcatgcatgtttgt

SEQ ID NO: 8508090 - DNA, 19 bp, Homo sapiens
aagagtcacaggcagccct

SEQ ID NO: 8508091 - DNA, 22 bp, Homo sapiens
aagagtatttggtatagaacac

SEQ ID NO: 8508092 - DNA, 22 bp, Homo sapiens
aagagtcccaaaatgattctta

SEQ ID NO: 8508093 - DNA, 22 bp, Homo sapiens
aagagtctattggaactagaca

SEQ ID NO: 8508094 - DNA, 22 bp, Homo sapiens
aagagtcagcttctgtatgggt

SEQ ID NO: 8508095 - DNA, 22 bp, Homo sapiens
aagagtcagcttctgtatgggt

SEQ ID NO: 8508096 - DNA, 22 bp, Homo sapiens
aagagtcatagagacattgatt

SEQ ID NO: 8508097 - DNA, 22 bp, Homo sapiens
aagagtcatagagacattgatt

SEQ ID NO: 8508098 - DNA, 22 bp, Homo sapiens
aagagtgtgaggttgtgctttt

SEQ ID NO: 8508099 - DNA, 22 bp, Homo sapiens
aagagtggagctggaaagtggg

SEQ ID NO: 8508100 - DNA, 22 bp, Homo sapiens
aagagtggagaataaaatagga

SEQ ID NO: 8508101 - DNA, 22 bp, Homo sapiens
aagagtgacttttcagctgtga

SEQ ID NO: 8508102 - DNA, 22 bp, Homo sapiens
aagagtctattggaactagaca

SEQ ID NO: 8508103 - DNA, 20 bp, Homo sapiens
aagagtctttactgagctaa

SEQ ID NO: 8508104 - DNA, 20 bp, Homo sapiens
aagagtctttactgagctaa

SEQ ID NO: 8508105 - DNA, 22 bp, Homo sapiens
aagagtttaattttgtctagac

SEQ ID NO: 8508106 - DNA, 22 bp, Homo sapiens
aagagtttaccagtgctgcttc

SEQ ID NO: 8508107 - DNA, 22 bp, Homo sapiens
aagagttaagcaacagatacca

SEQ ID NO: 8508108 - DNA, 22 bp, Homo sapiens
aagagttagctcaataacttga

SEQ ID NO: 8508109 - DNA, 19 bp, Homo sapiens
aagaggcaaccctcgagcc

SEQ ID NO: 8508110 - DNA, 22 bp, Homo sapiens
aagaggagtagatgtggttggt

SEQ ID NO: 8508111 - DNA, 22 bp, Homo sapiens
aagaggagtagatgtggttggt

SEQ ID NO: 8508112 - DNA, 22 bp, Homo sapiens
aagaggagggcagattcaaggc

SEQ ID NO: 8508113 - DNA, 22 bp, Homo sapiens
aagaggagggcagattcaaggc

SEQ ID NO: 8508114 - DNA, 22 bp, Homo sapiens
aagaggcagaaatatcgctgaa

SEQ ID NO: 8508115 - DNA, 22 bp, Homo sapiens
aagacattttagagatagggaa

SEQ ID NO: 8508116 - DNA, 22 bp, Homo sapiens
aagacattttagagatagggaa

SEQ ID NO: 8508117 - DNA, 22 bp, Homo sapiens
aagacattttagagatagggaa

SEQ ID NO: 8508118 - DNA, 22 bp, Homo sapiens
aagacattttgaaattggaagc

SEQ ID NO: 8508119 - DNA, 22 bp, Homo sapiens
aagaccagaggatataaccaga

SEQ ID NO: 8508120 - DNA, 22 bp, Homo sapiens
aagacatttatgaaaagtgctg

SEQ ID NO: 8508121 - DNA, 22 bp, Homo sapiens
aagaggaggattgatgtgggag

SEQ ID NO: 8508122 - DNA, 23 bp, Homo sapiens
aagaggaggccctgctcccgtcc

SEQ ID NO: 8508123 - DNA, 21 bp, Homo sapiens
aagaggaagcattatggcata

SEQ ID NO: 8508124 - DNA, 21 bp, Homo sapiens
aagaggaagcattatggcata

SEQ ID NO: 8508125 - DNA, 22 bp, Homo sapiens
aagaggaggattgatgtgggag

SEQ ID NO: 8508126 - DNA, 22 bp, Homo sapiens
aagaggaagtctccatggagag

SEQ ID NO: 8508127 - DNA, 22 bp, Homo sapiens
aagaggaagtctccatggagag

SEQ ID NO: 8508128 - DNA, 22 bp, Homo sapiens
acacacatgcatgcttgccatt

SEQ ID NO: 8508129 - DNA, 22 bp, Homo sapiens
acacacatgcatgcttgccatt

SEQ ID NO: 8508130 - DNA, 22 bp, Homo sapiens
acacacaggtaaaggagcctgg

SEQ ID NO: 8508131 - DNA, 22 bp, Homo sapiens
acacacatgcatgcttgccatt

SEQ ID NO: 8508132 - DNA, 22 bp, Homo sapiens
acacacatgcatgcttgccatt

SEQ ID NO: 8508133 - DNA, 22 bp, Homo sapiens
acacacatgcatgcttgccatt

SEQ ID NO: 8508134 - DNA, 22 bp, Homo sapiens
acacacatgcatgcttgccatt

SEQ ID NO: 8508135 - DNA, 22 bp, Homo sapiens
acacacatgcatgcttgccatt

SEQ ID NO: 8508136 - DNA, 22 bp, Homo sapiens
aagaggctttcagtgaacttgt

SEQ ID NO: 8508137 - DNA, 22 bp, Homo sapiens
aagaggtagcagtcacaaaaga

SEQ ID NO: 8508138 - DNA, 20 bp, Homo sapiens
aagaggtgataacaggtgag

SEQ ID NO: 8508139 - DNA, 22 bp, Homo sapiens
aagaggtcataccagataaggg

SEQ ID NO: 8508140 - DNA, 22 bp, Homo sapiens
aagaggtgagaagctacactta

SEQ ID NO: 8508141 - DNA, 22 bp, Homo sapiens
aagaggtggaacagcaattcgt

SEQ ID NO: 8508142 - DNA, 22 bp, Homo sapiens
aagaggtggaacagcaattcgt

SEQ ID NO: 8508143 - DNA, 22 bp, Homo sapiens
aagaggtggaacagcaattcgt

SEQ ID NO: 8508144 - DNA, 22 bp, Homo sapiens
aagaggttctaatttaactatc

SEQ ID NO: 8508145 - DNA, 22 bp, Homo sapiens
aagaggttattgttcccagctt

SEQ ID NO: 8508146 - DNA, 22 bp, Homo sapiens
aagaggtgggttggacagatac

SEQ ID NO: 8508147 - DNA, 22 bp, Homo sapiens
acacacagcgcctaccatgtgc

SEQ ID NO: 8508148 - DNA, 22 bp, Homo sapiens
acacacagcgcctaccatgtgc

SEQ ID NO: 8508149 - DNA, 22 bp, Homo sapiens
acacacagcgcctaccatgtgc

SEQ ID NO: 8508150 - DNA, 22 bp, Homo sapiens
acacacagagtttatacaggca

SEQ ID NO: 8508151 - DNA, 22 bp, Homo sapiens
acacacaggtaaaggagcctgg

SEQ ID NO: 8508152 - DNA, 22 bp, Homo sapiens
acacacaggtaaaggagcctgg

SEQ ID NO: 8508153 - DNA, 22 bp, Homo sapiens
acacacaggtaaaggagcctgg

SEQ ID NO: 8508154 - DNA, 22 bp, Homo sapiens
acacacagcgcctaccatgtgc

SEQ ID NO: 8508155 - DNA, 20 bp, Homo sapiens
acacacagagacatgcgcat

SEQ ID NO: 8508156 - DNA, 20 bp, Homo sapiens
acacacagagacatgcgcat

SEQ ID NO: 8508157 - DNA, 22 bp, Homo sapiens
acacacagagtttatacaggca

SEQ ID NO: 8508158 - DNA, 22 bp, Homo sapiens
acacacagaaggaagccccact

SEQ ID NO: 8508159 - DNA, 22 bp, Homo sapiens
aacaagtaagtttatatatatt

SEQ ID NO: 8508160 - DNA, 22 bp, Homo sapiens
aacaagatgttttgatatatgt

SEQ ID NO: 8508161 - DNA, 22 bp, Homo sapiens
aacaagcagatgcaatgcactt

SEQ ID NO: 8508162 - DNA, 22 bp, Homo sapiens
aacaaatgtgttttgtaattaa

SEQ ID NO: 8508163 - DNA, 22 bp, Homo sapiens
aacaagtgtattaatggaaata

SEQ ID NO: 8508164 - DNA, 22 bp, Homo sapiens
aacaagtaagtttatatatatt

SEQ ID NO: 8508165 - DNA, 22 bp, Homo sapiens
aagggagacagttgtgtgagga

SEQ ID NO: 8508166 - DNA, 22 bp, Homo sapiens
aagggagacagttgtgtgagga

SEQ ID NO: 8508167 - DNA, 22 bp, Homo sapiens
aacaataactagacatgccatg

SEQ ID NO: 8508168 - DNA, 22 bp, Homo sapiens
aacaataattgcggttctctat

SEQ ID NO: 8508169 - DNA, 22 bp, Homo sapiens
aacaataattgcggttctctat

SEQ ID NO: 8508170 - DNA, 22 bp, Homo sapiens
aacaataactagacatgccatg

SEQ ID NO: 8508171 - DNA, 22 bp, Homo sapiens
aacaataactagacatgccatg

SEQ ID NO: 8508172 - DNA, 22 bp, Homo sapiens
aacaataactagacatgccatg

SEQ ID NO: 8508173 - DNA, 22 bp, Homo sapiens
aacaataactagacatgccatg

SEQ ID NO: 8508174 - DNA, 22 bp, Homo sapiens
aaggccacagagcctcagagag

SEQ ID NO: 8508175 - DNA, 22 bp, Homo sapiens
aaggccacacttgctggccagc

SEQ ID NO: 8508176 - DNA, 22 bp, Homo sapiens
aaggccacacttgctggccagc

SEQ ID NO: 8508177 - DNA, 22 bp, Homo sapiens
aaggccaaggctgcagtgagcc

SEQ ID NO: 8508178 - DNA, 22 bp, Homo sapiens
aaggccactgaagaaatcacaa

SEQ ID NO: 8508179 - DNA, 22 bp, Homo sapiens
aaggccacgtctccttccagag

SEQ ID NO: 8508180 - DNA, 22 bp, Homo sapiens
aaggccacagagcctcagagag

SEQ ID NO: 8508181 - DNA, 22 bp, Homo sapiens
aaggccaccaccagcgaggggg

SEQ ID NO: 8508182 - DNA, 22 bp, Homo sapiens
aaggccactttaccttaaatcc

SEQ ID NO: 8508183 - DNA, 22 bp, Homo sapiens
aaggccactgaagaaatcacaa

SEQ ID NO: 8508184 - DNA, 22 bp, Homo sapiens
aaggccactttaccttaaatcc

SEQ ID NO: 8508185 - DNA, 22 bp, Homo sapiens
aacaaatgtgtggcagtgtggg

SEQ ID NO: 8508186 - DNA, 22 bp, Homo sapiens
aacaaatgtgtggcagtgtggg

SEQ ID NO: 8508187 - DNA, 22 bp, Homo sapiens
aaggccaactaggatgagctag

SEQ ID NO: 8508188 - DNA, 22 bp, Homo sapiens
aaggccaactaggatgagctag

SEQ ID NO: 8508189 - DNA, 22 bp, Homo sapiens
aaggccaaagttttcaggctaa

SEQ ID NO: 8508190 - DNA, 22 bp, Homo sapiens
aaggccaaagacacctacacag

SEQ ID NO: 8508191 - DNA, 22 bp, Homo sapiens
aaatttctaagcagccacttcc

SEQ ID NO: 8508192 - DNA, 22 bp, Homo sapiens
aaatttctaagcagccacttcc

SEQ ID NO: 8508193 - DNA, 20 bp, Homo sapiens
aaatttaggaaattttacgc

SEQ ID NO: 8508194 - DNA, 22 bp, Homo sapiens
aaatttcaagcaaagtagctat

SEQ ID NO: 8508195 - DNA, 22 bp, Homo sapiens
aaatttcaagcaaagtagctat

SEQ ID NO: 8508196 - DNA, 22 bp, Homo sapiens
aaatttcagttggaatgagctc

SEQ ID NO: 8508197 - DNA, 22 bp, Homo sapiens
aaatttcagttggaatgagctc

SEQ ID NO: 8508198 - DNA, 22 bp, Homo sapiens
aaatttcagttggaatgagctc

SEQ ID NO: 8508199 - DNA, 22 bp, Homo sapiens
aaggggatttaaggtaagaaga

SEQ ID NO: 8508200 - DNA, 22 bp, Homo sapiens
aaggggatagagcagacactcc

SEQ ID NO: 8508201 - DNA, 22 bp, Homo sapiens
aaggggatttaaggtaagaaga

SEQ ID NO: 8508202 - DNA, 21 bp, Homo sapiens
aaggggcaaacccaggacacc

SEQ ID NO: 8508203 - DNA, 22 bp, Homo sapiens
aaggggcctcacagatgggctt

SEQ ID NO: 8508204 - DNA, 22 bp, Homo sapiens
aaggggctcttgtcaggcgcag

SEQ ID NO: 8508205 - DNA, 22 bp, Homo sapiens
aaggggcctcacagatgggctt

SEQ ID NO: 8508206 - DNA, 22 bp, Homo sapiens
aaggggcatgcttttgccagga

SEQ ID NO: 8508207 - DNA, 22 bp, Homo sapiens
aaggggaagtagcaccagaggt

SEQ ID NO: 8508208 - DNA, 22 bp, Homo sapiens
aaggggaagtagcaccagaggt

SEQ ID NO: 8508209 - DNA, 22 bp, Homo sapiens
aaggggaagtagcaccagaggt

SEQ ID NO: 8508210 - DNA, 22 bp, Homo sapiens
aaggggaatagagtgggttgtg

SEQ ID NO: 8508211 - DNA, 22 bp, Homo sapiens
aaggggaatagagtgggttgtg

SEQ ID NO: 8508212 - DNA, 22 bp, Homo sapiens
aaggggagatgtcatgggccct

SEQ ID NO: 8508213 - DNA, 22 bp, Homo sapiens
aagggagcggggagaccctatg

SEQ ID NO: 8508214 - DNA, 22 bp, Homo sapiens
aagggagaggagggtcttgttg

SEQ ID NO: 8508215 - DNA, 22 bp, Homo sapiens
aagggagaggagggtcttgttg

SEQ ID NO: 8508216 - DNA, 22 bp, Homo sapiens
aagggagccaagaaagcagggc

SEQ ID NO: 8508217 - DNA, 22 bp, Homo sapiens
aaggggctcttgtcaggcgcag

SEQ ID NO: 8508218 - DNA, 22 bp, Homo sapiens
aagggggcacagtcactgtaat

SEQ ID NO: 8508219 - DNA, 22 bp, Homo sapiens
aacaataattgcggttctctat

SEQ ID NO: 8508220 - DNA, 22 bp, Homo sapiens
aacaataggctatatgctaggc

SEQ ID NO: 8508221 - DNA, 22 bp, Homo sapiens
aacaatcaagtttctaaatgac

SEQ ID NO: 8508222 - DNA, 22 bp, Homo sapiens
aacaatcaagtttctaaatgac

SEQ ID NO: 8508223 - DNA, 22 bp, Homo sapiens
aacaatcaagtttctaaatgac

SEQ ID NO: 8508224 - DNA, 20 bp, Homo sapiens
aacaatctagaagctattct

SEQ ID NO: 8508225 - DNA, 22 bp, Homo sapiens
aacaatctgttcgatagaaaat

SEQ ID NO: 8508226 - DNA, 22 bp, Homo sapiens
aacaatgaccacacaatgtact

SEQ ID NO: 8508227 - DNA, 16 bp, Homo sapiens
aacaatgccaatccag

SEQ ID NO: 8508228 - DNA, 22 bp, Homo sapiens
aacaatgccacattaagtgtat

SEQ ID NO: 8508229 - DNA, 22 bp, Homo sapiens
aacaatgcctgatgacctcctg

SEQ ID NO: 8508230 - DNA, 22 bp, Homo sapiens
aacaatgctgaactgaggaaag

SEQ ID NO: 8508231 - DNA, 22 bp, Homo sapiens
aacaatgcactatcgtaagtgg

SEQ ID NO: 8508232 - DNA, 22 bp, Homo sapiens
aacaatgccaacagcatgctgg

SEQ ID NO: 8508233 - DNA, 22 bp, Homo sapiens
aacaatgcagttaatgggaaga

SEQ ID NO: 8508234 - DNA, 22 bp, Homo sapiens
aacaatgaggatctgttctgag

SEQ ID NO: 8508235 - DNA, 22 bp, Homo sapiens
aacaatgatatagggattggca

SEQ ID NO: 8508236 - DNA, 22 bp, Homo sapiens
aagtacagaaatagcaggtgca

SEQ ID NO: 8508237 - DNA, 22 bp, Homo sapiens
aagtacagaaggagcgaacaat

SEQ ID NO: 8508238 - DNA, 22 bp, Homo sapiens
aagtatgacatttaagacaatt

SEQ ID NO: 8508239 - DNA, 22 bp, Homo sapiens
aagtatgacatttaagacaatt

SEQ ID NO: 8508240 - DNA, 22 bp, Homo sapiens
aagtatgtgatacatgttaatt

SEQ ID NO: 8508241 - DNA, 22 bp, Homo sapiens
aagtatgtcaatcatacttcaa

SEQ ID NO: 8508242 - DNA, 18 bp, Homo sapiens
aagtatgcctatgttatt

SEQ ID NO: 8508243 - DNA, 22 bp, Homo sapiens
aagtatgctaattaactagcac

SEQ ID NO: 8508244 - DNA, 22 bp, Homo sapiens
aagtacacatcgttggccccga

SEQ ID NO: 8508245 - DNA, 22 bp, Homo sapiens
aagccatgcaagccacaaggtg

SEQ ID NO: 8508246 - DNA, 22 bp, Homo sapiens
aagccatggcatgccaggatca

SEQ ID NO: 8508247 - DNA, 22 bp, Homo sapiens
aagccatggtagaaaactcagt

SEQ ID NO: 8508248 - DNA, 22 bp, Homo sapiens
aagccattcatctaatgtcctg

SEQ ID NO: 8508249 - DNA, 22 bp, Homo sapiens
aagccagtgtttttgagagttg

SEQ ID NO: 8508250 - DNA, 22 bp, Homo sapiens
aagccagtgtggtctgcccatt

SEQ ID NO: 8508251 - DNA, 22 bp, Homo sapiens
aagccagtgtgacaggaaactt

SEQ ID NO: 8508252 - DNA, 16 bp, Homo sapiens
aagccagttcagcatt

SEQ ID NO: 8508253 - DNA, 22 bp, Homo sapiens
aagccagttagcacatcattgc

SEQ ID NO: 8508254 - DNA, 22 bp, Homo sapiens
aagccagtcctctactgggcac

SEQ ID NO: 8508255 - DNA, 22 bp, Homo sapiens
aagccagtgggcatagcagttg

SEQ ID NO: 8508256 - DNA, 22 bp, Homo sapiens
aagccagtggcttctccctgct

SEQ ID NO: 8508257 - DNA, 22 bp, Homo sapiens
aagccagtggcttctccctgct

SEQ ID NO: 8508258 - DNA, 22 bp, Homo sapiens
aagccagtggtgagaagatagc

SEQ ID NO: 8508259 - DNA, 22 bp, Homo sapiens
aagccagtgtccagaatgggca

SEQ ID NO: 8508260 - DNA, 22 bp, Homo sapiens
aagccagtaagtttttgtcatt

SEQ ID NO: 8508261 - DNA, 22 bp, Homo sapiens
aagccagtattcaatggggcta

SEQ ID NO: 8508262 - DNA, 22 bp, Homo sapiens
aagccagccagtgccagtctta

SEQ ID NO: 8508263 - DNA, 22 bp, Homo sapiens
aagccagcattttcccattcct

SEQ ID NO: 8508264 - DNA, 22 bp, Homo sapiens
aagccagccagtgccagtctta

SEQ ID NO: 8508265 - DNA, 18 bp, Homo sapiens
aagctgggaaggagacag

SEQ ID NO: 8508266 - DNA, 18 bp, Homo sapiens
aagctgggaaggagacag

SEQ ID NO: 8508267 - DNA, 22 bp, Homo sapiens
aagctggctctgatgtcagaat

SEQ ID NO: 8508268 - DNA, 22 bp, Homo sapiens
aagctggcatgtcacctgagaa

SEQ ID NO: 8508269 - DNA, 22 bp, Homo sapiens
aagctggcatgtcacctgagaa

SEQ ID NO: 8508270 - DNA, 22 bp, Homo sapiens
aagcccagatgagatccctgga

SEQ ID NO: 8508271 - DNA, 22 bp, Homo sapiens
aagcccagaatcaagtctactg

SEQ ID NO: 8508272 - DNA, 22 bp, Homo sapiens
aagccatttgttgtccttcagg

SEQ ID NO: 8508273 - DNA, 22 bp, Homo sapiens
aagccatggctgcatcagcctg

SEQ ID NO: 8508274 - DNA, 22 bp, Homo sapiens
aagctggcaattatcaaaactg

SEQ ID NO: 8508275 - DNA, 22 bp, Homo sapiens
aagctggcaaacaagcatcatt

SEQ ID NO: 8508276 - DNA, 22 bp, Homo sapiens
aagctgattctaaaatttatta

SEQ ID NO: 8508277 - DNA, 22 bp, Homo sapiens
aagctgatgtcccagtttgaag

SEQ ID NO: 8508278 - DNA, 22 bp, Homo sapiens
aagcttttctctgtattacctg

SEQ ID NO: 8508279 - DNA, 22 bp, Homo sapiens
aagcttttctctgtattacctg

SEQ ID NO: 8508280 - DNA, 22 bp, Homo sapiens
aagctttttggatttgcttcag

SEQ ID NO: 8508281 - DNA, 22 bp, Homo sapiens
aagctttttggatttgcttcag

SEQ ID NO: 8508282 - DNA, 22 bp, Homo sapiens
aagcttttctcagtgtccttgg

SEQ ID NO: 8508283 - DNA, 19 bp, Homo sapiens
aagctttcccattaacccc

SEQ ID NO: 8508284 - DNA, 22 bp, Homo sapiens
aagctttatgatctctcagcta

SEQ ID NO: 8508285 - DNA, 22 bp, Homo sapiens
aagctggggactcagaccccat

SEQ ID NO: 8508286 - DNA, 22 bp, Homo sapiens
aagctgggacttagcgcagata

SEQ ID NO: 8508287 - DNA, 22 bp, Homo sapiens
aagctgggagggagcccagagt

SEQ ID NO: 8508288 - DNA, 22 bp, Homo sapiens
aagctgggacttagcgcagata

SEQ ID NO: 8508289 - DNA, 22 bp, Homo sapiens
aagctgtcaatgtatctagtct

SEQ ID NO: 8508290 - DNA, 22 bp, Homo sapiens
aagctgtcaggaggttaccttt

SEQ ID NO: 8508291 - DNA, 22 bp, Homo sapiens
aagctgtcagtgtcaggctaaa

SEQ ID NO: 8508292 - DNA, 22 bp, Homo sapiens
aagctgtcaggaggttaccttt

SEQ ID NO: 8508293 - DNA, 20 bp, Homo sapiens
aagctgtcagaggtggacag

SEQ ID NO: 8508294 - DNA, 22 bp, Homo sapiens
aagctgtgaaatagattacaca

SEQ ID NO: 8508295 - DNA, 19 bp, Homo sapiens
aagctgtcctgttggccct

SEQ ID NO: 8508296 - DNA, 22 bp, Homo sapiens
aaatttaaggaggtgctcactt

SEQ ID NO: 8508297 - DNA, 22 bp, Homo sapiens
aaatttaaggaggtgctcactt

SEQ ID NO: 8508298 - DNA, 22 bp, Homo sapiens
aaatttaagaagtgtgtgcgtg

SEQ ID NO: 8508299 - DNA, 22 bp, Homo sapiens
aaatttaaaaagcagcattgca

SEQ ID NO: 8508300 - DNA, 22 bp, Homo sapiens
aaatttaagaagtgtgtgcgtg

SEQ ID NO: 8508301 - DNA, 22 bp, Homo sapiens
aaattgttgatctacagtaagg

SEQ ID NO: 8508302 - DNA, 22 bp, Homo sapiens
aaatttaaaaagcagcattgca

SEQ ID NO: 8508303 - DNA, 22 bp, Homo sapiens
aaattgttgatctacagtaagg

SEQ ID NO: 8508304 - DNA, 20 bp, Homo sapiens
aaattgtgtttgtgagctcc

SEQ ID NO: 8508305 - DNA, 22 bp, Homo sapiens
aaattgttgatctacagtaagg

SEQ ID NO: 8508306 - DNA, 22 bp, Homo sapiens
aaattgcattttaaaggtagat

SEQ ID NO: 8508307 - DNA, 22 bp, Homo sapiens
aaggactccaattctttcatct

SEQ ID NO: 8508308 - DNA, 21 bp, Homo sapiens
aaggacgaggttttgattaca

SEQ ID NO: 8508309 - DNA, 22 bp, Homo sapiens
aaggacctatattgtcagagga

SEQ ID NO: 8508310 - DNA, 22 bp, Homo sapiens
aaggacctgattttgagcatct

SEQ ID NO: 8508311 - DNA, 22 bp, Homo sapiens
aaggagaaatggtagatgtgca

SEQ ID NO: 8508312 - DNA, 22 bp, Homo sapiens
aaggagaaatggtagatgtgca

SEQ ID NO: 8508313 - DNA, 22 bp, Homo sapiens
aaattgcattgagctgcttatt

SEQ ID NO: 8508314 - DNA, 22 bp, Homo sapiens
aaattattataggcagagctga

SEQ ID NO: 8508315 - DNA, 22 bp, Homo sapiens
aaattattacaagctagttggc

SEQ ID NO: 8508316 - DNA, 22 bp, Homo sapiens
aaattattacaagctagttggc

SEQ ID NO: 8508317 - DNA, 22 bp, Homo sapiens
aaattatcatgggggagaaaca

SEQ ID NO: 8508318 - DNA, 22 bp, Homo sapiens
aaggacaggttggggcttcagg

SEQ ID NO: 8508319 - DNA, 22 bp, Homo sapiens
aaattagtacattgcaaagtcc

SEQ ID NO: 8508320 - DNA, 22 bp, Homo sapiens
aaattaagagtaactctgtaga

SEQ ID NO: 8508321 - DNA, 22 bp, Homo sapiens
aaattatcatgattattgtgta

SEQ ID NO: 8508322 - DNA, 22 bp, Homo sapiens
aaattagtgcaccaggttgaag

SEQ ID NO: 8508323 - DNA, 22 bp, Homo sapiens
aaattagtcatgttgtattact

SEQ ID NO: 8508324 - DNA, 22 bp, Homo sapiens
aacatttattgagcacctactg

SEQ ID NO: 8508325 - DNA, 22 bp, Homo sapiens
aacatttattgagcacctactg

SEQ ID NO: 8508326 - DNA, 22 bp, Homo sapiens
aacatttattgagcacctactg

SEQ ID NO: 8508327 - DNA, 22 bp, Homo sapiens
aacatttcagcacctgattcct

SEQ ID NO: 8508328 - DNA, 22 bp, Homo sapiens
aacatttcagcacctgattcct

SEQ ID NO: 8508329 - DNA, 22 bp, Homo sapiens
aatcacatgtgctcaattttaa

SEQ ID NO: 8508330 - DNA, 22 bp, Homo sapiens
aatcacattaagccctgttcag

SEQ ID NO: 8508331 - DNA, 22 bp, Homo sapiens
aatcacatgtgggtcttgtagc

SEQ ID NO: 8508332 - DNA, 22 bp, Homo sapiens
aatatttgttagtgttttaatg

SEQ ID NO: 8508333 - DNA, 22 bp, Homo sapiens
aatcacatgcagggcctccacc

SEQ ID NO: 8508334 - DNA, 22 bp, Homo sapiens
aatcacatgcagggcctccacc

SEQ ID NO: 8508335 - DNA, 22 bp, Homo sapiens
aatatttcttctaaagcccttt

SEQ ID NO: 8508336 - DNA, 22 bp, Homo sapiens
aatatttgaacagtcactgagt

SEQ ID NO: 8508337 - DNA, 22 bp, Homo sapiens
aacatttattctaattctggga

SEQ ID NO: 8508338 - DNA, 22 bp, Homo sapiens
aacatttattctaattctggga

SEQ ID NO: 8508339 - DNA, 22 bp, Homo sapiens
aacatttatggtagtcattgca

SEQ ID NO: 8508340 - DNA, 22 bp, Homo sapiens
aacatttatgattgaggtaaat

SEQ ID NO: 8508341 - DNA, 22 bp, Homo sapiens
aacatttatggtagtcattgca

SEQ ID NO: 8508342 - DNA, 22 bp, Homo sapiens
aacatttatatgggttcatgaa

SEQ ID NO: 8508343 - DNA, 22 bp, Homo sapiens
aacatttatatgggttcatgaa

SEQ ID NO: 8508344 - DNA, 22 bp, Homo sapiens
aacatttatgattgaggtaaat

SEQ ID NO: 8508345 - DNA, 22 bp, Homo sapiens
aacatttatgattgaggtaaat

SEQ ID NO: 8508346 - DNA, 22 bp, Homo sapiens
aacatttaggaaggacctcctc

SEQ ID NO: 8508347 - DNA, 22 bp, Homo sapiens
aacattgattgcatctgttcac

SEQ ID NO: 8508348 - DNA, 22 bp, Homo sapiens
aacatttacaaatccttctgca

SEQ ID NO: 8508349 - DNA, 22 bp, Homo sapiens
aacatttacaaatccttctgca

SEQ ID NO: 8508350 - DNA, 20 bp, Homo sapiens
aacattgtttgtaaaagcag

SEQ ID NO: 8508351 - DNA, 20 bp, Homo sapiens
aacattgaaagtctagaaga

SEQ ID NO: 8508352 - DNA, 20 bp, Homo sapiens
aacattgaaagtctagaaga

SEQ ID NO: 8508353 - DNA, 22 bp, Homo sapiens
aacattgaaatatttgcaatag

SEQ ID NO: 8508354 - DNA, 22 bp, Homo sapiens
aacattgaacttggcacaccca

SEQ ID NO: 8508355 - DNA, 22 bp, Homo sapiens
aacattgaaatatttgcaatag

SEQ ID NO: 8508356 - DNA, 20 bp, Homo sapiens
aacattgaaagtctagaaga

SEQ ID NO: 8508357 - DNA, 22 bp, Homo sapiens
aacattctttggaggattattc

SEQ ID NO: 8508358 - DNA, 20 bp, Homo sapiens
aacattgaaagtctagaaga

SEQ ID NO: 8508359 - DNA, 20 bp, Homo sapiens
aacattgaaagtctagaaga

SEQ ID NO: 8508360 - DNA, 22 bp, Homo sapiens
aacattgagttctacttccatt

SEQ ID NO: 8508361 - DNA, 22 bp, Homo sapiens
aacagtttgggtaggtatgtag

SEQ ID NO: 8508362 - DNA, 22 bp, Homo sapiens
aacagtttgtggatagcttgta

SEQ ID NO: 8508363 - DNA, 22 bp, Homo sapiens
aacatgtttccagtgtaaggcc

SEQ ID NO: 8508364 - DNA, 22 bp, Homo sapiens
aacataaatttgaagtggcaaa

SEQ ID NO: 8508365 - DNA, 22 bp, Homo sapiens
aacattctgtcaattgatgacc

SEQ ID NO: 8508366 - DNA, 22 bp, Homo sapiens
aacattaagatggcggaacagt

SEQ ID NO: 8508367 - DNA, 22 bp, Homo sapiens
aacattaagatggcggaacagt

SEQ ID NO: 8508368 - DNA, 22 bp, Homo sapiens
aacattctttagctcttcctgc

SEQ ID NO: 8508369 - DNA, 22 bp, Homo sapiens
aacattcttcaaatatcactct

SEQ ID NO: 8508370 - DNA, 22 bp, Homo sapiens
aaccagctaacatgtggaatga

SEQ ID NO: 8508371 - DNA, 22 bp, Homo sapiens
aaccagctccagcctccattca

SEQ ID NO: 8508372 - DNA, 22 bp, Homo sapiens
aaccagcactgctggggcctgc

SEQ ID NO: 8508373 - DNA, 22 bp, Homo sapiens
aaccagctaaactttgctcgaa

SEQ ID NO: 8508374 - DNA, 22 bp, Homo sapiens
aatcagaaaattcagtggaatt

SEQ ID NO: 8508375 - DNA, 22 bp, Homo sapiens
aatcagaaaattcagtggaatt

SEQ ID NO: 8508376 - DNA, 22 bp, Homo sapiens
aatcagaaaattcagtggaatt

SEQ ID NO: 8508377 - DNA, 22 bp, Homo sapiens
aatcactttgcactcttatttg

SEQ ID NO: 8508378 - DNA, 22 bp, Homo sapiens
aaccagctgagaatgcttctgc

SEQ ID NO: 8508379 - DNA, 22 bp, Homo sapiens
aaccagctccagcctccattca

SEQ ID NO: 8508380 - DNA, 22 bp, Homo sapiens
aaccagctcctcaccccattgt

SEQ ID NO: 8508381 - DNA, 22 bp, Homo sapiens
aaccagctctgcaaaatgtcat

SEQ ID NO: 8508382 - DNA, 22 bp, Homo sapiens
aaccagctttgatacgcattat

SEQ ID NO: 8508383 - DNA, 22 bp, Homo sapiens
aaccagctgagaatgcttctgc

SEQ ID NO: 8508384 - DNA, 17 bp, Homo sapiens
aaccagctgtcccctcc

SEQ ID NO: 8508385 - DNA, 22 bp, Homo sapiens
aaccagctttgatacgcattat

SEQ ID NO: 8508386 - DNA, 19 bp, Homo sapiens
aaccaggaactaaagcaga

SEQ ID NO: 8508387 - DNA, 22 bp, Homo sapiens
aatcacttagaacccaggaagt

SEQ ID NO: 8508388 - DNA, 22 bp, Homo sapiens
aatcacatttacattgctaatt

SEQ ID NO: 8508389 - DNA, 22 bp, Homo sapiens
aatcacatttgcccccatattc

SEQ ID NO: 8508390 - DNA, 22 bp, Homo sapiens
aatcacttgtaaggaattcaat

SEQ ID NO: 8508391 - DNA, 22 bp, Homo sapiens
aatcacattagtgaaacactga

SEQ ID NO: 8508392 - DNA, 22 bp, Homo sapiens
aatcacattagtgaaacactga

SEQ ID NO: 8508393 - DNA, 22 bp, Homo sapiens
aatcacattacagcatatctgt

SEQ ID NO: 8508394 - DNA, 22 bp, Homo sapiens
aatcacattacagcatatctgt

SEQ ID NO: 8508395 - DNA, 22 bp, Homo sapiens
aatcacatttacattgctaatt

SEQ ID NO: 8508396 - DNA, 22 bp, Homo sapiens
aatcacattgaatctgctacct

SEQ ID NO: 8508397 - DNA, 22 bp, Homo sapiens
aatcacattagtgaaacactga

SEQ ID NO: 8508398 - DNA, 22 bp, Homo sapiens
aatcacattgaatctgctacct

SEQ ID NO: 8508399 - DNA, 20 bp, Homo sapiens
aactcctagcctcaagtgat

SEQ ID NO: 8508400 - DNA, 20 bp, Homo sapiens
aactcctagcctcaagtgat

SEQ ID NO: 8508401 - DNA, 22 bp, Homo sapiens
aactccagggggtcaatattta

SEQ ID NO: 8508402 - DNA, 22 bp, Homo sapiens
aactccagggggtcaatattta

SEQ ID NO: 8508403 - DNA, 22 bp, Homo sapiens
aactccatggttctcagattct

SEQ ID NO: 8508404 - DNA, 22 bp, Homo sapiens
aactccaggtcctttgaatctg

SEQ ID NO: 8508405 - DNA, 22 bp, Homo sapiens
aactccagggtcaccattcaca

SEQ ID NO: 8508406 - DNA, 22 bp, Homo sapiens
aactccaggcagggaggccact

SEQ ID NO: 8508407 - DNA, 22 bp, Homo sapiens
aactccaggcagggaggccact

SEQ ID NO: 8508408 - DNA, 22 bp, Homo sapiens
aactccagctcacacagtgacc

SEQ ID NO: 8508409 - DNA, 22 bp, Homo sapiens
aactccagctcacacagtgacc

SEQ ID NO: 8508410 - DNA, 22 bp, Homo sapiens
aactcattctaagtataccaaa

SEQ ID NO: 8508411 - DNA, 22 bp, Homo sapiens
aactcagttctttccacaatgc

SEQ ID NO: 8508412 - DNA, 22 bp, Homo sapiens
aactccagactactaatttagt

SEQ ID NO: 8508413 - DNA, 22 bp, Homo sapiens
aaccagtactttacacagctct

SEQ ID NO: 8508414 - DNA, 22 bp, Homo sapiens
aaccaggatttaagattctaga

SEQ ID NO: 8508415 - DNA, 22 bp, Homo sapiens
aaccagtgaaacaccaggcaag

SEQ ID NO: 8508416 - DNA, 22 bp, Homo sapiens
aaccatgaatgggttctggtgt

SEQ ID NO: 8508417 - DNA, 22 bp, Homo sapiens
aactataatggggttaggaaat

SEQ ID NO: 8508418 - DNA, 22 bp, Homo sapiens
aaccattagtcaatcagcaaga

SEQ ID NO: 8508419 - DNA, 22 bp, Homo sapiens
aactataatggggttaggaaat

SEQ ID NO: 8508420 - DNA, 22 bp, Homo sapiens
aaccatggatttcagttcacct

SEQ ID NO: 8508421 - DNA, 22 bp, Homo sapiens
aaccatgtactttattctgttt

SEQ ID NO: 8508422 - DNA, 22 bp, Homo sapiens
aaccatgtcttgttttcctagt

SEQ ID NO: 8508423 - DNA, 22 bp, Homo sapiens
aactatacatatttacatagac

SEQ ID NO: 8508424 - DNA, 22 bp, Homo sapiens
aactcagttacatattagaata

SEQ ID NO: 8508425 - DNA, 22 bp, Homo sapiens
aactcagttacatattagaata

SEQ ID NO: 8508426 - DNA, 22 bp, Homo sapiens
aactcagttacatattagaata

SEQ ID NO: 8508427 - DNA, 22 bp, Homo sapiens
aactcagtgtgtttcttagtat

SEQ ID NO: 8508428 - DNA, 22 bp, Homo sapiens
aactcagttacatattagaata

SEQ ID NO: 8508429 - DNA, 22 bp, Homo sapiens
aacactgtactggaagatggac

SEQ ID NO: 8508430 - DNA, 22 bp, Homo sapiens
aacactgtaacagcatcatttt

SEQ ID NO: 8508431 - DNA, 22 bp, Homo sapiens
aacactgtaacagcatcatttt

SEQ ID NO: 8508432 - DNA, 22 bp, Homo sapiens
aacactgtaacagcatcatttt

SEQ ID NO: 8508433 - DNA, 22 bp, Homo sapiens
aacactgtaacagcatcatttt

SEQ ID NO: 8508434 - DNA, 22 bp, Homo sapiens
aacactggttctgactacacag

SEQ ID NO: 8508435 - DNA, 22 bp, Homo sapiens
aacactggttctgactacacag

SEQ ID NO: 8508436 - DNA, 22 bp, Homo sapiens
aagttctgccaggctgtggcag

SEQ ID NO: 8508437 - DNA, 19 bp, Homo sapiens
aagttctcagagttcaaag

SEQ ID NO: 8508438 - DNA, 20 bp, Homo sapiens
aagttacattgtattgtacc

SEQ ID NO: 8508439 - DNA, 22 bp, Homo sapiens
aacactgtactggaagatggac

SEQ ID NO: 8508440 - DNA, 22 bp, Homo sapiens
aagttacattttggtctaattg

SEQ ID NO: 8508441 - DNA, 22 bp, Homo sapiens
aagttgaatcagtaacacagtt

SEQ ID NO: 8508442 - DNA, 22 bp, Homo sapiens
aagttgaatcagtaacacagtt

SEQ ID NO: 8508443 - DNA, 22 bp, Homo sapiens
aagttgaagcatgaaccaaggt

SEQ ID NO: 8508444 - DNA, 22 bp, Homo sapiens
aagttgaagcatgaaccaaggt

SEQ ID NO: 8508445 - DNA, 22 bp, Homo sapiens
aagttgagatgtcataggagac

SEQ ID NO: 8508446 - DNA, 22 bp, Homo sapiens
aagttgaatgcgtacgtgacat

SEQ ID NO: 8508447 - DNA, 19 bp, Homo sapiens
aagttgatcattttgacag

SEQ ID NO: 8508448 - DNA, 22 bp, Homo sapiens
aagttgattaatctttcgagaa

SEQ ID NO: 8508449 - DNA, 22 bp, Homo sapiens
aagttgatttaaactactagtc

SEQ ID NO: 8508450 - DNA, 22 bp, Homo sapiens
aagttgatttaaactactagtc

SEQ ID NO: 8508451 - DNA, 22 bp, Homo sapiens
aagtattcataaggacatatgt

SEQ ID NO: 8508452 - DNA, 22 bp, Homo sapiens
aagtatttcagcggttctttgt

SEQ ID NO: 8508453 - DNA, 22 bp, Homo sapiens
aagtattgtgggaaagcagaaa

SEQ ID NO: 8508454 - DNA, 22 bp, Homo sapiens
aagtcaaaccttgctcacagga

SEQ ID NO: 8508455 - DNA, 22 bp, Homo sapiens
aagtcaaaccttgctcacagga

SEQ ID NO: 8508456 - DNA, 22 bp, Homo sapiens
aagtcaaagctttcagaggaaa

SEQ ID NO: 8508457 - DNA, 20 bp, Homo sapiens
aacactgagggctactcttc

SEQ ID NO: 8508458 - DNA, 20 bp, Homo sapiens
aacactgagggctactcttc

SEQ ID NO: 8508459 - DNA, 20 bp, Homo sapiens
aacactgagggctactcttc

SEQ ID NO: 8508460 - DNA, 20 bp, Homo sapiens
aacactgaggcctactcttc

SEQ ID NO: 8508461 - DNA, 20 bp, Homo sapiens
aacactgaggcctactcttc

SEQ ID NO: 8508462 - DNA, 20 bp, Homo sapiens
aacactgaggcctactcttc

SEQ ID NO: 8508463 - DNA, 22 bp, Homo sapiens
aacactgagtatcagagttggg

SEQ ID NO: 8508464 - DNA, 22 bp, Homo sapiens
aacactgatggaaagtatgttt

SEQ ID NO: 8508465 - DNA, 22 bp, Homo sapiens
aacactggacaggaggctaggt

SEQ ID NO: 8508466 - DNA, 22 bp, Homo sapiens
aacactggaagggacatcaagt

SEQ ID NO: 8508467 - DNA, 22 bp, Homo sapiens
aagtttctgatattgttaaagc

SEQ ID NO: 8508468 - DNA, 20 bp, Homo sapiens
aagttgcagagagttgtctt

SEQ ID NO: 8508469 - DNA, 22 bp, Homo sapiens
aagtttctgtatgctcttctgt

SEQ ID NO: 8508470 - DNA, 22 bp, Homo sapiens
aagtttctgttcatatctctga

SEQ ID NO: 8508471 - DNA, 22 bp, Homo sapiens
aagtttctttattagcttgtcc

SEQ ID NO: 8508472 - DNA, 22 bp, Homo sapiens
aagtttgacagaagtttctaat

SEQ ID NO: 8508473 - DNA, 22 bp, Homo sapiens
aataaaatggtcagttttctca

SEQ ID NO: 8508474 - DNA, 22 bp, Homo sapiens
aataaaatggtcagttttctca

SEQ ID NO: 8508475 - DNA, 22 bp, Homo sapiens
aataaaatggtcagttttctca

SEQ ID NO: 8508476 - DNA, 22 bp, Homo sapiens
aataaaatggtcagttttctca

SEQ ID NO: 8508477 - DNA, 22 bp, Homo sapiens
aagtttgacagaagtttctaat

SEQ ID NO: 8508478 - DNA, 22 bp, Homo sapiens
aagtttgagaagcttatagata

SEQ ID NO: 8508479 - DNA, 22 bp, Homo sapiens
aagtttgagagcctttagtata

SEQ ID NO: 8508480 - DNA, 22 bp, Homo sapiens
aagtttggaggtcactggtctt

SEQ ID NO: 8508481 - DNA, 20 bp, Homo sapiens
aagtttggagtcaggagacc

SEQ ID NO: 8508482 - DNA, 22 bp, Homo sapiens
aagtttggaatgatagagacct

SEQ ID NO: 8508483 - DNA, 22 bp, Homo sapiens
aacagtttgagctttgaatttc

SEQ ID NO: 8508484 - DNA, 22 bp, Homo sapiens
aacagtttgagctttgaatttc

SEQ ID NO: 8508485 - DNA, 22 bp, Homo sapiens
aacagtttgagctttgaatttc

SEQ ID NO: 8508486 - DNA, 22 bp, Homo sapiens
aacagtttgctttaagaggcac

SEQ ID NO: 8508487 - DNA, 22 bp, Homo sapiens
aacagtttgcctgaaatgtatt

SEQ ID NO: 8508488 - DNA, 18 bp, Homo sapiens
aacagtttccagattctc

SEQ ID NO: 8508489 - DNA, 22 bp, Homo sapiens
aacagtttcagttactgatgag

SEQ ID NO: 8508490 - DNA, 22 bp, Homo sapiens
aacagtttatgataaattctta

SEQ ID NO: 8508491 - DNA, 22 bp, Homo sapiens
aacagtttatgataaattctta

SEQ ID NO: 8508492 - DNA, 22 bp, Homo sapiens
aacagtttatgtaaatgtccag

SEQ ID NO: 8508493 - DNA, 22 bp, Homo sapiens
aataaactgctcaattgcatca

SEQ ID NO: 8508494 - DNA, 22 bp, Homo sapiens
aataaactgctcaattgcatca

SEQ ID NO: 8508495 - DNA, 20 bp, Homo sapiens
aataaactactgagagatgt

SEQ ID NO: 8508496 - DNA, 20 bp, Homo sapiens
aataaactactgagagatgt

SEQ ID NO: 8508497 - DNA, 22 bp, Homo sapiens
aataaacaaatctttcctgtgg

SEQ ID NO: 8508498 - DNA, 22 bp, Homo sapiens
aataaacaaatctttcctgtgg

SEQ ID NO: 8508499 - DNA, 22 bp, Homo sapiens
aataaacaaatctttcctgtgg

SEQ ID NO: 8508500 - DNA, 22 bp, Homo sapiens
aataaacaaatctttcctgtgg

SEQ ID NO: 8508501 - DNA, 22 bp, Homo sapiens
aataaacaaatccttccttccc

SEQ ID NO: 8508502 - DNA, 22 bp, Homo sapiens
aataaacaaatccttccttccc

SEQ ID NO: 8508503 - DNA, 22 bp, Homo sapiens
aataaacaaatccttccttccc

SEQ ID NO: 8508504 - DNA, 22 bp, Homo sapiens
aataaacaaaggacaaggaggt

SEQ ID NO: 8508505 - DNA, 22 bp, Homo sapiens
aaatatgtaagattagcactag

SEQ ID NO: 8508506 - DNA, 22 bp, Homo sapiens
aaatatgtaagattagcactag

SEQ ID NO: 8508507 - DNA, 22 bp, Homo sapiens
aaatatgtaaccaaggtgaagt

SEQ ID NO: 8508508 - DNA, 22 bp, Homo sapiens
aaatatgtaaccaaggtgaagt

SEQ ID NO: 8508509 - DNA, 22 bp, Homo sapiens
aaatatgagggtgatgcccaga

SEQ ID NO: 8508510 - DNA, 22 bp, Homo sapiens
aaatatgagggtgatgcccaga

SEQ ID NO: 8508511 - DNA, 22 bp, Homo sapiens
aaatatgagggtgatgcccaga

SEQ ID NO: 8508512 - DNA, 22 bp, Homo sapiens
aaatatgatactcccttttagt

SEQ ID NO: 8508513 - DNA, 22 bp, Homo sapiens
aaatatgtaagattagcactag

SEQ ID NO: 8508514 - DNA, 22 bp, Homo sapiens
aaatatgtatggagttcatgaa

SEQ ID NO: 8508515 - DNA, 23 bp, Homo sapiens
aaatatgtctgagggcaaagaat

SEQ ID NO: 8508516 - DNA, 22 bp, Homo sapiens
aaatatgtgatcagtgaataaa

SEQ ID NO: 8508517 - DNA, 23 bp, Homo sapiens
aaactacatttatagtttttctc

SEQ ID NO: 8508518 - DNA, 23 bp, Homo sapiens
aaactacatttatagtttttctc

SEQ ID NO: 8508519 - DNA, 22 bp, Homo sapiens
aaactacatctcatggatgagg

SEQ ID NO: 8508520 - DNA, 22 bp, Homo sapiens
aaactactgatttgtgaattga

SEQ ID NO: 8508521 - DNA, 22 bp, Homo sapiens
aaatataatttctgcctcaata

SEQ ID NO: 8508522 - DNA, 19 bp, Homo sapiens
aaactaaggggaaatgttt

SEQ ID NO: 8508523 - DNA, 19 bp, Homo sapiens
aaactaaggggaaatgttt

SEQ ID NO: 8508524 - DNA, 22 bp, Homo sapiens
aaactaagactaatgaagaact

SEQ ID NO: 8508525 - DNA, 23 bp, Homo sapiens
aaactacaacgccaggcactgag

SEQ ID NO: 8508526 - DNA, 22 bp, Homo sapiens
aaactacactttgggaccagca

SEQ ID NO: 8508527 - DNA, 22 bp, Homo sapiens
aaatagaaaccaacaaggtcag

SEQ ID NO: 8508528 - DNA, 22 bp, Homo sapiens
aaatactgttgaatgaagtaag

SEQ ID NO: 8508529 - DNA, 22 bp, Homo sapiens
aaatactgttgaatgaagtaag

SEQ ID NO: 8508530 - DNA, 22 bp, Homo sapiens
aaatactgttgaatgaagtaag

SEQ ID NO: 8508531 - DNA, 22 bp, Homo sapiens
aaatactgttttattccatgat

SEQ ID NO: 8508532 - DNA, 22 bp, Homo sapiens
aaatacagattctgactcagag

SEQ ID NO: 8508533 - DNA, 22 bp, Homo sapiens
aaatactgtccaccatggagca

SEQ ID NO: 8508534 - DNA, 22 bp, Homo sapiens
aaatagaattaactagctactg

SEQ ID NO: 8508535 - DNA, 22 bp, Homo sapiens
aaatagaattaactagctactg

SEQ ID NO: 8508536 - DNA, 22 bp, Homo sapiens
aaatagaattaactagctactg

SEQ ID NO: 8508537 - DNA, 22 bp, Homo sapiens
aaatagaattggaagcagagtt

SEQ ID NO: 8508538 - DNA, 22 bp, Homo sapiens
aaatagaattggaagcagagtt

SEQ ID NO: 8508539 - DNA, 20 bp, Homo sapiens
aaacgagccatcattctggt

SEQ ID NO: 8508540 - DNA, 22 bp, Homo sapiens
aaactaaacctggcttagtaag

SEQ ID NO: 8508541 - DNA, 22 bp, Homo sapiens
aaacggttgctcatagttacat

SEQ ID NO: 8508542 - DNA, 22 bp, Homo sapiens
aaatattattgcttaaggggag

SEQ ID NO: 8508543 - DNA, 22 bp, Homo sapiens
aaatattagggagaacagggac

SEQ ID NO: 8508544 - DNA, 22 bp, Homo sapiens
aaatcagttagtggtaggattg

SEQ ID NO: 8508545 - DNA, 22 bp, Homo sapiens
aaatcagtccctcttggaattt

SEQ ID NO: 8508546 - DNA, 22 bp, Homo sapiens
aaatattattgcttaaggggag

SEQ ID NO: 8508547 - DNA, 22 bp, Homo sapiens
aaatgcagctgggcatgagagg

SEQ ID NO: 8508548 - DNA, 22 bp, Homo sapiens
aaatccaggtagtttggtttga

SEQ ID NO: 8508549 - DNA, 22 bp, Homo sapiens
aaatcatctctgcatccttagc

SEQ ID NO: 8508550 - DNA, 22 bp, Homo sapiens
aaatcatggtggaagaaacaga

SEQ ID NO: 8508551 - DNA, 22 bp, Homo sapiens
aaatgctctccaaaatgaaagt

SEQ ID NO: 8508552 - DNA, 22 bp, Homo sapiens
aaatgctctctaatgtaataca

SEQ ID NO: 8508553 - DNA, 22 bp, Homo sapiens
aaatgctctctaatgtaataca

SEQ ID NO: 8508554 - DNA, 22 bp, Homo sapiens
aaatgctatttgggaacaacat

SEQ ID NO: 8508555 - DNA, 18 bp, Homo sapiens
aaatgctaggctacatga

SEQ ID NO: 8508556 - DNA, 18 bp, Homo sapiens
aaatgctaggctacatga

SEQ ID NO: 8508557 - DNA, 22 bp, Homo sapiens
aaatggcagtagaaaagaatcc

SEQ ID NO: 8508558 - DNA, 22 bp, Homo sapiens
aaatggcatagaggtgaaggta

SEQ ID NO: 8508559 - DNA, 22 bp, Homo sapiens
aaatgctgagtgtttagagatc

SEQ ID NO: 8508560 - DNA, 22 bp, Homo sapiens
aaatggcaggctctttgctagt

SEQ ID NO: 8508561 - DNA, 22 bp, Homo sapiens
aaatggcagtagaaaagaatcc

SEQ ID NO: 8508562 - DNA, 22 bp, Homo sapiens
aaatgctaaatgcagcaagtag

SEQ ID NO: 8508563 - DNA, 22 bp, Homo sapiens
aaatgcctgtgtaaattctagc

SEQ ID NO: 8508564 - DNA, 22 bp, Homo sapiens
aaatgctacacaggaattctca

SEQ ID NO: 8508565 - DNA, 22 bp, Homo sapiens
aaatgctacacaggaattctca

SEQ ID NO: 8508566 - DNA, 22 bp, Homo sapiens
aaatgctagaacattttaaagg

SEQ ID NO: 8508567 - DNA, 22 bp, Homo sapiens
aaatgcctctgctgtacacaat

SEQ ID NO: 8508568 - DNA, 22 bp, Homo sapiens
aaatgcctctgggttattctag

SEQ ID NO: 8508569 - DNA, 22 bp, Homo sapiens
aaagcaataggttaggtcaaga

SEQ ID NO: 8508570 - DNA, 22 bp, Homo sapiens
aaagatgtgcctgtttcatagt

SEQ ID NO: 8508571 - DNA, 23 bp, Homo sapiens
aaagatgtgagtattcatatggc

SEQ ID NO: 8508572 - DNA, 23 bp, Homo sapiens
aaagatgtgagtattcatatggc

SEQ ID NO: 8508573 - DNA, 22 bp, Homo sapiens
aaagcaatctagttccaattct

SEQ ID NO: 8508574 - DNA, 22 bp, Homo sapiens
aaagcaatagtaatggtaatag

SEQ ID NO: 8508575 - DNA, 22 bp, Homo sapiens
aaagcaatagtaatggtaatag

SEQ ID NO: 8508576 - DNA, 22 bp, Homo sapiens
aaagcaatcagattcagatgtc

SEQ ID NO: 8508577 - DNA, 22 bp, Homo sapiens
aaagcaatgcttgtggaatgta

SEQ ID NO: 8508578 - DNA, 22 bp, Homo sapiens
aaagcaatgcttgtggaatgta

SEQ ID NO: 8508579 - DNA, 22 bp, Homo sapiens
aaagcaatgcccgttcattatc

SEQ ID NO: 8508580 - DNA, 22 bp, Homo sapiens
aaagcaatgatggtagacacgt

SEQ ID NO: 8508581 - DNA, 22 bp, Homo sapiens
aaagcaatgatggtagacacgt

SEQ ID NO: 8508582 - DNA, 22 bp, Homo sapiens
aaaggccatggttggagtgttt

SEQ ID NO: 8508583 - DNA, 22 bp, Homo sapiens
aaaggcccacagtcagtctacc

SEQ ID NO: 8508584 - DNA, 22 bp, Homo sapiens
aaaggccttgagctgggtgcca

SEQ ID NO: 8508585 - DNA, 22 bp, Homo sapiens
aaacactgatggatatttttcc

SEQ ID NO: 8508586 - DNA, 22 bp, Homo sapiens
aaacactgatggatatttttcc

SEQ ID NO: 8508587 - DNA, 22 bp, Homo sapiens
aaaggccaataaagacaagctg

SEQ ID NO: 8508588 - DNA, 22 bp, Homo sapiens
aaaggcattttaattctaaaga

SEQ ID NO: 8508589 - DNA, 22 bp, Homo sapiens
aaaggcatggatagtgaattca

SEQ ID NO: 8508590 - DNA, 22 bp, Homo sapiens
aaaggaggaatggagagatgct

SEQ ID NO: 8508591 - DNA, 22 bp, Homo sapiens
aaaggaggaatggagagatgct

SEQ ID NO: 8508592 - DNA, 22 bp, Homo sapiens
aaaggaggaatggagagatgct

SEQ ID NO: 8508593 - DNA, 22 bp, Homo sapiens
aaagcaatggatgagaatctgt

SEQ ID NO: 8508594 - DNA, 22 bp, Homo sapiens
aaagcaatggatgagaatctgt

SEQ ID NO: 8508595 - DNA, 22 bp, Homo sapiens
aaagcaatgcttgtggaatgta

SEQ ID NO: 8508596 - DNA, 22 bp, Homo sapiens
aaacagttttctcatttagtgt

SEQ ID NO: 8508597 - DNA, 22 bp, Homo sapiens
aaacagttttgccaaaaggaca

SEQ ID NO: 8508598 - DNA, 22 bp, Homo sapiens
aaagtgctgggattccaggcgt

SEQ ID NO: 8508599 - DNA, 22 bp, Homo sapiens
aaagtgctgaagacctagctgt

SEQ ID NO: 8508600 - DNA, 22 bp, Homo sapiens
aaacatagataatagatagatg

SEQ ID NO: 8508601 - DNA, 20 bp, Homo sapiens
aaacatagtggataccacag

SEQ ID NO: 8508602 - DNA, 22 bp, Homo sapiens
aaacatcaccattttacctaat

SEQ ID NO: 8508603 - DNA, 22 bp, Homo sapiens
aaacatcaccattttacctaat

SEQ ID NO: 8508604 - DNA, 22 bp, Homo sapiens
aaacatcaccattttacctaat

SEQ ID NO: 8508605 - DNA, 22 bp, Homo sapiens
aaacatcaattgcatctcccaa

SEQ ID NO: 8508606 - DNA, 22 bp, Homo sapiens
aaacatcaattgcatctcccaa

SEQ ID NO: 8508607 - DNA, 22 bp, Homo sapiens
aaacatctatcagcatttttta

SEQ ID NO: 8508608 - DNA, 22 bp, Homo sapiens
aaacatctatcagcatttttta

SEQ ID NO: 8508609 - DNA, 22 bp, Homo sapiens
aaacatcataggcatgcatgat

SEQ ID NO: 8508610 - DNA, 22 bp, Homo sapiens
aaacatcataggcatgcatgat

SEQ ID NO: 8508611 - DNA, 22 bp, Homo sapiens
aaacatctactgtaggctggag

SEQ ID NO: 8508612 - DNA, 22 bp, Homo sapiens
aaacactggtatgatgtatagt

SEQ ID NO: 8508613 - DNA, 22 bp, Homo sapiens
aaacactgtacaatctgcaggg

SEQ ID NO: 8508614 - DNA, 22 bp, Homo sapiens
aaacactgtacaatctgcaggg

SEQ ID NO: 8508615 - DNA, 22 bp, Homo sapiens
aaacactggtatgatgtatagt

SEQ ID NO: 8508616 - DNA, 22 bp, Homo sapiens
aaacactggtatgatgtatagt

SEQ ID NO: 8508617 - DNA, 22 bp, Homo sapiens
aaacactggtatgatgtatagt

SEQ ID NO: 8508618 - DNA, 22 bp, Homo sapiens
aaacactgcgtggtggcaactc

SEQ ID NO: 8508619 - DNA, 22 bp, Homo sapiens
aaacactggcaatttcatgcac

SEQ ID NO: 8508620 - DNA, 22 bp, Homo sapiens
aaacactggcaatttcatgcac

SEQ ID NO: 8508621 - DNA, 22 bp, Homo sapiens
aaacactggcaatttcatgcac

SEQ ID NO: 8508622 - DNA, 22 bp, Homo sapiens
aaacactgcagggtttacttga

SEQ ID NO: 8508623 - DNA, 22 bp, Homo sapiens
aaacactgcagggtttacttga

SEQ ID NO: 8508624 - DNA, 22 bp, Homo sapiens
aaagtgcattcgaaagtccatc

SEQ ID NO: 8508625 - DNA, 22 bp, Homo sapiens
aaagtgcatcaaatgacttccc

SEQ ID NO: 8508626 - DNA, 22 bp, Homo sapiens
aaagtgcatagagtagtgccta

SEQ ID NO: 8508627 - DNA, 23 bp, Homo sapiens
aaagtgcagttgaggaatcatag

SEQ ID NO: 8508628 - DNA, 22 bp, Homo sapiens
aaagtgcattgtttgtgttcct

SEQ ID NO: 8508629 - DNA, 22 bp, Homo sapiens
aaagtgcattcgaaagtccatc

SEQ ID NO: 8508630 - DNA, 22 bp, Homo sapiens
aaagtgctaaataagccctgaa

SEQ ID NO: 8508631 - DNA, 22 bp, Homo sapiens
aaagtgcagtccatgaaattaa

SEQ ID NO: 8508632 - DNA, 22 bp, Homo sapiens
aaagtgcagtccatgaaattaa

SEQ ID NO: 8508633 - DNA, 23 bp, Homo sapiens
aaagtgcagttgaggaatcatag

SEQ ID NO: 8508634 - DNA, 22 bp, Homo sapiens
aaacactgtctctggtattgaa

SEQ ID NO: 8508635 - DNA, 22 bp, Homo sapiens
aaagtcattttccagaccagta

SEQ ID NO: 8508636 - DNA, 22 bp, Homo sapiens
aaagtcatttgtatataccctt

SEQ ID NO: 8508637 - DNA, 22 bp, Homo sapiens
aaagtcatttagccttatctcc

SEQ ID NO: 8508638 - DNA, 22 bp, Homo sapiens
aaacttgatttagaactaaggc

SEQ ID NO: 8508639 - DNA, 22 bp, Homo sapiens
aaacttgaggcaatgaaggtgt

SEQ ID NO: 8508640 - DNA, 22 bp, Homo sapiens
aaacttgagtcacttctcttcc

SEQ ID NO: 8508641 - DNA, 23 bp, Homo sapiens
aaacttgctatggctgaaatcat

SEQ ID NO: 8508642 - DNA, 22 bp, Homo sapiens
aaacttgacagtgagacagttt

SEQ ID NO: 8508643 - DNA, 22 bp, Homo sapiens
aaacttctggctacaagcaata

SEQ ID NO: 8508644 - DNA, 22 bp, Homo sapiens
aaagaacttatcctagaatttg

SEQ ID NO: 8508645 - DNA, 19 bp, Homo sapiens
aaagaactttgggctaggc

SEQ ID NO: 8508646 - DNA, 22 bp, Homo sapiens
aaagaactattaacgaggaagc

SEQ ID NO: 8508647 - DNA, 22 bp, Homo sapiens
aaagaacttaagaaattaggct

SEQ ID NO: 8508648 - DNA, 22 bp, Homo sapiens
aaagaactcagagaggatttta

SEQ ID NO: 8508649 - DNA, 22 bp, Homo sapiens
aaagaactacctgtatgatatt

SEQ ID NO: 8508650 - DNA, 22 bp, Homo sapiens
aaacttggccgcatccaccggg

SEQ ID NO: 8508651 - DNA, 22 bp, Homo sapiens
aaacttgggtgaccctgagcaa

SEQ ID NO: 8508652 - DNA, 19 bp, Homo sapiens
aaagatctgggattgagac

SEQ ID NO: 8508653 - DNA, 22 bp, Homo sapiens
aaagatctccccttcaaagagt

SEQ ID NO: 8508654 - DNA, 22 bp, Homo sapiens
aaagagctttagaaatctcaga

SEQ ID NO: 8508655 - DNA, 22 bp, Homo sapiens
aaagatcattctctggtccaga

SEQ ID NO: 8508656 - DNA, 22 bp, Homo sapiens
aaagatcattctctggtccaga

SEQ ID NO: 8508657 - DNA, 22 bp, Homo sapiens
aaagatgagtccggcagacata

SEQ ID NO: 8508658 - DNA, 22 bp, Homo sapiens
aaagatgaccgtatgtcagagc

SEQ ID NO: 8508659 - DNA, 22 bp, Homo sapiens
aaagatgaccgtatgtcagagc

SEQ ID NO: 8508660 - DNA, 22 bp, Homo sapiens
aaagatggcccatgatctcttg

SEQ ID NO: 8508661 - DNA, 22 bp, Homo sapiens
aaagatgtcacaagatgtgatg

SEQ ID NO: 8508662 - DNA, 22 bp, Homo sapiens
aaagatgcataaatgccaatgg

SEQ ID NO: 8508663 - DNA, 22 bp, Homo sapiens
aaagaagagctggaaggagtct

SEQ ID NO: 8508664 - DNA, 22 bp, Homo sapiens
aaagaagagctggaaggagtct

SEQ ID NO: 8508665 - DNA, 22 bp, Homo sapiens
aaagaagacagacatttctttc

SEQ ID NO: 8508666 - DNA, 22 bp, Homo sapiens
aaagaacttatcctagaatttg

SEQ ID NO: 8508667 - DNA, 22 bp, Homo sapiens
aaagaagacagacatttctttc

SEQ ID NO: 8508668 - DNA, 22 bp, Homo sapiens
aaagaagacagacatttctttc

SEQ ID NO: 8508669 - DNA, 22 bp, Homo sapiens
aaagaagagctggaaggagtct

SEQ ID NO: 8508670 - DNA, 22 bp, Homo sapiens
aaagaaggatgggagaaatcct

SEQ ID NO: 8508671 - DNA, 22 bp, Homo sapiens
aaagaaggacctggaggaggat

SEQ ID NO: 8508672 - DNA, 22 bp, Homo sapiens
aaagaagcataggctagacttc

SEQ ID NO: 8508673 - DNA, 22 bp, Homo sapiens
aaagaaggatgggagaaatcct

SEQ ID NO: 8508674 - DNA, 18 bp, Homo sapiens
aaagaaggattggagagc

SEQ ID NO: 8508675 - DNA, 22 bp, Homo sapiens
aaagaagggacagactgcctct

SEQ ID NO: 8508676 - DNA, 18 bp, Homo sapiens
aaagaaggattggagagc

SEQ ID NO: 8508677 - DNA, 22 bp, Homo sapiens
aaacatctgacttgctttttca

SEQ ID NO: 8508678 - DNA, 22 bp, Homo sapiens
aaacagtctgatgccatctgcc

SEQ ID NO: 8508679 - DNA, 22 bp, Homo sapiens
aaacagtcttgtgggcttggag

SEQ ID NO: 8508680 - DNA, 22 bp, Homo sapiens
aaacagtctgatgccatctgcc

SEQ ID NO: 8508681 - DNA, 22 bp, Homo sapiens
aaacagtcgtcttaatagtatt

SEQ ID NO: 8508682 - DNA, 22 bp, Homo sapiens
aaacacagggatatatattcca

SEQ ID NO: 8508683 - DNA, 22 bp, Homo sapiens
aaacacaggtactgcagaagtg

SEQ ID NO: 8508684 - DNA, 22 bp, Homo sapiens
aaacagtcctctttatttagtc

SEQ ID NO: 8508685 - DNA, 22 bp, Homo sapiens
aaacagtcctctttatttagtc

SEQ ID NO: 8508686 - DNA, 22 bp, Homo sapiens
aaacagtcctctttatttagtc

SEQ ID NO: 8508687 - DNA, 22 bp, Homo sapiens
aaacacagggatatatattcca

SEQ ID NO: 8508688 - DNA, 22 bp, Homo sapiens
aaacacagggatatatattcca

SEQ ID NO: 8508689 - DNA, 20 bp, Homo sapiens
aaacacagcctctctttaca

SEQ ID NO: 8508690 - DNA, 19 bp, Homo sapiens
aaacacagatttcttacca

SEQ ID NO: 8508691 - DNA, 19 bp, Homo sapiens
aaacacagatttcttacca

SEQ ID NO: 8508692 - DNA, 22 bp, Homo sapiens
aaacacagcatgtccttgggga

SEQ ID NO: 8508693 - DNA, 22 bp, Homo sapiens
aaacacagatttctttgtccca

SEQ ID NO: 8508694 - DNA, 22 bp, Homo sapiens
aaacatgagcatctcttcaagc

SEQ ID NO: 8508695 - DNA, 22 bp, Homo sapiens
aaacatgagcacttgcttcata

SEQ ID NO: 8508696 - DNA, 22 bp, Homo sapiens
aaacatgagcacttgcttcata

SEQ ID NO: 8508697 - DNA, 22 bp, Homo sapiens
aaacatgaatagatattaaaca

SEQ ID NO: 8508698 - DNA, 22 bp, Homo sapiens
aaacatgaatagatattaaaca

SEQ ID NO: 8508699 - DNA, 22 bp, Homo sapiens
aaacatctttctattgcaagtt

SEQ ID NO: 8508700 - DNA, 22 bp, Homo sapiens
aaacatcttctcttgattcttt

SEQ ID NO: 8508701 - DNA, 22 bp, Homo sapiens
aaacatcttctcttgattcttt

SEQ ID NO: 8508702 - DNA, 22 bp, Homo sapiens
aaacatgagttaaaagtaactg

SEQ ID NO: 8508703 - DNA, 22 bp, Homo sapiens
aaacatgagcatctcttcaagc

SEQ ID NO: 8508704 - DNA, 22 bp, Homo sapiens
aaacatgagcatctcttcaagc

SEQ ID NO: 8508705 - DNA, 22 bp, Homo sapiens
aaacatttgcaactcggtttgg

SEQ ID NO: 8508706 - DNA, 22 bp, Homo sapiens
aaaccatggagtaagttcacat

SEQ ID NO: 8508707 - DNA, 22 bp, Homo sapiens
aaaccatggagtaagttcacat

SEQ ID NO: 8508708 - DNA, 22 bp, Homo sapiens
aaaccatcagataattcatact

SEQ ID NO: 8508709 - DNA, 22 bp, Homo sapiens
aaactgtaaacacagcagtaca

SEQ ID NO: 8508710 - DNA, 22 bp, Homo sapiens
aaaaactgtaattacttttgca

SEQ ID NO: 8508711 - DNA, 22 bp, Homo sapiens
aaaaactgtaattacttttgca

SEQ ID NO: 8508712 - DNA, 22 bp, Homo sapiens
aaaaactgtaattacttttgca

SEQ ID NO: 8508713 - DNA, 19 bp, Homo sapiens
aaaaacttagtccagaaag

SEQ ID NO: 8508714 - DNA, 22 bp, Homo sapiens
aaaaagacttccaactcaggag

SEQ ID NO: 8508715 - DNA, 22 bp, Homo sapiens
aaaaagatagcattgtgctcct

SEQ ID NO: 8508716 - DNA, 19 bp, Homo sapiens
aaaaagaggctataatatt

SEQ ID NO: 8508717 - DNA, 22 bp, Homo sapiens
aaaaagatgtcctgaagtttag

SEQ ID NO: 8508718 - DNA, 22 bp, Homo sapiens
aaaaagatagcattgtgctcct

SEQ ID NO: 8508719 - DNA, 22 bp, Homo sapiens
aaaaagatgtcctgaagtttag

SEQ ID NO: 8508720 - DNA, 22 bp, Homo sapiens
aaaaatgaattcttcagtggca

SEQ ID NO: 8508721 - DNA, 22 bp, Homo sapiens
aaaaatgaattcttcagtggca

SEQ ID NO: 8508722 - DNA, 22 bp, Homo sapiens
aaaaatgaaacggctggttggc

SEQ ID NO: 8508723 - DNA, 22 bp, Homo sapiens
aaaaatgaaacggctggttggc

SEQ ID NO: 8508724 - DNA, 21 bp, Homo sapiens
aaaaatgaagttgttcaggaa

SEQ ID NO: 8508725 - DNA, 21 bp, Homo sapiens
aaaaatgaagttgttcaggaa

SEQ ID NO: 8508726 - DNA, 22 bp, Homo sapiens
aaaagtctacaagcttcaacaa

SEQ ID NO: 8508727 - DNA, 22 bp, Homo sapiens
aaaagtattttggatctcagat

SEQ ID NO: 8508728 - DNA, 22 bp, Homo sapiens
aaaagtattttggatctcagat

SEQ ID NO: 8508729 - DNA, 22 bp, Homo sapiens
aaaagtctgctctcatttcaga

SEQ ID NO: 8508730 - DNA, 22 bp, Homo sapiens
aaaagtctctctgagtaaaagt

SEQ ID NO: 8508731 - DNA, 22 bp, Homo sapiens
aaaagtctctctgagtaaaagt

SEQ ID NO: 8508732 - DNA, 22 bp, Homo sapiens
aaaagtctctctgagtaaaagt

SEQ ID NO: 8508733 - DNA, 22 bp, Homo sapiens
aaaaatgaattcttcagtggca

SEQ ID NO: 8508734 - DNA, 22 bp, Homo sapiens
aaaaatgaattcttcagtggca

SEQ ID NO: 8508735 - DNA, 22 bp, Homo sapiens
aaaaatgctgtggtagctgtgt

SEQ ID NO: 8508736 - DNA, 22 bp, Homo sapiens
aaaaatgtcattatggaactga

SEQ ID NO: 8508737 - DNA, 22 bp, Homo sapiens
aaaaatgcttggacttaataaa

SEQ ID NO: 8508738 - DNA, 22 bp, Homo sapiens
aaaaatgtgaccacagggtgtt

SEQ ID NO: 8508739 - DNA, 22 bp, Homo sapiens
aaaaatgtgaccacagggtgtt

SEQ ID NO: 8508740 - DNA, 22 bp, Homo sapiens
aaaaatgtcattatggaactga

SEQ ID NO: 8508741 - DNA, 22 bp, Homo sapiens
aaacaacttctgcactatgggt

SEQ ID NO: 8508742 - DNA, 22 bp, Homo sapiens
aaacaagagcttacatggctgc

SEQ ID NO: 8508743 - DNA, 22 bp, Homo sapiens
aaacaagagcttacatggctgc

SEQ ID NO: 8508744 - DNA, 22 bp, Homo sapiens
aaacaacatggtgggtgtgtag

SEQ ID NO: 8508745 - DNA, 22 bp, Homo sapiens
aaacaacatggtgggtgtgtag

SEQ ID NO: 8508746 - DNA, 22 bp, Homo sapiens
aaacaactcggcaactgctttt

SEQ ID NO: 8508747 - DNA, 22 bp, Homo sapiens
aaacacacctttggaactgtga

SEQ ID NO: 8508748 - DNA, 22 bp, Homo sapiens
aaacacacctttggaactgtga

SEQ ID NO: 8508749 - DNA, 22 bp, Homo sapiens
aaacacacagaaatgaatgagg

SEQ ID NO: 8508750 - DNA, 19 bp, Homo sapiens
aaacacagatttcttacca

SEQ ID NO: 8508751 - DNA, 22 bp, Homo sapiens
aaacacacagaaatgaatgagg

SEQ ID NO: 8508752 - DNA, 22 bp, Homo sapiens
aaacacacagaaatgaatgagg

SEQ ID NO: 8508753 - DNA, 22 bp, Homo sapiens
aaacaacaatccaatgggagct

SEQ ID NO: 8508754 - DNA, 22 bp, Homo sapiens
aaacaaatttcaagctgtgaca

SEQ ID NO: 8508755 - DNA, 22 bp, Homo sapiens
aaacaaatagtgcatgggaatt

SEQ ID NO: 8508756 - DNA, 22 bp, Homo sapiens
aaacaaatagtgcatgggaatt

SEQ ID NO: 8508757 - DNA, 22 bp, Homo sapiens
aaacaaagccagggaagttatg

SEQ ID NO: 8508758 - DNA, 22 bp, Homo sapiens
aaacaaagcatcttgctatgca

SEQ ID NO: 8508759 - DNA, 22 bp, Homo sapiens
aaacaaacataggtttgaaagt

SEQ ID NO: 8508760 - DNA, 22 bp, Homo sapiens
aaacaaacataggtttgaaagt

SEQ ID NO: 8508761 - DNA, 22 bp, Homo sapiens
aaaatagatgaaaggaagtctg

SEQ ID NO: 8508762 - DNA, 22 bp, Homo sapiens
aaaatagataatgccagggtca

SEQ ID NO: 8508763 - DNA, 22 bp, Homo sapiens
aaaatagattctaggatgtctt

SEQ ID NO: 8508764 - DNA, 22 bp, Homo sapiens
aaaagtcttggggaaggccagg

SEQ ID NO: 8508765 - DNA, 22 bp, Homo sapiens
aaaagtcttggggaaggccagg

SEQ ID NO: 8508766 - DNA, 22 bp, Homo sapiens
aaaagtcttgtcaaggttccca

SEQ ID NO: 8508767 - DNA, 22 bp, Homo sapiens
aaaagtgatgggatggcacttc

SEQ ID NO: 8508768 - DNA, 22 bp, Homo sapiens
aaaatagcatattgctttcttt

SEQ ID NO: 8508769 - DNA, 22 bp, Homo sapiens
aaaatagcagggatgtgggaaa

SEQ ID NO: 8508770 - DNA, 22 bp, Homo sapiens
aaaatagcctcacataattgct

SEQ ID NO: 8508771 - DNA, 22 bp, Homo sapiens
aaaatagctatggaatgtcact

SEQ ID NO: 8508772 - DNA, 22 bp, Homo sapiens
aaaattcatggcttgggaaaag

SEQ ID NO: 8508773 - DNA, 22 bp, Homo sapiens
aaaatagctatggaatgtcact

SEQ ID NO: 8508774 - DNA, 22 bp, Homo sapiens
aaaatagctatggaatgtcact

SEQ ID NO: 8508775 - DNA, 22 bp, Homo sapiens
aacaacttgcgttcagagatgt

SEQ ID NO: 8508776 - DNA, 22 bp, Homo sapiens
aacaactgctaaggtgtgtcct

SEQ ID NO: 8508777 - DNA, 22 bp, Homo sapiens
aacaactgaaaagctttttctg

SEQ ID NO: 8508778 - DNA, 22 bp, Homo sapiens
aacaacagtgagtgctgggagg

SEQ ID NO: 8508779 - DNA, 22 bp, Homo sapiens
aacaacagctgctaaagagttg

SEQ ID NO: 8508780 - DNA, 22 bp, Homo sapiens
aacaacagctgctaaagagttg

SEQ ID NO: 8508781 - DNA, 22 bp, Homo sapiens
aacaaatttagctctgagtgct

SEQ ID NO: 8508782 - DNA, 22 bp, Homo sapiens
aacaaatttagctctgagtgct

SEQ ID NO: 8508783 - DNA, 22 bp, Homo sapiens
aacaaatttagctctgagtgct

SEQ ID NO: 8508784 - DNA, 22 bp, Homo sapiens
aacaaattagttgcaagactgg

SEQ ID NO: 8508785 - DNA, 22 bp, Homo sapiens
aacaaattagttgcaagactgg

SEQ ID NO: 8508786 - DNA, 22 bp, Homo sapiens
aacaaattagttgcaagactgg

SEQ ID NO: 8508787 - DNA, 22 bp, Homo sapiens
aacaaatgtgttttgtaattaa

SEQ ID NO: 8508788 - DNA, 22 bp, Homo sapiens
aacaaattagttgcaagactgg

SEQ ID NO: 8508789 - DNA, 22 bp, Homo sapiens
aaagcacagagctcccacagga

SEQ ID NO: 8508790 - DNA, 22 bp, Homo sapiens
aaagcacagagctcccacagga

SEQ ID NO: 8508791 - DNA, 22 bp, Homo sapiens
aaagcaatttaatggaccatga

SEQ ID NO: 8508792 - DNA, 22 bp, Homo sapiens
aaagcacatagtagaaggattt

SEQ ID NO: 8508793 - DNA, 22 bp, Homo sapiens
aaagcacagggtgctagagagt

SEQ ID NO: 8508794 - DNA, 22 bp, Homo sapiens
aaagcacattacaagctcagtc

SEQ ID NO: 8508795 - DNA, 22 bp, Homo sapiens
aaagcacattacaagctcagtc

SEQ ID NO: 8508796 - DNA, 22 bp, Homo sapiens
aaagcacattacaagctcagtc

SEQ ID NO: 8508797 - DNA, 22 bp, Homo sapiens
aaagcactatagccaaatagcc

SEQ ID NO: 8508798 - DNA, 22 bp, Homo sapiens
aaagcacatgagtagtgtagta

SEQ ID NO: 8508799 - DNA, 22 bp, Homo sapiens
aaagcacatgagtagtgtagta

SEQ ID NO: 8508800 - DNA, 22 bp, Homo sapiens
aaagcacatagtagaaggattt

SEQ ID NO: 8508801 - DNA, 22 bp, Homo sapiens
aaagcacatagtagaaggattt

SEQ ID NO: 8508802 - DNA, 22 bp, Homo sapiens
aaatgggcctggaaagaggatg

SEQ ID NO: 8508803 - DNA, 22 bp, Homo sapiens
aaatggctttgagggtaggaca

SEQ ID NO: 8508804 - DNA, 22 bp, Homo sapiens
aaatgggtttgattctcagcca

SEQ ID NO: 8508805 - DNA, 16 bp, Homo sapiens
aaatggcttaggctta

SEQ ID NO: 8508806 - DNA, 22 bp, Homo sapiens
aaatggctgactaaattaaatt

SEQ ID NO: 8508807 - DNA, 22 bp, Homo sapiens
aaatggctacaagatgtgctct

SEQ ID NO: 8508808 - DNA, 22 bp, Homo sapiens
aaatggtaagacaacacattat

SEQ ID NO: 8508809 - DNA, 22 bp, Homo sapiens
aaatggtaatgtctttctgttt

SEQ ID NO: 8508810 - DNA, 22 bp, Homo sapiens
aaatggtaggttttcttaagaa

SEQ ID NO: 8508811 - DNA, 22 bp, Homo sapiens
aaatggtccatcctaaagaagt

SEQ ID NO: 8508812 - DNA, 22 bp, Homo sapiens
aaatggtatttactctgtatta

SEQ ID NO: 8508813 - DNA, 22 bp, Homo sapiens
aaatggtataatgtcatgtatt

SEQ ID NO: 8508814 - DNA, 22 bp, Homo sapiens
aaatggtagtagcattccatat

SEQ ID NO: 8508815 - DNA, 22 bp, Homo sapiens
aaatggtgagggaattgaacag

SEQ ID NO: 8508816 - DNA, 22 bp, Homo sapiens
aaagcaatgggtctaaggtaaa

SEQ ID NO: 8508817 - DNA, 22 bp, Homo sapiens
aaagcaatagagggtaagactg

SEQ ID NO: 8508818 - DNA, 22 bp, Homo sapiens
aaagcaattgtggtttttgtca

SEQ ID NO: 8508819 - DNA, 22 bp, Homo sapiens
aaagcaattgtggtttttgcca

SEQ ID NO: 8508820 - DNA, 22 bp, Homo sapiens
aaagcaatgtctctgcctggtt

SEQ ID NO: 8508821 - DNA, 22 bp, Homo sapiens
aaagcaattacaaaagggataa

SEQ ID NO: 8508822 - DNA, 22 bp, Homo sapiens
aacaattagactgacggtatta

SEQ ID NO: 8508823 - DNA, 22 bp, Homo sapiens
aacaattagactgacggtatta

SEQ ID NO: 8508824 - DNA, 22 bp, Homo sapiens
aacaattactaccaaggcctgt

SEQ ID NO: 8508825 - DNA, 22 bp, Homo sapiens
aacaatgtgattgaagctagaa

SEQ ID NO: 8508826 - DNA, 22 bp, Homo sapiens
aacaagaagggaaggcatgatt

SEQ ID NO: 8508827 - DNA, 22 bp, Homo sapiens
aacacaaaaattctcaggggca

SEQ ID NO: 8508828 - DNA, 22 bp, Homo sapiens
aacacaaaaattctcaggggca

SEQ ID NO: 8508829 - DNA, 22 bp, Homo sapiens
aacacaaagaagctgcaggatc

SEQ ID NO: 8508830 - DNA, 22 bp, Homo sapiens
aacaattatcatatacattgca

SEQ ID NO: 8508831 - DNA, 22 bp, Homo sapiens
aacaattatcatatacattgca

SEQ ID NO: 8508832 - DNA, 23 bp, Homo sapiens
aacacaaagctgattccagtggc

SEQ ID NO: 8508833 - DNA, 23 bp, Homo sapiens
aacacaaagctgattccagtggc

SEQ ID NO: 8508834 - DNA, 22 bp, Homo sapiens
aacacataggcagagcatgaca

SEQ ID NO: 8508835 - DNA, 22 bp, Homo sapiens
aacacaaagaagctgcaggatc

SEQ ID NO: 8508836 - DNA, 22 bp, Homo sapiens
aacacaaagaagctgcaggatc

SEQ ID NO: 8508837 - DNA, 21 bp, Homo sapiens
aacacatccagagtatttgac

SEQ ID NO: 8508838 - DNA, 21 bp, Homo sapiens
aacacatccagagtatttgac

SEQ ID NO: 8508839 - DNA, 22 bp, Homo sapiens
aacacatgaaagttggtgagta

SEQ ID NO: 8508840 - DNA, 22 bp, Homo sapiens
aacacatatttatatatgcaca

SEQ ID NO: 8508841 - DNA, 22 bp, Homo sapiens
aacacatatttttgctgagcat

SEQ ID NO: 8508842 - DNA, 22 bp, Homo sapiens
aacacatatttatatatgcaca

SEQ ID NO: 8508843 - DNA, 22 bp, Homo sapiens
aacacatatttatatatgcaca

SEQ ID NO: 8508844 - DNA, 22 bp, Homo sapiens
aacacatatttatatatgcaca

SEQ ID NO: 8508845 - DNA, 22 bp, Homo sapiens
aacacataggcagagcatgaca

SEQ ID NO: 8508846 - DNA, 22 bp, Homo sapiens
aacacatggcaagagcaggaaa

SEQ ID NO: 8508847 - DNA, 22 bp, Homo sapiens
aacacatgggtgtttattgtac

SEQ ID NO: 8508848 - DNA, 22 bp, Homo sapiens
aacacatggcaagagcaggaaa

SEQ ID NO: 8508849 - DNA, 22 bp, Homo sapiens
aacacatgccttaagaataagt

SEQ ID NO: 8508850 - DNA, 22 bp, Homo sapiens
aacacatgccttaagaataagt

SEQ ID NO: 8508851 - DNA, 22 bp, Homo sapiens
aacacatgaaagttggtgagta

SEQ ID NO: 8508852 - DNA, 22 bp, Homo sapiens
aacacatgggtgtttattgtac

SEQ ID NO: 8508853 - DNA, 22 bp, Homo sapiens
aacacatgggtgtttattgtac

SEQ ID NO: 8508854 - DNA, 23 bp, Homo sapiens
aacacattgctaattacattcaa

SEQ ID NO: 8508855 - DNA, 22 bp, Homo sapiens
aacagcagcatgacagctgggt

SEQ ID NO: 8508856 - DNA, 22 bp, Homo sapiens
aacagcagctgaggagctgggc

SEQ ID NO: 8508857 - DNA, 22 bp, Homo sapiens
aacagctttgagcagttctgta

SEQ ID NO: 8508858 - DNA, 22 bp, Homo sapiens
aacagctttagaggataatagt

SEQ ID NO: 8508859 - DNA, 22 bp, Homo sapiens
aacagcttgctgcaccttaata

SEQ ID NO: 8508860 - DNA, 22 bp, Homo sapiens
aacagctttgtgctcagatttg

SEQ ID NO: 8508861 - DNA, 22 bp, Homo sapiens
aacagcttttttggtcagcatt

SEQ ID NO: 8508862 - DNA, 22 bp, Homo sapiens
aacagctttgagcagttctgta

SEQ ID NO: 8508863 - DNA, 22 bp, Homo sapiens
aacagctttgcttctggagaca

SEQ ID NO: 8508864 - DNA, 22 bp, Homo sapiens
aacagctttgcttctggagaca

SEQ ID NO: 8508865 - DNA, 22 bp, Homo sapiens
aacagctttgtatacagtaact

SEQ ID NO: 8508866 - DNA, 22 bp, Homo sapiens
aacattaattacagtcaaacat

SEQ ID NO: 8508867 - DNA, 22 bp, Homo sapiens
aacattaagatggcggaacagt

SEQ ID NO: 8508868 - DNA, 22 bp, Homo sapiens
aacatgcaatgtctgaaaatcc

SEQ ID NO: 8508869 - DNA, 22 bp, Homo sapiens
aacatgcaatgtctgaaaatcc

SEQ ID NO: 8508870 - DNA, 22 bp, Homo sapiens
aacatgcaaagctatgatgtat

SEQ ID NO: 8508871 - DNA, 22 bp, Homo sapiens
aacatgcaaagctatgatgtat

SEQ ID NO: 8508872 - DNA, 22 bp, Homo sapiens
aacatgcaatgtctgaaaatcc

SEQ ID NO: 8508873 - DNA, 22 bp, Homo sapiens
aacattcaaaacccagttcagt

SEQ ID NO: 8508874 - DNA, 22 bp, Homo sapiens
aacattcaaaacccagttcagt

SEQ ID NO: 8508875 - DNA, 22 bp, Homo sapiens
aacattcaagttctggtttatg

SEQ ID NO: 8508876 - DNA, 22 bp, Homo sapiens
aacattcacctctacctccttc

SEQ ID NO: 8508877 - DNA, 22 bp, Homo sapiens
aacatttcataacttgactttt

SEQ ID NO: 8508878 - DNA, 22 bp, Homo sapiens
aacattctggttctaaaaacct

SEQ ID NO: 8508879 - DNA, 22 bp, Homo sapiens
aacattctatgtgcattcagaa

SEQ ID NO: 8508880 - DNA, 22 bp, Homo sapiens
aacattctattttgctaaaaca

SEQ ID NO: 8508881 - DNA, 22 bp, Homo sapiens
aacattctactgtactgcattg

SEQ ID NO: 8508882 - DNA, 22 bp, Homo sapiens
aacattcagctgggtggagcag

SEQ ID NO: 8508883 - DNA, 22 bp, Homo sapiens
aacatttcattggaagctatgt

SEQ ID NO: 8508884 - DNA, 22 bp, Homo sapiens
aacatttccggccttttgttct

SEQ ID NO: 8508885 - DNA, 21 bp, Homo sapiens
aacatttctgggagaactcac

SEQ ID NO: 8508886 - DNA, 22 bp, Homo sapiens
aacatttctgagaatatcagtt

SEQ ID NO: 8508887 - DNA, 22 bp, Homo sapiens
aacagtactggacaaggagtca

SEQ ID NO: 8508888 - DNA, 22 bp, Homo sapiens
aacagtagtggtcaatatgcca

SEQ ID NO: 8508889 - DNA, 22 bp, Homo sapiens
aacagtacaactccacaagact

SEQ ID NO: 8508890 - DNA, 20 bp, Homo sapiens
aacagtaccatttatctcag

SEQ ID NO: 8508891 - DNA, 22 bp, Homo sapiens
aacagtaatgtggtgttgggtt

SEQ ID NO: 8508892 - DNA, 22 bp, Homo sapiens
aacaggaaatacttatgaggta

SEQ ID NO: 8508893 - DNA, 22 bp, Homo sapiens
aacaggaaacaagttgttagga

SEQ ID NO: 8508894 - DNA, 22 bp, Homo sapiens
aacaggaaacaagttgttagga

SEQ ID NO: 8508895 - DNA, 22 bp, Homo sapiens
aacaggaaaacagcacaatagc

SEQ ID NO: 8508896 - DNA, 22 bp, Homo sapiens
aacagtattggttgaactcaag

SEQ ID NO: 8508897 - DNA, 22 bp, Homo sapiens
aacagtcaaagtttggttcctt

SEQ ID NO: 8508898 - DNA, 22 bp, Homo sapiens
aacagtattggttgaactcaag

SEQ ID NO: 8508899 - DNA, 22 bp, Homo sapiens
aacagtatggaagccattagga

SEQ ID NO: 8508900 - DNA, 22 bp, Homo sapiens
aacagtatgtgagatttacaca

SEQ ID NO: 8508901 - DNA, 22 bp, Homo sapiens
aacagtatcttttatcagaaat

SEQ ID NO: 8508902 - DNA, 22 bp, Homo sapiens
aacagtatcttttatcagaaat

SEQ ID NO: 8508903 - DNA, 22 bp, Homo sapiens
aacagtatcttttatcagaaat

SEQ ID NO: 8508904 - DNA, 22 bp, Homo sapiens
aacagtatctacgggaactatt

SEQ ID NO: 8508905 - DNA, 22 bp, Homo sapiens
aacagtatctacgggaactatt

SEQ ID NO: 8508906 - DNA, 22 bp, Homo sapiens
aacagtatatgaaatgttagga

SEQ ID NO: 8508907 - DNA, 20 bp, Homo sapiens
aacagtcaaatgttgattgc

SEQ ID NO: 8508908 - DNA, 22 bp, Homo sapiens
aacagtcacattgttcaacttt

SEQ ID NO: 8508909 - DNA, 22 bp, Homo sapiens
aacagtcagcttctcgggacat

SEQ ID NO: 8508910 - DNA, 22 bp, Homo sapiens
aacagtgagaaggtggacagga

SEQ ID NO: 8508911 - DNA, 22 bp, Homo sapiens
aacagtgagaaggtggacagga

SEQ ID NO: 8508912 - DNA, 22 bp, Homo sapiens
aacatttgcatgctttattaga

SEQ ID NO: 8508913 - DNA, 22 bp, Homo sapiens
aactaatacattaatacatgtg

SEQ ID NO: 8508914 - DNA, 22 bp, Homo sapiens
aactaatacattaatacatgtg

SEQ ID NO: 8508915 - DNA, 22 bp, Homo sapiens
aactcacagctgtttggattag

SEQ ID NO: 8508916 - DNA, 22 bp, Homo sapiens
aactcacacaagtattgcctgc

SEQ ID NO: 8508917 - DNA, 22 bp, Homo sapiens
aactcactttgtggcttctgaa

SEQ ID NO: 8508918 - DNA, 22 bp, Homo sapiens
aactcactttgtggcttctgaa

SEQ ID NO: 8508919 - DNA, 22 bp, Homo sapiens
aactatataatctgaaagtgaa

SEQ ID NO: 8508920 - DNA, 22 bp, Homo sapiens
aactatactctgtaaatgtgct

SEQ ID NO: 8508921 - DNA, 22 bp, Homo sapiens
aactatactctgtaaatgtgct

SEQ ID NO: 8508922 - DNA, 22 bp, Homo sapiens
aactatcacaaacagagtgtct

SEQ ID NO: 8508923 - DNA, 22 bp, Homo sapiens
aactatgttaataagtttcatt

SEQ ID NO: 8508924 - DNA, 22 bp, Homo sapiens
aactgcaaaaatggtagtctta

SEQ ID NO: 8508925 - DNA, 22 bp, Homo sapiens
aactgatttcaagttcagtttc

SEQ ID NO: 8508926 - DNA, 22 bp, Homo sapiens
aactgattgttggatgatagtg

SEQ ID NO: 8508927 - DNA, 22 bp, Homo sapiens
aactgagcccctgcacttgtga

SEQ ID NO: 8508928 - DNA, 22 bp, Homo sapiens
aactgagattacaagagacatt

SEQ ID NO: 8508929 - DNA, 20 bp, Homo sapiens
aactgagagttcaggaggag

SEQ ID NO: 8508930 - DNA, 22 bp, Homo sapiens
aactcagtcataaagcgaatgc

SEQ ID NO: 8508931 - DNA, 22 bp, Homo sapiens
aactcagtgtgtttcttagtat

SEQ ID NO: 8508932 - DNA, 22 bp, Homo sapiens
aactgaaacttaggaagtaatc

SEQ ID NO: 8508933 - DNA, 22 bp, Homo sapiens
aactcagcatcctgcacagaga

SEQ ID NO: 8508934 - DNA, 22 bp, Homo sapiens
aactgaacagaactcagagatt

SEQ ID NO: 8508935 - DNA, 22 bp, Homo sapiens
aactgaaagtttcacctgaggt

SEQ ID NO: 8508936 - DNA, 22 bp, Homo sapiens
aactgagacacgaactatgatt

SEQ ID NO: 8508937 - DNA, 21 bp, Homo sapiens
aactgagaccagctaaagtgg

SEQ ID NO: 8508938 - DNA, 22 bp, Homo sapiens
aactgaacataatgaaagccaa

SEQ ID NO: 8508939 - DNA, 22 bp, Homo sapiens
aactgaacagcaggcttctacc

SEQ ID NO: 8508940 - DNA, 22 bp, Homo sapiens
aagaatgttcattaaactgttg

SEQ ID NO: 8508941 - DNA, 22 bp, Homo sapiens
aagaatgttcattaaactgttg

SEQ ID NO: 8508942 - DNA, 22 bp, Homo sapiens
aagaatgttcaacgcttttttg

SEQ ID NO: 8508943 - DNA, 22 bp, Homo sapiens
aagaatgttagtttctgataca

SEQ ID NO: 8508944 - DNA, 22 bp, Homo sapiens
aagaatgttagtttctgataca

SEQ ID NO: 8508945 - DNA, 22 bp, Homo sapiens
aagaatgttagtttctgataca

SEQ ID NO: 8508946 - DNA, 22 bp, Homo sapiens
aagaatgtgggtggatatgatg

SEQ ID NO: 8508947 - DNA, 22 bp, Homo sapiens
aagaatgttagtttctgataca

SEQ ID NO: 8508948 - DNA, 22 bp, Homo sapiens
aagacactaagctttcaggata

SEQ ID NO: 8508949 - DNA, 22 bp, Homo sapiens
aagacactaagctttcaggata

SEQ ID NO: 8508950 - DNA, 22 bp, Homo sapiens
aagaatgttcttgtagtcatga

SEQ ID NO: 8508951 - DNA, 22 bp, Homo sapiens
aagacactttctaaatagaagt

SEQ ID NO: 8508952 - DNA, 22 bp, Homo sapiens
aagacactttctaaatagaagt

SEQ ID NO: 8508953 - DNA, 22 bp, Homo sapiens
aagacactgggttaggcacgtg

SEQ ID NO: 8508954 - DNA, 22 bp, Homo sapiens
aagacactgggttaggcacgtg

SEQ ID NO: 8508955 - DNA, 22 bp, Homo sapiens
aagacactgatactctgtgatt

SEQ ID NO: 8508956 - DNA, 22 bp, Homo sapiens
aagaatgttcattaaactgttg

SEQ ID NO: 8508957 - DNA, 22 bp, Homo sapiens
aagacactcattatcactggtt

SEQ ID NO: 8508958 - DNA, 22 bp, Homo sapiens
aagacactgggggctgcagcca

SEQ ID NO: 8508959 - DNA, 22 bp, Homo sapiens
aagacactgggggctgcagcca

SEQ ID NO: 8508960 - DNA, 22 bp, Homo sapiens
aagacagaccacgtgacagggc

SEQ ID NO: 8508961 - DNA, 17 bp, Homo sapiens
aagacagaagccatgag

SEQ ID NO: 8508962 - DNA, 17 bp, Homo sapiens
aagacagaagccatgag

SEQ ID NO: 8508963 - DNA, 22 bp, Homo sapiens
aagacagaccacgtgacagggc

SEQ ID NO: 8508964 - DNA, 22 bp, Homo sapiens
aagacagaccacgtgacagggc

SEQ ID NO: 8508965 - DNA, 22 bp, Homo sapiens
aagacagagactctgcaacagg

SEQ ID NO: 8508966 - DNA, 20 bp, Homo sapiens
aagagcatagtacaggaaga

SEQ ID NO: 8508967 - DNA, 22 bp, Homo sapiens
aagacagagggaagcaatgatg

SEQ ID NO: 8508968 - DNA, 22 bp, Homo sapiens
aagagcatatggttctcaaagc

SEQ ID NO: 8508969 - DNA, 22 bp, Homo sapiens
aagagccctggttgaaaataac

SEQ ID NO: 8508970 - DNA, 20 bp, Homo sapiens
aagagcccgcagggcagtgc

SEQ ID NO: 8508971 - DNA, 22 bp, Homo sapiens
aagaggagaaaggctggctttg

SEQ ID NO: 8508972 - DNA, 22 bp, Homo sapiens
aagaggacttgtgaagatgtac

SEQ ID NO: 8508973 - DNA, 22 bp, Homo sapiens
aagaggacttgtgaagatgtac

SEQ ID NO: 8508974 - DNA, 22 bp, Homo sapiens
aagaggaagtctccatggagag

SEQ ID NO: 8508975 - DNA, 22 bp, Homo sapiens
aagaggaagtctccatggagag

SEQ ID NO: 8508976 - DNA, 22 bp, Homo sapiens
aagagccagtgggaaagtcttg

SEQ ID NO: 8508977 - DNA, 22 bp, Homo sapiens
aagagccaggacagatccagct

SEQ ID NO: 8508978 - DNA, 22 bp, Homo sapiens
aagagccaagcagtcatcaata

SEQ ID NO: 8508979 - DNA, 22 bp, Homo sapiens
aagagcatttggtgagatttga

SEQ ID NO: 8508980 - DNA, 22 bp, Homo sapiens
aagagcatctatttcacagtgg

SEQ ID NO: 8508981 - DNA, 22 bp, Homo sapiens
aagagcatattaatagtggaga

SEQ ID NO: 8508982 - DNA, 22 bp, Homo sapiens
aagagcatctatttcacagtgg

SEQ ID NO: 8508983 - DNA, 22 bp, Homo sapiens
aagagcatctatttcacagtgg

SEQ ID NO: 8508984 - DNA, 22 bp, Homo sapiens
aagagcatcggtggagccccca

SEQ ID NO: 8508985 - DNA, 22 bp, Homo sapiens
aagaaagtgggtaatatgattt

SEQ ID NO: 8508986 - DNA, 22 bp, Homo sapiens
aagaaagtgggtaatatgattt

SEQ ID NO: 8508987 - DNA, 22 bp, Homo sapiens
aagaaagtgtggagagcctagc

SEQ ID NO: 8508988 - DNA, 22 bp, Homo sapiens
aagaaagtgctttgtaaattat

SEQ ID NO: 8508989 - DNA, 22 bp, Homo sapiens
aagaaagtgatgagctacagat

SEQ ID NO: 8508990 - DNA, 22 bp, Homo sapiens
aagaaagtgatgagctacagat

SEQ ID NO: 8508991 - DNA, 22 bp, Homo sapiens
aagaaagtgctttgtaaattat

SEQ ID NO: 8508992 - DNA, 22 bp, Homo sapiens
aagaaagggctattgttctcca

SEQ ID NO: 8508993 - DNA, 22 bp, Homo sapiens
aagaaagggctattgttctcca

SEQ ID NO: 8508994 - DNA, 23 bp, Homo sapiens
aagaatgcttctgaagagctgcc

SEQ ID NO: 8508995 - DNA, 22 bp, Homo sapiens
aagaatgtctctggtgaggcgc

SEQ ID NO: 8508996 - DNA, 22 bp, Homo sapiens
aagaatgtctctggtgaggcgc

SEQ ID NO: 8508997 - DNA, 22 bp, Homo sapiens
aagaatgtcgttggtattttaa

SEQ ID NO: 8508998 - DNA, 22 bp, Homo sapiens
aagaatgtcgttggtattttaa

SEQ ID NO: 8508999 - DNA, 22 bp, Homo sapiens
aagaatgtcaagcagaaggtct

SEQ ID NO: 8509000 - DNA, 22 bp, Homo sapiens
aagaatgtgggtggatatgatg

SEQ ID NO: 8509001 - DNA, 22 bp, Homo sapiens
aagaatgtgggtggatatgatg

SEQ ID NO: 8509002 - DNA, 22 bp, Homo sapiens
aagaatgtgggtggatatgatg

SEQ ID NO: 8509003 - DNA, 22 bp, Homo sapiens
aagaatgtgggtggatatgatg

SEQ ID NO: 8509004 - DNA, 22 bp, Homo sapiens
aagaatgtggcatttatttata

SEQ ID NO: 8509005 - DNA, 22 bp, Homo sapiens
aagaatgtgctaatgaaaactt

SEQ ID NO: 8509006 - DNA, 22 bp, Homo sapiens
aagaatgtggcatttatttata

SEQ ID NO: 8509007 - DNA, 22 bp, Homo sapiens
aagaatgagctcaaagatctta

SEQ ID NO: 8509008 - DNA, 22 bp, Homo sapiens
aagaatgagctcaaagatctta

SEQ ID NO: 8509009 - DNA, 22 bp, Homo sapiens
aagaatgattacaaagcaacga

SEQ ID NO: 8509010 - DNA, 22 bp, Homo sapiens
aagaatgagctcaaagatctta

SEQ ID NO: 8509011 - DNA, 22 bp, Homo sapiens
aactttctttgcatctaagttt

SEQ ID NO: 8509012 - DNA, 22 bp, Homo sapiens
aactttcttgtgacatttgggg

SEQ ID NO: 8509013 - DNA, 22 bp, Homo sapiens
aacttggctaccagcgttaaat

SEQ ID NO: 8509014 - DNA, 23 bp, Homo sapiens
aactttgccaggagacagcacag

SEQ ID NO: 8509015 - DNA, 22 bp, Homo sapiens
aactttgttttattcactgctg

SEQ ID NO: 8509016 - DNA, 22 bp, Homo sapiens
aactttgttttattcactgctg

SEQ ID NO: 8509017 - DNA, 22 bp, Homo sapiens
aactttttctgggatggagggt

SEQ ID NO: 8509018 - DNA, 22 bp, Homo sapiens
aacttttgtccgatctcctgga

SEQ ID NO: 8509019 - DNA, 22 bp, Homo sapiens
aacttttacaaattgtcatcat

SEQ ID NO: 8509020 - DNA, 22 bp, Homo sapiens
aacttttaaaatacacagacaa

SEQ ID NO: 8509021 - DNA, 22 bp, Homo sapiens
aacttttcattgaatcatgtca

SEQ ID NO: 8509022 - DNA, 22 bp, Homo sapiens
aacttttcattgaatcatgtca

SEQ ID NO: 8509023 - DNA, 22 bp, Homo sapiens
aacttttcacaggctagctctt

SEQ ID NO: 8509024 - DNA, 22 bp, Homo sapiens
aacttttcataagggcaaattt

SEQ ID NO: 8509025 - DNA, 22 bp, Homo sapiens
aacttttcattccaaaggtgct

SEQ ID NO: 8509026 - DNA, 22 bp, Homo sapiens
aagaggagacttcagcaacttg

SEQ ID NO: 8509027 - DNA, 22 bp, Homo sapiens
aagaggaggacggttcccagaa

SEQ ID NO: 8509028 - DNA, 22 bp, Homo sapiens
aagaggaggacggttcccagaa

SEQ ID NO: 8509029 - DNA, 18 bp, Homo sapiens
aagaggaggaaacccagg

SEQ ID NO: 8509030 - DNA, 18 bp, Homo sapiens
aagaggaggagcaggttg

SEQ ID NO: 8509031 - DNA, 18 bp, Homo sapiens
aagaggaggagcaggttg

SEQ ID NO: 8509032 - DNA, 22 bp, Homo sapiens
aagattctcagagtgaaagaat

SEQ ID NO: 8509033 - DNA, 22 bp, Homo sapiens
aagattctccctgagatattta

SEQ ID NO: 8509034 - DNA, 22 bp, Homo sapiens
aagcaaagtgctttgcctccag

SEQ ID NO: 8509035 - DNA, 22 bp, Homo sapiens
aagcaaagtgaattttgccaag

SEQ ID NO: 8509036 - DNA, 22 bp, Homo sapiens
aagcaaaggcaggagcttgtga

SEQ ID NO: 8509037 - DNA, 22 bp, Homo sapiens
aagcaaagagtttagtgggtga

SEQ ID NO: 8509038 - DNA, 22 bp, Homo sapiens
aagcaaaggaaagctgactttt

SEQ ID NO: 8509039 - DNA, 22 bp, Homo sapiens
aagcaaaggaaagctgactttt

SEQ ID NO: 8509040 - DNA, 22 bp, Homo sapiens
aagcaaatgtgggtgcagaatt

SEQ ID NO: 8509041 - DNA, 22 bp, Homo sapiens
aagcaacagaaacattctaata

SEQ ID NO: 8509042 - DNA, 22 bp, Homo sapiens
aagcaaatgtgggtgcagaatt

SEQ ID NO: 8509043 - DNA, 22 bp, Homo sapiens
aaatatcttaggagtatatgag

SEQ ID NO: 8509044 - DNA, 22 bp, Homo sapiens
aaatatcttaggagtatatgag

SEQ ID NO: 8509045 - DNA, 22 bp, Homo sapiens
aaatatcttaggagtatatgag

SEQ ID NO: 8509046 - DNA, 22 bp, Homo sapiens
aaatatgaatgataagagttat

SEQ ID NO: 8509047 - DNA, 22 bp, Homo sapiens
aaatatgaatgataagagttat

SEQ ID NO: 8509048 - DNA, 22 bp, Homo sapiens
aaatatgaatgataagagttat

SEQ ID NO: 8509049 - DNA, 17 bp, Homo sapiens
aaatatgacctcaaagt

SEQ ID NO: 8509050 - DNA, 17 bp, Homo sapiens
aaatatgacctcaaagt

SEQ ID NO: 8509051 - DNA, 22 bp, Homo sapiens
aagcacctgcaccggtcgcctt

SEQ ID NO: 8509052 - DNA, 22 bp, Homo sapiens
aagcacagctggaacagcagga

SEQ ID NO: 8509053 - DNA, 22 bp, Homo sapiens
aagcacctgcagttgacaaaaa

SEQ ID NO: 8509054 - DNA, 22 bp, Homo sapiens
aagcacctgggttatatcttag

SEQ ID NO: 8509055 - DNA, 22 bp, Homo sapiens
aagcacctgggttatatcttag

SEQ ID NO: 8509056 - DNA, 22 bp, Homo sapiens
aagcacagctggaacagcagga

SEQ ID NO: 8509057 - DNA, 22 bp, Homo sapiens
aagcacagctggaacagcagga

SEQ ID NO: 8509058 - DNA, 22 bp, Homo sapiens
aaatatgactagaatgccaggt

SEQ ID NO: 8509059 - DNA, 22 bp, Homo sapiens
aaatatgactagaatgccaggt

SEQ ID NO: 8509060 - DNA, 17 bp, Homo sapiens
aaatatgacctcaaagt

SEQ ID NO: 8509061 - DNA, 22 bp, Homo sapiens
aaatatcatttataacttttaa

SEQ ID NO: 8509062 - DNA, 22 bp, Homo sapiens
aaatatcattctggtgcacaga

SEQ ID NO: 8509063 - DNA, 22 bp, Homo sapiens
aaatatcattctggtgcacaga

SEQ ID NO: 8509064 - DNA, 22 bp, Homo sapiens
aaatatcattctggtgcacaga

SEQ ID NO: 8509065 - DNA, 22 bp, Homo sapiens
aaatatcatttataacttttaa

SEQ ID NO: 8509066 - DNA, 22 bp, Homo sapiens
aaatatcatttataacttttaa

SEQ ID NO: 8509067 - DNA, 22 bp, Homo sapiens
aagcaactaaggcaaggaaatg

SEQ ID NO: 8509068 - DNA, 22 bp, Homo sapiens
aagcaactcctaggaggaaagg

SEQ ID NO: 8509069 - DNA, 22 bp, Homo sapiens
aagcaacattctctgtggcatt

SEQ ID NO: 8509070 - DNA, 19 bp, Homo sapiens
aaatatcagagagatgata

SEQ ID NO: 8509071 - DNA, 22 bp, Homo sapiens
aagcaactgttgaattggacta

SEQ ID NO: 8509072 - DNA, 22 bp, Homo sapiens
aagcagaaaaactgagctccaa

SEQ ID NO: 8509073 - DNA, 22 bp, Homo sapiens
aagcagaaagaacaactgagtg

SEQ ID NO: 8509074 - DNA, 22 bp, Homo sapiens
aagcagatgggactccaaggca

SEQ ID NO: 8509075 - DNA, 22 bp, Homo sapiens
aagcagatgccaagatttacca

SEQ ID NO: 8509076 - DNA, 22 bp, Homo sapiens
aagcagatctgatagggccctg

SEQ ID NO: 8509077 - DNA, 22 bp, Homo sapiens
aagcagattggggatttccatg

SEQ ID NO: 8509078 - DNA, 22 bp, Homo sapiens
aagcactgggtatagcaatgat

SEQ ID NO: 8509079 - DNA, 22 bp, Homo sapiens
aagcactgtgcctcatatctga

SEQ ID NO: 8509080 - DNA, 22 bp, Homo sapiens
aagcacttagaagagtgcctgc

SEQ ID NO: 8509081 - DNA, 22 bp, Homo sapiens
aagcactttagtgagaataagg

SEQ ID NO: 8509082 - DNA, 22 bp, Homo sapiens
aagcactgggaggaggctgaga

SEQ ID NO: 8509083 - DNA, 22 bp, Homo sapiens
aagcactgaggaaaaatttgat

SEQ ID NO: 8509084 - DNA, 22 bp, Homo sapiens
aagcactaatattttggcacct

SEQ ID NO: 8509085 - DNA, 22 bp, Homo sapiens
aagcactgagcacagtggctga

SEQ ID NO: 8509086 - DNA, 22 bp, Homo sapiens
aagcactgagcacagtggctga

SEQ ID NO: 8509087 - DNA, 23 bp, Homo sapiens
aagcatggttcacagttagtact

SEQ ID NO: 8509088 - DNA, 23 bp, Homo sapiens
aagcatggttcacagttagtact

SEQ ID NO: 8509089 - DNA, 22 bp, Homo sapiens
aagcagcagcctgaagtacgtc

SEQ ID NO: 8509090 - DNA, 22 bp, Homo sapiens
aagccagattccttaagcacag

SEQ ID NO: 8509091 - DNA, 22 bp, Homo sapiens
aagccagattccttaagcacag

SEQ ID NO: 8509092 - DNA, 22 bp, Homo sapiens
aagccagatagaagaactcatt

SEQ ID NO: 8509093 - DNA, 18 bp, Homo sapiens
aagccagagaccactgcc

SEQ ID NO: 8509094 - DNA, 22 bp, Homo sapiens
aagccagagtttttgagaactt

SEQ ID NO: 8509095 - DNA, 22 bp, Homo sapiens
aagccagagtttttgagaactt

SEQ ID NO: 8509096 - DNA, 22 bp, Homo sapiens
aagccactgttttggagtgctt

SEQ ID NO: 8509097 - DNA, 22 bp, Homo sapiens
aagccacttggggaaagatgga

SEQ ID NO: 8509098 - DNA, 22 bp, Homo sapiens
aagccacttggggaaagatgga

SEQ ID NO: 8509099 - DNA, 22 bp, Homo sapiens
aagccacagatcgttctgtcac

SEQ ID NO: 8509100 - DNA, 22 bp, Homo sapiens
aagccactgcagcaggagctgc

SEQ ID NO: 8509101 - DNA, 22 bp, Homo sapiens
aagccactattaaataatgatt

SEQ ID NO: 8509102 - DNA, 22 bp, Homo sapiens
agcctggtttaagcattttata

SEQ ID NO: 8509103 - DNA, 22 bp, Homo sapiens
agcggagctagtttttgtcctc

SEQ ID NO: 8509104 - DNA, 21 bp, Homo sapiens
agcggcagaccctgcatttga

SEQ ID NO: 8509105 - DNA, 23 bp, Homo sapiens
agctaacagatcgacaaagtata

SEQ ID NO: 8509106 - DNA, 22 bp, Homo sapiens
agctaacatggaggaaaaagtt

SEQ ID NO: 8509107 - DNA, 22 bp, Homo sapiens
agctaacatgactagaagcttc

SEQ ID NO: 8509108 - DNA, 22 bp, Homo sapiens
agctaagacttagtgacttagt

SEQ ID NO: 8509109 - DNA, 22 bp, Homo sapiens
agctaagacttagtgacttagt

SEQ ID NO: 8509110 - DNA, 22 bp, Homo sapiens
agcctggtgatatcagtggttt

SEQ ID NO: 8509111 - DNA, 22 bp, Homo sapiens
agcctggtgtggggctgcagag

SEQ ID NO: 8509112 - DNA, 22 bp, Homo sapiens
agcctggtgatatcagtggttt

SEQ ID NO: 8509113 - DNA, 18 bp, Homo sapiens
agcctgggctctgcctgg

SEQ ID NO: 8509114 - DNA, 22 bp, Homo sapiens
agcctggggcacttctccaaac

SEQ ID NO: 8509115 - DNA, 22 bp, Homo sapiens
agcctgggccctgcctcttctc

SEQ ID NO: 8509116 - DNA, 22 bp, Homo sapiens
agcctgggcatgggacgggagg

SEQ ID NO: 8509117 - DNA, 22 bp, Homo sapiens
agcctgggcatgggacgggagg

SEQ ID NO: 8509118 - DNA, 22 bp, Homo sapiens
agctacagtggacaagtgaact

SEQ ID NO: 8509119 - DNA, 22 bp, Homo sapiens
agctacagtcggaaggacagac

SEQ ID NO: 8509120 - DNA, 22 bp, Homo sapiens
agctacagttgccctcagcagg

SEQ ID NO: 8509121 - DNA, 22 bp, Homo sapiens
agctacatgaaattgctgatat

SEQ ID NO: 8509122 - DNA, 22 bp, Homo sapiens
agctacctgatccttcttctga

SEQ ID NO: 8509123 - DNA, 22 bp, Homo sapiens
agctacctggcttatcactgtc

SEQ ID NO: 8509124 - DNA, 22 bp, Homo sapiens
agctagactttccctttccatg

SEQ ID NO: 8509125 - DNA, 22 bp, Homo sapiens
agctagagaatgacagagtctg

SEQ ID NO: 8509126 - DNA, 22 bp, Homo sapiens
agctagaatattgatctgaaat

SEQ ID NO: 8509127 - DNA, 22 bp, Homo sapiens
agctacttccctgtaggaaaca

SEQ ID NO: 8509128 - DNA, 22 bp, Homo sapiens
agctacaacttttccatgagca

SEQ ID NO: 8509129 - DNA, 19 bp, Homo sapiens
agctacagcatggcgaggt

SEQ ID NO: 8509130 - DNA, 20 bp, Homo sapiens
agctacaatgcgaagctggc

SEQ ID NO: 8509131 - DNA, 22 bp, Homo sapiens
agctaaggagcaagtaggagtt

SEQ ID NO: 8509132 - DNA, 22 bp, Homo sapiens
agctaaggtgtcctggaggccc

SEQ ID NO: 8509133 - DNA, 22 bp, Homo sapiens
agctaatgatacatgctccaca

SEQ ID NO: 8509134 - DNA, 22 bp, Homo sapiens
agctaagatttattaaaggccc

SEQ ID NO: 8509135 - DNA, 22 bp, Homo sapiens
agctaaggaactctgtaacacc

SEQ ID NO: 8509136 - DNA, 23 bp, Homo sapiens
agctaaggaagctgaggcacagt

SEQ ID NO: 8509137 - DNA, 22 bp, Homo sapiens
agctaaggacagttgatttaga

SEQ ID NO: 8509138 - DNA, 22 bp, Homo sapiens
agctaaggaatcagaagaggtt

SEQ ID NO: 8509139 - DNA, 23 bp, Homo sapiens
cagatgtgcaactctaggcaatg

SEQ ID NO: 8509140 - DNA, 22 bp, Homo sapiens
cagatgtgcatgatgggaaggg

SEQ ID NO: 8509141 - DNA, 22 bp, Homo sapiens
cagatgtgcctccagggctttg

SEQ ID NO: 8509142 - DNA, 22 bp, Homo sapiens
cagatgtcatttcccatgcagc

SEQ ID NO: 8509143 - DNA, 22 bp, Homo sapiens
cagatgtaatctgacagctgga

SEQ ID NO: 8509144 - DNA, 22 bp, Homo sapiens
cagatgtaattactcaagtcaa

SEQ ID NO: 8509145 - DNA, 22 bp, Homo sapiens
cagatgtaatctgacagctgga

SEQ ID NO: 8509146 - DNA, 22 bp, Homo sapiens
cagatgtacatgaagggcaatg

SEQ ID NO: 8509147 - DNA, 22 bp, Homo sapiens
cagatgtacatgaagggcaatg

SEQ ID NO: 8509148 - DNA, 22 bp, Homo sapiens
cagatgtacatgaagggcaatg

SEQ ID NO: 8509149 - DNA, 22 bp, Homo sapiens
cagatgtacatgaagggcaatg

SEQ ID NO: 8509150 - DNA, 20 bp, Homo sapiens
cagatgggacgtggaggagt

SEQ ID NO: 8509151 - DNA, 20 bp, Homo sapiens
cagatgggacgtggaggagt

SEQ ID NO: 8509152 - DNA, 21 bp, Homo sapiens
cagcaaatcattgggcagact

SEQ ID NO: 8509153 - DNA, 22 bp, Homo sapiens
cagcaaatactactagttttta

SEQ ID NO: 8509154 - DNA, 22 bp, Homo sapiens
cagcaacatatatgaaactgtg

SEQ ID NO: 8509155 - DNA, 22 bp, Homo sapiens
cagatgtggaatgcagcaggct

SEQ ID NO: 8509156 - DNA, 22 bp, Homo sapiens
cagcaacatgtggtagtgtagg

SEQ ID NO: 8509157 - DNA, 22 bp, Homo sapiens
cagcaacatatatgaaactgtg

SEQ ID NO: 8509158 - DNA, 22 bp, Homo sapiens
cagcaacatatatgaaactgtg

SEQ ID NO: 8509159 - DNA, 22 bp, Homo sapiens
cagcaacggaaaatacacatag

SEQ ID NO: 8509160 - DNA, 20 bp, Homo sapiens
cagcaactttggactgagtt

SEQ ID NO: 8509161 - DNA, 22 bp, Homo sapiens
cagcaacttaggcagaacatct

SEQ ID NO: 8509162 - DNA, 21 bp, Homo sapiens
agcctgggaggcggaggttgc

SEQ ID NO: 8509163 - DNA, 21 bp, Homo sapiens
agcctgggaggcggaggttgc

SEQ ID NO: 8509164 - DNA, 21 bp, Homo sapiens
agcctgggaggcggaggttgc

SEQ ID NO: 8509165 - DNA, 22 bp, Homo sapiens
agcctgggcaacaacacagcga

SEQ ID NO: 8509166 - DNA, 22 bp, Homo sapiens
agcctgggcatgggacgggagg

SEQ ID NO: 8509167 - DNA, 22 bp, Homo sapiens
agcctgggcaactccattcact

SEQ ID NO: 8509168 - DNA, 22 bp, Homo sapiens
agcctgggcaacagagcaaaac

SEQ ID NO: 8509169 - DNA, 22 bp, Homo sapiens
agcctggcttagctctctcact

SEQ ID NO: 8509170 - DNA, 22 bp, Homo sapiens
agcctggcttagctctctcact

SEQ ID NO: 8509171 - DNA, 19 bp, Homo sapiens
agcctggctttgctctgct

SEQ ID NO: 8509172 - DNA, 19 bp, Homo sapiens
agcctggctttgctctgct

SEQ ID NO: 8509173 - DNA, 19 bp, Homo sapiens
agcctggctttgctctgct

SEQ ID NO: 8509174 - DNA, 17 bp, Homo sapiens
agcctgggaaggagtga

SEQ ID NO: 8509175 - DNA, 22 bp, Homo sapiens
agcctggccactcagggcctga

SEQ ID NO: 8509176 - DNA, 22 bp, Homo sapiens
agcctggcttaatcctcctttt

SEQ ID NO: 8509177 - DNA, 22 bp, Homo sapiens
agcctggcactgccccatccat

SEQ ID NO: 8509178 - DNA, 22 bp, Homo sapiens
cagcaagaaaattcacatgctc

SEQ ID NO: 8509179 - DNA, 22 bp, Homo sapiens
cagcaagaaaattcacatgctc

SEQ ID NO: 8509180 - DNA, 22 bp, Homo sapiens
agctcctgtggcagctcttctg

SEQ ID NO: 8509181 - DNA, 22 bp, Homo sapiens
agctcctgtggcagctcttctg

SEQ ID NO: 8509182 - DNA, 22 bp, Homo sapiens
agctctgggattctcaggccac

SEQ ID NO: 8509183 - DNA, 22 bp, Homo sapiens
agctcctgtggctgaaagagga

SEQ ID NO: 8509184 - DNA, 20 bp, Homo sapiens
agctcttaagaagaagatga

SEQ ID NO: 8509185 - DNA, 22 bp, Homo sapiens
agctctgtgttcacagcactaa

SEQ ID NO: 8509186 - DNA, 22 bp, Homo sapiens
agctctgtgaagccagcagttc

SEQ ID NO: 8509187 - DNA, 22 bp, Homo sapiens
agctctgggccaggaaccctaa

SEQ ID NO: 8509188 - DNA, 22 bp, Homo sapiens
agctcttatctctaagcacagc

SEQ ID NO: 8509189 - DNA, 22 bp, Homo sapiens
agctcctgtagtacatattatt

SEQ ID NO: 8509190 - DNA, 22 bp, Homo sapiens
agctcctgtctcaagggagcct

SEQ ID NO: 8509191 - DNA, 18 bp, Homo sapiens
agctcctggtctcaggga

SEQ ID NO: 8509192 - DNA, 22 bp, Homo sapiens
agctcctgggggttccaagcag

SEQ ID NO: 8509193 - DNA, 22 bp, Homo sapiens
agctcctggcaaggtcatggtg

SEQ ID NO: 8509194 - DNA, 19 bp, Homo sapiens
agctcctgggctctgggcc

SEQ ID NO: 8509195 - DNA, 19 bp, Homo sapiens
agctcctgggctctgggcc

SEQ ID NO: 8509196 - DNA, 22 bp, Homo sapiens
agctcctgggcacctctttcac

SEQ ID NO: 8509197 - DNA, 22 bp, Homo sapiens
agctcctgggccaagcccatgc

SEQ ID NO: 8509198 - DNA, 22 bp, Homo sapiens
agctccagaagcctgcaaggta

SEQ ID NO: 8509199 - DNA, 22 bp, Homo sapiens
agctccagaagcctgcaaggta

SEQ ID NO: 8509200 - DNA, 22 bp, Homo sapiens
agctccagaagcctgcaaggta

SEQ ID NO: 8509201 - DNA, 22 bp, Homo sapiens
agctccagaggcagtgatgaag

SEQ ID NO: 8509202 - DNA, 22 bp, Homo sapiens
agctccagagccacatccatca

SEQ ID NO: 8509203 - DNA, 22 bp, Homo sapiens
agctccagagtctgaactattc

SEQ ID NO: 8509204 - DNA, 22 bp, Homo sapiens
agctccagagtctgaactattc

SEQ ID NO: 8509205 - DNA, 22 bp, Homo sapiens
agctccagcccatctgctcgtg

SEQ ID NO: 8509206 - DNA, 22 bp, Homo sapiens
agctccagattaattgtaggag

SEQ ID NO: 8509207 - DNA, 22 bp, Homo sapiens
agctccagccctagtacagctg

SEQ ID NO: 8509208 - DNA, 22 bp, Homo sapiens
agctccagccctagtacagctg

SEQ ID NO: 8509209 - DNA, 22 bp, Homo sapiens
agctccagcccatctgctcgtg

SEQ ID NO: 8509210 - DNA, 22 bp, Homo sapiens
agctccagccctagtacagctg

SEQ ID NO: 8509211 - DNA, 22 bp, Homo sapiens
agctccagccgctgatgggttt

SEQ ID NO: 8509212 - DNA, 22 bp, Homo sapiens
agctccagccgctgatgggttt

SEQ ID NO: 8509213 - DNA, 22 bp, Homo sapiens
agctccagccgctgatgggttt

SEQ ID NO: 8509214 - DNA, 22 bp, Homo sapiens
agctagccatgtggctcctgtg

SEQ ID NO: 8509215 - DNA, 22 bp, Homo sapiens
agctagcttagcctgtgaggta

SEQ ID NO: 8509216 - DNA, 22 bp, Homo sapiens
agctaggaaattgaggctgaga

SEQ ID NO: 8509217 - DNA, 22 bp, Homo sapiens
agctaggacaggtagagatggg

SEQ ID NO: 8509218 - DNA, 22 bp, Homo sapiens
agctaggacaggtagagatggg

SEQ ID NO: 8509219 - DNA, 20 bp, Homo sapiens
agctaggagaaagcatggag

SEQ ID NO: 8509220 - DNA, 20 bp, Homo sapiens
agctaggagaaagcatggag

SEQ ID NO: 8509221 - DNA, 20 bp, Homo sapiens
agctaggagaaagcatggag

SEQ ID NO: 8509222 - DNA, 19 bp, Homo sapiens
agctcaggcccatcgtccc

SEQ ID NO: 8509223 - DNA, 19 bp, Homo sapiens
agctcaggcccatcgtccc

SEQ ID NO: 8509224 - DNA, 23 bp, Homo sapiens
agctccagaacatagcacaggaa

SEQ ID NO: 8509225 - DNA, 23 bp, Homo sapiens
agctccagaacatagcacaggaa

SEQ ID NO: 8509226 - DNA, 23 bp, Homo sapiens
agctccagaacatagcacaggaa

SEQ ID NO: 8509227 - DNA, 21 bp, Homo sapiens
agctccaggctcctggggttc

SEQ ID NO: 8509228 - DNA, 21 bp, Homo sapiens
agctccaggctcctggggttc

SEQ ID NO: 8509229 - DNA, 22 bp, Homo sapiens
agctccaggccttgggccccgg

SEQ ID NO: 8509230 - DNA, 22 bp, Homo sapiens
agctccaggccttgggccccgg

SEQ ID NO: 8509231 - DNA, 22 bp, Homo sapiens
agctccagggaaagagtggatc

SEQ ID NO: 8509232 - DNA, 19 bp, Homo sapiens
agctcctgattgtgcctcg

SEQ ID NO: 8509233 - DNA, 22 bp, Homo sapiens
agctcctggaggtgcgcactcg

SEQ ID NO: 8509234 - DNA, 22 bp, Homo sapiens
agctccagcctcttctggaggt

SEQ ID NO: 8509235 - DNA, 22 bp, Homo sapiens
agctccagcctcttctggaggt

SEQ ID NO: 8509236 - DNA, 22 bp, Homo sapiens
agctccagcggatggtcttata

SEQ ID NO: 8509237 - DNA, 23 bp, Homo sapiens
agctccagctgacgtgggcagcc

SEQ ID NO: 8509238 - DNA, 23 bp, Homo sapiens
agctccagctgacgtgggcagcc

SEQ ID NO: 8509239 - DNA, 23 bp, Homo sapiens
agctccagctgacgtgggcagcc

SEQ ID NO: 8509240 - DNA, 19 bp, Homo sapiens
agctccaggcctggatgct

SEQ ID NO: 8509241 - DNA, 19 bp, Homo sapiens
agctccaggcctggatgct

SEQ ID NO: 8509242 - DNA, 22 bp, Homo sapiens
agctccaggatctgaaagttcg

SEQ ID NO: 8509243 - DNA, 22 bp, Homo sapiens
agctccaggatctgaaagttcg

SEQ ID NO: 8509244 - DNA, 22 bp, Homo sapiens
agctccaggcagcattaataaa

SEQ ID NO: 8509245 - DNA, 22 bp, Homo sapiens
agctccaggataagacaggtgc

SEQ ID NO: 8509246 - DNA, 22 bp, Homo sapiens
agctccaggataagacaggtgc

SEQ ID NO: 8509247 - DNA, 22 bp, Homo sapiens
agctccaggataagacaggtgc

SEQ ID NO: 8509248 - DNA, 20 bp, Homo sapiens
agcccatctcccacagctac

SEQ ID NO: 8509249 - DNA, 22 bp, Homo sapiens
agcccagttgctccacgctgca

SEQ ID NO: 8509250 - DNA, 22 bp, Homo sapiens
agcccatggtgtactctgtggc

SEQ ID NO: 8509251 - DNA, 22 bp, Homo sapiens
agcccatggtgtactctgtggc

SEQ ID NO: 8509252 - DNA, 22 bp, Homo sapiens
agccccacactctctctgagaa

SEQ ID NO: 8509253 - DNA, 22 bp, Homo sapiens
agccccacactctctctgagaa

SEQ ID NO: 8509254 - DNA, 22 bp, Homo sapiens
agccccacactctctctgagaa

SEQ ID NO: 8509255 - DNA, 22 bp, Homo sapiens
agcccaggttgaggctgcagtg

SEQ ID NO: 8509256 - DNA, 22 bp, Homo sapiens
agcccaggttgaggctgcagtg

SEQ ID NO: 8509257 - DNA, 22 bp, Homo sapiens
agcccaggttgaggctgcagtg

SEQ ID NO: 8509258 - DNA, 22 bp, Homo sapiens
agcccaggttgaggctgcagtg

SEQ ID NO: 8509259 - DNA, 22 bp, Homo sapiens
agcccagtgggccgaggcgggg

SEQ ID NO: 8509260 - DNA, 22 bp, Homo sapiens
agcccagtgggccgaggcgggg

SEQ ID NO: 8509261 - DNA, 22 bp, Homo sapiens
agcccagtgggccgaggcgggg

SEQ ID NO: 8509262 - DNA, 22 bp, Homo sapiens
agccccaggatgggccgcagga

SEQ ID NO: 8509263 - DNA, 22 bp, Homo sapiens
agccccaggatgggccgcagga

SEQ ID NO: 8509264 - DNA, 22 bp, Homo sapiens
agccccaggatgggccgcagga

SEQ ID NO: 8509265 - DNA, 22 bp, Homo sapiens
agccccagcccctctctcacaa

SEQ ID NO: 8509266 - DNA, 22 bp, Homo sapiens
agccccagtaagggagggcctg

SEQ ID NO: 8509267 - DNA, 22 bp, Homo sapiens
agccccagtaagggagggcctg

SEQ ID NO: 8509268 - DNA, 22 bp, Homo sapiens
agccccagtccgctgcgggcgg

SEQ ID NO: 8509269 - DNA, 22 bp, Homo sapiens
agccccagtccgctgcgggcgg

SEQ ID NO: 8509270 - DNA, 22 bp, Homo sapiens
agccccaggcccggacgcctct

SEQ ID NO: 8509271 - DNA, 22 bp, Homo sapiens
agccccaggcccggacgcctct

SEQ ID NO: 8509272 - DNA, 22 bp, Homo sapiens
agcccagggacagggcggatgt

SEQ ID NO: 8509273 - DNA, 22 bp, Homo sapiens
agcccaggttctaaagccaaac

SEQ ID NO: 8509274 - DNA, 22 bp, Homo sapiens
agcccaggttgaggctgcagtg

SEQ ID NO: 8509275 - DNA, 22 bp, Homo sapiens
agccagtttaagcaggaggggt

SEQ ID NO: 8509276 - DNA, 22 bp, Homo sapiens
agccagttggctatgaggagga

SEQ ID NO: 8509277 - DNA, 22 bp, Homo sapiens
agccagtgtcgtgtgacatgag

SEQ ID NO: 8509278 - DNA, 22 bp, Homo sapiens
cagagctctatgttcatggagg

SEQ ID NO: 8509279 - DNA, 22 bp, Homo sapiens
agccagtgccagtcatgcctgc

SEQ ID NO: 8509280 - DNA, 22 bp, Homo sapiens
agccagtgcaacagcagtgaag

SEQ ID NO: 8509281 - DNA, 22 bp, Homo sapiens
agccctggcccggctgtgcttt

SEQ ID NO: 8509282 - DNA, 22 bp, Homo sapiens
agccctggcccggctgtgcttt

SEQ ID NO: 8509283 - DNA, 22 bp, Homo sapiens
agccctggcccggctgtgcttt

SEQ ID NO: 8509284 - DNA, 22 bp, Homo sapiens
agccctgggaggccagcttgta

SEQ ID NO: 8509285 - DNA, 22 bp, Homo sapiens
agccctgggaggccagcttgta

SEQ ID NO: 8509286 - DNA, 22 bp, Homo sapiens
agccctgggctgtagataagca

SEQ ID NO: 8509287 - DNA, 22 bp, Homo sapiens
cagatgaagatcatagaatagt

SEQ ID NO: 8509288 - DNA, 20 bp, Homo sapiens
cagatggcacgtcagggcat

SEQ ID NO: 8509289 - DNA, 22 bp, Homo sapiens
cagatgaagtaggtgacgagca

SEQ ID NO: 8509290 - DNA, 22 bp, Homo sapiens
cagatgaagatcatagaatagt

SEQ ID NO: 8509291 - DNA, 22 bp, Homo sapiens
cagatgaaggcctgaatgtcta

SEQ ID NO: 8509292 - DNA, 22 bp, Homo sapiens
agccctgggcgttactgggatg

SEQ ID NO: 8509293 - DNA, 22 bp, Homo sapiens
cagatggctgccaagatgggct

SEQ ID NO: 8509294 - DNA, 22 bp, Homo sapiens
cagatggctgccttcttgctgt

SEQ ID NO: 8509295 - DNA, 22 bp, Homo sapiens
cagatggccagaggcagctgca

SEQ ID NO: 8509296 - DNA, 22 bp, Homo sapiens
cagatggcagggcagctctgca

SEQ ID NO: 8509297 - DNA, 22 bp, Homo sapiens
agccctgattaaccttggcttt

SEQ ID NO: 8509298 - DNA, 22 bp, Homo sapiens
agccctgcgtgccaggggactg

SEQ ID NO: 8509299 - DNA, 22 bp, Homo sapiens
agcccccaaaagtgcttatgat

SEQ ID NO: 8509300 - DNA, 22 bp, Homo sapiens
agccctgagccagcctggtcag

SEQ ID NO: 8509301 - DNA, 22 bp, Homo sapiens
agccctgagctggcctgggctt

SEQ ID NO: 8509302 - DNA, 17 bp, Homo sapiens
agcccccactcccaagt

SEQ ID NO: 8509303 - DNA, 17 bp, Homo sapiens
agcccccactcccaagt

SEQ ID NO: 8509304 - DNA, 22 bp, Homo sapiens
agcccccaaaagtgcttatgat

SEQ ID NO: 8509305 - DNA, 22 bp, Homo sapiens
agccctggaagccacagtccta

SEQ ID NO: 8509306 - DNA, 22 bp, Homo sapiens
agccctggattctgaggtccaa

SEQ ID NO: 8509307 - DNA, 22 bp, Homo sapiens
agccctggcagagccaggtagt

SEQ ID NO: 8509308 - DNA, 22 bp, Homo sapiens
agccaggccagctgtcttgagt

SEQ ID NO: 8509309 - DNA, 22 bp, Homo sapiens
agccaggccagactcacaccct

SEQ ID NO: 8509310 - DNA, 22 bp, Homo sapiens
agccaggccagactcacaccct

SEQ ID NO: 8509311 - DNA, 22 bp, Homo sapiens
agccaggccttagggagaggca

SEQ ID NO: 8509312 - DNA, 20 bp, Homo sapiens
agccaggcctcaagttaagt

SEQ ID NO: 8509313 - DNA, 21 bp, Homo sapiens
cagagcctgtgttgacagttg

SEQ ID NO: 8509314 - DNA, 22 bp, Homo sapiens
cagagcctggcgatgtcatgga

SEQ ID NO: 8509315 - DNA, 22 bp, Homo sapiens
cagagcctggcgatgtcatgga

SEQ ID NO: 8509316 - DNA, 22 bp, Homo sapiens
cagagccattatggagacttgc

SEQ ID NO: 8509317 - DNA, 19 bp, Homo sapiens
cagagccttcagtgactcc

SEQ ID NO: 8509318 - DNA, 22 bp, Homo sapiens
cagagccttagttctcctagaa

SEQ ID NO: 8509319 - DNA, 22 bp, Homo sapiens
cagagcggccactagagggcgc

SEQ ID NO: 8509320 - DNA, 22 bp, Homo sapiens
cagagccttcctagcagactct

SEQ ID NO: 8509321 - DNA, 22 bp, Homo sapiens
cagagccttcctagcagactct

SEQ ID NO: 8509322 - DNA, 22 bp, Homo sapiens
cagagctcagagcagggcactc

SEQ ID NO: 8509323 - DNA, 22 bp, Homo sapiens
cagagctcagagcagggcactc

SEQ ID NO: 8509324 - DNA, 22 bp, Homo sapiens
cagagctcagagctgccaggca

SEQ ID NO: 8509325 - DNA, 22 bp, Homo sapiens
cagagctcagagctgccaggca

SEQ ID NO: 8509326 - DNA, 22 bp, Homo sapiens
cagagacccttctcagtggcca

SEQ ID NO: 8509327 - DNA, 22 bp, Homo sapiens
cagagacccttctcagtggcca

SEQ ID NO: 8509328 - DNA, 22 bp, Homo sapiens
agccaggcagggctctcgctct

SEQ ID NO: 8509329 - DNA, 22 bp, Homo sapiens
agccaggccagactcacaccct

SEQ ID NO: 8509330 - DNA, 17 bp, Homo sapiens
agccaggcatatgaagt

SEQ ID NO: 8509331 - DNA, 22 bp, Homo sapiens
cagagaccccgctgcccttctg

SEQ ID NO: 8509332 - DNA, 22 bp, Homo sapiens
cagagaccctaggcaggtgaca

SEQ ID NO: 8509333 - DNA, 22 bp, Homo sapiens
cagagaccctaggcaggtgaca

SEQ ID NO: 8509334 - DNA, 20 bp, Homo sapiens
cagagacccaggcttcagct

SEQ ID NO: 8509335 - DNA, 20 bp, Homo sapiens
cagagacccaggcttcagct

SEQ ID NO: 8509336 - DNA, 22 bp, Homo sapiens
cagagaccccgctgcccttctg

SEQ ID NO: 8509337 - DNA, 22 bp, Homo sapiens
cagagacatgtggcctgcacgt

SEQ ID NO: 8509338 - DNA, 22 bp, Homo sapiens
cagagacattaagtgccatgat

SEQ ID NO: 8509339 - DNA, 22 bp, Homo sapiens
cagagacattaagtgccatgat

SEQ ID NO: 8509340 - DNA, 22 bp, Homo sapiens
cagagacattaagtgccatgat

SEQ ID NO: 8509341 - DNA, 22 bp, Homo sapiens
cagagacatgtggcctgcacgt

SEQ ID NO: 8509342 - DNA, 22 bp, Homo sapiens
cagagaactccagtggctggcg

SEQ ID NO: 8509343 - DNA, 22 bp, Homo sapiens
cagagaacattcagagctgtag

SEQ ID NO: 8509344 - DNA, 17 bp, Homo sapiens
agccagcagtagctggt

SEQ ID NO: 8509345 - DNA, 17 bp, Homo sapiens
agccagcagtagctggt

SEQ ID NO: 8509346 - DNA, 22 bp, Homo sapiens
agccagcaggtgagtgcagcct

SEQ ID NO: 8509347 - DNA, 22 bp, Homo sapiens
agccagcaggtgagtgcagcct

SEQ ID NO: 8509348 - DNA, 22 bp, Homo sapiens
agccagcaggtgagtgcagcct

SEQ ID NO: 8509349 - DNA, 22 bp, Homo sapiens
agccagcaggtgagtgcagcct

SEQ ID NO: 8509350 - DNA, 22 bp, Homo sapiens
agccagcaggtgcagaattcca

SEQ ID NO: 8509351 - DNA, 22 bp, Homo sapiens
agccagcaggtgcagaattcca

SEQ ID NO: 8509352 - DNA, 22 bp, Homo sapiens
agccagcagggcttagaggaca

SEQ ID NO: 8509353 - DNA, 22 bp, Homo sapiens
agccagcagggcttagaggaca

SEQ ID NO: 8509354 - DNA, 22 bp, Homo sapiens
agccagcagggcttagaggaca

SEQ ID NO: 8509355 - DNA, 22 bp, Homo sapiens
agccagcagggcttagaggaca

SEQ ID NO: 8509356 - DNA, 22 bp, Homo sapiens
agccagcaggaacgtctaggtt

SEQ ID NO: 8509357 - DNA, 19 bp, Homo sapiens
agccagcaggcctctgagc

SEQ ID NO: 8509358 - DNA, 19 bp, Homo sapiens
agccagcagcgtagcatct

SEQ ID NO: 8509359 - DNA, 22 bp, Homo sapiens
agccagcaggaacgtctaggtt

SEQ ID NO: 8509360 - DNA, 22 bp, Homo sapiens
agccagcatgaagacagaggcc

SEQ ID NO: 8509361 - DNA, 22 bp, Homo sapiens
agccagcatcttgcttcttgag

SEQ ID NO: 8509362 - DNA, 22 bp, Homo sapiens
agccagcatcttgcttcttgag

SEQ ID NO: 8509363 - DNA, 22 bp, Homo sapiens
agccagcatgaagacagaggcc

SEQ ID NO: 8509364 - DNA, 22 bp, Homo sapiens
agccagcatcccttcagtctcc

SEQ ID NO: 8509365 - DNA, 22 bp, Homo sapiens
agccagcatcttgcttcttgag

SEQ ID NO: 8509366 - DNA, 20 bp, Homo sapiens
agccagccacttcctgctcc

SEQ ID NO: 8509367 - DNA, 22 bp, Homo sapiens
agccagcatgaagacagaggcc

SEQ ID NO: 8509368 - DNA, 22 bp, Homo sapiens
agccagccagttcactaggaaa

SEQ ID NO: 8509369 - DNA, 22 bp, Homo sapiens
agccagccgggggaccacagtg

SEQ ID NO: 8509370 - DNA, 22 bp, Homo sapiens
agccagccgggggaccacagtg

SEQ ID NO: 8509371 - DNA, 22 bp, Homo sapiens
agccagccgggggaccacagtg

SEQ ID NO: 8509372 - DNA, 22 bp, Homo sapiens
agccagctaagggaagcatgat

SEQ ID NO: 8509373 - DNA, 22 bp, Homo sapiens
agccagctaccggggctcctgg

SEQ ID NO: 8509374 - DNA, 22 bp, Homo sapiens
agccagctaagggaagcatgat

SEQ ID NO: 8509375 - DNA, 22 bp, Homo sapiens
agccagcacggcgccatggagt

SEQ ID NO: 8509376 - DNA, 22 bp, Homo sapiens
agccagcacggatttcccagga

SEQ ID NO: 8509377 - DNA, 22 bp, Homo sapiens
agccagcactttttctctgggc

SEQ ID NO: 8509378 - DNA, 22 bp, Homo sapiens
agccagcactttttctctgggc

SEQ ID NO: 8509379 - DNA, 22 bp, Homo sapiens
agccagcacggcgccatggagt

SEQ ID NO: 8509380 - DNA, 22 bp, Homo sapiens
agccagcacggcgccatggagt

SEQ ID NO: 8509381 - DNA, 21 bp, Homo sapiens
agccagcaacacagcatctcc

SEQ ID NO: 8509382 - DNA, 22 bp, Homo sapiens
agccagagagtgttggagatgt

SEQ ID NO: 8509383 - DNA, 22 bp, Homo sapiens
agccagagagtgttggagatgt

SEQ ID NO: 8509384 - DNA, 19 bp, Homo sapiens
agccagagtggcccagggg

SEQ ID NO: 8509385 - DNA, 22 bp, Homo sapiens
cactttctcatgaatttggccc

SEQ ID NO: 8509386 - DNA, 19 bp, Homo sapiens
cactttatttctgttttgt

SEQ ID NO: 8509387 - DNA, 22 bp, Homo sapiens
cactttattataaatttgagag

SEQ ID NO: 8509388 - DNA, 19 bp, Homo sapiens
cactttatttctgttttgt

SEQ ID NO: 8509389 - DNA, 22 bp, Homo sapiens
cactttatatgcattacctcat

SEQ ID NO: 8509390 - DNA, 22 bp, Homo sapiens
cactttataaaattggtgtgag

SEQ ID NO: 8509391 - DNA, 22 bp, Homo sapiens
cactttatgggaagcaaaaatt

SEQ ID NO: 8509392 - DNA, 22 bp, Homo sapiens
cactttatattctaagacggcc

SEQ ID NO: 8509393 - DNA, 17 bp, Homo sapiens
agcactaaaatgcttcc

SEQ ID NO: 8509394 - DNA, 22 bp, Homo sapiens
agcaccttgctcttggccttcc

SEQ ID NO: 8509395 - DNA, 22 bp, Homo sapiens
agcaccttgatcttggacttcc

SEQ ID NO: 8509396 - DNA, 22 bp, Homo sapiens
agcaccttcacaggctctcagg

SEQ ID NO: 8509397 - DNA, 22 bp, Homo sapiens
agcacctgtggctcatgctcgt

SEQ ID NO: 8509398 - DNA, 22 bp, Homo sapiens
agcacctgtggctcatgctcgt

SEQ ID NO: 8509399 - DNA, 20 bp, Homo sapiens
agcacctgtgtagaagcatc

SEQ ID NO: 8509400 - DNA, 20 bp, Homo sapiens
agcacctgtgtagaagcatc

SEQ ID NO: 8509401 - DNA, 22 bp, Homo sapiens
agcacctgttgcacttcataat

SEQ ID NO: 8509402 - DNA, 21 bp, Homo sapiens
agcaccttacagctataatgg

SEQ ID NO: 8509403 - DNA, 22 bp, Homo sapiens
agcactgctttagagcctctgc

SEQ ID NO: 8509404 - DNA, 22 bp, Homo sapiens
agcactgctttagagcctctgc

SEQ ID NO: 8509405 - DNA, 22 bp, Homo sapiens
agcactgattttgttgcactta

SEQ ID NO: 8509406 - DNA, 22 bp, Homo sapiens
agcactggagtttagtgggatt

SEQ ID NO: 8509407 - DNA, 20 bp, Homo sapiens
agcactgtctgaccagtggc

SEQ ID NO: 8509408 - DNA, 22 bp, Homo sapiens
agcactgggaacgcatggggcc

SEQ ID NO: 8509409 - DNA, 22 bp, Homo sapiens
agcactgggaacgcatggggcc

SEQ ID NO: 8509410 - DNA, 22 bp, Homo sapiens
agcactagctttaagcattctg

SEQ ID NO: 8509411 - DNA, 22 bp, Homo sapiens
agcactagagccaaaatttggg

SEQ ID NO: 8509412 - DNA, 22 bp, Homo sapiens
agcactgattttgttgcactta

SEQ ID NO: 8509413 - DNA, 22 bp, Homo sapiens
agcactgatttaaactggattt

SEQ ID NO: 8509414 - DNA, 22 bp, Homo sapiens
caaaggcagttactgaatgaag

SEQ ID NO: 8509415 - DNA, 22 bp, Homo sapiens
caaagggcatggcctgagcact

SEQ ID NO: 8509416 - DNA, 22 bp, Homo sapiens
caaagggcattttagtgaactg

SEQ ID NO: 8509417 - DNA, 22 bp, Homo sapiens
caaagggaaaagccatgtgggc

SEQ ID NO: 8509418 - DNA, 22 bp, Homo sapiens
caaagggaaacgcagtgtcaag

SEQ ID NO: 8509419 - DNA, 22 bp, Homo sapiens
agcacctgtcacaagcagaagg

SEQ ID NO: 8509420 - DNA, 22 bp, Homo sapiens
agcacctgtcacaagcagaagg

SEQ ID NO: 8509421 - DNA, 22 bp, Homo sapiens
agcacctggtctcctggcgctg

SEQ ID NO: 8509422 - DNA, 22 bp, Homo sapiens
agcacctgtcaagtccaggctg

SEQ ID NO: 8509423 - DNA, 19 bp, Homo sapiens
agcacctgtgagagcctgg

SEQ ID NO: 8509424 - DNA, 22 bp, Homo sapiens
agcacctggagggctgggacct

SEQ ID NO: 8509425 - DNA, 22 bp, Homo sapiens
agcacctgcttaatgtgcagtg

SEQ ID NO: 8509426 - DNA, 22 bp, Homo sapiens
caaagggcggctgtcggagggt

SEQ ID NO: 8509427 - DNA, 22 bp, Homo sapiens
caaagggcattttagtgaactg

SEQ ID NO: 8509428 - DNA, 22 bp, Homo sapiens
agcacctgcttaatgtgcagtg

SEQ ID NO: 8509429 - DNA, 22 bp, Homo sapiens
agcaccaggtcgctggcacgct

SEQ ID NO: 8509430 - DNA, 18 bp, Homo sapiens
agcaccagtcactaacag

SEQ ID NO: 8509431 - DNA, 21 bp, Homo sapiens
agcagaggggacatgtttgat

SEQ ID NO: 8509432 - DNA, 16 bp, Homo sapiens
agcagaggtgagtgaa

SEQ ID NO: 8509433 - DNA, 21 bp, Homo sapiens
agcagaggggacatgtttgat

SEQ ID NO: 8509434 - DNA, 21 bp, Homo sapiens
agcagaggggacatgtttgat

SEQ ID NO: 8509435 - DNA, 21 bp, Homo sapiens
agcagaggctgcctggtgact

SEQ ID NO: 8509436 - DNA, 22 bp, Homo sapiens
agcagaggtgtttattatggga

SEQ ID NO: 8509437 - DNA, 22 bp, Homo sapiens
agcagaggtgtttattatggga

SEQ ID NO: 8509438 - DNA, 22 bp, Homo sapiens
agcagaggtttgttggaaacct

SEQ ID NO: 8509439 - DNA, 22 bp, Homo sapiens
agcagagtctgtgtgcacttta

SEQ ID NO: 8509440 - DNA, 22 bp, Homo sapiens
agcagagtctgtgtgcacttta

SEQ ID NO: 8509441 - DNA, 22 bp, Homo sapiens
agcagaggtttgttggaaacct

SEQ ID NO: 8509442 - DNA, 22 bp, Homo sapiens
agcagaggtttgttggaaacct

SEQ ID NO: 8509443 - DNA, 22 bp, Homo sapiens
agcagaggtttgttggaaacct

SEQ ID NO: 8509444 - DNA, 22 bp, Homo sapiens
agcagagtcttcaagggcaggc

SEQ ID NO: 8509445 - DNA, 20 bp, Homo sapiens
agcagagtgcccatcccgga

SEQ ID NO: 8509446 - DNA, 20 bp, Homo sapiens
agcagagtgcccatcccgga

SEQ ID NO: 8509447 - DNA, 20 bp, Homo sapiens
agcagagtgcccatcccgga

SEQ ID NO: 8509448 - DNA, 20 bp, Homo sapiens
agcagagtgcccatcccgga

SEQ ID NO: 8509449 - DNA, 22 bp, Homo sapiens
caagtgactgtgctggcaacat

SEQ ID NO: 8509450 - DNA, 22 bp, Homo sapiens
caataatatcctgtgctgtttg

SEQ ID NO: 8509451 - DNA, 22 bp, Homo sapiens
caataatatcctgtgctgtttg

SEQ ID NO: 8509452 - DNA, 22 bp, Homo sapiens
caataatatcctgtgctgtttg

SEQ ID NO: 8509453 - DNA, 22 bp, Homo sapiens
caataattgctttccagagtta

SEQ ID NO: 8509454 - DNA, 22 bp, Homo sapiens
caataatttacattggatacca

SEQ ID NO: 8509455 - DNA, 20 bp, Homo sapiens
caataatttacttccctatt

SEQ ID NO: 8509456 - DNA, 22 bp, Homo sapiens
agcagaggacagttcttaggaa

SEQ ID NO: 8509457 - DNA, 22 bp, Homo sapiens
agcagaggacagttcttaggaa

SEQ ID NO: 8509458 - DNA, 22 bp, Homo sapiens
agcagaggacagttcttaggaa

SEQ ID NO: 8509459 - DNA, 22 bp, Homo sapiens
agcagaggaggatttagttagg

SEQ ID NO: 8509460 - DNA, 22 bp, Homo sapiens
agcagaggaggatttagttagg

SEQ ID NO: 8509461 - DNA, 21 bp, Homo sapiens
agcagaggcagaatgtatgca

SEQ ID NO: 8509462 - DNA, 21 bp, Homo sapiens
agcagaggcagaatgtatgca

SEQ ID NO: 8509463 - DNA, 21 bp, Homo sapiens
agcagaggcagaatgtatgca

SEQ ID NO: 8509464 - DNA, 21 bp, Homo sapiens
agcagaggcagaatgtatgca

SEQ ID NO: 8509465 - DNA, 21 bp, Homo sapiens
agcagaggctgcctggtgact

SEQ ID NO: 8509466 - DNA, 21 bp, Homo sapiens
agcagaggctgcctggtgact

SEQ ID NO: 8509467 - DNA, 21 bp, Homo sapiens
agcagaggctgcctggtgact

SEQ ID NO: 8509468 - DNA, 22 bp, Homo sapiens
agcagagctattcttgtgcaat

SEQ ID NO: 8509469 - DNA, 22 bp, Homo sapiens
agcagagcggggcctccggaag

SEQ ID NO: 8509470 - DNA, 22 bp, Homo sapiens
agcagagcgcctgctcagaggg

SEQ ID NO: 8509471 - DNA, 22 bp, Homo sapiens
agcagagctgcagtggcctgct

SEQ ID NO: 8509472 - DNA, 22 bp, Homo sapiens
agcagagctgcagtggcctgct

SEQ ID NO: 8509473 - DNA, 22 bp, Homo sapiens
agcagagctgcagtggcctgct

SEQ ID NO: 8509474 - DNA, 22 bp, Homo sapiens
agcagagctgcagtggcctgct

SEQ ID NO: 8509475 - DNA, 22 bp, Homo sapiens
agcactgtgagcaccagcacgc

SEQ ID NO: 8509476 - DNA, 22 bp, Homo sapiens
agcactgtgatttataacattt

SEQ ID NO: 8509477 - DNA, 22 bp, Homo sapiens
agcactgtgatttataacattt

SEQ ID NO: 8509478 - DNA, 22 bp, Homo sapiens
agcagagaccatatagcccaga

SEQ ID NO: 8509479 - DNA, 22 bp, Homo sapiens
agcagagacctggttttgttga

SEQ ID NO: 8509480 - DNA, 19 bp, Homo sapiens
agcagctggaggtggagtg

SEQ ID NO: 8509481 - DNA, 19 bp, Homo sapiens
agcagctggaggtggagtg

SEQ ID NO: 8509482 - DNA, 19 bp, Homo sapiens
agcagctggaggtggagtg

SEQ ID NO: 8509483 - DNA, 17 bp, Homo sapiens
agcagctggcacaggag

SEQ ID NO: 8509484 - DNA, 21 bp, Homo sapiens
agcagctgggcaacatggagg

SEQ ID NO: 8509485 - DNA, 22 bp, Homo sapiens
agcagctggaacatatgaagaa

SEQ ID NO: 8509486 - DNA, 22 bp, Homo sapiens
cacagagcaactcaaatcagct

SEQ ID NO: 8509487 - DNA, 22 bp, Homo sapiens
cacagagcaggggtctgtgtca

SEQ ID NO: 8509488 - DNA, 22 bp, Homo sapiens
cacagagattagaattagacta

SEQ ID NO: 8509489 - DNA, 22 bp, Homo sapiens
cacagagatggtctggcaggtg

SEQ ID NO: 8509490 - DNA, 22 bp, Homo sapiens
cacagagatggtctggcaggtg

SEQ ID NO: 8509491 - DNA, 22 bp, Homo sapiens
cacagagatggtctggcaggtg

SEQ ID NO: 8509492 - DNA, 22 bp, Homo sapiens
cacagagatggtctggcaggtg

SEQ ID NO: 8509493 - DNA, 22 bp, Homo sapiens
cacagagatggccagggcacat

SEQ ID NO: 8509494 - DNA, 22 bp, Homo sapiens
cacagagatggccagggcacat

SEQ ID NO: 8509495 - DNA, 22 bp, Homo sapiens
cacagagatggccagggcacat

SEQ ID NO: 8509496 - DNA, 22 bp, Homo sapiens
agcagctcacaggattcctgaa

SEQ ID NO: 8509497 - DNA, 22 bp, Homo sapiens
agcagctcaacagtgtctctat

SEQ ID NO: 8509498 - DNA, 22 bp, Homo sapiens
agcagctcaacagtgtctctat

SEQ ID NO: 8509499 - DNA, 22 bp, Homo sapiens
agcagctcaaagcctgcaagga

SEQ ID NO: 8509500 - DNA, 22 bp, Homo sapiens
agcagctcatggagtaggcact

SEQ ID NO: 8509501 - DNA, 22 bp, Homo sapiens
agcagcctttgatcatctggga

SEQ ID NO: 8509502 - DNA, 22 bp, Homo sapiens
agcagcctttgatcatctggga

SEQ ID NO: 8509503 - DNA, 22 bp, Homo sapiens
agcagctaagtagcgcagttaa

SEQ ID NO: 8509504 - DNA, 22 bp, Homo sapiens
agcagcctttgatcatctggga

SEQ ID NO: 8509505 - DNA, 22 bp, Homo sapiens
agcagcctttgatcatctggga

SEQ ID NO: 8509506 - DNA, 21 bp, Homo sapiens
agcagccttgtgtgccaggca

SEQ ID NO: 8509507 - DNA, 22 bp, Homo sapiens
cacagagatcggaacagaagta

SEQ ID NO: 8509508 - DNA, 22 bp, Homo sapiens
cacagagatcggaacagaagta

SEQ ID NO: 8509509 - DNA, 22 bp, Homo sapiens
cacagagatggccagggcacat

SEQ ID NO: 8509510 - DNA, 22 bp, Homo sapiens
cacagagatcggaacagaagta

SEQ ID NO: 8509511 - DNA, 21 bp, Homo sapiens
cacagagatattggtgagcct

SEQ ID NO: 8509512 - DNA, 21 bp, Homo sapiens
cacagagatattggtgagcct

SEQ ID NO: 8509513 - DNA, 21 bp, Homo sapiens
cacagagatattggtgagcct

SEQ ID NO: 8509514 - DNA, 22 bp, Homo sapiens
cacagaacatttttagatgcag

SEQ ID NO: 8509515 - DNA, 22 bp, Homo sapiens
cacagagagctacgtgcagcgt

SEQ ID NO: 8509516 - DNA, 21 bp, Homo sapiens
cacagagatattggtgagcct

SEQ ID NO: 8509517 - DNA, 22 bp, Homo sapiens
cacagagaggcttgtctccaag

SEQ ID NO: 8509518 - DNA, 22 bp, Homo sapiens
agcagctcccctcatgctccac

SEQ ID NO: 8509519 - DNA, 22 bp, Homo sapiens
agcagccagagaatgatgcagt

SEQ ID NO: 8509520 - DNA, 22 bp, Homo sapiens
agcagccagagaatgatgcagt

SEQ ID NO: 8509521 - DNA, 23 bp, Homo sapiens
agcagcccaatggcaagctctgg

SEQ ID NO: 8509522 - DNA, 23 bp, Homo sapiens
agcagcccaatggcaagctctgg

SEQ ID NO: 8509523 - DNA, 21 bp, Homo sapiens
agcagcagatctggtgagggc

SEQ ID NO: 8509524 - DNA, 21 bp, Homo sapiens
agcagcagatctggtgagggc

SEQ ID NO: 8509525 - DNA, 22 bp, Homo sapiens
agcagccagaaatccagaggtg

SEQ ID NO: 8509526 - DNA, 22 bp, Homo sapiens
agcagcccagataaagctcagg

SEQ ID NO: 8509527 - DNA, 22 bp, Homo sapiens
agcagcccctcggcgggtgcgc

SEQ ID NO: 8509528 - DNA, 22 bp, Homo sapiens
agcagcccgaggatcatgtgtc

SEQ ID NO: 8509529 - DNA, 22 bp, Homo sapiens
agcagcctctgtagaggtctcc

SEQ ID NO: 8509530 - DNA, 22 bp, Homo sapiens
agcagcctggacttggatgtgg

SEQ ID NO: 8509531 - DNA, 23 bp, Homo sapiens
agcagccctgggacctggcctgc

SEQ ID NO: 8509532 - DNA, 23 bp, Homo sapiens
agcagccctgggacctggcctgc

SEQ ID NO: 8509533 - DNA, 22 bp, Homo sapiens
agcagcctcccagggagcagcc

SEQ ID NO: 8509534 - DNA, 22 bp, Homo sapiens
agcagcctattcttctcttgga

SEQ ID NO: 8509535 - DNA, 22 bp, Homo sapiens
agcagcctattcttctcttgga

SEQ ID NO: 8509536 - DNA, 22 bp, Homo sapiens
agcagcagaggtcagaaaggta

SEQ ID NO: 8509537 - DNA, 22 bp, Homo sapiens
agcagcagaggtcagaaaggta

SEQ ID NO: 8509538 - DNA, 22 bp, Homo sapiens
agcagcagatcaaacaggcttg

SEQ ID NO: 8509539 - DNA, 22 bp, Homo sapiens
agcagcagagctctggtctgca

SEQ ID NO: 8509540 - DNA, 22 bp, Homo sapiens
agcagcagaggtcagaaaggta

SEQ ID NO: 8509541 - DNA, 22 bp, Homo sapiens
agcagcagatcaaacaggcttg

SEQ ID NO: 8509542 - DNA, 22 bp, Homo sapiens
agcagcagatccaaaaaatgtg

SEQ ID NO: 8509543 - DNA, 22 bp, Homo sapiens
agcagcagatccaaaaaatgtg

SEQ ID NO: 8509544 - DNA, 22 bp, Homo sapiens
agcagcagatccaaaaaatgtg

SEQ ID NO: 8509545 - DNA, 19 bp, Homo sapiens
agcagcagaagtgtgcctt

SEQ ID NO: 8509546 - DNA, 22 bp, Homo sapiens
caatacatcaggtcaaaatgtg

SEQ ID NO: 8509547 - DNA, 22 bp, Homo sapiens
caatacatcaggtcaaaatgtg

SEQ ID NO: 8509548 - DNA, 22 bp, Homo sapiens
caatacaattaccagttaatca

SEQ ID NO: 8509549 - DNA, 22 bp, Homo sapiens
caatacaattaccagttaatca

SEQ ID NO: 8509550 - DNA, 22 bp, Homo sapiens
agcagtggacctcagtgctatt

SEQ ID NO: 8509551 - DNA, 22 bp, Homo sapiens
agcagtggacctcagtgctatt

SEQ ID NO: 8509552 - DNA, 22 bp, Homo sapiens
agcagtggacctcagtgctatt

SEQ ID NO: 8509553 - DNA, 22 bp, Homo sapiens
agcagtgatgcatgacagccta

SEQ ID NO: 8509554 - DNA, 22 bp, Homo sapiens
agcagtgaaacagctgcatatg

SEQ ID NO: 8509555 - DNA, 22 bp, Homo sapiens
agcagtgatgcatgacagccta

SEQ ID NO: 8509556 - DNA, 22 bp, Homo sapiens
agcagtgatgaaatgagcatcc

SEQ ID NO: 8509557 - DNA, 22 bp, Homo sapiens
agcatcagagagaagttaacta

SEQ ID NO: 8509558 - DNA, 22 bp, Homo sapiens
agcatattgtctttggtgtctc

SEQ ID NO: 8509559 - DNA, 22 bp, Homo sapiens
agcatataggaaatgttgaatc

SEQ ID NO: 8509560 - DNA, 22 bp, Homo sapiens
agcatataggaaatgttgaatc

SEQ ID NO: 8509561 - DNA, 22 bp, Homo sapiens
agcatattcatgccagactact

SEQ ID NO: 8509562 - DNA, 22 bp, Homo sapiens
agcatattgtatgtctatatgt

SEQ ID NO: 8509563 - DNA, 22 bp, Homo sapiens
agcatattgtatgtctatatgt

SEQ ID NO: 8509564 - DNA, 22 bp, Homo sapiens
agcagtggagcgagatgtttaa

SEQ ID NO: 8509565 - DNA, 19 bp, Homo sapiens
agcagtggagccatgcctg

SEQ ID NO: 8509566 - DNA, 22 bp, Homo sapiens
agcatataggaaatgttgaatc

SEQ ID NO: 8509567 - DNA, 22 bp, Homo sapiens
agcatgaaagcataggacagtc

SEQ ID NO: 8509568 - DNA, 22 bp, Homo sapiens
agcatgaaaggcgtgccaactt

SEQ ID NO: 8509569 - DNA, 22 bp, Homo sapiens
agcatgaaaggcgtgccaactt

SEQ ID NO: 8509570 - DNA, 22 bp, Homo sapiens
agcatgaagacttcagagctag

SEQ ID NO: 8509571 - DNA, 22 bp, Homo sapiens
agcaggtgttggctgggccatc

SEQ ID NO: 8509572 - DNA, 22 bp, Homo sapiens
agcagggctggggcacgagcca

SEQ ID NO: 8509573 - DNA, 22 bp, Homo sapiens
agcaggttgttttgtggccagg

SEQ ID NO: 8509574 - DNA, 22 bp, Homo sapiens
agcaggtttaaactctaatgca

SEQ ID NO: 8509575 - DNA, 22 bp, Homo sapiens
agcagtaagacttttttctgtg

SEQ ID NO: 8509576 - DNA, 22 bp, Homo sapiens
agcagtattctcctgtggtgga

SEQ ID NO: 8509577 - DNA, 22 bp, Homo sapiens
agcagtcattttaggtcatgca

SEQ ID NO: 8509578 - DNA, 22 bp, Homo sapiens
agcatgctgggtcatttttgcc

SEQ ID NO: 8509579 - DNA, 22 bp, Homo sapiens
agcatgcttggcatttgtcaga

SEQ ID NO: 8509580 - DNA, 22 bp, Homo sapiens
agcatgctggtgttcatggcag

SEQ ID NO: 8509581 - DNA, 22 bp, Homo sapiens
agcatgcaggaaccacatggca

SEQ ID NO: 8509582 - DNA, 20 bp, Homo sapiens
agcatgcagccagagccaac

SEQ ID NO: 8509583 - DNA, 22 bp, Homo sapiens
agcatgcatttttggactgtgc

SEQ ID NO: 8509584 - DNA, 23 bp, Homo sapiens
agcatggaataggaaagaggcag

SEQ ID NO: 8509585 - DNA, 22 bp, Homo sapiens
agcatggggcaatgcatgtgct

SEQ ID NO: 8509586 - DNA, 22 bp, Homo sapiens
agcatggggcaatgcatgtgct

SEQ ID NO: 8509587 - DNA, 22 bp, Homo sapiens
agcatggggcaatgcatgtgct

SEQ ID NO: 8509588 - DNA, 22 bp, Homo sapiens
agcatggggctccgcaatgaac

SEQ ID NO: 8509589 - DNA, 22 bp, Homo sapiens
agcatgtaaagctcttagcacc

SEQ ID NO: 8509590 - DNA, 22 bp, Homo sapiens
agcatgtgtggagaaatatttt

SEQ ID NO: 8509591 - DNA, 22 bp, Homo sapiens
cactttactatctataaaataa

SEQ ID NO: 8509592 - DNA, 22 bp, Homo sapiens
cactttactatctataaaataa

SEQ ID NO: 8509593 - DNA, 22 bp, Homo sapiens
cacttaaagtcttagcttacag

SEQ ID NO: 8509594 - DNA, 22 bp, Homo sapiens
cactgtttttatgtaatcagtg

SEQ ID NO: 8509595 - DNA, 22 bp, Homo sapiens
cactgttttcagtcagttctat

SEQ ID NO: 8509596 - DNA, 22 bp, Homo sapiens
cactgtttggctcctgtactta

SEQ ID NO: 8509597 - DNA, 22 bp, Homo sapiens
cactgttttattccaacatagg

SEQ ID NO: 8509598 - DNA, 22 bp, Homo sapiens
cactgttcatcaaaactgctct

SEQ ID NO: 8509599 - DNA, 22 bp, Homo sapiens
cactgttgagcaatgtacagtg

SEQ ID NO: 8509600 - DNA, 19 bp, Homo sapiens
cactgttgtcctagtactt

SEQ ID NO: 8509601 - DNA, 22 bp, Homo sapiens
cactgttgaagatacttcctct

SEQ ID NO: 8509602 - DNA, 22 bp, Homo sapiens
cactgtgtctggagtgagctgg

SEQ ID NO: 8509603 - DNA, 22 bp, Homo sapiens
cactgttattactactatacat

SEQ ID NO: 8509604 - DNA, 22 bp, Homo sapiens
cactgttattactactatacat

SEQ ID NO: 8509605 - DNA, 22 bp, Homo sapiens
cactgttattactactatacat

SEQ ID NO: 8509606 - DNA, 22 bp, Homo sapiens
cactgtgtcagagtatgatgat

SEQ ID NO: 8509607 - DNA, 22 bp, Homo sapiens
cactgtgtaagaagatgggctt

SEQ ID NO: 8509608 - DNA, 22 bp, Homo sapiens
cactgtgtcagtttggttagac

SEQ ID NO: 8509609 - DNA, 22 bp, Homo sapiens
cactgtgtaagaagatgggctt

SEQ ID NO: 8509610 - DNA, 22 bp, Homo sapiens
cactgtgggtcccagactggag

SEQ ID NO: 8509611 - DNA, 19 bp, Homo sapiens
cactgtggtccttcactgc

SEQ ID NO: 8509612 - DNA, 22 bp, Homo sapiens
cactggtgacttctgagctgga

SEQ ID NO: 8509613 - DNA, 22 bp, Homo sapiens
cactggtgagtccagaagtcat

SEQ ID NO: 8509614 - DNA, 22 bp, Homo sapiens
agcagggcactggaaggcactg

SEQ ID NO: 8509615 - DNA, 22 bp, Homo sapiens
agcagggcaaagtcaggctaac

SEQ ID NO: 8509616 - DNA, 22 bp, Homo sapiens
agcagggcagctgatgcgcacg

SEQ ID NO: 8509617 - DNA, 22 bp, Homo sapiens
agcagggcagctgatgcgcacg

SEQ ID NO: 8509618 - DNA, 22 bp, Homo sapiens
agcagggcagctgatgcgcacg

SEQ ID NO: 8509619 - DNA, 22 bp, Homo sapiens
agcagggcaaagtcaggctaac

SEQ ID NO: 8509620 - DNA, 22 bp, Homo sapiens
agcagggcaaagtcaggctaac

SEQ ID NO: 8509621 - DNA, 22 bp, Homo sapiens
agcagggcagcttttttcagaa

SEQ ID NO: 8509622 - DNA, 22 bp, Homo sapiens
agcagggcaggtaaggatcaga

SEQ ID NO: 8509623 - DNA, 22 bp, Homo sapiens
agcagggcaggtaaggatcaga

SEQ ID NO: 8509624 - DNA, 22 bp, Homo sapiens
caccactgtatccctagcactt

SEQ ID NO: 8509625 - DNA, 22 bp, Homo sapiens
cacatttaatcctttataagta

SEQ ID NO: 8509626 - DNA, 22 bp, Homo sapiens
cacatttaatcctttataagta

SEQ ID NO: 8509627 - DNA, 22 bp, Homo sapiens
cacatttaatcctttataagta

SEQ ID NO: 8509628 - DNA, 22 bp, Homo sapiens
cacatttaatcctttataagta

SEQ ID NO: 8509629 - DNA, 22 bp, Homo sapiens
agcagggcagtgatcagaaagg

SEQ ID NO: 8509630 - DNA, 22 bp, Homo sapiens
agcagggcagtgatcagaaagg

SEQ ID NO: 8509631 - DNA, 22 bp, Homo sapiens
caccagctacagactactgtgt

SEQ ID NO: 8509632 - DNA, 22 bp, Homo sapiens
agcagggctctgccatgggccc

SEQ ID NO: 8509633 - DNA, 22 bp, Homo sapiens
caccagctacagactactgtgt

SEQ ID NO: 8509634 - DNA, 22 bp, Homo sapiens
caccagctacagactactgtgt

SEQ ID NO: 8509635 - DNA, 22 bp, Homo sapiens
caccagctaattaaaacagcag

SEQ ID NO: 8509636 - DNA, 22 bp, Homo sapiens
caccagccccctcacgctgtca

SEQ ID NO: 8509637 - DNA, 22 bp, Homo sapiens
caccagccccctcacgctgtca

SEQ ID NO: 8509638 - DNA, 22 bp, Homo sapiens
caccagccagagtgacagctcc

SEQ ID NO: 8509639 - DNA, 22 bp, Homo sapiens
caccagccagagtgacagctcc

SEQ ID NO: 8509640 - DNA, 22 bp, Homo sapiens
agcagggctctgtggagggtgg

SEQ ID NO: 8509641 - DNA, 22 bp, Homo sapiens
agcagggctctgtggagggtgg

SEQ ID NO: 8509642 - DNA, 22 bp, Homo sapiens
agcagggctctgtggagggtgg

SEQ ID NO: 8509643 - DNA, 22 bp, Homo sapiens
agcagggctctgccatgggccc

SEQ ID NO: 8509644 - DNA, 22 bp, Homo sapiens
agcagggctgcagtgtgtcttt

SEQ ID NO: 8509645 - DNA, 22 bp, Homo sapiens
agcagggctgcagtgtgtcttt

SEQ ID NO: 8509646 - DNA, 22 bp, Homo sapiens
caccagcagaagactgagggtg

SEQ ID NO: 8509647 - DNA, 22 bp, Homo sapiens
caccagcagaagactgagggtg

SEQ ID NO: 8509648 - DNA, 22 bp, Homo sapiens
caccagcaccagctctgtgcct

SEQ ID NO: 8509649 - DNA, 22 bp, Homo sapiens
caccagcagcggtgtgagggtg

SEQ ID NO: 8509650 - DNA, 20 bp, Homo sapiens
caccagcagcagctgccacc

SEQ ID NO: 8509651 - DNA, 23 bp, Homo sapiens
caccactttctccttctccttgg

SEQ ID NO: 8509652 - DNA, 22 bp, Homo sapiens
caccagaacaagacaggagaat

SEQ ID NO: 8509653 - DNA, 23 bp, Homo sapiens
caccactttctccttctccttgg

SEQ ID NO: 8509654 - DNA, 22 bp, Homo sapiens
caccagagttgtccaaatgatt

SEQ ID NO: 8509655 - DNA, 22 bp, Homo sapiens
caccagagtgagtggactgtcg

SEQ ID NO: 8509656 - DNA, 22 bp, Homo sapiens
cacagcagagggagccattgaa

SEQ ID NO: 8509657 - DNA, 22 bp, Homo sapiens
cacagcagagggagccattgaa

SEQ ID NO: 8509658 - DNA, 22 bp, Homo sapiens
cacagcagagggagccattgaa

SEQ ID NO: 8509659 - DNA, 22 bp, Homo sapiens
cacagcagatccaggggttgtg

SEQ ID NO: 8509660 - DNA, 22 bp, Homo sapiens
cacagcagacagggaggcggct

SEQ ID NO: 8509661 - DNA, 22 bp, Homo sapiens
cacagcagacagggaggcggct

SEQ ID NO: 8509662 - DNA, 22 bp, Homo sapiens
cacagcagagggagccattgaa

SEQ ID NO: 8509663 - DNA, 22 bp, Homo sapiens
cacagcagaaagtgtaggagga

SEQ ID NO: 8509664 - DNA, 22 bp, Homo sapiens
cacagcagaaatatgaaggcag

SEQ ID NO: 8509665 - DNA, 22 bp, Homo sapiens
cacagcagaaatatgaaggcag

SEQ ID NO: 8509666 - DNA, 22 bp, Homo sapiens
cacagcagaaatatgaaggcag

SEQ ID NO: 8509667 - DNA, 22 bp, Homo sapiens
cacagcagaacttaatttcaaa

SEQ ID NO: 8509668 - DNA, 22 bp, Homo sapiens
cacagcagaacttaatttcaaa

SEQ ID NO: 8509669 - DNA, 22 bp, Homo sapiens
agcagggaggtctagcacgtgg

SEQ ID NO: 8509670 - DNA, 22 bp, Homo sapiens
agcagggaggcggtgtgctggc

SEQ ID NO: 8509671 - DNA, 17 bp, Homo sapiens
agcagggagtcaaggga

SEQ ID NO: 8509672 - DNA, 17 bp, Homo sapiens
agcagggagtcaaggga

SEQ ID NO: 8509673 - DNA, 22 bp, Homo sapiens
agcagggagaccatctcttcct

SEQ ID NO: 8509674 - DNA, 22 bp, Homo sapiens
agcagggaggcccagggcactg

SEQ ID NO: 8509675 - DNA, 22 bp, Homo sapiens
agcaggaactgacaccaagcca

SEQ ID NO: 8509676 - DNA, 22 bp, Homo sapiens
agcagcttgaggctggattcca

SEQ ID NO: 8509677 - DNA, 22 bp, Homo sapiens
agcaggaaggggatgatgggca

SEQ ID NO: 8509678 - DNA, 22 bp, Homo sapiens
agcaggaaggctttgggggttc

SEQ ID NO: 8509679 - DNA, 22 bp, Homo sapiens
agcaggaaggggatgatgggca

SEQ ID NO: 8509680 - DNA, 22 bp, Homo sapiens
agcaggaaggtctgtgtgagtc

SEQ ID NO: 8509681 - DNA, 22 bp, Homo sapiens
agcaggaaggtctgtgtgagtc

SEQ ID NO: 8509682 - DNA, 22 bp, Homo sapiens
agcaggaagtagtctgtaagca

SEQ ID NO: 8509683 - DNA, 22 bp, Homo sapiens
cacagcaagagctaaatgacca

SEQ ID NO: 8509684 - DNA, 22 bp, Homo sapiens
cacagcaagagctaaatgacca

SEQ ID NO: 8509685 - DNA, 17 bp, Homo sapiens
agcaggaccccagagca

SEQ ID NO: 8509686 - DNA, 17 bp, Homo sapiens
agcaggaccccagagca

SEQ ID NO: 8509687 - DNA, 17 bp, Homo sapiens
agcaggaccccagagca

SEQ ID NO: 8509688 - DNA, 22 bp, Homo sapiens
cacagcaatagctaactgatac

SEQ ID NO: 8509689 - DNA, 22 bp, Homo sapiens
cacagcaatagctaactgatac

SEQ ID NO: 8509690 - DNA, 22 bp, Homo sapiens
cacagcaagagctaaatgacca

SEQ ID NO: 8509691 - DNA, 22 bp, Homo sapiens
agcaggacacgatgcggcagga

SEQ ID NO: 8509692 - DNA, 22 bp, Homo sapiens
agcaggacaatatgggatcagg

SEQ ID NO: 8509693 - DNA, 20 bp, Homo sapiens
agcaggaatgatgctttcat

SEQ ID NO: 8509694 - DNA, 20 bp, Homo sapiens
agcaggaatgatgctttcat

SEQ ID NO: 8509695 - DNA, 22 bp, Homo sapiens
agcaggaagtcctctcaggaga

SEQ ID NO: 8509696 - DNA, 22 bp, Homo sapiens
agcaggaatctgttctgtataa

SEQ ID NO: 8509697 - DNA, 22 bp, Homo sapiens
agactgtactttctgcagctct

SEQ ID NO: 8509698 - DNA, 22 bp, Homo sapiens
agactgtagggatagaggtctt

SEQ ID NO: 8509699 - DNA, 22 bp, Homo sapiens
agactgtactttctgcagctct

SEQ ID NO: 8509700 - DNA, 22 bp, Homo sapiens
agactgttaatttcaattaaaa

SEQ ID NO: 8509701 - DNA, 22 bp, Homo sapiens
agactgtgccacacatgggagt

SEQ ID NO: 8509702 - DNA, 22 bp, Homo sapiens
agactgtgagggagatacaggg

SEQ ID NO: 8509703 - DNA, 22 bp, Homo sapiens
agacttctcagttttattagta

SEQ ID NO: 8509704 - DNA, 21 bp, Homo sapiens
agacttctagaagtgagatag

SEQ ID NO: 8509705 - DNA, 21 bp, Homo sapiens
agacttctagaagtgagatag

SEQ ID NO: 8509706 - DNA, 22 bp, Homo sapiens
agacttctaaatagcagcttct

SEQ ID NO: 8509707 - DNA, 18 bp, Homo sapiens
agactttgagttagaggg

SEQ ID NO: 8509708 - DNA, 22 bp, Homo sapiens
agactttgagctcttagagaag

SEQ ID NO: 8509709 - DNA, 23 bp, Homo sapiens
agacttctccaacaagcttggct

SEQ ID NO: 8509710 - DNA, 22 bp, Homo sapiens
agacttcttgagctggcacttc

SEQ ID NO: 8509711 - DNA, 22 bp, Homo sapiens
agactttaatgtgcaaatgaaa

SEQ ID NO: 8509712 - DNA, 22 bp, Homo sapiens
agacttcttgagctggcacttc

SEQ ID NO: 8509713 - DNA, 22 bp, Homo sapiens
agagaaggtcactaaggaccca

SEQ ID NO: 8509714 - DNA, 22 bp, Homo sapiens
agagaaggtcactaaggaccca

SEQ ID NO: 8509715 - DNA, 22 bp, Homo sapiens
agagaaggtcactaaggaccca

SEQ ID NO: 8509716 - DNA, 22 bp, Homo sapiens
agagaagggtgtagcctgggcc

SEQ ID NO: 8509717 - DNA, 22 bp, Homo sapiens
agagaagggtgtagcctgggcc

SEQ ID NO: 8509718 - DNA, 22 bp, Homo sapiens
agagaagggtgtagcctgggcc

SEQ ID NO: 8509719 - DNA, 22 bp, Homo sapiens
agagaatgcagggcttcggaca

SEQ ID NO: 8509720 - DNA, 22 bp, Homo sapiens
agagaatacaaagaagatatgt

SEQ ID NO: 8509721 - DNA, 22 bp, Homo sapiens
agagaagtgagcttgttcactc

SEQ ID NO: 8509722 - DNA, 22 bp, Homo sapiens
agagaatacaaagaagatatgt

SEQ ID NO: 8509723 - DNA, 21 bp, Homo sapiens
agactttgcttgcagagagtc

SEQ ID NO: 8509724 - DNA, 23 bp, Homo sapiens
agagaaaaatatctgggcacatt

SEQ ID NO: 8509725 - DNA, 22 bp, Homo sapiens
agagaaaactcattgaggtgtc

SEQ ID NO: 8509726 - DNA, 22 bp, Homo sapiens
agagaaaactcattgaggtgtc

SEQ ID NO: 8509727 - DNA, 22 bp, Homo sapiens
agagaaaagagttcaggctttg

SEQ ID NO: 8509728 - DNA, 22 bp, Homo sapiens
agagaaaagagttcaggctttg

SEQ ID NO: 8509729 - DNA, 22 bp, Homo sapiens
agagaagggtagcccattctcc

SEQ ID NO: 8509730 - DNA, 22 bp, Homo sapiens
agagaagggtagcccattctcc

SEQ ID NO: 8509731 - DNA, 19 bp, Homo sapiens
agagaaggatcctatggtt

SEQ ID NO: 8509732 - DNA, 22 bp, Homo sapiens
agagagctgtcctgggacaccc

SEQ ID NO: 8509733 - DNA, 22 bp, Homo sapiens
agagagctgtcctgggacaccc

SEQ ID NO: 8509734 - DNA, 22 bp, Homo sapiens
agagagctctggctgggtgacc

SEQ ID NO: 8509735 - DNA, 22 bp, Homo sapiens
agagagctctggctgggtgacc

SEQ ID NO: 8509736 - DNA, 22 bp, Homo sapiens
agagagctctgatgggaggtga

SEQ ID NO: 8509737 - DNA, 23 bp, Homo sapiens
agagagctcactatatagcattg

SEQ ID NO: 8509738 - DNA, 22 bp, Homo sapiens
agagagctctgatgggaggtga

SEQ ID NO: 8509739 - DNA, 23 bp, Homo sapiens
agagagctcactatatagcattg

SEQ ID NO: 8509740 - DNA, 22 bp, Homo sapiens
agagagcccgggccagggcaca

SEQ ID NO: 8509741 - DNA, 22 bp, Homo sapiens
agagagcccgggccagggcaca

SEQ ID NO: 8509742 - DNA, 22 bp, Homo sapiens
agagaggatttgtttttctcct

SEQ ID NO: 8509743 - DNA, 22 bp, Homo sapiens
agagagcttccattctagtgat

SEQ ID NO: 8509744 - DNA, 22 bp, Homo sapiens
agagaggatttgtttttctcct

SEQ ID NO: 8509745 - DNA, 22 bp, Homo sapiens
agagaggctgctggactatatg

SEQ ID NO: 8509746 - DNA, 22 bp, Homo sapiens
agagagggcatagaaaaaggga

SEQ ID NO: 8509747 - DNA, 22 bp, Homo sapiens
agagaggttggctaggatgttt

SEQ ID NO: 8509748 - DNA, 21 bp, Homo sapiens
agagagggagatgaaacatcc

SEQ ID NO: 8509749 - DNA, 21 bp, Homo sapiens
agagagggagatgaaacatcc

SEQ ID NO: 8509750 - DNA, 22 bp, Homo sapiens
agagagggaatatttggggtat

SEQ ID NO: 8509751 - DNA, 19 bp, Homo sapiens
agagaggctgtgtgaggga

SEQ ID NO: 8509752 - DNA, 22 bp, Homo sapiens
agagacaccgcgcatcatggct

SEQ ID NO: 8509753 - DNA, 22 bp, Homo sapiens
agagacacatcatataagtata

SEQ ID NO: 8509754 - DNA, 22 bp, Homo sapiens
agagacacatcatataagtata

SEQ ID NO: 8509755 - DNA, 22 bp, Homo sapiens
agagacaatgccaatgcacacg

SEQ ID NO: 8509756 - DNA, 22 bp, Homo sapiens
agagacaaacactgcaacttct

SEQ ID NO: 8509757 - DNA, 22 bp, Homo sapiens
agagacaatgccaatgcacacg

SEQ ID NO: 8509758 - DNA, 22 bp, Homo sapiens
agagaattaacattccatggct

SEQ ID NO: 8509759 - DNA, 22 bp, Homo sapiens
agagaattacagaagaatgtca

SEQ ID NO: 8509760 - DNA, 20 bp, Homo sapiens
agagaattccctttggagat

SEQ ID NO: 8509761 - DNA, 22 bp, Homo sapiens
agagaattacagaagaatgtca

SEQ ID NO: 8509762 - DNA, 22 bp, Homo sapiens
agagaattctggtgctaacaag

SEQ ID NO: 8509763 - DNA, 22 bp, Homo sapiens
agagaatttgagacttgcccaa

SEQ ID NO: 8509764 - DNA, 22 bp, Homo sapiens
agagaattttaaaagccttgaa

SEQ ID NO: 8509765 - DNA, 22 bp, Homo sapiens
agagaattggagcagtgacagg

SEQ ID NO: 8509766 - DNA, 22 bp, Homo sapiens
agagaattctggtgctaacaag

SEQ ID NO: 8509767 - DNA, 21 bp, Homo sapiens
agagaattgccttagatgttc

SEQ ID NO: 8509768 - DNA, 22 bp, Homo sapiens
agagacaccgcgcatcatggct

SEQ ID NO: 8509769 - DNA, 22 bp, Homo sapiens
agagacagacacatcgggctgc

SEQ ID NO: 8509770 - DNA, 21 bp, Homo sapiens
agagacagagaaagtaacatt

SEQ ID NO: 8509771 - DNA, 22 bp, Homo sapiens
agagacagacacatcgggctgc

SEQ ID NO: 8509772 - DNA, 21 bp, Homo sapiens
agagacagagaaagtaacatt

SEQ ID NO: 8509773 - DNA, 22 bp, Homo sapiens
agagagcattgaggaaatcttc

SEQ ID NO: 8509774 - DNA, 22 bp, Homo sapiens
agagagcatggcacagaggggt

SEQ ID NO: 8509775 - DNA, 22 bp, Homo sapiens
agagagcatggcacagaggggt

SEQ ID NO: 8509776 - DNA, 22 bp, Homo sapiens
agagagcatggcacagaggggt

SEQ ID NO: 8509777 - DNA, 21 bp, Homo sapiens
agagagaaggccatatggtcc

SEQ ID NO: 8509778 - DNA, 22 bp, Homo sapiens
agagccctgaagcagagctaaa

SEQ ID NO: 8509779 - DNA, 22 bp, Homo sapiens
agagccctgaagcagagctaaa

SEQ ID NO: 8509780 - DNA, 22 bp, Homo sapiens
agagccctgacggggacagatg

SEQ ID NO: 8509781 - DNA, 22 bp, Homo sapiens
agagccctgagtcagttctgga

SEQ ID NO: 8509782 - DNA, 22 bp, Homo sapiens
agagccctgagtcagttctgga

SEQ ID NO: 8509783 - DNA, 22 bp, Homo sapiens
agagccctgcagttcttcagga

SEQ ID NO: 8509784 - DNA, 22 bp, Homo sapiens
agagccctaaaccctgccttgg

SEQ ID NO: 8509785 - DNA, 22 bp, Homo sapiens
agagccctctcattggcttatt

SEQ ID NO: 8509786 - DNA, 22 bp, Homo sapiens
agagccctctgcaatgcctcag

SEQ ID NO: 8509787 - DNA, 22 bp, Homo sapiens
agagccctcttcactgcccctt

SEQ ID NO: 8509788 - DNA, 22 bp, Homo sapiens
agagccctcttcactgcccctt

SEQ ID NO: 8509789 - DNA, 22 bp, Homo sapiens
agagccctggagggcagtcccg

SEQ ID NO: 8509790 - DNA, 22 bp, Homo sapiens
agagccctgccaatggatgagg

SEQ ID NO: 8509791 - DNA, 22 bp, Homo sapiens
agagccctggagggcagtcccg

SEQ ID NO: 8509792 - DNA, 22 bp, Homo sapiens
agagccctgtggttctggtaag

SEQ ID NO: 8509793 - DNA, 22 bp, Homo sapiens
agagccctgtggactgtcaagt

SEQ ID NO: 8509794 - DNA, 22 bp, Homo sapiens
agagccctgcagttcttcagga

SEQ ID NO: 8509795 - DNA, 23 bp, Homo sapiens
agagcctgaaagacttctggcac

SEQ ID NO: 8509796 - DNA, 23 bp, Homo sapiens
agagcctgaaagacttctggcac

SEQ ID NO: 8509797 - DNA, 22 bp, Homo sapiens
agagcctctgtcatggagagaa

SEQ ID NO: 8509798 - DNA, 22 bp, Homo sapiens
agagccctttctccaggcacct

SEQ ID NO: 8509799 - DNA, 22 bp, Homo sapiens
agagcctctgtcatggagagaa

SEQ ID NO: 8509800 - DNA, 22 bp, Homo sapiens
agagccctttctccaggcacct

SEQ ID NO: 8509801 - DNA, 22 bp, Homo sapiens
agagcccttgccctcagtcacc

SEQ ID NO: 8509802 - DNA, 22 bp, Homo sapiens
agagcctgaggatgtcccagct

SEQ ID NO: 8509803 - DNA, 22 bp, Homo sapiens
agagcctgaggatgtcccagct

SEQ ID NO: 8509804 - DNA, 21 bp, Homo sapiens
agagcctgagatcttccagca

SEQ ID NO: 8509805 - DNA, 21 bp, Homo sapiens
agagcctgagatcttccagca

SEQ ID NO: 8509806 - DNA, 22 bp, Homo sapiens
agagcctgagaggataatgggg

SEQ ID NO: 8509807 - DNA, 21 bp, Homo sapiens
agagcctgagatcttccagca

SEQ ID NO: 8509808 - DNA, 22 bp, Homo sapiens
agagctgaaaaagctgacccgg

SEQ ID NO: 8509809 - DNA, 22 bp, Homo sapiens
agagcctgcagctgtgaagaaa

SEQ ID NO: 8509810 - DNA, 22 bp, Homo sapiens
agagcctgaggccctgagaggg

SEQ ID NO: 8509811 - DNA, 22 bp, Homo sapiens
agagcctgaggccaggaaaatg

SEQ ID NO: 8509812 - DNA, 22 bp, Homo sapiens
agagctggctgctgcggtgctt

SEQ ID NO: 8509813 - DNA, 22 bp, Homo sapiens
agagctggctggtagccctgat

SEQ ID NO: 8509814 - DNA, 22 bp, Homo sapiens
agagctggctggtagccctgat

SEQ ID NO: 8509815 - DNA, 21 bp, Homo sapiens
agagctggcctgccaggccct

SEQ ID NO: 8509816 - DNA, 22 bp, Homo sapiens
agagctggccagggatcactct

SEQ ID NO: 8509817 - DNA, 22 bp, Homo sapiens
agagctggccagggatcactct

SEQ ID NO: 8509818 - DNA, 21 bp, Homo sapiens
agagctggcctgccaggccct

SEQ ID NO: 8509819 - DNA, 21 bp, Homo sapiens
agagctggcctgccaggccct

SEQ ID NO: 8509820 - DNA, 22 bp, Homo sapiens
agagctggcagcagcttctcct

SEQ ID NO: 8509821 - DNA, 22 bp, Homo sapiens
agagctggatggtcaagatggc

SEQ ID NO: 8509822 - DNA, 22 bp, Homo sapiens
agagctggatggtcaagatggc

SEQ ID NO: 8509823 - DNA, 22 bp, Homo sapiens
agagctggatggtcaagatggc

SEQ ID NO: 8509824 - DNA, 22 bp, Homo sapiens
agagctggatggtcaagatggc

SEQ ID NO: 8509825 - DNA, 22 bp, Homo sapiens
agagctggatggtcaagatggc

SEQ ID NO: 8509826 - DNA, 22 bp, Homo sapiens
agagctggagatgcaggtttcg

SEQ ID NO: 8509827 - DNA, 22 bp, Homo sapiens
agagctggacgtctgagcccta

SEQ ID NO: 8509828 - DNA, 22 bp, Homo sapiens
agagctggagatgcaggtttcg

SEQ ID NO: 8509829 - DNA, 22 bp, Homo sapiens
agagctggacgtctgagcccta

SEQ ID NO: 8509830 - DNA, 22 bp, Homo sapiens
agagctggacgtctgagcccta

SEQ ID NO: 8509831 - DNA, 22 bp, Homo sapiens
agagctgaaaaagctgacccgg

SEQ ID NO: 8509832 - DNA, 22 bp, Homo sapiens
agagctggaatcagacctcagg

SEQ ID NO: 8509833 - DNA, 22 bp, Homo sapiens
agagctggaatcagacctcagg

SEQ ID NO: 8509834 - DNA, 22 bp, Homo sapiens
agagattgtgctactcacccaa

SEQ ID NO: 8509835 - DNA, 22 bp, Homo sapiens
agagcacaggctctggagtcta

SEQ ID NO: 8509836 - DNA, 22 bp, Homo sapiens
agagaggtttgctggaagattc

SEQ ID NO: 8509837 - DNA, 22 bp, Homo sapiens
agagaggtttgctggaagattc

SEQ ID NO: 8509838 - DNA, 22 bp, Homo sapiens
agagagttctttctagttgaag

SEQ ID NO: 8509839 - DNA, 22 bp, Homo sapiens
agagcacaggctctggagtcta

SEQ ID NO: 8509840 - DNA, 22 bp, Homo sapiens
agagcacagtatctgcacatca

SEQ ID NO: 8509841 - DNA, 22 bp, Homo sapiens
agagcacagtatctgcacatca

SEQ ID NO: 8509842 - DNA, 22 bp, Homo sapiens
agagcacagtatctgcacatca

SEQ ID NO: 8509843 - DNA, 22 bp, Homo sapiens
agagcacagtgcaggatccccg

SEQ ID NO: 8509844 - DNA, 22 bp, Homo sapiens
agagcacagtgcaggatccccg

SEQ ID NO: 8509845 - DNA, 21 bp, Homo sapiens
agagcacaggtggacaatgct

SEQ ID NO: 8509846 - DNA, 22 bp, Homo sapiens
agagcactgagtgagcaaggcc

SEQ ID NO: 8509847 - DNA, 22 bp, Homo sapiens
agagcaccccgggaagagcaag

SEQ ID NO: 8509848 - DNA, 22 bp, Homo sapiens
agagcagaggcatggccgtggg

SEQ ID NO: 8509849 - DNA, 22 bp, Homo sapiens
agagcagacatccttgtcttgt

SEQ ID NO: 8509850 - DNA, 22 bp, Homo sapiens
agagcagagtggctgtagcttg

SEQ ID NO: 8509851 - DNA, 22 bp, Homo sapiens
agagcagagggctctgggacaa

SEQ ID NO: 8509852 - DNA, 22 bp, Homo sapiens
agagcagagtggctgtagcttg

SEQ ID NO: 8509853 - DNA, 22 bp, Homo sapiens
agagcagagtggctgtagcttg

SEQ ID NO: 8509854 - DNA, 22 bp, Homo sapiens
agagcagagggctctgggacaa

SEQ ID NO: 8509855 - DNA, 22 bp, Homo sapiens
agagcagagggctctgggacaa

SEQ ID NO: 8509856 - DNA, 22 bp, Homo sapiens
agagcagaggcatggccgtggg

SEQ ID NO: 8509857 - DNA, 22 bp, Homo sapiens
agagcagaggcatggccgtggg

SEQ ID NO: 8509858 - DNA, 22 bp, Homo sapiens
agagcagagggctctgggacaa

SEQ ID NO: 8509859 - DNA, 22 bp, Homo sapiens
agagcagagggctctgggacaa

SEQ ID NO: 8509860 - DNA, 22 bp, Homo sapiens
agagcagagggctctgggacaa

SEQ ID NO: 8509861 - DNA, 22 bp, Homo sapiens
agagcagcacgttgtccccaca

SEQ ID NO: 8509862 - DNA, 20 bp, Homo sapiens
agagcagcagttggtgaggt

SEQ ID NO: 8509863 - DNA, 22 bp, Homo sapiens
agagcagatttcaaatattggc

SEQ ID NO: 8509864 - DNA, 22 bp, Homo sapiens
agagcagatttcaaatattggc

SEQ ID NO: 8509865 - DNA, 22 bp, Homo sapiens
agagcagatggccagggggcct

SEQ ID NO: 8509866 - DNA, 22 bp, Homo sapiens
agagcagatggccagggggcct

SEQ ID NO: 8509867 - DNA, 22 bp, Homo sapiens
agagcagatggagctggaagag

SEQ ID NO: 8509868 - DNA, 22 bp, Homo sapiens
agagcagatggagctggaagag

SEQ ID NO: 8509869 - DNA, 22 bp, Homo sapiens
agagcagatggccagggggcct

SEQ ID NO: 8509870 - DNA, 22 bp, Homo sapiens
agagcagatggccagggggcct

SEQ ID NO: 8509871 - DNA, 22 bp, Homo sapiens
agagcagatggagctggaagag

SEQ ID NO: 8509872 - DNA, 22 bp, Homo sapiens
agagcagatggagctggaagag

SEQ ID NO: 8509873 - DNA, 22 bp, Homo sapiens
agagcagatggagctggaagag

SEQ ID NO: 8509874 - DNA, 22 bp, Homo sapiens
agagcagatggagctggaagag

SEQ ID NO: 8509875 - DNA, 22 bp, Homo sapiens
agagcagatggagctggaagag

SEQ ID NO: 8509876 - DNA, 22 bp, Homo sapiens
agagcccctggtggagtgagaa

SEQ ID NO: 8509877 - DNA, 22 bp, Homo sapiens
agagcccctggtggagtgagaa

SEQ ID NO: 8509878 - DNA, 22 bp, Homo sapiens
agagccaggcaggcaatgttga

SEQ ID NO: 8509879 - DNA, 22 bp, Homo sapiens
agagccaggccaggccggggca

SEQ ID NO: 8509880 - DNA, 22 bp, Homo sapiens
agagccaggccaggccggggca

SEQ ID NO: 8509881 - DNA, 22 bp, Homo sapiens
agactctgataagcaactcttg

SEQ ID NO: 8509882 - DNA, 22 bp, Homo sapiens
atgcggagccccaagcttgaag

SEQ ID NO: 8509883 - DNA, 22 bp, Homo sapiens
atgcggagccccaagcttgaag

SEQ ID NO: 8509884 - DNA, 22 bp, Homo sapiens
atgcgctttgtgtgaagcagtg

SEQ ID NO: 8509885 - DNA, 22 bp, Homo sapiens
agactctgattccctcatgtca

SEQ ID NO: 8509886 - DNA, 22 bp, Homo sapiens
agactctgcatttctaataagc

SEQ ID NO: 8509887 - DNA, 22 bp, Homo sapiens
agactgtaatttgtggcctcct

SEQ ID NO: 8509888 - DNA, 22 bp, Homo sapiens
agactgtaattgacatgtcagc

SEQ ID NO: 8509889 - DNA, 22 bp, Homo sapiens
agactgggtttgagacttagca

SEQ ID NO: 8509890 - DNA, 22 bp, Homo sapiens
atgcctttgccacagattagga

SEQ ID NO: 8509891 - DNA, 22 bp, Homo sapiens
atgccttattccaacaatctag

SEQ ID NO: 8509892 - DNA, 22 bp, Homo sapiens
atgcctgtctcagggtctgttt

SEQ ID NO: 8509893 - DNA, 22 bp, Homo sapiens
atgcctgtaatcccagtgcttt

SEQ ID NO: 8509894 - DNA, 22 bp, Homo sapiens
atgcctggtatgaagcaaggaa

SEQ ID NO: 8509895 - DNA, 22 bp, Homo sapiens
agacgagggcccccaggacagc

SEQ ID NO: 8509896 - DNA, 22 bp, Homo sapiens
agacgagggcccccaggacagc

SEQ ID NO: 8509897 - DNA, 22 bp, Homo sapiens
agacgagggcctggcacacagt

SEQ ID NO: 8509898 - DNA, 22 bp, Homo sapiens
agacctggtttatcaccagcat

SEQ ID NO: 8509899 - DNA, 22 bp, Homo sapiens
agacctggtttatcaccagcat

SEQ ID NO: 8509900 - DNA, 22 bp, Homo sapiens
agacctggtgatagctgtccta

SEQ ID NO: 8509901 - DNA, 22 bp, Homo sapiens
agacctggagtggggcctcagg

SEQ ID NO: 8509902 - DNA, 22 bp, Homo sapiens
agacctggatgtgagggaagta

SEQ ID NO: 8509903 - DNA, 22 bp, Homo sapiens
agacctggattccaatcctacc

SEQ ID NO: 8509904 - DNA, 22 bp, Homo sapiens
agacctgggtgccctgtgcttt

SEQ ID NO: 8509905 - DNA, 22 bp, Homo sapiens
agacctgggtgccctgtgcttt

SEQ ID NO: 8509906 - DNA, 22 bp, Homo sapiens
agacctgggttcgagtcctaac

SEQ ID NO: 8509907 - DNA, 22 bp, Homo sapiens
agacctgggttcgagtcctaac

SEQ ID NO: 8509908 - DNA, 22 bp, Homo sapiens
atgccacataaccagttcactt

SEQ ID NO: 8509909 - DNA, 22 bp, Homo sapiens
atgccaagtacaggcactgctc

SEQ ID NO: 8509910 - DNA, 22 bp, Homo sapiens
atgccaagctctatccctgacc

SEQ ID NO: 8509911 - DNA, 22 bp, Homo sapiens
agaccccatacctcagcaggta

SEQ ID NO: 8509912 - DNA, 22 bp, Homo sapiens
agacccaggattggggctgccg

SEQ ID NO: 8509913 - DNA, 22 bp, Homo sapiens
agacctggagtgaagagttccc

SEQ ID NO: 8509914 - DNA, 22 bp, Homo sapiens
atgcatatgtacccatgttctg

SEQ ID NO: 8509915 - DNA, 22 bp, Homo sapiens
atgcatatgtacccatgttctg

SEQ ID NO: 8509916 - DNA, 22 bp, Homo sapiens
atgcatatgtacttgcatatgt

SEQ ID NO: 8509917 - DNA, 22 bp, Homo sapiens
atgcatatgtgtgcacacgtgt

SEQ ID NO: 8509918 - DNA, 22 bp, Homo sapiens
atgcatatgtacttgcatatgt

SEQ ID NO: 8509919 - DNA, 22 bp, Homo sapiens
atgcatattcttagcccctcct

SEQ ID NO: 8509920 - DNA, 22 bp, Homo sapiens
atgcatattggattagcagcca

SEQ ID NO: 8509921 - DNA, 22 bp, Homo sapiens
atgcatattgattatagattca

SEQ ID NO: 8509922 - DNA, 22 bp, Homo sapiens
atgcatattgtcatttagtcct

SEQ ID NO: 8509923 - DNA, 22 bp, Homo sapiens
atgcatattgtcatttagtcct

SEQ ID NO: 8509924 - DNA, 22 bp, Homo sapiens
atgcatatttcatgaatctttg

SEQ ID NO: 8509925 - DNA, 22 bp, Homo sapiens
atgcatatttcttgggcttacc

SEQ ID NO: 8509926 - DNA, 22 bp, Homo sapiens
atgcatatttcttggagcacct

SEQ ID NO: 8509927 - DNA, 22 bp, Homo sapiens
atgcatattttctactatatcg

SEQ ID NO: 8509928 - DNA, 22 bp, Homo sapiens
atgcatattttctactatatcg

SEQ ID NO: 8509929 - DNA, 22 bp, Homo sapiens
atgcatattttctactatatcg

SEQ ID NO: 8509930 - DNA, 21 bp, Homo sapiens
atgcatattttaagttgtgtc

SEQ ID NO: 8509931 - DNA, 21 bp, Homo sapiens
atgcatattttaagttgtgtc

SEQ ID NO: 8509932 - DNA, 18 bp, Homo sapiens
atgcatattttaagttgt

SEQ ID NO: 8509933 - DNA, 22 bp, Homo sapiens
atgcatttgtaaaatataatcg

SEQ ID NO: 8509934 - DNA, 22 bp, Homo sapiens
atgcatattttctgttggtgac

SEQ ID NO: 8509935 - DNA, 22 bp, Homo sapiens
atgcatattttctactatatcg

SEQ ID NO: 8509936 - DNA, 22 bp, Homo sapiens
atgcatttttgagtatgaatga

SEQ ID NO: 8509937 - DNA, 22 bp, Homo sapiens
atgcatttgtaaaatataatcg

SEQ ID NO: 8509938 - DNA, 22 bp, Homo sapiens
atgcatttgtaaaatataatcg

SEQ ID NO: 8509939 - DNA, 22 bp, Homo sapiens
atgccaaagggagcactttggg

SEQ ID NO: 8509940 - DNA, 22 bp, Homo sapiens
atgcatttttgagtatgaatga

SEQ ID NO: 8509941 - DNA, 22 bp, Homo sapiens
atgcatttttgagtatgaatga

SEQ ID NO: 8509942 - DNA, 22 bp, Homo sapiens
atgcaggtccaaacgctagtgt

SEQ ID NO: 8509943 - DNA, 22 bp, Homo sapiens
atgcaggttgggcaagtgtggg

SEQ ID NO: 8509944 - DNA, 22 bp, Homo sapiens
atgcatatgtacccatgttctg

SEQ ID NO: 8509945 - DNA, 22 bp, Homo sapiens
atgcatatgtacccatgttctg

SEQ ID NO: 8509946 - DNA, 22 bp, Homo sapiens
atgcatatggcttgagggaata

SEQ ID NO: 8509947 - DNA, 22 bp, Homo sapiens
atgcagggttctgggctagaga

SEQ ID NO: 8509948 - DNA, 21 bp, Homo sapiens
atgatactgaagcacaactat

SEQ ID NO: 8509949 - DNA, 22 bp, Homo sapiens
atgatactctaggtgatttaca

SEQ ID NO: 8509950 - DNA, 22 bp, Homo sapiens
atgatactctaggtgatttaca

SEQ ID NO: 8509951 - DNA, 22 bp, Homo sapiens
atgatatacttcctagaacagt

SEQ ID NO: 8509952 - DNA, 22 bp, Homo sapiens
atgatatacttcctagaacagt

SEQ ID NO: 8509953 - DNA, 22 bp, Homo sapiens
atgatatacttcctagaacagt

SEQ ID NO: 8509954 - DNA, 22 bp, Homo sapiens
agacagacacatggtaacagat

SEQ ID NO: 8509955 - DNA, 20 bp, Homo sapiens
agacagaatcagagataaag

SEQ ID NO: 8509956 - DNA, 22 bp, Homo sapiens
agacagaatttgtcagataaat

SEQ ID NO: 8509957 - DNA, 22 bp, Homo sapiens
agacagaatttgtcagataaat

SEQ ID NO: 8509958 - DNA, 22 bp, Homo sapiens
agacagaacagaataattgttg

SEQ ID NO: 8509959 - DNA, 22 bp, Homo sapiens
agacagaacagaataattgttg

SEQ ID NO: 8509960 - DNA, 22 bp, Homo sapiens
atgatacatcttcatgtcagtg

SEQ ID NO: 8509961 - DNA, 22 bp, Homo sapiens
agacagacagagaatttaaata

SEQ ID NO: 8509962 - DNA, 22 bp, Homo sapiens
atgatacatcttcatgtcagtg

SEQ ID NO: 8509963 - DNA, 22 bp, Homo sapiens
atgatacatcttcatgtcagtg

SEQ ID NO: 8509964 - DNA, 22 bp, Homo sapiens
atgatacattgcaaaattttaa

SEQ ID NO: 8509965 - DNA, 22 bp, Homo sapiens
atgaggcctatcttggcagagg

SEQ ID NO: 8509966 - DNA, 22 bp, Homo sapiens
atgaggcctttcttcacccttt

SEQ ID NO: 8509967 - DNA, 22 bp, Homo sapiens
atgaggcctatcttggcagagg

SEQ ID NO: 8509968 - DNA, 22 bp, Homo sapiens
atgaggcctttcttcacccttt

SEQ ID NO: 8509969 - DNA, 22 bp, Homo sapiens
atgaggcccaaacattacaaat

SEQ ID NO: 8509970 - DNA, 22 bp, Homo sapiens
atgaggccatggctgtcactaa

SEQ ID NO: 8509971 - DNA, 22 bp, Homo sapiens
atgaggcccaggaatctgtatt

SEQ ID NO: 8509972 - DNA, 22 bp, Homo sapiens
atgaggcctatcttggcagagg

SEQ ID NO: 8509973 - DNA, 22 bp, Homo sapiens
atgagggcagctatgtaagtgt

SEQ ID NO: 8509974 - DNA, 22 bp, Homo sapiens
atgagggaggcaaggagatgct

SEQ ID NO: 8509975 - DNA, 22 bp, Homo sapiens
atgagggaggcaaggagatgct

SEQ ID NO: 8509976 - DNA, 22 bp, Homo sapiens
agaatcaactgaaaattggtga

SEQ ID NO: 8509977 - DNA, 22 bp, Homo sapiens
agaatcaaagagaaatactttg

SEQ ID NO: 8509978 - DNA, 22 bp, Homo sapiens
agaatcaaagagaaatactttg

SEQ ID NO: 8509979 - DNA, 22 bp, Homo sapiens
agaatattgaaagttcttgaca

SEQ ID NO: 8509980 - DNA, 22 bp, Homo sapiens
agaatattgaaagttcttgaca

SEQ ID NO: 8509981 - DNA, 22 bp, Homo sapiens
agaatattgaaagttcttgaca

SEQ ID NO: 8509982 - DNA, 22 bp, Homo sapiens
atgaggccagaccactctgcat

SEQ ID NO: 8509983 - DNA, 22 bp, Homo sapiens
atgaggccagggtgccatgaaa

SEQ ID NO: 8509984 - DNA, 22 bp, Homo sapiens
atgaggccagggtgccatgaaa

SEQ ID NO: 8509985 - DNA, 22 bp, Homo sapiens
atgaggccagggtgccatgaaa

SEQ ID NO: 8509986 - DNA, 20 bp, Homo sapiens
atgaggccagcagggctcag

SEQ ID NO: 8509987 - DNA, 22 bp, Homo sapiens
agacactgttctcacatgcttg

SEQ ID NO: 8509988 - DNA, 22 bp, Homo sapiens
agacactgttctcacatgcttg

SEQ ID NO: 8509989 - DNA, 22 bp, Homo sapiens
agacacttcatgtaagtggaat

SEQ ID NO: 8509990 - DNA, 22 bp, Homo sapiens
agacacttatttagtgggagtt

SEQ ID NO: 8509991 - DNA, 22 bp, Homo sapiens
agacactgttctcacatgcttg

SEQ ID NO: 8509992 - DNA, 22 bp, Homo sapiens
agacactgtgtacagaaaaaga

SEQ ID NO: 8509993 - DNA, 22 bp, Homo sapiens
agacagaaataggagaaaccag

SEQ ID NO: 8509994 - DNA, 22 bp, Homo sapiens
agacacttggcagagagctgtt

SEQ ID NO: 8509995 - DNA, 22 bp, Homo sapiens
agacacttggcagagagctgtt

SEQ ID NO: 8509996 - DNA, 21 bp, Homo sapiens
agacagaacaactgctctcca

SEQ ID NO: 8509997 - DNA, 21 bp, Homo sapiens
agacagaacaactgctctcca

SEQ ID NO: 8509998 - DNA, 23 bp, Homo sapiens
agacactgtaaagaattgcagtt

SEQ ID NO: 8509999 - DNA, 22 bp, Homo sapiens
agacaccagaatctgttgagca

SEQ ID NO: 8510000 - DNA, 22 bp, Homo sapiens
agacaccagaatctgttgagca

SEQ ID NO: 8510001 - DNA, 22 bp, Homo sapiens
agacaaggctggagtttaggca

SEQ ID NO: 8510002 - DNA, 22 bp, Homo sapiens
agacaaggcccccttgggctct

SEQ ID NO: 8510003 - DNA, 22 bp, Homo sapiens
agacaactagaaaactagacag

SEQ ID NO: 8510004 - DNA, 22 bp, Homo sapiens
agacaacatgatcagcagtcct

SEQ ID NO: 8510005 - DNA, 22 bp, Homo sapiens
agacaacatcactaaagctgag

SEQ ID NO: 8510006 - DNA, 22 bp, Homo sapiens
agacaacatctagtttggtgga

SEQ ID NO: 8510007 - DNA, 22 bp, Homo sapiens
agacaacatctagtttggtgga

SEQ ID NO: 8510008 - DNA, 22 bp, Homo sapiens
agacaaatttcctgcaatgaag

SEQ ID NO: 8510009 - DNA, 22 bp, Homo sapiens
agacaacaccaaatgctagtgt

SEQ ID NO: 8510010 - DNA, 22 bp, Homo sapiens
agacaacaccaaatgctagtgt

SEQ ID NO: 8510011 - DNA, 22 bp, Homo sapiens
agacaagactaggcagttgttg

SEQ ID NO: 8510012 - DNA, 22 bp, Homo sapiens
agacaactagaaaactagacag

SEQ ID NO: 8510013 - DNA, 22 bp, Homo sapiens
agacaactagaaaactagacag

SEQ ID NO: 8510014 - DNA, 21 bp, Homo sapiens
agacaactgtgactattccct

SEQ ID NO: 8510015 - DNA, 22 bp, Homo sapiens
agacaactgcagagcaaagaat

SEQ ID NO: 8510016 - DNA, 22 bp, Homo sapiens
agacaagagctgaggacatatt

SEQ ID NO: 8510017 - DNA, 22 bp, Homo sapiens
agacaaggaatgtagcttactc

SEQ ID NO: 8510018 - DNA, 22 bp, Homo sapiens
agacaaggcaaggcggccagat

SEQ ID NO: 8510019 - DNA, 22 bp, Homo sapiens
agacaaggcaaggcggccagat

SEQ ID NO: 8510020 - DNA, 22 bp, Homo sapiens
atctgctggcatctctagccca

SEQ ID NO: 8510021 - DNA, 22 bp, Homo sapiens
atctgctgtcacatgtttgaag

SEQ ID NO: 8510022 - DNA, 18 bp, Homo sapiens
atctgctggcaggtctgg

SEQ ID NO: 8510023 - DNA, 22 bp, Homo sapiens
atctgctgtgtgtaatggaatg

SEQ ID NO: 8510024 - DNA, 22 bp, Homo sapiens
atctgctgttcttcacagcttg

SEQ ID NO: 8510025 - DNA, 17 bp, Homo sapiens
atctgctgacattctgt

SEQ ID NO: 8510026 - DNA, 20 bp, Homo sapiens
atctgctgagaatgaaaggc

SEQ ID NO: 8510027 - DNA, 22 bp, Homo sapiens
atctgctgcccagccacttgct

SEQ ID NO: 8510028 - DNA, 22 bp, Homo sapiens
atctgctatgttatttcccact

SEQ ID NO: 8510029 - DNA, 19 bp, Homo sapiens
atctgccttagtgctgctg

SEQ ID NO: 8510030 - DNA, 22 bp, Homo sapiens
atctgcctggctccaggtgagc

SEQ ID NO: 8510031 - DNA, 22 bp, Homo sapiens
atctgcctggctccaggtgagc

SEQ ID NO: 8510032 - DNA, 19 bp, Homo sapiens
atctgcctgttatcacata

SEQ ID NO: 8510033 - DNA, 22 bp, Homo sapiens
atctgcctccaagtccatgtgt

SEQ ID NO: 8510034 - DNA, 22 bp, Homo sapiens
atctgcctcttcttcattgcga

SEQ ID NO: 8510035 - DNA, 22 bp, Homo sapiens
atctgcctgagtctaggttttc

SEQ ID NO: 8510036 - DNA, 22 bp, Homo sapiens
atctgcctgcagtggaggtggg

SEQ ID NO: 8510037 - DNA, 22 bp, Homo sapiens
atctgcctgcagtggaggtggg

SEQ ID NO: 8510038 - DNA, 22 bp, Homo sapiens
atgaacaatgactacatattga

SEQ ID NO: 8510039 - DNA, 22 bp, Homo sapiens
atctgcttgaaacttcttatac

SEQ ID NO: 8510040 - DNA, 22 bp, Homo sapiens
atctgcttcctgggctccatga

SEQ ID NO: 8510041 - DNA, 22 bp, Homo sapiens
atgaagttccagtatatgcagt

SEQ ID NO: 8510042 - DNA, 22 bp, Homo sapiens
atgaagttccagtatatgcagt

SEQ ID NO: 8510043 - DNA, 22 bp, Homo sapiens
atgaagttctagtgagaaatgc

SEQ ID NO: 8510044 - DNA, 22 bp, Homo sapiens
atgaagttctagtgagaaatgc

SEQ ID NO: 8510045 - DNA, 22 bp, Homo sapiens
agaatatagttaccaaattctg

SEQ ID NO: 8510046 - DNA, 22 bp, Homo sapiens
atgaagttctcaataatcatgt

SEQ ID NO: 8510047 - DNA, 22 bp, Homo sapiens
atgaagtctctttttcatgaga

SEQ ID NO: 8510048 - DNA, 22 bp, Homo sapiens
atgaagtctatttacctaagct

SEQ ID NO: 8510049 - DNA, 22 bp, Homo sapiens
atgaagtctagcaagcattgaa

SEQ ID NO: 8510050 - DNA, 22 bp, Homo sapiens
atgaagggtgtccctgtgagca

SEQ ID NO: 8510051 - DNA, 22 bp, Homo sapiens
atgaaggctgtgtggagccccc

SEQ ID NO: 8510052 - DNA, 22 bp, Homo sapiens
atgaaggcagttaaacgtcatc

SEQ ID NO: 8510053 - DNA, 22 bp, Homo sapiens
atgaaggatagggcaaaatttt

SEQ ID NO: 8510054 - DNA, 22 bp, Homo sapiens
atgaaggatggctggctgccct

SEQ ID NO: 8510055 - DNA, 22 bp, Homo sapiens
atgaaggacaacaggggagcag

SEQ ID NO: 8510056 - DNA, 22 bp, Homo sapiens
atgaaggatggctggctgccct

SEQ ID NO: 8510057 - DNA, 22 bp, Homo sapiens
atgaaggatggctggctgccct

SEQ ID NO: 8510058 - DNA, 22 bp, Homo sapiens
agatgtgtttctagttcctgca

SEQ ID NO: 8510059 - DNA, 22 bp, Homo sapiens
agatgtgtttctagttcctgca

SEQ ID NO: 8510060 - DNA, 22 bp, Homo sapiens
agcaaagctcatgacattacag

SEQ ID NO: 8510061 - DNA, 22 bp, Homo sapiens
agcaaagctcatgacattacag

SEQ ID NO: 8510062 - DNA, 22 bp, Homo sapiens
agcaaagctatctctatggaga

SEQ ID NO: 8510063 - DNA, 22 bp, Homo sapiens
agatgtgggtgtcaggcagtga

SEQ ID NO: 8510064 - DNA, 22 bp, Homo sapiens
agatgtgggcaatggaatggag

SEQ ID NO: 8510065 - DNA, 22 bp, Homo sapiens
agatgtgggcaatggaatggag

SEQ ID NO: 8510066 - DNA, 22 bp, Homo sapiens
agatgtggtagttgaagggaag

SEQ ID NO: 8510067 - DNA, 22 bp, Homo sapiens
agatgtgggtgtcaggcagtga

SEQ ID NO: 8510068 - DNA, 22 bp, Homo sapiens
agatgtggttattctcttcctt

SEQ ID NO: 8510069 - DNA, 22 bp, Homo sapiens
agatgtgtttctagttcctgca

SEQ ID NO: 8510070 - DNA, 22 bp, Homo sapiens
agatgtgtttctagttcctgca

SEQ ID NO: 8510071 - DNA, 19 bp, Homo sapiens
agcaacaccgtttatttcc

SEQ ID NO: 8510072 - DNA, 22 bp, Homo sapiens
agcaaatctatgaatgtatatt

SEQ ID NO: 8510073 - DNA, 22 bp, Homo sapiens
agcaacagccctgaggttcatg

SEQ ID NO: 8510074 - DNA, 22 bp, Homo sapiens
agcaacagccctgaggttcatg

SEQ ID NO: 8510075 - DNA, 22 bp, Homo sapiens
agcaacaggaatattatggcaa

SEQ ID NO: 8510076 - DNA, 22 bp, Homo sapiens
agcaacaggaatattatggcaa

SEQ ID NO: 8510077 - DNA, 22 bp, Homo sapiens
agcaacaggaaatagctgatta

SEQ ID NO: 8510078 - DNA, 22 bp, Homo sapiens
agcaacagccctgtttcattag

SEQ ID NO: 8510079 - DNA, 22 bp, Homo sapiens
agcaacaggaaatagctgatta

SEQ ID NO: 8510080 - DNA, 22 bp, Homo sapiens
agcaacaggaaatagctgatta

SEQ ID NO: 8510081 - DNA, 18 bp, Homo sapiens
agcaacagaaacatatgg

SEQ ID NO: 8510082 - DNA, 22 bp, Homo sapiens
agcaacagaagatagagtgaat

SEQ ID NO: 8510083 - DNA, 22 bp, Homo sapiens
attttagcaaatgcaagatgga

SEQ ID NO: 8510084 - DNA, 22 bp, Homo sapiens
attttaaccctcttatatatac

SEQ ID NO: 8510085 - DNA, 22 bp, Homo sapiens
attttaaccctcttatatatac

SEQ ID NO: 8510086 - DNA, 22 bp, Homo sapiens
attttaaccctcttatatatac

SEQ ID NO: 8510087 - DNA, 22 bp, Homo sapiens
attttagtacctcaagtatcca

SEQ ID NO: 8510088 - DNA, 22 bp, Homo sapiens
attttatgacacgattcttcca

SEQ ID NO: 8510089 - DNA, 22 bp, Homo sapiens
attttcaaaacatctgctgtgt

SEQ ID NO: 8510090 - DNA, 22 bp, Homo sapiens
attttcaaaacatctgctgtgt

SEQ ID NO: 8510091 - DNA, 22 bp, Homo sapiens
attttatctgcttactttcagg

SEQ ID NO: 8510092 - DNA, 22 bp, Homo sapiens
attttatctgcttactttcagg

SEQ ID NO: 8510093 - DNA, 22 bp, Homo sapiens
attttatccccactggattaca

SEQ ID NO: 8510094 - DNA, 22 bp, Homo sapiens
attttagttttagcatccatgc

SEQ ID NO: 8510095 - DNA, 22 bp, Homo sapiens
attttagttttagcatccatgc

SEQ ID NO: 8510096 - DNA, 22 bp, Homo sapiens
agatgtggcctttgggagatta

SEQ ID NO: 8510097 - DNA, 22 bp, Homo sapiens
agatgtggctgcacccaccgct

SEQ ID NO: 8510098 - DNA, 22 bp, Homo sapiens
agatgtggccggctagggagag

SEQ ID NO: 8510099 - DNA, 22 bp, Homo sapiens
agatgtggcctttgggagatta

SEQ ID NO: 8510100 - DNA, 22 bp, Homo sapiens
agatgtggatcctagggtagaa

SEQ ID NO: 8510101 - DNA, 22 bp, Homo sapiens
agatgtggatcctagggtagaa

SEQ ID NO: 8510102 - DNA, 22 bp, Homo sapiens
agatgtggccggctagggagag

SEQ ID NO: 8510103 - DNA, 22 bp, Homo sapiens
attttcagaacattcattcact

SEQ ID NO: 8510104 - DNA, 22 bp, Homo sapiens
attttcagaacattcattcact

SEQ ID NO: 8510105 - DNA, 22 bp, Homo sapiens
attttcagaacattcattcact

SEQ ID NO: 8510106 - DNA, 22 bp, Homo sapiens
attttcaccctgaatatattga

SEQ ID NO: 8510107 - DNA, 22 bp, Homo sapiens
attttcaccctgaatatattga

SEQ ID NO: 8510108 - DNA, 22 bp, Homo sapiens
attttcaagggagaggcctctg

SEQ ID NO: 8510109 - DNA, 22 bp, Homo sapiens
caaagatatgacatggaaaatg

SEQ ID NO: 8510110 - DNA, 22 bp, Homo sapiens
caaagatatgacatggaaaatg

SEQ ID NO: 8510111 - DNA, 23 bp, Homo sapiens
caaagatgattggaacatggctt

SEQ ID NO: 8510112 - DNA, 22 bp, Homo sapiens
caaagatgctgatgttggatca

SEQ ID NO: 8510113 - DNA, 22 bp, Homo sapiens
caaaccagtaggaagtctatta

SEQ ID NO: 8510114 - DNA, 22 bp, Homo sapiens
caaaccacactcagcgtatcgg

SEQ ID NO: 8510115 - DNA, 17 bp, Homo sapiens
caaaccagtaagactgc

SEQ ID NO: 8510116 - DNA, 22 bp, Homo sapiens
caaagcaagggctgaagactcc

SEQ ID NO: 8510117 - DNA, 22 bp, Homo sapiens
caaagcaaggctcagtttgaac

SEQ ID NO: 8510118 - DNA, 22 bp, Homo sapiens
caaagcaaggctcagtttgaac

SEQ ID NO: 8510119 - DNA, 22 bp, Homo sapiens
caaagcaaggctcagtttgaac

SEQ ID NO: 8510120 - DNA, 20 bp, Homo sapiens
agcaagagtaaggacagcga

SEQ ID NO: 8510121 - DNA, 22 bp, Homo sapiens
agcaagactcagcaggatacca

SEQ ID NO: 8510122 - DNA, 22 bp, Homo sapiens
agcaagagcatgtcggcctggt

SEQ ID NO: 8510123 - DNA, 17 bp, Homo sapiens
agcaacttctcccacag

SEQ ID NO: 8510124 - DNA, 22 bp, Homo sapiens
agcaactgttacaagaacaaca

SEQ ID NO: 8510125 - DNA, 22 bp, Homo sapiens
agcaacttttctagacatggtc

SEQ ID NO: 8510126 - DNA, 22 bp, Homo sapiens
agcaacaggcataatgtgttga

SEQ ID NO: 8510127 - DNA, 22 bp, Homo sapiens
agcaacaggcataatgtgttga

SEQ ID NO: 8510128 - DNA, 22 bp, Homo sapiens
agcaacaggaatattatggcaa

SEQ ID NO: 8510129 - DNA, 22 bp, Homo sapiens
agcaacaggaccatggagccca

SEQ ID NO: 8510130 - DNA, 22 bp, Homo sapiens
agcaacaggaccatggagccca

SEQ ID NO: 8510131 - DNA, 18 bp, Homo sapiens
agcaacaggatcccaggg

SEQ ID NO: 8510132 - DNA, 23 bp, Homo sapiens
agcaacagtgggtgagtgttgct

SEQ ID NO: 8510133 - DNA, 23 bp, Homo sapiens
agcaacagtgggtgagtgttgct

SEQ ID NO: 8510134 - DNA, 23 bp, Homo sapiens
agcaacagtgggtgagtgttgct

SEQ ID NO: 8510135 - DNA, 23 bp, Homo sapiens
agcaacagtgggtgagtgttgct

SEQ ID NO: 8510136 - DNA, 22 bp, Homo sapiens
agcaacagtgtatatcataggc

SEQ ID NO: 8510137 - DNA, 22 bp, Homo sapiens
agcaacatatatcaatgcctga

SEQ ID NO: 8510138 - DNA, 22 bp, Homo sapiens
agcaacatttttcaattaacat

SEQ ID NO: 8510139 - DNA, 22 bp, Homo sapiens
agcaacatttttcaattaacat

SEQ ID NO: 8510140 - DNA, 21 bp, Homo sapiens
agcaactctgactagatgagg

SEQ ID NO: 8510141 - DNA, 22 bp, Homo sapiens
agcaactgggctcattttttaa

SEQ ID NO: 8510142 - DNA, 22 bp, Homo sapiens
agcaacctggatcatggtgaaa

SEQ ID NO: 8510143 - DNA, 22 bp, Homo sapiens
agatgctgggaggctgagtgca

SEQ ID NO: 8510144 - DNA, 17 bp, Homo sapiens
agatgctggccacatgt

SEQ ID NO: 8510145 - DNA, 22 bp, Homo sapiens
agatgctgtcacacacactgtt

SEQ ID NO: 8510146 - DNA, 22 bp, Homo sapiens
agatgctgtgaggaagctagga

SEQ ID NO: 8510147 - DNA, 22 bp, Homo sapiens
agatgcttaagttttcagtgta

SEQ ID NO: 8510148 - DNA, 22 bp, Homo sapiens
agatgcttcagtgtttaattta

SEQ ID NO: 8510149 - DNA, 22 bp, Homo sapiens
agatgctttcctgatatttatg

SEQ ID NO: 8510150 - DNA, 21 bp, Homo sapiens
agatgctgtgctccaggagca

SEQ ID NO: 8510151 - DNA, 21 bp, Homo sapiens
agatgctgtgctccaggagca

SEQ ID NO: 8510152 - DNA, 22 bp, Homo sapiens
agatgctgtgtctgttcccttg

SEQ ID NO: 8510153 - DNA, 22 bp, Homo sapiens
agatgcaacctctgcttaacaa

SEQ ID NO: 8510154 - DNA, 22 bp, Homo sapiens
agatgattatgatagcactgtt

SEQ ID NO: 8510155 - DNA, 22 bp, Homo sapiens
agatccactcgaatccaggaat

SEQ ID NO: 8510156 - DNA, 22 bp, Homo sapiens
agatcatttggcagaagcaacg

SEQ ID NO: 8510157 - DNA, 21 bp, Homo sapiens
agatcattcttctgagcactt

SEQ ID NO: 8510158 - DNA, 22 bp, Homo sapiens
agatcattaaccacctgttctg

SEQ ID NO: 8510159 - DNA, 21 bp, Homo sapiens
agatcattcttctgagcactt

SEQ ID NO: 8510160 - DNA, 22 bp, Homo sapiens
agatcatatgcagtaatgaact

SEQ ID NO: 8510161 - DNA, 22 bp, Homo sapiens
agatcagtaagaggaagaatgg

SEQ ID NO: 8510162 - DNA, 22 bp, Homo sapiens
agatcagttagatagcttgatg

SEQ ID NO: 8510163 - DNA, 22 bp, Homo sapiens
agatcatatgaaaaatttcaag

SEQ ID NO: 8510164 - DNA, 22 bp, Homo sapiens
agatcagaaagccaatatcata

SEQ ID NO: 8510165 - DNA, 22 bp, Homo sapiens
agatcagaaagccaatatcata

SEQ ID NO: 8510166 - DNA, 22 bp, Homo sapiens
agatcactttgatgctacctgg

SEQ ID NO: 8510167 - DNA, 22 bp, Homo sapiens
agatcactttgatgctacctgg

SEQ ID NO: 8510168 - DNA, 22 bp, Homo sapiens
agatcagaaatgtaatggcagt

SEQ ID NO: 8510169 - DNA, 22 bp, Homo sapiens
agatcagagtggattgtgctgc

SEQ ID NO: 8510170 - DNA, 22 bp, Homo sapiens
agatcagagatgctaaaagagc

SEQ ID NO: 8510171 - DNA, 17 bp, Homo sapiens
agatggcaggaggcaga

SEQ ID NO: 8510172 - DNA, 17 bp, Homo sapiens
agatggcaggaggcaga

SEQ ID NO: 8510173 - DNA, 22 bp, Homo sapiens
agatggagttgtagcagtgact

SEQ ID NO: 8510174 - DNA, 19 bp, Homo sapiens
agatggcaaaatgcaaaga

SEQ ID NO: 8510175 - DNA, 22 bp, Homo sapiens
agatggatttcttccagtgaga

SEQ ID NO: 8510176 - DNA, 22 bp, Homo sapiens
agatggagaccttggatgaact

SEQ ID NO: 8510177 - DNA, 22 bp, Homo sapiens
agatggaggaaggctgaactca

SEQ ID NO: 8510178 - DNA, 22 bp, Homo sapiens
agatggctagattgcaagaact

SEQ ID NO: 8510179 - DNA, 22 bp, Homo sapiens
agatggctccagtgtccagagg

SEQ ID NO: 8510180 - DNA, 22 bp, Homo sapiens
agatggctgattaactccatgg

SEQ ID NO: 8510181 - DNA, 22 bp, Homo sapiens
agatggctgggccccaccccag

SEQ ID NO: 8510182 - DNA, 22 bp, Homo sapiens
agatggctgggctcgtccgcag

SEQ ID NO: 8510183 - DNA, 22 bp, Homo sapiens
agatggcttagcctggctccca

SEQ ID NO: 8510184 - DNA, 22 bp, Homo sapiens
agatggctgattaactccatgg

SEQ ID NO: 8510185 - DNA, 22 bp, Homo sapiens
agatggctgatggcaggagcca

SEQ ID NO: 8510186 - DNA, 22 bp, Homo sapiens
agatggctgggagctctgtttg

SEQ ID NO: 8510187 - DNA, 22 bp, Homo sapiens
agatgggccttcgagcatgccc

SEQ ID NO: 8510188 - DNA, 22 bp, Homo sapiens
attttaaccctcttatatatac

SEQ ID NO: 8510189 - DNA, 19 bp, Homo sapiens
agatggcttggactgaaaa

SEQ ID NO: 8510190 - DNA, 22 bp, Homo sapiens
attggtagttttgtatttctct

SEQ ID NO: 8510191 - DNA, 22 bp, Homo sapiens
attggtaagcaagatggcaata

SEQ ID NO: 8510192 - DNA, 22 bp, Homo sapiens
attgggatgccggctgataaga

SEQ ID NO: 8510193 - DNA, 22 bp, Homo sapiens
attgggctggccttctggagag

SEQ ID NO: 8510194 - DNA, 22 bp, Homo sapiens
attgggctggattaggactgtt

SEQ ID NO: 8510195 - DNA, 22 bp, Homo sapiens
attgggctttatgtaggggaag

SEQ ID NO: 8510196 - DNA, 22 bp, Homo sapiens
attggcatactttctatattca

SEQ ID NO: 8510197 - DNA, 22 bp, Homo sapiens
attggctattgagtgtgtgctg

SEQ ID NO: 8510198 - DNA, 22 bp, Homo sapiens
agatattaggaggattcataat

SEQ ID NO: 8510199 - DNA, 22 bp, Homo sapiens
agatattaggaggattcataat

SEQ ID NO: 8510200 - DNA, 22 bp, Homo sapiens
agatattctgcctaacaggttt

SEQ ID NO: 8510201 - DNA, 22 bp, Homo sapiens
agatattctagaacctagtaga

SEQ ID NO: 8510202 - DNA, 22 bp, Homo sapiens
agatataataatttacaagtgt

SEQ ID NO: 8510203 - DNA, 22 bp, Homo sapiens
agatattaccagcagtctatgc

SEQ ID NO: 8510204 - DNA, 22 bp, Homo sapiens
agatatttaaatcagacaaaga

SEQ ID NO: 8510205 - DNA, 22 bp, Homo sapiens
agatattgtttgtttcaccaat

SEQ ID NO: 8510206 - DNA, 22 bp, Homo sapiens
agatattgtgcatactgctgtt

SEQ ID NO: 8510207 - DNA, 22 bp, Homo sapiens
agatatttgtatcttgctattg

SEQ ID NO: 8510208 - DNA, 22 bp, Homo sapiens
agatattttgtgtgatgtttca

SEQ ID NO: 8510209 - DNA, 22 bp, Homo sapiens
agatcaaatctgggatttctaa

SEQ ID NO: 8510210 - DNA, 22 bp, Homo sapiens
agatcaaagccatgagagattt

SEQ ID NO: 8510211 - DNA, 22 bp, Homo sapiens
agatcaaagccatgagagattt

SEQ ID NO: 8510212 - DNA, 22 bp, Homo sapiens
agatcaaaaacttaatggcttt

SEQ ID NO: 8510213 - DNA, 22 bp, Homo sapiens
agatattttgtgtgatgtttca

SEQ ID NO: 8510214 - DNA, 22 bp, Homo sapiens
agatcaaatctgggatttctaa

SEQ ID NO: 8510215 - DNA, 22 bp, Homo sapiens
agatcacagcccccagatgcca

SEQ ID NO: 8510216 - DNA, 22 bp, Homo sapiens
agatcacagcccccagatgcca

SEQ ID NO: 8510217 - DNA, 22 bp, Homo sapiens
agatcacagagccaagattcca

SEQ ID NO: 8510218 - DNA, 22 bp, Homo sapiens
agatcacagagccaagattcca

SEQ ID NO: 8510219 - DNA, 22 bp, Homo sapiens
agatcacagtcaattgcaagtt

SEQ ID NO: 8510220 - DNA, 22 bp, Homo sapiens
agatcacagtcaattgcaagtt

SEQ ID NO: 8510221 - DNA, 22 bp, Homo sapiens
agatcacagtggcaactccctt

SEQ ID NO: 8510222 - DNA, 22 bp, Homo sapiens
agatcacagtggcaactccctt

SEQ ID NO: 8510223 - DNA, 22 bp, Homo sapiens
agatcacagttctctattcgta

SEQ ID NO: 8510224 - DNA, 22 bp, Homo sapiens
agatcacagtggcaactccctt

SEQ ID NO: 8510225 - DNA, 22 bp, Homo sapiens
agatcacagtggcaactccctt

SEQ ID NO: 8510226 - DNA, 23 bp, Homo sapiens
agatcacatgctgatggaaaatg

SEQ ID NO: 8510227 - DNA, 23 bp, Homo sapiens
agatcacatagttatcagatgac

SEQ ID NO: 8510228 - DNA, 23 bp, Homo sapiens
agatcacatagttatcagatgac

SEQ ID NO: 8510229 - DNA, 22 bp, Homo sapiens
agatcacataatttcctgtgac

SEQ ID NO: 8510230 - DNA, 22 bp, Homo sapiens
agatcacagttctctattcgta

SEQ ID NO: 8510231 - DNA, 22 bp, Homo sapiens
agatcactggttacttaatgaa

SEQ ID NO: 8510232 - DNA, 22 bp, Homo sapiens
agaggggcccggttctccgtct

SEQ ID NO: 8510233 - DNA, 22 bp, Homo sapiens
agaggggcccggttctccgtct

SEQ ID NO: 8510234 - DNA, 22 bp, Homo sapiens
agaggggcagggtctccggatt

SEQ ID NO: 8510235 - DNA, 22 bp, Homo sapiens
agaggggcgggaactcaacctc

SEQ ID NO: 8510236 - DNA, 22 bp, Homo sapiens
agaggggcgggaactcaacctc

SEQ ID NO: 8510237 - DNA, 22 bp, Homo sapiens
agaggggctcaagcagtggtct

SEQ ID NO: 8510238 - DNA, 22 bp, Homo sapiens
agaggtgacataggagaggctc

SEQ ID NO: 8510239 - DNA, 22 bp, Homo sapiens
agaggggctcaagcagtggtct

SEQ ID NO: 8510240 - DNA, 22 bp, Homo sapiens
agaggggctcaagcagtggtct

SEQ ID NO: 8510241 - DNA, 22 bp, Homo sapiens
agaggggcaagtaaagagtctt

SEQ ID NO: 8510242 - DNA, 22 bp, Homo sapiens
agaggggcaagtaaagagtctt

SEQ ID NO: 8510243 - DNA, 22 bp, Homo sapiens
agaggggagtcctaatctgatt

SEQ ID NO: 8510244 - DNA, 22 bp, Homo sapiens
agaggggagtcctaatctgatt

SEQ ID NO: 8510245 - DNA, 23 bp, Homo sapiens
agaggggagcatctgctggctga

SEQ ID NO: 8510246 - DNA, 22 bp, Homo sapiens
agaggggaagtaatgaatgata

SEQ ID NO: 8510247 - DNA, 23 bp, Homo sapiens
agaggggagcatctgctggctga

SEQ ID NO: 8510248 - DNA, 22 bp, Homo sapiens
agaggggaggcgaaccagagtc

SEQ ID NO: 8510249 - DNA, 22 bp, Homo sapiens
agaggggaggcgaaccagagtc

SEQ ID NO: 8510250 - DNA, 22 bp, Homo sapiens
agaggctgggaagggtccccgg

SEQ ID NO: 8510251 - DNA, 22 bp, Homo sapiens
agaggctgggcaggacccacag

SEQ ID NO: 8510252 - DNA, 22 bp, Homo sapiens
agaggctgggaagggtccccgg

SEQ ID NO: 8510253 - DNA, 22 bp, Homo sapiens
agaggctgggcaggacccacag

SEQ ID NO: 8510254 - DNA, 22 bp, Homo sapiens
agaggctgggtacgggccacct

SEQ ID NO: 8510255 - DNA, 22 bp, Homo sapiens
agaggctgggtacgggccacct

SEQ ID NO: 8510256 - DNA, 22 bp, Homo sapiens
agaggctgtcccttgctattcc

SEQ ID NO: 8510257 - DNA, 22 bp, Homo sapiens
agaggctgtcccttgctattcc

SEQ ID NO: 8510258 - DNA, 19 bp, Homo sapiens
agaggctgtcacctgtagc

SEQ ID NO: 8510259 - DNA, 19 bp, Homo sapiens
agaggctgtcacctgtagc

SEQ ID NO: 8510260 - DNA, 16 bp, Homo sapiens
agaggctgtaatggaa

SEQ ID NO: 8510261 - DNA, 19 bp, Homo sapiens
agaggctgtcacctgtagc

SEQ ID NO: 8510262 - DNA, 16 bp, Homo sapiens
agaggctgtaatggaa

SEQ ID NO: 8510263 - DNA, 22 bp, Homo sapiens
agaggctgggtacgggccacct

SEQ ID NO: 8510264 - DNA, 22 bp, Homo sapiens
agagggctggacgcaggttgga

SEQ ID NO: 8510265 - DNA, 22 bp, Homo sapiens
agagggctgggatgtgctgtgt

SEQ ID NO: 8510266 - DNA, 22 bp, Homo sapiens
agaggctgtctcatattttgta

SEQ ID NO: 8510267 - DNA, 22 bp, Homo sapiens
agagggcttccctaggagtgag

SEQ ID NO: 8510268 - DNA, 22 bp, Homo sapiens
agagtgcccaagcctggcaggg

SEQ ID NO: 8510269 - DNA, 22 bp, Homo sapiens
agagtgccctgctctgagctct

SEQ ID NO: 8510270 - DNA, 22 bp, Homo sapiens
agagtgccctgctctgagctct

SEQ ID NO: 8510271 - DNA, 22 bp, Homo sapiens
agagtgcagaggtcaaagaaca

SEQ ID NO: 8510272 - DNA, 22 bp, Homo sapiens
agagtgagggggcactgagacg

SEQ ID NO: 8510273 - DNA, 22 bp, Homo sapiens
agagtgagggggcactgagacg

SEQ ID NO: 8510274 - DNA, 22 bp, Homo sapiens
agagtgagggggcactgagacg

SEQ ID NO: 8510275 - DNA, 22 bp, Homo sapiens
agagtgagggggcactgagacg

SEQ ID NO: 8510276 - DNA, 22 bp, Homo sapiens
agagtcctgagtggaaaaatgg

SEQ ID NO: 8510277 - DNA, 19 bp, Homo sapiens
agagtcggggggacatagg

SEQ ID NO: 8510278 - DNA, 22 bp, Homo sapiens
agagtctgaggcagctgcagcc

SEQ ID NO: 8510279 - DNA, 21 bp, Homo sapiens
agagtctgagtgtgcaagggc

SEQ ID NO: 8510280 - DNA, 22 bp, Homo sapiens
agagtctgaggcagctgcagcc

SEQ ID NO: 8510281 - DNA, 22 bp, Homo sapiens
agagtctgatatttgtaccaga

SEQ ID NO: 8510282 - DNA, 22 bp, Homo sapiens
agagtccagaaaacagtgtgct

SEQ ID NO: 8510283 - DNA, 22 bp, Homo sapiens
agagtccatatattgatttgtt

SEQ ID NO: 8510284 - DNA, 22 bp, Homo sapiens
agagtcccagggacactccaga

SEQ ID NO: 8510285 - DNA, 22 bp, Homo sapiens
agagtccatgaagacagctgag

SEQ ID NO: 8510286 - DNA, 22 bp, Homo sapiens
agagtataattagtgtcttcta

SEQ ID NO: 8510287 - DNA, 22 bp, Homo sapiens
agagtagcctcatagacactca

SEQ ID NO: 8510288 - DNA, 22 bp, Homo sapiens
agagtagttctttgcagagtgg

SEQ ID NO: 8510289 - DNA, 20 bp, Homo sapiens
agagtagaggtagatttatg

SEQ ID NO: 8510290 - DNA, 22 bp, Homo sapiens
agaggtggagctcttggcatca

SEQ ID NO: 8510291 - DNA, 22 bp, Homo sapiens
agagtactgcctcagttatgaa

SEQ ID NO: 8510292 - DNA, 22 bp, Homo sapiens
agagtcaaaatttaccagaatg

SEQ ID NO: 8510293 - DNA, 22 bp, Homo sapiens
agagtattttgattatcctgga

SEQ ID NO: 8510294 - DNA, 22 bp, Homo sapiens
agagtattgtgaccatttgtca

SEQ ID NO: 8510295 - DNA, 19 bp, Homo sapiens
agagtattgaatttgccct

SEQ ID NO: 8510296 - DNA, 22 bp, Homo sapiens
agagtagttctttgcagagtgg

SEQ ID NO: 8510297 - DNA, 19 bp, Homo sapiens
agagtattgaatttgccct

SEQ ID NO: 8510298 - DNA, 22 bp, Homo sapiens
agagtcaccttttcctcaggat

SEQ ID NO: 8510299 - DNA, 22 bp, Homo sapiens
agagtcagaaagcagacagggg

SEQ ID NO: 8510300 - DNA, 22 bp, Homo sapiens
agagtcagaaagcagacagggg

SEQ ID NO: 8510301 - DNA, 22 bp, Homo sapiens
agagtcagaaagcagacagggg

SEQ ID NO: 8510302 - DNA, 22 bp, Homo sapiens
agagtcagaaagcagacagggg

SEQ ID NO: 8510303 - DNA, 22 bp, Homo sapiens
agagtcagaaccaagatgaggc

SEQ ID NO: 8510304 - DNA, 22 bp, Homo sapiens
agagtcagaaccaagatgaggc

SEQ ID NO: 8510305 - DNA, 22 bp, Homo sapiens
agagtcagaaccaagatgaggc

SEQ ID NO: 8510306 - DNA, 22 bp, Homo sapiens
agagtcagaaccaagatgaggc

SEQ ID NO: 8510307 - DNA, 22 bp, Homo sapiens
agagtcagcttatgacacagtc

SEQ ID NO: 8510308 - DNA, 22 bp, Homo sapiens
agagtcagcttatgacacagtc

SEQ ID NO: 8510309 - DNA, 22 bp, Homo sapiens
agagtcagactaagccatggtg

SEQ ID NO: 8510310 - DNA, 22 bp, Homo sapiens
agagtcatagtttaacttttgt

SEQ ID NO: 8510311 - DNA, 22 bp, Homo sapiens
agagtccaaatgtgcagttatg

SEQ ID NO: 8510312 - DNA, 22 bp, Homo sapiens
agagtcagttagcgaatactta

SEQ ID NO: 8510313 - DNA, 22 bp, Homo sapiens
agagtcagttagcgaatactta

SEQ ID NO: 8510314 - DNA, 22 bp, Homo sapiens
agagtcagttatgtcaagtgct

SEQ ID NO: 8510315 - DNA, 22 bp, Homo sapiens
agagtcagtaacatatatggta

SEQ ID NO: 8510316 - DNA, 22 bp, Homo sapiens
agagtcagtcactggcactttg

SEQ ID NO: 8510317 - DNA, 22 bp, Homo sapiens
agagtcagtaacatatatggta

SEQ ID NO: 8510318 - DNA, 22 bp, Homo sapiens
agaggccaggcagcccaaggtg

SEQ ID NO: 8510319 - DNA, 22 bp, Homo sapiens
agaggccaggcagcccaaggtg

SEQ ID NO: 8510320 - DNA, 22 bp, Homo sapiens
agaggccaggcagcccaaggtg

SEQ ID NO: 8510321 - DNA, 22 bp, Homo sapiens
agaggccaggcagcccaaggtg

SEQ ID NO: 8510322 - DNA, 23 bp, Homo sapiens
agaggccagcctttggagacacc

SEQ ID NO: 8510323 - DNA, 22 bp, Homo sapiens
agaggccagctagcgggccatc

SEQ ID NO: 8510324 - DNA, 22 bp, Homo sapiens
agaggccagctagcgggccatc

SEQ ID NO: 8510325 - DNA, 22 bp, Homo sapiens
agaggccaggctgcagagggat

SEQ ID NO: 8510326 - DNA, 22 bp, Homo sapiens
agaggccaggctgcagagggat

SEQ ID NO: 8510327 - DNA, 22 bp, Homo sapiens
agaggctccttcactctggcac

SEQ ID NO: 8510328 - DNA, 22 bp, Homo sapiens
agaggctcctcggtgcctcgtg

SEQ ID NO: 8510329 - DNA, 22 bp, Homo sapiens
agaggctgcacttgctcatgat

SEQ ID NO: 8510330 - DNA, 22 bp, Homo sapiens
agaggctgcacttgctcatgat

SEQ ID NO: 8510331 - DNA, 22 bp, Homo sapiens
agaggctgcacttgctcatgat

SEQ ID NO: 8510332 - DNA, 22 bp, Homo sapiens
agaggctgcacttgctcatgat

SEQ ID NO: 8510333 - DNA, 22 bp, Homo sapiens
agaggctgcacttgctcatgat

SEQ ID NO: 8510334 - DNA, 22 bp, Homo sapiens
agaggctccttcactctggcac

SEQ ID NO: 8510335 - DNA, 22 bp, Homo sapiens
agaggctgatggagtagtgtct

SEQ ID NO: 8510336 - DNA, 22 bp, Homo sapiens
agaggctgcacttgctcatgat

SEQ ID NO: 8510337 - DNA, 23 bp, Homo sapiens
agaggctgcagggtattgagaat

SEQ ID NO: 8510338 - DNA, 22 bp, Homo sapiens
agaggctgcaggctggaaatca

SEQ ID NO: 8510339 - DNA, 18 bp, Homo sapiens
agaggctggacaggggat

SEQ ID NO: 8510340 - DNA, 22 bp, Homo sapiens
agaggctgcaggctggaaatca

SEQ ID NO: 8510341 - DNA, 23 bp, Homo sapiens
agaggctgcagggtattgagaat

SEQ ID NO: 8510342 - DNA, 18 bp, Homo sapiens
agaggctggacaggggat

SEQ ID NO: 8510343 - DNA, 18 bp, Homo sapiens
agaggctggacaggggat

SEQ ID NO: 8510344 - DNA, 22 bp, Homo sapiens
agaggctggattgagcatagac

SEQ ID NO: 8510345 - DNA, 22 bp, Homo sapiens
agaggctggattgagcatagac

SEQ ID NO: 8510346 - DNA, 22 bp, Homo sapiens
agaggctggattgagcatagac

SEQ ID NO: 8510347 - DNA, 22 bp, Homo sapiens
agaggctgggaagggtccccgg

SEQ ID NO: 8510348 - DNA, 22 bp, Homo sapiens
agaggctggattgagcatagac

SEQ ID NO: 8510349 - DNA, 22 bp, Homo sapiens
agaggctggattgagcatagac

SEQ ID NO: 8510350 - DNA, 22 bp, Homo sapiens
agaggccactttgcctgtgatg

SEQ ID NO: 8510351 - DNA, 22 bp, Homo sapiens
agaggccactttgcctgtgatg

SEQ ID NO: 8510352 - DNA, 22 bp, Homo sapiens
agaggccactttgcctgtgatg

SEQ ID NO: 8510353 - DNA, 22 bp, Homo sapiens
agaggccactttgcctgtgatg

SEQ ID NO: 8510354 - DNA, 22 bp, Homo sapiens
agaggccaccttctcttgagaa

SEQ ID NO: 8510355 - DNA, 22 bp, Homo sapiens
agaggccagaaagtatgccacc

SEQ ID NO: 8510356 - DNA, 22 bp, Homo sapiens
agaggccagaaagtatgccacc

SEQ ID NO: 8510357 - DNA, 22 bp, Homo sapiens
agaggccagaaagtatgccacc

SEQ ID NO: 8510358 - DNA, 22 bp, Homo sapiens
agaggccagaaggcgcaccccg

SEQ ID NO: 8510359 - DNA, 22 bp, Homo sapiens
agaggccagaaggcgcaccccg

SEQ ID NO: 8510360 - DNA, 22 bp, Homo sapiens
agaggccaccactgtcagggac

SEQ ID NO: 8510361 - DNA, 22 bp, Homo sapiens
agaggccaccactgtcagggac

SEQ ID NO: 8510362 - DNA, 22 bp, Homo sapiens
agaggccaccactgtcagggac

SEQ ID NO: 8510363 - DNA, 16 bp, Homo sapiens
agaggccacagacaga

SEQ ID NO: 8510364 - DNA, 23 bp, Homo sapiens
agaggcaggagtggcttgcccgg

SEQ ID NO: 8510365 - DNA, 22 bp, Homo sapiens
agaggccaccttctcttgagaa

SEQ ID NO: 8510366 - DNA, 22 bp, Homo sapiens
agaggccaccagaggtggtgcc

SEQ ID NO: 8510367 - DNA, 22 bp, Homo sapiens
agaggccaccagaggtggtgcc

SEQ ID NO: 8510368 - DNA, 22 bp, Homo sapiens
agaggccagcagtgcctatctg

SEQ ID NO: 8510369 - DNA, 22 bp, Homo sapiens
agaggccagcactgcagggaag

SEQ ID NO: 8510370 - DNA, 22 bp, Homo sapiens
agaggccagcactgcagggaag

SEQ ID NO: 8510371 - DNA, 22 bp, Homo sapiens
agaggccagcactgcagggaag

SEQ ID NO: 8510372 - DNA, 22 bp, Homo sapiens
agaggccagcactgcagggaag

SEQ ID NO: 8510373 - DNA, 22 bp, Homo sapiens
agaggccagcaaccacagtaaa

SEQ ID NO: 8510374 - DNA, 22 bp, Homo sapiens
agaggccagcactgcagggaag

SEQ ID NO: 8510375 - DNA, 22 bp, Homo sapiens
agaggccagatcatcatagatg

SEQ ID NO: 8510376 - DNA, 22 bp, Homo sapiens
agaggccagcaaccacagtaaa

SEQ ID NO: 8510377 - DNA, 22 bp, Homo sapiens
agaggccagcccaggccaccga

SEQ ID NO: 8510378 - DNA, 22 bp, Homo sapiens
agaggccagcccaggccaccga

SEQ ID NO: 8510379 - DNA, 22 bp, Homo sapiens
agaggccagcagtgcctatctg

SEQ ID NO: 8510380 - DNA, 22 bp, Homo sapiens
agaggccagcagtgcctatctg

SEQ ID NO: 8510381 - DNA, 23 bp, Homo sapiens
agaggccagcctttggagacacc

SEQ ID NO: 8510382 - DNA, 23 bp, Homo sapiens
agaggccagcctttggagacacc

SEQ ID NO: 8510383 - DNA, 23 bp, Homo sapiens
agaggccagcctttggagacacc

SEQ ID NO: 8510384 - DNA, 23 bp, Homo sapiens
agaggccagcctttggagacacc

SEQ ID NO: 8510385 - DNA, 22 bp, Homo sapiens
agagctgggaccgtctggaagt

SEQ ID NO: 8510386 - DNA, 21 bp, Homo sapiens
agagctgggacttgcctgaga

SEQ ID NO: 8510387 - DNA, 21 bp, Homo sapiens
agagctgggacttgcctgaga

SEQ ID NO: 8510388 - DNA, 22 bp, Homo sapiens
agaggaggctgggtccagataa

SEQ ID NO: 8510389 - DNA, 22 bp, Homo sapiens
agaggaggctgggtccagataa

SEQ ID NO: 8510390 - DNA, 22 bp, Homo sapiens
agaggaggctgggtccagataa

SEQ ID NO: 8510391 - DNA, 22 bp, Homo sapiens
agagctgggaccgtctggaagt

SEQ ID NO: 8510392 - DNA, 22 bp, Homo sapiens
agagctgggaccgtctggaagt

SEQ ID NO: 8510393 - DNA, 22 bp, Homo sapiens
agagctggctgtgggtgacttt

SEQ ID NO: 8510394 - DNA, 22 bp, Homo sapiens
agagctggctgtgggtgacttt

SEQ ID NO: 8510395 - DNA, 22 bp, Homo sapiens
agagctggctgtgggtgacttt

SEQ ID NO: 8510396 - DNA, 22 bp, Homo sapiens
agaggcacaaactggaaaggac

SEQ ID NO: 8510397 - DNA, 22 bp, Homo sapiens
agaggcaccatctggaacagcc

SEQ ID NO: 8510398 - DNA, 22 bp, Homo sapiens
agaggcacagaggcagtcccct

SEQ ID NO: 8510399 - DNA, 22 bp, Homo sapiens
agaggcaagggacctttctggg

SEQ ID NO: 8510400 - DNA, 19 bp, Homo sapiens
agaggcaagggctcatgac

SEQ ID NO: 8510401 - DNA, 19 bp, Homo sapiens
agaggcaagggctcatgac

SEQ ID NO: 8510402 - DNA, 22 bp, Homo sapiens
agaggcaagttcagagctagga

SEQ ID NO: 8510403 - DNA, 22 bp, Homo sapiens
attacagtaacagctacaatgc

SEQ ID NO: 8510404 - DNA, 22 bp, Homo sapiens
attacagtaacagctacaatgc

SEQ ID NO: 8510405 - DNA, 23 bp, Homo sapiens
agaggcaggagtggcttgcccgg

SEQ ID NO: 8510406 - DNA, 22 bp, Homo sapiens
attacagtaaatgctacaggca

SEQ ID NO: 8510407 - DNA, 22 bp, Homo sapiens
attacagaagatatgctcaaca

SEQ ID NO: 8510408 - DNA, 22 bp, Homo sapiens
attacacttgttcatcatcacc

SEQ ID NO: 8510409 - DNA, 22 bp, Homo sapiens
attacagaaagcaatattgagt

SEQ ID NO: 8510410 - DNA, 22 bp, Homo sapiens
attacacaggctggctctttga

SEQ ID NO: 8510411 - DNA, 22 bp, Homo sapiens
attacacatagacattcgttca

SEQ ID NO: 8510412 - DNA, 22 bp, Homo sapiens
attacactaatgtgacaacaat

SEQ ID NO: 8510413 - DNA, 22 bp, Homo sapiens
attacacagcggttactactag

SEQ ID NO: 8510414 - DNA, 22 bp, Homo sapiens
attacacaggctggctctttga

SEQ ID NO: 8510415 - DNA, 22 bp, Homo sapiens
attacacagcggttactactag

SEQ ID NO: 8510416 - DNA, 23 bp, Homo sapiens
agaggcactaattattcagagat

SEQ ID NO: 8510417 - DNA, 22 bp, Homo sapiens
attacaatcgagagaaacaaat

SEQ ID NO: 8510418 - DNA, 22 bp, Homo sapiens
agaggcactaagggaagagcag

SEQ ID NO: 8510419 - DNA, 22 bp, Homo sapiens
agaggcacggaggctgcatgga

SEQ ID NO: 8510420 - DNA, 22 bp, Homo sapiens
agaggcaccgtctgcagcgtgc

SEQ ID NO: 8510421 - DNA, 22 bp, Homo sapiens
agaggcacccgcgcgcggccat

SEQ ID NO: 8510422 - DNA, 22 bp, Homo sapiens
accagtccgcggagctccgggg

SEQ ID NO: 8510423 - DNA, 22 bp, Homo sapiens
accagtatgtgccttcagtgtc

SEQ ID NO: 8510424 - DNA, 22 bp, Homo sapiens
accagtatgtgccttcagtgtc

SEQ ID NO: 8510425 - DNA, 22 bp, Homo sapiens
accagtcatagaaagcagtggt

SEQ ID NO: 8510426 - DNA, 22 bp, Homo sapiens
accaggtggccccagcgtggtt

SEQ ID NO: 8510427 - DNA, 22 bp, Homo sapiens
accaggtggccccagcgtggtt

SEQ ID NO: 8510428 - DNA, 22 bp, Homo sapiens
accaggtggccccagcgtggtt

SEQ ID NO: 8510429 - DNA, 22 bp, Homo sapiens
accaggtaatgtaaagcagggt

SEQ ID NO: 8510430 - DNA, 22 bp, Homo sapiens
accagttaaagggaaattgaaa

SEQ ID NO: 8510431 - DNA, 22 bp, Homo sapiens
accagtggatgaatgctggacc

SEQ ID NO: 8510432 - DNA, 22 bp, Homo sapiens
accagtggaattattctgtggt

SEQ ID NO: 8510433 - DNA, 22 bp, Homo sapiens
accatacttgaaatggatagga

SEQ ID NO: 8510434 - DNA, 22 bp, Homo sapiens
accatagactggaggatctcct

SEQ ID NO: 8510435 - DNA, 20 bp, Homo sapiens
accataatgttaattacaaa

SEQ ID NO: 8510436 - DNA, 22 bp, Homo sapiens
agggcctcgggctcagtgggtc

SEQ ID NO: 8510437 - DNA, 23 bp, Homo sapiens
agggcccaagcctggacagcagg

SEQ ID NO: 8510438 - DNA, 22 bp, Homo sapiens
accagggccgcgggcgactagc

SEQ ID NO: 8510439 - DNA, 22 bp, Homo sapiens
accagggcggcttgaggaggca

SEQ ID NO: 8510440 - DNA, 22 bp, Homo sapiens
accagggcggcttgaggaggca

SEQ ID NO: 8510441 - DNA, 22 bp, Homo sapiens
accagggcggcttgaggaggca

SEQ ID NO: 8510442 - DNA, 22 bp, Homo sapiens
accagggcggcttgaggaggca

SEQ ID NO: 8510443 - DNA, 22 bp, Homo sapiens
accagggcggcttgaggaggca

SEQ ID NO: 8510444 - DNA, 22 bp, Homo sapiens
accagggcagccgaggtgtgtc

SEQ ID NO: 8510445 - DNA, 22 bp, Homo sapiens
accagggcccgggagagctctc

SEQ ID NO: 8510446 - DNA, 22 bp, Homo sapiens
accagggcagccgaggtgtgtc

SEQ ID NO: 8510447 - DNA, 22 bp, Homo sapiens
accagggcttacagcagtagct

SEQ ID NO: 8510448 - DNA, 22 bp, Homo sapiens
accaggggatggttggcactgt

SEQ ID NO: 8510449 - DNA, 22 bp, Homo sapiens
accaggggtgtcaacagcattt

SEQ ID NO: 8510450 - DNA, 22 bp, Homo sapiens
accagggcttacagcagtagct

SEQ ID NO: 8510451 - DNA, 22 bp, Homo sapiens
accagggttgagtcagctgcgt

SEQ ID NO: 8510452 - DNA, 22 bp, Homo sapiens
accagggttgagtcagctgcgt

SEQ ID NO: 8510453 - DNA, 22 bp, Homo sapiens
accaggggtgtcaacagcattt

SEQ ID NO: 8510454 - DNA, 22 bp, Homo sapiens
accagggctgacaatctgatgg

SEQ ID NO: 8510455 - DNA, 22 bp, Homo sapiens
accagggcagccgaggtgtgtc

SEQ ID NO: 8510456 - DNA, 22 bp, Homo sapiens
accaggagtctagcctagtcaa

SEQ ID NO: 8510457 - DNA, 22 bp, Homo sapiens
accaggagtctagcctagtcaa

SEQ ID NO: 8510458 - DNA, 22 bp, Homo sapiens
accaggctgtgaagtgagacta

SEQ ID NO: 8510459 - DNA, 22 bp, Homo sapiens
accaggagggaccctggtggcc

SEQ ID NO: 8510460 - DNA, 22 bp, Homo sapiens
accaggagggaccctggtggcc

SEQ ID NO: 8510461 - DNA, 22 bp, Homo sapiens
accaggaggctacactgtccca

SEQ ID NO: 8510462 - DNA, 22 bp, Homo sapiens
accaggaggtgtttgctcaagt

SEQ ID NO: 8510463 - DNA, 22 bp, Homo sapiens
accaggagggaccctggtggcc

SEQ ID NO: 8510464 - DNA, 22 bp, Homo sapiens
accaggagtaacagtgagtggt

SEQ ID NO: 8510465 - DNA, 19 bp, Homo sapiens
accaggagtatcagagctg

SEQ ID NO: 8510466 - DNA, 19 bp, Homo sapiens
accaggagtatcagagctg

SEQ ID NO: 8510467 - DNA, 19 bp, Homo sapiens
accaggagtatcagagctg

SEQ ID NO: 8510468 - DNA, 19 bp, Homo sapiens
accaggaacttccctaggc

SEQ ID NO: 8510469 - DNA, 22 bp, Homo sapiens
accaggaagtgtgggccaacgt

SEQ ID NO: 8510470 - DNA, 18 bp, Homo sapiens
accaggaagcttcttgtc

SEQ ID NO: 8510471 - DNA, 22 bp, Homo sapiens
accaggactttgtattcagctt

SEQ ID NO: 8510472 - DNA, 19 bp, Homo sapiens
accaggagacagtgagctt

SEQ ID NO: 8510473 - DNA, 22 bp, Homo sapiens
accaggagacatgaccaatgag

SEQ ID NO: 8510474 - DNA, 22 bp, Homo sapiens
accaggagccacaggaggagcc

SEQ ID NO: 8510475 - DNA, 22 bp, Homo sapiens
accaggagccacaggaggagcc

SEQ ID NO: 8510476 - DNA, 23 bp, Homo sapiens
accaggagccaagatctccctgg

SEQ ID NO: 8510477 - DNA, 23 bp, Homo sapiens
accaggagccaagatctccctgg

SEQ ID NO: 8510478 - DNA, 20 bp, Homo sapiens
accaggagatggaggcaggg

SEQ ID NO: 8510479 - DNA, 23 bp, Homo sapiens
accaggagccaagatctccctgg

SEQ ID NO: 8510480 - DNA, 22 bp, Homo sapiens
accaggaggaagtgttaatgat

SEQ ID NO: 8510481 - DNA, 22 bp, Homo sapiens
accaggaggcctggagcacaaa

SEQ ID NO: 8510482 - DNA, 22 bp, Homo sapiens
accaggaggccttggttctgag

SEQ ID NO: 8510483 - DNA, 22 bp, Homo sapiens
accaggaggcctggagcacaaa

SEQ ID NO: 8510484 - DNA, 22 bp, Homo sapiens
accaggaggcctggagcacaaa

SEQ ID NO: 8510485 - DNA, 23 bp, Homo sapiens
aggcttcctatcttagagctggg

SEQ ID NO: 8510486 - DNA, 22 bp, Homo sapiens
accaaataggcttcctgggttg

SEQ ID NO: 8510487 - DNA, 22 bp, Homo sapiens
accaagcacaaagatgagtaaa

SEQ ID NO: 8510488 - DNA, 22 bp, Homo sapiens
accaagctctcttcccggctct

SEQ ID NO: 8510489 - DNA, 22 bp, Homo sapiens
accaagcacaaagatgagtaaa

SEQ ID NO: 8510490 - DNA, 22 bp, Homo sapiens
accagctcttctgctctagttg

SEQ ID NO: 8510491 - DNA, 22 bp, Homo sapiens
accagctctttcttttcactat

SEQ ID NO: 8510492 - DNA, 22 bp, Homo sapiens
accagctctttcttttcactat

SEQ ID NO: 8510493 - DNA, 22 bp, Homo sapiens
accagctgaactgcagcccagg

SEQ ID NO: 8510494 - DNA, 22 bp, Homo sapiens
accacaggaattgctctgtggt

SEQ ID NO: 8510495 - DNA, 22 bp, Homo sapiens
accacaggaattgctctgtggt

SEQ ID NO: 8510496 - DNA, 22 bp, Homo sapiens
accacagaggaatttgaagagg

SEQ ID NO: 8510497 - DNA, 22 bp, Homo sapiens
accacactggctagtgaagaag

SEQ ID NO: 8510498 - DNA, 22 bp, Homo sapiens
accaaggctaaaataacatgtt

SEQ ID NO: 8510499 - DNA, 22 bp, Homo sapiens
accctgggcacaccatttcccc

SEQ ID NO: 8510500 - DNA, 18 bp, Homo sapiens
accctgggcaattcactc

SEQ ID NO: 8510501 - DNA, 22 bp, Homo sapiens
accctgggcttggcctgctcag

SEQ ID NO: 8510502 - DNA, 23 bp, Homo sapiens
accctgggcaagtcacctaacct

SEQ ID NO: 8510503 - DNA, 22 bp, Homo sapiens
accctgggagggagaaatcaga

SEQ ID NO: 8510504 - DNA, 22 bp, Homo sapiens
accctgggaactggaaactgga

SEQ ID NO: 8510505 - DNA, 22 bp, Homo sapiens
accctgggacttccgagttgag

SEQ ID NO: 8510506 - DNA, 22 bp, Homo sapiens
accctgggacctggaggtggat

SEQ ID NO: 8510507 - DNA, 22 bp, Homo sapiens
accctgggacctggaggtggat

SEQ ID NO: 8510508 - DNA, 22 bp, Homo sapiens
accctggcctggttcatgtgat

SEQ ID NO: 8510509 - DNA, 22 bp, Homo sapiens
accctggcccattgctgtgcct

SEQ ID NO: 8510510 - DNA, 18 bp, Homo sapiens
accctggcatgctcttcc

SEQ ID NO: 8510511 - DNA, 22 bp, Homo sapiens
accctggcagccttctgtcctg

SEQ ID NO: 8510512 - DNA, 22 bp, Homo sapiens
accctggcagccttctgtcctg

SEQ ID NO: 8510513 - DNA, 21 bp, Homo sapiens
accctgggttctccataccct

SEQ ID NO: 8510514 - DNA, 22 bp, Homo sapiens
accctgggttcccgcagcacca

SEQ ID NO: 8510515 - DNA, 22 bp, Homo sapiens
accctgggttcccgcagcacca

SEQ ID NO: 8510516 - DNA, 22 bp, Homo sapiens
accctgtatacgctacattttt

SEQ ID NO: 8510517 - DNA, 21 bp, Homo sapiens
accctgggttctccataccct

SEQ ID NO: 8510518 - DNA, 22 bp, Homo sapiens
accctgggtctcaatcatccta

SEQ ID NO: 8510519 - DNA, 22 bp, Homo sapiens
accctgggtgagaggcaaacag

SEQ ID NO: 8510520 - DNA, 22 bp, Homo sapiens
accctgggtcatatacagtgtg

SEQ ID NO: 8510521 - DNA, 22 bp, Homo sapiens
accctgggttcccgcagcacca

SEQ ID NO: 8510522 - DNA, 22 bp, Homo sapiens
accctgggtgagaggcaaacag

SEQ ID NO: 8510523 - DNA, 22 bp, Homo sapiens
accctgggtatttcccaaactt

SEQ ID NO: 8510524 - DNA, 22 bp, Homo sapiens
accctggggtcacccttctctg

SEQ ID NO: 8510525 - DNA, 16 bp, Homo sapiens
accctgggtagtcctg

SEQ ID NO: 8510526 - DNA, 22 bp, Homo sapiens
accctgggcttggcctgctcag

SEQ ID NO: 8510527 - DNA, 22 bp, Homo sapiens
accctgggggtggccagtgcca

SEQ ID NO: 8510528 - DNA, 22 bp, Homo sapiens
accctgggggtggccagtgcca

SEQ ID NO: 8510529 - DNA, 20 bp, Homo sapiens
accccacagagtccattgca

SEQ ID NO: 8510530 - DNA, 22 bp, Homo sapiens
accccacagcatacaaaggcac

SEQ ID NO: 8510531 - DNA, 22 bp, Homo sapiens
accccaagacagtagaagagaa

SEQ ID NO: 8510532 - DNA, 22 bp, Homo sapiens
accccagaggcggaggctgcag

SEQ ID NO: 8510533 - DNA, 22 bp, Homo sapiens
accccagaggcggaggctgcag

SEQ ID NO: 8510534 - DNA, 22 bp, Homo sapiens
accccagaatctatgctttaca

SEQ ID NO: 8510535 - DNA, 22 bp, Homo sapiens
acccatgtgctcttttgtaccc

SEQ ID NO: 8510536 - DNA, 23 bp, Homo sapiens
acccatctctcctgtcatgcaga

SEQ ID NO: 8510537 - DNA, 22 bp, Homo sapiens
acccatgagtgtatctttaaaa

SEQ ID NO: 8510538 - DNA, 22 bp, Homo sapiens
accctggagcaataatccctgg

SEQ ID NO: 8510539 - DNA, 22 bp, Homo sapiens
accctctgccttgagcagtgcc

SEQ ID NO: 8510540 - DNA, 18 bp, Homo sapiens
accctctggcttctgagc

SEQ ID NO: 8510541 - DNA, 18 bp, Homo sapiens
accctctggcttctgagc

SEQ ID NO: 8510542 - DNA, 18 bp, Homo sapiens
accctctggcttctgagc

SEQ ID NO: 8510543 - DNA, 20 bp, Homo sapiens
accccagcccctctatctga

SEQ ID NO: 8510544 - DNA, 22 bp, Homo sapiens
accccagccctgcttctgggag

SEQ ID NO: 8510545 - DNA, 22 bp, Homo sapiens
acccagagcactgggtgtgggc

SEQ ID NO: 8510546 - DNA, 22 bp, Homo sapiens
acccagagcacagatgcaacgt

SEQ ID NO: 8510547 - DNA, 22 bp, Homo sapiens
acccagagcacagatgcaacgt

SEQ ID NO: 8510548 - DNA, 22 bp, Homo sapiens
acccagagatggacctggctgc

SEQ ID NO: 8510549 - DNA, 22 bp, Homo sapiens
acccagggtagaacctcagagc

SEQ ID NO: 8510550 - DNA, 22 bp, Homo sapiens
acccagggaccccgctgacgcc

SEQ ID NO: 8510551 - DNA, 22 bp, Homo sapiens
acccagggtagagtgcagtggc

SEQ ID NO: 8510552 - DNA, 22 bp, Homo sapiens
acccagggtagagtgcagtggc

SEQ ID NO: 8510553 - DNA, 22 bp, Homo sapiens
acccagggtagagtgcagtggc

SEQ ID NO: 8510554 - DNA, 22 bp, Homo sapiens
acccagggtagagtgcagtggc

SEQ ID NO: 8510555 - DNA, 22 bp, Homo sapiens
acccagggtagagtgcagtggc

SEQ ID NO: 8510556 - DNA, 18 bp, Homo sapiens
acccagtttgaaggaaag

SEQ ID NO: 8510557 - DNA, 22 bp, Homo sapiens
acccagtgacatcctttacctg

SEQ ID NO: 8510558 - DNA, 22 bp, Homo sapiens
acccagtctggagtgcagtgac

SEQ ID NO: 8510559 - DNA, 22 bp, Homo sapiens
acccagggtttgagctctgcag

SEQ ID NO: 8510560 - DNA, 22 bp, Homo sapiens
acccagggtttgagctctgcag

SEQ ID NO: 8510561 - DNA, 22 bp, Homo sapiens
acccaggtggctctgacggggg

SEQ ID NO: 8510562 - DNA, 22 bp, Homo sapiens
acccagtcatcctggtgtgaga

SEQ ID NO: 8510563 - DNA, 22 bp, Homo sapiens
acccagggttcctgggtcccag

SEQ ID NO: 8510564 - DNA, 22 bp, Homo sapiens
acccagggtcaccccgtagggt

SEQ ID NO: 8510565 - DNA, 19 bp, Homo sapiens
acccagggttgatgtccag

SEQ ID NO: 8510566 - DNA, 19 bp, Homo sapiens
acccagggttgatgtccag

SEQ ID NO: 8510567 - DNA, 19 bp, Homo sapiens
acccagggttgatgtccag

SEQ ID NO: 8510568 - DNA, 22 bp, Homo sapiens
agggcctgacacccttgccagc

SEQ ID NO: 8510569 - DNA, 22 bp, Homo sapiens
agggcctgacacccttgccagc

SEQ ID NO: 8510570 - DNA, 22 bp, Homo sapiens
agggcctgacacccttgccagc

SEQ ID NO: 8510571 - DNA, 22 bp, Homo sapiens
agggcctgagaccgtggcttga

SEQ ID NO: 8510572 - DNA, 22 bp, Homo sapiens
agggcctctgacgcccccagcc

SEQ ID NO: 8510573 - DNA, 22 bp, Homo sapiens
acccacagccgctgtgcgtccc

SEQ ID NO: 8510574 - DNA, 22 bp, Homo sapiens
acccacagccgctgtgcgtccc

SEQ ID NO: 8510575 - DNA, 22 bp, Homo sapiens
acccacgaagatgagcggcatg

SEQ ID NO: 8510576 - DNA, 22 bp, Homo sapiens
acccacgaagatgagcggcatg

SEQ ID NO: 8510577 - DNA, 22 bp, Homo sapiens
acccacgaagatgagcggcatg

SEQ ID NO: 8510578 - DNA, 22 bp, Homo sapiens
acccagagaactgtgccttgag

SEQ ID NO: 8510579 - DNA, 22 bp, Homo sapiens
acccactgtcatctctgaccac

SEQ ID NO: 8510580 - DNA, 22 bp, Homo sapiens
acccagagaactgaggcatgaa

SEQ ID NO: 8510581 - DNA, 22 bp, Homo sapiens
aggctgtgattccaccactctc

SEQ ID NO: 8510582 - DNA, 22 bp, Homo sapiens
aggctgtgattccaccactctc

SEQ ID NO: 8510583 - DNA, 22 bp, Homo sapiens
aggctccagtctcctctggcag

SEQ ID NO: 8510584 - DNA, 22 bp, Homo sapiens
aggctccaggcctccctgcatg

SEQ ID NO: 8510585 - DNA, 22 bp, Homo sapiens
aggctccaggcaaaatttcgga

SEQ ID NO: 8510586 - DNA, 22 bp, Homo sapiens
aggctccagcccaaggctgcag

SEQ ID NO: 8510587 - DNA, 22 bp, Homo sapiens
aggctccaggcccttcaccagc

SEQ ID NO: 8510588 - DNA, 22 bp, Homo sapiens
aggctccaggcccttcaccagc

SEQ ID NO: 8510589 - DNA, 22 bp, Homo sapiens
aggctgtgcaattagggtaaga

SEQ ID NO: 8510590 - DNA, 22 bp, Homo sapiens
aggcttcagcagccctctcttg

SEQ ID NO: 8510591 - DNA, 22 bp, Homo sapiens
aggcttcaggaagtctcctggg

SEQ ID NO: 8510592 - DNA, 19 bp, Homo sapiens
aggcttcaggccacatgct

SEQ ID NO: 8510593 - DNA, 19 bp, Homo sapiens
aggcttcaggccacatgct

SEQ ID NO: 8510594 - DNA, 22 bp, Homo sapiens
aggcttcagttgtaccttcttg

SEQ ID NO: 8510595 - DNA, 22 bp, Homo sapiens
aggcttcattacagtggttcaa

SEQ ID NO: 8510596 - DNA, 22 bp, Homo sapiens
aggcttcccagctgagctcagc

SEQ ID NO: 8510597 - DNA, 22 bp, Homo sapiens
aggcttcccagctgagctcagc

SEQ ID NO: 8510598 - DNA, 22 bp, Homo sapiens
aggcttcccaagcagctgcaaa

SEQ ID NO: 8510599 - DNA, 22 bp, Homo sapiens
aggcttccgagtagctgggact

SEQ ID NO: 8510600 - DNA, 18 bp, Homo sapiens
aggcttcccaggcaggcc

SEQ ID NO: 8510601 - DNA, 22 bp, Homo sapiens
aggctccagcccaaggctgcag

SEQ ID NO: 8510602 - DNA, 22 bp, Homo sapiens
aggctccagccaatgggtctgt

SEQ ID NO: 8510603 - DNA, 22 bp, Homo sapiens
aggctccagcagccagaggaag

SEQ ID NO: 8510604 - DNA, 22 bp, Homo sapiens
aggctccagcagccagaggaag

SEQ ID NO: 8510605 - DNA, 22 bp, Homo sapiens
aggctccagcagccagaggaag

SEQ ID NO: 8510606 - DNA, 22 bp, Homo sapiens
aggctccagcagccagaggaag

SEQ ID NO: 8510607 - DNA, 22 bp, Homo sapiens
aggctccagcagccagaggaag

SEQ ID NO: 8510608 - DNA, 22 bp, Homo sapiens
aggctccagcagccagaggaag

SEQ ID NO: 8510609 - DNA, 22 bp, Homo sapiens
acattgagtgctccataaatca

SEQ ID NO: 8510610 - DNA, 22 bp, Homo sapiens
acattgacctgattttgaagac

SEQ ID NO: 8510611 - DNA, 19 bp, Homo sapiens
acattgaattttcttcttt

SEQ ID NO: 8510612 - DNA, 22 bp, Homo sapiens
aggctccacggtcactggctct

SEQ ID NO: 8510613 - DNA, 22 bp, Homo sapiens
acattgatactgagatacaaag

SEQ ID NO: 8510614 - DNA, 22 bp, Homo sapiens
aggctccacggtcactggctct

SEQ ID NO: 8510615 - DNA, 23 bp, Homo sapiens
aggctccactccctgggatgtgg

SEQ ID NO: 8510616 - DNA, 23 bp, Homo sapiens
aggctccactccctgggatgtgg

SEQ ID NO: 8510617 - DNA, 22 bp, Homo sapiens
acattgaattcaaaattactga

SEQ ID NO: 8510618 - DNA, 19 bp, Homo sapiens
acattgaattttcttcttt

SEQ ID NO: 8510619 - DNA, 22 bp, Homo sapiens
acattgaatttcacttttgtac

SEQ ID NO: 8510620 - DNA, 22 bp, Homo sapiens
acattgaatgtatgtgatgaaa

SEQ ID NO: 8510621 - DNA, 22 bp, Homo sapiens
acattgaatgtatgtgatgaaa

SEQ ID NO: 8510622 - DNA, 22 bp, Homo sapiens
acattgaagggaatgcaaagat

SEQ ID NO: 8510623 - DNA, 22 bp, Homo sapiens
acattgaagctgtgaaatcaaa

SEQ ID NO: 8510624 - DNA, 22 bp, Homo sapiens
acattgaagggaatgcaaagat

SEQ ID NO: 8510625 - DNA, 22 bp, Homo sapiens
acattgaagggctatccaatag

SEQ ID NO: 8510626 - DNA, 22 bp, Homo sapiens
acattgaagtgtctggcctcct

SEQ ID NO: 8510627 - DNA, 22 bp, Homo sapiens
acattgaactacttgtaatgag

SEQ ID NO: 8510628 - DNA, 22 bp, Homo sapiens
acattgaaccagtagacacaaa

SEQ ID NO: 8510629 - DNA, 22 bp, Homo sapiens
acattgaactacttgtaatgag

SEQ ID NO: 8510630 - DNA, 22 bp, Homo sapiens
acattgaacagtacaaatgatc

SEQ ID NO: 8510631 - DNA, 22 bp, Homo sapiens
acattgaaagcatattatctcc

SEQ ID NO: 8510632 - DNA, 22 bp, Homo sapiens
acattgaacagtacaaatgatc

SEQ ID NO: 8510633 - DNA, 22 bp, Homo sapiens
acattgaacatggcaggacatt

SEQ ID NO: 8510634 - DNA, 22 bp, Homo sapiens
acattgaacatggcaggacatt

SEQ ID NO: 8510635 - DNA, 22 bp, Homo sapiens
acattctatgaagataatttta

SEQ ID NO: 8510636 - DNA, 22 bp, Homo sapiens
acattctatgaagataatttta

SEQ ID NO: 8510637 - DNA, 22 bp, Homo sapiens
acattctatagcaagctgatct

SEQ ID NO: 8510638 - DNA, 22 bp, Homo sapiens
acattctagatatgttatattt

SEQ ID NO: 8510639 - DNA, 22 bp, Homo sapiens
acattctagatatgttatattt

SEQ ID NO: 8510640 - DNA, 22 bp, Homo sapiens
acattctagatatgttatattt

SEQ ID NO: 8510641 - DNA, 22 bp, Homo sapiens
acattctagatatgttatattt

SEQ ID NO: 8510642 - DNA, 22 bp, Homo sapiens
acattctagaagtctttgcaat

SEQ ID NO: 8510643 - DNA, 22 bp, Homo sapiens
acattctagaagagcttcactt

SEQ ID NO: 8510644 - DNA, 22 bp, Homo sapiens
acattctttgagttttgttaaa

SEQ ID NO: 8510645 - DNA, 22 bp, Homo sapiens
acattcttggactccactctag

SEQ ID NO: 8510646 - DNA, 22 bp, Homo sapiens
acattctttcgatgtctgattt

SEQ ID NO: 8510647 - DNA, 22 bp, Homo sapiens
acattctttcaccttgtgtcca

SEQ ID NO: 8510648 - DNA, 22 bp, Homo sapiens
acattctttcaccttgtgtcca

SEQ ID NO: 8510649 - DNA, 22 bp, Homo sapiens
acattcattgccagggtggaag

SEQ ID NO: 8510650 - DNA, 22 bp, Homo sapiens
acattcattgagcaacaacaat

SEQ ID NO: 8510651 - DNA, 22 bp, Homo sapiens
acattccaggttggtgcagggt

SEQ ID NO: 8510652 - DNA, 19 bp, Homo sapiens
acattcccatcagcaatgt

SEQ ID NO: 8510653 - DNA, 22 bp, Homo sapiens
acattcctcagtgccagttgag

SEQ ID NO: 8510654 - DNA, 22 bp, Homo sapiens
acattcctgaatgggcacattt

SEQ ID NO: 8510655 - DNA, 22 bp, Homo sapiens
acattctaacattgtacagata

SEQ ID NO: 8510656 - DNA, 22 bp, Homo sapiens
acattctaaagcatgctcagga

SEQ ID NO: 8510657 - DNA, 22 bp, Homo sapiens
acattcctgaggaaatacattc

SEQ ID NO: 8510658 - DNA, 22 bp, Homo sapiens
acattcattgagcaacaacaat

SEQ ID NO: 8510659 - DNA, 22 bp, Homo sapiens
acattcagaatcttgtagcagt

SEQ ID NO: 8510660 - DNA, 22 bp, Homo sapiens
acattcatgggttttacattat

SEQ ID NO: 8510661 - DNA, 22 bp, Homo sapiens
acattcacgctctcaaagctga

SEQ ID NO: 8510662 - DNA, 22 bp, Homo sapiens
acattcactatgtccaaactct

SEQ ID NO: 8510663 - DNA, 22 bp, Homo sapiens
acattcactatgtccaaactct

SEQ ID NO: 8510664 - DNA, 22 bp, Homo sapiens
acattcaggccacagtggagtc

SEQ ID NO: 8510665 - DNA, 22 bp, Homo sapiens
acattcaggccacagtggagtc

SEQ ID NO: 8510666 - DNA, 22 bp, Homo sapiens
acattcattccaggtcagtcag

SEQ ID NO: 8510667 - DNA, 22 bp, Homo sapiens
acattcattccaggtcagtcag

SEQ ID NO: 8510668 - DNA, 22 bp, Homo sapiens
acattcatgtcccacttctagc

SEQ ID NO: 8510669 - DNA, 22 bp, Homo sapiens
acattcatgtcccacttctagc

SEQ ID NO: 8510670 - DNA, 22 bp, Homo sapiens
acattcatgtcccacttctagc

SEQ ID NO: 8510671 - DNA, 22 bp, Homo sapiens
acattcacgctctcaaagctga

SEQ ID NO: 8510672 - DNA, 21 bp, Homo sapiens
acattcacaggatattatcat

SEQ ID NO: 8510673 - DNA, 22 bp, Homo sapiens
acattcacaagcctacaaggtt

SEQ ID NO: 8510674 - DNA, 22 bp, Homo sapiens
acattcaaggccttctgacaca

SEQ ID NO: 8510675 - DNA, 22 bp, Homo sapiens
aggccctgcattgtactgaggg

SEQ ID NO: 8510676 - DNA, 22 bp, Homo sapiens
aggccctgcattgtactgaggg

SEQ ID NO: 8510677 - DNA, 22 bp, Homo sapiens
acattaagaaacgagagagcaa

SEQ ID NO: 8510678 - DNA, 22 bp, Homo sapiens
acattacactgtggtcctgttc

SEQ ID NO: 8510679 - DNA, 23 bp, Homo sapiens
acattacacgcagtaattgcccc

SEQ ID NO: 8510680 - DNA, 22 bp, Homo sapiens
aggccctgcaggagtggggaca

SEQ ID NO: 8510681 - DNA, 22 bp, Homo sapiens
aggccctgcaggaagcaggatg

SEQ ID NO: 8510682 - DNA, 20 bp, Homo sapiens
acatgaaaggaaacaggaaa

SEQ ID NO: 8510683 - DNA, 22 bp, Homo sapiens
acatgaaactgttgcattagaa

SEQ ID NO: 8510684 - DNA, 22 bp, Homo sapiens
acatgaaacccagccgtggtcc

SEQ ID NO: 8510685 - DNA, 22 bp, Homo sapiens
acatgaaacctgagtctaactc

SEQ ID NO: 8510686 - DNA, 20 bp, Homo sapiens
acatgaaaggaaacaggaaa

SEQ ID NO: 8510687 - DNA, 20 bp, Homo sapiens
acatgaaaggaaacaggaaa

SEQ ID NO: 8510688 - DNA, 21 bp, Homo sapiens
aggcccagctttcctcttgct

SEQ ID NO: 8510689 - DNA, 22 bp, Homo sapiens
aggcccagcttgaagtgggaag

SEQ ID NO: 8510690 - DNA, 22 bp, Homo sapiens
aggcccagcttgaagtgggaag

SEQ ID NO: 8510691 - DNA, 22 bp, Homo sapiens
aggcccagctgggccaggaaca

SEQ ID NO: 8510692 - DNA, 22 bp, Homo sapiens
aggccctgagaaaatccctgca

SEQ ID NO: 8510693 - DNA, 22 bp, Homo sapiens
aggccctgatccgaatccagat

SEQ ID NO: 8510694 - DNA, 22 bp, Homo sapiens
aggccctgagcatccgagggca

SEQ ID NO: 8510695 - DNA, 22 bp, Homo sapiens
aggcccagggctgctctctgaa

SEQ ID NO: 8510696 - DNA, 22 bp, Homo sapiens
aggcccagggctgctctctgaa

SEQ ID NO: 8510697 - DNA, 22 bp, Homo sapiens
acatgaaaagactatctgatta

SEQ ID NO: 8510698 - DNA, 22 bp, Homo sapiens
acatgaaaagactatctgatta

SEQ ID NO: 8510699 - DNA, 22 bp, Homo sapiens
acatgaaaagactatctgatta

SEQ ID NO: 8510700 - DNA, 22 bp, Homo sapiens
acatgaaaagactatctgatta

SEQ ID NO: 8510701 - DNA, 22 bp, Homo sapiens
acatgaaaagactatctgatta

SEQ ID NO: 8510702 - DNA, 22 bp, Homo sapiens
acatgaaacccagccgtggtcc

SEQ ID NO: 8510703 - DNA, 22 bp, Homo sapiens
acatgaaaactggttccttcag

SEQ ID NO: 8510704 - DNA, 22 bp, Homo sapiens
acatgaaaactggttccttcag

SEQ ID NO: 8510705 - DNA, 22 bp, Homo sapiens
acatgaaaactggttccttcag

SEQ ID NO: 8510706 - DNA, 22 bp, Homo sapiens
aggccagcctcaggcagggacc

SEQ ID NO: 8510707 - DNA, 22 bp, Homo sapiens
acatctttgctcttatagagct

SEQ ID NO: 8510708 - DNA, 22 bp, Homo sapiens
aggccagccctgggctgagaga

SEQ ID NO: 8510709 - DNA, 22 bp, Homo sapiens
aggccagcattctctctccagg

SEQ ID NO: 8510710 - DNA, 22 bp, Homo sapiens
aggccagcatgcagttctaagg

SEQ ID NO: 8510711 - DNA, 22 bp, Homo sapiens
aggccagcattctctctccagg

SEQ ID NO: 8510712 - DNA, 22 bp, Homo sapiens
aggccagcattctctctccagg

SEQ ID NO: 8510713 - DNA, 22 bp, Homo sapiens
aggccagccctcacctgtgttc

SEQ ID NO: 8510714 - DNA, 22 bp, Homo sapiens
aggccagccctcacctgtgttc

SEQ ID NO: 8510715 - DNA, 22 bp, Homo sapiens
aggccagccctgggctgagaga

SEQ ID NO: 8510716 - DNA, 22 bp, Homo sapiens
aggccagccctgggctgagaga

SEQ ID NO: 8510717 - DNA, 22 bp, Homo sapiens
aggccagccctgggctgagaga

SEQ ID NO: 8510718 - DNA, 18 bp, Homo sapiens
aggccagccctgctactg

SEQ ID NO: 8510719 - DNA, 18 bp, Homo sapiens
aggccagccctgctactg

SEQ ID NO: 8510720 - DNA, 18 bp, Homo sapiens
aggccagccctgctactg

SEQ ID NO: 8510721 - DNA, 22 bp, Homo sapiens
aggccacagagagtgcatgtgc

SEQ ID NO: 8510722 - DNA, 22 bp, Homo sapiens
aggccacagagagtgcatgtgc

SEQ ID NO: 8510723 - DNA, 22 bp, Homo sapiens
aggccacagagagtgcatgtgc

SEQ ID NO: 8510724 - DNA, 22 bp, Homo sapiens
aggccacagatactgtgaagta

SEQ ID NO: 8510725 - DNA, 22 bp, Homo sapiens
aggccacacaactcttagagat

SEQ ID NO: 8510726 - DNA, 18 bp, Homo sapiens
aggccacactccagaaca

SEQ ID NO: 8510727 - DNA, 18 bp, Homo sapiens
aggccacactccagaaca

SEQ ID NO: 8510728 - DNA, 22 bp, Homo sapiens
aggcatgggtagaagagaagcc

SEQ ID NO: 8510729 - DNA, 22 bp, Homo sapiens
aggcatgtatatgtgcacatgt

SEQ ID NO: 8510730 - DNA, 22 bp, Homo sapiens
aggccacaagaactaccccatc

SEQ ID NO: 8510731 - DNA, 22 bp, Homo sapiens
aggccagcaccagagtcaagaa

SEQ ID NO: 8510732 - DNA, 22 bp, Homo sapiens
aggccagcacgacagccgcagg

SEQ ID NO: 8510733 - DNA, 22 bp, Homo sapiens
aggccagcacgacagccgcagg

SEQ ID NO: 8510734 - DNA, 22 bp, Homo sapiens
aggccagcagacgtgggactga

SEQ ID NO: 8510735 - DNA, 22 bp, Homo sapiens
aggccacaggcaccctgtgttc

SEQ ID NO: 8510736 - DNA, 22 bp, Homo sapiens
aggccacaggtggaagccagag

SEQ ID NO: 8510737 - DNA, 22 bp, Homo sapiens
aggccagcaagaaagagagtct

SEQ ID NO: 8510738 - DNA, 22 bp, Homo sapiens
aggccagcaagaaagagagtct

SEQ ID NO: 8510739 - DNA, 22 bp, Homo sapiens
aggccacagcctgggaggtgac

SEQ ID NO: 8510740 - DNA, 22 bp, Homo sapiens
aggccacagcctgggaggtgac

SEQ ID NO: 8510741 - DNA, 22 bp, Homo sapiens
aggccacaggattgcacagcat

SEQ ID NO: 8510742 - DNA, 22 bp, Homo sapiens
aggccacaggcaccctgtgttc

SEQ ID NO: 8510743 - DNA, 22 bp, Homo sapiens
aggccacaggcaccctgtgttc

SEQ ID NO: 8510744 - DNA, 19 bp, Homo sapiens
aggcatgggaagagaagtc

SEQ ID NO: 8510745 - DNA, 22 bp, Homo sapiens
aggcatggctttaggcaggcgt

SEQ ID NO: 8510746 - DNA, 22 bp, Homo sapiens
aggcatggggctgcagtcaggt

SEQ ID NO: 8510747 - DNA, 22 bp, Homo sapiens
aggcatggggctgcagtcaggt

SEQ ID NO: 8510748 - DNA, 22 bp, Homo sapiens
acatacatggtgctttcttggt

SEQ ID NO: 8510749 - DNA, 22 bp, Homo sapiens
acatacatgtaaaggaaattat

SEQ ID NO: 8510750 - DNA, 22 bp, Homo sapiens
aggcagtgttcttctaagggca

SEQ ID NO: 8510751 - DNA, 22 bp, Homo sapiens
aggcagtgttcttctaagggca

SEQ ID NO: 8510752 - DNA, 22 bp, Homo sapiens
aggcatggcatggggcagatgt

SEQ ID NO: 8510753 - DNA, 22 bp, Homo sapiens
acatacatggtgctttcttggt

SEQ ID NO: 8510754 - DNA, 22 bp, Homo sapiens
acatacatggtgctttcttggt

SEQ ID NO: 8510755 - DNA, 22 bp, Homo sapiens
acatacatgggattaaaaaatt

SEQ ID NO: 8510756 - DNA, 22 bp, Homo sapiens
acatacatgggattaaaaaatt

SEQ ID NO: 8510757 - DNA, 22 bp, Homo sapiens
acatacatgggattaaaaaatt

SEQ ID NO: 8510758 - DNA, 22 bp, Homo sapiens
agcttttagtacgttaaaattg

SEQ ID NO: 8510759 - DNA, 21 bp, Homo sapiens
agcttttctgttttatatcta

SEQ ID NO: 8510760 - DNA, 22 bp, Homo sapiens
agcttttattggctgtcatttg

SEQ ID NO: 8510761 - DNA, 22 bp, Homo sapiens
aggaaaaaagtctgtgattata

SEQ ID NO: 8510762 - DNA, 22 bp, Homo sapiens
aggaaaaaagtctgtgattata

SEQ ID NO: 8510763 - DNA, 22 bp, Homo sapiens
aggaaaaaagtctgtgattata

SEQ ID NO: 8510764 - DNA, 22 bp, Homo sapiens
aggaaaaagagttgctgccttc

SEQ ID NO: 8510765 - DNA, 22 bp, Homo sapiens
aggaaaaacctgttaatggtag

SEQ ID NO: 8510766 - DNA, 22 bp, Homo sapiens
aggaaaaacctgttaatggtag

SEQ ID NO: 8510767 - DNA, 23 bp, Homo sapiens
agcttcattattttccatgatct

SEQ ID NO: 8510768 - DNA, 22 bp, Homo sapiens
agcttcattccagccactgtga

SEQ ID NO: 8510769 - DNA, 22 bp, Homo sapiens
agcttcattccagccactgtga

SEQ ID NO: 8510770 - DNA, 23 bp, Homo sapiens
agcttcatcttgctgtgtctcag

SEQ ID NO: 8510771 - DNA, 22 bp, Homo sapiens
agcttcataattccttgactca

SEQ ID NO: 8510772 - DNA, 22 bp, Homo sapiens
agctttggttgaggggagtgtg

SEQ ID NO: 8510773 - DNA, 22 bp, Homo sapiens
agctttggttgaggggagtgtg

SEQ ID NO: 8510774 - DNA, 20 bp, Homo sapiens
aggaagccaaaggctgtctt

SEQ ID NO: 8510775 - DNA, 18 bp, Homo sapiens
aggaagcaggaggaaggc

SEQ ID NO: 8510776 - DNA, 22 bp, Homo sapiens
aggaagccatggtggacgtcta

SEQ ID NO: 8510777 - DNA, 22 bp, Homo sapiens
aggaagccatggtggacgtcta

SEQ ID NO: 8510778 - DNA, 22 bp, Homo sapiens
aggaagagcattcacatggtag

SEQ ID NO: 8510779 - DNA, 18 bp, Homo sapiens
aggaaagaaaggcaggtg

SEQ ID NO: 8510780 - DNA, 18 bp, Homo sapiens
aggaaagaaaggcaggtg

SEQ ID NO: 8510781 - DNA, 22 bp, Homo sapiens
aggaaagaaaggaggtgcattt

SEQ ID NO: 8510782 - DNA, 22 bp, Homo sapiens
aggaaacttcagagttttggtc

SEQ ID NO: 8510783 - DNA, 22 bp, Homo sapiens
aggaaactaaggctcagtgaag

SEQ ID NO: 8510784 - DNA, 22 bp, Homo sapiens
aggaaactaattagtagaataa

SEQ ID NO: 8510785 - DNA, 22 bp, Homo sapiens
aggaaactcccctacatctcaa

SEQ ID NO: 8510786 - DNA, 22 bp, Homo sapiens
agctgtgtaagtcatgtaggtg

SEQ ID NO: 8510787 - DNA, 22 bp, Homo sapiens
agctgtgtaggatcataacacg

SEQ ID NO: 8510788 - DNA, 22 bp, Homo sapiens
agctgtggtgttttcaagccct

SEQ ID NO: 8510789 - DNA, 22 bp, Homo sapiens
agctgtggggaggaggctagca

SEQ ID NO: 8510790 - DNA, 22 bp, Homo sapiens
agcttcaggaacaggcagcctg

SEQ ID NO: 8510791 - DNA, 22 bp, Homo sapiens
agcttcactttgtactttgtca

SEQ ID NO: 8510792 - DNA, 22 bp, Homo sapiens
agcttcaaagctaggaagatct

SEQ ID NO: 8510793 - DNA, 22 bp, Homo sapiens
agcttattaatttttctgcatg

SEQ ID NO: 8510794 - DNA, 22 bp, Homo sapiens
agcttagtggttgtatgagtta

SEQ ID NO: 8510795 - DNA, 22 bp, Homo sapiens
agctgtgtaggatcataacacg

SEQ ID NO: 8510796 - DNA, 22 bp, Homo sapiens
agcttagaatgtgttaggaaag

SEQ ID NO: 8510797 - DNA, 22 bp, Homo sapiens
agcttagtggttgtatgagtta

SEQ ID NO: 8510798 - DNA, 22 bp, Homo sapiens
agcttaggaggatgatgaacat

SEQ ID NO: 8510799 - DNA, 22 bp, Homo sapiens
agctgggatgaggagcatcctt

SEQ ID NO: 8510800 - DNA, 22 bp, Homo sapiens
agctgggatgataacctcagtc

SEQ ID NO: 8510801 - DNA, 22 bp, Homo sapiens
agctgggcaaaatgtgaggttg

SEQ ID NO: 8510802 - DNA, 22 bp, Homo sapiens
agctgggcaaaatgtgaggttg

SEQ ID NO: 8510803 - DNA, 22 bp, Homo sapiens
agctgggcaaaatgtgaggttg

SEQ ID NO: 8510804 - DNA, 22 bp, Homo sapiens
agctggttagcaatctaagtga

SEQ ID NO: 8510805 - DNA, 20 bp, Homo sapiens
agctggttatcttaattctt

SEQ ID NO: 8510806 - DNA, 22 bp, Homo sapiens
agctgtgggcctgggagagctg

SEQ ID NO: 8510807 - DNA, 22 bp, Homo sapiens
agctgtgggcctgggagagctg

SEQ ID NO: 8510808 - DNA, 22 bp, Homo sapiens
agctgtgggatttgggtgtgcc

SEQ ID NO: 8510809 - DNA, 22 bp, Homo sapiens
agctgtgggatttgggtgtgcc

SEQ ID NO: 8510810 - DNA, 21 bp, Homo sapiens
agctgtggcgaggggaacatg

SEQ ID NO: 8510811 - DNA, 22 bp, Homo sapiens
agctgtgggagaatctctgggt

SEQ ID NO: 8510812 - DNA, 22 bp, Homo sapiens
agctggttcagtttctgggcct

SEQ ID NO: 8510813 - DNA, 22 bp, Homo sapiens
agctggttcagaaattagatgg

SEQ ID NO: 8510814 - DNA, 22 bp, Homo sapiens
agctgggagctgaaggctgatt

SEQ ID NO: 8510815 - DNA, 22 bp, Homo sapiens
agctgggagcagagccacagcc

SEQ ID NO: 8510816 - DNA, 21 bp, Homo sapiens
agctggctctctctggagaga

SEQ ID NO: 8510817 - DNA, 22 bp, Homo sapiens
agctgggagcagagccacagcc

SEQ ID NO: 8510818 - DNA, 22 bp, Homo sapiens
agctgggagcagagccacagcc

SEQ ID NO: 8510819 - DNA, 22 bp, Homo sapiens
agctgggagcagagccacagcc

SEQ ID NO: 8510820 - DNA, 22 bp, Homo sapiens
agctgggaggctcctctgtgac

SEQ ID NO: 8510821 - DNA, 22 bp, Homo sapiens
agctgggaggctcctctgtgac

SEQ ID NO: 8510822 - DNA, 22 bp, Homo sapiens
agctgggaggctcctctgtgac

SEQ ID NO: 8510823 - DNA, 22 bp, Homo sapiens
agctgggaggtgggcagtgaga

SEQ ID NO: 8510824 - DNA, 22 bp, Homo sapiens
agctgggaggtgggcagtgaga

SEQ ID NO: 8510825 - DNA, 18 bp, Homo sapiens
agctgcttgcaggccttc

SEQ ID NO: 8510826 - DNA, 22 bp, Homo sapiens
agctgcttgggaaccatcaatt

SEQ ID NO: 8510827 - DNA, 22 bp, Homo sapiens
agctgcttgtacatgaccacat

SEQ ID NO: 8510828 - DNA, 22 bp, Homo sapiens
acagcccagaaagcctaagggg

SEQ ID NO: 8510829 - DNA, 22 bp, Homo sapiens
acagcccagaaagcctaagggg

SEQ ID NO: 8510830 - DNA, 22 bp, Homo sapiens
acagcccagctctttctctgca

SEQ ID NO: 8510831 - DNA, 22 bp, Homo sapiens
agctgcttagagtctcttctta

SEQ ID NO: 8510832 - DNA, 22 bp, Homo sapiens
agctgcttataagatttgggag

SEQ ID NO: 8510833 - DNA, 22 bp, Homo sapiens
agctgcttcaaaatgggctcct

SEQ ID NO: 8510834 - DNA, 22 bp, Homo sapiens
agctgcttcctctttgatgtca

SEQ ID NO: 8510835 - DNA, 21 bp, Homo sapiens
acagcctccatctcctgggct

SEQ ID NO: 8510836 - DNA, 22 bp, Homo sapiens
acagcccaggactccagtgggc

SEQ ID NO: 8510837 - DNA, 21 bp, Homo sapiens
agctgctgtggccagaatcca

SEQ ID NO: 8510838 - DNA, 22 bp, Homo sapiens
agctgctgtttggtgagtcttg

SEQ ID NO: 8510839 - DNA, 22 bp, Homo sapiens
agctgcttagagtcctcaggat

SEQ ID NO: 8510840 - DNA, 22 bp, Homo sapiens
acagcctgagagtggagctggc

SEQ ID NO: 8510841 - DNA, 22 bp, Homo sapiens
acagcctgagagtggagctggc

SEQ ID NO: 8510842 - DNA, 22 bp, Homo sapiens
acagcctgagagtggagctggc

SEQ ID NO: 8510843 - DNA, 22 bp, Homo sapiens
acagcctgacttttgttgtcac

SEQ ID NO: 8510844 - DNA, 22 bp, Homo sapiens
acagcctgacttttgttgtcac

SEQ ID NO: 8510845 - DNA, 22 bp, Homo sapiens
acagcctgcagccccaggtcgc

SEQ ID NO: 8510846 - DNA, 22 bp, Homo sapiens
acagcctgatttatggagcagt

SEQ ID NO: 8510847 - DNA, 22 bp, Homo sapiens
acagcctgatttatggagcagt

SEQ ID NO: 8510848 - DNA, 22 bp, Homo sapiens
agctggcagctctcaggggtac

SEQ ID NO: 8510849 - DNA, 22 bp, Homo sapiens
agctggcagctctcaggggtac

SEQ ID NO: 8510850 - DNA, 22 bp, Homo sapiens
agctggcagctctcaggggtac

SEQ ID NO: 8510851 - DNA, 20 bp, Homo sapiens
agctggcctgtcctaggcct

SEQ ID NO: 8510852 - DNA, 20 bp, Homo sapiens
agctggcctgtcctaggcct

SEQ ID NO: 8510853 - DNA, 20 bp, Homo sapiens
agctggcctgtcctaggcct

SEQ ID NO: 8510854 - DNA, 20 bp, Homo sapiens
agctggcctgtcctaggcct

SEQ ID NO: 8510855 - DNA, 20 bp, Homo sapiens
agctggcctgtcctaggcct

SEQ ID NO: 8510856 - DNA, 21 bp, Homo sapiens
agctggctctctctggagaga

SEQ ID NO: 8510857 - DNA, 21 bp, Homo sapiens
agctggctctctctggagaga

SEQ ID NO: 8510858 - DNA, 21 bp, Homo sapiens
agctggctctctctggagaga

SEQ ID NO: 8510859 - DNA, 22 bp, Homo sapiens
agctggctatgccctgtgaacc

SEQ ID NO: 8510860 - DNA, 22 bp, Homo sapiens
agctggctatgccctgtgaacc

SEQ ID NO: 8510861 - DNA, 22 bp, Homo sapiens
agctggctatgccctgtgaacc

SEQ ID NO: 8510862 - DNA, 22 bp, Homo sapiens
agctggctatacttgaaaagtc

SEQ ID NO: 8510863 - DNA, 22 bp, Homo sapiens
agctggctatacttgaaaagtc

SEQ ID NO: 8510864 - DNA, 22 bp, Homo sapiens
agctggccttcggtgtcactgg

SEQ ID NO: 8510865 - DNA, 22 bp, Homo sapiens
agctggccttcggtgtcactgg

SEQ ID NO: 8510866 - DNA, 22 bp, Homo sapiens
agctggccttcggtgtcactgg

SEQ ID NO: 8510867 - DNA, 22 bp, Homo sapiens
agctggccttagtgagcacctg

SEQ ID NO: 8510868 - DNA, 22 bp, Homo sapiens
agctggcctgttagagctgagt

SEQ ID NO: 8510869 - DNA, 22 bp, Homo sapiens
agctggcctgttagagctgagt

SEQ ID NO: 8510870 - DNA, 22 bp, Homo sapiens
agctggccttagtgagcacctg

SEQ ID NO: 8510871 - DNA, 22 bp, Homo sapiens
agctggccttcggtgtcactgg

SEQ ID NO: 8510872 - DNA, 22 bp, Homo sapiens
agctgcaggagtcgcctaggat

SEQ ID NO: 8510873 - DNA, 22 bp, Homo sapiens
agctgctgggatacagtagtga

SEQ ID NO: 8510874 - DNA, 22 bp, Homo sapiens
agctgctcaggagagccaggtc

SEQ ID NO: 8510875 - DNA, 22 bp, Homo sapiens
agctgctcaggagagccaggtc

SEQ ID NO: 8510876 - DNA, 22 bp, Homo sapiens
agctgcaggcccatgctcagtc

SEQ ID NO: 8510877 - DNA, 22 bp, Homo sapiens
agctgcaggaagtagaagcgga

SEQ ID NO: 8510878 - DNA, 22 bp, Homo sapiens
agctgcagctgttttctgagtg

SEQ ID NO: 8510879 - DNA, 22 bp, Homo sapiens
acagcccaagtcacctgcagga

SEQ ID NO: 8510880 - DNA, 22 bp, Homo sapiens
acagcccaagtcacctgcagga

SEQ ID NO: 8510881 - DNA, 22 bp, Homo sapiens
acagccagtgactgcagaccct

SEQ ID NO: 8510882 - DNA, 22 bp, Homo sapiens
acagccagtgactggacaagct

SEQ ID NO: 8510883 - DNA, 22 bp, Homo sapiens
agctgcagccctcctgcatggc

SEQ ID NO: 8510884 - DNA, 22 bp, Homo sapiens
agctgcagccctcctgcatggc

SEQ ID NO: 8510885 - DNA, 22 bp, Homo sapiens
agctgcagccgcagctgtggcc

SEQ ID NO: 8510886 - DNA, 22 bp, Homo sapiens
acagccagtcatctcagcaggg

SEQ ID NO: 8510887 - DNA, 22 bp, Homo sapiens
acagccagtaatctacccctgt

SEQ ID NO: 8510888 - DNA, 22 bp, Homo sapiens
acagccagtcctcccacagggt

SEQ ID NO: 8510889 - DNA, 22 bp, Homo sapiens
acagccagtgactgcagaccct

SEQ ID NO: 8510890 - DNA, 22 bp, Homo sapiens
acagccagtgactgcagaccct

SEQ ID NO: 8510891 - DNA, 22 bp, Homo sapiens
acagccagtcctcccacagggt

SEQ ID NO: 8510892 - DNA, 22 bp, Homo sapiens
acagccagggtctcaggaggcg

SEQ ID NO: 8510893 - DNA, 22 bp, Homo sapiens
acagccaggtaaaggcatggca

SEQ ID NO: 8510894 - DNA, 22 bp, Homo sapiens
acagccaggtaaaggcatggca

SEQ ID NO: 8510895 - DNA, 22 bp, Homo sapiens
agctccaggtgcaagtcatggt

SEQ ID NO: 8510896 - DNA, 22 bp, Homo sapiens
agctccaggtgcaagtcatggt

SEQ ID NO: 8510897 - DNA, 22 bp, Homo sapiens
agctccaggtgcaagtcatggt

SEQ ID NO: 8510898 - DNA, 22 bp, Homo sapiens
agctccagttacttacctagag

SEQ ID NO: 8510899 - DNA, 20 bp, Homo sapiens
agctccagtgctgacgcttc

SEQ ID NO: 8510900 - DNA, 20 bp, Homo sapiens
agctccagtgctgacgcttc

SEQ ID NO: 8510901 - DNA, 20 bp, Homo sapiens
agctccagtgctgacgcttc

SEQ ID NO: 8510902 - DNA, 22 bp, Homo sapiens
acagccagaggtggtcctgggt

SEQ ID NO: 8510903 - DNA, 18 bp, Homo sapiens
agctccatctgtcagcat

SEQ ID NO: 8510904 - DNA, 22 bp, Homo sapiens
agctccagtttcctgactgagc

SEQ ID NO: 8510905 - DNA, 22 bp, Homo sapiens
agctccagttacttacctagag

SEQ ID NO: 8510906 - DNA, 20 bp, Homo sapiens
agctccatgaagtagtcact

SEQ ID NO: 8510907 - DNA, 22 bp, Homo sapiens
agctcccaattgacttgaacta

SEQ ID NO: 8510908 - DNA, 22 bp, Homo sapiens
agctcccaattgacttgaacta

SEQ ID NO: 8510909 - DNA, 22 bp, Homo sapiens
aggagggtcatgttgaagtgta

SEQ ID NO: 8510910 - DNA, 20 bp, Homo sapiens
aggatggcaagcaagtgcat

SEQ ID NO: 8510911 - DNA, 22 bp, Homo sapiens
aggagggtacaatgggtggaaa

SEQ ID NO: 8510912 - DNA, 22 bp, Homo sapiens
aggagggtcatgttgaagtgta

SEQ ID NO: 8510913 - DNA, 22 bp, Homo sapiens
aggagggtacaatgggtggaaa

SEQ ID NO: 8510914 - DNA, 22 bp, Homo sapiens
aggaggggttctcgggtgctga

SEQ ID NO: 8510915 - DNA, 22 bp, Homo sapiens
aggaggggttctcgggtgctga

SEQ ID NO: 8510916 - DNA, 21 bp, Homo sapiens
aggaggggtctttcccactga

SEQ ID NO: 8510917 - DNA, 21 bp, Homo sapiens
aggaggggtctttcccactga

SEQ ID NO: 8510918 - DNA, 22 bp, Homo sapiens
aggaggggttctcgggtgctga

SEQ ID NO: 8510919 - DNA, 22 bp, Homo sapiens
aggaggggttctcgggtgctga

SEQ ID NO: 8510920 - DNA, 22 bp, Homo sapiens
aggaggggttctcgggtgctga

SEQ ID NO: 8510921 - DNA, 22 bp, Homo sapiens
aggaggggttctcgggtgctga

SEQ ID NO: 8510922 - DNA, 22 bp, Homo sapiens
aggaggggttctcgggtgctga

SEQ ID NO: 8510923 - DNA, 22 bp, Homo sapiens
aggcaaaataagcctctcctgt

SEQ ID NO: 8510924 - DNA, 22 bp, Homo sapiens
aggcaaagcgataccagagcta

SEQ ID NO: 8510925 - DNA, 22 bp, Homo sapiens
aggcaaagaggatattttgggg

SEQ ID NO: 8510926 - DNA, 22 bp, Homo sapiens
aggcaaagaggatattttgggg

SEQ ID NO: 8510927 - DNA, 22 bp, Homo sapiens
aggcaaattattgtatgcagtt

SEQ ID NO: 8510928 - DNA, 22 bp, Homo sapiens
aggaggctgtggagcactccat

SEQ ID NO: 8510929 - DNA, 22 bp, Homo sapiens
aggaggccgctgatgggctccc

SEQ ID NO: 8510930 - DNA, 22 bp, Homo sapiens
aggaggccgctgatgggctccc

SEQ ID NO: 8510931 - DNA, 22 bp, Homo sapiens
aggaggccgatttcagaggtcg

SEQ ID NO: 8510932 - DNA, 22 bp, Homo sapiens
aggaggcttttgcaggtgccac

SEQ ID NO: 8510933 - DNA, 22 bp, Homo sapiens
aggaggggcatagaaatgtaat

SEQ ID NO: 8510934 - DNA, 22 bp, Homo sapiens
aggaggggcatagaaatgtaat

SEQ ID NO: 8510935 - DNA, 22 bp, Homo sapiens
aggaggggcatagaaatgtaat

SEQ ID NO: 8510936 - DNA, 21 bp, Homo sapiens
aggaggggtctttcccactga

SEQ ID NO: 8510937 - DNA, 20 bp, Homo sapiens
aggagggacctggattggcg

SEQ ID NO: 8510938 - DNA, 22 bp, Homo sapiens
aggcacagatttggggaaagca

SEQ ID NO: 8510939 - DNA, 18 bp, Homo sapiens
aggcacagagcatacata

SEQ ID NO: 8510940 - DNA, 18 bp, Homo sapiens
aggcacagagcatacata

SEQ ID NO: 8510941 - DNA, 18 bp, Homo sapiens
aggcacagagcatacata

SEQ ID NO: 8510942 - DNA, 18 bp, Homo sapiens
aggcacagagcatacata

SEQ ID NO: 8510943 - DNA, 22 bp, Homo sapiens
aggcacagatttggggaaagca

SEQ ID NO: 8510944 - DNA, 18 bp, Homo sapiens
aggcacagagcatacata

SEQ ID NO: 8510945 - DNA, 18 bp, Homo sapiens
aggcacagagcatacata

SEQ ID NO: 8510946 - DNA, 22 bp, Homo sapiens
aggcacagagaatgccctccat

SEQ ID NO: 8510947 - DNA, 22 bp, Homo sapiens
aggcaacatgggccaggcagaa

SEQ ID NO: 8510948 - DNA, 22 bp, Homo sapiens
aggcaacataacacgaaagtct

SEQ ID NO: 8510949 - DNA, 22 bp, Homo sapiens
aggcaacatgactcacttgcac

SEQ ID NO: 8510950 - DNA, 22 bp, Homo sapiens
aggcaacaagggtagtcagtga

SEQ ID NO: 8510951 - DNA, 22 bp, Homo sapiens
aggcaaattgtgagaaaatgaa

SEQ ID NO: 8510952 - DNA, 22 bp, Homo sapiens
aggcaacaggaaaccacatgat

SEQ ID NO: 8510953 - DNA, 22 bp, Homo sapiens
aggcaacaggaaaccacatgat

SEQ ID NO: 8510954 - DNA, 19 bp, Homo sapiens
aggcacaattctgagaagc

SEQ ID NO: 8510955 - DNA, 19 bp, Homo sapiens
aggcacaattctgagaagc

SEQ ID NO: 8510956 - DNA, 19 bp, Homo sapiens
aggcacaattctgagaagc

SEQ ID NO: 8510957 - DNA, 22 bp, Homo sapiens
aggcacaaagacagaaaagcac

SEQ ID NO: 8510958 - DNA, 19 bp, Homo sapiens
aggcaaccaatgaggcaaa

SEQ ID NO: 8510959 - DNA, 19 bp, Homo sapiens
aggcaaccaatgaggcaaa

SEQ ID NO: 8510960 - DNA, 22 bp, Homo sapiens
acatacatcaagtatcacaaga

SEQ ID NO: 8510961 - DNA, 22 bp, Homo sapiens
acatacatcaagtatcacaaga

SEQ ID NO: 8510962 - DNA, 22 bp, Homo sapiens
acatacatcaagtatcacaaga

SEQ ID NO: 8510963 - DNA, 22 bp, Homo sapiens
acatacatcaagtatcacaaga

SEQ ID NO: 8510964 - DNA, 23 bp, Homo sapiens
acatacatggagataaagtgatg

SEQ ID NO: 8510965 - DNA, 23 bp, Homo sapiens
acatacatggagataaagtgatg

SEQ ID NO: 8510966 - DNA, 23 bp, Homo sapiens
acatacatggagataaagtgatg

SEQ ID NO: 8510967 - DNA, 21 bp, Homo sapiens
acatacataccttaccacctt

SEQ ID NO: 8510968 - DNA, 22 bp, Homo sapiens
acatacatatgacaactttcct

SEQ ID NO: 8510969 - DNA, 21 bp, Homo sapiens
acatacataccttaccacctt

SEQ ID NO: 8510970 - DNA, 21 bp, Homo sapiens
acatacataccttaccacctt

SEQ ID NO: 8510971 - DNA, 22 bp, Homo sapiens
acatacatatgacaactttcct

SEQ ID NO: 8510972 - DNA, 22 bp, Homo sapiens
acatacatatgtttaaatgcat

SEQ ID NO: 8510973 - DNA, 22 bp, Homo sapiens
acatacatcaagtatcacaaga

SEQ ID NO: 8510974 - DNA, 22 bp, Homo sapiens
acatacatcaagtatcacaaga

SEQ ID NO: 8510975 - DNA, 22 bp, Homo sapiens
acatacatcaagtatcacaaga

SEQ ID NO: 8510976 - DNA, 22 bp, Homo sapiens
acataacaatcataggacatag

SEQ ID NO: 8510977 - DNA, 22 bp, Homo sapiens
acatacacaagcgtacatgaac

SEQ ID NO: 8510978 - DNA, 22 bp, Homo sapiens
acatacacatgaatatattttt

SEQ ID NO: 8510979 - DNA, 22 bp, Homo sapiens
acatacacaagcgtacatgaac

SEQ ID NO: 8510980 - DNA, 23 bp, Homo sapiens
acatacataagcaccacattttg

SEQ ID NO: 8510981 - DNA, 23 bp, Homo sapiens
acatacataagcaccacattttg

SEQ ID NO: 8510982 - DNA, 23 bp, Homo sapiens
acatacataagcaccacattttg

SEQ ID NO: 8510983 - DNA, 22 bp, Homo sapiens
acatacacatgaatatattttt

SEQ ID NO: 8510984 - DNA, 22 bp, Homo sapiens
acatacacgggaaacctctttt

SEQ ID NO: 8510985 - DNA, 22 bp, Homo sapiens
aggagctgctttggtgcggttt

SEQ ID NO: 8510986 - DNA, 21 bp, Homo sapiens
aggagctggagaaaactttcc

SEQ ID NO: 8510987 - DNA, 22 bp, Homo sapiens
aggagctgcttaaatggttggt

SEQ ID NO: 8510988 - DNA, 22 bp, Homo sapiens
aggagctgcttaaatggttggt

SEQ ID NO: 8510989 - DNA, 22 bp, Homo sapiens
aggagctgcttaaatggttggt

SEQ ID NO: 8510990 - DNA, 22 bp, Homo sapiens
aggagctgcatggatacctggt

SEQ ID NO: 8510991 - DNA, 22 bp, Homo sapiens
aggagctgcatggatacctggt

SEQ ID NO: 8510992 - DNA, 22 bp, Homo sapiens
aggagctgcagattctgccttg

SEQ ID NO: 8510993 - DNA, 22 bp, Homo sapiens
aggagctgcagattctgccttg

SEQ ID NO: 8510994 - DNA, 22 bp, Homo sapiens
aggagctgcagattctgccttg

SEQ ID NO: 8510995 - DNA, 22 bp, Homo sapiens
aggagctgcagattctgccttg

SEQ ID NO: 8510996 - DNA, 22 bp, Homo sapiens
aggagctgcagattctgccttg

SEQ ID NO: 8510997 - DNA, 22 bp, Homo sapiens
aggagctgcactgggagttttt

SEQ ID NO: 8510998 - DNA, 22 bp, Homo sapiens
aggagctgcactgggagttttt

SEQ ID NO: 8510999 - DNA, 22 bp, Homo sapiens
aggagcccctcttcagtcctgg

SEQ ID NO: 8511000 - DNA, 22 bp, Homo sapiens
aggagcccctcttcagtcctgg

SEQ ID NO: 8511001 - DNA, 22 bp, Homo sapiens
aggagccctgcgggaggcagag

SEQ ID NO: 8511002 - DNA, 22 bp, Homo sapiens
aggagccctgcgggaggcagag

SEQ ID NO: 8511003 - DNA, 22 bp, Homo sapiens
aggagcctccttctcatgtgca

SEQ ID NO: 8511004 - DNA, 22 bp, Homo sapiens
aggagcctccttctcatgtgca

SEQ ID NO: 8511005 - DNA, 22 bp, Homo sapiens
aggagcctgaatcagagggtga

SEQ ID NO: 8511006 - DNA, 22 bp, Homo sapiens
aggagctgcaaatattagtaat

SEQ ID NO: 8511007 - DNA, 22 bp, Homo sapiens
acaggggctccgaaggtgaggg

SEQ ID NO: 8511008 - DNA, 22 bp, Homo sapiens
acaggggtgcatggtgcatggt

SEQ ID NO: 8511009 - DNA, 22 bp, Homo sapiens
acaggggtgcatggtgcatggt

SEQ ID NO: 8511010 - DNA, 22 bp, Homo sapiens
acaggggtgcatggtgcatggt

SEQ ID NO: 8511011 - DNA, 22 bp, Homo sapiens
acagggtgaatgtgacattatc

SEQ ID NO: 8511012 - DNA, 22 bp, Homo sapiens
acagggtcaagggtgctacaag

SEQ ID NO: 8511013 - DNA, 22 bp, Homo sapiens
acagggtcattttatgatctgt

SEQ ID NO: 8511014 - DNA, 22 bp, Homo sapiens
acagggtgactttgtgacagat

SEQ ID NO: 8511015 - DNA, 22 bp, Homo sapiens
acagggtggggatggtgagctt

SEQ ID NO: 8511016 - DNA, 22 bp, Homo sapiens
aggagcagaccgtagtcctgca

SEQ ID NO: 8511017 - DNA, 22 bp, Homo sapiens
acagggtggggatggtgagctt

SEQ ID NO: 8511018 - DNA, 22 bp, Homo sapiens
acagggtgactttgtgacagat

SEQ ID NO: 8511019 - DNA, 22 bp, Homo sapiens
acagggtgactttgtgacagat

SEQ ID NO: 8511020 - DNA, 22 bp, Homo sapiens
acagggtgactttgtgacagat

SEQ ID NO: 8511021 - DNA, 22 bp, Homo sapiens
acagggtgactttgtgacagat

SEQ ID NO: 8511022 - DNA, 22 bp, Homo sapiens
aggagccattgcaggatggcag

SEQ ID NO: 8511023 - DNA, 20 bp, Homo sapiens
aggagccattgactgcagca

SEQ ID NO: 8511024 - DNA, 20 bp, Homo sapiens
aggagccattgactgcagca

SEQ ID NO: 8511025 - DNA, 20 bp, Homo sapiens
aggagccattgactgcagca

SEQ ID NO: 8511026 - DNA, 21 bp, Homo sapiens
aggagccatgtggtctgatgg

SEQ ID NO: 8511027 - DNA, 22 bp, Homo sapiens
aggagccatgagtgacatcaca

SEQ ID NO: 8511028 - DNA, 22 bp, Homo sapiens
aggagcagaccgtagtcctgca

SEQ ID NO: 8511029 - DNA, 22 bp, Homo sapiens
aggagcagaccgtagtcctgca

SEQ ID NO: 8511030 - DNA, 22 bp, Homo sapiens
aggagcagaccgtagtcctgca

SEQ ID NO: 8511031 - DNA, 22 bp, Homo sapiens
aggagcagaccgtagtcctgca

SEQ ID NO: 8511032 - DNA, 23 bp, Homo sapiens
aggagccatgagttggatatgtt

SEQ ID NO: 8511033 - DNA, 23 bp, Homo sapiens
aggagccatgagttggatatgtt

SEQ ID NO: 8511034 - DNA, 22 bp, Homo sapiens
aggagccatgagtgacatcaca

SEQ ID NO: 8511035 - DNA, 22 bp, Homo sapiens
aggagccatggaggtgaggcgg

SEQ ID NO: 8511036 - DNA, 22 bp, Homo sapiens
aggagccatggaggtgaggcgg

SEQ ID NO: 8511037 - DNA, 22 bp, Homo sapiens
aggaagcccttgtcatttctgt

SEQ ID NO: 8511038 - DNA, 22 bp, Homo sapiens
aggaagcctgcaggtgactgct

SEQ ID NO: 8511039 - DNA, 22 bp, Homo sapiens
aggaagcctggggctgccctcg

SEQ ID NO: 8511040 - DNA, 23 bp, Homo sapiens
aggaagctaccaattttgtaggc

SEQ ID NO: 8511041 - DNA, 22 bp, Homo sapiens
aggaagctagagccaccggact

SEQ ID NO: 8511042 - DNA, 22 bp, Homo sapiens
aggaaggagggcagatattaag

SEQ ID NO: 8511043 - DNA, 22 bp, Homo sapiens
aggaaggcatgaggtgttcaca

SEQ ID NO: 8511044 - DNA, 22 bp, Homo sapiens
aggaaggctgatcactgcttgt

SEQ ID NO: 8511045 - DNA, 22 bp, Homo sapiens
aggaagggagcagtttgttgtt

SEQ ID NO: 8511046 - DNA, 22 bp, Homo sapiens
aggaagggagcagtttgttgtt

SEQ ID NO: 8511047 - DNA, 22 bp, Homo sapiens
aggaagggatacataggatagt

SEQ ID NO: 8511048 - DNA, 22 bp, Homo sapiens
aggaagggatacataggatagt

SEQ ID NO: 8511049 - DNA, 20 bp, Homo sapiens
aggacttgtttgggcagagt

SEQ ID NO: 8511050 - DNA, 22 bp, Homo sapiens
aggacttcttagatgccttccg

SEQ ID NO: 8511051 - DNA, 22 bp, Homo sapiens
aggaagggatacataggatagt

SEQ ID NO: 8511052 - DNA, 17 bp, Homo sapiens
aggaagggcaagtttct

SEQ ID NO: 8511053 - DNA, 23 bp, Homo sapiens
aggagacagggaagtgcctggct

SEQ ID NO: 8511054 - DNA, 22 bp, Homo sapiens
aggagacccagaatgttgctgt

SEQ ID NO: 8511055 - DNA, 22 bp, Homo sapiens
aggagacccaatgccagaaaga

SEQ ID NO: 8511056 - DNA, 22 bp, Homo sapiens
aggagaccttcaccacttccac

SEQ ID NO: 8511057 - DNA, 21 bp, Homo sapiens
aggagaccggcttgtttgtgc

SEQ ID NO: 8511058 - DNA, 21 bp, Homo sapiens
aggagaccggcttgtttgtgc

SEQ ID NO: 8511059 - DNA, 22 bp, Homo sapiens
aggagactcagagacctggccg

SEQ ID NO: 8511060 - DNA, 22 bp, Homo sapiens
aggagaccttttgagtgtgaga

SEQ ID NO: 8511061 - DNA, 22 bp, Homo sapiens
aggagaccttttgagtgtgaga

SEQ ID NO: 8511062 - DNA, 22 bp, Homo sapiens
acaggggctccgaaggtgaggg

SEQ ID NO: 8511063 - DNA, 22 bp, Homo sapiens
aggagacatactataggaatat

SEQ ID NO: 8511064 - DNA, 22 bp, Homo sapiens
aggagacataactatgatgaga

SEQ ID NO: 8511065 - DNA, 22 bp, Homo sapiens
aggagacatactataggaatat

SEQ ID NO: 8511066 - DNA, 22 bp, Homo sapiens
aggagacatggaatagtgaggc

SEQ ID NO: 8511067 - DNA, 20 bp, Homo sapiens
aggagaccaagccaagtgga

SEQ ID NO: 8511068 - DNA, 22 bp, Homo sapiens
aggagacatggaatagtgaggc

SEQ ID NO: 8511069 - DNA, 22 bp, Homo sapiens
acctttcaaagtggctatcact

SEQ ID NO: 8511070 - DNA, 20 bp, Homo sapiens
acctttcaaatgattcagca

SEQ ID NO: 8511071 - DNA, 22 bp, Homo sapiens
accttcctctaagacatttagc

SEQ ID NO: 8511072 - DNA, 22 bp, Homo sapiens
aggtccagtgctcttggtggtt

SEQ ID NO: 8511073 - DNA, 22 bp, Homo sapiens
acctttcacggtatcagacatc

SEQ ID NO: 8511074 - DNA, 22 bp, Homo sapiens
acctttcattaaagtctgtagt

SEQ ID NO: 8511075 - DNA, 22 bp, Homo sapiens
aggtccaggatttgtggggtct

SEQ ID NO: 8511076 - DNA, 22 bp, Homo sapiens
aggtccaggcatttgggttggg

SEQ ID NO: 8511077 - DNA, 22 bp, Homo sapiens
aggtccaggcatttgggttggg

SEQ ID NO: 8511078 - DNA, 22 bp, Homo sapiens
aggtccagctgttgcagcctcc

SEQ ID NO: 8511079 - DNA, 22 bp, Homo sapiens
aggtccaggagatttggcaatt

SEQ ID NO: 8511080 - DNA, 20 bp, Homo sapiens
aggtccactgaggctgcctc

SEQ ID NO: 8511081 - DNA, 20 bp, Homo sapiens
aggtccactgaggctgcctc

SEQ ID NO: 8511082 - DNA, 22 bp, Homo sapiens
aggtccagagttgagatacaga

SEQ ID NO: 8511083 - DNA, 22 bp, Homo sapiens
aggtccagaggttgaacggtgg

SEQ ID NO: 8511084 - DNA, 22 bp, Homo sapiens
aggtcaagggagctgagggcca

SEQ ID NO: 8511085 - DNA, 22 bp, Homo sapiens
aggtcaaggctgcagtgagctg

SEQ ID NO: 8511086 - DNA, 22 bp, Homo sapiens
aggtcaaggctgcagtgagctg

SEQ ID NO: 8511087 - DNA, 22 bp, Homo sapiens
aggtcaaggccaaaagagtggt

SEQ ID NO: 8511088 - DNA, 22 bp, Homo sapiens
aggtcaagggcaagagtgaggt

SEQ ID NO: 8511089 - DNA, 22 bp, Homo sapiens
aggtcaagggcaagagtgaggt

SEQ ID NO: 8511090 - DNA, 22 bp, Homo sapiens
aggtcacacaactgtcagaggc

SEQ ID NO: 8511091 - DNA, 22 bp, Homo sapiens
aggtcaagtttagatagagtta

SEQ ID NO: 8511092 - DNA, 22 bp, Homo sapiens
aggtcaagtttagatagagtta

SEQ ID NO: 8511093 - DNA, 22 bp, Homo sapiens
aggtcaaggttcacaggggatc

SEQ ID NO: 8511094 - DNA, 22 bp, Homo sapiens
aggtcatttccttagaggcaga

SEQ ID NO: 8511095 - DNA, 22 bp, Homo sapiens
aggtccacagttcagctgccca

SEQ ID NO: 8511096 - DNA, 22 bp, Homo sapiens
aggtcatttttgccttctattt

SEQ ID NO: 8511097 - DNA, 22 bp, Homo sapiens
aggtcaagagtaaatttgggta

SEQ ID NO: 8511098 - DNA, 22 bp, Homo sapiens
aggtcaaggccaaaagagtggt

SEQ ID NO: 8511099 - DNA, 22 bp, Homo sapiens
aggtcaagagtaaatttgggta

SEQ ID NO: 8511100 - DNA, 22 bp, Homo sapiens
aggtcaaaatgcttttcaggtc

SEQ ID NO: 8511101 - DNA, 22 bp, Homo sapiens
aggtcaaaatcaggcagggaag

SEQ ID NO: 8511102 - DNA, 22 bp, Homo sapiens
aggtattttatagataagtaaa

SEQ ID NO: 8511103 - DNA, 23 bp, Homo sapiens
aggtcaaccacaagctgacaaac

SEQ ID NO: 8511104 - DNA, 22 bp, Homo sapiens
aggtcaaaccacagctctaggc

SEQ ID NO: 8511105 - DNA, 22 bp, Homo sapiens
aggtcaaagaacctagctatag

SEQ ID NO: 8511106 - DNA, 22 bp, Homo sapiens
accctgttatggtgtaacattt

SEQ ID NO: 8511107 - DNA, 22 bp, Homo sapiens
acccttccaaatgagcttatta

SEQ ID NO: 8511108 - DNA, 22 bp, Homo sapiens
accctttagaaggcatctcagt

SEQ ID NO: 8511109 - DNA, 19 bp, Homo sapiens
aggtagctcagactcaaag

SEQ ID NO: 8511110 - DNA, 22 bp, Homo sapiens
aggtattttatagataagtaaa

SEQ ID NO: 8511111 - DNA, 22 bp, Homo sapiens
acgatgagatggggctggaagg

SEQ ID NO: 8511112 - DNA, 22 bp, Homo sapiens
acgagtatgtttgtattttctt

SEQ ID NO: 8511113 - DNA, 22 bp, Homo sapiens
acgacagcacaacagcatcctc

SEQ ID NO: 8511114 - DNA, 22 bp, Homo sapiens
acgaagacgccgttcttgccga

SEQ ID NO: 8511115 - DNA, 22 bp, Homo sapiens
accttttttcagaactctaaag

SEQ ID NO: 8511116 - DNA, 22 bp, Homo sapiens
acctttttgttctgttctcagc

SEQ ID NO: 8511117 - DNA, 22 bp, Homo sapiens
accttttcatctgaaactttta

SEQ ID NO: 8511118 - DNA, 22 bp, Homo sapiens
acctttttccaaagcttcttac

SEQ ID NO: 8511119 - DNA, 22 bp, Homo sapiens
acctttttgttctgttctcagc

SEQ ID NO: 8511120 - DNA, 22 bp, Homo sapiens
accttttatgtaaatatatgtt

SEQ ID NO: 8511121 - DNA, 22 bp, Homo sapiens
accttttacggtgtgactagca

SEQ ID NO: 8511122 - DNA, 22 bp, Homo sapiens
acctttggtcatttacttttca

SEQ ID NO: 8511123 - DNA, 21 bp, Homo sapiens
acctttgggtgtttataatag

SEQ ID NO: 8511124 - DNA, 22 bp, Homo sapiens
aggtgacatgaaaaatgttgag

SEQ ID NO: 8511125 - DNA, 22 bp, Homo sapiens
aggtgactactattttaaaata

SEQ ID NO: 8511126 - DNA, 22 bp, Homo sapiens
aggtgactactattttaaaata

SEQ ID NO: 8511127 - DNA, 22 bp, Homo sapiens
aggtgacatcccggcagcagag

SEQ ID NO: 8511128 - DNA, 22 bp, Homo sapiens
aggtgaagttgaggaggcagaa

SEQ ID NO: 8511129 - DNA, 22 bp, Homo sapiens
aggtgaagttgaggaggcagaa

SEQ ID NO: 8511130 - DNA, 22 bp, Homo sapiens
aggtgaagttgaggaggcagaa

SEQ ID NO: 8511131 - DNA, 22 bp, Homo sapiens
actagaaaattcctagaaacta

SEQ ID NO: 8511132 - DNA, 23 bp, Homo sapiens
actagaaaatgactttctccctg

SEQ ID NO: 8511133 - DNA, 22 bp, Homo sapiens
actagaaaattcctagaaacta

SEQ ID NO: 8511134 - DNA, 22 bp, Homo sapiens
actagaaagcaaaagccatttc

SEQ ID NO: 8511135 - DNA, 22 bp, Homo sapiens
actagaaagtttccagagttat

SEQ ID NO: 8511136 - DNA, 22 bp, Homo sapiens
aggtgggcactccgctcgaggt

SEQ ID NO: 8511137 - DNA, 22 bp, Homo sapiens
aggtgggcactccgctcgaggt

SEQ ID NO: 8511138 - DNA, 23 bp, Homo sapiens
actacagatactcctgctgtttg

SEQ ID NO: 8511139 - DNA, 22 bp, Homo sapiens
actacagtactatatctatagg

SEQ ID NO: 8511140 - DNA, 22 bp, Homo sapiens
actacagtccctcatatgttgg

SEQ ID NO: 8511141 - DNA, 22 bp, Homo sapiens
aggtgactggtttatctggcag

SEQ ID NO: 8511142 - DNA, 22 bp, Homo sapiens
aggtgactggtttatctggcag

SEQ ID NO: 8511143 - DNA, 22 bp, Homo sapiens
aggtgactggtttatctggcag

SEQ ID NO: 8511144 - DNA, 22 bp, Homo sapiens
aggtgagaaaacgagggttgca

SEQ ID NO: 8511145 - DNA, 22 bp, Homo sapiens
actaaatatttgagaggtgtag

SEQ ID NO: 8511146 - DNA, 22 bp, Homo sapiens
actacatcttgcatatctataa

SEQ ID NO: 8511147 - DNA, 22 bp, Homo sapiens
actacagtgtgataagaggggc

SEQ ID NO: 8511148 - DNA, 22 bp, Homo sapiens
actactacaagtgagtacaaag

SEQ ID NO: 8511149 - DNA, 22 bp, Homo sapiens
actactgaatattagttctgaa

SEQ ID NO: 8511150 - DNA, 22 bp, Homo sapiens
actactttgggccatttgttta

SEQ ID NO: 8511151 - DNA, 22 bp, Homo sapiens
actccctctctagtccttgcaa

SEQ ID NO: 8511152 - DNA, 21 bp, Homo sapiens
actccctgcataagtgattta

SEQ ID NO: 8511153 - DNA, 22 bp, Homo sapiens
actccctccaaatctgcacagt

SEQ ID NO: 8511154 - DNA, 22 bp, Homo sapiens
actccctccaaatctgcacagt

SEQ ID NO: 8511155 - DNA, 22 bp, Homo sapiens
actccagggtgactctgtctga

SEQ ID NO: 8511156 - DNA, 22 bp, Homo sapiens
actcctgccacacagatgctgt

SEQ ID NO: 8511157 - DNA, 22 bp, Homo sapiens
actcctacatattagcattaac

SEQ ID NO: 8511158 - DNA, 22 bp, Homo sapiens
actccgactctgagtctacatt

SEQ ID NO: 8511159 - DNA, 22 bp, Homo sapiens
actcccttttcccgtaatctat

SEQ ID NO: 8511160 - DNA, 22 bp, Homo sapiens
actcccttttcccgtaatctat

SEQ ID NO: 8511161 - DNA, 22 bp, Homo sapiens
actcctcagccagcatcaggga

SEQ ID NO: 8511162 - DNA, 22 bp, Homo sapiens
actcccttggtggagaatgcaa

SEQ ID NO: 8511163 - DNA, 22 bp, Homo sapiens
actcccttggtggagaatgcaa

SEQ ID NO: 8511164 - DNA, 22 bp, Homo sapiens
actcccttgtgaactcattctt

SEQ ID NO: 8511165 - DNA, 22 bp, Homo sapiens
actcccttgtgaactcattctt

SEQ ID NO: 8511166 - DNA, 22 bp, Homo sapiens
actccctttccaggaaacacaa

SEQ ID NO: 8511167 - DNA, 22 bp, Homo sapiens
actccctttccaggaaacacaa

SEQ ID NO: 8511168 - DNA, 22 bp, Homo sapiens
actcccttttctacttctaccc

SEQ ID NO: 8511169 - DNA, 22 bp, Homo sapiens
actcccttttctacttctaccc

SEQ ID NO: 8511170 - DNA, 22 bp, Homo sapiens
actcctgggtgctgaccagcgt

SEQ ID NO: 8511171 - DNA, 22 bp, Homo sapiens
actcctggggctgccatcacag

SEQ ID NO: 8511172 - DNA, 22 bp, Homo sapiens
actcctggggatccattccttt

SEQ ID NO: 8511173 - DNA, 22 bp, Homo sapiens
actcctggggatccattccttt

SEQ ID NO: 8511174 - DNA, 22 bp, Homo sapiens
actcctgggtgctgaccagcgt

SEQ ID NO: 8511175 - DNA, 22 bp, Homo sapiens
agtcaccaggttttagagacct

SEQ ID NO: 8511176 - DNA, 22 bp, Homo sapiens
agtcactctgctacatgacagc

SEQ ID NO: 8511177 - DNA, 22 bp, Homo sapiens
agtcaccctccaactctccact

SEQ ID NO: 8511178 - DNA, 22 bp, Homo sapiens
actctctggtgtagaaagacct

SEQ ID NO: 8511179 - DNA, 22 bp, Homo sapiens
actctctgagctaccaggtgag

SEQ ID NO: 8511180 - DNA, 22 bp, Homo sapiens
actctctctgatggaactttag

SEQ ID NO: 8511181 - DNA, 22 bp, Homo sapiens
actctcttgggggagagcagag

SEQ ID NO: 8511182 - DNA, 22 bp, Homo sapiens
actctctgtgatggaggccagc

SEQ ID NO: 8511183 - DNA, 22 bp, Homo sapiens
actctctgtctaaatgcagttt

SEQ ID NO: 8511184 - DNA, 22 bp, Homo sapiens
actctaaatagcctcttaaaca

SEQ ID NO: 8511185 - DNA, 22 bp, Homo sapiens
actctaaatagcctcttaaaca

SEQ ID NO: 8511186 - DNA, 22 bp, Homo sapiens
actctctcacagcttggctgat

SEQ ID NO: 8511187 - DNA, 22 bp, Homo sapiens
actctctcacagcttggctgat

SEQ ID NO: 8511188 - DNA, 22 bp, Homo sapiens
actctctcacacacgcctatat

SEQ ID NO: 8511189 - DNA, 22 bp, Homo sapiens
agtcactgggctgcttcctata

SEQ ID NO: 8511190 - DNA, 22 bp, Homo sapiens
agtcactgttctgtcatgtcaa

SEQ ID NO: 8511191 - DNA, 22 bp, Homo sapiens
agtcactggttctgtaattaat

SEQ ID NO: 8511192 - DNA, 22 bp, Homo sapiens
agtcacttccagacacctgcct

SEQ ID NO: 8511193 - DNA, 22 bp, Homo sapiens
agtcacttccagacacctgcct

SEQ ID NO: 8511194 - DNA, 22 bp, Homo sapiens
aggtggggaaaccagcgatccc

SEQ ID NO: 8511195 - DNA, 22 bp, Homo sapiens
aggtggggaaaccagcgatccc

SEQ ID NO: 8511196 - DNA, 22 bp, Homo sapiens
aggtggggaaaccagcgatccc

SEQ ID NO: 8511197 - DNA, 22 bp, Homo sapiens
aggtggggaaaccagcgatccc

SEQ ID NO: 8511198 - DNA, 22 bp, Homo sapiens
aggtgggcggattcatgaggtc

SEQ ID NO: 8511199 - DNA, 21 bp, Homo sapiens
aggtgggcaggtggagtggcc

SEQ ID NO: 8511200 - DNA, 21 bp, Homo sapiens
aggtgggcaggtggagtggcc

SEQ ID NO: 8511201 - DNA, 22 bp, Homo sapiens
aggtgggcccagtgggctccag

SEQ ID NO: 8511202 - DNA, 22 bp, Homo sapiens
aggtgggcccagtgggctccag

SEQ ID NO: 8511203 - DNA, 22 bp, Homo sapiens
aggtgggcgctgctcccgctgg

SEQ ID NO: 8511204 - DNA, 22 bp, Homo sapiens
aggtgggcgctgctcccgctgg

SEQ ID NO: 8511205 - DNA, 22 bp, Homo sapiens
aggtgggcgctgctcccgctgg

SEQ ID NO: 8511206 - DNA, 22 bp, Homo sapiens
aggtgggcggatcacaaggtca

SEQ ID NO: 8511207 - DNA, 22 bp, Homo sapiens
agtacatttattaatggtaaaa

SEQ ID NO: 8511208 - DNA, 22 bp, Homo sapiens
agtacatttattaatggtaaaa

SEQ ID NO: 8511209 - DNA, 23 bp, Homo sapiens
agtacattcgaaaaattctgtga

SEQ ID NO: 8511210 - DNA, 23 bp, Homo sapiens
agtacattcgaaaaattctgtga

SEQ ID NO: 8511211 - DNA, 21 bp, Homo sapiens
agtacatctcaaatgtaaatc

SEQ ID NO: 8511212 - DNA, 21 bp, Homo sapiens
agtacatctcaaatgtaaatc

SEQ ID NO: 8511213 - DNA, 22 bp, Homo sapiens
agtacatatagtaatttagcca

SEQ ID NO: 8511214 - DNA, 22 bp, Homo sapiens
agtacatttttcagtggggagt

SEQ ID NO: 8511215 - DNA, 22 bp, Homo sapiens
agtaccatgcttcctgactggt

SEQ ID NO: 8511216 - DNA, 22 bp, Homo sapiens
agtaccctagggtgggagctca

SEQ ID NO: 8511217 - DNA, 22 bp, Homo sapiens
agtaccattactcacttatttt

SEQ ID NO: 8511218 - DNA, 22 bp, Homo sapiens
agtaccattatccagtaaagga

SEQ ID NO: 8511219 - DNA, 22 bp, Homo sapiens
actccaggggttgctatttaca

SEQ ID NO: 8511220 - DNA, 22 bp, Homo sapiens
agtatacaaataaatgtgtaat

SEQ ID NO: 8511221 - DNA, 22 bp, Homo sapiens
agtatacaaataaatgtgtaat

SEQ ID NO: 8511222 - DNA, 22 bp, Homo sapiens
agtatacaaataaatgtgtaat

SEQ ID NO: 8511223 - DNA, 22 bp, Homo sapiens
agtatacaaataaatgtgtaat

SEQ ID NO: 8511224 - DNA, 22 bp, Homo sapiens
agtataattagatatcaaaagt

SEQ ID NO: 8511225 - DNA, 22 bp, Homo sapiens
agtataatgaaatgtgtcagta

SEQ ID NO: 8511226 - DNA, 22 bp, Homo sapiens
agtataatttacatttggtatt

SEQ ID NO: 8511227 - DNA, 22 bp, Homo sapiens
agtataattagatatcaaaagt

SEQ ID NO: 8511228 - DNA, 22 bp, Homo sapiens
agtataaagtggttttcagcac

SEQ ID NO: 8511229 - DNA, 22 bp, Homo sapiens
agtactttacttcttacagttt

SEQ ID NO: 8511230 - DNA, 22 bp, Homo sapiens
agtactttgcactttgctcaga

SEQ ID NO: 8511231 - DNA, 22 bp, Homo sapiens
agtactttacttcttacagttt

SEQ ID NO: 8511232 - DNA, 22 bp, Homo sapiens
agtactgtcagcagggtgttga

SEQ ID NO: 8511233 - DNA, 20 bp, Homo sapiens
agtaccttttgtatgttacc

SEQ ID NO: 8511234 - DNA, 18 bp, Homo sapiens
agtagtgggtttagcttc

SEQ ID NO: 8511235 - DNA, 22 bp, Homo sapiens
agtagtggggccagggtttgaa

SEQ ID NO: 8511236 - DNA, 22 bp, Homo sapiens
agtagtggcttcctggagtgct

SEQ ID NO: 8511237 - DNA, 22 bp, Homo sapiens
agtagaaagaaggcactgggcc

SEQ ID NO: 8511238 - DNA, 22 bp, Homo sapiens
agtagaaagaaggcactgggcc

SEQ ID NO: 8511239 - DNA, 22 bp, Homo sapiens
agtagaaagttgcaggaggaat

SEQ ID NO: 8511240 - DNA, 22 bp, Homo sapiens
actgcactcctgcctgggtaac

SEQ ID NO: 8511241 - DNA, 22 bp, Homo sapiens
actgcacttcaccctgggtgac

SEQ ID NO: 8511242 - DNA, 22 bp, Homo sapiens
actgcactcctgcctgggtaac

SEQ ID NO: 8511243 - DNA, 22 bp, Homo sapiens
actgcactcctgcctgggtaac

SEQ ID NO: 8511244 - DNA, 22 bp, Homo sapiens
actgcactccagcctgggtgat

SEQ ID NO: 8511245 - DNA, 22 bp, Homo sapiens
actgcactccagcctgggtgat

SEQ ID NO: 8511246 - DNA, 22 bp, Homo sapiens
actgcactccagcctgggtgat

SEQ ID NO: 8511247 - DNA, 22 bp, Homo sapiens
actgcactccagcctgggtgat

SEQ ID NO: 8511248 - DNA, 22 bp, Homo sapiens
actgcactccagcctgggtgat

SEQ ID NO: 8511249 - DNA, 22 bp, Homo sapiens
actgcactccagcctgggtgat

SEQ ID NO: 8511250 - DNA, 22 bp, Homo sapiens
agtgaagaggaagtggggcaca

SEQ ID NO: 8511251 - DNA, 21 bp, Homo sapiens
agtgaagagtgaaacacatgg

SEQ ID NO: 8511252 - DNA, 22 bp, Homo sapiens
actgcacagtcccagaggatgc

SEQ ID NO: 8511253 - DNA, 22 bp, Homo sapiens
actgcacagtcccagaggatgc

SEQ ID NO: 8511254 - DNA, 22 bp, Homo sapiens
actgcacagattaagttagatt

SEQ ID NO: 8511255 - DNA, 22 bp, Homo sapiens
agtgaatatgcagcaagaagtt

SEQ ID NO: 8511256 - DNA, 20 bp, Homo sapiens
agtgaatagagacattgccc

SEQ ID NO: 8511257 - DNA, 22 bp, Homo sapiens
agtgaagtgatagtttgcctag

SEQ ID NO: 8511258 - DNA, 20 bp, Homo sapiens
agtgaatagagacattgccc

SEQ ID NO: 8511259 - DNA, 22 bp, Homo sapiens
agtgaatacatgtcactcagca

SEQ ID NO: 8511260 - DNA, 22 bp, Homo sapiens
agtgctctgtcattggtgggat

SEQ ID NO: 8511261 - DNA, 22 bp, Homo sapiens
actgcagcctagggaccacagt

SEQ ID NO: 8511262 - DNA, 22 bp, Homo sapiens
agtgctcctttcattgctgccc

SEQ ID NO: 8511263 - DNA, 22 bp, Homo sapiens
agtgctctctccccagtgctac

SEQ ID NO: 8511264 - DNA, 22 bp, Homo sapiens
agtgctcctgaagcttgaggca

SEQ ID NO: 8511265 - DNA, 22 bp, Homo sapiens
agtgctcctgccagctttctgg

SEQ ID NO: 8511266 - DNA, 22 bp, Homo sapiens
agtgctcctcagaagagttgga

SEQ ID NO: 8511267 - DNA, 22 bp, Homo sapiens
agtgctcctatggatcagttgt

SEQ ID NO: 8511268 - DNA, 22 bp, Homo sapiens
agtgctccctagagttgtgcaa

SEQ ID NO: 8511269 - DNA, 22 bp, Homo sapiens
agtgctccacattgcactattc

SEQ ID NO: 8511270 - DNA, 23 bp, Homo sapiens
agtgctcccaggacctggggcag

SEQ ID NO: 8511271 - DNA, 22 bp, Homo sapiens
agtgctccaaaggttggtcatt

SEQ ID NO: 8511272 - DNA, 22 bp, Homo sapiens
actgcacttcagcctgggtgac

SEQ ID NO: 8511273 - DNA, 22 bp, Homo sapiens
actgcacttcaccctgggtgac

SEQ ID NO: 8511274 - DNA, 22 bp, Homo sapiens
actgcacttcaccctgggtgac

SEQ ID NO: 8511275 - DNA, 22 bp, Homo sapiens
actgcacttcaccctgggtgac

SEQ ID NO: 8511276 - DNA, 22 bp, Homo sapiens
actgcacttcaccctgggtgac

SEQ ID NO: 8511277 - DNA, 22 bp, Homo sapiens
actgcacttcaccctgggtgac

SEQ ID NO: 8511278 - DNA, 22 bp, Homo sapiens
actgagcagggttccgcatgga

SEQ ID NO: 8511279 - DNA, 22 bp, Homo sapiens
actgagcataaatatgtgtcca

SEQ ID NO: 8511280 - DNA, 22 bp, Homo sapiens
actgagcagaagagatctgtga

SEQ ID NO: 8511281 - DNA, 22 bp, Homo sapiens
actgagcagaagagatctgtga

SEQ ID NO: 8511282 - DNA, 22 bp, Homo sapiens
actgagcagaacaatgggagcc

SEQ ID NO: 8511283 - DNA, 23 bp, Homo sapiens
actgagcaatgtttacatacttg

SEQ ID NO: 8511284 - DNA, 22 bp, Homo sapiens
actgagcactcacttttgttat

SEQ ID NO: 8511285 - DNA, 22 bp, Homo sapiens
actgagcaatgcagtgggagcg

SEQ ID NO: 8511286 - DNA, 22 bp, Homo sapiens
actgagaggtgatagtgacatt

SEQ ID NO: 8511287 - DNA, 22 bp, Homo sapiens
actgagagtcaagatagcatgg

SEQ ID NO: 8511288 - DNA, 22 bp, Homo sapiens
actgagagtcaagatagcatgg

SEQ ID NO: 8511289 - DNA, 22 bp, Homo sapiens
actgagagcgtgtacaaactta

SEQ ID NO: 8511290 - DNA, 22 bp, Homo sapiens
actgagagcgtgtacaaactta

SEQ ID NO: 8511291 - DNA, 22 bp, Homo sapiens
agtgaacaagttaagaacacta

SEQ ID NO: 8511292 - DNA, 22 bp, Homo sapiens
agtgaacaaaggtagtgagcat

SEQ ID NO: 8511293 - DNA, 22 bp, Homo sapiens
agtgaacaaaggtagtgagcat

SEQ ID NO: 8511294 - DNA, 22 bp, Homo sapiens
agtgaactgtggcccgtgaact

SEQ ID NO: 8511295 - DNA, 19 bp, Homo sapiens
agtgaactccatatcaggt

SEQ ID NO: 8511296 - DNA, 22 bp, Homo sapiens
agtgaagaggaagtggggcaca

SEQ ID NO: 8511297 - DNA, 22 bp, Homo sapiens
agtgaacagtttggaacacatg

SEQ ID NO: 8511298 - DNA, 22 bp, Homo sapiens
actgagcatggctcacagagag

SEQ ID NO: 8511299 - DNA, 23 bp, Homo sapiens
actgagcattagtatttttataa

SEQ ID NO: 8511300 - DNA, 23 bp, Homo sapiens
actgagccagggcctgggtcagc

SEQ ID NO: 8511301 - DNA, 22 bp, Homo sapiens
actgagcatcagggctgggaac

SEQ ID NO: 8511302 - DNA, 22 bp, Homo sapiens
actgagcagtagattttctgtt

SEQ ID NO: 8511303 - DNA, 22 bp, Homo sapiens
actgagcataaatatgtgtcca

SEQ ID NO: 8511304 - DNA, 22 bp, Homo sapiens
actgagctctaggttttgaacc

SEQ ID NO: 8511305 - DNA, 22 bp, Homo sapiens
agtgaaatttgtttagataggt

SEQ ID NO: 8511306 - DNA, 22 bp, Homo sapiens
agtgaaatttgtttagataggt

SEQ ID NO: 8511307 - DNA, 22 bp, Homo sapiens
actctgccatcccaggtgctgt

SEQ ID NO: 8511308 - DNA, 22 bp, Homo sapiens
actctgccccgagttctgggaa

SEQ ID NO: 8511309 - DNA, 22 bp, Homo sapiens
actctgccctaggcctctgggg

SEQ ID NO: 8511310 - DNA, 22 bp, Homo sapiens
actctgcctttcagcagatgaa

SEQ ID NO: 8511311 - DNA, 18 bp, Homo sapiens
actctgcggaggccccag

SEQ ID NO: 8511312 - DNA, 22 bp, Homo sapiens
actctgccttagtcctggggct

SEQ ID NO: 8511313 - DNA, 22 bp, Homo sapiens
actctgaggcaggtcagggcag

SEQ ID NO: 8511314 - DNA, 22 bp, Homo sapiens
actctgaggagtgactagaggt

SEQ ID NO: 8511315 - DNA, 22 bp, Homo sapiens
actctgagccaccagatcccca

SEQ ID NO: 8511316 - DNA, 22 bp, Homo sapiens
actctgacatttaaaaagcaat

SEQ ID NO: 8511317 - DNA, 22 bp, Homo sapiens
actctgagcatcccaagtctta

SEQ ID NO: 8511318 - DNA, 22 bp, Homo sapiens
actctgagaatccctggacttt

SEQ ID NO: 8511319 - DNA, 22 bp, Homo sapiens
actctcttgggggagagcagag

SEQ ID NO: 8511320 - DNA, 22 bp, Homo sapiens
actctcttgggggagagcagag

SEQ ID NO: 8511321 - DNA, 22 bp, Homo sapiens
actctgaaccagagatcatacc

SEQ ID NO: 8511322 - DNA, 22 bp, Homo sapiens
actctgaagaagacttccagac

SEQ ID NO: 8511323 - DNA, 22 bp, Homo sapiens
actctgaaccagagatcatacc

SEQ ID NO: 8511324 - DNA, 22 bp, Homo sapiens
actgggcctggattggcgtgtc

SEQ ID NO: 8511325 - DNA, 22 bp, Homo sapiens
actgggcctgtacagagaaaac

SEQ ID NO: 8511326 - DNA, 22 bp, Homo sapiens
actgggccttgccatggcagcc

SEQ ID NO: 8511327 - DNA, 22 bp, Homo sapiens
actgggcctgtacagagaaaac

SEQ ID NO: 8511328 - DNA, 22 bp, Homo sapiens
actgggcctgtacagagaaaac

SEQ ID NO: 8511329 - DNA, 22 bp, Homo sapiens
actgggcctgattgggtcggag

SEQ ID NO: 8511330 - DNA, 22 bp, Homo sapiens
actgggcctggattggcgtgtc

SEQ ID NO: 8511331 - DNA, 22 bp, Homo sapiens
actgggcctggattggcgtgtc

SEQ ID NO: 8511332 - DNA, 20 bp, Homo sapiens
actgggcctaggggaggcat

SEQ ID NO: 8511333 - DNA, 22 bp, Homo sapiens
actgggcctgattgggtcggag

SEQ ID NO: 8511334 - DNA, 22 bp, Homo sapiens
actgggcctacccagattggca

SEQ ID NO: 8511335 - DNA, 20 bp, Homo sapiens
actgggcctaggggaggcat

SEQ ID NO: 8511336 - DNA, 22 bp, Homo sapiens
actgggccgaaatggacagaat

SEQ ID NO: 8511337 - DNA, 22 bp, Homo sapiens
actgggccgcgctgcagagggc

SEQ ID NO: 8511338 - DNA, 22 bp, Homo sapiens
actgggccgaaatggacagaat

SEQ ID NO: 8511339 - DNA, 22 bp, Homo sapiens
actgggcccagtggtgtggctg

SEQ ID NO: 8511340 - DNA, 22 bp, Homo sapiens
actgggcccatatactcagtct

SEQ ID NO: 8511341 - DNA, 22 bp, Homo sapiens
actgggcccatatactcagtct

SEQ ID NO: 8511342 - DNA, 22 bp, Homo sapiens
actgggccggtgcagagtagtt

SEQ ID NO: 8511343 - DNA, 22 bp, Homo sapiens
actgggcctacccagattggca

SEQ ID NO: 8511344 - DNA, 22 bp, Homo sapiens
actgggccgcgctgcagagggc

SEQ ID NO: 8511345 - DNA, 22 bp, Homo sapiens
actgggccggtgcagagtagtt

SEQ ID NO: 8511346 - DNA, 22 bp, Homo sapiens
actgggccggtgcagagtagtt

SEQ ID NO: 8511347 - DNA, 22 bp, Homo sapiens
actgggccagatcagagcaact

SEQ ID NO: 8511348 - DNA, 22 bp, Homo sapiens
actgggccagacactgattccc

SEQ ID NO: 8511349 - DNA, 22 bp, Homo sapiens
actgggccagatcagagcaact

SEQ ID NO: 8511350 - DNA, 18 bp, Homo sapiens
actgggccagcaggcagg

SEQ ID NO: 8511351 - DNA, 18 bp, Homo sapiens
actgggccagcaggcagg

SEQ ID NO: 8511352 - DNA, 23 bp, Homo sapiens
actgggccagctacttagcactg

SEQ ID NO: 8511353 - DNA, 22 bp, Homo sapiens
actgggccaggggctttggagc

SEQ ID NO: 8511354 - DNA, 23 bp, Homo sapiens
actgggccagctacttagcactg

SEQ ID NO: 8511355 - DNA, 22 bp, Homo sapiens
actgggccaggggctttggagc

SEQ ID NO: 8511356 - DNA, 22 bp, Homo sapiens
actgggcccagtggtgtggctg

SEQ ID NO: 8511357 - DNA, 22 bp, Homo sapiens
actgggccaggtgtgggtgagt

SEQ ID NO: 8511358 - DNA, 22 bp, Homo sapiens
actgggccaggtgtgggtgagt

SEQ ID NO: 8511359 - DNA, 22 bp, Homo sapiens
actgggccagatcagagcaact

SEQ ID NO: 8511360 - DNA, 22 bp, Homo sapiens
actgggccagacactgattccc

SEQ ID NO: 8511361 - DNA, 22 bp, Homo sapiens
actgggccacatagacctgctg

SEQ ID NO: 8511362 - DNA, 22 bp, Homo sapiens
actgggccacatagacctgctg

SEQ ID NO: 8511363 - DNA, 22 bp, Homo sapiens
actgggccaactatttgttcta

SEQ ID NO: 8511364 - DNA, 22 bp, Homo sapiens
actgggccaactatttgttcta

SEQ ID NO: 8511365 - DNA, 22 bp, Homo sapiens
actgggcatcccatggcagagc

SEQ ID NO: 8511366 - DNA, 22 bp, Homo sapiens
actggcttgaagtagattcaaa

SEQ ID NO: 8511367 - DNA, 22 bp, Homo sapiens
agtgtcctggcaagggtttcag

SEQ ID NO: 8511368 - DNA, 22 bp, Homo sapiens
actggctgtggccacggctgct

SEQ ID NO: 8511369 - DNA, 21 bp, Homo sapiens
agtgtctctggaagcacgtgt

SEQ ID NO: 8511370 - DNA, 22 bp, Homo sapiens
agtgtctcagccccaactagag

SEQ ID NO: 8511371 - DNA, 21 bp, Homo sapiens
agtgtccttttactgtgaata

SEQ ID NO: 8511372 - DNA, 22 bp, Homo sapiens
actgggcagggaaggagaccga

SEQ ID NO: 8511373 - DNA, 22 bp, Homo sapiens
actgggaggcaaagagcaagga

SEQ ID NO: 8511374 - DNA, 21 bp, Homo sapiens
agtgtccttgatcttgccttg

SEQ ID NO: 8511375 - DNA, 22 bp, Homo sapiens
agtgtccttagttagctttggg

SEQ ID NO: 8511376 - DNA, 22 bp, Homo sapiens
agtgtcctgtgtcccagactgt

SEQ ID NO: 8511377 - DNA, 22 bp, Homo sapiens
agtgtccttgttattactgctc

SEQ ID NO: 8511378 - DNA, 22 bp, Homo sapiens
agtgtccttgattcctgttgtt

SEQ ID NO: 8511379 - DNA, 22 bp, Homo sapiens
actggctgcgttcctgtgagac

SEQ ID NO: 8511380 - DNA, 22 bp, Homo sapiens
actggctgatcacctgcctcag

SEQ ID NO: 8511381 - DNA, 21 bp, Homo sapiens
actggccaccactggcagggg

SEQ ID NO: 8511382 - DNA, 22 bp, Homo sapiens
actggcatcccactggtacagg

SEQ ID NO: 8511383 - DNA, 22 bp, Homo sapiens
actggcatctgtgggtagaggc

SEQ ID NO: 8511384 - DNA, 21 bp, Homo sapiens
actgcctggggtgctggccaa

SEQ ID NO: 8511385 - DNA, 21 bp, Homo sapiens
actgcctggggtgctggccaa

SEQ ID NO: 8511386 - DNA, 22 bp, Homo sapiens
actgcctggcctggcctcactg

SEQ ID NO: 8511387 - DNA, 22 bp, Homo sapiens
actgcctggcagaggtttgcaa

SEQ ID NO: 8511388 - DNA, 22 bp, Homo sapiens
actgcctgctcctggctccaca

SEQ ID NO: 8511389 - DNA, 22 bp, Homo sapiens
actgcctgctcctggctccaca

SEQ ID NO: 8511390 - DNA, 22 bp, Homo sapiens
actgcctgctcctggctccaca

SEQ ID NO: 8511391 - DNA, 22 bp, Homo sapiens
actgcctgctcataacattgct

SEQ ID NO: 8511392 - DNA, 22 bp, Homo sapiens
actgcctgctcataacattgct

SEQ ID NO: 8511393 - DNA, 22 bp, Homo sapiens
actgcctgccttccaggtactg

SEQ ID NO: 8511394 - DNA, 23 bp, Homo sapiens
actgcctgctactatgcccacgg

SEQ ID NO: 8511395 - DNA, 22 bp, Homo sapiens
actgcctgccttccaggtactg

SEQ ID NO: 8511396 - DNA, 22 bp, Homo sapiens
actgcctgcctctgattctgca

SEQ ID NO: 8511397 - DNA, 22 bp, Homo sapiens
actgcctgcatccttagggtag

SEQ ID NO: 8511398 - DNA, 19 bp, Homo sapiens
actgcctgaggctcacagg

SEQ ID NO: 8511399 - DNA, 22 bp, Homo sapiens
actgcctgatgtggttctaaat

SEQ ID NO: 8511400 - DNA, 19 bp, Homo sapiens
actgcctgcaggtgttggg

SEQ ID NO: 8511401 - DNA, 22 bp, Homo sapiens
actgcccattaaaggtgctttg

SEQ ID NO: 8511402 - DNA, 22 bp, Homo sapiens
actgccctcccatctattgcaa

SEQ ID NO: 8511403 - DNA, 22 bp, Homo sapiens
actgcctcttggtgctgagaga

SEQ ID NO: 8511404 - DNA, 22 bp, Homo sapiens
actgcctcttggtgctgagaga

SEQ ID NO: 8511405 - DNA, 22 bp, Homo sapiens
actgcctgagctattggaaaag

SEQ ID NO: 8511406 - DNA, 22 bp, Homo sapiens
actgccattggtcaaatgagtg

SEQ ID NO: 8511407 - DNA, 22 bp, Homo sapiens
actgccaggatggcactagagg

SEQ ID NO: 8511408 - DNA, 22 bp, Homo sapiens
actgccaatggtagtttgatgg

SEQ ID NO: 8511409 - DNA, 22 bp, Homo sapiens
actgccacctggtggtcctgga

SEQ ID NO: 8511410 - DNA, 22 bp, Homo sapiens
actgccaatggtagtttgatgg

SEQ ID NO: 8511411 - DNA, 23 bp, Homo sapiens
actgccagattgaaggtttctta

SEQ ID NO: 8511412 - DNA, 22 bp, Homo sapiens
actgccagaggaggtatctgaa

SEQ ID NO: 8511413 - DNA, 22 bp, Homo sapiens
actttgcagagccagaagagaa

SEQ ID NO: 8511414 - DNA, 23 bp, Homo sapiens
actttgcagagccccttgaaaca

SEQ ID NO: 8511415 - DNA, 22 bp, Homo sapiens
actttgcaggtacatgagcatc

SEQ ID NO: 8511416 - DNA, 19 bp, Homo sapiens
actttgcatgtgtgtctaa

SEQ ID NO: 8511417 - DNA, 22 bp, Homo sapiens
atacatcatgctccatatattt

SEQ ID NO: 8511418 - DNA, 22 bp, Homo sapiens
atacatcatgctccatatattt

SEQ ID NO: 8511419 - DNA, 22 bp, Homo sapiens
atacatcatgctccatatattt

SEQ ID NO: 8511420 - DNA, 22 bp, Homo sapiens
atacatcatgctccatatattt

SEQ ID NO: 8511421 - DNA, 22 bp, Homo sapiens
atacatcatttcccatcaatcg

SEQ ID NO: 8511422 - DNA, 22 bp, Homo sapiens
atacatcatttcccatcaatcg

SEQ ID NO: 8511423 - DNA, 22 bp, Homo sapiens
atacatcatttcccatcaatcg

SEQ ID NO: 8511424 - DNA, 22 bp, Homo sapiens
actttgcaatacttaatacaaa

SEQ ID NO: 8511425 - DNA, 22 bp, Homo sapiens
actttgcactaagttactcatt

SEQ ID NO: 8511426 - DNA, 22 bp, Homo sapiens
actttgcacttcaatataactt

SEQ ID NO: 8511427 - DNA, 22 bp, Homo sapiens
actttgcaatgggcagaaccca

SEQ ID NO: 8511428 - DNA, 22 bp, Homo sapiens
actttgcaatgggcagaaccca

SEQ ID NO: 8511429 - DNA, 22 bp, Homo sapiens
atacatctagagtcataaaaac

SEQ ID NO: 8511430 - DNA, 22 bp, Homo sapiens
actttctgccttacaggagtcc

SEQ ID NO: 8511431 - DNA, 22 bp, Homo sapiens
actttctgcagtgttggaaatg

SEQ ID NO: 8511432 - DNA, 20 bp, Homo sapiens
actttctcggtttctcacct

SEQ ID NO: 8511433 - DNA, 22 bp, Homo sapiens
actttctgtcatctagacaagt

SEQ ID NO: 8511434 - DNA, 22 bp, Homo sapiens
atagagtgatgtaaggtatgtg

SEQ ID NO: 8511435 - DNA, 22 bp, Homo sapiens
atagatacattaggtaacttgt

SEQ ID NO: 8511436 - DNA, 22 bp, Homo sapiens
actttggatctgatgtaatcag

SEQ ID NO: 8511437 - DNA, 22 bp, Homo sapiens
atagatattagcaaaattttat

SEQ ID NO: 8511438 - DNA, 20 bp, Homo sapiens
atagatatcatctttagaag

SEQ ID NO: 8511439 - DNA, 22 bp, Homo sapiens
atagatacattgttatatttgt

SEQ ID NO: 8511440 - DNA, 20 bp, Homo sapiens
atagatatcatctttagaag

SEQ ID NO: 8511441 - DNA, 22 bp, Homo sapiens
actttgtgcccaacagaaagaa

SEQ ID NO: 8511442 - DNA, 22 bp, Homo sapiens
actttgtgcccaacagaaagaa

SEQ ID NO: 8511443 - DNA, 22 bp, Homo sapiens
atagatcattgatacttgcatc

SEQ ID NO: 8511444 - DNA, 22 bp, Homo sapiens
atagatcatgttaaaagctcca

SEQ ID NO: 8511445 - DNA, 22 bp, Homo sapiens
atagatcaatatttagaaactt

SEQ ID NO: 8511446 - DNA, 22 bp, Homo sapiens
atagatcatgttaaaagctcca

SEQ ID NO: 8511447 - DNA, 20 bp, Homo sapiens
atagatcagtgagactaaag

SEQ ID NO: 8511448 - DNA, 22 bp, Homo sapiens
atagatcacaatggttcacttt

SEQ ID NO: 8511449 - DNA, 22 bp, Homo sapiens
acttctctggttgaggtccaat

SEQ ID NO: 8511450 - DNA, 22 bp, Homo sapiens
acttctcttcataggtggcaat

SEQ ID NO: 8511451 - DNA, 22 bp, Homo sapiens
acttctcttcataggtggcaat

SEQ ID NO: 8511452 - DNA, 22 bp, Homo sapiens
acttctctcattcagacatagc

SEQ ID NO: 8511453 - DNA, 22 bp, Homo sapiens
acttctctgctacctgcaaaga

SEQ ID NO: 8511454 - DNA, 22 bp, Homo sapiens
atacaaaaattagccgggagta

SEQ ID NO: 8511455 - DNA, 22 bp, Homo sapiens
atacaaaaattagccgggagta

SEQ ID NO: 8511456 - DNA, 22 bp, Homo sapiens
atacaaaaattagccgggagta

SEQ ID NO: 8511457 - DNA, 22 bp, Homo sapiens
atacaaaaattagccgggagta

SEQ ID NO: 8511458 - DNA, 22 bp, Homo sapiens
atacaaaatatatactggagac

SEQ ID NO: 8511459 - DNA, 22 bp, Homo sapiens
atacaaaatatatactggagac

SEQ ID NO: 8511460 - DNA, 22 bp, Homo sapiens
atacaaaatatatactggagac

SEQ ID NO: 8511461 - DNA, 22 bp, Homo sapiens
atacaaaatatatactggagac

SEQ ID NO: 8511462 - DNA, 23 bp, Homo sapiens
atacaaaccttgcaggacatgtt

SEQ ID NO: 8511463 - DNA, 22 bp, Homo sapiens
actttaaagcagaatggctatg

SEQ ID NO: 8511464 - DNA, 22 bp, Homo sapiens
actttaaaactgatcatcagag

SEQ ID NO: 8511465 - DNA, 22 bp, Homo sapiens
atacatatccacaggagataaa

SEQ ID NO: 8511466 - DNA, 22 bp, Homo sapiens
atacatatccacaggagataaa

SEQ ID NO: 8511467 - DNA, 21 bp, Homo sapiens
actttacaatttacatagtga

SEQ ID NO: 8511468 - DNA, 22 bp, Homo sapiens
actttacacatcttttctcatt

SEQ ID NO: 8511469 - DNA, 21 bp, Homo sapiens
actttacaatttacatagtga

SEQ ID NO: 8511470 - DNA, 22 bp, Homo sapiens
atacatcatgctccatatattt

SEQ ID NO: 8511471 - DNA, 22 bp, Homo sapiens
atacatcacctatatattcaca

SEQ ID NO: 8511472 - DNA, 22 bp, Homo sapiens
atacatcacctatatattcaca

SEQ ID NO: 8511473 - DNA, 20 bp, Homo sapiens
actttacagagaagactgac

SEQ ID NO: 8511474 - DNA, 22 bp, Homo sapiens
atacatatgaatgatttggctc

SEQ ID NO: 8511475 - DNA, 22 bp, Homo sapiens
actttacaaactcctcactgtt

SEQ ID NO: 8511476 - DNA, 22 bp, Homo sapiens
actttacaagcttatagcctag

SEQ ID NO: 8511477 - DNA, 22 bp, Homo sapiens
actttacaaactcctcactgtt

SEQ ID NO: 8511478 - DNA, 21 bp, Homo sapiens
actttacaatttacatagtga

SEQ ID NO: 8511479 - DNA, 21 bp, Homo sapiens
actttacaatttacatagtga

SEQ ID NO: 8511480 - DNA, 22 bp, Homo sapiens
actttacaatatcctgtgactt

SEQ ID NO: 8511481 - DNA, 22 bp, Homo sapiens
actttacaatatcctgtgactt

SEQ ID NO: 8511482 - DNA, 22 bp, Homo sapiens
actttaaagcagaatggctatg

SEQ ID NO: 8511483 - DNA, 22 bp, Homo sapiens
actgttttcctaatgagcaaga

SEQ ID NO: 8511484 - DNA, 22 bp, Homo sapiens
actgtttctgccacaatagccc

SEQ ID NO: 8511485 - DNA, 22 bp, Homo sapiens
actgtttctcaaattatgtggt

SEQ ID NO: 8511486 - DNA, 22 bp, Homo sapiens
actgtttagtaaattgaaatgg

SEQ ID NO: 8511487 - DNA, 22 bp, Homo sapiens
actgttttcttagctccctgct

SEQ ID NO: 8511488 - DNA, 22 bp, Homo sapiens
actgttttcttagctccctgct

SEQ ID NO: 8511489 - DNA, 22 bp, Homo sapiens
actgttttgtgccttagtttcc

SEQ ID NO: 8511490 - DNA, 22 bp, Homo sapiens
acttaaaaagaatcttttcacg

SEQ ID NO: 8511491 - DNA, 22 bp, Homo sapiens
acttaaaaagaatcttttcacg

SEQ ID NO: 8511492 - DNA, 22 bp, Homo sapiens
ataaagtcaaggcattttatga

SEQ ID NO: 8511493 - DNA, 22 bp, Homo sapiens
ataaagtagctttcagtgccaa

SEQ ID NO: 8511494 - DNA, 22 bp, Homo sapiens
acttaaagtagttttactgtgg

SEQ ID NO: 8511495 - DNA, 22 bp, Homo sapiens
acttaaagtagttttactgtgg

SEQ ID NO: 8511496 - DNA, 22 bp, Homo sapiens
acttaaagaggctacttttggt

SEQ ID NO: 8511497 - DNA, 18 bp, Homo sapiens
ataaagtgctaataatgg

SEQ ID NO: 8511498 - DNA, 18 bp, Homo sapiens
ataaagtgctaataatgg

SEQ ID NO: 8511499 - DNA, 22 bp, Homo sapiens
ataaagtcatggcagctagaat

SEQ ID NO: 8511500 - DNA, 22 bp, Homo sapiens
ataaagtcatggcagctagaat

SEQ ID NO: 8511501 - DNA, 22 bp, Homo sapiens
ataaagtcaaggcattttatga

SEQ ID NO: 8511502 - DNA, 22 bp, Homo sapiens
acttccttttgggaaactgttt

SEQ ID NO: 8511503 - DNA, 22 bp, Homo sapiens
acttccttttcaaccatacagc

SEQ ID NO: 8511504 - DNA, 22 bp, Homo sapiens
acttccttttgggaaactgttt

SEQ ID NO: 8511505 - DNA, 22 bp, Homo sapiens
acttccttgtcaggtgcatcat

SEQ ID NO: 8511506 - DNA, 22 bp, Homo sapiens
acttcctgtaaatagaattcca

SEQ ID NO: 8511507 - DNA, 22 bp, Homo sapiens
acttcctgggcatgcagagtcc

SEQ ID NO: 8511508 - DNA, 22 bp, Homo sapiens
acttcctgtgttggtcttgctg

SEQ ID NO: 8511509 - DNA, 19 bp, Homo sapiens
ataaataaaaagtgggaga

SEQ ID NO: 8511510 - DNA, 19 bp, Homo sapiens
ataaataaaaagtgggaga

SEQ ID NO: 8511511 - DNA, 22 bp, Homo sapiens
acttcctggctgggtgacctgg

SEQ ID NO: 8511512 - DNA, 19 bp, Homo sapiens
ataaataaaaagtgggaga

SEQ ID NO: 8511513 - DNA, 22 bp, Homo sapiens
ataaagtttaaaagtcaatagt

SEQ ID NO: 8511514 - DNA, 22 bp, Homo sapiens
ataaagtttaaaagtcaatagt

SEQ ID NO: 8511515 - DNA, 22 bp, Homo sapiens
ataaagttctgctggcatatat

SEQ ID NO: 8511516 - DNA, 21 bp, Homo sapiens
agttttatattataagctaaa

SEQ ID NO: 8511517 - DNA, 21 bp, Homo sapiens
agttttatattataagctaaa

SEQ ID NO: 8511518 - DNA, 22 bp, Homo sapiens
agttttatctgtaagctgttca

SEQ ID NO: 8511519 - DNA, 22 bp, Homo sapiens
agttttatgcagtgttctgata

SEQ ID NO: 8511520 - DNA, 22 bp, Homo sapiens
agttttatctgtaagctgttca

SEQ ID NO: 8511521 - DNA, 22 bp, Homo sapiens
agttttatggctcaacctaata

SEQ ID NO: 8511522 - DNA, 22 bp, Homo sapiens
agttttatggctcaacctaata

SEQ ID NO: 8511523 - DNA, 22 bp, Homo sapiens
agttttatgcagtgttctgata

SEQ ID NO: 8511524 - DNA, 22 bp, Homo sapiens
agttttatgcagtgttctgata

SEQ ID NO: 8511525 - DNA, 22 bp, Homo sapiens
agttttaaatgatggtggtggt

SEQ ID NO: 8511526 - DNA, 22 bp, Homo sapiens
agttttaaatgatggtggtggt

SEQ ID NO: 8511527 - DNA, 22 bp, Homo sapiens
agttttaagatgcgcttctgtt

SEQ ID NO: 8511528 - DNA, 22 bp, Homo sapiens
agttttaagatgcgcttctgtt

SEQ ID NO: 8511529 - DNA, 22 bp, Homo sapiens
agttttataaaggcacctcagt

SEQ ID NO: 8511530 - DNA, 22 bp, Homo sapiens
agttttataaaggcacctcagt

SEQ ID NO: 8511531 - DNA, 22 bp, Homo sapiens
agttttatatcttccattggtt

SEQ ID NO: 8511532 - DNA, 22 bp, Homo sapiens
agttttatatcttccattggtt

SEQ ID NO: 8511533 - DNA, 21 bp, Homo sapiens
agttttatattataagctaaa

SEQ ID NO: 8511534 - DNA, 22 bp, Homo sapiens
actgggccttgtgtgtctcatc

SEQ ID NO: 8511535 - DNA, 22 bp, Homo sapiens
actgggccttgccatggcagcc

SEQ ID NO: 8511536 - DNA, 22 bp, Homo sapiens
actgggccttgccatggcagcc

SEQ ID NO: 8511537 - DNA, 22 bp, Homo sapiens
actgggccttgtgtgtctcatc

SEQ ID NO: 8511538 - DNA, 21 bp, Homo sapiens
actgggctagcctgacttctg

SEQ ID NO: 8511539 - DNA, 22 bp, Homo sapiens
actgggctagagtggaagctgg

SEQ ID NO: 8511540 - DNA, 22 bp, Homo sapiens
agtttctagcaaggattgttga

SEQ ID NO: 8511541 - DNA, 22 bp, Homo sapiens
agtttctaccggtacattcagg

SEQ ID NO: 8511542 - DNA, 22 bp, Homo sapiens
agtttctaccggtacattcagg

SEQ ID NO: 8511543 - DNA, 22 bp, Homo sapiens
actgggctccaaggacctggag

SEQ ID NO: 8511544 - DNA, 22 bp, Homo sapiens
ataaaaactgacccatcctttg

SEQ ID NO: 8511545 - DNA, 22 bp, Homo sapiens
agtttttctgctggtctcacta

SEQ ID NO: 8511546 - DNA, 22 bp, Homo sapiens
agtttttcctgattttacagaa

SEQ ID NO: 8511547 - DNA, 22 bp, Homo sapiens
actgtttaggaggcttatatgc

SEQ ID NO: 8511548 - DNA, 22 bp, Homo sapiens
actgtttaggaggcttatatgc

SEQ ID NO: 8511549 - DNA, 22 bp, Homo sapiens
actgtttaaaggcttcctttct

SEQ ID NO: 8511550 - DNA, 22 bp, Homo sapiens
actgtttaaaggcttcctttct

SEQ ID NO: 8511551 - DNA, 22 bp, Homo sapiens
actgttatttgtaatccattat

SEQ ID NO: 8511552 - DNA, 22 bp, Homo sapiens
actgttgtcaggctgctttgga

SEQ ID NO: 8511553 - DNA, 22 bp, Homo sapiens
actgttcaagcaaatgacattg

SEQ ID NO: 8511554 - DNA, 21 bp, Homo sapiens
actgttattcccattttcacc

SEQ ID NO: 8511555 - DNA, 22 bp, Homo sapiens
actgttatttgtaatccattat

SEQ ID NO: 8511556 - DNA, 22 bp, Homo sapiens
agttttatgtagacaattcatt

SEQ ID NO: 8511557 - DNA, 22 bp, Homo sapiens
agttttatgttcacagaaggat

SEQ ID NO: 8511558 - DNA, 22 bp, Homo sapiens
agttttatggctcaacctaata

SEQ ID NO: 8511559 - DNA, 22 bp, Homo sapiens
agttttatgtagacaattcatt

SEQ ID NO: 8511560 - DNA, 23 bp, Homo sapiens
agtttttaatggtcatagctgag

SEQ ID NO: 8511561 - DNA, 23 bp, Homo sapiens
agtttttaatggtcatagctgag

SEQ ID NO: 8511562 - DNA, 23 bp, Homo sapiens
agtttttaatggtcatagctgag

SEQ ID NO: 8511563 - DNA, 23 bp, Homo sapiens
agtttttaatggtcatagctgag

SEQ ID NO: 8511564 - DNA, 22 bp, Homo sapiens
agtttttccgtggctacgataa

SEQ ID NO: 8511565 - DNA, 21 bp, Homo sapiens
agtttttactcttaactgtgg

SEQ ID NO: 8511566 - DNA, 18 bp, Homo sapiens
agtttttaggaagaaatg

SEQ ID NO: 8511567 - DNA, 21 bp, Homo sapiens
agaaaaacacgatataagccc

SEQ ID NO: 8511568 - DNA, 21 bp, Homo sapiens
agaaaaacacgatataagccc

SEQ ID NO: 8511569 - DNA, 22 bp, Homo sapiens
agaaaaacacaatcgggcctcc

SEQ ID NO: 8511570 - DNA, 21 bp, Homo sapiens
agaaaaacacgatataagccc

SEQ ID NO: 8511571 - DNA, 21 bp, Homo sapiens
agaaaaacacgatataagccc

SEQ ID NO: 8511572 - DNA, 23 bp, Homo sapiens
agaaaaacaggattgtgttccta

SEQ ID NO: 8511573 - DNA, 23 bp, Homo sapiens
agaaaaacaggattgtgttccta

SEQ ID NO: 8511574 - DNA, 21 bp, Homo sapiens
agaaaaacacgatataagccc

SEQ ID NO: 8511575 - DNA, 22 bp, Homo sapiens
acttttttataaggaagaagat

SEQ ID NO: 8511576 - DNA, 22 bp, Homo sapiens
actttttgctggtctcttccat

SEQ ID NO: 8511577 - DNA, 22 bp, Homo sapiens
acttttttataaggaagaagat

SEQ ID NO: 8511578 - DNA, 22 bp, Homo sapiens
actttttacagggtgtatacca

SEQ ID NO: 8511579 - DNA, 22 bp, Homo sapiens
actttttagtttcctcaaacat

SEQ ID NO: 8511580 - DNA, 22 bp, Homo sapiens
acttttgaggactttattgtat

SEQ ID NO: 8511581 - DNA, 22 bp, Homo sapiens
acttttggttctgtaactgtga

SEQ ID NO: 8511582 - DNA, 22 bp, Homo sapiens
acttttgtgcaggtctctccca

SEQ ID NO: 8511583 - DNA, 22 bp, Homo sapiens
actttttacagggtgtatacca

SEQ ID NO: 8511584 - DNA, 22 bp, Homo sapiens
actttttacagggtgtatacca

SEQ ID NO: 8511585 - DNA, 22 bp, Homo sapiens
acttttctgcagatgatctctt

SEQ ID NO: 8511586 - DNA, 22 bp, Homo sapiens
acttttctgcagatgatctctt

SEQ ID NO: 8511587 - DNA, 22 bp, Homo sapiens
acttttcttatcagaaaggcca

SEQ ID NO: 8511588 - DNA, 22 bp, Homo sapiens
acttttgaagaattatgcaaaa

SEQ ID NO: 8511589 - DNA, 22 bp, Homo sapiens
acttttgaacaaactcctctgt

SEQ ID NO: 8511590 - DNA, 23 bp, Homo sapiens
acttttcaattagctatgcttaa

SEQ ID NO: 8511591 - DNA, 23 bp, Homo sapiens
acttttcaattagctatgcttaa

SEQ ID NO: 8511592 - DNA, 22 bp, Homo sapiens
acttttctaagcaatggtcttg

SEQ ID NO: 8511593 - DNA, 22 bp, Homo sapiens
acttttctaagcaatggtcttg

SEQ ID NO: 8511594 - DNA, 22 bp, Homo sapiens
acttttctgcagatgatctctt

SEQ ID NO: 8511595 - DNA, 22 bp, Homo sapiens
acttttctccctcctgccttca

SEQ ID NO: 8511596 - DNA, 22 bp, Homo sapiens
acttttctccctcctgccttca

SEQ ID NO: 8511597 - DNA, 22 bp, Homo sapiens
atattttgtaacttggaatagg

SEQ ID NO: 8511598 - DNA, 22 bp, Homo sapiens
atatttttccatgtgggactct

SEQ ID NO: 8511599 - DNA, 22 bp, Homo sapiens
atatttttccatgtgggactct

SEQ ID NO: 8511600 - DNA, 22 bp, Homo sapiens
atcaaaaccttgacttttaatg

SEQ ID NO: 8511601 - DNA, 22 bp, Homo sapiens
atcaaaaccttgacttttaatg

SEQ ID NO: 8511602 - DNA, 21 bp, Homo sapiens
atatttttgtttggactgtca

SEQ ID NO: 8511603 - DNA, 21 bp, Homo sapiens
atatttttgtttggactgtca

SEQ ID NO: 8511604 - DNA, 21 bp, Homo sapiens
atatttttgtttggactgtca

SEQ ID NO: 8511605 - DNA, 21 bp, Homo sapiens
agaaaaaccagcatgttttca

SEQ ID NO: 8511606 - DNA, 22 bp, Homo sapiens
agaaaaactaagagtgggtggt

SEQ ID NO: 8511607 - DNA, 22 bp, Homo sapiens
agaaaaactaagagtgggtggt

SEQ ID NO: 8511608 - DNA, 21 bp, Homo sapiens
agaaaaaccagcatgttttca

SEQ ID NO: 8511609 - DNA, 21 bp, Homo sapiens
agaaaaaccagcatgttttca

SEQ ID NO: 8511610 - DNA, 19 bp, Homo sapiens
agaaaaactggtactgctg

SEQ ID NO: 8511611 - DNA, 22 bp, Homo sapiens
atatttctccaaatgttttcaa

SEQ ID NO: 8511612 - DNA, 22 bp, Homo sapiens
agaaaaagtcaaggaattggac

SEQ ID NO: 8511613 - DNA, 22 bp, Homo sapiens
atatttctccaaatgttttcaa

SEQ ID NO: 8511614 - DNA, 22 bp, Homo sapiens
atatttctccaaatgttttcaa

SEQ ID NO: 8511615 - DNA, 22 bp, Homo sapiens
atcagtctgtgttagaaaagag

SEQ ID NO: 8511616 - DNA, 22 bp, Homo sapiens
atcagtatattccttggtcttt

SEQ ID NO: 8511617 - DNA, 23 bp, Homo sapiens
atcagtcttggtagctgtgccca

SEQ ID NO: 8511618 - DNA, 22 bp, Homo sapiens
atcagtatcctgcagtttctat

SEQ ID NO: 8511619 - DNA, 22 bp, Homo sapiens
atcagtaaatattcattgtgca

SEQ ID NO: 8511620 - DNA, 17 bp, Homo sapiens
atcagtagcatatcaga

SEQ ID NO: 8511621 - DNA, 22 bp, Homo sapiens
atcagtgcttcatagccctggt

SEQ ID NO: 8511622 - DNA, 22 bp, Homo sapiens
atcagtgctaaagcaaatgccc

SEQ ID NO: 8511623 - DNA, 22 bp, Homo sapiens
agaaatcatgtcttatttctat

SEQ ID NO: 8511624 - DNA, 22 bp, Homo sapiens
agaaatcatgtcttatttctat

SEQ ID NO: 8511625 - DNA, 22 bp, Homo sapiens
agaaatcattcccaaacccata

SEQ ID NO: 8511626 - DNA, 22 bp, Homo sapiens
agaaatcatgactaagagcagt

SEQ ID NO: 8511627 - DNA, 22 bp, Homo sapiens
agaaatcatgactaagagcagt

SEQ ID NO: 8511628 - DNA, 22 bp, Homo sapiens
agaaatcaggaacagtaaggag

SEQ ID NO: 8511629 - DNA, 22 bp, Homo sapiens
atcagttatttttaagctataa

SEQ ID NO: 8511630 - DNA, 22 bp, Homo sapiens
atcagttatttttaagctataa

SEQ ID NO: 8511631 - DNA, 22 bp, Homo sapiens
agaaagcagcatttatgatctc

SEQ ID NO: 8511632 - DNA, 22 bp, Homo sapiens
agaaagcagcatttatgatctc

SEQ ID NO: 8511633 - DNA, 22 bp, Homo sapiens
agaaagcagcatttatgatctc

SEQ ID NO: 8511634 - DNA, 22 bp, Homo sapiens
agaaagcagtcccttccgaccg

SEQ ID NO: 8511635 - DNA, 22 bp, Homo sapiens
agaaagcatctccattgtaggt

SEQ ID NO: 8511636 - DNA, 22 bp, Homo sapiens
agaaagcatctccattgtaggt

SEQ ID NO: 8511637 - DNA, 22 bp, Homo sapiens
agaaagcactctgtcttttacc

SEQ ID NO: 8511638 - DNA, 22 bp, Homo sapiens
agaaagcactctgtcttttacc

SEQ ID NO: 8511639 - DNA, 22 bp, Homo sapiens
agaaagcactctgtcttttacc

SEQ ID NO: 8511640 - DNA, 22 bp, Homo sapiens
agaaagcaccctgcactttctg

SEQ ID NO: 8511641 - DNA, 22 bp, Homo sapiens
agaaagcaccctgcactttctg

SEQ ID NO: 8511642 - DNA, 22 bp, Homo sapiens
agaaagcacagcgggtccattt

SEQ ID NO: 8511643 - DNA, 22 bp, Homo sapiens
atcaaaatgctccagtgatggt

SEQ ID NO: 8511644 - DNA, 22 bp, Homo sapiens
agaaagattttcaacaggaggt

SEQ ID NO: 8511645 - DNA, 20 bp, Homo sapiens
atcaaaatcctattgaggtt

SEQ ID NO: 8511646 - DNA, 22 bp, Homo sapiens
atccatttttgcaaagttgttc

SEQ ID NO: 8511647 - DNA, 19 bp, Homo sapiens
atcccaaggagctgggact

SEQ ID NO: 8511648 - DNA, 22 bp, Homo sapiens
atcccacacccctacaacatat

SEQ ID NO: 8511649 - DNA, 22 bp, Homo sapiens
atcccacacccctacaacatat

SEQ ID NO: 8511650 - DNA, 22 bp, Homo sapiens
atcccacacccctacaacatat

SEQ ID NO: 8511651 - DNA, 22 bp, Homo sapiens
atcccacacccctacaacatat

SEQ ID NO: 8511652 - DNA, 22 bp, Homo sapiens
atcccagatagtgaccctcagg

SEQ ID NO: 8511653 - DNA, 22 bp, Homo sapiens
atcccagatggaggctggtcac

SEQ ID NO: 8511654 - DNA, 22 bp, Homo sapiens
atccagctttgtctggtcttcg

SEQ ID NO: 8511655 - DNA, 22 bp, Homo sapiens
agaaatctgactgctgtgcaca

SEQ ID NO: 8511656 - DNA, 22 bp, Homo sapiens
agaaatctgactgctgtgcaca

SEQ ID NO: 8511657 - DNA, 19 bp, Homo sapiens
agaaatctcgagatttgtt

SEQ ID NO: 8511658 - DNA, 22 bp, Homo sapiens
agaaatctatgttttggttaga

SEQ ID NO: 8511659 - DNA, 22 bp, Homo sapiens
agaacatctaaatatctgagac

SEQ ID NO: 8511660 - DNA, 22 bp, Homo sapiens
agaacagtttgttggagactgt

SEQ ID NO: 8511661 - DNA, 23 bp, Homo sapiens
agaacagtgactaatatagagag

SEQ ID NO: 8511662 - DNA, 23 bp, Homo sapiens
agaacagtgactaatatagagag

SEQ ID NO: 8511663 - DNA, 22 bp, Homo sapiens
agaacagtgctgataaatcata

SEQ ID NO: 8511664 - DNA, 22 bp, Homo sapiens
atccccacgatatagccaaagc

SEQ ID NO: 8511665 - DNA, 22 bp, Homo sapiens
atccccacgatatagccaaagc

SEQ ID NO: 8511666 - DNA, 22 bp, Homo sapiens
atccccactgctgctggtgtag

SEQ ID NO: 8511667 - DNA, 22 bp, Homo sapiens
atccccagaaaataggtgccta

SEQ ID NO: 8511668 - DNA, 22 bp, Homo sapiens
atccccagaaaataggtgccta

SEQ ID NO: 8511669 - DNA, 22 bp, Homo sapiens
atccccagaaaataggtgccta

SEQ ID NO: 8511670 - DNA, 22 bp, Homo sapiens
agaacagtcgtggtgagagaaa

SEQ ID NO: 8511671 - DNA, 22 bp, Homo sapiens
agaacagggactggaggcttca

SEQ ID NO: 8511672 - DNA, 22 bp, Homo sapiens
agaacagggactggaggcttca

SEQ ID NO: 8511673 - DNA, 22 bp, Homo sapiens
atctcagggctggagccctgga

SEQ ID NO: 8511674 - DNA, 22 bp, Homo sapiens
agaacctgcctttactctcctt

SEQ ID NO: 8511675 - DNA, 22 bp, Homo sapiens
agaacctgcctttactctcctt

SEQ ID NO: 8511676 - DNA, 22 bp, Homo sapiens
agaacctgcctttactctcctt

SEQ ID NO: 8511677 - DNA, 22 bp, Homo sapiens
agaacctctggatacagtttaa

SEQ ID NO: 8511678 - DNA, 22 bp, Homo sapiens
agaacctcaattatttttgcac

SEQ ID NO: 8511679 - DNA, 20 bp, Homo sapiens
agaacctaagttaaaacaca

SEQ ID NO: 8511680 - DNA, 22 bp, Homo sapiens
agaaccagtttaagatttgggt

SEQ ID NO: 8511681 - DNA, 22 bp, Homo sapiens
agaacatctgaagatacaaagt

SEQ ID NO: 8511682 - DNA, 22 bp, Homo sapiens
agaacattaatgcgaggtatta

SEQ ID NO: 8511683 - DNA, 22 bp, Homo sapiens
agaacatttgtcaaaaagccaa

SEQ ID NO: 8511684 - DNA, 22 bp, Homo sapiens
agaacatttgtcgatcaatttg

SEQ ID NO: 8511685 - DNA, 20 bp, Homo sapiens
agaagccaagtgacatgttt

SEQ ID NO: 8511686 - DNA, 22 bp, Homo sapiens
agaagccaacagggcaggagag

SEQ ID NO: 8511687 - DNA, 22 bp, Homo sapiens
agaagccaacagggcaggagag

SEQ ID NO: 8511688 - DNA, 22 bp, Homo sapiens
atctctttgatggctcctgtga

SEQ ID NO: 8511689 - DNA, 22 bp, Homo sapiens
atctctttgatggctcctgtga

SEQ ID NO: 8511690 - DNA, 22 bp, Homo sapiens
agaagccaagaacagacagtgc

SEQ ID NO: 8511691 - DNA, 22 bp, Homo sapiens
agaagccaagaacagacagtgc

SEQ ID NO: 8511692 - DNA, 22 bp, Homo sapiens
agaagccaacagggcaggagag

SEQ ID NO: 8511693 - DNA, 22 bp, Homo sapiens
agaagccaattctgtgtgagtc

SEQ ID NO: 8511694 - DNA, 22 bp, Homo sapiens
atctcttctcccaacacctggc

SEQ ID NO: 8511695 - DNA, 22 bp, Homo sapiens
atctcttatgtcacataaacca

SEQ ID NO: 8511696 - DNA, 22 bp, Homo sapiens
atctcttatgtcacataaacca

SEQ ID NO: 8511697 - DNA, 22 bp, Homo sapiens
atctcttcccaactccacattc

SEQ ID NO: 8511698 - DNA, 22 bp, Homo sapiens
atctcttagcagtctagtgacc

SEQ ID NO: 8511699 - DNA, 22 bp, Homo sapiens
atctctgtaattacatgatatt

SEQ ID NO: 8511700 - DNA, 22 bp, Homo sapiens
atctctgtaattacatgatatt

SEQ ID NO: 8511701 - DNA, 22 bp, Homo sapiens
atctctgtaaaccataaattga

SEQ ID NO: 8511702 - DNA, 22 bp, Homo sapiens
atctctggttgttttgctccca

SEQ ID NO: 8511703 - DNA, 22 bp, Homo sapiens
atctctggccttccttttccaa

SEQ ID NO: 8511704 - DNA, 22 bp, Homo sapiens
atctctggccttccttttccaa

SEQ ID NO: 8511705 - DNA, 21 bp, Homo sapiens
agaaggcaaaagcagacatct

SEQ ID NO: 8511706 - DNA, 22 bp, Homo sapiens
agaaggagtgtacaggtcatgc

SEQ ID NO: 8511707 - DNA, 22 bp, Homo sapiens
agaaggagtgtacaggtcatgc

SEQ ID NO: 8511708 - DNA, 19 bp, Homo sapiens
agaagctgtgaaatgaagg

SEQ ID NO: 8511709 - DNA, 19 bp, Homo sapiens
agaagctgtgaaatgaagg

SEQ ID NO: 8511710 - DNA, 23 bp, Homo sapiens
agaagctgggagcctggggatgg

SEQ ID NO: 8511711 - DNA, 23 bp, Homo sapiens
agaagctgggagcctggggatgg

SEQ ID NO: 8511712 - DNA, 22 bp, Homo sapiens
agaaggagtgtacaggtcatgc

SEQ ID NO: 8511713 - DNA, 22 bp, Homo sapiens
agaaggagtgtacaggtcatgc

SEQ ID NO: 8511714 - DNA, 22 bp, Homo sapiens
agaagctgtggtatgaaatgtg

SEQ ID NO: 8511715 - DNA, 22 bp, Homo sapiens
agaaggcagatgggacggagca

SEQ ID NO: 8511716 - DNA, 22 bp, Homo sapiens
agaaggcactcacactggcacg

SEQ ID NO: 8511717 - DNA, 22 bp, Homo sapiens
agaaggcaccgtggccaatatt

SEQ ID NO: 8511718 - DNA, 22 bp, Homo sapiens
atctgccaatgccatgagaaga

SEQ ID NO: 8511719 - DNA, 22 bp, Homo sapiens
agaaggcaggttttaaaatgtc

SEQ ID NO: 8511720 - DNA, 20 bp, Homo sapiens
agaaggcaggagacaaaagg

SEQ ID NO: 8511721 - DNA, 22 bp, Homo sapiens
agaaggcagatgggacggagca

SEQ ID NO: 8511722 - DNA, 22 bp, Homo sapiens
ataaaagaagttttggtacttg

SEQ ID NO: 8511723 - DNA, 22 bp, Homo sapiens
ataaaagaagttttggtacttg

SEQ ID NO: 8511724 - DNA, 22 bp, Homo sapiens
ataaaagaagttttggtacttg

SEQ ID NO: 8511725 - DNA, 22 bp, Homo sapiens
ataaaagatcccttctgagctc

SEQ ID NO: 8511726 - DNA, 22 bp, Homo sapiens
ctgcaggctcgaagacacggat

SEQ ID NO: 8511727 - DNA, 20 bp, Homo sapiens
ataaaactctaatctggcct

SEQ ID NO: 8511728 - DNA, 22 bp, Homo sapiens
ataaaacttgggtatgatccct

SEQ ID NO: 8511729 - DNA, 22 bp, Homo sapiens
ataaaacttgggtatgatccct

SEQ ID NO: 8511730 - DNA, 22 bp, Homo sapiens
ataaaacttattagaattgtgt

SEQ ID NO: 8511731 - DNA, 20 bp, Homo sapiens
ataaaactctaatctggcct

SEQ ID NO: 8511732 - DNA, 22 bp, Homo sapiens
ataaaaccaaagcagcagtgtt

SEQ ID NO: 8511733 - DNA, 22 bp, Homo sapiens
ataaaaaggacagatgtggtct

SEQ ID NO: 8511734 - DNA, 22 bp, Homo sapiens
ataaaaaggacagatgtggtct

SEQ ID NO: 8511735 - DNA, 22 bp, Homo sapiens
ataaaaaggacagatgtggtct

SEQ ID NO: 8511736 - DNA, 22 bp, Homo sapiens
ataaaaatgagggcggtagcta

SEQ ID NO: 8511737 - DNA, 22 bp, Homo sapiens
agttttgtaattctcaaaaata

SEQ ID NO: 8511738 - DNA, 22 bp, Homo sapiens
agttctggttgcccatgacatc

SEQ ID NO: 8511739 - DNA, 22 bp, Homo sapiens
agttctctggctcctttccaga

SEQ ID NO: 8511740 - DNA, 22 bp, Homo sapiens
agttctctttagctcatatggt

SEQ ID NO: 8511741 - DNA, 22 bp, Homo sapiens
agttctctttagctcatatggt

SEQ ID NO: 8511742 - DNA, 22 bp, Homo sapiens
agttctgaatgaggaatctggg

SEQ ID NO: 8511743 - DNA, 22 bp, Homo sapiens
agttctaagatgctccacagag

SEQ ID NO: 8511744 - DNA, 22 bp, Homo sapiens
agttctagaagacttttccatt

SEQ ID NO: 8511745 - DNA, 22 bp, Homo sapiens
agttctaagatgctccacagag

SEQ ID NO: 8511746 - DNA, 23 bp, Homo sapiens
agttctcaaaaccagcttgacaa

SEQ ID NO: 8511747 - DNA, 22 bp, Homo sapiens
agttctcaagacaattacctgt

SEQ ID NO: 8511748 - DNA, 23 bp, Homo sapiens
agttctcattcatcacggcctat

SEQ ID NO: 8511749 - DNA, 22 bp, Homo sapiens
agttctcattgcatgagacaga

SEQ ID NO: 8511750 - DNA, 22 bp, Homo sapiens
agttctcaggtcagctgagtct

SEQ ID NO: 8511751 - DNA, 22 bp, Homo sapiens
agttctcagcttagtatgctgt

SEQ ID NO: 8511752 - DNA, 22 bp, Homo sapiens
agttctcagcttagtatgctgt

SEQ ID NO: 8511753 - DNA, 22 bp, Homo sapiens
ataaactgaagggaacactgag

SEQ ID NO: 8511754 - DNA, 22 bp, Homo sapiens
ataaactgaagggaacactgag

SEQ ID NO: 8511755 - DNA, 22 bp, Homo sapiens
ataaactgggtatcaagaggcc

SEQ ID NO: 8511756 - DNA, 21 bp, Homo sapiens
ataaactgcatcaagttggtg

SEQ ID NO: 8511757 - DNA, 22 bp, Homo sapiens
ataaactgaagggaacactgag

SEQ ID NO: 8511758 - DNA, 22 bp, Homo sapiens
ataaacctatgctaagctgtgg

SEQ ID NO: 8511759 - DNA, 22 bp, Homo sapiens
ataaaccagaagtaaaagctac

SEQ ID NO: 8511760 - DNA, 22 bp, Homo sapiens
ataaaatcagagttggattgga

SEQ ID NO: 8511761 - DNA, 22 bp, Homo sapiens
ataaacatctgtttctcttctg

SEQ ID NO: 8511762 - DNA, 22 bp, Homo sapiens
ataaacatctgtttctcttctg

SEQ ID NO: 8511763 - DNA, 22 bp, Homo sapiens
ataaacatctgtttctcttctg

SEQ ID NO: 8511764 - DNA, 22 bp, Homo sapiens
ataaacatctgtttctcttctg

SEQ ID NO: 8511765 - DNA, 22 bp, Homo sapiens
ataaacatctgtttctcttctg

SEQ ID NO: 8511766 - DNA, 22 bp, Homo sapiens
ctgcagggaccacaagcaggtt

SEQ ID NO: 8511767 - DNA, 22 bp, Homo sapiens
ctgcagggaccacaagcaggtt

SEQ ID NO: 8511768 - DNA, 22 bp, Homo sapiens
ctgcagggacccaagtctttgg

SEQ ID NO: 8511769 - DNA, 22 bp, Homo sapiens
ctgcagggagaggggacagcct

SEQ ID NO: 8511770 - DNA, 22 bp, Homo sapiens
ctgcaggctgagcgcctgccgg

SEQ ID NO: 8511771 - DNA, 22 bp, Homo sapiens
ctgcaggctgagcgcctgccgg

SEQ ID NO: 8511772 - DNA, 22 bp, Homo sapiens
ctgcaggctgagcgcctgccgg

SEQ ID NO: 8511773 - DNA, 22 bp, Homo sapiens
ctgcagggaactgaggcccaga

SEQ ID NO: 8511774 - DNA, 22 bp, Homo sapiens
ataaactgtgctggatgatgag

SEQ ID NO: 8511775 - DNA, 22 bp, Homo sapiens
ataaacttgagtctcagagtat

SEQ ID NO: 8511776 - DNA, 23 bp, Homo sapiens
ataaactgtcaaaagccagccct

SEQ ID NO: 8511777 - DNA, 22 bp, Homo sapiens
ataaactggtaggaaaacagta

SEQ ID NO: 8511778 - DNA, 22 bp, Homo sapiens
ataaactgggtatcaagaggcc

SEQ ID NO: 8511779 - DNA, 22 bp, Homo sapiens
ataaagaccagtatcttatgtt

SEQ ID NO: 8511780 - DNA, 22 bp, Homo sapiens
ataaacttgagtctcagagtat

SEQ ID NO: 8511781 - DNA, 22 bp, Homo sapiens
ataaagatttttaggcatttct

SEQ ID NO: 8511782 - DNA, 22 bp, Homo sapiens
ataaagatttctttttctctac

SEQ ID NO: 8511783 - DNA, 22 bp, Homo sapiens
ataaagatttctttttctctac

SEQ ID NO: 8511784 - DNA, 22 bp, Homo sapiens
ataaagaccagtatcttatgtt

SEQ ID NO: 8511785 - DNA, 22 bp, Homo sapiens
ataaagaggatgtatttacagc

SEQ ID NO: 8511786 - DNA, 22 bp, Homo sapiens
ataaagaggatgtatttacagc

SEQ ID NO: 8511787 - DNA, 22 bp, Homo sapiens
ataaagctaagacttacatgaa

SEQ ID NO: 8511788 - DNA, 22 bp, Homo sapiens
ataaagctaagacttacatgaa

SEQ ID NO: 8511789 - DNA, 22 bp, Homo sapiens
ataaagctattcctctcttttt

SEQ ID NO: 8511790 - DNA, 22 bp, Homo sapiens
ataaagctatttttaattctgt

SEQ ID NO: 8511791 - DNA, 22 bp, Homo sapiens
ataaagcatctagtctgtcact

SEQ ID NO: 8511792 - DNA, 22 bp, Homo sapiens
ataaagcaagcataccattaag

SEQ ID NO: 8511793 - DNA, 22 bp, Homo sapiens
ataaagcatactttgtatgact

SEQ ID NO: 8511794 - DNA, 22 bp, Homo sapiens
ataaagcaaataggactattgc

SEQ ID NO: 8511795 - DNA, 22 bp, Homo sapiens
ataaagcaagcataccattaag

SEQ ID NO: 8511796 - DNA, 22 bp, Homo sapiens
ataaagcaagcataccattaag

SEQ ID NO: 8511797 - DNA, 22 bp, Homo sapiens
ctgcctggaaggagcaagggga

SEQ ID NO: 8511798 - DNA, 22 bp, Homo sapiens
ctgcctggaaggagcaagggga

SEQ ID NO: 8511799 - DNA, 22 bp, Homo sapiens
ctgcctgggttcaagtcctgtt

SEQ ID NO: 8511800 - DNA, 22 bp, Homo sapiens
ctgcctggggcatcagtcaagg

SEQ ID NO: 8511801 - DNA, 22 bp, Homo sapiens
ctgcctggtactttaggcactt

SEQ ID NO: 8511802 - DNA, 22 bp, Homo sapiens
ctgcctgggttcaagtcctgtt

SEQ ID NO: 8511803 - DNA, 22 bp, Homo sapiens
ctgcctgggttcaagtcctgtt

SEQ ID NO: 8511804 - DNA, 22 bp, Homo sapiens
ctgcctggtctcaggcatgggg

SEQ ID NO: 8511805 - DNA, 22 bp, Homo sapiens
ctgcctggtctcaggcatgggg

SEQ ID NO: 8511806 - DNA, 22 bp, Homo sapiens
ctgcctgtgatttttctctagt

SEQ ID NO: 8511807 - DNA, 22 bp, Homo sapiens
ctgcctgtgcatgcagtcagaa

SEQ ID NO: 8511808 - DNA, 22 bp, Homo sapiens
ctgcctgtgcatgcagtcagaa

SEQ ID NO: 8511809 - DNA, 22 bp, Homo sapiens
ctgcctggtgcggtgcccaccc

SEQ ID NO: 8511810 - DNA, 22 bp, Homo sapiens
ctgcctgtattgtctgcttggg

SEQ ID NO: 8511811 - DNA, 22 bp, Homo sapiens
ctgcctgtgccaatgctccttt

SEQ ID NO: 8511812 - DNA, 22 bp, Homo sapiens
ctgcctgtgccaatgctccttt

SEQ ID NO: 8511813 - DNA, 22 bp, Homo sapiens
ctgcctgtgccaccgcctcatt

SEQ ID NO: 8511814 - DNA, 22 bp, Homo sapiens
ctgctacaccggaatagtgaca

SEQ ID NO: 8511815 - DNA, 22 bp, Homo sapiens
ctgcctgtgccaccgcctcatt

SEQ ID NO: 8511816 - DNA, 22 bp, Homo sapiens
ctgctcagcggaaggaagagcg

SEQ ID NO: 8511817 - DNA, 22 bp, Homo sapiens
ctgctcagaggaaggaatgtct

SEQ ID NO: 8511818 - DNA, 19 bp, Homo sapiens
ctgctcagagcagctccag

SEQ ID NO: 8511819 - DNA, 19 bp, Homo sapiens
ctgctcagagcagctccag

SEQ ID NO: 8511820 - DNA, 19 bp, Homo sapiens
ctgctcagagcagctccag

SEQ ID NO: 8511821 - DNA, 22 bp, Homo sapiens
ctgctagcccaggatgcaggga

SEQ ID NO: 8511822 - DNA, 22 bp, Homo sapiens
ctgctagcccgccggccagcga

SEQ ID NO: 8511823 - DNA, 22 bp, Homo sapiens
ctgctcacgccaccgttcatca

SEQ ID NO: 8511824 - DNA, 22 bp, Homo sapiens
ctgctgccattagggcacagac

SEQ ID NO: 8511825 - DNA, 22 bp, Homo sapiens
ctgctgccattagggcacagac

SEQ ID NO: 8511826 - DNA, 22 bp, Homo sapiens
ctgctgcccagtgtgcattggg

SEQ ID NO: 8511827 - DNA, 22 bp, Homo sapiens
ctgctgggcagaggctgcatga

SEQ ID NO: 8511828 - DNA, 22 bp, Homo sapiens
ctgctgggcagaggctgcatga

SEQ ID NO: 8511829 - DNA, 22 bp, Homo sapiens
ctgctgggcctggtctctgagg

SEQ ID NO: 8511830 - DNA, 22 bp, Homo sapiens
ctgctgggcagaggctgcatga

SEQ ID NO: 8511831 - DNA, 22 bp, Homo sapiens
ctgctggggaggcgcctcgacg

SEQ ID NO: 8511832 - DNA, 22 bp, Homo sapiens
ctgctgggctcctcatgtgact

SEQ ID NO: 8511833 - DNA, 22 bp, Homo sapiens
ctgctgggctcctcatgtgact

SEQ ID NO: 8511834 - DNA, 22 bp, Homo sapiens
ctgctgggctcctcatgtgact

SEQ ID NO: 8511835 - DNA, 22 bp, Homo sapiens
ctgctgggctcctcatgtgact

SEQ ID NO: 8511836 - DNA, 22 bp, Homo sapiens
ctgctgggctcctcatgtgact

SEQ ID NO: 8511837 - DNA, 22 bp, Homo sapiens
ctgctgggctcctcatgtgact

SEQ ID NO: 8511838 - DNA, 21 bp, Homo sapiens
ctgctgtggcccccgacatgc

SEQ ID NO: 8511839 - DNA, 22 bp, Homo sapiens
ctgctgtggccagccaggtcaa

SEQ ID NO: 8511840 - DNA, 22 bp, Homo sapiens
ctgctgtggatgcaggacctca

SEQ ID NO: 8511841 - DNA, 22 bp, Homo sapiens
ctgctgtgggttaagacactgt

SEQ ID NO: 8511842 - DNA, 22 bp, Homo sapiens
ctgctgtgggttaagacactgt

SEQ ID NO: 8511843 - DNA, 20 bp, Homo sapiens
ctgctgtggtcctttatttt

SEQ ID NO: 8511844 - DNA, 22 bp, Homo sapiens
ctgctgtgggcagggtagctgg

SEQ ID NO: 8511845 - DNA, 22 bp, Homo sapiens
ctgctgtgggcagggtagctgg

SEQ ID NO: 8511846 - DNA, 22 bp, Homo sapiens
ctgctgtgggttaagacactgt

SEQ ID NO: 8511847 - DNA, 22 bp, Homo sapiens
ctgctgtgggttaagacactgt

SEQ ID NO: 8511848 - DNA, 22 bp, Homo sapiens
ctgctgtgtcagagtccagggg

SEQ ID NO: 8511849 - DNA, 22 bp, Homo sapiens
ctgctgtggtgtcaagcatctc

SEQ ID NO: 8511850 - DNA, 22 bp, Homo sapiens
ctgctgtgtatcattttagatg

SEQ ID NO: 8511851 - DNA, 18 bp, Homo sapiens
ctgctgtgtcgtctgggc

SEQ ID NO: 8511852 - DNA, 18 bp, Homo sapiens
ctgctgtgtcgtctgggc

SEQ ID NO: 8511853 - DNA, 22 bp, Homo sapiens
ctgctgtgtcagagtccagggg

SEQ ID NO: 8511854 - DNA, 22 bp, Homo sapiens
atacaagttctcatgtgtatct

SEQ ID NO: 8511855 - DNA, 22 bp, Homo sapiens
ctgctgtgcatatttatctagg

SEQ ID NO: 8511856 - DNA, 22 bp, Homo sapiens
ctgctgtgcctcttttcacgtg

SEQ ID NO: 8511857 - DNA, 22 bp, Homo sapiens
ctgctgtgcaggtgcctatgat

SEQ ID NO: 8511858 - DNA, 22 bp, Homo sapiens
ctgctgtgcaggtgcctatgat

SEQ ID NO: 8511859 - DNA, 22 bp, Homo sapiens
ctgctgtgcttgtggccacccg

SEQ ID NO: 8511860 - DNA, 22 bp, Homo sapiens
ctgctgtgcctcttttcacgtg

SEQ ID NO: 8511861 - DNA, 22 bp, Homo sapiens
ctgctgtgccttaaaatgcaag

SEQ ID NO: 8511862 - DNA, 22 bp, Homo sapiens
ctgctggggtcagagcactggg

SEQ ID NO: 8511863 - DNA, 22 bp, Homo sapiens
ctgctggggtcagagcactggg

SEQ ID NO: 8511864 - DNA, 22 bp, Homo sapiens
ctgctgtgcagacagactctct

SEQ ID NO: 8511865 - DNA, 22 bp, Homo sapiens
ctgctgggggacacaggtccgg

SEQ ID NO: 8511866 - DNA, 22 bp, Homo sapiens
atacacagctacattgaacaat

SEQ ID NO: 8511867 - DNA, 22 bp, Homo sapiens
atacaagttgcccaaatgatta

SEQ ID NO: 8511868 - DNA, 22 bp, Homo sapiens
atacacaggcatgcttctgatt

SEQ ID NO: 8511869 - DNA, 22 bp, Homo sapiens
atacacaggtgctaggtcaata

SEQ ID NO: 8511870 - DNA, 21 bp, Homo sapiens
atacacatacacataaatgtg

SEQ ID NO: 8511871 - DNA, 21 bp, Homo sapiens
atacacatacacataaatgtg

SEQ ID NO: 8511872 - DNA, 21 bp, Homo sapiens
atacacatacacataaatgtg

SEQ ID NO: 8511873 - DNA, 22 bp, Homo sapiens
atacacatatcaggtgtataca

SEQ ID NO: 8511874 - DNA, 22 bp, Homo sapiens
atacacatatcaggtgtataca

SEQ ID NO: 8511875 - DNA, 22 bp, Homo sapiens
atacacatatatacacgtttaa

SEQ ID NO: 8511876 - DNA, 19 bp, Homo sapiens
atacacatacgtaaactga

SEQ ID NO: 8511877 - DNA, 19 bp, Homo sapiens
atacacatacgtaaactga

SEQ ID NO: 8511878 - DNA, 19 bp, Homo sapiens
atacacatacgtaaactga

SEQ ID NO: 8511879 - DNA, 21 bp, Homo sapiens
atacacatacacataaatgtg

SEQ ID NO: 8511880 - DNA, 21 bp, Homo sapiens
atacacatacacataaatgtg

SEQ ID NO: 8511881 - DNA, 21 bp, Homo sapiens
atacacatacacataaatgtg

SEQ ID NO: 8511882 - DNA, 22 bp, Homo sapiens
atacacatgcacacatgtgtgt

SEQ ID NO: 8511883 - DNA, 20 bp, Homo sapiens
atacacatgcagacagatgc

SEQ ID NO: 8511884 - DNA, 22 bp, Homo sapiens
atacacatgcacacatgtgtgt

SEQ ID NO: 8511885 - DNA, 22 bp, Homo sapiens
atacacatgcacacatgtgtgt

SEQ ID NO: 8511886 - DNA, 22 bp, Homo sapiens
atacacatctatttaagagaca

SEQ ID NO: 8511887 - DNA, 22 bp, Homo sapiens
atacacatctatttaagagaca

SEQ ID NO: 8511888 - DNA, 22 bp, Homo sapiens
atacacatctatttaagagaca

SEQ ID NO: 8511889 - DNA, 20 bp, Homo sapiens
atacacatattcttgcaact

SEQ ID NO: 8511890 - DNA, 20 bp, Homo sapiens
atacacatattcttgcaact

SEQ ID NO: 8511891 - DNA, 20 bp, Homo sapiens
atacacatattcttgcaact

SEQ ID NO: 8511892 - DNA, 22 bp, Homo sapiens
atacacatatgtgtgtatatgt

SEQ ID NO: 8511893 - DNA, 22 bp, Homo sapiens
atacacatatgtgtgtatatgt

SEQ ID NO: 8511894 - DNA, 22 bp, Homo sapiens
atacacatatgtgtgtatatgt

SEQ ID NO: 8511895 - DNA, 22 bp, Homo sapiens
atacacatatgtgtgtatatgt

SEQ ID NO: 8511896 - DNA, 22 bp, Homo sapiens
ctggctcacaggtgagatgcat

SEQ ID NO: 8511897 - DNA, 22 bp, Homo sapiens
ctggctcacaggtgagatgcat

SEQ ID NO: 8511898 - DNA, 22 bp, Homo sapiens
atagtggggacaggatggttgg

SEQ ID NO: 8511899 - DNA, 22 bp, Homo sapiens
atagtgggtacaggggcagaga

SEQ ID NO: 8511900 - DNA, 22 bp, Homo sapiens
atagtggtgagctgcatttatg

SEQ ID NO: 8511901 - DNA, 22 bp, Homo sapiens
atagtttaccttccagatggct

SEQ ID NO: 8511902 - DNA, 22 bp, Homo sapiens
ctggctatgtggttagacataa

SEQ ID NO: 8511903 - DNA, 22 bp, Homo sapiens
ctggctcaataaatattagctg

SEQ ID NO: 8511904 - DNA, 22 bp, Homo sapiens
ctggctcaatttgtactgctgt

SEQ ID NO: 8511905 - DNA, 22 bp, Homo sapiens
ctggcgtgaaggtggccatgag

SEQ ID NO: 8511906 - DNA, 22 bp, Homo sapiens
ctggctaaagagcaagaagatg

SEQ ID NO: 8511907 - DNA, 22 bp, Homo sapiens
ctggcctcggcagcaggaacag

SEQ ID NO: 8511908 - DNA, 22 bp, Homo sapiens
ctggcctctctgagcagggagc

SEQ ID NO: 8511909 - DNA, 22 bp, Homo sapiens
ctggcctctgtgttcaccatag

SEQ ID NO: 8511910 - DNA, 22 bp, Homo sapiens
ctggcctgtgggctgtctccgg

SEQ ID NO: 8511911 - DNA, 22 bp, Homo sapiens
ctggcctgtgggctgtctccgg

SEQ ID NO: 8511912 - DNA, 19 bp, Homo sapiens
ctggcctgtgtcctgtgct

SEQ ID NO: 8511913 - DNA, 22 bp, Homo sapiens
ctggccttttgtttctggagaa

SEQ ID NO: 8511914 - DNA, 22 bp, Homo sapiens
ctggcctttcgtgagagctggg

SEQ ID NO: 8511915 - DNA, 22 bp, Homo sapiens
ctggcctttagccccagtgtct

SEQ ID NO: 8511916 - DNA, 22 bp, Homo sapiens
ctggcctttcgtgagagctggg

SEQ ID NO: 8511917 - DNA, 22 bp, Homo sapiens
ctggccttcagactcggactga

SEQ ID NO: 8511918 - DNA, 22 bp, Homo sapiens
ctggccttcagactcggactga

SEQ ID NO: 8511919 - DNA, 21 bp, Homo sapiens
ctggccttcaactgattggat

SEQ ID NO: 8511920 - DNA, 22 bp, Homo sapiens
ctggccttgttcctccccaagt

SEQ ID NO: 8511921 - DNA, 22 bp, Homo sapiens
ctggccttggtgcttgcagaca

SEQ ID NO: 8511922 - DNA, 22 bp, Homo sapiens
ctggctctttcctagctaggct

SEQ ID NO: 8511923 - DNA, 22 bp, Homo sapiens
ctggctctttcagccgctggag

SEQ ID NO: 8511924 - DNA, 22 bp, Homo sapiens
ctggctgaatcctagtctcata

SEQ ID NO: 8511925 - DNA, 22 bp, Homo sapiens
ctggctgacacaaaggtatcga

SEQ ID NO: 8511926 - DNA, 22 bp, Homo sapiens
ctggctgacaccttgatagcag

SEQ ID NO: 8511927 - DNA, 22 bp, Homo sapiens
ctggctcttgcgactcagcttg

SEQ ID NO: 8511928 - DNA, 22 bp, Homo sapiens
ctggctcttgcgactcagcttg

SEQ ID NO: 8511929 - DNA, 22 bp, Homo sapiens
ctggctcttggctagggagagt

SEQ ID NO: 8511930 - DNA, 22 bp, Homo sapiens
atataaagtgtttagaaagctg

SEQ ID NO: 8511931 - DNA, 22 bp, Homo sapiens
atataaagtgtttagaaagctg

SEQ ID NO: 8511932 - DNA, 22 bp, Homo sapiens
atataaagtgtttagaaagctg

SEQ ID NO: 8511933 - DNA, 22 bp, Homo sapiens
atataaagtgtttagaaagctg

SEQ ID NO: 8511934 - DNA, 22 bp, Homo sapiens
atataaagtgtttagaaagctg

SEQ ID NO: 8511935 - DNA, 23 bp, Homo sapiens
atataaacaccagatagattgta

SEQ ID NO: 8511936 - DNA, 23 bp, Homo sapiens
atataaacaccagatagattgta

SEQ ID NO: 8511937 - DNA, 22 bp, Homo sapiens
atagttttatagatattgtgta

SEQ ID NO: 8511938 - DNA, 22 bp, Homo sapiens
atagttttatagatattgtgta

SEQ ID NO: 8511939 - DNA, 22 bp, Homo sapiens
atagttttatagatattgtgta

SEQ ID NO: 8511940 - DNA, 22 bp, Homo sapiens
atataaagaagtggaaaatgag

SEQ ID NO: 8511941 - DNA, 22 bp, Homo sapiens
atataaagaagtggaaaatgag

SEQ ID NO: 8511942 - DNA, 22 bp, Homo sapiens
atataaagaagtggaaaatgag

SEQ ID NO: 8511943 - DNA, 22 bp, Homo sapiens
atataaagagcttagtatagtg

SEQ ID NO: 8511944 - DNA, 22 bp, Homo sapiens
atataaagagcttagtatagtg

SEQ ID NO: 8511945 - DNA, 22 bp, Homo sapiens
atataaagagcttagtatagtg

SEQ ID NO: 8511946 - DNA, 22 bp, Homo sapiens
atataaagagcttagtatagtg

SEQ ID NO: 8511947 - DNA, 22 bp, Homo sapiens
atatacagggagaaacagctta

SEQ ID NO: 8511948 - DNA, 22 bp, Homo sapiens
atatacactccactgatacagg

SEQ ID NO: 8511949 - DNA, 22 bp, Homo sapiens
atatacagggagaaacagctta

SEQ ID NO: 8511950 - DNA, 22 bp, Homo sapiens
atatacaggtggtatgtgtaaa

SEQ ID NO: 8511951 - DNA, 22 bp, Homo sapiens
atatacaggtggtatgtgtaaa

SEQ ID NO: 8511952 - DNA, 22 bp, Homo sapiens
atatacacatgtgtatacattt

SEQ ID NO: 8511953 - DNA, 22 bp, Homo sapiens
atatacacatgtgtatacattt

SEQ ID NO: 8511954 - DNA, 19 bp, Homo sapiens
ctggctgcaatgccagggt

SEQ ID NO: 8511955 - DNA, 22 bp, Homo sapiens
atataatacaacctgctaagtg

SEQ ID NO: 8511956 - DNA, 19 bp, Homo sapiens
ctggctgcaatgccagggt

SEQ ID NO: 8511957 - DNA, 22 bp, Homo sapiens
atatacacatgtgtatacattt

SEQ ID NO: 8511958 - DNA, 19 bp, Homo sapiens
ctggctgcaatgccagggt

SEQ ID NO: 8511959 - DNA, 22 bp, Homo sapiens
ctggctgcaaaatctattcact

SEQ ID NO: 8511960 - DNA, 22 bp, Homo sapiens
ctggctgaggcagagcctgggg

SEQ ID NO: 8511961 - DNA, 22 bp, Homo sapiens
ctggctgaggcagagcctgggg

SEQ ID NO: 8511962 - DNA, 22 bp, Homo sapiens
ctggctgaggtcaccagtagct

SEQ ID NO: 8511963 - DNA, 22 bp, Homo sapiens
ctggctgagttactccactgag

SEQ ID NO: 8511964 - DNA, 22 bp, Homo sapiens
ctgggagaggaacctcgagggt

SEQ ID NO: 8511965 - DNA, 22 bp, Homo sapiens
ctgggagaggctgctccgctct

SEQ ID NO: 8511966 - DNA, 22 bp, Homo sapiens
atatacttggagactatcattg

SEQ ID NO: 8511967 - DNA, 22 bp, Homo sapiens
atatacttggagactatcattg

SEQ ID NO: 8511968 - DNA, 22 bp, Homo sapiens
atatacttggagactatcattg

SEQ ID NO: 8511969 - DNA, 22 bp, Homo sapiens
ctgggagaggaacctcgagggt

SEQ ID NO: 8511970 - DNA, 22 bp, Homo sapiens
ctgggagctggaatgggagaag

SEQ ID NO: 8511971 - DNA, 22 bp, Homo sapiens
ctgggagctgtcaggagcgtgt

SEQ ID NO: 8511972 - DNA, 22 bp, Homo sapiens
atatactgtaggccactataag

SEQ ID NO: 8511973 - DNA, 22 bp, Homo sapiens
atatacctcattctttgagtgc

SEQ ID NO: 8511974 - DNA, 20 bp, Homo sapiens
atataccatcccacaacagg

SEQ ID NO: 8511975 - DNA, 20 bp, Homo sapiens
atataccatcccacaacagg

SEQ ID NO: 8511976 - DNA, 22 bp, Homo sapiens
atatacatgggaatatgtggag

SEQ ID NO: 8511977 - DNA, 19 bp, Homo sapiens
atatacatactgtgtgcat

SEQ ID NO: 8511978 - DNA, 22 bp, Homo sapiens
ctggccactggaggtggcaccc

SEQ ID NO: 8511979 - DNA, 22 bp, Homo sapiens
ctggccactgcgggcctctgcc

SEQ ID NO: 8511980 - DNA, 22 bp, Homo sapiens
ctggccactgcgggcctctgcc

SEQ ID NO: 8511981 - DNA, 22 bp, Homo sapiens
ctggccactggaggtggcaccc

SEQ ID NO: 8511982 - DNA, 22 bp, Homo sapiens
ctggccactggaggtggcaccc

SEQ ID NO: 8511983 - DNA, 22 bp, Homo sapiens
ctggcaggttatagagctgccc

SEQ ID NO: 8511984 - DNA, 22 bp, Homo sapiens
ctggcaggttatagagctgccc

SEQ ID NO: 8511985 - DNA, 22 bp, Homo sapiens
ctggcaggtttggtgtctggtg

SEQ ID NO: 8511986 - DNA, 22 bp, Homo sapiens
ctggcaggtttggtgtctggtg

SEQ ID NO: 8511987 - DNA, 22 bp, Homo sapiens
ctggcaggtctcgctgacgtgt

SEQ ID NO: 8511988 - DNA, 22 bp, Homo sapiens
ctggcaggtccagctggactca

SEQ ID NO: 8511989 - DNA, 22 bp, Homo sapiens
ctggcaggtccagctggactca

SEQ ID NO: 8511990 - DNA, 22 bp, Homo sapiens
ctggcaggtggaggttgcagtg

SEQ ID NO: 8511991 - DNA, 22 bp, Homo sapiens
ctggcaggtggatggggactcc

SEQ ID NO: 8511992 - DNA, 22 bp, Homo sapiens
ctggcaggtggatggggactcc

SEQ ID NO: 8511993 - DNA, 22 bp, Homo sapiens
ctggccagaagcacctttggcg

SEQ ID NO: 8511994 - DNA, 22 bp, Homo sapiens
ctggccagactacacatgtgtg

SEQ ID NO: 8511995 - DNA, 22 bp, Homo sapiens
ctggccagactacacatgtgtg

SEQ ID NO: 8511996 - DNA, 22 bp, Homo sapiens
ctggccagactacacatgtgtg

SEQ ID NO: 8511997 - DNA, 20 bp, Homo sapiens
ctggccagaacgcctacaca

SEQ ID NO: 8511998 - DNA, 22 bp, Homo sapiens
ctggccagaagcacctttggcg

SEQ ID NO: 8511999 - DNA, 20 bp, Homo sapiens
ctggccagaacgcctacaca

SEQ ID NO: 8512000 - DNA, 22 bp, Homo sapiens
ctggccctatgagcctcctgat

SEQ ID NO: 8512001 - DNA, 22 bp, Homo sapiens
ctggccctatgagcctcctgat

SEQ ID NO: 8512002 - DNA, 22 bp, Homo sapiens
ctggcccttctcttgcttcctg

SEQ ID NO: 8512003 - DNA, 22 bp, Homo sapiens
ctggccctatgagcctcctgat

SEQ ID NO: 8512004 - DNA, 22 bp, Homo sapiens
ctggccctatgagcctcctgat

SEQ ID NO: 8512005 - DNA, 22 bp, Homo sapiens
ctggcccttgacttacagcagg

SEQ ID NO: 8512006 - DNA, 22 bp, Homo sapiens
ctggcccttgacttacagcagg

SEQ ID NO: 8512007 - DNA, 22 bp, Homo sapiens
ctggcccttctcttgcttcctg

SEQ ID NO: 8512008 - DNA, 22 bp, Homo sapiens
ctggcccttctcttgcttcctg

SEQ ID NO: 8512009 - DNA, 22 bp, Homo sapiens
ctggccagactacacatgtgtg

SEQ ID NO: 8512010 - DNA, 22 bp, Homo sapiens
ctggccctaggcaaacacagat

SEQ ID NO: 8512011 - DNA, 22 bp, Homo sapiens
ctggccagaggttcctctgccc

SEQ ID NO: 8512012 - DNA, 22 bp, Homo sapiens
ctggccggtatttgcctctggg

SEQ ID NO: 8512013 - DNA, 22 bp, Homo sapiens
ctggcctaggaatggttttccg

SEQ ID NO: 8512014 - DNA, 22 bp, Homo sapiens
ctggcctaaaattgcttctgca

SEQ ID NO: 8512015 - DNA, 22 bp, Homo sapiens
ctggcctcacagaggctaagcc

SEQ ID NO: 8512016 - DNA, 22 bp, Homo sapiens
ctggcctcggcagcaggaacag

SEQ ID NO: 8512017 - DNA, 23 bp, Homo sapiens
ctggcctccgacactggccaaga

SEQ ID NO: 8512018 - DNA, 22 bp, Homo sapiens
ctggcctcatagccaagctgtg

SEQ ID NO: 8512019 - DNA, 22 bp, Homo sapiens
ctggcctcatagccaagctgtg

SEQ ID NO: 8512020 - DNA, 22 bp, Homo sapiens
ctggcctcacctcagacttact

SEQ ID NO: 8512021 - DNA, 22 bp, Homo sapiens
ctggcctcacctcagacttact

SEQ ID NO: 8512022 - DNA, 22 bp, Homo sapiens
ctggcctcagagggtcatggtg

SEQ ID NO: 8512023 - DNA, 22 bp, Homo sapiens
ctggcctcagagggtcatggtg

SEQ ID NO: 8512024 - DNA, 22 bp, Homo sapiens
ctggcctcagagggtcatggtg

SEQ ID NO: 8512025 - DNA, 22 bp, Homo sapiens
atacatgtcatcatatgtttgt

SEQ ID NO: 8512026 - DNA, 22 bp, Homo sapiens
atacatgtcatcatatgtttgt

SEQ ID NO: 8512027 - DNA, 22 bp, Homo sapiens
atacatgtcatcatatgtttgt

SEQ ID NO: 8512028 - DNA, 22 bp, Homo sapiens
atacatgtaactgcattgtaat

SEQ ID NO: 8512029 - DNA, 22 bp, Homo sapiens
atacatgtaactgcattgtaat

SEQ ID NO: 8512030 - DNA, 22 bp, Homo sapiens
atacatgtgggtctaaacatat

SEQ ID NO: 8512031 - DNA, 22 bp, Homo sapiens
atacatgtgggtctaaacatat

SEQ ID NO: 8512032 - DNA, 22 bp, Homo sapiens
atacatgtgctatgttggtgta

SEQ ID NO: 8512033 - DNA, 22 bp, Homo sapiens
atacatgtcatcatatgtttgt

SEQ ID NO: 8512034 - DNA, 22 bp, Homo sapiens
atacatgtgccatgttggtgta

SEQ ID NO: 8512035 - DNA, 22 bp, Homo sapiens
atacatgtgccgcgttggtgtg

SEQ ID NO: 8512036 - DNA, 22 bp, Homo sapiens
atacatgtgtgtgcatacatgt

SEQ ID NO: 8512037 - DNA, 22 bp, Homo sapiens
ctggcagcttattagaaatgca

SEQ ID NO: 8512038 - DNA, 22 bp, Homo sapiens
ctggcagcttagcactctggtt

SEQ ID NO: 8512039 - DNA, 22 bp, Homo sapiens
ctggcagcttagcactctggtt

SEQ ID NO: 8512040 - DNA, 22 bp, Homo sapiens
atacatgtgtccctgatttatt

SEQ ID NO: 8512041 - DNA, 22 bp, Homo sapiens
atacatgtgggtctaaacatat

SEQ ID NO: 8512042 - DNA, 22 bp, Homo sapiens
ctggcacaggatccgagacctt

SEQ ID NO: 8512043 - DNA, 22 bp, Homo sapiens
atacatgtaactgcattgtaat

SEQ ID NO: 8512044 - DNA, 22 bp, Homo sapiens
atacatgtaactgcattgtaat

SEQ ID NO: 8512045 - DNA, 22 bp, Homo sapiens
ctggcacacagcaggctctcag

SEQ ID NO: 8512046 - DNA, 22 bp, Homo sapiens
ctggcacaactccacctcagcg

SEQ ID NO: 8512047 - DNA, 22 bp, Homo sapiens
ctggcacaaaagaaaactgcca

SEQ ID NO: 8512048 - DNA, 22 bp, Homo sapiens
ctggcacagagtgagcattcaa

SEQ ID NO: 8512049 - DNA, 22 bp, Homo sapiens
ctggcacagagacagaaggatt

SEQ ID NO: 8512050 - DNA, 22 bp, Homo sapiens
ctggcacacagtaggcaccaat

SEQ ID NO: 8512051 - DNA, 20 bp, Homo sapiens
atacacatgcagacagatgc

SEQ ID NO: 8512052 - DNA, 20 bp, Homo sapiens
atacacatgcagacagatgc

SEQ ID NO: 8512053 - DNA, 22 bp, Homo sapiens
atacacatgtgtatgtgcatgc

SEQ ID NO: 8512054 - DNA, 20 bp, Homo sapiens
atacacatgcagacagatgc

SEQ ID NO: 8512055 - DNA, 22 bp, Homo sapiens
atacacatgtgtatgtgcatgc

SEQ ID NO: 8512056 - DNA, 22 bp, Homo sapiens
atacacatgtgtatgtgcatgc

SEQ ID NO: 8512057 - DNA, 22 bp, Homo sapiens
atacacatgtgtatgtgcatgc

SEQ ID NO: 8512058 - DNA, 22 bp, Homo sapiens
atacacatgttattgtggaagc

SEQ ID NO: 8512059 - DNA, 22 bp, Homo sapiens
atacacattactttctgtctga

SEQ ID NO: 8512060 - DNA, 20 bp, Homo sapiens
atacacattcatagaaaaat

SEQ ID NO: 8512061 - DNA, 22 bp, Homo sapiens
ctgtaatcccagctacctggga

SEQ ID NO: 8512062 - DNA, 22 bp, Homo sapiens
ctgtaatcccagctactcggga

SEQ ID NO: 8512063 - DNA, 22 bp, Homo sapiens
ctgtaatcccagctactcggga

SEQ ID NO: 8512064 - DNA, 22 bp, Homo sapiens
ctgtaatcccagctactcggga

SEQ ID NO: 8512065 - DNA, 22 bp, Homo sapiens
ctgtaatcccagctacctggga

SEQ ID NO: 8512066 - DNA, 22 bp, Homo sapiens
ctgtaacttagcatggttacta

SEQ ID NO: 8512067 - DNA, 20 bp, Homo sapiens
ctgtaactgtcccttttgcc

SEQ ID NO: 8512068 - DNA, 22 bp, Homo sapiens
ctgtaacttaatgagaggcaga

SEQ ID NO: 8512069 - DNA, 22 bp, Homo sapiens
ctgtaagatgggataagacttt

SEQ ID NO: 8512070 - DNA, 22 bp, Homo sapiens
ctgtaatcccagctacctggga

SEQ ID NO: 8512071 - DNA, 22 bp, Homo sapiens
ctgtaatcccagctacctggga

SEQ ID NO: 8512072 - DNA, 22 bp, Homo sapiens
ctgtaacagctgtcagagcagg

SEQ ID NO: 8512073 - DNA, 22 bp, Homo sapiens
ctgtaaatatgaagaatatatg

SEQ ID NO: 8512074 - DNA, 22 bp, Homo sapiens
ctgtaaatggaactatgtagta

SEQ ID NO: 8512075 - DNA, 22 bp, Homo sapiens
ctgtaactctgccaagaaggct

SEQ ID NO: 8512076 - DNA, 22 bp, Homo sapiens
atcagcaggtgctggtggagac

SEQ ID NO: 8512077 - DNA, 22 bp, Homo sapiens
atcagcaggtgctggtggagac

SEQ ID NO: 8512078 - DNA, 22 bp, Homo sapiens
atcagcagtgtctacctcggtg

SEQ ID NO: 8512079 - DNA, 22 bp, Homo sapiens
atcagcatctttaacaattacc

SEQ ID NO: 8512080 - DNA, 22 bp, Homo sapiens
atcagcattcccaaatgatgtg

SEQ ID NO: 8512081 - DNA, 22 bp, Homo sapiens
atcagcatcgggtggtggtggg

SEQ ID NO: 8512082 - DNA, 22 bp, Homo sapiens
atcagcatctttaacaattacc

SEQ ID NO: 8512083 - DNA, 22 bp, Homo sapiens
atcagctgaaaaacaggcagca

SEQ ID NO: 8512084 - DNA, 22 bp, Homo sapiens
atcagctcattttgatggaaat

SEQ ID NO: 8512085 - DNA, 22 bp, Homo sapiens
atcacaaaggtctcagagcaca

SEQ ID NO: 8512086 - DNA, 22 bp, Homo sapiens
atcacaaaggtctcagagcaca

SEQ ID NO: 8512087 - DNA, 22 bp, Homo sapiens
atcacaaaggtctcagagcaca

SEQ ID NO: 8512088 - DNA, 22 bp, Homo sapiens
atcaagaatgttcattcttcta

SEQ ID NO: 8512089 - DNA, 22 bp, Homo sapiens
atcaagaattgggagctattga

SEQ ID NO: 8512090 - DNA, 22 bp, Homo sapiens
atcacaaaggctgcttcatgat

SEQ ID NO: 8512091 - DNA, 22 bp, Homo sapiens
atcacaaaggctgcttcatgat

SEQ ID NO: 8512092 - DNA, 22 bp, Homo sapiens
atcacaaagggttttctctgag

SEQ ID NO: 8512093 - DNA, 22 bp, Homo sapiens
atcacaaaggtctcagagcaca

SEQ ID NO: 8512094 - DNA, 22 bp, Homo sapiens
atcacaatccctctctctgata

SEQ ID NO: 8512095 - DNA, 22 bp, Homo sapiens
atcacaatcttcaaatcgattc

SEQ ID NO: 8512096 - DNA, 22 bp, Homo sapiens
atcacaatcttcaaatcgattc

SEQ ID NO: 8512097 - DNA, 22 bp, Homo sapiens
atcacaatgtacgttaaaatgt

SEQ ID NO: 8512098 - DNA, 22 bp, Homo sapiens
atcacaatcttcaaatcgattc

SEQ ID NO: 8512099 - DNA, 22 bp, Homo sapiens
atcacaatgtacgttaaaatgt

SEQ ID NO: 8512100 - DNA, 22 bp, Homo sapiens
atcacaatgtacgttaaaatgt

SEQ ID NO: 8512101 - DNA, 22 bp, Homo sapiens
atcacactggacattggatact

SEQ ID NO: 8512102 - DNA, 22 bp, Homo sapiens
atcacactggacattggatact

SEQ ID NO: 8512103 - DNA, 22 bp, Homo sapiens
ctgtaaatggaactatgtagta

SEQ ID NO: 8512104 - DNA, 22 bp, Homo sapiens
ctgtaaatatgaagaatatatg

SEQ ID NO: 8512105 - DNA, 22 bp, Homo sapiens
ctgtaaataatgacagttgact

SEQ ID NO: 8512106 - DNA, 20 bp, Homo sapiens
ctgtaaactgcgtctgtaat

SEQ ID NO: 8512107 - DNA, 22 bp, Homo sapiens
atcacagcacacctgacatgta

SEQ ID NO: 8512108 - DNA, 22 bp, Homo sapiens
atcacactgttattttagttaa

SEQ ID NO: 8512109 - DNA, 22 bp, Homo sapiens
atcacacttttgtaaccatcag

SEQ ID NO: 8512110 - DNA, 22 bp, Homo sapiens
atcacagagattgcttttaaaa

SEQ ID NO: 8512111 - DNA, 19 bp, Homo sapiens
atcacagacgtgcctcatc

SEQ ID NO: 8512112 - DNA, 22 bp, Homo sapiens
atcacagattgtgaataactat

SEQ ID NO: 8512113 - DNA, 22 bp, Homo sapiens
atcacagagctcccttccactg

SEQ ID NO: 8512114 - DNA, 22 bp, Homo sapiens
atcacagagctcccttccactg

SEQ ID NO: 8512115 - DNA, 22 bp, Homo sapiens
atcagtttttattaatgtagct

SEQ ID NO: 8512116 - DNA, 22 bp, Homo sapiens
atcataaaattgcaccatttct

SEQ ID NO: 8512117 - DNA, 22 bp, Homo sapiens
atcagtttggtgctttcagtga

SEQ ID NO: 8512118 - DNA, 22 bp, Homo sapiens
atcagtttgtatatgaaacact

SEQ ID NO: 8512119 - DNA, 22 bp, Homo sapiens
atcagtttgtatatgaaacact

SEQ ID NO: 8512120 - DNA, 22 bp, Homo sapiens
atcagttttgggggacatactg

SEQ ID NO: 8512121 - DNA, 22 bp, Homo sapiens
atcagtttctaccatgtggaat

SEQ ID NO: 8512122 - DNA, 22 bp, Homo sapiens
atcagtttggaacattcaggcc

SEQ ID NO: 8512123 - DNA, 22 bp, Homo sapiens
atcagtttctgtgaagaacaca

SEQ ID NO: 8512124 - DNA, 22 bp, Homo sapiens
atcataaaccactttgtaatct

SEQ ID NO: 8512125 - DNA, 22 bp, Homo sapiens
atcataaaccactttgtaatct

SEQ ID NO: 8512126 - DNA, 22 bp, Homo sapiens
atcataaaattgcaccatttct

SEQ ID NO: 8512127 - DNA, 22 bp, Homo sapiens
atcataaaccactttgtaatct

SEQ ID NO: 8512128 - DNA, 22 bp, Homo sapiens
atcataaagtgctatctgattg

SEQ ID NO: 8512129 - DNA, 22 bp, Homo sapiens
atcataaaccactttgtaatct

SEQ ID NO: 8512130 - DNA, 22 bp, Homo sapiens
atcataaagtgctatctgattg

SEQ ID NO: 8512131 - DNA, 22 bp, Homo sapiens
atcataaagtgctatctgattg

SEQ ID NO: 8512132 - DNA, 22 bp, Homo sapiens
atcataaagtgctatctgattg

SEQ ID NO: 8512133 - DNA, 22 bp, Homo sapiens
atcataaagtgctatctgattg

SEQ ID NO: 8512134 - DNA, 22 bp, Homo sapiens
atcatacactcacataaacaga

SEQ ID NO: 8512135 - DNA, 22 bp, Homo sapiens
atcatacactcacataaacaga

SEQ ID NO: 8512136 - DNA, 22 bp, Homo sapiens
ctgtctccgccctcttggtagg

SEQ ID NO: 8512137 - DNA, 22 bp, Homo sapiens
ctgtctcctccactgcatggga

SEQ ID NO: 8512138 - DNA, 22 bp, Homo sapiens
ctgtctcctccactgcatggga

SEQ ID NO: 8512139 - DNA, 23 bp, Homo sapiens
ctgtctcctgggctaggtggaat

SEQ ID NO: 8512140 - DNA, 22 bp, Homo sapiens
atcaggtgaagtcactgagtgg

SEQ ID NO: 8512141 - DNA, 22 bp, Homo sapiens
atcaggtagatttaatattctg

SEQ ID NO: 8512142 - DNA, 22 bp, Homo sapiens
ctgtctctgtcttaactcccag

SEQ ID NO: 8512143 - DNA, 22 bp, Homo sapiens
ctgtctctctaggacactgggg

SEQ ID NO: 8512144 - DNA, 22 bp, Homo sapiens
ctgtctctctaggacactgggg

SEQ ID NO: 8512145 - DNA, 22 bp, Homo sapiens
ctgtctctgataagctcgaggg

SEQ ID NO: 8512146 - DNA, 23 bp, Homo sapiens
ctgtccttggtcttggctgagtg

SEQ ID NO: 8512147 - DNA, 22 bp, Homo sapiens
ctgtcgtgttcactgtggccta

SEQ ID NO: 8512148 - DNA, 22 bp, Homo sapiens
ctgtctcagcaggaagtcatca

SEQ ID NO: 8512149 - DNA, 22 bp, Homo sapiens
ctgtctcagcaggaagtcatca

SEQ ID NO: 8512150 - DNA, 22 bp, Homo sapiens
ctgtctccagggcaggtgcagg

SEQ ID NO: 8512151 - DNA, 22 bp, Homo sapiens
ctgtctccagggcaggtgcagg

SEQ ID NO: 8512152 - DNA, 22 bp, Homo sapiens
atcaggaaagaaaagcttggcg

SEQ ID NO: 8512153 - DNA, 19 bp, Homo sapiens
ctgtccttggctgcactgt

SEQ ID NO: 8512154 - DNA, 22 bp, Homo sapiens
atcagcttaattctcaacaggt

SEQ ID NO: 8512155 - DNA, 22 bp, Homo sapiens
atcagcttcataaagttggtca

SEQ ID NO: 8512156 - DNA, 22 bp, Homo sapiens
ctgggaggattcattgaggtga

SEQ ID NO: 8512157 - DNA, 22 bp, Homo sapiens
ctgggaggacaacttggagctc

SEQ ID NO: 8512158 - DNA, 22 bp, Homo sapiens
ctgggaggatacacaagatcag

SEQ ID NO: 8512159 - DNA, 22 bp, Homo sapiens
ctgggaggatacacaagatcag

SEQ ID NO: 8512160 - DNA, 22 bp, Homo sapiens
ctgggaggatacacaagatcag

SEQ ID NO: 8512161 - DNA, 22 bp, Homo sapiens
ctgggaggatacacaagatcag

SEQ ID NO: 8512162 - DNA, 22 bp, Homo sapiens
ctgggaggatacacaagatcag

SEQ ID NO: 8512163 - DNA, 22 bp, Homo sapiens
ctgggaggattcattgaggtga

SEQ ID NO: 8512164 - DNA, 22 bp, Homo sapiens
ctgggaggacaacttggagctc

SEQ ID NO: 8512165 - DNA, 22 bp, Homo sapiens
ctgggaggacaacttggagctc

SEQ ID NO: 8512166 - DNA, 22 bp, Homo sapiens
ctgggaggacaacttggagctc

SEQ ID NO: 8512167 - DNA, 22 bp, Homo sapiens
ctgggaggacaacttggagctc

SEQ ID NO: 8512168 - DNA, 22 bp, Homo sapiens
ctgggaggacaacttggagctc

SEQ ID NO: 8512169 - DNA, 22 bp, Homo sapiens
ctgggaggacaacttggagctc

SEQ ID NO: 8512170 - DNA, 22 bp, Homo sapiens
ctgggagcttgttaggaatgca

SEQ ID NO: 8512171 - DNA, 22 bp, Homo sapiens
ctgggagcttggagcctttggt

SEQ ID NO: 8512172 - DNA, 22 bp, Homo sapiens
ctgggagcttttagaaatgcag

SEQ ID NO: 8512173 - DNA, 22 bp, Homo sapiens
ctgggaggacaacttggagctc

SEQ ID NO: 8512174 - DNA, 22 bp, Homo sapiens
ctgggaggcggaggttgtagtg

SEQ ID NO: 8512175 - DNA, 22 bp, Homo sapiens
ctgggaggcggaggttgtagtg

SEQ ID NO: 8512176 - DNA, 22 bp, Homo sapiens
ctgggaggcggaggttgtagtg

SEQ ID NO: 8512177 - DNA, 22 bp, Homo sapiens
ctgggaggcggaggttgtagtg

SEQ ID NO: 8512178 - DNA, 22 bp, Homo sapiens
ctgggaggggtagccaatccta

SEQ ID NO: 8512179 - DNA, 22 bp, Homo sapiens
ctgggaggcggaggttgtagtg

SEQ ID NO: 8512180 - DNA, 20 bp, Homo sapiens
ctgggaggtcttccaaatca

SEQ ID NO: 8512181 - DNA, 20 bp, Homo sapiens
ctgggaggtcttccaaatca

SEQ ID NO: 8512182 - DNA, 20 bp, Homo sapiens
ctgggaggtcttccaaatca

SEQ ID NO: 8512183 - DNA, 22 bp, Homo sapiens
ctgggaggggtagccaatccta

SEQ ID NO: 8512184 - DNA, 22 bp, Homo sapiens
ctgggaggggtagccaatccta

SEQ ID NO: 8512185 - DNA, 22 bp, Homo sapiens
ctgggaggggtagccaatccta

SEQ ID NO: 8512186 - DNA, 22 bp, Homo sapiens
ctgggaggggtagccaatccta

SEQ ID NO: 8512187 - DNA, 22 bp, Homo sapiens
ctgggaggtggaggttgcattg

SEQ ID NO: 8512188 - DNA, 22 bp, Homo sapiens
ctgggaggtggaggttgcattg

SEQ ID NO: 8512189 - DNA, 19 bp, Homo sapiens
ctgggaggtgttcagagaa

SEQ ID NO: 8512190 - DNA, 22 bp, Homo sapiens
ctgggaggtggaggttgcattg

SEQ ID NO: 8512191 - DNA, 22 bp, Homo sapiens
ctgggaggtggaggttgcattg

SEQ ID NO: 8512192 - DNA, 22 bp, Homo sapiens
ctgggaggtgaacagaaaaact

SEQ ID NO: 8512193 - DNA, 22 bp, Homo sapiens
ctgggaggtgcagcaaaaatca

SEQ ID NO: 8512194 - DNA, 22 bp, Homo sapiens
ctgggaggtgcagcaaaaatca

SEQ ID NO: 8512195 - DNA, 22 bp, Homo sapiens
ctgggaggtgcagcaaaaatca

SEQ ID NO: 8512196 - DNA, 22 bp, Homo sapiens
ctgggaggtgaacagaaaaact

SEQ ID NO: 8512197 - DNA, 22 bp, Homo sapiens
ctgggaggtgaacagaaaaact

SEQ ID NO: 8512198 - DNA, 22 bp, Homo sapiens
ctgggaggtgaacagaaaaact

SEQ ID NO: 8512199 - DNA, 23 bp, Homo sapiens
ctggggctttcaaatctgggcag

SEQ ID NO: 8512200 - DNA, 23 bp, Homo sapiens
ctggggctttcaaatctgggcag

SEQ ID NO: 8512201 - DNA, 23 bp, Homo sapiens
ctggggctttcaaatctgggcag

SEQ ID NO: 8512202 - DNA, 22 bp, Homo sapiens
ctggggcttcaatgcttcggtg

SEQ ID NO: 8512203 - DNA, 22 bp, Homo sapiens
ctggggctgtgggagacaaggc

SEQ ID NO: 8512204 - DNA, 22 bp, Homo sapiens
ctggggctgtgggagacaaggc

SEQ ID NO: 8512205 - DNA, 22 bp, Homo sapiens
ctggggctgtaggaggacttat

SEQ ID NO: 8512206 - DNA, 22 bp, Homo sapiens
ctggggcttcaatgcttcggtg

SEQ ID NO: 8512207 - DNA, 19 bp, Homo sapiens
ctgggaggtgttcagagaa

SEQ ID NO: 8512208 - DNA, 19 bp, Homo sapiens
ctgggaggtgttcagagaa

SEQ ID NO: 8512209 - DNA, 22 bp, Homo sapiens
ctggggcatgggcccctagagg

SEQ ID NO: 8512210 - DNA, 22 bp, Homo sapiens
ctggggcatctgacagataaat

SEQ ID NO: 8512211 - DNA, 22 bp, Homo sapiens
ctggggctgtaggaggacttat

SEQ ID NO: 8512212 - DNA, 19 bp, Homo sapiens
ctggggctttggtactgcc

SEQ ID NO: 8512213 - DNA, 19 bp, Homo sapiens
ctggggctttggtactgcc

SEQ ID NO: 8512214 - DNA, 19 bp, Homo sapiens
ctggggctttggtactgcc

SEQ ID NO: 8512215 - DNA, 22 bp, Homo sapiens
ctgggggcaagcagacagctgt

SEQ ID NO: 8512216 - DNA, 22 bp, Homo sapiens
ctgggggcaagcagacagctgt

SEQ ID NO: 8512217 - DNA, 22 bp, Homo sapiens
ctgggggcaatggtcagagtgt

SEQ ID NO: 8512218 - DNA, 22 bp, Homo sapiens
ctgggggcaatggtcagagtgt

SEQ ID NO: 8512219 - DNA, 22 bp, Homo sapiens
atattattctagctcttgtgtg

SEQ ID NO: 8512220 - DNA, 22 bp, Homo sapiens
atattattctagtaacagtgat

SEQ ID NO: 8512221 - DNA, 22 bp, Homo sapiens
atattattctagtaacagtgat

SEQ ID NO: 8512222 - DNA, 22 bp, Homo sapiens
atattattctagtaacagtgat

SEQ ID NO: 8512223 - DNA, 22 bp, Homo sapiens
atattattctagctcttgtgtg

SEQ ID NO: 8512224 - DNA, 22 bp, Homo sapiens
ctggtccagtggatgctgaggg

SEQ ID NO: 8512225 - DNA, 22 bp, Homo sapiens
ctggtccagtggatgctgaggg

SEQ ID NO: 8512226 - DNA, 22 bp, Homo sapiens
ctggtccctggacctccctgga

SEQ ID NO: 8512227 - DNA, 22 bp, Homo sapiens
ctggtcctaaagccctactcca

SEQ ID NO: 8512228 - DNA, 22 bp, Homo sapiens
atcaagaacttattttggaaat

SEQ ID NO: 8512229 - DNA, 22 bp, Homo sapiens
atcaagaatgttcattcttcta

SEQ ID NO: 8512230 - DNA, 22 bp, Homo sapiens
atcaagaacttattttggaaat

SEQ ID NO: 8512231 - DNA, 22 bp, Homo sapiens
ctggtcagggctctttgggagc

SEQ ID NO: 8512232 - DNA, 18 bp, Homo sapiens
ctggtcagggcaatgggc

SEQ ID NO: 8512233 - DNA, 22 bp, Homo sapiens
ctggtcaggctgaactgccaca

SEQ ID NO: 8512234 - DNA, 22 bp, Homo sapiens
ctggtcaggaaggtggggacag

SEQ ID NO: 8512235 - DNA, 22 bp, Homo sapiens
ctggtcaggggatggggctcag

SEQ ID NO: 8512236 - DNA, 22 bp, Homo sapiens
ctgggtggcgtctggggccagt

SEQ ID NO: 8512237 - DNA, 22 bp, Homo sapiens
ctgggtggcgtctggggccagt

SEQ ID NO: 8512238 - DNA, 22 bp, Homo sapiens
ctgggtggctgtccagccagcc

SEQ ID NO: 8512239 - DNA, 22 bp, Homo sapiens
ctgggtggctgtccagccagcc

SEQ ID NO: 8512240 - DNA, 22 bp, Homo sapiens
ctgggtggctgtccagccagcc

SEQ ID NO: 8512241 - DNA, 18 bp, Homo sapiens
atattcaagaagacagag

SEQ ID NO: 8512242 - DNA, 22 bp, Homo sapiens
atattcaaattacatttactaa

SEQ ID NO: 8512243 - DNA, 22 bp, Homo sapiens
atattattttccctggagttgt

SEQ ID NO: 8512244 - DNA, 22 bp, Homo sapiens
atattattttccctggagttgt

SEQ ID NO: 8512245 - DNA, 18 bp, Homo sapiens
ctgggtctccaggctgcc

SEQ ID NO: 8512246 - DNA, 22 bp, Homo sapiens
atattcactgagcataaagcca

SEQ ID NO: 8512247 - DNA, 18 bp, Homo sapiens
atattcaagaagacagag

SEQ ID NO: 8512248 - DNA, 18 bp, Homo sapiens
atattcaagaagacagag

SEQ ID NO: 8512249 - DNA, 20 bp, Homo sapiens
ctgggtggcaagcaaggggg

SEQ ID NO: 8512250 - DNA, 20 bp, Homo sapiens
ctgggtggcaagcaaggggg

SEQ ID NO: 8512251 - DNA, 22 bp, Homo sapiens
ctgggtggcagagcctgcagtg

SEQ ID NO: 8512252 - DNA, 22 bp, Homo sapiens
ctgggtggcagagcctgcagtg

SEQ ID NO: 8512253 - DNA, 22 bp, Homo sapiens
ctgggtggcagagcctgcagtg

SEQ ID NO: 8512254 - DNA, 22 bp, Homo sapiens
ctgggtggcagagcctgcagtg

SEQ ID NO: 8512255 - DNA, 22 bp, Homo sapiens
ctgggtggcagagcctgcagtg

SEQ ID NO: 8512256 - DNA, 22 bp, Homo sapiens
ctgggtggcagagcctgcagtg

SEQ ID NO: 8512257 - DNA, 20 bp, Homo sapiens
ctgggtggcaagcaaggggg

SEQ ID NO: 8512258 - DNA, 22 bp, Homo sapiens
ctgggtggatcgcagccccagg

SEQ ID NO: 8512259 - DNA, 22 bp, Homo sapiens
ctgggtggatcgcagccccagg

SEQ ID NO: 8512260 - DNA, 18 bp, Homo sapiens
ctgggtctccaggctgcc

SEQ ID NO: 8512261 - DNA, 22 bp, Homo sapiens
ctgggtggagcctggtcatctg

SEQ ID NO: 8512262 - DNA, 22 bp, Homo sapiens
cttctgtgcttcacagttgcca

SEQ ID NO: 8512263 - DNA, 22 bp, Homo sapiens
cttctgtgcaattgtggaggag

SEQ ID NO: 8512264 - DNA, 22 bp, Homo sapiens
cttctgtgcaattgtggaggag

SEQ ID NO: 8512265 - DNA, 22 bp, Homo sapiens
cttctgtgcgcctctattccct

SEQ ID NO: 8512266 - DNA, 22 bp, Homo sapiens
cttctgcccctgtagcctgagt

SEQ ID NO: 8512267 - DNA, 22 bp, Homo sapiens
cttctgcccctgtagcctgagt

SEQ ID NO: 8512268 - DNA, 22 bp, Homo sapiens
cttctgtgatttggttaggata

SEQ ID NO: 8512269 - DNA, 22 bp, Homo sapiens
cttctgtgatttggttaggata

SEQ ID NO: 8512270 - DNA, 22 bp, Homo sapiens
cttctgtgcttcacagttgcca

SEQ ID NO: 8512271 - DNA, 22 bp, Homo sapiens
cttctgtggtaaactttgttgt

SEQ ID NO: 8512272 - DNA, 22 bp, Homo sapiens
cttctgtggtaaactttgttgt

SEQ ID NO: 8512273 - DNA, 22 bp, Homo sapiens
cttctgtggatgttggatgcat

SEQ ID NO: 8512274 - DNA, 22 bp, Homo sapiens
cttctgtggatgttggatgcat

SEQ ID NO: 8512275 - DNA, 22 bp, Homo sapiens
cttctgtgttaaatgagtcttt

SEQ ID NO: 8512276 - DNA, 22 bp, Homo sapiens
cttctgtgtagaaaggtagccc

SEQ ID NO: 8512277 - DNA, 22 bp, Homo sapiens
cttctgtgttttactatatgta

SEQ ID NO: 8512278 - DNA, 22 bp, Homo sapiens
cttctgtgttttactatatgta

SEQ ID NO: 8512279 - DNA, 22 bp, Homo sapiens
cttctgttactgttagctgaag

SEQ ID NO: 8512280 - DNA, 22 bp, Homo sapiens
cttctgagatgttgttttacag

SEQ ID NO: 8512281 - DNA, 22 bp, Homo sapiens
cttctgagatgttgttttacag

SEQ ID NO: 8512282 - DNA, 22 bp, Homo sapiens
cttctgagatgttgttttacag

SEQ ID NO: 8512283 - DNA, 22 bp, Homo sapiens
cttctgagatgttgttttacag

SEQ ID NO: 8512284 - DNA, 22 bp, Homo sapiens
cttctgaggactctaaagagga

SEQ ID NO: 8512285 - DNA, 22 bp, Homo sapiens
cttctgagggcctttgcttcca

SEQ ID NO: 8512286 - DNA, 22 bp, Homo sapiens
cttctgattagcaagtttgtat

SEQ ID NO: 8512287 - DNA, 22 bp, Homo sapiens
cttctgcaataagttttggtcc

SEQ ID NO: 8512288 - DNA, 23 bp, Homo sapiens
atctctctggtggtcacagtcag

SEQ ID NO: 8512289 - DNA, 23 bp, Homo sapiens
atctctctggtggtcacagtcag

SEQ ID NO: 8512290 - DNA, 23 bp, Homo sapiens
atctctctggtggtcacagtcag

SEQ ID NO: 8512291 - DNA, 15 bp, Homo sapiens
atctctctagctgct

SEQ ID NO: 8512292 - DNA, 22 bp, Homo sapiens
atctctctatgcactgaggact

SEQ ID NO: 8512293 - DNA, 22 bp, Homo sapiens
atctctctatgcactgaggact

SEQ ID NO: 8512294 - DNA, 22 bp, Homo sapiens
atctctctgcccaggggctgtg

SEQ ID NO: 8512295 - DNA, 17 bp, Homo sapiens
atctctctaaggcaggc

SEQ ID NO: 8512296 - DNA, 22 bp, Homo sapiens
atctctccttcagctgaggccc

SEQ ID NO: 8512297 - DNA, 23 bp, Homo sapiens
atctctctttattcttggggata

SEQ ID NO: 8512298 - DNA, 22 bp, Homo sapiens
atctctgatttacagcatctct

SEQ ID NO: 8512299 - DNA, 22 bp, Homo sapiens
atctctgatttacagcatctct

SEQ ID NO: 8512300 - DNA, 22 bp, Homo sapiens
atctccgccatcgcgaacgcct

SEQ ID NO: 8512301 - DNA, 22 bp, Homo sapiens
atctctaatttaaaaagtaaca

SEQ ID NO: 8512302 - DNA, 22 bp, Homo sapiens
atctcgttttgagaactgtgtt

SEQ ID NO: 8512303 - DNA, 22 bp, Homo sapiens
cttccttgtggtccttctcatt

SEQ ID NO: 8512304 - DNA, 22 bp, Homo sapiens
cttccttggcttctggggtgtg

SEQ ID NO: 8512305 - DNA, 22 bp, Homo sapiens
cttccttgtggtccttctcatt

SEQ ID NO: 8512306 - DNA, 22 bp, Homo sapiens
atctccccgagcttacctcctg

SEQ ID NO: 8512307 - DNA, 22 bp, Homo sapiens
atctgtgtatgaaagtataact

SEQ ID NO: 8512308 - DNA, 22 bp, Homo sapiens
atctgtgtatgaaagtataact

SEQ ID NO: 8512309 - DNA, 22 bp, Homo sapiens
atctgtggctggtgagaggcag

SEQ ID NO: 8512310 - DNA, 22 bp, Homo sapiens
atctgtggcgcaaacaaaggct

SEQ ID NO: 8512311 - DNA, 22 bp, Homo sapiens
atctgtgtccttataagagaca

SEQ ID NO: 8512312 - DNA, 22 bp, Homo sapiens
atctgtgtatgtgaccttatct

SEQ ID NO: 8512313 - DNA, 23 bp, Homo sapiens
atctgtgtgtgggtagggatgat

SEQ ID NO: 8512314 - DNA, 22 bp, Homo sapiens
atctgtgtgttattgtttatca

SEQ ID NO: 8512315 - DNA, 23 bp, Homo sapiens
atctgtgtgtgggtagggatgat

SEQ ID NO: 8512316 - DNA, 23 bp, Homo sapiens
atctgttcatctgacacagattc

SEQ ID NO: 8512317 - DNA, 22 bp, Homo sapiens
atctgttattgaataggtgcta

SEQ ID NO: 8512318 - DNA, 22 bp, Homo sapiens
atctgttatttacccatctctg

SEQ ID NO: 8512319 - DNA, 22 bp, Homo sapiens
atctgttcccctatgctctcta

SEQ ID NO: 8512320 - DNA, 22 bp, Homo sapiens
atctgttatttacccatctctg

SEQ ID NO: 8512321 - DNA, 22 bp, Homo sapiens
atctgtgtgttcaggaagtcct

SEQ ID NO: 8512322 - DNA, 22 bp, Homo sapiens
atctgttaacaaagaagacagc

SEQ ID NO: 8512323 - DNA, 22 bp, Homo sapiens
atctgttaacaaagaagacagc

SEQ ID NO: 8512324 - DNA, 22 bp, Homo sapiens
atctgtgtgttgagttctcagc

SEQ ID NO: 8512325 - DNA, 22 bp, Homo sapiens
atcttatttaacacagcaaaac

SEQ ID NO: 8512326 - DNA, 22 bp, Homo sapiens
atcttatttaacacagcaaaac

SEQ ID NO: 8512327 - DNA, 22 bp, Homo sapiens
atctgttcccctatgctctcta

SEQ ID NO: 8512328 - DNA, 22 bp, Homo sapiens
atctgtgatcaagacagacagt

SEQ ID NO: 8512329 - DNA, 22 bp, Homo sapiens
atctgtcttttattcatgagct

SEQ ID NO: 8512330 - DNA, 22 bp, Homo sapiens
atctgtcttccaccacacatcc

SEQ ID NO: 8512331 - DNA, 22 bp, Homo sapiens
atctgtcttccaccacacatcc

SEQ ID NO: 8512332 - DNA, 22 bp, Homo sapiens
atctgtcttgccttgcatattt

SEQ ID NO: 8512333 - DNA, 22 bp, Homo sapiens
atctgtcttccaccacacatcc

SEQ ID NO: 8512334 - DNA, 22 bp, Homo sapiens
atctgtcttgccttgcatattt

SEQ ID NO: 8512335 - DNA, 22 bp, Homo sapiens
atctgtcttgccttgcatattt

SEQ ID NO: 8512336 - DNA, 22 bp, Homo sapiens
atctgtctatgatatagtctgt

SEQ ID NO: 8512337 - DNA, 22 bp, Homo sapiens
atctgtctatgatatagtctgt

SEQ ID NO: 8512338 - DNA, 22 bp, Homo sapiens
atctgtctatgtggctatgtat

SEQ ID NO: 8512339 - DNA, 22 bp, Homo sapiens
atctgtctgggtgcagcagtcc

SEQ ID NO: 8512340 - DNA, 22 bp, Homo sapiens
atctgtctatgatatagtctgt

SEQ ID NO: 8512341 - DNA, 22 bp, Homo sapiens
atctgtcctgtgacagtgggag

SEQ ID NO: 8512342 - DNA, 22 bp, Homo sapiens
atctggttcttcttaggcatca

SEQ ID NO: 8512343 - DNA, 22 bp, Homo sapiens
atctgggtttcaaagaagcctt

SEQ ID NO: 8512344 - DNA, 22 bp, Homo sapiens
atctggctctctcatttacaaa

SEQ ID NO: 8512345 - DNA, 22 bp, Homo sapiens
atctggctcctacacttgaaga

SEQ ID NO: 8512346 - DNA, 22 bp, Homo sapiens
cttcttaaagattacacaatga

SEQ ID NO: 8512347 - DNA, 22 bp, Homo sapiens
cttctgttactgttagctgaag

SEQ ID NO: 8512348 - DNA, 22 bp, Homo sapiens
cttctgtgttttactatatgta

SEQ ID NO: 8512349 - DNA, 22 bp, Homo sapiens
cttctgttactgttagctgaag

SEQ ID NO: 8512350 - DNA, 22 bp, Homo sapiens
cttcttaaagttgtcacagctg

SEQ ID NO: 8512351 - DNA, 22 bp, Homo sapiens
cttcttaactgtatatactatg

SEQ ID NO: 8512352 - DNA, 22 bp, Homo sapiens
cttcttaatcccttatatattt

SEQ ID NO: 8512353 - DNA, 22 bp, Homo sapiens
cttcttaatcccttatatattt

SEQ ID NO: 8512354 - DNA, 22 bp, Homo sapiens
cttcttaactgtatatactatg

SEQ ID NO: 8512355 - DNA, 22 bp, Homo sapiens
cttcttaaattggattgctatt

SEQ ID NO: 8512356 - DNA, 22 bp, Homo sapiens
atctgtaactgctatcatctcc

SEQ ID NO: 8512357 - DNA, 22 bp, Homo sapiens
atctgtaattttgaatgcaaat

SEQ ID NO: 8512358 - DNA, 22 bp, Homo sapiens
atctgtcaagatagactctgca

SEQ ID NO: 8512359 - DNA, 22 bp, Homo sapiens
atctgtcaggagcaaggactac

SEQ ID NO: 8512360 - DNA, 22 bp, Homo sapiens
atctgtccctcctcacagcctc

SEQ ID NO: 8512361 - DNA, 22 bp, Homo sapiens
atctgtcaggagcaaggactac

SEQ ID NO: 8512362 - DNA, 22 bp, Homo sapiens
atctgtaacatcagtagcagaa

SEQ ID NO: 8512363 - DNA, 22 bp, Homo sapiens
atctgtaaatgcaaatgtagct

SEQ ID NO: 8512364 - DNA, 22 bp, Homo sapiens
atctggttcttcttaggcatca

SEQ ID NO: 8512365 - DNA, 22 bp, Homo sapiens
atctggtttggggatccttgtg

SEQ ID NO: 8512366 - DNA, 22 bp, Homo sapiens
atctgtaaagataatcatatgt

SEQ ID NO: 8512367 - DNA, 22 bp, Homo sapiens
cttattcagcaagtttgggtac

SEQ ID NO: 8512368 - DNA, 22 bp, Homo sapiens
cttattcagcaagtttgggtac

SEQ ID NO: 8512369 - DNA, 22 bp, Homo sapiens
cttattcagatacagactcttg

SEQ ID NO: 8512370 - DNA, 22 bp, Homo sapiens
cttattcagatacagactcttg

SEQ ID NO: 8512371 - DNA, 22 bp, Homo sapiens
cttattcagatacagactcttg

SEQ ID NO: 8512372 - DNA, 22 bp, Homo sapiens
cttattcataagtcagacacac

SEQ ID NO: 8512373 - DNA, 22 bp, Homo sapiens
cttattcagcacttgctctgta

SEQ ID NO: 8512374 - DNA, 22 bp, Homo sapiens
cttattcagcacttgctctgta

SEQ ID NO: 8512375 - DNA, 22 bp, Homo sapiens
cttattcagcacttgctctgta

SEQ ID NO: 8512376 - DNA, 22 bp, Homo sapiens
cttattcagaaggagaaatgga

SEQ ID NO: 8512377 - DNA, 22 bp, Homo sapiens
cttattcagaaggagaaatgga

SEQ ID NO: 8512378 - DNA, 22 bp, Homo sapiens
cttattcagaccttggattctt

SEQ ID NO: 8512379 - DNA, 22 bp, Homo sapiens
cttattcagaccttggattctt

SEQ ID NO: 8512380 - DNA, 21 bp, Homo sapiens
cttattcactgttatttatca

SEQ ID NO: 8512381 - DNA, 21 bp, Homo sapiens
cttattcactgttatttatca

SEQ ID NO: 8512382 - DNA, 22 bp, Homo sapiens
cttattcagaaggagaaatgga

SEQ ID NO: 8512383 - DNA, 22 bp, Homo sapiens
cttattcatatattctcggtag

SEQ ID NO: 8512384 - DNA, 22 bp, Homo sapiens
cttattcatatattctcggtag

SEQ ID NO: 8512385 - DNA, 22 bp, Homo sapiens
cttattcataagtcagacacac

SEQ ID NO: 8512386 - DNA, 23 bp, Homo sapiens
cttattcattcatgtagcccatt

SEQ ID NO: 8512387 - DNA, 22 bp, Homo sapiens
cttcaaatgtgattttaataac

SEQ ID NO: 8512388 - DNA, 22 bp, Homo sapiens
cttcaacttccctagatgtcat

SEQ ID NO: 8512389 - DNA, 22 bp, Homo sapiens
cttatgtacacacatatattgt

SEQ ID NO: 8512390 - DNA, 22 bp, Homo sapiens
cttatgtatatttggaacgtac

SEQ ID NO: 8512391 - DNA, 22 bp, Homo sapiens
cttatgtataatgttccacata

SEQ ID NO: 8512392 - DNA, 22 bp, Homo sapiens
cttatgtaaactacagataata

SEQ ID NO: 8512393 - DNA, 22 bp, Homo sapiens
cttatgtaaaacggaaagggaa

SEQ ID NO: 8512394 - DNA, 22 bp, Homo sapiens
cttatgctgagaatgaaagaat

SEQ ID NO: 8512395 - DNA, 22 bp, Homo sapiens
cttatggaagaaacctcagaga

SEQ ID NO: 8512396 - DNA, 22 bp, Homo sapiens
cttattcaatgctggaaatgtt

SEQ ID NO: 8512397 - DNA, 22 bp, Homo sapiens
cttattcaatgctggaaatgtt

SEQ ID NO: 8512398 - DNA, 22 bp, Homo sapiens
cttattataaaatcctgtttga

SEQ ID NO: 8512399 - DNA, 22 bp, Homo sapiens
cttattataaaatcctgtttga

SEQ ID NO: 8512400 - DNA, 22 bp, Homo sapiens
cttattaatggaatcctaatga

SEQ ID NO: 8512401 - DNA, 22 bp, Homo sapiens
cttattaatggaatcctaatga

SEQ ID NO: 8512402 - DNA, 22 bp, Homo sapiens
cttatgtatgctactttgtggt

SEQ ID NO: 8512403 - DNA, 22 bp, Homo sapiens
cttccttccttccccgaaatgc

SEQ ID NO: 8512404 - DNA, 22 bp, Homo sapiens
cttccttctgaagcatagaagc

SEQ ID NO: 8512405 - DNA, 22 bp, Homo sapiens
cttcctctatgttcaggtagaa

SEQ ID NO: 8512406 - DNA, 22 bp, Homo sapiens
cttcctctatgttcaggtagaa

SEQ ID NO: 8512407 - DNA, 22 bp, Homo sapiens
cttcctctcaataagatgagaa

SEQ ID NO: 8512408 - DNA, 22 bp, Homo sapiens
cttcctctcaataagatgagaa

SEQ ID NO: 8512409 - DNA, 22 bp, Homo sapiens
cttcctctcttgcccataagag

SEQ ID NO: 8512410 - DNA, 22 bp, Homo sapiens
cttcctctcttgcccataagag

SEQ ID NO: 8512411 - DNA, 22 bp, Homo sapiens
cttccttgcggcccctgcctag

SEQ ID NO: 8512412 - DNA, 19 bp, Homo sapiens
cttccttgctccccatgtg

SEQ ID NO: 8512413 - DNA, 22 bp, Homo sapiens
cttccttgctgtctgctccagg

SEQ ID NO: 8512414 - DNA, 22 bp, Homo sapiens
cttcaattgccaccagctagca

SEQ ID NO: 8512415 - DNA, 22 bp, Homo sapiens
cttcaataggaactgcatggca

SEQ ID NO: 8512416 - DNA, 22 bp, Homo sapiens
cttcaatacctgcgttgctagt

SEQ ID NO: 8512417 - DNA, 22 bp, Homo sapiens
cttcacaaatggcctagagttc

SEQ ID NO: 8512418 - DNA, 22 bp, Homo sapiens
cttcacaaaatatttcattata

SEQ ID NO: 8512419 - DNA, 22 bp, Homo sapiens
cttcacaaagctctctttatgt

SEQ ID NO: 8512420 - DNA, 22 bp, Homo sapiens
cttcaagatatttctagaatca

SEQ ID NO: 8512421 - DNA, 22 bp, Homo sapiens
cttcaagatatttctagaatca

SEQ ID NO: 8512422 - DNA, 22 bp, Homo sapiens
cttcaagatccatagatattgc

SEQ ID NO: 8512423 - DNA, 22 bp, Homo sapiens
cttcaagagaatgcagggatgt

SEQ ID NO: 8512424 - DNA, 22 bp, Homo sapiens
cttcaagagaatgcagggatgt

SEQ ID NO: 8512425 - DNA, 22 bp, Homo sapiens
cttaagaatattgaagttgtgg

SEQ ID NO: 8512426 - DNA, 22 bp, Homo sapiens
cttaagagtctttctgtgttta

SEQ ID NO: 8512427 - DNA, 22 bp, Homo sapiens
cttaagaagcaagtctcagcaa

SEQ ID NO: 8512428 - DNA, 22 bp, Homo sapiens
cttaagatttgagatacctaat

SEQ ID NO: 8512429 - DNA, 22 bp, Homo sapiens
cttaagattgtcagcttcagcc

SEQ ID NO: 8512430 - DNA, 22 bp, Homo sapiens
cttaagatgaggtcatgctata

SEQ ID NO: 8512431 - DNA, 22 bp, Homo sapiens
cttaagatttgcgatacctaat

SEQ ID NO: 8512432 - DNA, 22 bp, Homo sapiens
cttaaggaaaagtctcttttaa

SEQ ID NO: 8512433 - DNA, 22 bp, Homo sapiens
cttaacttgatgtctctctgct

SEQ ID NO: 8512434 - DNA, 22 bp, Homo sapiens
cttaactctacactgcacttta

SEQ ID NO: 8512435 - DNA, 22 bp, Homo sapiens
cttaaccagaaaatgcacttgt

SEQ ID NO: 8512436 - DNA, 21 bp, Homo sapiens
cttaacattttaaatgaaagg

SEQ ID NO: 8512437 - DNA, 22 bp, Homo sapiens
cttaacatggggggtaagtctg

SEQ ID NO: 8512438 - DNA, 22 bp, Homo sapiens
cttaacatcctgcatttttctt

SEQ ID NO: 8512439 - DNA, 22 bp, Homo sapiens
cttaacatcctgcatttttctt

SEQ ID NO: 8512440 - DNA, 22 bp, Homo sapiens
cttaacagcaagatctgtgtca

SEQ ID NO: 8512441 - DNA, 22 bp, Homo sapiens
cttaacagatacatctgtggtt

SEQ ID NO: 8512442 - DNA, 22 bp, Homo sapiens
cttaacagagagaagtgttgct

SEQ ID NO: 8512443 - DNA, 22 bp, Homo sapiens
cttaacagcaagatctgtgtca

SEQ ID NO: 8512444 - DNA, 22 bp, Homo sapiens
cttaacagatacatctgtggtt

SEQ ID NO: 8512445 - DNA, 22 bp, Homo sapiens
cttaacagagagaagtgttgct

SEQ ID NO: 8512446 - DNA, 22 bp, Homo sapiens
cttaacaagcccaactttcatt

SEQ ID NO: 8512447 - DNA, 22 bp, Homo sapiens
atcataggtgtgttaccagtta

SEQ ID NO: 8512448 - DNA, 22 bp, Homo sapiens
atcataggtataagtaaattag

SEQ ID NO: 8512449 - DNA, 22 bp, Homo sapiens
atcatacagcctttgttagtgt

SEQ ID NO: 8512450 - DNA, 22 bp, Homo sapiens
atcatacagcctttgttagtgt

SEQ ID NO: 8512451 - DNA, 22 bp, Homo sapiens
atcatacagcctttgttagtgt

SEQ ID NO: 8512452 - DNA, 22 bp, Homo sapiens
atcatagaacacctacctacct

SEQ ID NO: 8512453 - DNA, 22 bp, Homo sapiens
atcatagaacacctacctacct

SEQ ID NO: 8512454 - DNA, 22 bp, Homo sapiens
atccatcccatcttcaccaggg

SEQ ID NO: 8512455 - DNA, 21 bp, Homo sapiens
atccatccatcttggcctaac

SEQ ID NO: 8512456 - DNA, 21 bp, Homo sapiens
atccatccatcttggcctaac

SEQ ID NO: 8512457 - DNA, 20 bp, Homo sapiens
atccatgagagtctggattc

SEQ ID NO: 8512458 - DNA, 22 bp, Homo sapiens
atccatgaaggtacttctcagg

SEQ ID NO: 8512459 - DNA, 22 bp, Homo sapiens
atccatcttgatgtaatagcca

SEQ ID NO: 8512460 - DNA, 22 bp, Homo sapiens
atccatctttcctgctgaactg

SEQ ID NO: 8512461 - DNA, 22 bp, Homo sapiens
atccatctttcctgctgaactg

SEQ ID NO: 8512462 - DNA, 22 bp, Homo sapiens
cttaatctcacctgcaaagtcc

SEQ ID NO: 8512463 - DNA, 22 bp, Homo sapiens
cttaatctcacctgcaaagtcc

SEQ ID NO: 8512464 - DNA, 22 bp, Homo sapiens
atccatttgacataatttcagc

SEQ ID NO: 8512465 - DNA, 22 bp, Homo sapiens
atccatttctatcttgctgagg

SEQ ID NO: 8512466 - DNA, 22 bp, Homo sapiens
cttagatgaagtcacagaaccc

SEQ ID NO: 8512467 - DNA, 22 bp, Homo sapiens
cttagcaagaatcagctgctgg

SEQ ID NO: 8512468 - DNA, 22 bp, Homo sapiens
cttatctgtaaaatggatacaa

SEQ ID NO: 8512469 - DNA, 18 bp, Homo sapiens
atccatttaatgcctgga

SEQ ID NO: 8512470 - DNA, 21 bp, Homo sapiens
atccattctccggttaatgag

SEQ ID NO: 8512471 - DNA, 22 bp, Homo sapiens
atccattctatgtgaaatgtcc

SEQ ID NO: 8512472 - DNA, 23 bp, Homo sapiens
atccatgtgagaatagactagca

SEQ ID NO: 8512473 - DNA, 22 bp, Homo sapiens
atccatgattagtaggataaag

SEQ ID NO: 8512474 - DNA, 22 bp, Homo sapiens
atccatgattgcccagaggtgt

SEQ ID NO: 8512475 - DNA, 23 bp, Homo sapiens
atccatgcttaagtaatcatttg

SEQ ID NO: 8512476 - DNA, 22 bp, Homo sapiens
atccatgattgcccagaggtgt

SEQ ID NO: 8512477 - DNA, 21 bp, Homo sapiens
ctattggaaaagaaaatattt

SEQ ID NO: 8512478 - DNA, 22 bp, Homo sapiens
ctattgaaagtgtacaattcaa

SEQ ID NO: 8512479 - DNA, 22 bp, Homo sapiens
ctattgaaagtgtacaattcaa

SEQ ID NO: 8512480 - DNA, 22 bp, Homo sapiens
ctattgaatagcccaaatcatt

SEQ ID NO: 8512481 - DNA, 22 bp, Homo sapiens
ctattgaatagcccaaatcatt

SEQ ID NO: 8512482 - DNA, 22 bp, Homo sapiens
ctattgaattaactattaaagt

SEQ ID NO: 8512483 - DNA, 22 bp, Homo sapiens
ctattgaattaactattaaagt

SEQ ID NO: 8512484 - DNA, 22 bp, Homo sapiens
ctatttatctatttctgaatga

SEQ ID NO: 8512485 - DNA, 22 bp, Homo sapiens
ctatttatctatttctgaatga

SEQ ID NO: 8512486 - DNA, 22 bp, Homo sapiens
agtcctgggtccagcaggtcct

SEQ ID NO: 8512487 - DNA, 22 bp, Homo sapiens
ctatcttttgttcattttgagt

SEQ ID NO: 8512488 - DNA, 22 bp, Homo sapiens
ctatctttcgattctagcttaa

SEQ ID NO: 8512489 - DNA, 18 bp, Homo sapiens
ctatccctggagcttggg

SEQ ID NO: 8512490 - DNA, 22 bp, Homo sapiens
ctatccattaaagccttggaaa

SEQ ID NO: 8512491 - DNA, 22 bp, Homo sapiens
ctatgaaaggatttggagttgt

SEQ ID NO: 8512492 - DNA, 22 bp, Homo sapiens
ctatgaccccagcatgaataag

SEQ ID NO: 8512493 - DNA, 22 bp, Homo sapiens
ctattctgtgtatttactggct

SEQ ID NO: 8512494 - DNA, 22 bp, Homo sapiens
ctattctagattacagtataaa

SEQ ID NO: 8512495 - DNA, 22 bp, Homo sapiens
agtcagcagcctggccaggaga

SEQ ID NO: 8512496 - DNA, 22 bp, Homo sapiens
agtcagcagcctggccaggaga

SEQ ID NO: 8512497 - DNA, 22 bp, Homo sapiens
agtcagctacaagttcattcac

SEQ ID NO: 8512498 - DNA, 22 bp, Homo sapiens
agtcaggaagctggagctgggg

SEQ ID NO: 8512499 - DNA, 22 bp, Homo sapiens
agtcagcttggctcctcccatg

SEQ ID NO: 8512500 - DNA, 22 bp, Homo sapiens
agtcaggagctgctgcattgta

SEQ ID NO: 8512501 - DNA, 22 bp, Homo sapiens
agtcaggagatattttgatatg

SEQ ID NO: 8512502 - DNA, 22 bp, Homo sapiens
agtcaggacacagcatgaacat

SEQ ID NO: 8512503 - DNA, 22 bp, Homo sapiens
ctatatttcttggctttaaaca

SEQ ID NO: 8512504 - DNA, 22 bp, Homo sapiens
ctatccatatcctgggcatggc

SEQ ID NO: 8512505 - DNA, 22 bp, Homo sapiens
ctatcaaacagccattaatata

SEQ ID NO: 8512506 - DNA, 22 bp, Homo sapiens
ctatcaaacagccattaatata

SEQ ID NO: 8512507 - DNA, 22 bp, Homo sapiens
ctatatttggtgagggatgtct

SEQ ID NO: 8512508 - DNA, 22 bp, Homo sapiens
ctatattctggaatgtccattt

SEQ ID NO: 8512509 - DNA, 22 bp, Homo sapiens
ctatatttcttggctttaaaca

SEQ ID NO: 8512510 - DNA, 22 bp, Homo sapiens
ctatatctacatttgctgtttg

SEQ ID NO: 8512511 - DNA, 22 bp, Homo sapiens
agtcaggatttaaactcagaca

SEQ ID NO: 8512512 - DNA, 22 bp, Homo sapiens
agtcaggatttaaactcagaca

SEQ ID NO: 8512513 - DNA, 22 bp, Homo sapiens
ctagtgaaatttgcaagtaatt

SEQ ID NO: 8512514 - DNA, 22 bp, Homo sapiens
ctagtctgtgtgggaccagggc

SEQ ID NO: 8512515 - DNA, 20 bp, Homo sapiens
agtcacatgcatacacaagt

SEQ ID NO: 8512516 - DNA, 22 bp, Homo sapiens
agtcacatgagtttctctttat

SEQ ID NO: 8512517 - DNA, 22 bp, Homo sapiens
agtcacatgcattttcttcaat

SEQ ID NO: 8512518 - DNA, 22 bp, Homo sapiens
agtcacatgcattttcttcaat

SEQ ID NO: 8512519 - DNA, 22 bp, Homo sapiens
agtcacatgatccctgggcctg

SEQ ID NO: 8512520 - DNA, 22 bp, Homo sapiens
agtcacatcgattataaaattt

SEQ ID NO: 8512521 - DNA, 22 bp, Homo sapiens
agtcacatagtgttttggaatc

SEQ ID NO: 8512522 - DNA, 22 bp, Homo sapiens
agtcacatagtgttttggaatc

SEQ ID NO: 8512523 - DNA, 22 bp, Homo sapiens
agtcacatgagcactaattagg

SEQ ID NO: 8512524 - DNA, 22 bp, Homo sapiens
agtcacatgagcactaattagg

SEQ ID NO: 8512525 - DNA, 22 bp, Homo sapiens
agtcacatcgattataaaattt

SEQ ID NO: 8512526 - DNA, 22 bp, Homo sapiens
agtcacatcgattataaaattt

SEQ ID NO: 8512527 - DNA, 22 bp, Homo sapiens
agtcacagttctgctgtctgag

SEQ ID NO: 8512528 - DNA, 22 bp, Homo sapiens
agtcacagtttccctgagagag

SEQ ID NO: 8512529 - DNA, 22 bp, Homo sapiens
agtcacatagaagtgggtttaa

SEQ ID NO: 8512530 - DNA, 20 bp, Homo sapiens
agtcacagtatcagtcttag

SEQ ID NO: 8512531 - DNA, 22 bp, Homo sapiens
agtcacaggttcttgggattag

SEQ ID NO: 8512532 - DNA, 22 bp, Homo sapiens
agtcacagggggcccctgcaac

SEQ ID NO: 8512533 - DNA, 22 bp, Homo sapiens
agtcacagggtacacaaggatt

SEQ ID NO: 8512534 - DNA, 20 bp, Homo sapiens
agtcacaggcctggaacatg

SEQ ID NO: 8512535 - DNA, 19 bp, Homo sapiens
agtcacagggaagaggaac

SEQ ID NO: 8512536 - DNA, 19 bp, Homo sapiens
agtcacagggaagaggaac

SEQ ID NO: 8512537 - DNA, 22 bp, Homo sapiens
agtcacagggggcccctgcaac

SEQ ID NO: 8512538 - DNA, 20 bp, Homo sapiens
agtcacaggcctggaacatg

SEQ ID NO: 8512539 - DNA, 22 bp, Homo sapiens
agtcacagaaacccaggtgtgg

SEQ ID NO: 8512540 - DNA, 22 bp, Homo sapiens
agtcacagaaacccaggtgtgg

SEQ ID NO: 8512541 - DNA, 22 bp, Homo sapiens
agtcacagaaacccaggtgtgg

SEQ ID NO: 8512542 - DNA, 22 bp, Homo sapiens
agtcacagaaacccaggtgtgg

SEQ ID NO: 8512543 - DNA, 22 bp, Homo sapiens
agtcaattcttttcaactcaag

SEQ ID NO: 8512544 - DNA, 22 bp, Homo sapiens
agtcacaataccgtgtgtcagt

SEQ ID NO: 8512545 - DNA, 22 bp, Homo sapiens
agtcacaataccgtgtgtcagt

SEQ ID NO: 8512546 - DNA, 22 bp, Homo sapiens
agtcaattatctctaggtcatc

SEQ ID NO: 8512547 - DNA, 22 bp, Homo sapiens
ctagagaaaaagcttaggtacg

SEQ ID NO: 8512548 - DNA, 22 bp, Homo sapiens
ctagagaaaactgtgtatcttg

SEQ ID NO: 8512549 - DNA, 22 bp, Homo sapiens
ctagcctgggatttgaacttat

SEQ ID NO: 8512550 - DNA, 22 bp, Homo sapiens
ctagcttcaagtcctggctgtg

SEQ ID NO: 8512551 - DNA, 22 bp, Homo sapiens
ctagcttcaagtcctggctgtg

SEQ ID NO: 8512552 - DNA, 21 bp, Homo sapiens
agtcacattgggggtttaggg

SEQ ID NO: 8512553 - DNA, 20 bp, Homo sapiens
agtcacattgagcttttgga

SEQ ID NO: 8512554 - DNA, 22 bp, Homo sapiens
agtcacatggactcaggatgac

SEQ ID NO: 8512555 - DNA, 22 bp, Homo sapiens
agtcacatggactcaggatgac

SEQ ID NO: 8512556 - DNA, 22 bp, Homo sapiens
agtcacatgggattagaaccca

SEQ ID NO: 8512557 - DNA, 22 bp, Homo sapiens
agtcacatgggattagaaccca

SEQ ID NO: 8512558 - DNA, 22 bp, Homo sapiens
ctaggaatagcaaagtaggaca

SEQ ID NO: 8512559 - DNA, 22 bp, Homo sapiens
ctaggaggcgggggctgcagta

SEQ ID NO: 8512560 - DNA, 22 bp, Homo sapiens
ctaggaatccttttagagttgg

SEQ ID NO: 8512561 - DNA, 22 bp, Homo sapiens
ctaggaaatgaatacagtacac

SEQ ID NO: 8512562 - DNA, 22 bp, Homo sapiens
ctaggaacagttcaacagttta

SEQ ID NO: 8512563 - DNA, 22 bp, Homo sapiens
ctaggaaagacacagagagttt

SEQ ID NO: 8512564 - DNA, 22 bp, Homo sapiens
ctaggaaagacacagagagttt

SEQ ID NO: 8512565 - DNA, 22 bp, Homo sapiens
ctaggaaagacacagagagttt

SEQ ID NO: 8512566 - DNA, 22 bp, Homo sapiens
ccttctctctgaagaccccaaa

SEQ ID NO: 8512567 - DNA, 22 bp, Homo sapiens
agtaaaaatatgcttgtggcta

SEQ ID NO: 8512568 - DNA, 22 bp, Homo sapiens
agtaaaaattgaggtgcaaaat

SEQ ID NO: 8512569 - DNA, 22 bp, Homo sapiens
agtaaaaattgaggtgcaaaat

SEQ ID NO: 8512570 - DNA, 22 bp, Homo sapiens
agtaaaaattgaggtgcaaaat

SEQ ID NO: 8512571 - DNA, 22 bp, Homo sapiens
agtaaacagtatctttagtgtc

SEQ ID NO: 8512572 - DNA, 22 bp, Homo sapiens
agtaaacagtttcttagaagaa

SEQ ID NO: 8512573 - DNA, 22 bp, Homo sapiens
ccttctccctctgagaggaacc

SEQ ID NO: 8512574 - DNA, 22 bp, Homo sapiens
ccttctccctctgagaggaacc

SEQ ID NO: 8512575 - DNA, 22 bp, Homo sapiens
ccttctctactcctgatgcatg

SEQ ID NO: 8512576 - DNA, 22 bp, Homo sapiens
ccttctctactcctgatgcatg

SEQ ID NO: 8512577 - DNA, 22 bp, Homo sapiens
ccttctctaccatgtgaggaaa

SEQ ID NO: 8512578 - DNA, 22 bp, Homo sapiens
ccttctcctgccttgggttcat

SEQ ID NO: 8512579 - DNA, 22 bp, Homo sapiens
ccttccaggttttggctccatt

SEQ ID NO: 8512580 - DNA, 22 bp, Homo sapiens
ccttccagtgactaaggaggaa

SEQ ID NO: 8512581 - DNA, 22 bp, Homo sapiens
ccttccagtatgttaagatggt

SEQ ID NO: 8512582 - DNA, 22 bp, Homo sapiens
ccttccaggtgcaggcaagcct

SEQ ID NO: 8512583 - DNA, 22 bp, Homo sapiens
ccttccaggtgcaggcaagcct

SEQ ID NO: 8512584 - DNA, 21 bp, Homo sapiens
ccttctccattacagtaagct

SEQ ID NO: 8512585 - DNA, 22 bp, Homo sapiens
ccttctcccctctgcagggtgt

SEQ ID NO: 8512586 - DNA, 22 bp, Homo sapiens
ccttccagtgactaaggaggaa

SEQ ID NO: 8512587 - DNA, 20 bp, Homo sapiens
ccttctccagcttgttcttg

SEQ ID NO: 8512588 - DNA, 20 bp, Homo sapiens
ccttctccagcttgttcttg

SEQ ID NO: 8512589 - DNA, 21 bp, Homo sapiens
ccttctccattacagtaagct

SEQ ID NO: 8512590 - DNA, 21 bp, Homo sapiens
ccttctccattacagtaagct

SEQ ID NO: 8512591 - DNA, 22 bp, Homo sapiens
agtaaatgaaagcaattttaga

SEQ ID NO: 8512592 - DNA, 22 bp, Homo sapiens
agtaaatcagacctcattatgt

SEQ ID NO: 8512593 - DNA, 18 bp, Homo sapiens
agtaaatgttaaatattg

SEQ ID NO: 8512594 - DNA, 22 bp, Homo sapiens
agtaaatttctgcatgtgtact

SEQ ID NO: 8512595 - DNA, 18 bp, Homo sapiens
agtaaagcttattacatg

SEQ ID NO: 8512596 - DNA, 22 bp, Homo sapiens
agtaaagcggtgtcacagaatg

SEQ ID NO: 8512597 - DNA, 22 bp, Homo sapiens
agtaaataacagagaaaatggg

SEQ ID NO: 8512598 - DNA, 22 bp, Homo sapiens
agtaaataacagagaaaatggg

SEQ ID NO: 8512599 - DNA, 22 bp, Homo sapiens
agtaaagtaccaaagtgtgagt

SEQ ID NO: 8512600 - DNA, 22 bp, Homo sapiens
agtaaataacagagaaaatggg

SEQ ID NO: 8512601 - DNA, 22 bp, Homo sapiens
agtaaataacagagaaaatggg

SEQ ID NO: 8512602 - DNA, 22 bp, Homo sapiens
agtaaataacagagaaaatggg

SEQ ID NO: 8512603 - DNA, 22 bp, Homo sapiens
agtaaataacagagaaaatggg

SEQ ID NO: 8512604 - DNA, 22 bp, Homo sapiens
agtaaataacagagaaaatggg

SEQ ID NO: 8512605 - DNA, 22 bp, Homo sapiens
agtaaactgtgtgcctttgact

SEQ ID NO: 8512606 - DNA, 22 bp, Homo sapiens
agtaaagcagagttgcagtaca

SEQ ID NO: 8512607 - DNA, 22 bp, Homo sapiens
agtaaagcagagttgcagtaca

SEQ ID NO: 8512608 - DNA, 22 bp, Homo sapiens
agtaaagcagagttgcagtaca

SEQ ID NO: 8512609 - DNA, 22 bp, Homo sapiens
agtaaagcattgtcttcagagt

SEQ ID NO: 8512610 - DNA, 22 bp, Homo sapiens
agtaaacataatttacctgtag

SEQ ID NO: 8512611 - DNA, 22 bp, Homo sapiens
agtaaacatagaatgttcttcc

SEQ ID NO: 8512612 - DNA, 22 bp, Homo sapiens
agtaaacatgtaattgttcatt

SEQ ID NO: 8512613 - DNA, 22 bp, Homo sapiens
agtaaacatttcagatttattt

SEQ ID NO: 8512614 - DNA, 20 bp, Homo sapiens
agtaggggaatgcaagagca

SEQ ID NO: 8512615 - DNA, 20 bp, Homo sapiens
agtaggggaatgcaagagca

SEQ ID NO: 8512616 - DNA, 22 bp, Homo sapiens
agtaggcattgtgaaactgcat

SEQ ID NO: 8512617 - DNA, 22 bp, Homo sapiens
agtaggcatttaataaacatga

SEQ ID NO: 8512618 - DNA, 22 bp, Homo sapiens
agtatttcttcatatgattact

SEQ ID NO: 8512619 - DNA, 22 bp, Homo sapiens
agtcaaggtggaccagaaaaat

SEQ ID NO: 8512620 - DNA, 22 bp, Homo sapiens
agtaggcagaagtggcattcgg

SEQ ID NO: 8512621 - DNA, 20 bp, Homo sapiens
agtaggcaaaggaaagatct

SEQ ID NO: 8512622 - DNA, 18 bp, Homo sapiens
agtaggcactgtggggtt

SEQ ID NO: 8512623 - DNA, 22 bp, Homo sapiens
agtaggaggcgggagcatgaag

SEQ ID NO: 8512624 - DNA, 22 bp, Homo sapiens
agtaggactaggggttgaggca

SEQ ID NO: 8512625 - DNA, 20 bp, Homo sapiens
agtagcagtgtgacattgac

SEQ ID NO: 8512626 - DNA, 20 bp, Homo sapiens
agtagcagtgtgacattgac

SEQ ID NO: 8512627 - DNA, 22 bp, Homo sapiens
agtagcagtgacagctgaggta

SEQ ID NO: 8512628 - DNA, 22 bp, Homo sapiens
agtagcagtgacagctgaggta

SEQ ID NO: 8512629 - DNA, 22 bp, Homo sapiens
agtagcagtgacagctgaggta

SEQ ID NO: 8512630 - DNA, 22 bp, Homo sapiens
agtagcagaaggtcttgaaggg

SEQ ID NO: 8512631 - DNA, 22 bp, Homo sapiens
agtaacacttggaatgatagca

SEQ ID NO: 8512632 - DNA, 22 bp, Homo sapiens
agtaacactattttcatatgta

SEQ ID NO: 8512633 - DNA, 22 bp, Homo sapiens
agtaacaagtgccaacgttaga

SEQ ID NO: 8512634 - DNA, 22 bp, Homo sapiens
agtaacaagtgccaacgttaga

SEQ ID NO: 8512635 - DNA, 22 bp, Homo sapiens
agtaacaagtgccaacgttaga

SEQ ID NO: 8512636 - DNA, 22 bp, Homo sapiens
agtaacaaatattcattggatt

SEQ ID NO: 8512637 - DNA, 22 bp, Homo sapiens
agtaacaaatagctgcctttaa

SEQ ID NO: 8512638 - DNA, 22 bp, Homo sapiens
agtaacaaagtgggagaatgat

SEQ ID NO: 8512639 - DNA, 22 bp, Homo sapiens
agtacatacttcaaatgtactt

SEQ ID NO: 8512640 - DNA, 22 bp, Homo sapiens
agtacatacttcaaatgtactt

SEQ ID NO: 8512641 - DNA, 22 bp, Homo sapiens
agtacatacttcaaatgtactt

SEQ ID NO: 8512642 - DNA, 22 bp, Homo sapiens
agtaacagaaggcctgacttaa

SEQ ID NO: 8512643 - DNA, 22 bp, Homo sapiens
agtaacagaaggcctgacttaa

SEQ ID NO: 8512644 - DNA, 22 bp, Homo sapiens
agtaacagagcatgggttcaga

SEQ ID NO: 8512645 - DNA, 19 bp, Homo sapiens
agtagcagaaagtgcagtg

SEQ ID NO: 8512646 - DNA, 22 bp, Homo sapiens
agtagatttttgaatgtaagtt

SEQ ID NO: 8512647 - DNA, 22 bp, Homo sapiens
agtagcaatggctctgagctat

SEQ ID NO: 8512648 - DNA, 22 bp, Homo sapiens
agtagacattttgcaacatctg

SEQ ID NO: 8512649 - DNA, 22 bp, Homo sapiens
agtagatttctgctgaagcttt

SEQ ID NO: 8512650 - DNA, 22 bp, Homo sapiens
agtagattctcattgatctggt

SEQ ID NO: 8512651 - DNA, 22 bp, Homo sapiens
agtagacagacagaacacagcc

SEQ ID NO: 8512652 - DNA, 22 bp, Homo sapiens
agtagaatcagcctcttgatgg

SEQ ID NO: 8512653 - DNA, 22 bp, Homo sapiens
agtagaatagatggatactatt

SEQ ID NO: 8512654 - DNA, 22 bp, Homo sapiens
cctgtgggccaaggacctgcca

SEQ ID NO: 8512655 - DNA, 22 bp, Homo sapiens
aggtggcagagctggcccagcg

SEQ ID NO: 8512656 - DNA, 22 bp, Homo sapiens
ccttcattgcatctttaagaga

SEQ ID NO: 8512657 - DNA, 22 bp, Homo sapiens
cctgtttattgtgaagaaccca

SEQ ID NO: 8512658 - DNA, 22 bp, Homo sapiens
cctgtttggtacaatctgccaa

SEQ ID NO: 8512659 - DNA, 22 bp, Homo sapiens
cctgttgtttagcacttagaac

SEQ ID NO: 8512660 - DNA, 22 bp, Homo sapiens
cctgtttatctatctagagatg

SEQ ID NO: 8512661 - DNA, 22 bp, Homo sapiens
ccttccaggctggaggcttggg

SEQ ID NO: 8512662 - DNA, 22 bp, Homo sapiens
ccttccaggctggaggcttggg

SEQ ID NO: 8512663 - DNA, 22 bp, Homo sapiens
ccttccaggagtctctgcaggt

SEQ ID NO: 8512664 - DNA, 22 bp, Homo sapiens
ccttccagggagcaggcagtgt

SEQ ID NO: 8512665 - DNA, 22 bp, Homo sapiens
ccttccagatgtaagagctgat

SEQ ID NO: 8512666 - DNA, 22 bp, Homo sapiens
ccttccagatgtaagagctgat

SEQ ID NO: 8512667 - DNA, 22 bp, Homo sapiens
ccttccagatgtaagagctgat

SEQ ID NO: 8512668 - DNA, 20 bp, Homo sapiens
aggtcctggttctctgggat

SEQ ID NO: 8512669 - DNA, 22 bp, Homo sapiens
cctgggctttgagggcaggatg

SEQ ID NO: 8512670 - DNA, 22 bp, Homo sapiens
cctgggctttgagggcaggatg

SEQ ID NO: 8512671 - DNA, 22 bp, Homo sapiens
cctggggctccagagcagcgga

SEQ ID NO: 8512672 - DNA, 20 bp, Homo sapiens
cctggggtacactggcatgt

SEQ ID NO: 8512673 - DNA, 22 bp, Homo sapiens
aggtcctgatgatctctgagag

SEQ ID NO: 8512674 - DNA, 22 bp, Homo sapiens
aggtcctggactgctcttgtta

SEQ ID NO: 8512675 - DNA, 23 bp, Homo sapiens
aggtcctggacatatgtgcatca

SEQ ID NO: 8512676 - DNA, 23 bp, Homo sapiens
aggtcctggacatatgtgcatca

SEQ ID NO: 8512677 - DNA, 22 bp, Homo sapiens
aggtcctgggagttctagtgtg

SEQ ID NO: 8512678 - DNA, 22 bp, Homo sapiens
aggtcctggtcttgagtcttaa

SEQ ID NO: 8512679 - DNA, 21 bp, Homo sapiens
aggtgcagagccagggaccag

SEQ ID NO: 8512680 - DNA, 21 bp, Homo sapiens
aggtgcagagccagggaccag

SEQ ID NO: 8512681 - DNA, 17 bp, Homo sapiens
aggtgcagaggcagagc

SEQ ID NO: 8512682 - DNA, 17 bp, Homo sapiens
aggtgcagaggcagagc

SEQ ID NO: 8512683 - DNA, 17 bp, Homo sapiens
aggtgcagaggcagagc

SEQ ID NO: 8512684 - DNA, 17 bp, Homo sapiens
aggtgcagaggcagagc

SEQ ID NO: 8512685 - DNA, 17 bp, Homo sapiens
aggtgcagaggcagagc

SEQ ID NO: 8512686 - DNA, 17 bp, Homo sapiens
aggtgcagaggcagagc

SEQ ID NO: 8512687 - DNA, 22 bp, Homo sapiens
cctgggtcactcaggcaggcgg

SEQ ID NO: 8512688 - DNA, 22 bp, Homo sapiens
cctgggtacgcagggctcctct

SEQ ID NO: 8512689 - DNA, 22 bp, Homo sapiens
cctggggtatataggtgaatat

SEQ ID NO: 8512690 - DNA, 22 bp, Homo sapiens
aggtgcagcatgagtccaacgg

SEQ ID NO: 8512691 - DNA, 22 bp, Homo sapiens
aggtgcagcatgagtccaacgg

SEQ ID NO: 8512692 - DNA, 23 bp, Homo sapiens
aggtgcagccctggacctgcccc

SEQ ID NO: 8512693 - DNA, 22 bp, Homo sapiens
aggtgcagctggtggagtctgg

SEQ ID NO: 8512694 - DNA, 22 bp, Homo sapiens
aggtgcagctgacaccatgtgg

SEQ ID NO: 8512695 - DNA, 21 bp, Homo sapiens
cctgtgccagtctatgtgttc

SEQ ID NO: 8512696 - DNA, 22 bp, Homo sapiens
cctgtgggagcccaggcagata

SEQ ID NO: 8512697 - DNA, 22 bp, Homo sapiens
aggtgcagctggtggagtctgg

SEQ ID NO: 8512698 - DNA, 22 bp, Homo sapiens
aggtgcagctggtggagtctgg

SEQ ID NO: 8512699 - DNA, 22 bp, Homo sapiens
cctgggagggcaagtgctgatg

SEQ ID NO: 8512700 - DNA, 22 bp, Homo sapiens
cctgggagggcaagtgctgatg

SEQ ID NO: 8512701 - DNA, 22 bp, Homo sapiens
cctgggagggcaagtgctgatg

SEQ ID NO: 8512702 - DNA, 22 bp, Homo sapiens
cctgggaggctgtttccagcct

SEQ ID NO: 8512703 - DNA, 22 bp, Homo sapiens
cctgggaggctgtgggtctgct

SEQ ID NO: 8512704 - DNA, 22 bp, Homo sapiens
cctgggaggctgtttccagcct

SEQ ID NO: 8512705 - DNA, 22 bp, Homo sapiens
cctgggaggctgtttccagcct

SEQ ID NO: 8512706 - DNA, 22 bp, Homo sapiens
cctgggaggctgtgggtctgct

SEQ ID NO: 8512707 - DNA, 22 bp, Homo sapiens
cctgggaggctgtgggtctgct

SEQ ID NO: 8512708 - DNA, 22 bp, Homo sapiens
cctgggaggctgtgggtctgct

SEQ ID NO: 8512709 - DNA, 22 bp, Homo sapiens
cctgggaggtggaggttgcagt

SEQ ID NO: 8512710 - DNA, 22 bp, Homo sapiens
cctgggaggtggaggttgcagt

SEQ ID NO: 8512711 - DNA, 22 bp, Homo sapiens
cctgggaggtggaggttgcagc

SEQ ID NO: 8512712 - DNA, 22 bp, Homo sapiens
cctgggaggtggaggttgcagc

SEQ ID NO: 8512713 - DNA, 22 bp, Homo sapiens
aggtcaggtatcagcaggtatt

SEQ ID NO: 8512714 - DNA, 22 bp, Homo sapiens
aggtcaggaggttaagagtctt

SEQ ID NO: 8512715 - DNA, 22 bp, Homo sapiens
aggtcaggaggttaagagtctt

SEQ ID NO: 8512716 - DNA, 22 bp, Homo sapiens
aggtcagggtattcacgtctgt

SEQ ID NO: 8512717 - DNA, 22 bp, Homo sapiens
aggtcagggtattcacgtctgt

SEQ ID NO: 8512718 - DNA, 22 bp, Homo sapiens
cctgggagaactgctgggttgg

SEQ ID NO: 8512719 - DNA, 22 bp, Homo sapiens
aggtcaggtatcagcaggtatt

SEQ ID NO: 8512720 - DNA, 22 bp, Homo sapiens
aggtcaggtatcagcaggtatt

SEQ ID NO: 8512721 - DNA, 22 bp, Homo sapiens
aggtcaggtatcagcaggtatt

SEQ ID NO: 8512722 - DNA, 22 bp, Homo sapiens
cctgggaggctgaggctgcagt

SEQ ID NO: 8512723 - DNA, 22 bp, Homo sapiens
cctgggaggctgaggctgcagt

SEQ ID NO: 8512724 - DNA, 21 bp, Homo sapiens
cctgggagaattgggtgtggc

SEQ ID NO: 8512725 - DNA, 22 bp, Homo sapiens
cctgggaggctgaggctgcagt

SEQ ID NO: 8512726 - DNA, 22 bp, Homo sapiens
cctgggaggctgaggctgcagt

SEQ ID NO: 8512727 - DNA, 22 bp, Homo sapiens
cctgggaggctgaggctgcagt

SEQ ID NO: 8512728 - DNA, 22 bp, Homo sapiens
cctgggaggctgtgggtctgct

SEQ ID NO: 8512729 - DNA, 22 bp, Homo sapiens
aggtcagaaaaggagagcattg

SEQ ID NO: 8512730 - DNA, 22 bp, Homo sapiens
aggtcagaaaaggagagcattg

SEQ ID NO: 8512731 - DNA, 22 bp, Homo sapiens
aggtcagaaaaggagagcattg

SEQ ID NO: 8512732 - DNA, 22 bp, Homo sapiens
aggtcagaagtgccagggaatt

SEQ ID NO: 8512733 - DNA, 22 bp, Homo sapiens
aggtcagaaaaggagagcattg

SEQ ID NO: 8512734 - DNA, 22 bp, Homo sapiens
aggtcagaaaaggagagcattg

SEQ ID NO: 8512735 - DNA, 22 bp, Homo sapiens
aggtcagaagtgccagggaatt

SEQ ID NO: 8512736 - DNA, 22 bp, Homo sapiens
aggtcagaagtgccagggaatt

SEQ ID NO: 8512737 - DNA, 22 bp, Homo sapiens
aggtcagacagggtgtctttct

SEQ ID NO: 8512738 - DNA, 22 bp, Homo sapiens
aggtcacccgtttgactatcca

SEQ ID NO: 8512739 - DNA, 22 bp, Homo sapiens
aggtcaccatggcatgctccac

SEQ ID NO: 8512740 - DNA, 22 bp, Homo sapiens
aggtcaccatggcatgctccac

SEQ ID NO: 8512741 - DNA, 22 bp, Homo sapiens
aggtcacatggataatgatcag

SEQ ID NO: 8512742 - DNA, 22 bp, Homo sapiens
aggtcacaggctttgaaatcaa

SEQ ID NO: 8512743 - DNA, 22 bp, Homo sapiens
aggtcacagggttgaagtactt

SEQ ID NO: 8512744 - DNA, 22 bp, Homo sapiens
aggtcaggaggcctctgccatt

SEQ ID NO: 8512745 - DNA, 18 bp, Homo sapiens
aggtcaggaaagcagagt

SEQ ID NO: 8512746 - DNA, 22 bp, Homo sapiens
aggtcaggaggcctctgccatt

SEQ ID NO: 8512747 - DNA, 22 bp, Homo sapiens
aggtcaggaggcctctgccatt

SEQ ID NO: 8512748 - DNA, 18 bp, Homo sapiens
aggtcaggaaagcagagt

SEQ ID NO: 8512749 - DNA, 22 bp, Homo sapiens
aggtcagatgggagatgggatg

SEQ ID NO: 8512750 - DNA, 22 bp, Homo sapiens
aggtcagatgggagatgggatg

SEQ ID NO: 8512751 - DNA, 22 bp, Homo sapiens
aggtcagatgggagatgggatg

SEQ ID NO: 8512752 - DNA, 22 bp, Homo sapiens
aggtcagcatgctcctctctgt

SEQ ID NO: 8512753 - DNA, 21 bp, Homo sapiens
aggtcagcccagctctggaag

SEQ ID NO: 8512754 - DNA, 22 bp, Homo sapiens
agggtgggctagactcttcccc

SEQ ID NO: 8512755 - DNA, 22 bp, Homo sapiens
cctgagtagctggaattaaagg

SEQ ID NO: 8512756 - DNA, 22 bp, Homo sapiens
cctgagtagctggaattaaagg

SEQ ID NO: 8512757 - DNA, 22 bp, Homo sapiens
cctgaggtttttggatagttgt

SEQ ID NO: 8512758 - DNA, 22 bp, Homo sapiens
cctgaggtttttggatagttgt

SEQ ID NO: 8512759 - DNA, 21 bp, Homo sapiens
cctgaggtttctggcctctgt

SEQ ID NO: 8512760 - DNA, 21 bp, Homo sapiens
cctgaggtttctggcctctgt

SEQ ID NO: 8512761 - DNA, 22 bp, Homo sapiens
cctgaggtggctgcagcactgc

SEQ ID NO: 8512762 - DNA, 22 bp, Homo sapiens
cctgaggtggctgcagcactgc

SEQ ID NO: 8512763 - DNA, 18 bp, Homo sapiens
cctgaggtgggaggaagg

SEQ ID NO: 8512764 - DNA, 18 bp, Homo sapiens
cctgaggtgggaggaagg

SEQ ID NO: 8512765 - DNA, 18 bp, Homo sapiens
cctgaggtgggaggaagg

SEQ ID NO: 8512766 - DNA, 19 bp, Homo sapiens
cctgaggtggggtggaagg

SEQ ID NO: 8512767 - DNA, 19 bp, Homo sapiens
cctgaggtggggtggaagg

SEQ ID NO: 8512768 - DNA, 22 bp, Homo sapiens
cctgaggttatccatctacctg

SEQ ID NO: 8512769 - DNA, 22 bp, Homo sapiens
cctgaggttgaagtataaattg

SEQ ID NO: 8512770 - DNA, 22 bp, Homo sapiens
agggttcagtgaggtgtactcc

SEQ ID NO: 8512771 - DNA, 22 bp, Homo sapiens
agggtgggctagactcttcccc

SEQ ID NO: 8512772 - DNA, 22 bp, Homo sapiens
agggtgggctagactcttcccc

SEQ ID NO: 8512773 - DNA, 22 bp, Homo sapiens
agggttctgccagtgtcttgag

SEQ ID NO: 8512774 - DNA, 22 bp, Homo sapiens
agggttgcatttttagaggctc

SEQ ID NO: 8512775 - DNA, 22 bp, Homo sapiens
agggttgcctctgagtgctccg

SEQ ID NO: 8512776 - DNA, 22 bp, Homo sapiens
aggtaaagaaaggtgtaacatt

SEQ ID NO: 8512777 - DNA, 22 bp, Homo sapiens
aggtaaaatagatagtatttct

SEQ ID NO: 8512778 - DNA, 22 bp, Homo sapiens
aggtaaaatagatagtatttct

SEQ ID NO: 8512779 - DNA, 22 bp, Homo sapiens
aggtcacacaactgtcagaggc

SEQ ID NO: 8512780 - DNA, 22 bp, Homo sapiens
aggtcacacaactgtcagaggc

SEQ ID NO: 8512781 - DNA, 22 bp, Homo sapiens
aggtcacacttggatcatagaa

SEQ ID NO: 8512782 - DNA, 22 bp, Homo sapiens
aggtcacacttggatcatagaa

SEQ ID NO: 8512783 - DNA, 22 bp, Homo sapiens
aggtcacaggctttgaaatcaa

SEQ ID NO: 8512784 - DNA, 22 bp, Homo sapiens
aggtcacagctttctcgtgagg

SEQ ID NO: 8512785 - DNA, 22 bp, Homo sapiens
aggtatttatgagagcacatat

SEQ ID NO: 8512786 - DNA, 22 bp, Homo sapiens
aggtaatagggttcagaattat

SEQ ID NO: 8512787 - DNA, 22 bp, Homo sapiens
aggtaatgcaactactttgcta

SEQ ID NO: 8512788 - DNA, 22 bp, Homo sapiens
aggtaatgcatataaagtgctt

SEQ ID NO: 8512789 - DNA, 22 bp, Homo sapiens
aggtaatgcaactactttgcta

SEQ ID NO: 8512790 - DNA, 22 bp, Homo sapiens
aggtaattactagagttattta

SEQ ID NO: 8512791 - DNA, 22 bp, Homo sapiens
aggtacagatgaaagtctagtt

SEQ ID NO: 8512792 - DNA, 22 bp, Homo sapiens
aggtacagatgaaagtctagtt

SEQ ID NO: 8512793 - DNA, 22 bp, Homo sapiens
aggtacagatgaaagtctagtt

SEQ ID NO: 8512794 - DNA, 22 bp, Homo sapiens
aggtaacactacttagtatact

SEQ ID NO: 8512795 - DNA, 22 bp, Homo sapiens
aggtaaagacagtgaaagaggg

SEQ ID NO: 8512796 - DNA, 22 bp, Homo sapiens
aggtaaagacagtgaaagaggg

SEQ ID NO: 8512797 - DNA, 22 bp, Homo sapiens
aggtaaagactgcaaggagaat

SEQ ID NO: 8512798 - DNA, 22 bp, Homo sapiens
aggtaaatgtcagagcctttaa

SEQ ID NO: 8512799 - DNA, 22 bp, Homo sapiens
aggtaactagcattagcttctg

SEQ ID NO: 8512800 - DNA, 22 bp, Homo sapiens
aggtaacattgcctccatctga

SEQ ID NO: 8512801 - DNA, 22 bp, Homo sapiens
aggtaaggctgtaagctaagcc

SEQ ID NO: 8512802 - DNA, 22 bp, Homo sapiens
aggtaagggtcacagttcatat

SEQ ID NO: 8512803 - DNA, 22 bp, Homo sapiens
agttatttcagtaacataatag

SEQ ID NO: 8512804 - DNA, 22 bp, Homo sapiens
agttatttcagtaacataatag

SEQ ID NO: 8512805 - DNA, 22 bp, Homo sapiens
ctgagctgcggcaggcacctgg

SEQ ID NO: 8512806 - DNA, 22 bp, Homo sapiens
ctgagctgctcccgctgcagcg

SEQ ID NO: 8512807 - DNA, 22 bp, Homo sapiens
ctgagctgctcccgctgcagcg

SEQ ID NO: 8512808 - DNA, 20 bp, Homo sapiens
ctgagctgagctccatgggt

SEQ ID NO: 8512809 - DNA, 20 bp, Homo sapiens
ctgagctgagctccatgggt

SEQ ID NO: 8512810 - DNA, 22 bp, Homo sapiens
ctgagctgaaacttgagaggct

SEQ ID NO: 8512811 - DNA, 22 bp, Homo sapiens
ctgagctgaaacttgagaggct

SEQ ID NO: 8512812 - DNA, 20 bp, Homo sapiens
ctgagctgagctccatgggt

SEQ ID NO: 8512813 - DNA, 22 bp, Homo sapiens
ctgagctgcagtcctggctctg

SEQ ID NO: 8512814 - DNA, 22 bp, Homo sapiens
ctgagctgcagtcctggctctg

SEQ ID NO: 8512815 - DNA, 22 bp, Homo sapiens
agttcccaggtgatgctgatgt

SEQ ID NO: 8512816 - DNA, 22 bp, Homo sapiens
agttccctccacaacttctcac

SEQ ID NO: 8512817 - DNA, 22 bp, Homo sapiens
agttcccaggtgatgctgatgt

SEQ ID NO: 8512818 - DNA, 22 bp, Homo sapiens
agttccatccttccactgccct

SEQ ID NO: 8512819 - DNA, 22 bp, Homo sapiens
agttccatgtctgggtttgtga

SEQ ID NO: 8512820 - DNA, 22 bp, Homo sapiens
agttccagctgtgaccagaaaa

SEQ ID NO: 8512821 - DNA, 23 bp, Homo sapiens
agttccagaaaaatgctcaagca

SEQ ID NO: 8512822 - DNA, 23 bp, Homo sapiens
agttccagaaaaatgctcaagca

SEQ ID NO: 8512823 - DNA, 22 bp, Homo sapiens
agttccaaagcctgtattctta

SEQ ID NO: 8512824 - DNA, 21 bp, Homo sapiens
agttcatactgagtaacaaaa

SEQ ID NO: 8512825 - DNA, 22 bp, Homo sapiens
agttcatgtggtttaacttaat

SEQ ID NO: 8512826 - DNA, 22 bp, Homo sapiens
agttcatggaagattcaatgga

SEQ ID NO: 8512827 - DNA, 22 bp, Homo sapiens
ctgagccactgcttgttcagtg

SEQ ID NO: 8512828 - DNA, 22 bp, Homo sapiens
ctgagccagagggagtcgggtc

SEQ ID NO: 8512829 - DNA, 22 bp, Homo sapiens
ctgagccaaggggacagtgaca

SEQ ID NO: 8512830 - DNA, 22 bp, Homo sapiens
ctgagccaaggggacagtgaca

SEQ ID NO: 8512831 - DNA, 22 bp, Homo sapiens
agttaactaaactgtgagtaaa

SEQ ID NO: 8512832 - DNA, 22 bp, Homo sapiens
agttaactcattttataatgcc

SEQ ID NO: 8512833 - DNA, 22 bp, Homo sapiens
ctgagccaaggggacagtgaca

SEQ ID NO: 8512834 - DNA, 22 bp, Homo sapiens
ctgagccagggccacacatgga

SEQ ID NO: 8512835 - DNA, 22 bp, Homo sapiens
ctgagccagggccacacatgga

SEQ ID NO: 8512836 - DNA, 22 bp, Homo sapiens
ctgagctcaagcgatcctccca

SEQ ID NO: 8512837 - DNA, 22 bp, Homo sapiens
ctgagctcaagcgatcctccca

SEQ ID NO: 8512838 - DNA, 22 bp, Homo sapiens
ctgagctcagtcccagctctac

SEQ ID NO: 8512839 - DNA, 22 bp, Homo sapiens
ctgagctcacgccattctcctt

SEQ ID NO: 8512840 - DNA, 22 bp, Homo sapiens
ctgagctcaagtgatctgccca

SEQ ID NO: 8512841 - DNA, 22 bp, Homo sapiens
ctgagctctaatgtcagccttg

SEQ ID NO: 8512842 - DNA, 22 bp, Homo sapiens
ctgagccagggccacacatgga

SEQ ID NO: 8512843 - DNA, 22 bp, Homo sapiens
ctgagccagggccacacatgga

SEQ ID NO: 8512844 - DNA, 22 bp, Homo sapiens
ctgagccagctggcatgtgcta

SEQ ID NO: 8512845 - DNA, 22 bp, Homo sapiens
ctgagccagctggcatgtgcta

SEQ ID NO: 8512846 - DNA, 22 bp, Homo sapiens
ctgagccagctggcatgtgcta

SEQ ID NO: 8512847 - DNA, 22 bp, Homo sapiens
ctgagccagctggcatgtgcta

SEQ ID NO: 8512848 - DNA, 22 bp, Homo sapiens
ctgagccagcgggctcactttt

SEQ ID NO: 8512849 - DNA, 22 bp, Homo sapiens
ctgagccagcgggctcactttt

SEQ ID NO: 8512850 - DNA, 22 bp, Homo sapiens
agtgtgcattcctctcctcagg

SEQ ID NO: 8512851 - DNA, 20 bp, Homo sapiens
agtgtgcatttagagtctgc

SEQ ID NO: 8512852 - DNA, 22 bp, Homo sapiens
agtgtgagtgctcatgtccatc

SEQ ID NO: 8512853 - DNA, 22 bp, Homo sapiens
agtgtgagtaattcagggaggg

SEQ ID NO: 8512854 - DNA, 22 bp, Homo sapiens
agtgtgagtaattgagtctgtc

SEQ ID NO: 8512855 - DNA, 19 bp, Homo sapiens
agtgtgagtaattggagtt

SEQ ID NO: 8512856 - DNA, 22 bp, Homo sapiens
agtgtgagttacaaagtgtgaa

SEQ ID NO: 8512857 - DNA, 22 bp, Homo sapiens
agtgtgagttacaaagtgtgaa

SEQ ID NO: 8512858 - DNA, 22 bp, Homo sapiens
agtgtgagtttggttgagactt

SEQ ID NO: 8512859 - DNA, 22 bp, Homo sapiens
agtgtggattggctggagctat

SEQ ID NO: 8512860 - DNA, 22 bp, Homo sapiens
agtgtggacttttcctaggagg

SEQ ID NO: 8512861 - DNA, 22 bp, Homo sapiens
agtgtggagcatcgagggcaga

SEQ ID NO: 8512862 - DNA, 22 bp, Homo sapiens
agtgtgctgtttccagaagggc

SEQ ID NO: 8512863 - DNA, 22 bp, Homo sapiens
agtgtttcaagaagcaggaagt

SEQ ID NO: 8512864 - DNA, 22 bp, Homo sapiens
agtgtttcaagtgatgctttgg

SEQ ID NO: 8512865 - DNA, 22 bp, Homo sapiens
agtgtttcaagtgatgctttgg

SEQ ID NO: 8512866 - DNA, 18 bp, Homo sapiens
agtgttctcgttttataa

SEQ ID NO: 8512867 - DNA, 18 bp, Homo sapiens
agtgttctcgttttataa

SEQ ID NO: 8512868 - DNA, 22 bp, Homo sapiens
agtgtgggcccccaggttagcc

SEQ ID NO: 8512869 - DNA, 22 bp, Homo sapiens
agtgtgggggctttggtgtcac

SEQ ID NO: 8512870 - DNA, 22 bp, Homo sapiens
agtgtgggccacgcagctgagc

SEQ ID NO: 8512871 - DNA, 22 bp, Homo sapiens
agtgtgggcccccaggttagcc

SEQ ID NO: 8512872 - DNA, 22 bp, Homo sapiens
agtgtgggccacgcagctgagc

SEQ ID NO: 8512873 - DNA, 22 bp, Homo sapiens
agtgtgggccacgcagctgagc

SEQ ID NO: 8512874 - DNA, 22 bp, Homo sapiens
agtgtggccaatgaggatgggc

SEQ ID NO: 8512875 - DNA, 17 bp, Homo sapiens
agtgtggccctggttaa

SEQ ID NO: 8512876 - DNA, 22 bp, Homo sapiens
agtgtggctgcgtagggctctc

SEQ ID NO: 8512877 - DNA, 22 bp, Homo sapiens
agtgtggcaggaatgactagaa

SEQ ID NO: 8512878 - DNA, 22 bp, Homo sapiens
agtgtggcaggaatgactagaa

SEQ ID NO: 8512879 - DNA, 22 bp, Homo sapiens
agtgtttcaccgtatgttctca

SEQ ID NO: 8512880 - DNA, 22 bp, Homo sapiens
agtgtttcaatcctaggggttg

SEQ ID NO: 8512881 - DNA, 22 bp, Homo sapiens
agtgtttcacagcactttttct

SEQ ID NO: 8512882 - DNA, 22 bp, Homo sapiens
agtgtttcaccgtatgttctca

SEQ ID NO: 8512883 - DNA, 19 bp, Homo sapiens
agtgtttcatgtgctttta

SEQ ID NO: 8512884 - DNA, 22 bp, Homo sapiens
agtgtttcaccgtatgttctca

SEQ ID NO: 8512885 - DNA, 22 bp, Homo sapiens
agtgtttcccagtaggatgaaa

SEQ ID NO: 8512886 - DNA, 22 bp, Homo sapiens
agtgtttcctgagtgttatcat

SEQ ID NO: 8512887 - DNA, 22 bp, Homo sapiens
agtgtttcctgagtgttatcat

SEQ ID NO: 8512888 - DNA, 17 bp, Homo sapiens
agtgtttccttatcatt

SEQ ID NO: 8512889 - DNA, 17 bp, Homo sapiens
agtgtttccttatcatt

SEQ ID NO: 8512890 - DNA, 22 bp, Homo sapiens
agtgtttctaagtagatgtgaa

SEQ ID NO: 8512891 - DNA, 22 bp, Homo sapiens
agtgtttctaagtagatgtgaa

SEQ ID NO: 8512892 - DNA, 20 bp, Homo sapiens
agtgtttctcaacatggggc

SEQ ID NO: 8512893 - DNA, 20 bp, Homo sapiens
agtgtttctcaacatggggc

SEQ ID NO: 8512894 - DNA, 20 bp, Homo sapiens
agtgtttctcaacatggggc

SEQ ID NO: 8512895 - DNA, 20 bp, Homo sapiens
agtgtttgctcacagtctcc

SEQ ID NO: 8512896 - DNA, 22 bp, Homo sapiens
agtgtttgcatctcattgattt

SEQ ID NO: 8512897 - DNA, 22 bp, Homo sapiens
agtgtttgagacacatttcact

SEQ ID NO: 8512898 - DNA, 22 bp, Homo sapiens
agtgtttctggaatcagtgttt

SEQ ID NO: 8512899 - DNA, 22 bp, Homo sapiens
agtgtttctggcaaatgaaagt

SEQ ID NO: 8512900 - DNA, 22 bp, Homo sapiens
agtgtttctggaatcagtgttt

SEQ ID NO: 8512901 - DNA, 22 bp, Homo sapiens
agtgtttctcagaagggcctat

SEQ ID NO: 8512902 - DNA, 22 bp, Homo sapiens
agtgtttctggaatcagtgttt

SEQ ID NO: 8512903 - DNA, 22 bp, Homo sapiens
agtgtttctgtgccccagtgtt

SEQ ID NO: 8512904 - DNA, 22 bp, Homo sapiens
agtgtttgagacacatttcact

SEQ ID NO: 8512905 - DNA, 21 bp, Homo sapiens
agttaaacctttagagaacta

SEQ ID NO: 8512906 - DNA, 22 bp, Homo sapiens
agtgttttattagaacacagcc

SEQ ID NO: 8512907 - DNA, 22 bp, Homo sapiens
agtgtttggggtgattgtaacc

SEQ ID NO: 8512908 - DNA, 22 bp, Homo sapiens
agtgtttgtcccgttagaaatg

SEQ ID NO: 8512909 - DNA, 22 bp, Homo sapiens
agtgtttgtcccgttagaaatg

SEQ ID NO: 8512910 - DNA, 22 bp, Homo sapiens
agttaacacaagtaagattcca

SEQ ID NO: 8512911 - DNA, 22 bp, Homo sapiens
agttaacaagttggcaatcaac

SEQ ID NO: 8512912 - DNA, 22 bp, Homo sapiens
agttaaagtctgaaatagagaa

SEQ ID NO: 8512913 - DNA, 22 bp, Homo sapiens
agttaaactttgccagatggga

SEQ ID NO: 8512914 - DNA, 22 bp, Homo sapiens
agttaaacttgcctttattcct

SEQ ID NO: 8512915 - DNA, 22 bp, Homo sapiens
agttaaactctagtagatacaa

SEQ ID NO: 8512916 - DNA, 22 bp, Homo sapiens
agttaaactctagtagatacaa

SEQ ID NO: 8512917 - DNA, 22 bp, Homo sapiens
agtggctctccaagaagtcaca

SEQ ID NO: 8512918 - DNA, 22 bp, Homo sapiens
agtggctcttgggtcactgggc

SEQ ID NO: 8512919 - DNA, 22 bp, Homo sapiens
agtggctgaagcatcaaaggca

SEQ ID NO: 8512920 - DNA, 22 bp, Homo sapiens
agtggggagtttccagatgtgt

SEQ ID NO: 8512921 - DNA, 22 bp, Homo sapiens
agtgggtgataagaccaaggag

SEQ ID NO: 8512922 - DNA, 22 bp, Homo sapiens
agtgggtgagcttggtctagat

SEQ ID NO: 8512923 - DNA, 22 bp, Homo sapiens
agtgggtgagcttggtctagat

SEQ ID NO: 8512924 - DNA, 22 bp, Homo sapiens
agtgggtgagcttggtctagat

SEQ ID NO: 8512925 - DNA, 22 bp, Homo sapiens
agtgggtcagagagctccagat

SEQ ID NO: 8512926 - DNA, 22 bp, Homo sapiens
agtgggtactgggcaggcagag

SEQ ID NO: 8512927 - DNA, 22 bp, Homo sapiens
agtggcctggagccccgcctgg

SEQ ID NO: 8512928 - DNA, 22 bp, Homo sapiens
agtggcctggagccccgcctgg

SEQ ID NO: 8512929 - DNA, 22 bp, Homo sapiens
agtggcctggagccccgcctgg

SEQ ID NO: 8512930 - DNA, 22 bp, Homo sapiens
agtggctaataacagctaaaca

SEQ ID NO: 8512931 - DNA, 22 bp, Homo sapiens
agtggccagtgctgctctgggg

SEQ ID NO: 8512932 - DNA, 22 bp, Homo sapiens
agtggccagtgctgctctgggg

SEQ ID NO: 8512933 - DNA, 22 bp, Homo sapiens
ctctggagttctcatgaggaac

SEQ ID NO: 8512934 - DNA, 22 bp, Homo sapiens
ctctggagttcttcaagctact

SEQ ID NO: 8512935 - DNA, 22 bp, Homo sapiens
ctctggagttcttcaagctact

SEQ ID NO: 8512936 - DNA, 22 bp, Homo sapiens
ctctggagttagtgatctgggc

SEQ ID NO: 8512937 - DNA, 22 bp, Homo sapiens
ctctggagttagtgatctgggc

SEQ ID NO: 8512938 - DNA, 22 bp, Homo sapiens
ctctggagtgtctggccagggt

SEQ ID NO: 8512939 - DNA, 22 bp, Homo sapiens
agtggtcctgcaaacccgtgtg

SEQ ID NO: 8512940 - DNA, 22 bp, Homo sapiens
agtggtaactaagtcctgctta

SEQ ID NO: 8512941 - DNA, 22 bp, Homo sapiens
agtggtaagggcataggcactg

SEQ ID NO: 8512942 - DNA, 22 bp, Homo sapiens
agtgggtgtagtcttcctcctg

SEQ ID NO: 8512943 - DNA, 22 bp, Homo sapiens
agtgggtgggtgtctgacagtt

SEQ ID NO: 8512944 - DNA, 22 bp, Homo sapiens
agtgggtgggtgtctgacagtt

SEQ ID NO: 8512945 - DNA, 22 bp, Homo sapiens
agtgggtggcgcagaggaggaa

SEQ ID NO: 8512946 - DNA, 22 bp, Homo sapiens
agtgtgaccttatttggaaaca

SEQ ID NO: 8512947 - DNA, 22 bp, Homo sapiens
agtgtctttgtcaaattacagg

SEQ ID NO: 8512948 - DNA, 22 bp, Homo sapiens
agtgtctttgtctctcaagcac

SEQ ID NO: 8512949 - DNA, 19 bp, Homo sapiens
agtgtgagactccatctca

SEQ ID NO: 8512950 - DNA, 22 bp, Homo sapiens
agtgtgagaacggactaataaa

SEQ ID NO: 8512951 - DNA, 23 bp, Homo sapiens
agtgtgacttttttgactgtcac

SEQ ID NO: 8512952 - DNA, 23 bp, Homo sapiens
agtgtgacttttttgactgtcac

SEQ ID NO: 8512953 - DNA, 22 bp, Homo sapiens
agtgtgagatgattgaggagca

SEQ ID NO: 8512954 - DNA, 19 bp, Homo sapiens
agtgtgagactccatctca

SEQ ID NO: 8512955 - DNA, 22 bp, Homo sapiens
agtgtgagtaattcagggaggg

SEQ ID NO: 8512956 - DNA, 22 bp, Homo sapiens
agtgtgagctaatagcagagcc

SEQ ID NO: 8512957 - DNA, 22 bp, Homo sapiens
agtgtgagctaatagcagagcc

SEQ ID NO: 8512958 - DNA, 22 bp, Homo sapiens
agtgtgaggggttctttgatat

SEQ ID NO: 8512959 - DNA, 22 bp, Homo sapiens
agtgtgagccctggagtggtgc

SEQ ID NO: 8512960 - DNA, 22 bp, Homo sapiens
agtgtgagattaaaccgaatca

SEQ ID NO: 8512961 - DNA, 22 bp, Homo sapiens
agtgtgagctaatagcagagcc

SEQ ID NO: 8512962 - DNA, 22 bp, Homo sapiens
agtgtgagcctacaggccaaag

SEQ ID NO: 8512963 - DNA, 21 bp, Homo sapiens
agtgtcatttgatcattgtta

SEQ ID NO: 8512964 - DNA, 22 bp, Homo sapiens
agtgtcccctacagaggcattc

SEQ ID NO: 8512965 - DNA, 22 bp, Homo sapiens
agtgtccaactcagcttgtcaa

SEQ ID NO: 8512966 - DNA, 22 bp, Homo sapiens
agtgtcccctccaagggcctgg

SEQ ID NO: 8512967 - DNA, 22 bp, Homo sapiens
agtgtcccctccaagggcctgg

SEQ ID NO: 8512968 - DNA, 22 bp, Homo sapiens
agtgtcctcaggctttgttcct

SEQ ID NO: 8512969 - DNA, 22 bp, Homo sapiens
agtgtcctcctctgggagccag

SEQ ID NO: 8512970 - DNA, 22 bp, Homo sapiens
agtgtctgggctcccttggagc

SEQ ID NO: 8512971 - DNA, 22 bp, Homo sapiens
agtgtctggtctctgaactaaa

SEQ ID NO: 8512972 - DNA, 22 bp, Homo sapiens
agtgtctttctctctccaagtg

SEQ ID NO: 8512973 - DNA, 22 bp, Homo sapiens
agtgtctttgacacattcaaag

SEQ ID NO: 8512974 - DNA, 22 bp, Homo sapiens
agtgtctttgtcaaattacagg

SEQ ID NO: 8512975 - DNA, 22 bp, Homo sapiens
agtgtctttgtctctcaagcac

SEQ ID NO: 8512976 - DNA, 20 bp, Homo sapiens
agtgtatttgggtagagtgt

SEQ ID NO: 8512977 - DNA, 19 bp, Homo sapiens
agtgtatttttttctgtag

SEQ ID NO: 8512978 - DNA, 19 bp, Homo sapiens
agtgtatttttttctgtag

SEQ ID NO: 8512979 - DNA, 22 bp, Homo sapiens
agtgtacaaaatgatagataaa

SEQ ID NO: 8512980 - DNA, 22 bp, Homo sapiens
agtgtacaaaatgatagataaa

SEQ ID NO: 8512981 - DNA, 21 bp, Homo sapiens
ctctggagtttgaaggctggg

SEQ ID NO: 8512982 - DNA, 21 bp, Homo sapiens
ctctggagtttgaaggctggg

SEQ ID NO: 8512983 - DNA, 22 bp, Homo sapiens
agtgtattgattggaacagcct

SEQ ID NO: 8512984 - DNA, 22 bp, Homo sapiens
agtgtattcagaatgtagcaaa

SEQ ID NO: 8512985 - DNA, 22 bp, Homo sapiens
agtgtacaaaatgatagataaa

SEQ ID NO: 8512986 - DNA, 22 bp, Homo sapiens
agtgtcacaaacctgccttgta

SEQ ID NO: 8512987 - DNA, 22 bp, Homo sapiens
agtgtcacagacccaatcagga

SEQ ID NO: 8512988 - DNA, 17 bp, Homo sapiens
agtgtcagaagacagtt

SEQ ID NO: 8512989 - DNA, 22 bp, Homo sapiens
agtgtcagcctgggcaaggaac

SEQ ID NO: 8512990 - DNA, 21 bp, Homo sapiens
agtgtcattcccaagctgtga

SEQ ID NO: 8512991 - DNA, 22 bp, Homo sapiens
agtgtcatcgtgaaaacatagc

SEQ ID NO: 8512992 - DNA, 22 bp, Homo sapiens
agtgtcagcctgggcaaggaac

SEQ ID NO: 8512993 - DNA, 22 bp, Homo sapiens
agtgaaatgatagtgtaaatac

SEQ ID NO: 8512994 - DNA, 22 bp, Homo sapiens
agtgaaatgactgaatcagata

SEQ ID NO: 8512995 - DNA, 22 bp, Homo sapiens
agtgaaatgactgaatcagata

SEQ ID NO: 8512996 - DNA, 22 bp, Homo sapiens
agtgaaatcctggtcaacaggt

SEQ ID NO: 8512997 - DNA, 22 bp, Homo sapiens
agtgaaatcctggtcaacaggt

SEQ ID NO: 8512998 - DNA, 22 bp, Homo sapiens
agtgaaatcctggtcaacaggt

SEQ ID NO: 8512999 - DNA, 22 bp, Homo sapiens
agtgaaattcctggtctttgtt

SEQ ID NO: 8513000 - DNA, 22 bp, Homo sapiens
agtgaaatgactgaatcagata

SEQ ID NO: 8513001 - DNA, 22 bp, Homo sapiens
agtgaaatgattctgagcaaga

SEQ ID NO: 8513002 - DNA, 22 bp, Homo sapiens
agtgacttctcctaatgtcata

SEQ ID NO: 8513003 - DNA, 21 bp, Homo sapiens
agtgaaattgcatcagaggga

SEQ ID NO: 8513004 - DNA, 22 bp, Homo sapiens
agtgaaattgctgtaagaggaa

SEQ ID NO: 8513005 - DNA, 21 bp, Homo sapiens
agtgaaattgcatcagaggga

SEQ ID NO: 8513006 - DNA, 22 bp, Homo sapiens
agtgaggctaataggcaatggt

SEQ ID NO: 8513007 - DNA, 17 bp, Homo sapiens
agtgacttggaaagagc

SEQ ID NO: 8513008 - DNA, 22 bp, Homo sapiens
agtgaaaacactagttcttgcc

SEQ ID NO: 8513009 - DNA, 22 bp, Homo sapiens
agtgaaaacactagttcttgcc

SEQ ID NO: 8513010 - DNA, 22 bp, Homo sapiens
agtgaaaacactagttcttgcc

SEQ ID NO: 8513011 - DNA, 22 bp, Homo sapiens
agtgaaacagagcacagcatgc

SEQ ID NO: 8513012 - DNA, 22 bp, Homo sapiens
agtgaaaagatgcatttctctg

SEQ ID NO: 8513013 - DNA, 22 bp, Homo sapiens
agtgaaaagatgcatttctctg

SEQ ID NO: 8513014 - DNA, 22 bp, Homo sapiens
agtgaaaacctaatcatgcagt

SEQ ID NO: 8513015 - DNA, 22 bp, Homo sapiens
agtgaaaacctaatcatgcagt

SEQ ID NO: 8513016 - DNA, 22 bp, Homo sapiens
agtgaaatatgcccattgctgt

SEQ ID NO: 8513017 - DNA, 22 bp, Homo sapiens
agtgaaatcaggttttgactgc

SEQ ID NO: 8513018 - DNA, 22 bp, Homo sapiens
agtgaaatcaggttttgactgc

SEQ ID NO: 8513019 - DNA, 22 bp, Homo sapiens
agtgaaatagcatttatgaagc

SEQ ID NO: 8513020 - DNA, 22 bp, Homo sapiens
agtgaaatactgtcgtttttag

SEQ ID NO: 8513021 - DNA, 22 bp, Homo sapiens
agtgaaatagcatttatgaagc

SEQ ID NO: 8513022 - DNA, 22 bp, Homo sapiens
agtgaaaggttgagaatattct

SEQ ID NO: 8513023 - DNA, 22 bp, Homo sapiens
agtgatggagcttcctctgcta

SEQ ID NO: 8513024 - DNA, 22 bp, Homo sapiens
agtgatggggccctgcactgat

SEQ ID NO: 8513025 - DNA, 22 bp, Homo sapiens
agtgatggcatatatagatgtg

SEQ ID NO: 8513026 - DNA, 22 bp, Homo sapiens
agtgatggcatcgggtccagca

SEQ ID NO: 8513027 - DNA, 22 bp, Homo sapiens
agtgatggtttccagtcactga

SEQ ID NO: 8513028 - DNA, 22 bp, Homo sapiens
agtgatggtgagtgagaagctc

SEQ ID NO: 8513029 - DNA, 22 bp, Homo sapiens
agtgatggtgagtgagaagctc

SEQ ID NO: 8513030 - DNA, 22 bp, Homo sapiens
agtgatggggccctgcactgat

SEQ ID NO: 8513031 - DNA, 22 bp, Homo sapiens
agtgagtgggttacagatggga

SEQ ID NO: 8513032 - DNA, 22 bp, Homo sapiens
agtgagtgggttacagatggga

SEQ ID NO: 8513033 - DNA, 22 bp, Homo sapiens
agtgagtgggttacagatggga

SEQ ID NO: 8513034 - DNA, 19 bp, Homo sapiens
agtgagtggggaaggccct

SEQ ID NO: 8513035 - DNA, 22 bp, Homo sapiens
agtgagtttagggtgcaggtgt

SEQ ID NO: 8513036 - DNA, 22 bp, Homo sapiens
agtgataatgtggtaattattt

SEQ ID NO: 8513037 - DNA, 22 bp, Homo sapiens
agtgaggggcagctgagtgggc

SEQ ID NO: 8513038 - DNA, 22 bp, Homo sapiens
agtgaggggcagctgagtgggc

SEQ ID NO: 8513039 - DNA, 22 bp, Homo sapiens
agtgaggggattcaggcaaggt

SEQ ID NO: 8513040 - DNA, 22 bp, Homo sapiens
agtgaggggattcaggcaaggt

SEQ ID NO: 8513041 - DNA, 22 bp, Homo sapiens
agtgaggggattcaggcaaggt

SEQ ID NO: 8513042 - DNA, 22 bp, Homo sapiens
agtgagtggatgtaggaattgg

SEQ ID NO: 8513043 - DNA, 22 bp, Homo sapiens
agtgagtggagagctctaggtt

SEQ ID NO: 8513044 - DNA, 22 bp, Homo sapiens
agtgagtggaccctgcaaggaa

SEQ ID NO: 8513045 - DNA, 22 bp, Homo sapiens
agtgagtggaccctgcaaggaa

SEQ ID NO: 8513046 - DNA, 22 bp, Homo sapiens
agtgaggggcagctgagtgggc

SEQ ID NO: 8513047 - DNA, 22 bp, Homo sapiens
agtgaggtcatactggagaggg

SEQ ID NO: 8513048 - DNA, 18 bp, Homo sapiens
agtcttctgatccatttt

SEQ ID NO: 8513049 - DNA, 18 bp, Homo sapiens
agtcttctgatccatttt

SEQ ID NO: 8513050 - DNA, 18 bp, Homo sapiens
agtcttctgatccatttt

SEQ ID NO: 8513051 - DNA, 19 bp, Homo sapiens
agtctttcccactcgtctt

SEQ ID NO: 8513052 - DNA, 22 bp, Homo sapiens
agtctttcctgcttgactgttc

SEQ ID NO: 8513053 - DNA, 22 bp, Homo sapiens
ctcaccacagagcctgtccagc

SEQ ID NO: 8513054 - DNA, 22 bp, Homo sapiens
ctcaccacagagcctgtccagc

SEQ ID NO: 8513055 - DNA, 22 bp, Homo sapiens
ctcacattcacaggacagaagg

SEQ ID NO: 8513056 - DNA, 22 bp, Homo sapiens
ctcacattccacttgtgccaac

SEQ ID NO: 8513057 - DNA, 23 bp, Homo sapiens
ctcaccaagcgccgccgctgtgt

SEQ ID NO: 8513058 - DNA, 22 bp, Homo sapiens
ctcacatgatggcctttttcat

SEQ ID NO: 8513059 - DNA, 22 bp, Homo sapiens
ctcacagttttctgtagtccaa

SEQ ID NO: 8513060 - DNA, 22 bp, Homo sapiens
ctcacagtttcacagtgtagat

SEQ ID NO: 8513061 - DNA, 22 bp, Homo sapiens
agtcctgggtctggagaatgga

SEQ ID NO: 8513062 - DNA, 22 bp, Homo sapiens
agtctcagaaaagaagcatgga

SEQ ID NO: 8513063 - DNA, 22 bp, Homo sapiens
agtctcacttcttgagctatgc

SEQ ID NO: 8513064 - DNA, 20 bp, Homo sapiens
ctcacagtcaatgcagaggt

SEQ ID NO: 8513065 - DNA, 20 bp, Homo sapiens
ctcacagtcaatgcagaggt

SEQ ID NO: 8513066 - DNA, 22 bp, Homo sapiens
agtctatttttggttcttcggg

SEQ ID NO: 8513067 - DNA, 22 bp, Homo sapiens
agtctatttcagtcttactagt

SEQ ID NO: 8513068 - DNA, 22 bp, Homo sapiens
agtctatttccccttctcttga

SEQ ID NO: 8513069 - DNA, 18 bp, Homo sapiens
agtggaaaacaaatacac

SEQ ID NO: 8513070 - DNA, 22 bp, Homo sapiens
agtgctttgtgctctcactgca

SEQ ID NO: 8513071 - DNA, 22 bp, Homo sapiens
agtggaatgtagaaaaaagatg

SEQ ID NO: 8513072 - DNA, 20 bp, Homo sapiens
agtggaatttcagatacccc

SEQ ID NO: 8513073 - DNA, 22 bp, Homo sapiens
agtggaaggtcaggggacagtg

SEQ ID NO: 8513074 - DNA, 22 bp, Homo sapiens
agtggactcttcccagtgcttg

SEQ ID NO: 8513075 - DNA, 22 bp, Homo sapiens
agtggacattctgcacttggag

SEQ ID NO: 8513076 - DNA, 22 bp, Homo sapiens
agtggaccagaagactgaagct

SEQ ID NO: 8513077 - DNA, 22 bp, Homo sapiens
agtggagacaggacagtcgata

SEQ ID NO: 8513078 - DNA, 22 bp, Homo sapiens
agtggagaatatgcagaaagcc

SEQ ID NO: 8513079 - DNA, 22 bp, Homo sapiens
agtggaggcactaattggattt

SEQ ID NO: 8513080 - DNA, 22 bp, Homo sapiens
agtggagcttttcctatcagag

SEQ ID NO: 8513081 - DNA, 22 bp, Homo sapiens
agtggaggttacagctgtacat

SEQ ID NO: 8513082 - DNA, 22 bp, Homo sapiens
agtggaggcactaattggattt

SEQ ID NO: 8513083 - DNA, 22 bp, Homo sapiens
agtggcagtttgggagctacag

SEQ ID NO: 8513084 - DNA, 22 bp, Homo sapiens
agtggcagtttgggagctacag

SEQ ID NO: 8513085 - DNA, 22 bp, Homo sapiens
agtggcagttttatatttcatg

SEQ ID NO: 8513086 - DNA, 22 bp, Homo sapiens
agtggcagtttgggagctacag

SEQ ID NO: 8513087 - DNA, 22 bp, Homo sapiens
agtggcagtggggcagggccct

SEQ ID NO: 8513088 - DNA, 22 bp, Homo sapiens
agtggcagtggggcagggccct

SEQ ID NO: 8513089 - DNA, 22 bp, Homo sapiens
agtggccaatatgtcatgctct

SEQ ID NO: 8513090 - DNA, 22 bp, Homo sapiens
agtggcattttaatggatgtca

SEQ ID NO: 8513091 - DNA, 22 bp, Homo sapiens
agtggccactgacttggaaatc

SEQ ID NO: 8513092 - DNA, 22 bp, Homo sapiens
agtggccagcagcctagcctag

SEQ ID NO: 8513093 - DNA, 22 bp, Homo sapiens
agtggccaatatgtcatgctct

SEQ ID NO: 8513094 - DNA, 22 bp, Homo sapiens
agtggcaattgacaacaaagga

SEQ ID NO: 8513095 - DNA, 20 bp, Homo sapiens
agtggcagggaaatggaaag

SEQ ID NO: 8513096 - DNA, 22 bp, Homo sapiens
agtggcagggacttcatataaa

SEQ ID NO: 8513097 - DNA, 22 bp, Homo sapiens
agtggcagaactacctttttat

SEQ ID NO: 8513098 - DNA, 22 bp, Homo sapiens
agtggcaggcggagatgtagga

SEQ ID NO: 8513099 - DNA, 22 bp, Homo sapiens
agtggcaaagtcttcagaagtt

SEQ ID NO: 8513100 - DNA, 22 bp, Homo sapiens
agtgatgtctaacttgatccct

SEQ ID NO: 8513101 - DNA, 22 bp, Homo sapiens
agtgatgtgggagagtatagct

SEQ ID NO: 8513102 - DNA, 22 bp, Homo sapiens
agtgatgtgggagagtatagct

SEQ ID NO: 8513103 - DNA, 22 bp, Homo sapiens
agtgatgtgggagagtatagct

SEQ ID NO: 8513104 - DNA, 22 bp, Homo sapiens
agtgatgttgactagctataag

SEQ ID NO: 8513105 - DNA, 22 bp, Homo sapiens
agtgatgttgactagctataag

SEQ ID NO: 8513106 - DNA, 22 bp, Homo sapiens
agtgatgttgactagctataag

SEQ ID NO: 8513107 - DNA, 22 bp, Homo sapiens
agtgatgttgattttaccactt

SEQ ID NO: 8513108 - DNA, 22 bp, Homo sapiens
agtgattagaaagtacacttgg

SEQ ID NO: 8513109 - DNA, 19 bp, Homo sapiens
agtgcattttatgtttcaa

SEQ ID NO: 8513110 - DNA, 22 bp, Homo sapiens
agtgcatttggggtagtggaag

SEQ ID NO: 8513111 - DNA, 22 bp, Homo sapiens
agtgcatttggggtagtggaag

SEQ ID NO: 8513112 - DNA, 22 bp, Homo sapiens
agtgcattgcatctctgcttca

SEQ ID NO: 8513113 - DNA, 22 bp, Homo sapiens
agtgcattgcatctctgcttca

SEQ ID NO: 8513114 - DNA, 22 bp, Homo sapiens
agtgcattctgtcatcttggtt

SEQ ID NO: 8513115 - DNA, 22 bp, Homo sapiens
agtgcattctggcagaacaggt

SEQ ID NO: 8513116 - DNA, 22 bp, Homo sapiens
agtgcattctctaattacaggt

SEQ ID NO: 8513117 - DNA, 22 bp, Homo sapiens
agtgcattctccatcatctagg

SEQ ID NO: 8513118 - DNA, 22 bp, Homo sapiens
agtgcattctccatcatctagg

SEQ ID NO: 8513119 - DNA, 22 bp, Homo sapiens
agtgcattcagtattcataggc

SEQ ID NO: 8513120 - DNA, 22 bp, Homo sapiens
agtgcattatatgtttcaatgg

SEQ ID NO: 8513121 - DNA, 22 bp, Homo sapiens
agtgcattcctggggaagaagc

SEQ ID NO: 8513122 - DNA, 22 bp, Homo sapiens
agtgcattatatgtttcaatgg

SEQ ID NO: 8513123 - DNA, 22 bp, Homo sapiens
agtgcagggggaaagggtgtct

SEQ ID NO: 8513124 - DNA, 22 bp, Homo sapiens
agtgcctggaccccatgacata

SEQ ID NO: 8513125 - DNA, 22 bp, Homo sapiens
agtgcctggaccccatgacata

SEQ ID NO: 8513126 - DNA, 22 bp, Homo sapiens
agtgcctggcacatggaaggtg

SEQ ID NO: 8513127 - DNA, 22 bp, Homo sapiens
agtgccctgtcactggaactga

SEQ ID NO: 8513128 - DNA, 22 bp, Homo sapiens
agtgcgtggtttacagctagtt

SEQ ID NO: 8513129 - DNA, 22 bp, Homo sapiens
agtgcgtggtttacagctagtt

SEQ ID NO: 8513130 - DNA, 22 bp, Homo sapiens
agtgctgtcagttttatagata

SEQ ID NO: 8513131 - DNA, 22 bp, Homo sapiens
agtgctgtaacaacttatttgg

SEQ ID NO: 8513132 - DNA, 22 bp, Homo sapiens
agtgcgtggacccctggctgct

SEQ ID NO: 8513133 - DNA, 22 bp, Homo sapiens
agtgcgtgggcaggcatggaag

SEQ ID NO: 8513134 - DNA, 22 bp, Homo sapiens
agtgccctcgtgcccagggcct

SEQ ID NO: 8513135 - DNA, 22 bp, Homo sapiens
agtgcccagttaggttggagca

SEQ ID NO: 8513136 - DNA, 22 bp, Homo sapiens
agtgcccggacaactggacaga

SEQ ID NO: 8513137 - DNA, 22 bp, Homo sapiens
agtgcccggggtgccagacaca

SEQ ID NO: 8513138 - DNA, 22 bp, Homo sapiens
agtgccctgctggggcaggaga

SEQ ID NO: 8513139 - DNA, 22 bp, Homo sapiens
agtgccctgctggggcaggaga

SEQ ID NO: 8513140 - DNA, 22 bp, Homo sapiens
agtgccctggcccagctggacc

SEQ ID NO: 8513141 - DNA, 22 bp, Homo sapiens
agtgccctggcccagctggacc

SEQ ID NO: 8513142 - DNA, 22 bp, Homo sapiens
agtgccctgggccttccaggac

SEQ ID NO: 8513143 - DNA, 22 bp, Homo sapiens
agtgccctgggccttccaggac

SEQ ID NO: 8513144 - DNA, 22 bp, Homo sapiens
agtgccctggcccagctggacc

SEQ ID NO: 8513145 - DNA, 23 bp, Homo sapiens
agtgccagggagatcaggacgga

SEQ ID NO: 8513146 - DNA, 22 bp, Homo sapiens
agtgccaggagcaaggagctcc

SEQ ID NO: 8513147 - DNA, 22 bp, Homo sapiens
agtgccaggagcaaggagctcc

SEQ ID NO: 8513148 - DNA, 20 bp, Homo sapiens
agtgccagggcaggtgagag

SEQ ID NO: 8513149 - DNA, 22 bp, Homo sapiens
aggaaacagtgaacttggcagg

SEQ ID NO: 8513150 - DNA, 22 bp, Homo sapiens
aggaaacaggcagcctttgaac

SEQ ID NO: 8513151 - DNA, 22 bp, Homo sapiens
aggaaacagagtgaagcttggg

SEQ ID NO: 8513152 - DNA, 22 bp, Homo sapiens
aggaaacagttggtaatgcata

SEQ ID NO: 8513153 - DNA, 22 bp, Homo sapiens
aggaaacatccttatctattct

SEQ ID NO: 8513154 - DNA, 22 bp, Homo sapiens
aggaaacatccttatctattct

SEQ ID NO: 8513155 - DNA, 22 bp, Homo sapiens
aggaaacattgatattgggaaa

SEQ ID NO: 8513156 - DNA, 17 bp, Homo sapiens
aggaaacattttctttc

SEQ ID NO: 8513157 - DNA, 17 bp, Homo sapiens
aggaaacattttctttc

SEQ ID NO: 8513158 - DNA, 17 bp, Homo sapiens
aggaaacattttctttc

SEQ ID NO: 8513159 - DNA, 22 bp, Homo sapiens
aggaaacatgaatctgccttga

SEQ ID NO: 8513160 - DNA, 22 bp, Homo sapiens
aggaaacatgaatctgccttga

SEQ ID NO: 8513161 - DNA, 22 bp, Homo sapiens
aggaaacatccttatctattct

SEQ ID NO: 8513162 - DNA, 22 bp, Homo sapiens
aggaaacatccttatctattct

SEQ ID NO: 8513163 - DNA, 22 bp, Homo sapiens
cagggttcagtgggccctcttg

SEQ ID NO: 8513164 - DNA, 22 bp, Homo sapiens
cagggtggtaccagcatctagt

SEQ ID NO: 8513165 - DNA, 22 bp, Homo sapiens
cagggtggtgaatagctatagt

SEQ ID NO: 8513166 - DNA, 22 bp, Homo sapiens
cagggtggtgaatagctatagt

SEQ ID NO: 8513167 - DNA, 22 bp, Homo sapiens
cagggtggtaccagcatctagt

SEQ ID NO: 8513168 - DNA, 22 bp, Homo sapiens
cagggtgctgcaccatccctca

SEQ ID NO: 8513169 - DNA, 22 bp, Homo sapiens
cagggtgctgcaccatccctca

SEQ ID NO: 8513170 - DNA, 22 bp, Homo sapiens
cagggtggggctggctatcaaa

SEQ ID NO: 8513171 - DNA, 22 bp, Homo sapiens
aggaaggactgcagcatttggt

SEQ ID NO: 8513172 - DNA, 22 bp, Homo sapiens
aggaagatgtgcaaagttggaa

SEQ ID NO: 8513173 - DNA, 22 bp, Homo sapiens
aggaagatgggagagctctgga

SEQ ID NO: 8513174 - DNA, 22 bp, Homo sapiens
aggaagcaaaaggcagggtcta

SEQ ID NO: 8513175 - DNA, 22 bp, Homo sapiens
aggaagcaaaaggcagggtcta

SEQ ID NO: 8513176 - DNA, 22 bp, Homo sapiens
aggaagatgtgtttagcaggtt

SEQ ID NO: 8513177 - DNA, 22 bp, Homo sapiens
aggaagaggtgtgcaatggtgt

SEQ ID NO: 8513178 - DNA, 22 bp, Homo sapiens
aggaagaggtgtgcaatggtgt

SEQ ID NO: 8513179 - DNA, 22 bp, Homo sapiens
aggaagagtgttacctatgggt

SEQ ID NO: 8513180 - DNA, 22 bp, Homo sapiens
aggaagagggtggcagataatc

SEQ ID NO: 8513181 - DNA, 22 bp, Homo sapiens
aggaagagggtggcagataatc

SEQ ID NO: 8513182 - DNA, 22 bp, Homo sapiens
aggaagaggtagctgtcaaggg

SEQ ID NO: 8513183 - DNA, 22 bp, Homo sapiens
aggaagaggtagctgtcaaggg

SEQ ID NO: 8513184 - DNA, 22 bp, Homo sapiens
cagggttgcatgcatctgtggg

SEQ ID NO: 8513185 - DNA, 22 bp, Homo sapiens
cagggttggggtagataagaaa

SEQ ID NO: 8513186 - DNA, 22 bp, Homo sapiens
cagggttgattccttctgaggg

SEQ ID NO: 8513187 - DNA, 22 bp, Homo sapiens
cagggttggtttctcctcaggc

SEQ ID NO: 8513188 - DNA, 22 bp, Homo sapiens
cagggtttcaccatgttagcag

SEQ ID NO: 8513189 - DNA, 22 bp, Homo sapiens
cagggtttcaccatgttagcag

SEQ ID NO: 8513190 - DNA, 22 bp, Homo sapiens
cagggtttcaccatgttagcag

SEQ ID NO: 8513191 - DNA, 22 bp, Homo sapiens
cagggtttcaccatgttagcag

SEQ ID NO: 8513192 - DNA, 22 bp, Homo sapiens
cagggtttcaccatgttagcag

SEQ ID NO: 8513193 - DNA, 22 bp, Homo sapiens
caggtcctggcatcaggcaggt

SEQ ID NO: 8513194 - DNA, 22 bp, Homo sapiens
caggtcctggcatcaggcaggt

SEQ ID NO: 8513195 - DNA, 22 bp, Homo sapiens
aggaatgtcgtcataaacatga

SEQ ID NO: 8513196 - DNA, 22 bp, Homo sapiens
caggtcctgcagggagagtaaa

SEQ ID NO: 8513197 - DNA, 22 bp, Homo sapiens
caggtcctcacgcctcaccctt

SEQ ID NO: 8513198 - DNA, 22 bp, Homo sapiens
caggtcctcgggggaggccggc

SEQ ID NO: 8513199 - DNA, 22 bp, Homo sapiens
caggtcctcacgcctcaccctt

SEQ ID NO: 8513200 - DNA, 22 bp, Homo sapiens
aggaatgtctgagaaagaggca

SEQ ID NO: 8513201 - DNA, 22 bp, Homo sapiens
aggaatgtggcaatcttcaagt

SEQ ID NO: 8513202 - DNA, 22 bp, Homo sapiens
aggaatgtttagaatgtcagaa

SEQ ID NO: 8513203 - DNA, 22 bp, Homo sapiens
aggaatgttaagaaggtctacc

SEQ ID NO: 8513204 - DNA, 22 bp, Homo sapiens
aggaatgtgtttctaggctgtt

SEQ ID NO: 8513205 - DNA, 21 bp, Homo sapiens
aggaatgtgtatatatacaat

SEQ ID NO: 8513206 - DNA, 22 bp, Homo sapiens
aggaagggctgtttctccaaga

SEQ ID NO: 8513207 - DNA, 22 bp, Homo sapiens
aggaaggggagaagttaaagct

SEQ ID NO: 8513208 - DNA, 22 bp, Homo sapiens
aggaaggggagaagttaaagct

SEQ ID NO: 8513209 - DNA, 22 bp, Homo sapiens
aggaagggtggatagtaacgtg

SEQ ID NO: 8513210 - DNA, 22 bp, Homo sapiens
aggaagggtggatagtaacgtg

SEQ ID NO: 8513211 - DNA, 22 bp, Homo sapiens
aggaaggggagaagttaaagct

SEQ ID NO: 8513212 - DNA, 22 bp, Homo sapiens
aggaagggtggatagtaacgtg

SEQ ID NO: 8513213 - DNA, 22 bp, Homo sapiens
aggaagggtgtcatgagccctt

SEQ ID NO: 8513214 - DNA, 22 bp, Homo sapiens
aggaagggttctttgtgaaaga

SEQ ID NO: 8513215 - DNA, 22 bp, Homo sapiens
aggaagggtgtcatgagccctt

SEQ ID NO: 8513216 - DNA, 22 bp, Homo sapiens
caggtcccctcccctaccaggc

SEQ ID NO: 8513217 - DNA, 17 bp, Homo sapiens
caggtcccagggtctct

SEQ ID NO: 8513218 - DNA, 22 bp, Homo sapiens
caggtccccagggtacctacct

SEQ ID NO: 8513219 - DNA, 22 bp, Homo sapiens
caggtcccctcccctaccaggc

SEQ ID NO: 8513220 - DNA, 22 bp, Homo sapiens
caggtcccgccccgggctgacc

SEQ ID NO: 8513221 - DNA, 22 bp, Homo sapiens
caggtcccgccccgggctgacc

SEQ ID NO: 8513222 - DNA, 22 bp, Homo sapiens
caggtccagtcactggtctgca

SEQ ID NO: 8513223 - DNA, 20 bp, Homo sapiens
caggtccagcacgtgcacgg

SEQ ID NO: 8513224 - DNA, 20 bp, Homo sapiens
caggtccagcacgtgcacgg

SEQ ID NO: 8513225 - DNA, 22 bp, Homo sapiens
caggtccagtaaaaagagtcct

SEQ ID NO: 8513226 - DNA, 22 bp, Homo sapiens
aggaagggttctttgtgaaaga

SEQ ID NO: 8513227 - DNA, 22 bp, Homo sapiens
aggaagggttctttgtgaaaga

SEQ ID NO: 8513228 - DNA, 22 bp, Homo sapiens
aggaagggttctttgtgaaaga

SEQ ID NO: 8513229 - DNA, 22 bp, Homo sapiens
aggaaggtaatgaactgaggag
